United States Patent 7,745,391 (HUMAN THROMBOSPONDIN POLYPEPTIDE) - sequence listing, part 280

SEQ ID NO: 859669 - protein, 233 aa, Homo sapiens
MELHFLFFFSLWELPFYSLVFILLTKEKFYFFSPQLAELKQECLARGLETKGIKQDLIHRLQAYLEEHAEEEANEEDVLGDETEEEETKPIELPVKEEEPPEKTVDVAAEKKVVKITSEIPQTERMQKRAERFNVPVSLESKKAARAARFGISSVPTKGLSSDNKPMVNLDKLKERAQRFGLNVSSISRKSEDDEKLKKRKERFGIVTSSAGTGTTEDTEAKKRKRAERFGIA

SEQ ID NO: 859670 - protein, 228 aa, Homo sapiens; identical to SEQ ID NO: 859656

SEQ ID NO: 859671 - protein, 108 aa, Homo sapiens
MQKRAERFNVPVSLESKKAARAARLGFLQFQQKVCQSDNKPMVNLDKLKERAQRFGLNVSSISRKSEDDEKLKKRKERFGIVTSSAGTGTTEDTEAKKRKRAERFGIA

SEQ ID NO: 859672 - protein, 71 aa, Homo sapiens
LNDVVDTHERKERRGLAGDDSLNLPPLHSEDDEKLKKRKERFGIVTSSAGTGTTEDTEAKKRKRAERFGIA

SEQ ID NO: 859673 - protein, 169 aa, Homo sapiens; identical to SEQ ID NO: 859664

SEQ ID NO: 859674 - protein, 180 aa, Homo sapiens
APGGGGRGWGPSGVRGNKMATETVELHKLKLAELKQECLARGLETKGIKQDLIHRLQAYLEEHAEEEANEEDVLGDETEEEETKPIELPVKEEEPPEKTVDVAAEKKVVKITSEIPQTERMQKRAERFNVPVSLESKKAARAARFGISSVPTKGKSTEILLRKLPFYSFFSGITGFISPK

SEQ ID NO: 859675 - protein, 716 aa, Homo sapiens
MPLPEPSEQEGESVKAGQEPSPKPGTDVIPAAPRKPREFSKLVLLTASDQDEDGVGSKPQEVHCVLSLEMAGPATLASTLQILPVEEQGGVVQPALEMPEQKCSKLDAAAPQSLEFLRTPFGGRLLVLESFLYKQEKAVGDKVYWKCRQHAELGCRGRAITRGLRATVMRGHCHAPDEQGLEARRQREKLPSLALPEGLGEPQGPEGPGGRVEEPLEGVGPWQCPEEPEPTPGLVLSKPALEEEEAPRALSLLSLPPKKRSILGLGQARPLEFLRTCYGGSFLVHESFLYKREKAVGDKVYWTCRDHALHGCRSRAITQGQRVTVMRGHCHQPDMEGLEARRQQEKAVETLQAGQDGPGSQVDTLLRGVDSLLYRRGPGPLTLTRPRPRKRAKVEDQELPTQPEAPDEHQDMDADPGGPEFLKTPLGGSFLVYESFLYRREKAAGEKVYWTCRDQARMGCRSRAITQGRRVTVMRGHCHPPDLGGLEALRQREKRPNTAQRGSPGGPEFLKTPLGGSFLVYESFLYRREKAAGEKVYWTCRDQARMGCRSRAITQGRRVMVMRRHCHPPDLGGLEALRQREHFPNLAQWDSPDPLRPLEFLRTSLGGRFLVHESFLYRKEKAAGEKVYWMCRDQARLGCRSRAITQGHRIMVMRSHCHQPDLAGLEALRQRERLPTTAQQEDPEKIQVQLCFKTCSPESQQIYGDIKDVRLDGESQ

SEQ ID NO: 859676 - protein, 765 aa, Homo sapiens
MPLPEPSEQEGESVKAGQEPSPKPGTDVIPAAPRKPREFSKLVLLTASDQDEDGVGSKPQEVHCVLSLEMAGPATLASTLQILPVEEQGGVVQPALEMPEQKCSKLDAAAPQSLEFLRTPFGGRLLVLESFLYKQEKAVGDKVYWKCRQHAELGCRGRAITRGLRATVMRGHCHAPDEQGLEARRQREKLPSLALPEGLGEPQGPEGPGGRVEEPLEGVGPWQCPEEPEPTPGLVLSKPALEEEEAPRALSLLSLPPKKRSILGLGQARPLEFLRTCYGGSFLVHESFLYKREKAVGDKVYWTCRDHALHGCRSRAITQGQRVTVMRGHCHQPDMEGLEARRQQEKAVETLQAGQDGPGSQVDTLLRGVDSLLYRRGPGPLTLTRPRPRKRAKVEDQELPTQPEAPDEHQDMDADPGGPEFLKTPLGGSFLVYESFLYRREKAAGEKVYWTCRDQARMGCRSRAITQGRRVTVMRGHCHPPDLGGLEALRQREKRPNTAQRGSPGAGLSFQWLFRILQLLGHAPVLLCPSGSSCLPSLPAPHGPCPALSIPLEGGPEFLKTPLGGSFLVYESFLYRREKAAGEKVYWTCRDQARMGCRSRAITQGRRVMVMRRHCHPPDLGGLEALRQREHFPNLAQWDSPDPLRPLEFLRTSLGGRFLVHESFLYRKEKAAGEKVYWMCRDQARLGCRSRAITQGHRIMVMRSHCHQPDLAGLEALRQRERLPTTAQQEDPEKIQVQLCFKTCSPESQQIYGDIKDVRLDGESQ

SEQ ID NO: 859677 - protein, 803 aa, Homo sapiens
MPLPEPSEQEGESVKAGQEPSPKPGTDVIPAAPRKPREFSKLVLLTASDQDEDGVGSKPQEVHCVLSLEMAGPATLASTLQILPVEEQGGVVQPALEMPEQKCSKLDAAAPQSLEFLRTPFGGRLLVLESFLYKQEKAVGDKVYWKCRQHAELGCRGRAITRGLRATVMRGHCHAPDEQGLEARRQREKLPSLALPEGLGEPQGPEGPGGRVEEPLEGVGPWQCPEEPEPTPGLVLSKPALEEEEAPRALSLLSLPPKKRSILGLGQARPLEFLRTCYGGSFLVHESFLYKREKAVGDKVYWTCRDHALHGCRSRAITQGQRVTVMRGHCHQPDMEGLEARRQQEKAVETLQAGQDGPGSQVDTLLRGVDSLLYRRGPGPLTLTRPRPRKRAKVEDQELPTQPEAPDEHQDMDADPGGPEFLKTPLGGSFLVYESFLYRREKAAGEKVYWTCRDQARMGCRSRAITQGRRVTVMRGHCHPPDLGGLEALRQREKRPNTAQRGSPERQCCEVPASSSPPLLTPQSPGVTPLPARLSGATPLSPIRLLSSFVPRGPRVIPLTNQARRTLHASLGGCWGRTSDAADTASLKAWQGGPEFLKTPLGGSFLVYESFLYRREKAAGEKVYWTCRDQARMGCRSRAITQGRRVMVMRRHCHPPDLGGLEALRQREHFPNLAQWDSPDPLRPLEFLRTSLGGRFLVHESFLYRKEKAAGEKVYWMCRDQARLGCRSRAITQGHRIMVMRSHCHQPDLAGLEALRQRERLPTTAQQEDPEKIQVQLCFKTCSPESQQIYGDIKDVRLDGESQ

SEQ ID NO: 859678 - protein, 716 aa, Homo sapiens; identical to SEQ ID NO: 859675

SEQ ID NO: 859679 - protein, 704 aa, Homo sapiens
MPLPEPSEQEGESVKAGQEPSPKPGTDVIPAAPRKPREFSKLVLLTASDQDEDGVGSKPQEVHCVLSLEMAGPATLASTLQILPVEEQGGVVQPALEMPEQKCSKLDAAAPQSLEFLRTPFGGRLLVLESFLYKQEKAVGDKVYWKCRQHAELGCRGRAITRGLRATVMRGHCHAPDEQGLEARRQREKLPSLALPEGLGEPQGPEGPGGRVEEPLEGVGPWQCPEEPEPTPGLVLSKPALEEEEAPRALSLLSLPPKKRSILGLGQARPLEFLRTCYGGSFLVHESFLYKREKAVGDKVYWTCRDHALHGCRSRAITQGQRVTVMRGHCHQPDMEGLEARRQQEKAVETLQAGQDGPGSQVDTLLRGVDSLLYRRGPGPLTLTRPRPRKRAKVEDQELPTQPEAPDEHQDMDADPGGPEFLKTPLGGSFLVYESFLYRREKAAGEKVYWTCRDQARMGCRSRAITQGRRVTVMRGHCHPPDLGGLEALRQREKRPNTAQRGSPGGPEFLKTPLGGSFLVYESFLYRREKAAGEKVYWTCRDQARMGCRSRAITQGRRVMVMRRHCHPPDLGGLEALRQREHFPNLAQWDSPDPLRPLEFLRTSLGGRFLVHESFLYRKEKAAGEKVYWMCRDQARLGCRSRAITQGHRIMVMRSHCHQPDLAGLEALRQRERLPTTAQQEDPEKIQVQLCFKTCSPESQQIYG

SEQ ID NO: 859680 - protein, 710 aa, Homo sapiens
MPLPEPSEQEGESVKAGQEPSPKPGTDVIPAAPRKPREFSKLVLLTASDQDEDGVGSKPQEVHCVLSLEMAGPATLASTLQILPVEEQGGVVQPALEMPEQKCSKLDAAAPQSLEFLRTPFGGRLLVLESFLYKQEKAVGDKVYWKCRQHAELGCRGRAITRGLRATVMRGHCHAPDEQGLEARRQREKLPSLALPEGLGEPQGPEGPGGRVEEPLEGVGPWQCPEEPEPTPGLVLSKPALEEEEAPRALSLLSLPPKKRSILGLGQARPLEFLRTCYGGSFLVHESFLYKREKAVGDKVYWTCRDHALHGCRSRAITQGQRVTVMRGHCHQPDMEGLEARRQQEKAVETLQAGQDGPGSQVDTLLRGVDSLLYRRGPGPLTLTRPRPRKRAKVEDQELPTQPEAPDEHQDMDADPGGPEFLKTPLGGSFLVYESFLYRREKAAGEKVYWTCRDQARMGCRSRAITQGRRVTVMRGHCHPPDLGGLEALRQREKRPNTAQRGSPGGPEFLKTPLGGSFLVYESFLYRREKAAGEKVYWTCRDQARMGCRSRAITQGRRVMVMRRHCHPPDLGGLEALRQREHFPNLAQWDSPDPLRPLEFLRTSLGGRFLVHESFLYRKEKAAGEKVYWMCRDQARLGCRSRAITQGHRIMVMRSHCHQPDLAGLEALRQRERLPTTAQQEDPEKIQVQLCFKTCSPESQQIYGKSQPLV

SEQ ID NO: 859681 - protein, 517 aa, Homo sapiens
MPLPEPSEQEGESVKAGQEPSPKPGTDVIPAAPRKPREFSKLVLLTASDQDEDGVGSKPQEVHCVLSLEMAGPATLASTLQILPVEEQGGVVQPALEMPEQKCSKLDAAAPQSLEFLRTPFGGRLLVLESFLYKQEKAVGDKVYWKCRQHAELGCRGRAITRGLRATVMRGHCHAPDEQGLEARRQREKLPSLALPEGLGEPQGPEGPGGRVEEPLEGVGPWQCPEEPEPTPGLVLSKPALEEEEAPRALSLLSLPPKKRSILGLGQARPLEFLRTCYGGSFLVHESFLYKREKAVGDKVYWTCRDHALHGCRSRAITQGQRVTVMRGHCHQPDMEGLEARRQQEKAVETLQAGQDGPGSQVDTLLRGVDSLLYRRGPGPLTLTRPRPRKRAKVEDQELPTQPEAPDEHQDMDADPGGPEFLKTPLGGSFLVYESFLYRREKAAGEKVYWTCRDQARMGCRSRAITQGRRVTVMRGHCHPPDLGGLEALRQREKRPNTSCGGCPSCGGPVRPFPVLQ

SEQ ID NO: 859682 - protein, 110 aa, Homo sapiens
RARGHGARSRGAGRGWELVPGSGWRRRPGPRGRRSLLQRQRLKDPPRRCRRRGRAPLPSVKPAQRSYGICPRGSCPASQRRDPGVGDDGDASHSHVKVILWLHQLPTEPP

SEQ ID NO: 859683 - protein, 734 aa, Homo sapiens
MPLPEPSEQEGESVKAGQEPSPKPGTDVIPAAPRKPREFSKLVLLTASDQDEDGVGSKPQEVHCVLSLEMAGPATLASTLQILPVEEQGGVVQPALEMPEQKCSKLDAAAPQSLEFLRTPFGGRLLVLESFLYKQEKAVGDKVYWKCRQHAELGCRGRAITRGLRATVMRGHCHAPDEQGLEARRQREKLPSLALPEGLGEPQGPEGPGGRVEEPLEGVGPWQCPEEPEPTPGLVLSKPALEEEEAPRALSLLSLPPKKRSILGLGQARPLEFLRTCYGGSFLVHESFLYKREKAVGDKVYWTCRDHALHGCRSRAITQGQRVTVMRGHCHQPDMEGLEARRQQEKAVETLQAGQDGPGSQVDTLLRGVDSLLYRRGPGPLTLTRPRPRKRAKVEDQELPTQPEAPDEHQDMDADPGGPEFLKTPLGGSFLVYESFLYRREKAAGEKVYWTCRDQARMGCRSRAITQGRRVTVMRGHCHPPDLGGLEALRQREKRPNTAQRGSPGAGLSFQWLFRILQLLGSGGPEFLKTPLGGSFLVYESFLYRREKAAGEKVYWTCRDQARMGCRSRAITQGRRVMVMRRHCHPPDLGGLEALRQREHFPNLAQWDSPDPLRPLEFLRTSLGGRFLVHESFLYRKEKAAGEKVYWMCRDQARLGCRSRAITQGHRIMVMRSHCHQPDLAGLEALRQRERLPTTAQQEDPEKIQVQLCFKTCSPESQQIYGDIKDVRLDGESQ

SEQ ID NO: 859684 - protein, 716 aa, Homo sapiens; identical to SEQ ID NO: 859675

SEQ ID NO: 859685 - protein, 84 aa, Homo sapiens
PGAVGQPRCVWRVLGWVCLVSQDLCPTRWLEAARGVLCVVHGGLTAGAINSPGAGGSICGLRAPAAGPLGSGDWLSEVETHSAL

SEQ ID NO: 859686 - protein, 68 aa, Homo sapiens
RQACEGVRWWVPGLVSSNDNPAPPRDLGAESPTRWGDPGTEKEGPDQTGEESKQMFAPLWYLIQTNQL

SEQ ID NO: 859687 - protein, 278 aa, Homo sapiens
MHKAGLLGLCARAWNSVRMASSGMTRRDPLANKVALVTASTDGIGFAIARRLAQDGAHVVVSSRKQQNVDQAVATLQGEGLSVTGTVCHVGKAEDRERLVATAVKLHGGIDILVSNAAVNPFFGSIMDVTEEVWDKTLDINVKAPALMTKAVVPEMEKRGGGSVVIVSSIAAFSPSPGFSPYNVSKTALLGLTKTLAIELAPRNIRVNCLAPGLIKTSFSRMLWMDKEKEESMKETLRIRRLGEPEDCAGIVSFLCSEDASYITGETVVVGGGTPSRL

SEQ ID NO: 859688 - protein, 155 aa, Homo sapiens
MHKAGLLGLCARAWNSVRMASSGMTRRDPLANKVALVTASTDGIGFAIARRLAQDGAHVVVSSRKQQNVDQAVATLQGEGLSVTGTVCHVGKAEDRERLVATAVKLHGGIDILVSNAAVNPFFGSIMDVTEEVWDKLWMDKEKEESMKETLRIRR

SEQ ID NO: 859689 - protein, 66 aa, Homo sapiens
LFFLVHPELVPHLLSDIHYASKETLRIKRLGEPEDCAGIVSFLCSEDASYITGETVVVGGGTPSRL

SEQ ID NO: 859690 - protein, 152 aa, Homo sapiens [sequence omitted]

SEQ ID NO: 859691 - protein, 192 aa, Homo sapiens
MHKAGLLGLCARAWNSVRMASSGMTRRDPLANKVALVTASTDGIGFAIARRLAQDGAHVVVSSRKQQNVDQAVATLQGEGLSVTGTVCHVGKAEDRERLVATAVKLHGGIDILVSNAAVNPFFGSIMDVTEEVWDKLWMDKEKEESMKETLRIRRLGEPEDCAGIVSFLCSEDASYITGETVVVGGGTPSRL

SEQ ID NO: 859692 - protein, 261 aa, Homo sapiens
MHKAGLLGLCARAWNSVRMASSGMTRRDPLANKVALVTASTDGIGFAIARRLAQDGAHVVVSSRKQQNVDQAVATLQGEGLSVTGTVCHVGKAEDRERLVATAVKLHGGIDILVSNAAVNPFFGSIMDVTEEVWDKTLDINVKAPALMTKAVVPEMEKRGGGSVVIVSSIAAFSPSPGFSPYNVSKTALLGLTKTLAIELAPRNIRVNCLAPGLIKTSFSRMLWMDKEKEESMKRSSLPCRQGGVLLGIPAVVVALGKGLP

SEQ ID NO: 859693 - protein, 248 aa, Homo sapiens
MHKAGLLGLCARAWNSVRMASSGMTRRDPLANKVALVTASTDGIGFAIARRLAQDGAHVVVSSRKQQNVDQAVATLQGEGLSVTGTVCHVGKAEDRERLVATAVKLHGGIDILVSNAAVNPFFGSIMDVTEEVWDKTLDINVKAPALMTKAVVPEMEKRGGGSVVIVSSIAAFSPSPGFSPYNVSKTALLGLTKTLAIELAPRNIRVNCLAPGLIKTSFSRMLWMDKEKEESMKETLRIRSPLSQSHR

SEQ ID NO: 859694 - protein, 144 aa, Homo sapiens
MHKAGLLGLCARAWNSVRMASSGMTRRDPLANKVALVTASTDGIGFAIARRLAQDGAHVVVSSRKQQNVDQAVATLQGEGLSVTGTVCHVGKAEDRERLVATAVKLHGGIDILVSNAAVNPFFGSIMDITGETVVVGGGTPSRL

SEQ ID NO: 859695 - protein, 142 aa, Homo sapiens
MHKAGLLGLCARAWNSVRMASSGMTRRDPLANKVALVTASTDGIGFAIARRLAQDGAHVVVSSRKQQNVDQAVATLQGEGLSVTGTVCHVGKAEDRERLVATAVKLHGGIDILVSNAAVNPFFGSIMDVTEEVWDKVIYLFL

SEQ ID NO: 859696 - protein, 105 aa, Homo sapiens
FVVIVVVVFNIKIRSRCMAQASLKLLSSSEPPTLASQSAMITGMSHSSLPRRKFLSTWVNAPPLLTAALVQNLPLSLGCEASWRYRYPSLQCCCQPFLWKHNGCH

SEQ ID NO: 859697 - protein, 192 aa, Homo sapiens; identical to SEQ ID NO: 859691

SEQ ID NO: 859698 - protein, 278 aa, Homo sapiens; identical to SEQ ID NO: 859687

SEQ ID NO: 859699 - protein, 278 aa, Homo sapiens; identical to SEQ ID NO: 859687

SEQ ID NO: 859700 - protein, 291 aa, Homo sapiens
MHKAGLLGLCARAWNSVRMASSGMTRRDPLANKVALVTASTDGIGFAIARRLAQDGAHVVVSSRKQQNVDQAVATLQGEGLSVTGTVCHVGKAEDRERLVATAVKLHGGIDILVSNAAVNPFFGSIMDVTEEVWDKTLDINVKAPALMTKAVVPEMEKRGGGSVVIVSSIAAFSPSPGFSPYNVSKTALLGLTKTLAIELAPRNIRVNCLAPGLIKTSFSRMLWMDKEKEESMKETLRIRRLGEPEDCAGIVSFLCSEDASYITGETVVVGGGTPAPALGSHWSTRDSQLR

SEQ ID NO: 859701 - protein, 158 aa, Homo sapiens
MHKAGLLGLCARAWNSVRMASSGMTRRDPLANKVALVTASTDGIGFAIARRLAQDGAHVVVSSRKQQNVDQAVATLQGEGLSVTGTVCHVGKAEDRERLVATLWMDKEKEESMKETLRIRRLGEPEDCAGIVSFLCSEDASYITGETVVVGGGTPSRL

SEQ ID NO: 859702 - protein, 127 aa, Homo sapiens [sequence omitted]

SEQ ID NO: 859703 - protein, 86 aa, Homo sapiens
MGASAVVSRIVIRLWWLRVVCSVTVSDFLFAVRLSFRCLQYKIGVELRFSTLVVLLRVLFSLFKVSPRAYAVRFCAVCLIGESRGQ

SEQ ID NO: 859704 - protein, 129 aa, Homo sapiens
MSISRAVLGEKEGGLGSVAPCQPALREDRVSHARMAGHVSVLVSHFPPSVTYLGIPQGLLECDCPLPSCLGYKSWPYVPAVRGSGNPTQPPVLGWSVSIHPLVVIEAALPVLGEDIWATRAPLAPSRRK

SEQ ID NO: 859705 - protein, 129 aa, Homo sapiens; identical to SEQ ID NO: 859704

SEQ ID NO: 859706 - protein, 371 aa, Homo sapiens
PCVQPCCRPLCYEQSERRLHKSLQMKMEEMSLSGLDNSKLEAIAQEIYADLVEDSCLGFCFEVHRAVKCGYFFLDDTDPDSMKDFEIVDQPGLDIFGQVFNQWKSKECVCPNCSRSIAASRFAPHLEKCLGMGRNSSRIANRRIANSNNMNKSESDQEDNDDINDNDWSYGSEKKAKKRKSDKNPNSPRRSKSLKHKNGELSNSDPFKYNNSTGISYETLGPEELRSLLTTQCGVISEHTKKMCTRSLRCPQHTDEQRRTVRIYFLGPSAVLPEVESSLDNDSFDMTDSQALISRLQWDGSSDLSPSDSGSSKTSENQGWGLGTNSSESRKTKKKKSHLSLVGTASGLGSNKKKKPKPPAPPTPSIYDDIN

SEQ ID NO: 859707 - protein, 371 aa, Homo sapiens; identical to SEQ ID NO: 859706

SEQ ID NO: 859708 - protein, 129 aa, Homo sapiens
MCTRSLRCPQHTDEQRRTVRIYFLGPSAVLPEVESSLDNDSFDMTDSQALISRLQWDGSSDLSPSDSGSSKTSENQGWGLGTNSSESRKTKKKKSHLSLVGTASGLGSNKKKKPKPPAPPTPSIYDDIN

SEQ ID NO: 859709 - protein, 371 aa, Homo sapiens; identical to SEQ ID NO: 859706

SEQ ID NO: 859710 - protein, 371 aa, Homo sapiens; identical to SEQ ID NO: 859706

SEQ ID NO: 859711 - protein, 345 aa, Homo sapiens
PCVQPCCRPLCYEQSERRLHKSLQMKMEEMSLSGLDNSKLEAIAQEIYADLVEDSCLGFCFEVHRAVKCGYFFLDDTDPDSMKDFEIVDQPGLDIFGQVFNQWKSKECVCPNCSRSIAASRFAPHLEKCLGMGRNSSRIANRRIANSNNMNKSESDQEDNDDINDNDWSYGSEKKAKKRKSDKNPNSPRRSKSLKHKNGELSNSDPFKYNNSTGISYETLGPEELRSLLTTQCGVISEHTKKMCTRSLRCPQHTDEQRRTVRIYFLGPSAVLPEVESSLDNDSFDMTDSQALISRLQWDGSSDLSPSDSGSSKTSENQGWGLGTNSSESRKTKKKKSKRSHPTFG

SEQ ID NO: 859712 - protein, 232 aa, Homo sapiens
TGLLLGRKSRNLRMLLCQIFFPSLGSRLPLFVTLSPKLWYLPFQNPNSPRRSKSLKHKNGELSNSDPFKYNNSTGISYETLGPEELRSLLTTQCGVISEHTKKMCTRSLRCPQHTDEQRRTVRIYFLGPSAVLPEVESSLDNDSFDMTDSQALISRLQWDGSSDLSPSDSGSSKTSENQGWGLGTNSSESRKTKKKKSHLSLVGTASGLGSNKKKKPKPPAPPTPSIYDDIN

SEQ ID NO: 859713 - protein, 396 aa, Homo sapiens
PCVQPCCRPLCYEQSERRLHKSLQMKMEEMSLSGLDNSKLEAIAQEIYADLVEDSCLGFCFEVHRAVKCGYFFLDDTDPDSMKDFEIVDQPGLDIFGQVFNQWKSKECVCPNCSRSIAASRFAPHLEKCLGMGRNSSRIANRRIANSNNMNKSESDQEDNDDINDNDWSYGSEKKAKKRKSDKNPNSPRRSKSLKHKNGFSVCTSASNTLPLLFSSSGELSNSDPFKYNNSTGISYETLGPEELRSLLTTLIFLFQQCGVISEHTKKMCTRSLRCPQHTDEQRRTVRIYFLGPSAVLPEVESSLDNDSFDMTDSQALISRLQWDGSSDLSPSDSGSSKTSENQGWGLGTNSSESRKTKKKKSHLSLVGTASGLGSNKKKKPKPPAPPTPSIYDDIN

SEQ ID NO: 859714 - protein, 371 aa, Homo sapiens; identical to SEQ ID NO: 859706

SEQ ID NO: 859715 - protein, 371 aa, Homo sapiens; identical to SEQ ID NO: 859706

SEQ ID NO: 859716 - protein, 198 aa, Homo sapiens
TSVSTNAGGSCSAGLASARSYGRKMAAAAELSLLEKSLGLSKGNKYSAQGERQIPVLQTNNGPSLTGLTTIAAHLVKQANKEYLLGSTAEEKAIVQQWLEYRVTQVDGHSSKNDIHTLLKDLNSYLEDKVYLTGYNFTLADILLYYGLHRFIVDLTVQEKEKYLNVSRWFCHIQHYPGIRQHLSSVVFIKNRLYTNSH

SEQ ID NO: 859717 - protein, 187 aa, Homo sapiens
MSGGGTETPVGCEAAPGGGSKKRDSLGTAGSAHLIIKDLGEIHSRLLDHRPVIQGETRYFVKEFEEKRGLREMRVLENLKNMIHETNEHTLPKCRDTMRDSLSQVLQRLQAANDSVCRLQQREQERKKIHSDHLVASEKQHMLQWDNFMKEQPNKRAEVDEEHRKAMERLKEQYAEMEKDLAKFSTF

SEQ ID NO: 859718 - protein, 174 aa, Homo sapiens
TSVSTNAGGSCSAGLASARSYGRKMAAAAELSLLEKSLGLSKGNKYSAQGERQIPVLQTNNGPSLTGLTTIAAHLVKQANKEYLLGSTAEEKAIVQQWLEYRVTQVDGHSSKNDIHTLLKDLNSYLEDKVYLTGYNFTLADILLYYGLHRFIVSICIVTGFFSVVLRMIFKTLS

SEQ ID NO: 859719 - protein, 198 aa, Homo sapiens; identical to SEQ ID NO: 859716

SEQ ID NO: 859720 - protein, 165 aa, Homo sapiens
MCICHRVLFCESDGELSHFPIPVLQTNNGPSLTGLTTIAAHLVKQANKEYLLGSTAEEKAIVQQWLEYRVTQVDGHSSKNDIHTLLKDLNSYLEDKVYLTGYNFTLADILLYYGLHRFIVDLTVQEKEKYLNVSRWFCHIQHYPGIRQHLSSVVFIKNRLYTNSH

SEQ ID NO: 859721 - protein, 187 aa, Homo sapiens; identical to SEQ ID NO: 859717

SEQ ID NO: 859722 - protein, 175 aa, Homo sapiens
TSVSTNAGGSCSAGLASARSYGRKMAAAAELSLLEKSLGLSKGNKYSAQGERQIPVLQTNNGPSLTGLTTIAAHLVKQANKEYLLGSTAEEKAIVQQWLEYRVTQVDGHSSKNDIHTLLKDLNSYLEDKVYLTGYNFTLADILLYYGLHRFIILEKFIQGFWITDQLFKVKLVIL

SEQ ID NO: 859723 - protein, 187 aa, Homo sapiens; identical to SEQ ID NO: 859717

SEQ ID NO: 859724 - protein, 163 aa, Homo sapiens
TSVSTNAGGSCSAGLASARSYGRKMAAAAELSLLEKSLGLSKGNKYSAQGERQIPVLQTNNGPSLTGLTTIAAHLVKQANKEYLLGSTAEEKAIVQQWLEYRVTQVDGHSSKNDIHTLLKDLNSYLEDKVYLTGYNFTLADILLYYGLHRFIIRKLRHTEVGN

SEQ ID NO: 859725 - protein, 198 aa, Homo sapiens; identical to SEQ ID NO: 859716

SEQ ID NO: 859726 - protein, 198 aa, Homo sapiens; identical to SEQ ID NO: 859716

SEQ ID NO: 859727 - protein, 198 aa, Homo sapiens; identical to SEQ ID NO: 859716

SEQ ID NO: 859728 - protein, 186 aa, Homo sapiens
MAERTPKESWPNLGDSGKAFLKPWIISLSVTTHSECGKHHKIPVLQTNNGPSLTGLTTIAAHLVKQANKEYLLGSTAEEKAIVQQWLEYRVTQVDGHSSKNDIHTLLKDLNSYLEDKVYLTGYNFTLADILLYYGLHRFIVDLTVQEKEKYLNVSRWFCHIQHYPGIRQHLSSVVFIKNRLYTNSH

SEQ ID NO: 859729 - protein, 187 aa, Homo sapiens; identical to SEQ ID NO: 859717

SEQ ID NO: 859730 - protein, 175 aa, Homo sapiens; identical to SEQ ID NO: 859722

SEQ ID NO: 859731 - protein, 161 aa, Homo sapiens
TSVSTNAGGSCSAGLASARSYGRKMAAAAELSLLEKSLGLSKGNKYSAQGERQIPVLQTNNGPSLTGLTTIAAHLVKQANKEYLLGSTAEEKAIVQQWLEYRVTQVDGHSSKNDIHTLLKVLTLSPRLECNGVILAHCNLRLLGSSDSRASASRVNGITGS

SEQ ID NO: 859732 - protein, 73 aa, Homo sapiens
NEVPCSLRHDLYAIWRRESVQENGFPDKLVCQNIPRHVLEATYGINIITPREDEDPHRPPTSEELLTAYGCKL

SEQ ID NO: 859733 - protein, 114 aa, Homo sapiens
EQEFVAEKLNIKFVPAEARTGLLSFEESQRIKKLHEENKQFLCIPRRPNWNQNTTPEELKLLTSDNLPASTSQNAGITGVSHHAWPFKFLCKLIVRHESFIAGSLRLGAVEDRA

SEQ ID NO: 859734 - protein, 214 aa, Homo sapiens
NEVPCSLRHDLYAIWRRESVQENGFPDKLVCQNIPRHVLEATYGINIITPREDEDPHRPPTSEELLTAYGYMRGFMTAHGQPDQPRSARYILKDYVSGKLLYCHPPPGRDPVTFQHQHQRLLENKMNSDEIKMQLGRNKKAKQIENIVDKTFFHQENVRALTKGVQAVMGYKPGSGVVTASTASSENGAGKPWKKHGNRNKKEKSRRLYKHLDM

SEQ ID NO: 859735 - protein, 521 aa, Homo sapiens
KLHAPSREASSSGRVAMGRRRAPAGGSLGRALMRHQTQRSRSHRHTDSWLHTSELNDGYDWGRLNLQSVTEQSSLDDFLATAELAGTEFVAEKLNIKFVPAEARTGLLSFEESQRIKKLHEENKQFLCIPRRPNWNQNTTPEELKQAEKDNFLEWRRQLVRLEEEQKLILTPFERNLDFWRQLWRVIERSDIVVQIVDARNPLLFRCEDLECYVKEMDANKENVILINKADLLTAEQRSAWAMYFEKEDVKVIFWSALAGAIPLNGDSEEEANRDDRQSNTTEFGHSSFDQAEISHSESEHLPARDSPSLSENPTTDEDDSEYEDCPEEEEDDWQTCSEEDGPKEEDCSQDWKESSTADSEARSRKTPQKRQIHNFSHLVSKQELLELFKELHTGRKVKDGQLTVGLVGYPNVGKSSTINTIMGNKKVSVSATPGHTKHFQTLYVEPGLCLCDCPGLVMPSFVSTKAEMTCSGILPIDQMRDHVPPVSLISFLLWKHSSYYVHIRASGLFWAFEGFRFDEE

SEQ ID NO: 859736 - protein, 106 aa, Homo sapiens
IPSSNLLLVFQTLYVEPGLCLCDCPGLVMPSFVSTKAEMTCSGILPIDQMRDHVPPVSLISFLLWKHSSYYVHIRASGLFWAFEGFRFDEELKILVICTSLYCEIA

SEQ ID NO: 859737 - protein, 674 aa, Homo sapiens
KLHAPSREASSSGRVAMGRRRAPAGGSLGRALMRHQTQRSRSHRHTDSWLHTSELNDGYDWGRLNLQSVTEQSSLDDFLATAELAGTEFVAEKLNIKFVPAEARTGLLSFEESQRIKKLHEENKQFLCIPRRPNWNQNTTPEELKQAEKDNFLEWRRQLVRLEEEQKLILTPFERNLDFWRQLWRVIERSDIVVQIVDARNPLLFRCEDLECYVKEMDANKENVILINKADLLTAEQRSAWAMYFEKEDVKVIFWSALAGAIPLNGDSEEEANRDDRQSNTTEFGHSSFDQAEISHSESEHLPARDSPSLSENPTTDEDDSEYEDCPEEEEDDWQTCSEEDGPKEEDCSQDWKESSTADSEARSRKTPQKRQIHNFSHLVSKQELLELFKELHTGRKVKDGQLTVGLVGYPNVGKSSTINTIMGNKKVSVSATPGHTKHFQTLYVEPGLCLCDCPGLVMPSFVSTKAEMTCSGILPIDQMRDHVPPVSLVCQNIPRHVLEATYGINIITPREDEDPHRPPTSEELLTAYGYMRGFMTAHGQPDQPRSARYILKDYVSGKLLYCHPPPGRDPVTFQHQHQRLLENKMNSDEIKMQLGRNKKAKQIENIVDKTFFHQENVRALTKGVQAVMGYKPGSGVVTASTASSENGAGKPWKKHGNRNKKEKSRRLYKHLDM

SEQ ID NO: 859738 - protein, 674 aa, Homo sapiens; identical to SEQ ID NO: 859737

SEQ ID NO: 859739 - protein, 533 aa, Homo sapiens
KLHAPSREASSSGRVAMGRRRAPAGGSLGRALMRHQTQRSRSHRHTDSWLHTSELNDGYDWGRLNLQSVTEQSSLDDFLATAELAGTEFVAEKLNIKFVPAEARTGLLSFEESQRIKKLHEENKQFLCIPRRPNWNQNTTPEELKQAEKDNFLEWRRQLVRLEEEQKLILTPFERNLDFWRQLWRVIERSDIVVQIVDARNPLLFRCEDLECYVKEMDANKENVILINKADLLTAEQRSAWAMYFEKEDVKVIFWSALAGAIPLNGDSEEEANRDDRQSNTTEFGHSSFDQAEISHSESEHLPARDSPSLSENPTTDEDDSEYEDCPEEEEDDWQTCSEEDGPKEEDCSQDWKESSTADSEARSRKTPQKRQIHNFSHLVSKQELLELFKELHTGRKVKDGQLTVGLVGYPNVGKSSTINTIMGNKKVSVSATPGHTKHFQTLYVEPGLCLCDCPGLVMPSFVSTKAEMTCSGILPIDQMRDHVPPVSLVCQNIPRHVLEATYGINIITPREDEDPHRPPTSEELLTAYGCKL

SEQ ID NO: 859740 - protein, 176 aa, Homo sapiens
PAHHRSFNCAGAPEAPRERRVRSGSRSGDPGVAREPQAELVGAMLSPEAERVLRYLVEVEELAEEVLADKRQIVDLDTKRNQNREGLRALQKDLSLSEDVMVCFGNMFIKMPHPETKEMIEKDQDHLDKEIEKLRKQLKVKVNRLFEAQGKPELKGFNLNPLNQDELKALKVILKG

SEQ ID NO: 859741 - protein, 176 aa, Homo sapiens; identical to SEQ ID NO: 859740

SEQ ID NO: 859742 - protein, 163 aa, Homo sapiens
PAHHRSFNCAGAPEAPRERRVRSGSRSGDPGVAREPQAELVGAMLSPEAERVLRYLVEVEELAEEVLADKRQIVDLDTKRNQNREGLRALQKDLSLSEDVMVCFGNMFIKMPHPETKEMIEKGRREGGAEWSVIPAFLSEGREVFRLVPCDWNKAGGSWVVAE

SEQ ID NO: 859743 - protein, 84 aa, Homo sapiens
SRQLQFCTFSLLDSKSRCCLAALRGHSLLRRALQSPAPGLGEWMRLLPYDTCQDALPPPLKVGPGQHCSLLSAFSGLRSQYELP

SEQ ID NO: 859744 - protein, 176 aa, Homo sapiens; identical to SEQ ID NO: 859740

SEQ ID NO: 859745 - protein, 176 aa, Homo sapiens; identical to SEQ ID NO: 859740

SEQ ID NO: 859746 - protein, 85 aa, Homo sapiens
GDTGAVVMPHLVHCRIGGPSLPDLQAEFGSISAASPLSWAWLQSQQEARRADGSSSLLGKPELKGFNLNPLNQDELKALKVILKG

SEQ ID NO: 859747 - protein, 120 aa, Homo sapiens
MDSLFRVCIYPADTPIPPSLPPRASDFLFHPAAYYWQGMAGVNLGSVYHQGKLPSLLQSLWKGTFFRVQHVPMHSQVPKVTYTYIVNIVPTALQTFIWPLAVHTSQPIHVFMMMFILLFS

SEQ ID NO: 859748 - protein, 67 aa, Homo sapiens
LGTRDTPHYSSLRGLQQIERECEMAEEEHRIKMEVLNKKKMYWERKLQTFTKEWPVSSFNRPFPNSP

SEQ ID NO: 859749 - protein, 150 aa, Homo sapiens
MQNNEIIKPAKYFSELEKSILLALVEKYKYVLECKKSDARTIALKQRTWQALAHEYNSQPSVSLRDFKQLKKCWENIKARTKKIMAHERREKVKRSVSPLLSTHVLGKEKIASMLPEQLYFLQSPPEEEPEYQNTRNASAKAERNSWEKQ

SEQ ID NO: 859750 - protein, 275 aa, Homo sapiens
MQNNEIIKPAKYFSELEKSILLALVEKYKYVLECKKSDARTIALKQRTWQALAHEYNSQPSVSLRDFKQLKKCWENIKARTKKIMAHERREKVKRSVSPLLSTHVLGKEKIASMLPEQLYFLQSPPEEEPEYHPDASAQESFAVSNRELCDDEKEFIHFPVCEGTSQPEPSCSAVRITANKNYRSKTSQEGALKKMHEEEHHQQMSILQLQLIQMNEVHVAKIQQIERECEMAEEEHRIKMEVLNKKKMYWERKLQTFTKEWPVSSFNRPFPNSP

SEQ ID NO: 859751 - protein, 275 aa, Homo sapiens; identical to SEQ ID NO: 859750

SEQ ID NO: 859752 - protein, 257 aa, Homo sapiens
MQNNEIIKPAKYFSELEKSILLALVEKYKYVLECKKSDARTIALKQRTWQALAHEYNSQPSVSLRDFKQLKKCWENIKARTKLSTHVLGKEKIASMLPEQLYFLQSPPEEEPEYHPDASAQESFAVSNRELCDDEKEFIHFPVCEGTSQPEPSCSAVRITANKNYRSKTSQEGALKKMHEEEHHQQMSILQLQLIQMNEVHVAKIQQIERECEMAEEEHRIKMEVLNKKKMYWERKLQTFTKEWPVSSFNRPFPNSP

SEQ ID NO: 859753 - protein, 275 aa, Homo sapiens; identical to SEQ ID NO: 859750

SEQ ID NO: 859754 - protein, 167 aa, Homo sapiens
GRGWGARAGRRGGRGPAWRVFGPSRCDPGLAGWAPGGRLCAPRWDSVSRAGLLPTKPRGAGLWGTQWRAHGWERGGLWTPGLGELLGGNPGDLQYRGLPIPASPLCADHCARRFSILVSFKTSSAPPVQSVTGGIPHLQDEGRASHPCLTDLGKAPLLRAGATVSVN

SEQ ID NO: 859755 - protein, 275 aa, Homo sapiens; identical to SEQ ID NO: 859750

SEQ ID NO: 859756 - protein, 159 aa, Homo sapiens
MQNNEIIKPAKYFSELEKSILLALVEKYKYVLECKKSDARTIALKQRTWQALAHEYNSQPSVSLRDFKQLKKCWENIKARTKKIMAHERREKVKRSVSPLLSTHVLGKEKIASMLPEQLYFLQSPPEEEPEYHPDASAQVFFQERKRSLELSIILSGTW

SEQ ID NO: 859757 - protein, 150 aa, Homo sapiens
SLGRRLPTKSLRSPSPRGGHEGLLLLFLLPSLPLGLRLLLLLLLHCPDLPPQVPRALMPAPLTQRSPGPDVHNPRGMGRPLLPGHSSSQTGQCQSASSGRSGVAPEIHVSHLSQQVMMKLLLWSGLPVNSAQRAGPPTSLLSLNIPPTPP

SEQ ID NO: 859758 - protein, 86 aa, Homo sapiens
SLGRRLPTKSLRSPSPRGGHEGLLLLFLLPSLPLGLRLLLLLLLHCPDLPPQVPRALMPAPLTQRSPGPDVHNPRGYGEASAPWTQ

SEQ ID NO: 859759 - protein, 173 aa, Homo sapiens
MQWRALVLGLVLLRLGLHGVLWLVFGLGPSMGFYQRFPLSFGFQRLRSPDGPASPTSGPVGRPGGVSGPSWLQPPGTGAAQSPRKAPRRPGPGMCGPANWGYVLGGRGRGPDEYEKRYSGAFPPQLRAQMRDLARGMFVFGYDNYMAHAFPQDELNPIHCRGRGPDRGDPLRA

SEQ ID NO: 859760 - protein, 657 aa, Homo sapiens
MQWRALVLGLVLLRLGLHGVLWLVFGLGPSMGFYQRFPLSFGFQRLRSPDGPASPTSGPVGRPGGVSGPSWLQPPGTGAAQSPRKAPRRPGPGMCGPANWGYVLGGRGRGPDEYEKRYSGAFPPQLRAQMRDLARGMFVFGYDNYMAHAFPQDELNPIHCRGRGPDRGDPSNLNINDVLGNYSLTLVDALDTLAIMGNSSEFQKAVKLVINTVSFDKDSTVQVFEATIRVLGSLLSAHRIITDSKQPFGDMTIKDYDNELLYMAHDLAVRLLPAFENTKTGIPYPRVNLKTGVPPDTNNETCTAGAGSLLVEFGILSRLLGDSTFEWVARRAVKALWNLRSNDTGLLGNVVNIQTGHWVGKQSGLGAGLDSFYEYLLKSYILFGEKEDLEMFNAAYQSIQNYLRRGREACNEGEGDPPLYVNVNMFSGQLMNTWIDSLQAFFPGLQVLIGDVEDAICLHAFYYAIWKRYGALPERYNWQLQAPDVLFYPLRPELVESTYLLYQATKNPFYLHVGMDILQSLEKYTKVKCGYATLHHVIDKSTEDRMESFFLSETCKYLYLLFDEDNPVHKSGTRYMFTTEGHIVSVDEHLRELPWKEFFSEEGGQDQGGKSVHRPKPHELKVINSSSNCNRVPDERRYSLPLKSIYMRQIDQMVGLI

SEQ ID NO: 859761 - protein, 657 aa, Homo sapiens; identical to SEQ ID NO: 859760

SEQ ID NO: 859762 - protein, 210 aa, Homo sapiens
MQWRALVLGLVLLRLGLHGVLWLVFGLGPSMGFYQRFPLSFGFQRLRSPDGPASPTSGPVGRPGGVSGPSWLQPPGTGAAQSPRKAPRRPGPGMCGARARTFTFRFRSRFRSFARLRIYVNRRTIVRRVVRSFVSIIRRTVFDVFRFFVRFFVRTNVRFRRRRVDLRIVEIRSVVVFSRYRFYFENRLTIEFILRILTYVDFTFFYSIFY

SEQ ID NO: 859763 - protein, 462 aa, Homo sapiens
MGNSSEFQKAVKLVINTVSFDKDSTVQVFEATIRVLGSLLSAHRIITDSKQPFGDMTIKDYDNELLYMAHDLAVRLLPAFENTKTGIPYPRVNLKTGVPPDTNNETCTAGAGSLLVEFGILSRLLGDSTFEWVARRAVKALWNLRSNDTGLLGNVVNIQTGHWVGKQSGLGAGLDSFYEYLLKSYILFGEKEDLEMFNAAYQSIQNYLRRGREACNEGEGDPPLYVNVNMFSGQLMNTWIDSLQAFFPGLQVLIGDVEDAICLHAFYYAIWKRYGALPERYNWQLQAPDVLFYPLRPELVESTYLLYQATKNPFYLHVGMDILQSLEKYTKVKCGYATLHHVIDKSTEDRMESFFLSETCKYLYLLFDEDNPVHKSGTRYMFTTEGHIVSVDEHLRELPWKEFFSEEGGQDQGGKSVHRPKPHELKVINSSSNCNRVPDERRYSLPLKSIYMRQIDQMVGLI

SEQ ID NO: 859764 - protein, 571 aa, Homo sapiens [sequence omitted]

SEQ ID NO: 859765 - protein, 211 aa, Homo sapiens
MTPWLGLIVLLGSWSLGDWGAEACTCSPSHPQDAFCNSDIVIRAKVVGKKLVKEGPFGTLVYTIKQMKMYRGFTKMPHVQYIHTEASESLCGLKLEVNKYQYLLTGRVYDGKMYTGLCNFVERWDQLTLSQRKGLNYRYHLGCNCKIKSCYYLPCFVTSKNECLWTDMLSNFGYPGYQSKHYACIRQKGGYCSWYRGWAPPDKSIINATDP

SEQ ID NO: 859766 - protein, 211 aa, Homo sapiens; identical to SEQ ID NO: 859765

SEQ ID NO: 859767 - protein, 259 aa, Homo sapiens
MKDLQTSGSTMRALSPSVPLENTSNSFASVVPWGIYLDGQVGACFCWVWWQIGTPLPLPEPPTEEPPPPPPEEPPPQTEPPPLMMQPLPIPEEPPPQPELPPPPPLEKQPLPPLPPPPDDPPPVTRLGRARGLSDLLRGDVAGAAAARGASAAARAAARAAARVAADRAAAPAAGEAAGAAPGGAAARDASVALALDRLAREAAAAGGGNPESGQTVAPRRHYPSMPQTSVLHVTIDNLDYPKMAPKCLASGYLRLTCH

SEQ ID NO: 859768 - protein, 232 aa, Homo sapiens
MTPWLGLIVLLGSWSLGDWGAEACTCSPSHPQDAFCNSDIVIRAKVVGKKLVKEGPFGTLVYTIKQMKMYRGFTKMPHVQYIHTEASESLCGLKLEVNKYQYLLTGRVYDGKMYTGLCNFVERWDQLTLSQRKGLNYRYHLGCNCKIKSCYYLPCFVTSKNECLWTDMSSIRYLVQSKHKLIRRRGSRYEKGPGKLGRTEGKRTSPPGRETREKRCHAERGGGPPPRSGGGI

SEQ ID NO: 859769 - protein, 143 aa, Homo sapiens
SRYLANVLSHVQYIHTEASESLCGLKLEVNKYQYLLTGRVYDGKMYTGLCNFVERWDQLTLSQRKGLNYRYHLGCNCKIKSCYYLPCFVTSKNECLWTDMLSNFGYPGYQSKHYACIRQKGGYCSWYRGWAPPDNTFARTDSM

SEQ ID NO: 859770 - protein, 155 aa, Homo sapiens
MTPWLGLIVLLGSWSLGDWGAAGGRCTIASAQGNPPVDALLCKLPEHSVIPGAQGCVGADKKTRFNKAHGALFRDNGWVLTTHSKPGVNRICTREGFHPKIAPQWFAGTFQLREGFPEEVLVVGLLSVGCQPKYQVPCWTGSGSMMGKIAPGVGA

SEQ ID NO: 859771 - protein, 211 aa, Homo sapiens; identical to SEQ ID NO: 859765

SEQ ID NO: 859772 - protein, 211 aa, Homo sapiens; identical to SEQ ID NO: 859765

SEQ ID NO: 859773 - protein, 211 aa, Homo sapiens; identical to SEQ ID NO: 859765

SEQ ID NO: 859774 - protein, 211 aa, Homo sapiens; identical to SEQ ID NO: 859765

SEQ ID NO: 859775 - protein, 211 aa, Homo sapiens; identical to SEQ ID NO: 859765

SEQ ID NO: 859776 - protein, 211 aa, Homo sapiens; identical to SEQ ID NO: 859765

SEQ ID NO: 859777 - protein, 211 aa, Homo sapiens; identical to SEQ ID NO: 859765

SEQ ID NO: 859778 - protein, 211 aa, Homo sapiens; identical to SEQ ID NO: 859765

SEQ ID NO: 859779 - protein, 125 aa, Homo sapiens
RPTTTTARIQASNDVRGHDCSLSLFSAYGYLSSISICIFSSFHFRKQSCQLKQKKKKKKSSRQHTVESCTHTSAQARCLAEPQSGKRVPASGFLGINFITVYLSHCGHAIWQGENGRLGLLCEAV

SEQ ID NO: 859780 - protein, 211 aa, Homo sapiens; identical to SEQ ID NO: 859765

SEQ ID NO: 859781 - protein, 211 aa, Homo sapiens; identical to SEQ ID NO: 859765

SEQ ID NO: 859782 - protein, 211 aa, Homo sapiens; identical to SEQ ID NO: 859765

SEQ ID NO: 859783 - protein, 211 aa, Homo sapiens; identical to SEQ ID NO: 859765

SEQ ID NO: 859784 - protein, 211 aa, Homo sapiens; identical to SEQ ID NO: 859765

SEQ ID NO: 859785 - protein, 221 aa, Homo sapiens
MTPWLGLIVLLGSWSLGDWGAEACTCSPSHPQDAFCNSDIVIRAKVVGKKLVKEGPFGTLVYTIKQMKMYRGFTKMPHVQYIHTEASESLCGLKLEVNKYQYLLTGRVYDGKMYTGLCNFVERWDQLTLSQRKGLNYRYHLGCNCKIKSCYYLPCFVTSKNECLWTDMLSNFGYPGYQSKHYACIRQKGGYCSWYRGWAPPDKSIINATDPFSRAGGYSGI

SEQ ID NO: 859786 - protein, 219 aa, Homo sapiens
MTPWLGLIVLLGSWSLGDWGAEACTCSPSHPQDAFCNSDIVIRAKVVGKKLVKEGPFGTLVYTIKQMKMYRGFTKMPHVQYIHTEASESLCGLKLEVNKYQYLLTGRVYDGKMYTGLCNFVERWDQLTLSQRKGLNYRYHLGCNCKIKSCYYLPCFVTSKNECLWTDMLSNFGYPGYQSKHYACIRQKGGYCSWYRGWAPPDKSIINATDPFSRALRIL

SEQ ID NO: 859787 - protein, 94 aa, Homo sapiens
PGSESRLGSLRPGHTMAESINCCLLSNVQIKSCYYLPCFVTSKNECLWTDMLSNFGYPGYQSKHYACIRQKGGYCSWYRGWAPPDKSIINATDP

SEQ ID NO: 859788 - protein, 211 aa, Homo sapiens; identical to SEQ ID NO: 859765

SEQ ID NO: 859789 - protein, 211 aa, Homo sapiens; identical to SEQ ID NO: 859765

SEQ ID NO: 859790 - protein, 211 aa, Homo sapiens; identical to SEQ ID NO: 859765

SEQ ID NO: 859791 - protein, 237 aa, Homo sapiens
MHSAAQAAAQSGQQAGGGRSDGFSSSSCSSSSCSFAGRPPAESCASAEACTCSPSHPQDAFCNSDIVIRAKVVGKKLVKEGPFGTLVYTIKQMKMYRGFTKMPHVQYIHTEASESLCGLKLEVNKYQYLLTGRVYDGKMYTGLCNFVERWDQLTLSQRKGLNYRYHLGCNCKIKSCYYLPCFVTSKNECLWTDMLSNFGYPGYQSKHYACIRQKGGYCSWYRGWAPPDKSIINATDP

SEQ ID NO: 859792 - protein, 211 aa, Homo sapiens; identical to SEQ ID NO: 859765

SEQ ID NO: 859793 - protein, 211 aa, Homo sapiens; identical to SEQ ID NO: 859765

SEQ ID NO: 859794 - protein, 211 aa, Homo sapiens; identical to SEQ ID NO: 859765

SEQ ID NO: 859795 - protein, 211 aa, Homo sapiens; identical to SEQ ID NO: 859765

SEQ ID NO: 859796 - protein, 211 aa, Homo sapiens; identical to SEQ ID NO: 859765

SEQ ID NO: 859797 - protein, 211 aa, Homo sapiens; identical to SEQ ID NO: 859765

SEQ ID NO: 859798 - protein, 211 aa, Homo sapiens; identical to SEQ ID NO: 859765

SEQ ID NO: 859799 - protein, 637 aa, Homo sapiens
MGLLSQGSPLSWEETKRHADHVRRHGILQFLHIYHAVKDRHKDVLKWGDEVEYMLVSFDHENKKVRLVLSGEKVLETLQEKGERTNPNHPTLWRPEYGSYMIEGTPGQPYGGTMSEFNTVEANMRKRRKEATSILEENQALCTITSFPRLGCPGFTLPEVKPNPVEGGASKSLFFPDEAINKHPRFSTLTRNIRHRRGEKVVINVPIFKDKNTPSPFIETFTEDDEASRASKPDHIYMDAMGFGMGNCCLQVTFQACSISEARYLYDQLATICPIVMALSAASPFYRGYVSDIDCRWGVISASVDDRTREERGLEPLKNNNYRISKSRYDSIDSYLSKCGEKYNDIDLTIDKEIYEQLLQEGIDHLLAQHVAHLFIRDPLTLFEEKIHLDDANESDHFENIQSTNWQTMRFKPPPPNSDIGWRVEFRPMEVQLTDFENSAYVVFVVLLTRVILSYKLDFLIPLSKVDENMKVAQKRDAVLQGMFYFRKDICKGGNAVVDGCGKAQNSTELAAEEYTLMSIDTIINGKEGVFPGLIPILNSYLENMEVDVDTRCSILNYLKLIKKRASGELMTVARWMREFIANHPDYKQDSVITDEMNYSLILKCNQIANELCECPELLGSAFRKVKYSGSKTDSSN

SEQ ID NO: 859800 - protein, 452 aa, Homo sapiens
MGLLSQGSPLSWEETKRHADHVRRHGILQFLHIYHAVKDRHKDVLKWGDEVEYMLVSFDHENKKVRLVLSGEKVLETLQEKGERTNPNHPTLWRPEYGSYMIEGTPGQPYGGTMSEFNTVEANMRKRRKEATSILEENQALCTITSFPRLGCPGFTLPEVKPNPVEGGASKSLFFPDEAINKHPRFSTLTRNIRHRRGEKVVINVPIFKDKNTPSPFIETFTEDDEASRASKPDHIYMDAMGFGMGNCCLQVTFQACSISEARYLYDQLATICPIVMALSAASPFYRGYVSDIDCRWGVISASVDDRTREERGLEPLKNNNYRISKSRYDSIDSYLSKCGEKYNDIDLTIDKEIYEQLLQEGIDHLLAQHVAHLFIRDPLTLFEEKIHLDDANESDHFENIQSTNWQTMRFKPPPPNSDIGWRVEFRPMEVRHMHQQELTQKYSFASCSSPF

SEQ ID NO: 859801 - protein, 619 aa, Homo sapiens
MGLLSQGSPLSWEETKRHADHVRRHGILQFLHIYHAVKDRHKDVLKWGDEVEYMLVSFDHENKKVRLVLSGEKVLETLQEKGERTNPNHPTLWRPEYGSYMIEGTPGQPYGGTMSEFNTVEANMRKRRKEATSILEENQALCTITSFPRLGCPGFTLPEVKPNPVEGGASKSLFFPDEAINKHPRFSTLTRNIRHRRGVIETFTEDDEASRASKPDHIYMDAMGFGMGNCCLQVTFQACSISEARYLYDQLATICPIVMALSAASPFYRGYVSDIDCRWGVISASVDDRTREERGLEPLKNNNYRISKSRYDSIDSYLSKCGEKYNDIDLTIDKEIYEQLLQEGIDHLLAQHVAHLFIRDPLTLFEEKIHLDDANESDHFENIQSTNWQTMRFKPPPPNSDIGWRVEFRPMEVQLTDFENSAYVVFVVLLTRVILSYKLDFLIPLSKVDENMKVAQKRDAVLQGMFYFRKDICKGGNAVVDGCGKAQNSTELAAEEYTLMSIDTIINGKEGVFPGLIPILNSYLENMEVDVDTRCSILNYLKLIKKRASGELMTVARWMREFIANHPDYKQDSVITDEMNYSLILKCNQIANELCECPELLGSAFRKVKYSGSKTDSSN

SEQ ID NO: 859802 - protein, 512 aa, Homo sapiens
MGLLSQGSPLSWEETKRHADHVRRHGILQFLHIYHAVKDRHKDVLKWGDEVTNLLRLVVCFSTLTRNIRHRRGEKVVINVPIFKDKNTPSPFIETFTEDDEASRASKPDHIYMDAMGFGMGNCCLQVTFQACSISEARYLYDQLATICPIVMALSAASPFYRGYVSDIDCRWGVISASVDDRTREERGLEPLKNNNYRISKSRYDSIDSYLSKCGEKYNDIDLTIDKEIYEQLLQEGIDHLLAQHVAHLFIRDPLTLFEEKIHLDDANESDHFENIQSTNWQTMRFKPPPPNSDIGWRVEFRPMEVQLTDFENSAYVVFVVLLTRVILSYKLDFLIPLSKVDENMKVAQKRDAVLQGMFYFRKDICKGGNAVVDGCGKAQNSTELAAEEYTLMSIDTIINGKEGVFPGLIPILNSYLENMEVDVDTRCSILNYLKLIKKRASGELMTVARWMREFIANHPDYKQDSVITDEMNYSLILKCNQIANELCECPELLGSAFRKVKYSGSKTDSSN

SEQ ID NO: 859803 - protein, 361 aa, Homo sapiens
MALSAASPFYRGYVSDIDCRWGVISASVDDRTREERGLEPLKNNNYRISKSRYDSIDSYLSKCGEKYNDIDLTIDKEIYEQLLQEGIDHLLAQHVAHLFIRDPLTLFEEKIHLDDANESDHFENIQSTNWQTMRFKPPPPNSDIGWRVEFRPMEVQLTDFENSAYVVFVVLLTRVILSYKLDFLIPLSKVDENMKVAQKRDAVLQGMFYFRKDICKGGNAVVDGCGKAQNSTELAAEEYTLMSIDTIINGKEGVFPGLIPILNSYLENMEVDVDTRCSILNYLKLIKKRASGELMTVARWMREFIANHPDYKQDSVITDEMNYSLILKCNQIANELCECPELLGSAFRKVKYSGSKTDSSN

SEQ ID NO: 859804 - protein, 637 aa, Homo sapiens; identical to SEQ ID NO: 859799

SEQ ID NO: 859805 - protein, 637 aa, Homo sapiens; identical to SEQ ID NO: 859799

SEQ ID NO: 859806 - protein, 637 aa, Homo sapiens; identical to SEQ ID NO: 859799

SEQ ID NO: 859807 - protein, 604 aa, Homo sapiens
MGLLSQGSPLSWEETKRHADHVRRHGILQFLHIYHAVKDRHKDVLKWGDEVEYMLVSFDHENKKVRLVLSGEKVLETLQEKGERTNPNHPTLWRPEYGSYMIEGTPGQPYGGTMSEFNTVEANMRKRRKEATSILEENQALCTITSFPRLGCPGFTLPEVKPNPVEGGASKSLFFPDEAINKHPRFSTLTRNIRHRRGEKVVINVPIFKDKNTPSPFIETFTEDDEASRASKPDHIYMDAMGFGMGNCCLQVTFQACSISEARYLYDQLATICPIVMALSAASPFYRGYVSDIDCRWGVISASVDDRTREERGLEPLKNNNYRISKSRYDSIDSYLSKCGEKYNDIDLTIDKEIYEQLLQEGIDHLLAQHVAHLFIRDPLTLFEEKIHLDDANESDHFENIQSTNWQTMRFKPPPPNSDIGWRVEFRPMEVQLTDFENSAYVVFVVLLTRVILSYKLDFLIPLSKVDENMKVAQKRDAVLQGMFYFRKDICKGGNAVVDGCGKAQNSTELAAEEYTLMSIDTIINGKEGVFPGLIPILNSYLENMEVDVDTRCSILNYLKLIKKRASGELMTVARWMREFIANHPDYKQDSVITDLIRSGAPLL

SEQ ID NO: 859808 - protein, 549 aa, Homo sapiens
MGLLSQGSPLSWEETKRHADHVRRHGILQFLHIYHAVKDRHKDVLKWGDEVEYMLVSFDHENKKVRLVLSGEKVLETLQEKGERTNPNHPTLWRPEYGSYMIEGTPGQPYGGTMSEFNTVEANMRKRRKEATSILEENQALCTITSFPRLGCPGFTLPEVKPNPVEGGASKSLFFPDEAINKHPRFSTLTRNIRHRRGEKVVINVPIFKDKNTPSPFIETFTEDDEASRASKPDHIYMDAMGFGMGNCCLQVTFQACSISEARYLYDQLATICPIVMALSAASPFYRGYVSDIDCRWGVISASVDDRTREERGLEPLKNNNYRISKSRYDSIDSYLSKCGEKYNDIDLTIDKEIYEQLLQEGIDHLLAQHVAHLFIRDPLTLFEEKIHLDDANESDHFENIQSTNWQTMRFKPPPPNSDIGWRVEFRPMEVQLTDFENSAYVVFVVLLTRVILSYKLDFLIPLSKVDENMKVAQKRDAVLQGMFYFRKDICKGGNAVVDGCGKAQNSTELAAEEYTLMSIDTIINGKEGVFPGMIPILNSNPVQDPSRV

SEQ ID NO: 859809 - protein, 452 aa, Homo sapiens; identical to SEQ ID NO: 859800

SEQ ID NO: 859810 - protein, 137 aa, Homo sapiens
MGLLSQGSPLSWEETKRHADHVRRHGILQFLHIYHAVKDRHKDVLKWGDEVEYMLVSFDHENKKVRLVLSGEKVLETLQEKGERTNPNHPTLWRPEYGSYMIEGTPGQPYGGTMSEFNTVEANMRKRRKEATSILED

SEQ ID NO: 859811 - protein, 113 aa, Homo sapiens [sequence omitted]

SEQ ID NO: 859812 - protein, 637 aa, Homo sapiens; identical to SEQ ID NO: 859799

SEQ ID NO: 859813 - protein, 596 aa, Homo sapiens
PEYHSLVQMKETKRHADHVRRHGILQFLHIYHAVKDRHKDVLKWGDEVEYMLVSFDHENKKVRLVLSGEKVLETLQEKGERTNPNHPTLWRPEYGSYMIEGTPGQPYGGTMSEFNTVEANMRKRRKEATSILEENQALCTITSFPSTLTRNIRHRRGEKVVINVPIFKDKNTPSPFIETFTEDDEASRASKPDHIYMDAMGFGMGNCCLQVTFQACSISEARYLYDQLATICPIVMALSAASPFYRGYVSDIDCRWGVISASVDDRTREERGLEPLKNNNYRISKSRYDSIDSYLSKCGEKYNDIDLTIDKEIYEQLLQEGIDHLLAQHVAHLFIRDPLTLFEEKIHLDDANESDHFENIQSTNWQTMRFKPPPPNSDIGWRVEFRPMEVQLTDFENSAYVVFVVLLTRVILSYKLDFLIPLSKVDENMKVAQKRDAVLQGMFYFRKDICKGGNAVVDGCGKAQNSTELAAEEYTLMSIDTIINGKEGVFPGLIPILNSYLENMEVDVDTRCSILNYLKLIKKRASGELMTVARWMREFIANHPDYKQDSVITDEMNYSLILKCNQIANELCECPELLGSAFRKVKYSGSKTDSSN

SEQ ID NO: 859814 - protein, 550 aa, Homo sapiens
MGLLSQGSPLSWEETKRHADHVRRHGILQFLHIYHAVKDRHKDVLKWGDEVEYMLVSFDHENKKVRLVLSGEKVLETLQEKGERTNPNHPTLWRPEYGSYMIEGTPGQPYGGTMSEFNTVEANMRKRRKEATSILEENQALCTITSFPRLGCPGFTLPEVKPNPVEGGASKSLFFPDEAINKHPRFSTLTRNIRHRRGEKVVINVPIFKDKNTPSPFIETFTEDDEASRASKPDHIYMDAMGFGMGNCCLQVTFQACSISEARYLYDQLATICPIVMALSAASPFYRGYVSDIDCRWGVISASVDDRTREERGLEPLKNNNYRISKSRYDSIDSYLSKCGEKYNDIDLTIDKEIYEQLLQEGIDHLLAQHVAHLFIRDPLTLFEEKIHLDDANESDHFENIQSTNWQTMRFKPPPPNSDIGWRVEFRPMEVQLTDFENSAYVVFVVLLTRVILSYKLDFLIPLSKVDENMKVAQKRDAVLQGMFYFRKDICKGGNAVVDGCGKAQNSTELAAEEYTLMSIDTIINGKEGVFPGLIPILNSYLENMEVDEN

SEQ ID NO: 859815 - protein, 637 aa, Homo sapiens; identical to SEQ ID NO: 859799

SEQ ID NO: 859816 - protein, 492 aa, Homo sapiens
MGLLSQGSPLSWEETKRHADHVRRHGILQFLHIYHAVKDRHKDVLKWGDEVEYMLVSFDHENKKVRLVLSGEKVLETLQEKGERTNPNHPTLWRPEYGSYMIEGTPGQPYGGTMSEFNTVEANMRKRRKEATSILEENQALCTITSFPRLGCPGFTLPEVKPNPVEGGASKSLFFPDEAINKHPRFSTLTRNIRHRRGEKVVINVPIFKDKNTPSPFIETFTEDDEASRASKPDHIYMDAMGFGMGNCCLQVTFQACSISEARYLYDQLATICPIVMALSAASPFYRGYVSDIDCRWGVISASVDDRTREERGLEPLKNNNYRISKSRYDSIDSYLSKCGEKYNDIDLTIDKEIYEQLLQEGIDHLLAQHVAHLFIRDPLTLFEEKIHLDDANESDHFENIQSTNWQTMRFKPPPPNSDIGWRVEFRPMEVQLTDFENSAYVVFVVLLTRVILSYKLDFLIPLSKVRICFFMVMGIDLSVDIFIYICYLFPT

SEQ ID NO: 859817 - protein, 36 aa, Homo sapiens
CGKAQNSTELAAEEYTLMSIDTIINGKVGGWPCTVP

SEQ ID NO: 859818 - protein, 297 aa, Homo sapiens
MDPGKDKEGVPQPSGPPARKKFVIPLDEDEVPPGVAKPLFRSTQSLPTVDTSAQAAPQTYAEYAISQPLEGAGATCPTGSEPLAGETPNQALKPGAKSNSIIVSPRQRGNPVLKFVRNVPWEFGDVIPDYVLGQSTCALFLSLRYHNLHPDYIHGRLQSLGKNFALRVLLVQVDVKDPQQALKELAKMCILADCTLILAWSPEEAGRYLETYKAYEQKPADLLMEKLEQDFVSRVTECLTTVKSVNKTDSQTLLTTFGSLEQLIAASREDLALCPGLGPQKARRLFDVLHEPFLKVP

SEQ ID NO: 859819 - protein, 259 aa, Homo sapiens [sequence omitted]

SEQ ID NO: 859820 - protein, 280 aa, Homo sapiens
MSSAHPNQSPANSLSPQQAKPLFRSTQSLPTVDTSAQAAPQTYAEYAISQPLEGAGATCPTGSEPLAGETPNQALKPGAKSNSIIVSPRQRGNPVLKFVRNVPWEFGDVIPDYVLGQSTCALFLSLRYHNLHPDYIHGRLQSLGKNFALRVLLVQVDVKDPQQALKELAKMCILADCTLILAWSPEEAGRYLETYKAYEQKPADLLMEKLEQDFVSRVTECLTTVKSVNKTDSQTLLTTFGSLEQLIAASREDLALCPGLGPQKARRLFDVLHEPFLKVP

SEQ ID NO: 859821 - protein, 225 aa, Homo sapiens
MDPGKDKEGVPQPSGPPARKKFVIPLDEDEVPPGVRGNPVLKFVRNVPWEFGDVIPDYVLGQSTCALFLSLRYHNLHPDYIHGRLQSLGKNFALRVLLVQVDVKDPQQALKELAKMCILADCTLILAWSPEEAGRYLETYKAYEQKPADLLMEKLEQDFVSRVTECLTTVKSVNKTDSQTLLTTFGSLEQLIAASREDLALCPGLGPQKARRLFDVLHEPFLKVP

SEQ ID NO: 859822 - protein, 323 aa, Homo sapiens
MDPGKDKEGVPQPSGPPARKKFVIPLDEDEVPPGVAKPLFRSTQSLPTVDTSAQAAPQTYAEYAISQPLEGAGATCPTGSEPLAGETPNQALKPGAKSNSIIVSPRQRGNPVLKFVRNVPWEFGDVIPDYVLGQSTCALFLSLRYHNLHPDYIHGRLQSLGKNFALRVLLVQVDVKDPQQALKELAKMCILADCTLILAWSPEEAGRYLETYKAYEQKPADLLMEKLEQDFVSRVTECLTTVKSVNKTDSQTLLTTFGSLEQLIAASREDLALCPGLGPQKVRALGKNPRSWGKERAPNKHNLRPQSFKVKKEPKTRHSGFRL

SEQ ID NO: 859823 - protein, 316 aa, Homo sapiens
MDPGKDKEGVPQPSGPPARKKFVIPLDEDEVPPGVAKPLFRSTQSLPTVDTSAQAAPQTYAEYAISQPLEGAGATCPTGSEPLAGETPNQALKPGAKSNSIIVSPRQRGNPVLKFVRNVPWEFGDVIPDYVLGQSTCALFLSLRYHNLHPDYIHGRLQSLGKNFALRVLLVQVDVKDPQQALKELAKMCILADCTLILAWSPEEAGRYLETYKAYEQKPADLLMEKLEQDFVSRVTECLTTVKSVNKTDSQTLLTTFGSLEQLIAASREDLALCPGLGPQKVRALGKNPRSWGKERAPNKHNLRPQSFKVKKEPKT

SEQ ID NO: 859824 - protein, 262 aa, Homo sapiens
MDPGKDKEGVPQPSGPPARKKFVIPLDEDEVPPGVAKPLFRSTQSLPTVDTSAQAAPQTYAEYAISQPLEGAGATCPTGSEPLAGETPNQALKPGAKSNSIIVSPRQRGNPVLKFVRNVPWEFGDVIPDYVLGQSTCALFLSLRYHNLHPDYIHGRLQSLGKNFALRVLLVQVDVKDPQQALKELAKMCILADCTLILAWSPEEAGRYLETYKAYEQKPADLLMEKLEQDFVSRVTECLTTVKSVNKTDSQTLLTTFGSLGT

SEQ ID NO: 859825 - protein, 299 aa, Homo sapiens
MDPGKDKEGVPQPSGPPARKKFVIPLDEDEVPPGVAKPLFRSTQSLPTVDTSAQAAPQTYAEYAISQPLEGAGATCPTGSEPLAGETPNQALKPGAKSNSIIVSPRQRGNPVLKFVRNVPWEFGDVIPDYVLGQSTCALFLSLRYHNLHPDYIHGRLQSLGKNFALRVLLVQVDVKDPQQALKELAKMCILADCTLILAWSPEEAGRYLETYKAYEQKPADLLMEKLEQDFVSRSLEQLIAASREDLALCPGLGPQKVRALGKNPRSWGKERAPNKHNLRPQSFKVKKEPKTRHSGFRL

SEQ ID NO: 859826 - protein, 275 aa, Homo sapiens
MDPGKDKEGVPQPSGPPARKKFVIPLDEDEVPPGVAKPLFRSTQSLPTVDTSAQAAPQTYAEYAISQPLEGAGATCPTGSEPLAGETPNQALKPGAKSNSIIVSPRQRGNPVLKFVRNVPWEFGDVIPDYVLGQSTCALFLSLRYHNLHPDYIHGRLQSLGKNFALRVLLVQVDVKDPQQALKELAKMCILADCTLILAWSPEEAGRYLETYKAYEQKPADLLMEKLEQDFVSRSLEQLIAASREDLALCPGLGPQKPGEEKKMRNQSLKELFPG

SEQ ID NO: 859827 - protein, 201 aa, Homo sapiens
MDPGKDKEGVPQPSGPPARKKFVIPLDEDEVPPGVAKPLFRSTQSLPTVDTSAQAAPQTYAEYAISQPLEGAGATCPTGSEPLAGETPNQALKPGAKSNSIIVSPRQRGNPVLKFVRNVPWEFGDVIPDYVLGQSTCALFLSLRYHNLHPDYIHGRLQSLGKNFALRVLLVQVDVKDPQQALKELAKMCILADCTLILAWR

SEQ ID NO: 859828 - protein, 273 aa, Homo sapiens
MDPGKDKEGVPQPSGPPARKKFVIPLDEDEVPPGVAKPLFRSTQSLPTVDTSAQAAPQTYAEYAISQPLEGAGATCPTGSEPLAGETPNQALKPGAKSNSIIVSPRQRGNPVLKFVRNVPWEFGDVIPDYVLGQSTCALFLSLRYHNLHPDYIHGRLQSLGKNFALRVLLVQVDVKDPQQALKELAKMCILADCTLILAWSPEEAGRYLETYKAYEQKPADLLMEKLEQDFVSRSLEQLIAASREDLALCPGLGPQKARRLFDVLHEPFLKVP

SEQ ID NO: 859829 - protein, 236 aa, Homo sapiens [sequence omitted]

SEQ ID NO: 859830 - protein, 297 aa, Homo sapiens; identical to SEQ ID NO: 859818

SEQ ID NO: 859831 - protein, 297 aa, Homo sapiens; identical to SEQ ID NO: 859818

SEQ ID NO: 859832 - protein, 297 aa, Homo sapiens; identical to SEQ ID NO: 859818

SEQ ID NO: 859833 - protein, 297 aa, Homo sapiens; identical to SEQ ID NO: 859818

SEQ ID NO: 859834 - protein, 279 aa, Homo sapiens
MDPGKDKEGVPQPSGPPARKKFVIPLDEDEVPPGVAKPLFRSTQSLPTVDTSAQAAPQTYAEYAISQPLEGAGATCPTGSEPLAGETPNQALKPGAFVRNVPWEFGDVIPDYVLGQSTCALFLSLRYHNLHPDYIHGRLQSLGKNFALRVLLVQVDVKDPQQALKELAKMCILADCTLILAWSPEEAGRYLETYKAYEQKPADLLMEKLEQDFVSRVTECLTTVKSVNKTDSQTLLTTFGSLEQLIAASREDLALCPGLGPQKARRLFDVLHEPFLKVP

SEQ ID NO: 859835 - protein, 323 aa, Homo sapiens
MDPGKDKEGVPQPSGPPARKKFVIPLDEDEVPPGVAKPLFRSTQSLPTVDTSAQAAPQTYAEYAISQPLEGAGATCPTGSEPLAGETPNQALKPGAKSNSIIVSPRQRGNPVLKFVRNVPWEFGDVIPDYVLGQSTCALFLRAPGTCSPLKPKSLPLFMKKPGVWSSSLRYHNLHPDYIHGRLQSLGKNFALRVLLVQVDVKDPQQALKELAKMCILADCTLILAWSPEEAGRYLETYKAYEQKPADLLMEKLEQDFVSRVTECLTTVKSVNKTDSQTLLTTFGSLEQLIAASREDLALCPGLGPQKARRLFDVLHEPFLKVP

SEQ ID NO: 859836 - protein, 297 aa, Homo sapiens; identical to SEQ ID NO: 859818

SEQ ID NO: 859837 - protein, 323 aa, Homo sapiens; identical to SEQ ID NO: 859822

SEQ ID NO: 859838 - protein, 273 aa, Homo sapiens; identical to SEQ ID NO: 859828

SEQ ID NO: 859839 - protein, 273 aa, Homo sapiens; identical to SEQ ID NO: 859828

SEQ ID NO: 859840 - protein, 273 aa, Homo sapiens; identical to SEQ ID NO: 859828

SEQ ID NO: 859841 - protein, 259 aa, Homo sapiens [sequence omitted]

SEQ ID NO: 859842 - protein, 213 aa, Homo sapiens
MDPGKDKEGVPQPSGPPARKKFVIPLDEDEVPPGVAKPLFRSTQSLPTVDTSAQAAPQTYAEYAISQPLEGAGATCPTGSEPLAGETPNQALKPGAKSNSIIVSPRQRGNPVLKFVRNVPWEFGDVIPDYVLGQSTCALFLSLRYHNLHPDYIHGRLQSLGKNFALRVLLVQVDVKDPQQALKELAKMCILADCTLILAWRPGGCLMSCTSPS

SEQ ID NO: 859843 - protein, 81 aa, Homo sapiens
CNGAILAHCNVCLPGSSSSPTSASLVAGITGTCHHAWLIFVIPGFLVSNSDFLLQKDPQQALKELAKMCILADCTLILAWR

SEQ ID NO: 859844 - protein, 73 aa, Homo sapiens
MELSQMSELMGLSVLLGLLALMATVYRVPEKTRAAKQWFHLTNLRIRATIASRTKIHALGLNQDFCCFDGSGP

SEQ ID NO: 859845 - protein, 442 aa, Homo sapiens [sequence omitted]

SEQ ID NO: 859846 - protein, 480 aa, Homo sapiens
MSELMGLSVLLGLLALMATAAVARGWLRAGEERSGRPACQKANGFPPDKSSGSKKQKQYQRIRKEKPQQHNFTHRLLAAALKSHSGNISCMDFSSNGKYLATCADDRTIRIWSTKDFLQREHRSMRANVELDHATLVRFSPDCRAFIVWLANGDTLRVFKMTKREDGGYTFTATPEDFPKKHKAPVIDIGIANTGKFIMTASSDTTVLIWSLKGQVLSTINTNQMNNTHAAVSPCGRFVASCGFTPDVKVWEVCFGKKGEFQEVVRAFELKGHSAAVHSFAFSNDSRRMASVSKDGTWKLWDTDVEYKKKQDPYLLKTGRFEEAAGAAPCRLALSPNAQVLALASGSSIHLYNTRRGEKEECFERVHGECIANLSFDITGRFLASCGDRAVRLFHNTPGHRAMVEEMQGHLKRASNESTRQRLQQQLTQAQESDSGRARRRGLRRRDLASSWHCCHLSSQVEAFQKESPGFLTGGPASSH

SEQ ID NO: 859847 - protein, 282 aa, Homo sapiens
MTKREDGGYTFTATPEDFPKKHKAPVIDIGIANTGKFIMTASSDTTVLIWSLKGQVLSTINTNQMNNTHAAVSPCGRFVASCGFTPDVKVWEVCFGKKGEFQEVVRAFELKGHSAAVHSFAFSNDSRRMASVSKDGTWKLWDTDVEYKKKQDPYLLKTGRFEEAAGAAPCRLALSPNAQVLALASGSSIHLYNTRRGEKEECFERVHGECIANLSFDITGRFLASCGDRAVRLFHNTPGHRAMVEEMQGHLKRASNESTRQRLQQQLTQAQETLKSLGALKK

SEQ ID NO: 859848 - protein, 352 aa, Homo sapiens
MDFSSNGKYLATCADDRTIRIWSTKDFLQREHRSMRANVELDHATLVRFSPDCRAFIVWLANGDTLRVFKMTKREDGGYTFTATPEDFPKKHKAPVIDIGIANTGKFIMTASSDTTVLIWSLKGQVLSTINTNQMNNTHAAVSPCGRFVASCGFTPDVKVWEVCFGKKGEFQEVVRAFELKGHSAAVHSFAFSNDSRRMASVSKDGTWKLWDTDVEYKKKQDPYLLKTGRFEEAAGAAPCRLALSPNAQVLALASGSSIHLYNTRRGEKEECFERVHGECIANLSFDITGRFLASCGDRAVRLFHNTPGHRAMVEEMQGHLKRASNESTRQRLQQQLTQAQETLKSLGALKK

SEQ ID NO: 859849 - protein, 443 aa, Homo sapiens
MSELMGLSVLLGLLALMATAAVARGWLRAGEERSGRPACQKANGFPPDKSSGSKKQKQYQRIRKEKPQQHNFTHRLLAAALKSHSGNISCMDFSSNGKYLATCADDRTIRIWSTKDFLQREHRSMRANVELDHATLVRFSPDCRAFIVWLANGDTLRVFKMTKREDGGYTFTATPEDFPKKHKAPVIDIGIANTGKFIMTASSDTTVLIWSLKGQVLSTINTNQMNNTHAAVSPCGRFVASCGFTPDVKVWEVCFGKKGEFQEVVRAFELKGHSAAVHSFAFSNDSRRMASVSKDGTWKLWDTDVEYKKKQDPYLLKTGRFEEAAGAAPCRLALSPNAQVLALASGSSIHLYNTRRGEKEECFERVHGECIANLSFDITGRFLASCGDRAVRLFHNTPGHRAMVEEMQGHLKRASNESTRQRLQQQLTQAQDCFFPLKLLLST

SEQ ID NO: 859850 - protein, 352 aa, Homo sapiens; identical to SEQ ID NO: 859848

SEQ ID NO: 859851 - protein, 414 aa, Homo sapiens
MLTSHPRVLSGQKANGFPPDKSSGSKKQKQYQRIRKEKPQQHNFTHRLLAAALKSHSGNISCMDFSSNGKYLATCADDRTIRIWSTKDFLQREHRSMRANVELDHATLVRFSPDCRAFIVWLANGDTLRVFKMTKREDGGYTFTATPEDFPKKHKAPVIDIGIANTGKFIMTASSDTTVLIWSLKGQVLSTINTNQMNNTHAAVSPCGRFVASCGFTPDVKVWEVCFGKKGEFQEVVRAFELKGHSAAVHSFAFSNDSRRMASVSKDGTWKLWDTDVEYKKKQDPYLLKTGRFEEAAGAAPCRLALSPNAQVLALASGSSIHLYNTRRGEKEECFERVHGECIANLSFDITGRFLASCGDRAVRLFHNTPGHRAMVEEMQGHLKRASNESTRQRLQQQLTQAQETLKSLGALKK

SEQ ID NO: 859852 - protein, 209 aa, Homo sapiens
RLGPPVTVIDIGIANTGKFIMTASSDTTVLIWSLKGQVLSTINTNQMNNTHAAVSPCGRFVASCGFTPDVKVWEVCFGKKGEFQEVVRAFELKGHSAAVHSFAFSNDSRRMASVSKDGTWKLWDTDVEYKKKQDPYLLKTGRFEEAAGAAVSQHSWPPSHGGGDAGPPEAGLQREHPPEAAAAADPGPRDPEEPGCPEEVTLGGPGAED

SEQ ID NO: 859853 - protein, 442 aa, Homo sapiens [sequence omitted]

SEQ ID NO: 859854 - protein, 154 aa, Homo sapiens [sequence omitted]

SEQ ID NO: 859855 - protein, 175 aa, Homo sapiens
RAARDGCAHYSLHRDVWPRIHTPLAVLCTRPAASPNPESAPFPLYMKVLCGLTVNSLLSSQSVVETESKPRSDSKASVLFLFSVCFFLRQGLALSLRMECSSVVIIAYCSLELLGSNDPKHWDYRHEPPYPASQSLCFCPYHTHSPPEDKGHIWLISCCSTQCLAHHRWAVNAYQ

SEQ ID NO: 859856 - protein, 387 aa, Homo sapiens
MSELMGLSVLLGLLALMATAAVARGWLRAGEERSGRPACQKANGFPPDKSSGSKKQKQYQRIRKEKPQQHNFTHRLLAAALKSHSGNISCMDFSSNGKYLATCADDRTIRIWSTKDFLQREHRSMRANVELDHATLVRFSPDCRAFIVWLANGDTLRVFKMTKREDGGYTFTATPEDFPKKHKAPVIDIGIANTGKFIMTASSDTTVLIWSLKGQVLSTINTNQMNNTHAAVSPCGRFVASCGFTPDVKVWEVCFGKKGEFQEVVRAFELKGHSAAVHSFAFSNDSRRMASVSKDGTWKLWDTDVEYKKKQDPYLLKTGRFEEAAGAAVSQHSWPPSHGGGDAGPPEAGLQREHPPEAAAAADPGPRDPEEPGCPEEVTLGGPGAED

SEQ ID NO: 859857 - protein, 414 aa, Homo sapiens; identical to SEQ ID NO: 859851

SEQ ID NO: 859858 - protein, 442 aa, Homo sapiens [sequence omitted]

SEQ ID NO: 859859 - protein, 442 aa, Homo sapiens [sequence omitted]

SEQ ID NO: 859860 - protein, 414 aa, Homo sapiens; identical to SEQ ID NO: 859851

SEQ ID NO: 859861 - protein, 208 aa, Homo sapiens
MELSQMSELMGLSVLLGLLALMATAAVARGWLRAGEERSGRPACQKANGFPPDKSSGSKKQKQYQRIRKEKPQQHNFTHRLLAAALKSHSGNISCMDFSSNGKYLATCADDRTIRIWSTKDFLQREHRSMRANVELDHATLVRFSPDCRAFIVWLANGDTLRVFKMTKREDGGYTFTATPEDFPKKHKAPVIDIGIANTVTPLSSSGA

SEQ ID NO: 859862 - protein, 104 aa, Homo sapiens
MELSQMSELMGLSVLLGLLALMATAAVARGWLRAGEERSGRPAYDGDPPCRVRRTSWGGTGSNLGPLLRLSLWPRPGRPRGGQESTVNSSACSVAAISEKAPIL

SEQ ID NO: 859863 - protein, 225 aa, Homo sapiens
FTGTTCSENEVLKASGLYGRFVASCGFTPDVKVWEVCFGKKGEFQEVVRAFELKGHSAAVHSFAFSNDSRRMASVSKDGTWKLWDTDVEYKKKQDPYLLKTGRFEEAAGAAPCRLALSPNAQVLALASGSSIHLYNTRRGEKEECFERVHGECIANLSFDITGRFLASCGDRAVRLFHNTPGHRAMVEEMQGHLKRASNESTRQRLQQQLTQAQETLKSLGALKK

SEQ ID NO: 859864 - protein, 469 aa, Homo sapiens
QVCCDRRGTPVVAAAAAAGAPGRGATMAVRQALGRGLQLGRALLLRFTGKPGRAYGLGRPGPAAGCVRGERPGWAAGPGAEPRRVGLGLPNRLRFFRQSVAGLAARLQRQFVVRAWGCAGPCGRAVFLAFGLGLGLIEEKQAESRRAVSACQEIQAIFTQKSKPGPDPLDTRRLQGFRLEEYLIGQSIGKGCSAAVYEATMPTLPQNLEVTKSTGLLPGRGPGTSAPGEGQERAPGAPAFPLAIKMMWNISAGSSSEAILNTMSQELVPASRVALAGEYGAVTYRKSKRGPKQLAPHPNIIRVLRAFTSSVPLLPGALVDYPDVLPSRLHPEGLGHGRTLFLVMKNYPCTLRQYLCVNTPSPRLAAMMLLQLLEGVDHLVQQGIAHRDLKSDNILVELDPDGCPWLVIADFGCCLADESIGLQLPFSSWYVDRGGNGCLMAPEVSPECVMRHRQPFPHMSTECRRLDAL

SEQ ID NO: 859865 - protein, 600 aa, Homo sapiens
QVCCDRRGTPVVAAAAAAGAPGRGATMAVRQALGRGLQLGRALLLRFTGKPGRAYGLGRPGPAAGCVRGERPGWAAGPGAEPRRVGLGLPNRLRFFRQSVAGLAARLQRQFVVRAWGCAGPCGRAVFLAFGLGLGLIEEKQAESRRAVSACQEIQAIFTQKSKPGPDPLDTRRLQGFRLEEYLIGQSIGKGCSAAVYEATMPTLPQNLEVTKSTGLLPGRGPGTSAPGEGQERAPGAPAFPLAIKMMWNISAGSSSEAILNTMSQELVPASRVALAGEYGAVTYRKSKRGPKQLAPHPNIIRVLRAFTSSVPLLPGALVDYPDVLPSRLHPEGLGHGRTLFLVMKNYPCTLRQYLCVNTPSPRLAAMMLLQLLEGVDHLVQQGIAHRDLKSDNILVELDPDGCPWLVIADFGCCLADESIGLQLPFSSWYVDRGGNGCLMAPEPRAVIDYSKADAWAVGAIAYEIFGLVNPFYGQGKAHLESRSYQEAQLPALPESVPPDVRQLVRALLQREASKRPSARVAANVLHLSLWGEHILALKNLKLDKMVGWLLQQSAATLLANRLTEKCCVETKMKMLFLANLECETLCQAALLLCSWRAAL

SEQ ID NO: 859866 - protein, 355 aa, Homo sapiens [sequence omitted]

SEQ ID NO: 859867 - protein, 404 aa, Homo sapiens
QVCCDRRGTPVVAAAAAAGAPGRGATMAVRQALGRGLQLGRALLLRFTGKPGRAYGLGRPGPAAGCVRGERPGWAAGPGAEPRRVGLGLPNRLRFFRQSVAGLAARLQRQFVVRAWGCAGPCGRAVFLAFGGHGRTLFLVMKNYPCTLRQYLCVNTPSPRLAAMMLLQLLEGVDHLVQQGIAHRDLKSDNILVELDPDGCPWLVIADFGCCLADESIGLQLPFSSWYVDRGGNGCLMAPEVSTARPGPRAVIDYSKADAWAVGAIAYEIFGLVNPFYGQGKAHLESRSYQEAQLPALPESVPPDVRQLVRALLQREASKRPSARVAANVLHLSLWGEHILALKNLKLDKMVGWLLQQSAATLLANRLTEKCCVETKMKMLFLANLECETLCQAALLLCSWRAAL

SEQ ID NO: 859868 - protein, 607 aa, Homo sapiens
QVCCDRRGTPVVAAAAAAGAPGRGATMAVRQALGRGLQLGRALLLRFTGKPGRAYGLGRPGPAAGCVRGERPGWAAGPGAEPRRVGLGLPNRLRFFRQSVAGLAARLQRQFVVRAWGCAGPCGRAVFLAFGLGLGLIEEKQAESRRAVSACQEIQAIFTQKSKPGPDPLDTRRLQGFRLEEYLIGQSIGKGCSAAVYEATMPTLPQNLEVTKSTGLLPGRGPGTSAPGEGQERAPGAPAFPLAIKMMWNISAGSSSEAILNTMSQELVPASRVALAGEYGAVTYRKSKRGPKQLAPHPNIIRVLRAFTSSVPLLPGALVDYPDVLPSRLHPEGLGHGRTLFLVMKNYPCTLRQYLCVNTPSPRLAAMMLLQLLEGVDHLVQQGIAHRDLKSDNILVELDPDGCPWLVIADFGCCLADESIGLQLPFSSWYVDRGGNGCLMAPEVSTARPGPRAVIDYSKADAWAVGAIAYEIFGLVNPFYGQGKAHLESRSYQEAQLPALPESVPPDVRQLVRALLQREASKRPSARVAANVLHLSLWGEHILALKNLKLDKMVGWLLQQSAATLLANRLTEKCCVETKMKMLFLANLECETLCQAALLLCSWRAAL

SEQ ID NO: 859869 - protein, 607 aa, Homo sapiens; identical to SEQ ID NO: 859868

SEQ ID NO: 859870 - protein, 534 aa, Homo sapiens
QVCCDRRGTPVVAAAAAAGAPGRGATMAVRQALGRGLQLGRALLLRFTGKPGRAYGLGRPGPAAGCVRGERPGWAAGPGAEPRRVGLGLPNRLRFFRQSVAGLAARLQRQFVVRAWGCAGPCGRAVFLAFGLGLGLIEEKQAESRRAVSACQEIQAIFTQKSKPGPDPLDTRRLQGFRLEEYLIGQSIGKGCSAAVYEATMPTLPQNLEVTKSTGLLPGRGPGTSAPGEGQERAPGAPAFPLAIKMMWNISAGSSSEAILNTMSQELVPASRVALAGEYGAVTYRKSKRGPKQLAPHPNIIRVLRAFTSSVPLLPGALVDYPDVLPSRLHPEGLGHGRTLFLVMKNYPCTLRQYLCVNTPSPRLAAMMLLQLLEGVDHLVQQGIAHRDLKSDNILVELDPDGCPWLVIADFGCCLADESIGLQLPFSSWYVDRGGNGCLMAPEVSTARPGPRAVIDYSKADAWAVGAIAYEIFGLVNPFYGQGKAHLESRSYQEAQLPALPESVPPDVRQLVRALLQREASKVRLSPASRGRCG

SEQ ID NO: 859871 - protein, 517 aa, Homo sapiens
QVCCDRRGTPVVAAAAAAGAPGRGATMAVRQALGRGLQLGRALLLRFTGKPGRAYGLGRPGPAAGCVRGERPGWAAGPGAEPRRVGLGLPNRLRFFRQSVAGLAARLQRQFVVRAWGCAGPCGRAVFLAFGLGLGLIEEKQAESRRAVSACQEIQAIFTQKSKPGPDPLDTRRLQGFRLEEYLIGQSIGKGCSAAVYEATMPTLPQNLEVTKSTGLLPGRGPGTSAPGEGQERAPGAPAFPLAIKMMWNISAGSSSEAILNTMSQELVPASRVALAGEYGAVTYRKSKRGPKQLAPHPNIIRVLRAFTSSVPLLPGALVDYPDVLPSRLHPEGLGHGRTLFLVMKNYPCTLRQYLCVNTPSPRLAAMMLLQLLEGVDHLVQQGIAHRDLKSDNILVELDPDGCPWLVIADFGCCLADESIGLQLPFSSWYVDRGGNGCLMAPEVSTARPGPRAVIDYSKADAWAVGAIAYEIYSSPEESEVRQDGWLAPPTIGRHFVGQQAHREVLCGNKNEDALSG

SEQ ID NO: 859872 - protein, 607 aa, Homo sapiens; identical to SEQ ID NO: 859868

SEQ ID NO: 859873 - protein, 607 aa, Homo sapiens; identical to SEQ ID NO: 859868

SEQ ID NO: 859874 - protein, 591 aa, Homo sapiens
QVCCDRRGTPVVAAAAAAGAPGRGATMAVRQALGRGLQLGRALLLRFTGKPGRAYGLGRPGPAAGCVRGERPGWAAGPGAEPRRVGLGLPNRLRFFRQSVAGLAARLQRQFVVRALGLGLIEEKQAESRRAVSACQEIQAIFTQKSKPGPDPLDTRRLQGFRLEEYLIGQSIGKGCSAAVYEATMPTLPQNLEVTKSTGLLPGRGPGTSAPGEGQERAPGAPAFPLAIKMMWNISAGSSSEAILNTMSQELVPASRVALAGEYGAVTYRKSKRGPKQLAPHPNIIRVLRAFTSSVPLLPGALVDYPDVLPSRLHPEGLGHGRTLFLVMKNYPCTLRQYLCVNTPSPRLAAMMLLQLLEGVDHLVQQGIAHRDLKSDNILVELDPDGCPWLVIADFGCCLADESIGLQLPFSSWYVDRGGNGCLMAPEVSTARPGPRAVIDYSKADAWAVGAIAYEIFGLVNPFYGQGKAHLESRSYQEAQLPALPESVPPDVRQLVRALLQREASKRPSARVAANVLHLSLWGEHILALKNLKLDKMVGWLLQQSAATLLANRLTEKCCVETKMKMLFLANLECETLCQAALLLCSWRAAL

SEQ ID NO: 859875 - protein, 607 aa, Homo sapiens; identical to SEQ ID NO: 859868

SEQ ID NO: 859876 - protein, 317 aa, Homo sapiens
PKFVVTGGGRRWWRQRRLRGHRAAAPPWRCDRRWAAACSWVERWGHGRTLFLVMKNYPCTLRQYLCVNTPSPRLAAMMLLQLLEGVDHLVQQGIAHRDLKSDNILVELDPDGCPWLVIADFGCCLADESIGLQLPFSSWYVDRGGNGCLMAPEVSTARPGPRAVIDYSKADAWAVGAIAYEIFGLVNPFYGQGKAHLESRSYQEAQLPALPESVPPDVRQLVRALLQREASKRPSARVAANVLHLSLWGEHILALKNLKLDKMVGWLLQQSAATLLANRLTEKCCVETKMKMLFLANLECETLCQAALLLCSWRAAL

SEQ ID NO: 859877 - protein, 607 aa, Homo sapiens; identical to SEQ ID NO: 859868

SEQ ID NO: 859878 - protein, 534 aa, Homo sapiens; identical to SEQ ID NO: 859870

SEQ ID NO: 859879 - protein, 439 aa, Homo sapiens
QVCCDRRGTPVVAAAAAAGAPGRGATMAVRQALGRGLQLGRALLLRFTGKPGRAYGLGRPGPAAGCVRGERPGWAAGPGAEPRRVGLGLPNRLRFFRQSVAGLAARLQRQFVVRAWGCAGPCGRAVFLAFGLGLGLIEEKQAESRRAVSACQEIQAIFTQKSKPGPDPLDTRRLQGFRLEEYLIGQSIGKGCSAAVYEATMPTLPQNLEVTKSTGLLPGRGPGTSAPGEGQERAPGAPAFPLAIKMMWNISAGSSSEAILNTMSQELVPASRVALAGEYGAVTYRKSKRGPKQLAPHPNIIRVLRAFTSSVPLLPGALVDYPDVLPSRLHPEGLGHGRTLFLVMKNYPCTLRQYLCVNTPSPRLAAMMLLQLLEGVDHLVQQGIAHRDLKSDNILVELDPGRNLLHHQSSPGALEGGSGAFRTDSSGPLWFCVLSHVFI

SEQ ID NO: 859880 - protein, 74 aa, Homo sapiens
MDSEVQRDGRILDLIDDAWREDKLPYEDVAIPLNELPEPEQDNGGTTESVKEQEMKWTDLALQYLHENVPPIGN

SEQ ID NO: 859881 - protein, 100 aa, Homo sapiens
CRHVMRGRAGRGRSKRLPRWPGAGKGFQRPRPRFWRRGNAFVAQCRTSPYSHRPRLSLYAHNRFSLLHSCREERDLRGTPRPPRLRFHVWYILPEAGSRS

SEQ ID NO: 859882 - protein, 74 aa, Homo sapiens; identical to SEQ ID NO: 859880

SEQ ID NO: 859883 - protein, 100 aa, Homo sapiens; identical to SEQ ID NO: 859881

SEQ ID NO: 859884 - protein, 100 aa, Homo sapiens; identical to SEQ ID NO: 859881

SEQ ID NO: 859885 - protein, 100 aa, Homo sapiens; identical to SEQ ID NO: 859881

SEQ ID NO: 859886 - protein, 100 aa, Homo sapiens; identical to SEQ ID NO: 859881

SEQ ID NO: 859887 - protein, 100 aa, Homo sapiens; identical to SEQ ID NO: 859881

SEQ ID NO: 859888 - protein, 74 aa, Homo sapiens; identical to SEQ ID NO: 859880

SEQ ID NO: 859889 - protein, 74 aa, Homo sapiens; identical to SEQ ID NO: 859880

SEQ ID NO: 859890 - protein, 302 aa, Homo sapiens
MTSSRLSTARSLAWWWIAVAALKVGDRGCLPHRPYPKSAWKLTTKYKNKTRKRRKKKNERGGNTQQRVHNQKERMRARTYKERSDSAAHNARKQGHPRNKRENPEEKTKREQTRTEQTPTKDSRTKAPRKHAQNEDATQQQHTQQQGRNKPNKNGRHSARKQKTEHKNNETTKNKRESATRTYKQENEEQMNTTTALTKRTESKAEGTDHRQREHTQNDNSRQEETQHQAKAEQETHDKQREQDGRHEQATTLEDTNTKTEGKKNNKGRRHNDKNEKAEEQDKKSKGTQQREDTEQKAARDE

SEQ ID NO: 859891 - protein, 407 aa, Homo sapiens
MVLAAPLLLGFLLLALELRPRGEAAEGPAAAAAAAAAAAAAGVGGERSSRPAPSVAPEPDGCPVCVWRQHSRELRLESIKSQILSKLRLKEAPNISREVVKQLLPKAPPLQQILDLHDFQGDALQPEDFLEEDEYHATTETVISMAQETDPAVQTDGSPLCCHFHFSPKVMFTKVLKAQLWVYLRPVPRPATVYLQILRLKPLTGEGTAGGGGGGRRHIRIRSLKIELHSRSGHWQSIDFKQVLHSWFRQPQSNWGIEINAFDPSGTDLAVTSLGPGAEGLHPFMELRVLENTKRSRRNLGLDCDEHSSESRCCRYPLTVDFEAFGWDWIIAPKRYKANYCSGQCEYMFMQKYPHTHLVQQANPRGSAGPCCTPTKMSPINMLYFNDKQQIIYGKIPGMVVDRCGCS

SEQ ID NO: 859892 - protein, 407 aa, Homo sapiens; identical to SEQ ID NO: 859891

SEQ ID NO: 859893 - protein, 407 aa, Homo sapiens; identical to SEQ ID NO: 859891

SEQ ID NO: 859894 - protein, 407 aa, Homo sapiens; identical to SEQ ID NO: 859891

SEQ ID NO: 859895 - protein, 219 aa, Homo sapiens
MLRAGAPTGDLPRAGEVHTGTTIMAVEFDGGVVMGSDSRVSAGEAVVNRVFDKLSPLHERIYCALSGSAADAQAVADMAAYQLELHGIELEEPPLVLAAANVVRNISYKYREDLSAHLMVAGWDQREGGQVYGTLGGMLTRQPFAIGGSGSTFIYGYVDAAYKPGMSPEECRRFTTDAIALAMSRDGSSGGVIYLVTITAAGVDHRVILGNELPKFYDE

SEQ ID NO: 859896 - protein, 219 aa, Homo sapiens; identical to SEQ ID NO: 859895

SEQ ID NO: 859897 - protein, 163 aa, Homo sapiens
RKGQLVPGPGPSHWGPASLLSRYGGRGNDGSRVFRRKRERNRRLQKPTWRWVTVRGSLHYHEELGKEVTHSRQISSNSSWRQLPTLQLWFSTTERRKGREMECAGLRRLSFWSICRSLHHGPVAPLFLHELLVGSPLPDSASFQKEDVVSLLHQAEVLGDEKH

SEQ ID NO: 859898 - protein, 219 aa, Homo sapiens; identical to SEQ ID NO: 859895

SEQ ID NO: 859899 - protein, 196 aa, Homo sapiens
MAVEFDGGVVMGSDSRVSAGEAVVNRVFDKLSPLHERIYCALSGSAADAQAVADMAAYQLELHGIELEEPPLVLAAANVVRNISYKYREDLSAHLMVAGWDQREGGQVYGTLGGMLTRQPFAIGGSGSTFIYGYVDAAYKPGMSPEECRRFTTDAIALAMSRDGSSGGVIYLVTITAAGVDHRVILGNELPKFYDE

SEQ ID NO: 859900 - protein, 155 aa, Homo sapiens
GPGPSHWGPASLLSRYGGRGNDGSRVFRRKRERNRRLQKPTWRWVTVRGTSRPGHPLETGVGRVVSSKGAASTRRLEVSQELGVVSRGVGVPMSITLQNQEGRKCEGAESWKQVLGQLQQNIPAACRGRRRQGEGAVSESFHGVHPRAPPGSTVS

SEQ ID NO: 859901 - protein, 219 aa, Homo sapiens; identical to SEQ ID NO: 859895

SEQ ID NO: 859902 - protein, 196 aa, Homo sapiens; identical to SEQ ID NO: 859899

SEQ ID NO: 859903 - protein, 178 aa, Homo sapiens
MLRAGAPTGDLPRAGEVHTGTTIMAVEFDGGVVMGSDSRVSAGIELEEPPLVLAAANVVRNISYKYREDLSAHLMVAGWDQREGGQVYGTLGGMLTRQPFAIGGSGSTFIYGYVDAAYKPGMSPEECRRFTTDATSTKRRVCGYFLRTQKRENQNQRVHEYMCTGERSLSSSPLLSCS

SEQ ID NO: 859904 - protein, 35 aa, Homo sapiens
MLRAGAPTGDLPRAGEVHTGVMGLGLRVGRGVEEM

SEQ ID NO: 859905 - protein, 114 aa, Homo sapiens
MTAQHPEICPLSEEEVKAKATDRRGGNKTLFHIPLPFPRKGQLVPGPGPSHWGPASLLSRYGGRGNDGSRVFRRKRERNRRLQKPTWRWVTVRGTSRPGHPLETGVGRVVSSKG

SEQ ID NO: 859906 - protein, 267 aa, Homo sapiens
SPSNSQPTSPASAPALPPPARRSRGAQTVSLTMGTADSDEMAPEAPQHTHIDVHIHQESALAKLLLTCCSALRPRATQARGSSRLLVASWVMQIVLGILSAVLGGFFYIRDYTLLVTSGAAIWTGAVAVLAGAAAFIYEKRGGTYWALLRTLLALAAFSTAIAALKLWNEDFRYGYSYYNSACRISSSSDWNTPAPTQSPEEVRRLHLCTSFMDMLKALFRTLQAMLLGVWILLLLASLAPLWLYCWRMFPTKGKRDQKEMLEVSGI

SEQ ID NO: 859907 - protein, 163 aa, Homo sapiens
PQELDPGSTLSAIILPWIIKLSMKPPAQAVCWGRACMEALSWERSCISCTKPAPGSISPQAVLAGAAAFIYEKRGGTYWALLRTLLALAAFSTAIAALKLWNEDFRYGYSYYNSACRISSSSDWNTPAPTQSPEEVRRLHLCTSFMDMLKKRDQKEMLEVSGI

SEQ ID NO: 859908 - protein, 313 aa, Homo sapiens
PLQLSTHFSSQRPSPPAARSQVPRSAGEAAPHSRRPPGLLPHAPRAASAQLEERRRDPHPGMTLQEGDCRGSQTVSLTMGTADSDEMAPEAPQHTHIDVHIHQESALAKLLLTCCSALRPRATQARGSSRLLVASWVMQIVLGILSAVLGGFFYIRDYTLLVTSGAAIWTGAVAVLAGAAAFIYEKRGGTYWALLRTLLALAAFSTAIAALKLWNEDFRYGYSYYNSACRISSSSDWNTPAPTQSPEEVRRLHLCTSFMDMLKALFRTLQAMLLGVWILLLLASLAPLWLYCWRMFPTKGKRDQKEMLEVSGI

SEQ ID NO: 859909 - protein, 176 aa, Homo sapiens
MQIVLGILSAVLGGFFYIRDYTLLVTSGAAIWTGAVAVLAGAAAFIYEKRGGTYWALLRTLLALAAFSTAIAALKLWNEDFRYGYSYYNSACRISSSSDWNTPAPTQSPEEVRRLHLCTSFMDMLKALFRTLQAMLLGVWILLLLASLAPLWLYCWRMFPTKGKRDQKEMLEVSGI

SEQ ID NO: 859910 - protein, 138 aa, Homo sapiens
ASVSAAYDILFAEHWASFTISYTTLYHPFSTAIAALKLWNEDFRYGYSYYNSACRISSSSDWNTPAPTQSPEEVRRLHLCTSFMDMLKALFRTLQAMLLGVWILLLLASLAPLWLYCWRMFPTKGKRDQKEMLEVSGI

SEQ ID NO: 859911 - protein, 267 aa, Homo sapiens; identical to SEQ ID NO: 859906

SEQ ID NO: 859912 - protein, 267 aa, Homo sapiens; identical to SEQ ID NO: 859906

SEQ ID NO: 859913 - protein, 267 aa, Homo sapiens; identical to SEQ ID NO: 859906

SEQ ID NO: 859914 - protein, 230 aa, Homo sapiens
SPSNSQPTSPASAPALPPPARRSRGAQTVSLTMGTADSDEMAPEAPQHTHIDVHIHQESALAKLLLTCCSALRPRATQARGSSRLLVASWVMQIVLGILSAVLGGFFYIRDYTLLVTSGAAIWTGAVAVLAGAAAFIYEKRGGTYWALLRTLLALAAFSTAIAALKLWNEDFRYGYSYYNSACRISSSSDWNTPAPTQSPEEVRRLHLCTSFMDMLKKRDQKEMLEVSGI

SEQ ID NO: 859915 - protein, 200 aa, Homo sapiens
PQELDPGSTLSAIILPWIIKLSMKPPAQAVCWGRACMEALSWERSCISCTKPAPGSISPQAVLAGAAAFIYEKRGGTYWALLRTLLALAAFSTAIAALKLWNEDFRYGYSYYNSACRISSSSDWNTPAPTQSPEEVRRLHLCTSFMDMLKALFRTLQAMLLGVWILLLLASLAPLWLYCWRMFPTKGKRDQKEMLEVSGI

SEQ ID NO: 859916 - protein, 164 aa, Homo sapiens
HQRVGSSPYCRPAGGANSLVISCEAVLAGAAAFIYEKRGGTYWALLRTLLALAAFSTAIAALKLWNEDFRYGYSYYNSACRISSSSDWNTPAPTQSPEEVRRLHLCTSFMDMLKALFRTLQAMLLGVWILLLLASLAPLWLYCWRMFPTKGKRDQKEMLEVSGI

SEQ ID NO: 859917 - protein, 267 aa, Homo sapiens; identical to SEQ ID NO: 859906

SEQ ID NO: 859918 - protein, 286 aa, Homo sapiens
SPSNSQPTSPASAPALPPPARRSRGAQTVSLTMGTADSDEMAPEAPQHTHIDVHIHQESALAKLLLTCCSALRPRATQARGSSRLLVASWVMQIVLGILSAVLGGFFYIRDYTLLVTSGAAIWTGAVAVLAGAAAFIYEKRGGTYWALLRTLLALAAFSTAIAALKLWNEDFRYGYSYYNSACRISSSSDWNTPAPTQSPEEVRRLHLCTSFMDMLKALFRTLQAMLLGVWILLLLASLAPLWLYCWRMFPTKGVPKVCACVFGAVELLKGDRNGQWTVWGGERGP

SEQ ID NO: 859919 - protein, 230 aa, Homo sapiens; identical to SEQ ID NO: 859914

SEQ ID NO: 859920 - protein, 157 aa, Homo sapiens
SPREGPGVRPCDQDSHSLGDFEPPLAPDLPNSNEICENLLTAVPLWCSLPHETVSLTMGTADSDEMAPEAPQHTHIDVHIHQESALAKLLLTCCSALRPRATQARGSSRLLVASWVSVTACLVGRREELPTSSRSSTLCQPPSEQDTEPVMSSYLAM

SEQ ID NO: 859921 - protein, 337 aa, Homo sapiens
MRPTLLWSLLLLLGVFAAAAAAPPDPLSQLPAPQHPKIRLYNAEQVLSWEPVALSNSTRPVVYQVQFKYTDSKWFTADIMSIGVNCTQITATECDFTAASPSAGFPMDFNVTLRLRAELGALHSAWVTMPWFQHYRNVTVGPPENIEVTPGEGSLIIRFSSPFDIADTSTAFFCYYVHYWEKGGIQQVKGPFRSNSISLDNLKPSRVYCLQVQAQLLWNKSNIFRVGHLSNISCYETMADASTELQQVILISVGTFSLLSVLAGACFFLVLKYRGLIKYWFHTPPSIPLQIEEYLKDPTQPILEALDKDSSPKDDVWDSVSIISFPEKEQEDVLQTL

SEQ ID NO: 859922 - protein, 356 aa, Homo sapiens
MRPTLLWSLLLLLGVFAAAAAAPPAQLTLETYQEWCNDSAATHDPLSQLPAPQHPKIRLYNAEQVLSWEPVALSNSTRPVVYQVQFKYTDSKWFTADIMSIGVNCTQITATECDFTAASPSAGFPMDFNVTLRLRAELGALHSAWVTMPWFQHYRNVTVGPPENIEVTPGEGSLIIRFSSPFDIADTSTAFFCYYVHYWEKGGIQQVKGPFRSNSISLDNLKPSRVYCLQVQAQLLWNKSNIFRVGHLSNISCYETMADASTELQQVILISVGTFSLLSVLAGACFFLVLKYRGLIKYWFHTPPSIPLQIEEYLKDPTQPILEALDKDSSPKDDVWDSVSIISFPEKEQEDVLQTL

SEQ ID NO: 859923 - protein, 339 aa, Homo sapiens
MSTPSSSESVNLGMCCLTYKRDSADVNPLSQLPAPQHPKIRLYNAEQVLSWEPVALSNSTRPVVYQVQFKYTDSKWFTADIMSIGVNCTQITATECDFTAASPSAGFPMDFNVTLRLRAELGALHSAWVTMPWFQHYRNVTVGPPENIEVTPGEGSLIIRFSSPFDIADTSTAFFCYYVHYWEKGGIQQVKGPFRSNSISLDNLKPSRVYCLQVQAQLLWNKSNIFRVGHLSNISCYETMADASTELQQVILISVGTFSLLSVLAGACFFLVLKYRGLIKYWFHTPPSIPLQIEEYLKDPTQPILEALDKDSSPKDDVWDSVSIISFPEKEQEDVLQTL

SEQ ID NO: 859924 - protein, 258 aa, Homo sapiens
MSIGVNCTQITATECDFTAASPSAGFPMDFNVTLRLRAELGALHSAWVTMPWFQHYRNVTVGPPENIEVTPGEGSLIIRFSSPFDIADTSTAFFCYYVHYWEKGGIQQVKGPFRSNSISLDNLKPSRVYCLQVQAQLLWNKSNIFRVGHLSNISCYETMADASTELQQVILISVGTFSLLSVLAGACFFLVLKYRGLIKYWFHTPPSIPLQIEEYLKDPTQPILEALDKDSSPKDDVWDSVSIISFPEKEQEDVLQTL

SEQ ID NO: 859925 - protein, 207 aa, Homo sapiens
MSLYAFELTVGPPENIEVTPGEGSLIIRFSSPFDIADTSTAFFCYYVHYWEKGGIQQVKGPFRSNSISLDNLKPSRVYCLQVQAQLLWNKSNIFRVGHLSNISCYETMADASTELQQVILISVGTFSLLSVLAGACFFLVLKYRGLIKYWFHTPPSIPLQIEEYLKDPTQPILEALDKDSSPKDDVWDSVSIISFPEKEQEDVLQTL

SEQ ID NO: 859926 - protein, 155 aa, Homo sapiens
MFLKQVKGPFRSNSISLDNLKPSRVYCLQVQAQLLWNKSNIFRVGHLSNISCYETMADASTELQQVILISVGTFSLLSVLAGACFFLVLKYRGLIKYWFHTPPSIPLQIEEYLKDPTQPILEALDKDSSPKDDVWDSVSIISFPEKEQEDVLQTL

SEQ ID NO: 859927 - protein, 337 aa, Homo sapiens; identical to SEQ ID NO: 859921

SEQ ID NO: 859928 - protein, 337 aa, Homo sapiens; identical to SEQ ID NO: 859921

SEQ ID NO: 859929 - protein, 337 aa, Homo sapiens; identical to SEQ ID NO: 859921

SEQ ID NO: 859930 - protein, 335 aa, Homo sapiens
MRPTLLWSLLLLLGVFAAAAAAPPDPLSQLPAPQHPKIRLYNAEQVLSWEPVALSNSTRPVVYQVQFKYTDSKWFTADIMSIGVNCTQITATECDFTAASPSAGFPMDFNVTLRLRAELGALHSAWVTMPWFQHYRNVTVGPPENIEVTPGEGSLIIRFSSPFDIADTSTAFFCYYVHYWEKGGIQQVKGPFRSNSISLDNLKPSRVYCLQVQAQLLWNKSNIFRVGHLSNISCYETMADASTELQQVILISVGTFSLLSVLAGACFFLVLKYRGLIKYWFHTPPSIPLQIEEYLKDPTQPILEALDKDSSQFSKSNSRMILRRYPRKIKASLKH

SEQ ID NO: 859931 - protein, 302 aa, Homo sapiens
MRPTLLWSLLLLLGVFAAAAAAPPDPLSQLPAPQHPKIRLYNAEQVLSWEPVALSNSTRPVVYQVQFKYTDSKWFTADIMSIGVNCTQITATECDFTAASPSAGFPMDFNVTLRLRAELGALHSAWVTMPWFQHYRNVTVGPPENIEVTPGEGSLIIRFSSPFDIADTSTAFFCYYVHYWEKGGIQQVKGPFRSNSISLDNLKPSRVYCLQVQAQLLWNKSNIFRVGHLSNISCYETMADASTELQQVILISVGTFSLLSVLAGACFFLVLKYRGLIKYWFHTPPSIPLQIEEPGRRLDFGK

SEQ ID NO: 859932 - protein, 141 aa, Homo sapiens
MRPTLLWSLLLLLGVFAAAAAAPPDPLSQLPAPQHPKIRLYNAEQVLSWEPVALSNSTRPVVYQVQFKYTDSKWFTADIMSIGVNCTQITATECDFTAASPSAGFPMDFNVTLRLRAELGALHSAWVTMPWFQHYRNGKRT

SEQ ID NO: 859933 - protein, 250 aa, Homo sapiens
MRPTLLWSLLLLLGVFAAAAAAPPDPLSQLPAPQHPKIRLYNAEQVLSWEPVALSNSTRPVVYQVQFKYTDSKWFTADIMSIGVNCTQITATECDFTAASPSAGFPMDFNVTLRLRAELGALHSAWVTMPWFQHYRNVTVGPPENIEVTPGEGSLIIRFSSPFDIADTSTAFFCYYVHYWEKGGIQQVKGPFRSNSISLDNLKPSMPWFQHYRTVTVGPPENIEVTQEKAPSSSCSPLPLTSLITPRPLR

SEQ ID NO: 859934 - protein, 258 aa, Homo sapiens; identical to SEQ ID NO: 859924

SEQ ID NO: 859935 - protein, 369 aa, Homo sapiens
MRPTLLWSLLLLLGVFAAAAAAPPDPLSQLPAPQHPKIRLYNAEQVLSWEPVALSNSTRPVVYQVQFKYTDSKWFTADIMSIGVNCTQITATECDFTAASPSAGFPMDFNVTLRLRAELGALHSAWVTMPWFQHYRNVETAFLHVGQTGLELLTSSDLPTSASQSAGITVTVGPPENIEVTPGEGSLIIRFSSPFDIADTSTAFFCYYVHYWEKGGIQQVKGPFRSNSISLDNLKPSRVYCLQVQAQLLWNKSNIFRVGHLSNISCYETMADASTELQQVILISVGTFSLLSVLAGACFFLVLKYRGLIKYWFHTPPSIPLQIEEYLKDPTQPILEALDKDSSPKDDVWDSVSIISFPEKEQEDVLQTL

SEQ ID NO: 859936 - protein, 320 aa, Homo sapiens
MRPTLLWSLLLLLGVFAAAAAAPPDPLSQLPAPQHPKIRLYNAEQVLSWEPVALSNSTRPVVYQVQFKYTDSKWFTADIMSIGVNCTQITATECDFTAASPSAGFPMDFNVTLRLRAELGALHSAWVTMPWFQHYRNVIIRFSSPFDIADTSTAFFCYYVHYWEKGGIQQVKGPFRSNSISLDNLKPSRVYCLQVQAQLLWNKSNIFRVGHLSNISCYETMADASTELQQVILISVGTFSLLSVLAGACFFLVLKYRGLIKYWFHTPPSIPLQIEEYLKDPTQPILEALDKDSSPKDDVWDSVSIISFPEKEQEDVLQTL

SEQ ID NO: 859937 - protein, 316 aa, Homo sapiens
MRPTLLWSLLLLLGVFAAAAAAPPDPLSQLPAPQHPKIRLYNAEQVLSWEPVALSNSTRPVVYQVQFKYTDSKWFTADIMSIGVNCTQITATECDFTAASPSAGFPMDFNVTLRLRAELGALHSAWVTMPWFQHYRNVTVGPPENIEVTPGEGSLIIRFSSPFDIADTSTAFFCYYVHYWEKGGIQQVKGPFRSNSISLDNLKPSRVYCLQVQAQLLWNKSNIFRVGHLSNISCYETMADASTELQQVILISVGTFSLLSVLAGACFFLVQRMTSGTLCPLSRFRKRSKKMFSKRFEPKHGPSPLAPWKRSSHRSC

SEQ ID NO: 859938 - protein, 337 aa, Homo sapiens; identical to SEQ ID NO: 859921

SEQ ID NO: 859939 - protein, 316 aa, Homo sapiens
MRPTLLWSLLLLLGVFAAAAAAPPDPLSQLPAPQHPKIRLYNAEQVLSWEPVALSNSTRPVVYQVQFKYTDSKWFTADIMSIGVNCTQITATECDFTAASPSAGFPMDFNVTLRLRAELGALHSAWVTMPWFQHYRNVTVGPPENIEVTPGEGSLIIRFSSPFDIADTSTAFFCYYVHYWEKGGIQQVKGPFRSNSISLDNLKPSRVYCLQVQAQLLWNKSNIFRVGHLSNISCYETMADASTELQQVILISVGTFSLLSVLAGACFFLVLKYRGLIKYWFHTPPSIPLQIEEYLKDPTQPILEALDKDSSPWSSS

SEQ ID NO: 859940 - protein, 155 aa, Homo sapiens
MRPTLLWSLLLLLGVFAAAAAAPPDPLSQLPAPQHPKIRLYNAEQVLSWEPVALSNSTRPVVYQVQFKYTDSKWFTADIMSIGVNCTQITATECDFTAASPSAGFPMDFNVTLRLRALVVVLTLANEPEPLGQVTQPVPARDTEWPFMYIHGVLA

SEQ ID NO: 859941 - protein, 191 aa, Homo sapiens
MELKNLEYRPVKVRGCFDHSKELYMMPRTMVDPVREAREGGLISSSTQSGAYVVTPFHCTDLGVTILVNRGFVPRKKVNPETRQKGQIEGEVDLIGMVRLTETRQPFVPENNPERNHWHYRDLEAMARITGAEPIFIDANFQSTVPGGPIGGQTRVTLRNEHLQYIVTWYGLSAATSYLWFKKFLRGTPGV

SEQ ID NO: 859942 - protein, 132 aa, Homo sapiens
RTLRASVWSRRLGCSRRNARTSPGNSLMADAPAEQPGGSRSQNLEPGAGLWAGLSGAPDADASCVPEAPAGPGAMAAVAALQLGLRAAGLGRAPASAAWRSVLRVSPRPGEGCRPGCDPGAWAEPPAVCPAL

SEQ ID NO: 859943 - protein, 283 aa, Homo sapiens
SVNGYGEHIYLQTLNSWGGVAWRPSRCGSSAAEASATKAEDDSFLQWVLLLIPVTAFGLGTWQVQRRKWKLNLIAELESRVLAEPVPLPADPMELKNLEYRPVKVRGCFDHSKELYMMPRTMVDPVREAREGGLISSSTQSGAYVVTPFHCTDLGVTILVNRGFVPRKKVNPETRQKGQIEGEVDLIGMVRLTETRQPFVPENNPERNHWHYRDLEAMARITGAEPIFIDANFQSTVPGGPIGGQTRVTLRNEHLQYIVTWYGLSAATSYLWFKKFLRGTPGV

SEQ ID NO: 859944 - protein, 374 aa, Homo sapiens
RTLRASVWSRRLGCSRRNARTSPGNSLMADAPAEQPGGSRSQNLEPGAGLWAGLSGAPDADASCVPEAPAGPGAMAAVAALQLGLRAAGLGRAPASAAWRSVLRVSPRPGVAWRPSRCGSSAAEASATKAEDDSFLQWVLLLIPVTAFGLGTWQVQRRKWKLNLIAELESRVLAEPVPLPADPMELKNLEYRPVKVRGCFDHSKELYMMPRTMVDPVREAREGGLISSSTQSGAYVVTPFHCTDLGVTILVNRGFVPRKKVNPETRQKGQIEGEVDLIGMVRLTETRQPFVPENNPERNHWHYRDLEAMARITGAEPIFIDANFQSTVPGGPIGGQTRVTLRNEHLQYIVTWYGLSAATSYLWFKKFLRGTPGV

SEQ ID NO: 859945 - protein, 374 aa, Homo sapiens; identical to SEQ ID NO: 859944

SEQ ID NO: 859946 - protein, 357 aa, Homo sapiens
ANLAGVRLEPQARVLPQKRPHVARQLAHGRRARGAARRKPLAEPGAGGGALGGTQRRPGCRCLLRPGSARGAGCDGGGGCVAAGAAGGGAGTGVAWRPSRCGSSAAEASATKAEDDSFLQWVLLLIPVTAFGLGTWQVQRRKWKLNLIAELESRVLAEPVPLPADPMELKNLEYRPVKVRGCFDHSKELYMMPRTMVDPVREAREGGLISSSTQSGAYVVTPFHCTDLGVTILVNRGFVPRKKVNPETRQKGQIEGEVDLIGMVRLTETRQPFVPENNPERNHWHYRDLEAMARITGAEPIFIDANFQSTVPGGPIGGQTRVTLRNEHLQYIVTWYGLSAATSYLWFKKFLRGTPGV

SEQ ID NO: 859947 - protein, 374 aa, Homo sapiens; identical to SEQ ID NO: 859944

SEQ ID NO: 859948 - protein, 480 aa, Homo sapiens
MSAEVIHQVEEALDTDEKEMLLFLCRDVAIDVVPPNVRDLLDILRERGKLSVGDLAELLYRVRRFDLLKRILKMDRKAVETHLLRNPHLVSDYRVLMAEIGEDLDKSDVSSLIFLMKDYMGRGKISKEKSFLDLVVELEKLNLVAPDQLDLLEKCLKNIHRIDLKTKIQKYKQSVQGAGTSYRNVLQAAIQKSLKDPSNNFRLHNGRSKEQRLKEQLGAQQEPVKKSIQESEAFLPQSIPEERYKMKSKPLGICLIIDCIGNETELLRDTFTSLGYEVQKFLHLSMHGISQILGQFACMPEHRDYDSFVCVLVSRGGSQSVYGVDQTHSGLPLHHIRRMFMGDSCPYLAGKPKMFFIQNYVVSEGQLEDSSLLEVDGPAMKNVEFKAQKRGLCTVHREADFFWSLCTADMSLLEQSHSSPSLYLQCLSQKLRQERKRPLLDLHIELNGYMYDWNSRVSAKEKYYVWLQHTLRKKLILSYT

SEQ ID NO: 859949 - protein, 107 aa, Homo sapiens
MVRNSGKINGPVPICIHLIDHILQLLLRIQHERKMEARRLHQSSLSMFCLLLFWQCWQLIRWCPPRLRMVCLSQSTDSNVKSPLAAPSQMYPGTLCILLFNQVDTQY

SEQ ID NO: 859950 - protein, 121 aa, Homo sapiens
MVSLSHPPEEPVKKSIQESEAFLPQSIPEERYKMKSKPLGICLIIDCIGNETGRCGSCRLTGAPRLRSWHRQAVFIGVISTNCRDKPVQESVLHPGCGGSCLEFQHFVRLRWEDHLSPVKN

SEQ ID NO: 859951 - protein, 480 aa, Homo sapiens; identical to SEQ ID NO: 859948

SEQ ID NO: 859952 - protein, 480 aa, Homo sapiens; identical to SEQ ID NO: 859948

SEQ ID NO: 859953 - protein, 480 aa, Homo sapiens; identical to SEQ ID NO: 859948

SEQ ID NO: 859954 - protein, 480 aa, Homo sapiens; identical to SEQ ID NO: 859948

SEQ ID NO: 859955 - protein, 445 aa, Homo sapiens
MSAEVIHQVEEALDTDEKEMLLFLCRDVAIDVVPPNVRDLLDILRERGKLSVGDLAELLYRVRRFDLLKRILKMDRKAVETHLLRNPHLVSDYRVLMAEIGEDLDKSDVSSLIFLMKDYMGRGKISKEKSFLDLVVELEKLNLVAPDQLDLLEKCLKNIHRIDLKTKIQKYKQSVQGAGTSYRNVLQAAIQKSLKDPSNNFRSIPEERYKMKSKPLGICLIIDCIGNETELLRDTFTSLGYEVQKFLHLSMHGISQILGQFACMPEHRDYDSFVCVLVSRGGSQSVYGVDQTHSGLPLHHIRRMFMGDSCPYLAGKPKMFFIQNYVVSEGQLEDSSLLEVDGPAMKNVEFKAQKRGLCTVHREADFFWSLCTADMSLLEQSHSSPSLYLQCLSQKLRQERKRPLLDLHIELNGYMYDWNSRVSAKEKYYVWLQHTLRKKLILSYT

SEQ ID NO: 859956 - protein, 205 aa, Homo sapiens
MSAEVIHQVEEALDTDEKEMLLFLCRDVAIDVVPPNVRDLLDILRERGKLSVGDLAELLYRVRRFDLLKRILKMDRKAVETHLLRNPHLVSDYRVLMAEIGEDLDKSDVSSLIFLMKDYMGRGKISKEKSFLDLVVELEKLNLVAPDQLDLLEKCLKNIHRIDLKTKIQKYKQSVQGAGTSYRNVLQAAIQKSLKDPSNNFRKNQ

SEQ ID NO: 859957 - protein, 590 aa, Homo sapiens
MSAEVIHQVEEALDTDEKEMLLFLCRDVAIDVVPPNVRDLLDILRERGKLSVGDLAELLYRVRRFDLLKRILKMDRKAVETHLLRNPHLVSDYRVLMAEIGEDLDKSDVSSLIFLMKDYMGRGKISKEKSFLDLVVELEKLNLVAPDQLDLLEKCLKNIHRIDLKTKIQKYKQSVQGAGTSYRNVLQAAIQKSLKDPSNNFRLHNGRSKEQRLKEQLGAQQEPVKKSIQESEAFLPQSIPEERYKMKSKPLGICLIIDCIGNETELLRDTFTSLGYEVQKFLHLSMHGISQILGQFACMPEHRDYDSFVCVLVSRGGSQSVYGVDQTHSGLPLHHIRRMFMGDSCPYLAGKPKMFFIQNYVVSEGQLEDSSLLEVDGPAMKNVEFKAQKRGLCTVHREADFFWSLCTADMSLLEQSHSSPSLYLQCLSQKLRQERKRPLLDLHIELNGYMYDWNSRVSAKEKYYVWLQHTLRKKLILSYTYVQRLTSDAELCGHEDAQNQGPDVQALGGGGIGLGPGHVANHLPVPRLHGVGECYEAQAAGVHEEGVEQGPDDMVGTEVSLRMWITVDVGGAGLWGAPSTATRAPPLSIT

SEQ ID NO: 859958 - protein, 300 aa, Homo sapiens
MSAEVIHQVEEALDTDEKEMLLFLCRDVAIDVVPPNVRDLLDILRERGKLSVGDLAELLYRVRRFDLLKRILKMDRKAVETHLLRNPHLVSDYRVLMAEIGEDLDKSDVSSLIFLMKDYMGRGKISKEKSFLDLVVELEKLNLVAPDQLDLLEKCLKNIHRIDLKTKIQKYKQSVQGAGTSYRNVLQAAIQKSLKDPSNNFRLHNGRSKEQRLKEQLGAQQEPVKKSIQESEAFLPQSIPEERYKMKSKPLGICLIIDCIGNETENAHSWIFTLNSMATCMIGTAEFLPRRNIMSGCSTL

SEQ ID NO: 859959 - protein, 213 aa, Homo sapiens [sequence omitted]

SEQ ID NO: 859960 - protein, 221 aa, Homo sapiens
MSAEVIHQVEEALDTDEKEMLLFLCRDVAIDVVPPNVRDLLDILRERGKLSVGDLAELLYRVRRFDLLKRILKMDRKAVETHLLRNPHLVSDYRVLMAEIGEDLDKSDVSSLIFLMKDYMGRGKISKEKSFLDLVVELEKLNLVAPDQLDLLEKCLKNIHRIDLKTKIQKYKQSVQGAGTSYRNVLQAAIQKSLKDPSNNFRMITPYAHCPDLKILGNCSM

SEQ ID NO: 859961 - protein, 187 aa, Homo sapiens
MSAEVIHQVEEALDTDEKEMLLFLCRDVAIDVVPPNVRDLLDILRERGKLSVGDLAELLYRVRRFDLLKRILKMDRVLMAEIGEDLDKSDVSSLIFLMKDYMGRGKISKEKSFLDLVVELEKLNLVAPDQLDLLEKCLKNIHRIDLKTKIQKYKQSVQGAGTSYRNVLQAAIQKSLKDPSNNFRKNQ

SEQ ID NO: 859962 - protein, 250 aa, Homo sapiens
MSAEVIHQVEEALDTDEKEMLLFLCRDVAIDVVPPNVRDLLDILRERGKLSVGDLAELLYRVRRFDLLKRILKMDRKAVETHLLRNPHLVSDYRVLMAEIGEDLDKSDVSSLIFLMKDYMGRGKISKEKSFLDLVVELEKLNLVAPDQLDLLEKCLKNIHRIDLKTKIQKYKQSGGWNGTWMTKASFSLWLEIASLYILHIPDLPTPLPCIFMISAKCCQAVLNISVFKKESGICTGWQSYGHSGVLHVC

SEQ ID NO: 859963 - protein, 235 aa, Homo sapiens
MKSKPLGICLIIDCIGNETELLRDTFTSLGYEVQKFLHLSMHGISQILGQFACMPEHRDYDSFVCVLVSRGGSQSVYGVDQTHSGLPLHHIRRMFMGDSCPYLAGKPKMFFIQNYVVSEGQLEDSSLLEVDGPAMKNVEFKAQKRGLCTVHREADFFWSLCTADMSLLEQSHSSPSLYLQCLSQKLRQERKRPLLDLHIELNGYMYDWNSRVSAKEKYYVWLQHTLRKKLILSYT

SEQ ID NO: 859964 - protein, 384 aa, Homo sapiens
MAEIGEDLDKSDVSSLIFLMKDYMGRGKISKEKSFLDLVVELEKLNLVAPDQLDLLEKCLKNIHRIDLKTKIQKYKQSVQGAGTSYRNVLQAAIQKSLKDPSNNFRLHNGRSKEQRLKEQLGAQQEPVKKSIQESEAFLPQSIPEERYKMKSKPLGICLIIDCIGNETELLRDTFTSLGYEVQKFLHLSMHGISQILGQFACMPEHRDYDSFVCVLVSRGGSQSVYGVDQTHSGLPLHHIRRMFMGDSCPYLAGKPKMFFIQNYVVSEGQLEDSSLLEVDGPAMKNVEFKAQKRGLCTVHREADFFWSLCTADMSLLEQSHSSPSLYLQCLSQKLRQERKRPLLDLHIELNGYMYDWNSRVSAKEKYYVWLQHTLRKKLILSYT

SEQ ID NO: 859965 - protein, 217 aa, Homo sapiens
MKSKPLGICLIIDCIGNETELLRDTFTSLGYEVQKFLHLSMHGISQILGQFACMPEHRDYDSFVCVLVSRGGSQSVYGVDQTHSGLPLHHIRRMFMGDSCPYLAGKPKMFFIQNYVVSEGQLEDSSLLEVDGPAMKNVEFKAQKRGLCTVHREADFFWSLCTADMSLLEQSHSSPSLYLQCLSQKLRQERGTIPGSGITESKDMHFSSLGCILLDVL

SEQ ID NO: 859966 - protein, 433 aa, Homo sapiens
DDAHQLAAHGTRLSDGDAREAMTHLGLQHITHSVQGAQHHGVCDKARFKLLDLLHLTGLELWGAVVVNETSTSHQSHHDGQVGLCHSVHGGGDQRRLQSDHWVRAEVRSTSSAMKSMNPGRIKKSVVVQGAGTSYRNVLQAAIQKSLKDPSNNFRLHNGRSKEQRLKEQLGAQQEPVKKSIQESEAFLPQSIPEERYKMKSKPLGICLIIDCIGNETELLRDTFTSLGYEVQKFLHLSMHGISQILGQFACMPEHRDYDSFVCVLVSRGGSQSVYGVDQTHSGLPLHHIRRMFMGDSCPYLAGKPKMFFIQNYVVSEGQLEDSSLLEVDGPAMKNVEFKAQKRGLCTVHREADFFWSLCTADMSLLEQSHSSPSLYLQCLSQKLRQERKRPLLDLHIELNGYMYDWNSRVSAKEKYYVWLQHTLRKKLILSYT

SEQ ID NO: 859967 - protein, 317 aa, Homo sapiens
MQYLYQKYKQSVQGAGTSYRNVLQAAIQKSLKDPSNNFRLHNGRSKEQRLKEQLGAQQEPVKKSIQESEAFLPQSIPEERYKMKSKPLGICLIIDCIGNETELLRDTFTSLGYEVQKFLHLSMHGISQILGQFACMPEHRDYDSFVCVLVSRGGSQSVYGVDQTHSGLPLHHIRRMFMGDSCPYLAGKPKMFFIQNYVVSEGQLEDSSLLEVDGPAMKNVEFKAQKRGLCTVHREADFFWSLCTADMSLLEQSHSSPSLYLQCLSQKLRQERKRPLLDLHIELNGYMYDWNSRVSAKEKYYVWLQHTLRKKLILSYT

SEQ ID NO: 859968 - protein, 235 aa, Homo sapiens; identical to SEQ ID NO: 859963

SEQ ID NO: 859969 - protein, 221 aa, Homo sapiens; identical to SEQ ID NO: 859960

SEQ ID NO: 859970 - protein, 250 aa, Homo sapiens; identical to SEQ ID NO: 859962

SEQ ID NO: 859971 - protein, 480 aa, Homo sapiens; identical to SEQ ID NO: 859948

SEQ ID NO: 859972 - protein, 221 aa, Homo sapiens; identical to SEQ ID NO: 859960

SEQ ID NO: 859973 - protein, 126 aa, Homo sapiens
DDAHQLAAHGTRLSDGDAREAMTHLGLQHITHSVQGAQHHGVCDKARFKLLDLLHLTGLELWGAVVVNETSTSHQSHHDGQVGLCHSVHGGGDQRRLQSDHWVRAEVRSTSSAMKSMNPGRIKKSL

SEQ ID NO: 859974 - protein, 480 aa, Homo sapiens; identical to SEQ ID NO: 859948

SEQ ID NO: 859975 - protein, 480 aa, Homo sapiens; identical to SEQ ID NO: 859948

SEQ ID NO: 859976 - protein, 480 aa, Homo sapiens; identical to SEQ ID NO: 859948

SEQ ID NO: 859977 - protein, 480 aa, Homo sapiens; identical to SEQ ID NO: 859948

SEQ ID NO: 859978 - protein, 480 aa, Homo sapiens; identical to SEQ ID NO: 859948

SEQ ID NO: 859979 - protein, 480 aa, Homo sapiens; identical to SEQ ID NO: 859948

SEQ ID NO: 859980 - protein, 480 aa, Homo sapiens; identical to SEQ ID NO: 859948

SEQ ID NO: 859981 - protein, 480 aa, Homo sapiens; identical to SEQ ID NO: 859948

SEQ ID NO: 859982 - protein, 480 aa, Homo sapiens; identical to SEQ ID NO: 859948

SEQ ID NO: 859983 - protein, 462 aa, Homo sapiens
MSAEVIHQVEEALDTDEKEMLLFLCRDVAIDVVPPNVRDLLDILRERGKLSVGDLAELLYRVRRFDLLKRILKMDRKAVETHLLRNPHLVSDYRVLMAEIGEDLDKSDVSSLIFLMKDYMGRGKISKEKSFLDLVVELEKLNLVAPDQLDLLEKCLKNIHRIDLKTKIQKYKQSVQGAGTSYRNVLQAAIQKSLKDPSNNFRLHNGRSKEQRLKEQLGAQQEPVKKSIQESEAFLPQSIPEERYKMKSKPLGICLIIDCIGNETELLRDTFTSLGYEVQKFLHLSMHGISQILGQFACMPEHRDYDSFVCVLVSRGGSQSVYGVDQTHSGLPLHHIRRMFMGDSCPYLAGKPKMFFIQNYVVSEGQLEDSSLLEVDGPAMKNVEFKAQKRGLCTVHREADFFWSLCTADMSLLEQSHSSPSLYLQCLSQKLRQERGTIPGSGITESKDMHFSSLGCILLDVL

SEQ ID NO: 859984 - protein, 270 aa, Homo sapiens
MSAEVIHQVEEALDTDEKEMLLFLCRDVAIDVVPPNVRDLLDILRERGKLSVGDLAELLYRVRRFDLLKRILKMDRKAVETHLLRNPHLVSDYRVLMAEIGEDLDKSDVSSLIFLMKDYMGRGKISKEKSFLDLVVELEKLNLVAPDQLDLLEKCLKNIHRIDLKTKIQKYKQSVQGAGTSYRNVLQAAIQKSLKDPSNNFRSIPEERYKMKSKPLGICLIIDCIGNETELCGVRGPAGGQQPLGGGWASDEECGIQGSEARAVHSSPRS

SEQ ID NO: 859985 - protein, 292 aa, Homo sapiens
MSAEVIHQVEEALDTDEKEMLLFLCRDVAIDVVPPNVRDLLDILRERGKLSVGDLAELLYRVRRFDLLKRILKMDRKAVETHLLRNPHLVSDYRVLMAEIGEDLDKSDVSSLIFLMKDYMGRGKISKEKSFLDLVVELEKLNLVAPDQLDLLEKCLKNIHRIDLKTKIQKYKQSVQGAGTSYRNVLQAAIQKSLKDPSNNFRLHNGRSKEQRLKEQLGAQQEPVKKSIQESEAFLPQSIPEERYKMKSKPLGICLIIDCIGNETGWSAMAQSQLTAISTSQVQAILLPQPPE

SEQ ID NO: 859986 - protein, 451 aa, Homo sapiens
MSAEVIHQVEEALDTDEKEMLLFLCRDVAIDVVPPNVRDLLDILRERGKLSVGDLAELLYRVRRFDLLKRILKMDRKAVETHLLRNPHLVSDYRVLMAEIGEDLDKSDVSSLIFLMKDYMGRGKISKEKSFLDLVVELEKLNLVAPDQLDLLEKCLKNIHRIDLKTKIQKYKQSVQGAGTSYRNVLQAAIQKSLKDPSNNFRLHNGRSKEQRLKEQLGAQQEPVKKSIQESEAFLPQSIPEERYKMKSKPLGICLIIDCIGNETELLRDTFTSLGYEVQKFLHLSMHGISQILGQFACMPEHRDYDSFVCVLVSRGGSQSVYGVDQTHSGLPLHHIRRMFMGDSCPYLAGKPKMFFIQNYVVSEGQLEDSSLLEVDGPAMKNVEFKAQKRGLCTVHREADFFWSLCTADMSLLEQSHSSPSLYLQCLSQKLRQERKRPLLDLHIVQRLTVP

SEQ ID NO: 859987 - protein, 462 aa, Homo sapiens
MSAEVIHQVEEALDTDEKEMLLFLCRDVAIDVVPPNVRDLLDILRERGKLSVGDLAELLYRVRRFDLLKRILKMDRVLMAEIGEDLDKSDVSSLIFLMKDYMGRGKISKEKSFLDLVVELEKLNLVAPDQLDLLEKCLKNIHRIDLKTKIQKYKQSVQGAGTSYRNVLQAAIQKSLKDPSNNFRLHNGRSKEQRLKEQLGAQQEPVKKSIQESEAFLPQSIPEERYKMKSKPLGICLIIDCIGNETELLRDTFTSLGYEVQKFLHLSMHGISQILGQFACMPEHRDYDSFVCVLVSRGGSQSVYGVDQTHSGLPLHHIRRMFMGDSCPYLAGKPKMFFIQNYVVSEGQLEDSSLLEVDGPAMKNVEFKAQKRGLCTVHREADFFWSLCTADMSLLEQSHSSPSLYLQCLSQKLRQERKRPLLDLHIELNGYMYDWNSRVSAKEKYYVWLQHTLRKKLILSYT

SEQ ID NO: 859988 - protein, 183 aa, Homo sapiens [sequence omitted]

SEQ ID NO: 859989 - protein, 217 aa, Homo sapiens; identical to SEQ ID NO: 859965

SEQ ID NO: 859990 - protein, 217 aa, Homo sapiens; identical to SEQ ID NO: 859965

SEQ ID NO: 859991 - protein, 370 aa, Homo sapiens
EESRKCTVLHGPREISKEKSFLDLVVELEKLNLVAPDQLDLLEKCLKNIHRIDLKTKIQKYKQSVQGAGTSYRNVLQAAIQKSLKDPSNNFRLHNGRSKEQRLKEQLGAQQEPVKKSIQESEAFLPQSIPEERYKMKSKPLGICLIIDCIGNETELLRDTFTSLGYEVQKFLHLSMHGISQILGQFACMPEHRDYDSFVCVLVSRGGSQSVYGVDQTHSGLPLHHIRRMFMGDSCPYLAGKPKMFFIQNYVVSEGQLEDSSLLEVDGPAMKNVEFKAQKRGLCTVHREADFFWSLCTADMSLLEQSHSSPSLYLQCLSQKLRQERKRPLLDLHIELNGYMYDWNSRVSAKEKYYVWLQHTLRKKLILSYT

SEQ ID NO: 859992 - protein, 235 aa, Homo sapiens; identical to SEQ ID NO: 859963

SEQ ID NO: 859993 - protein, 133 aa, Homo sapiens
MSAEVIHQVEEALDTDEKEMLLFLCRDVAIDVVPPNVRDLLDILRERGKLSVGDLAELLYRVRRFDLLKRILKMDRKAVETHLLRNPHLVSDYRVLMAEIGEDLDNTFREISTVTQEVEKKESEEAGYGGSRL

SEQ ID NO: 859994 - protein, 70 aa, Homo sapiens
QLEDSSLLEVDGPAMKNVEFKAQKRGLCTVHREADFFWSLCTADMSLLEQSHSSPSLYLQCLSQKLRQER

SEQ ID NO: 859995 - protein, 939 aa, Homo sapiens
RERGRGGARRPGRAEAARAPRPLRPLAAGWTHFAARPRESRDFGKSRGNPRAYNPHTTETGQSRLRSLQSSWRAKRAWSPRGRSGESGRQERSHPQPTLPASEPDPRRPWSVASARSLPRPPPAARSCLDQDLGLCERIAGPGEVLESTMAEQVLPQALYLSNMRKAVKIRERTPEDIFKPTNGIIHHFKTMHRYTLEMFRTCQFCPQFREIIHKALIDRNIQATLESQKKLNWCREVRKLVALKTNGDGNCLMHATSQYMWGVQDTDLVLRKALFSTLKETDTRNFKFRWQLESLKSQEFVETGLCYDTRNWNDEWDNLIKMASTDTPMARSGLQYNSLEEIHIFVLCNILRRPIIVISDKMLRSLESGSNFAPLKVGGIYLPLHWPAQECYRYPIVLGYDSHHFVPLVTLKDSGPEIRAVPLVNRDRGRFEDLKVHFLTDPENEMKEKLLKEYLMVIEIPVQGWDHGTTHLINAAKLDEANLPKEINLVDDYFELVQHEYKKWQENSEQGRREGHAQNPMEPSVPQLSLMDVKCETPNCPFFMSVNTQPLCHECSERRQKNQNKLPKLNSKPGPEGLPGMALGASRGEAYEPLAWNPEESTGGPHSAPPTAPSPFLFSETTAMKCRSPGCPFTLNVQHNGFCERCHNARQLHASHAPDHTRHLDPGKCQACLQDVTRTFNGICSTCFKRTTAEASSSLSTSLPPSCHQRSKSDPSRLVRSPSPHSCHRAGNDAPAGCLSQAARTPGDRTGTSKCRKAGCVYFGTPENKGFCTLCFIEYRENKHFAAASGKVSPTASRFQNTIPCLGRECGTLGSTMFEGYCQKCFIEAQNQRFHEAKRTEEQLRSSQRRDVPRTTQSTSRPKCARASCKNILACRSEELCMECQHPNQRMGPGAHRGEPAPEDPPKQRCRAPACDHFGNAKCNGYCNECFQFKQMYG

SEQ ID NO: 859996 - protein, 267 aa, Homo sapiens
RERGRGGARRPGRAEAARAPRPLRPLAAGWTHFAARPRESRDFGKSRGNPRAYNPHTTETGQSRLRSLQSSWRAKRAWSPRGRSGESGRQERSHPQPTLPASEPDPRRPWSVASARSLPRPPPAARSCLDQDLGLCERIAGPGEVTAAPPGEVLESTMAEQVLPQALYLSNMRKAVKIRERTPEDIFKPTNGIIHHFKTMHRYTLEMFRTCQFCPQFREIIHKALIDRNIQATLESQKKLNWCREVRKLVALKTNGKTCSVVFLLPG

SEQ ID NO: 859997 - protein, 1020 aa, Homo sapiens
RERGRGGARRPGRAEAARAPRPLRPLAAGWTHFAARPRESRDFGKSRGNPRAYNPHTTETGQSRLRSLQSSWRAKRAWSPRGRSGESGRQERSHPQPTLPASEPDPRRPWSVASARSLPRPPPAARSCLDQDLGLCERIAGPGEVTAAPPGEVTAAPPGEVTAAPPRAVCLGLHRSQGLRVHVGQRPPGWHRLPGVGFAALLDWEFVGRFCLGFEVLGVEVTAAEVLESTMAEQVLPQALYLSNMRKAVKIRERTPEDIFKPTNGIIHHFKTMHRYTLEMFRTCQFCPQFREIIHKALIDRNIQATLESQKKLNWCREVRKLVALKTNGDGNCLMHATSQYMWGVQDTDLVLRKALFSTLKETDTRNFKFRWQLESLKSQEFVETGLCYDTRNWNDEWDNLIKMASTDTPMARSGLQYNSLEEIHIFVLCNILRRPIIVISDKMLRSLESGSNFAPLKVGGIYLPLHWPAQECYRYPIVLGYDSHHFVPLVTLKDSGPEIRAVPLVNRDRGRFEDLKVHFLTDPENEMKEKLLKEYLMVIEIPVQGWDHGTTHLINAAKLDEANLPKEINLVDDYFELVQHEYKKWQENSEQGRREGHAQNPMEPSVPQLSLMDVKCETPNCPFFMSVNTQPLCHECSERRQKNQNKLPKLNSKPGPEGLPGMALGASRGEAYEPLAWNPEESTGGPHSAPPTAPSPFLFSETTAMKCRSPGCPFTLNVQHNGFCERCHNARQLHASHAPDHTRHLDPGKCQACLQDVTRTFNGICSTCFKRTTAEASSSLSTSLPPSCHQRSKSDPSRLVRSPSPHSCHRAGNDAPAGCLSQAARTPGDRTGTSKCRKAGCVYFGTPENKGFCTLCFIEYRENKHFAAASGKVSPTASRFQNTIPCLGRECGTLGSTMFEGYCQKCFIEAQNQRFHEAKRTEEQLRSSQRRDVPRTTQSTSRPKCARASCKNILACRSEELCMECQHPNQRMGPGAHRGEPAPEDPPKQRCRAPACDHFGNAKCNGYCNECFQFKQMYG

SEQ ID NO: 859998 - protein, 1073 aa, Homo sapiens
RERGRGGARRPGRAEAARAPRPLRPLAAGWTHFAARPRESRDFGKSRGNPRAYNPHTTETGQSRLRSLQSSWRAKRAWSPRGRSGESGRQERSHPQPTLPASEPDPRRPWSVASARSLPRPPPAARSCLDQDLGLCERIAGPGEVTAAPPGEVTAAPPGEVTAAPPRAVCLGLHRSQGLRVHVGQRPPGWHRLPGVGFAALLDWEFVGRFCLGFEVLGVEVTAAEVLESTMAEQVLPQALYLSNMRKAVKIRERTPEDIFKPTNGIIHHFKTMHRYTLEMFRTCQFCPQFREIIHKALIDRNIQATLESQKKLNWCREVRKLVALKTNGDGNCLMHATSQYMWGVQDTDLVLRKALFSTLKETDTRNFKFRWQLESLKSQEFVETGLCYDTRNWNDEWDNLIKMASTDTPMARSGLQYNSLEEIHIFVLCNILRRPIIVISGEMPADHGSVLKCFQPYALAPGENHTAKVQVTEFKEFDESHLRASFSFLFLCTDKMLRSLESGSNFAPLKVGGIYLPLHWPAQECYRYPIVLGYDSHHFVPLVTLKDSGPEIRAVPLVNRDRGRFEDLKVHFLTDPENEMKEKLLKEYLMVIEIPVQGWDHGTTHLINAAKLDEANLPKEINLVDDYFELVQHEYKKWQENSEQGRREGHAQNPMEPSVPQLSLMDVKCETPNCPFFMSVNTQPLCHECSERRQKNQNKLPKLNSKPGPEGLPGMALGASRGEAYEPLAWNPEESTGGPHSAPPTAPSPFLFSETTAMKCRSPGCPFTLNVQHNGFCERCHNARQLHASHAPDHTRHLDPGKCQACLQDVTRTFNGICSTCFKRTTAEASSSLSTSLPPSCHQRSKSDPSRLVRSPSPHSCHRAGNDAPAGCLSQAARTPGDRTGTSKCRKAGCVYFGTPENKGFCTLCFIEYRENKHFAAASGKVSPTASRFQNTIPCLGRECGTLGSTMFEGYCQKCFIEAQNQRFHEAKRTEEQLRSSQRRDVPRTTQSTSRPKCARASCKNILACRSEELCMECQHPNQRMGPGAHRGEPAPEDPPKQRCRAPACDHFGNAKCNGYCNECFQFKQMYG

SEQ ID NO: 859999 - protein, 1020 aa, Homo sapiens; identical to SEQ ID NO: 859997

SEQ ID NO: 860000 - protein, 227 aa, Homo sapiens
RERGRGGARRPGRAEAARAPRPLRPLAAGWTHFAARPRESRDFGKSRGNPRAYNPHTTETGQSRLRSLQSSWRAKRAWSPRGRSGESGRQERSHPQPTLPASEPDPRRPWSVASARSLPRPPPAARSCLDQDLGLCERIAGPGEVTAAPPGEVTAAPPGEVTAAPPRAVCLGLTAVKGCGCMLGSDPRAGTVYLALVLQRSWTGSLLDVSVWVLKCWELRSLLQRLE

SEQ ID NO: 860001 - protein, 1020 aa, Homo sapiens; identical to SEQ ID NO: 859997

SEQ ID NO: 860002 - protein, 1020 aa, Homo sapiens; identical to SEQ ID NO: 859997

SEQ ID NO: 860003 - protein, 1020 aa, Homo sapiens; identical to SEQ ID NO: 859997

SEQ ID NO: 860004 - protein, 102 aa, Homo sapiens [sequence omitted]

SEQ ID NO: 860005 - protein, 1522 aa, Homo sapiens
MMMARKQDVRIPTYNISVVGLSGTEKEKGQCGIGKSCLCNRFVRPSADEFHLDHTSVLSTSDFGGRVVNNDHFLYWGEVSRSLEDCVECKMHIVEQTEFIDDQTFQPHRSTALQPYIKRAAATKLASAEKLMYFCTDQLGLEQDFEQKQMPDGKLLVDGFLLGIDVSRGMNRNFDDQLKFVSNLYNQLAKTKKPIVVVLTKCDEGVERYIRDAHTFALSKKNLQVVETSARSNVNVDLAFSTLVQLIDKSRGKTKIIPYFEALKQQSQQIATAKDKYEWLVSRIVKNHNENWLSVSRKMQASPEYQDYVYLEGTQKAKKLFLQHIHRLKHEHIERRRKLYLAALPLAFEALIPNLDEIDHLSCIKAKKLLETKPEFLKWFVVLEETPWDATSHIDNMENERIPFDLMDTVPAEQLYEAHLEKLRNERKRVEMRRAFKENLETSPFITPGKPWEEARSFIMNEDFYQWLEESVYMDIYGKHQKQIIDKAKEEFQELLLEYSELFYELELDAKPSKEKMGVIQDVLGEEQRFKAIYKSSKQSVDALILKHIHFVYHPTKETCPSCPACVDAKIEHLISSRFIRPSDRNQKNSLSDPNIDRINLVILGKDALPESWPMEIRALCTNDDKYVIDGKMYELSLRPIEGNVRLPVNSFQTPTFQPHGCLCLYNSKESLSYVVESIEKSRESTLGRRDNHLVHLPLTLILVNKRGDTSGETLHSLIQQGQQIASKLQCVFLDPASAGIGYGRNINEKQISQVLKGLLDSKRNLNLVSSTASIKDLADVDLRIVMCLMCGDPFSADDILFPVLQSQTCKSSHCGSNNSVLLELPIGLHKKRIELSVLSYHSSFSIRKSRLVHGYIVFYSAKRKASLAMLRAFLCEVQDIIPIQLVALTDGAVDVLDNDLSREQLTEGEEIAQEIDGRFTSIPCSQPQHKLEIFHPFFKDVVEKKNIIEATHMYDNAAEACSTTEEVFNSPRAGSPLCNSNLQDSEEDIEPSYSLFREDTSLPSLSKDHSKLSMELEGNDGLSFIMSNFESKLNNKVPPPVKPKPPVHFEITKGDLSYLDQGHRDGQRKSVSSSPWLPQDGFDPSDYAEPMDAVVKPRNEEENIYSVPHDSTQGKIITIRNINKAQSNGSGNGSDSEMDTSSLERGRKVSIVSKPVLYRTRCTRLGRFASYRTSFSVGSDDELGPIRKKEEDQASQGYKGDNAVIPYETDEDPRRRNILRSLRRNTKKPKPKPRPSITKATWESNYFGVPLTTVVTPEKPIPIFIERCIEYIEATGLSTEGIYRVSGNKSEMESLQRQFDQDHNLDLAEKDFTVNTVAGAMKSFFSELPDPLVPYNMQIDLVEAHKINDREQKLHALKEVLKKFPKENHEVFKYVISHLNKVSHNNKVNLMTSENLSICFWPTLMRPDFSTMDALTATRTYQTIIELFIQQCPFFFYNRPITEPPGARPSSPSAVASTVPFLTSTPVTSQPSPPQSPPPTPQSPMQPLLPASSPPSHSTAFPKHSLANKGTLGEKMEKPFQ

SEQ ID NO: 860006 - protein, 1522 aa, Homo sapiens; identical to SEQ ID NO: 860005

SEQ ID NO: 860007 - protein, 1500 aa, Homo sapiens
MMMARKQDVRIPTYNISVVGLSGTEKEKGQCGIGKSCLCNRFVRPSADEFHLDHTSVLSTSDFGGRVVNNDHFLYWGEVSRSLEDCVECKMHIVEQTEFIDDQTFQPHRSTALQPYIKRAAATKLASAEKLMYFCTDQLGLEQDFEQKQMPDGKLLVDGFLLGIDVSRGMNRNFDDQLKFVSNLYNQLAKTKKPIVVVLTKCDEGVERYIRDAHTFALSKKNLQVVETSARSNVNVDLAFSTLVQLIDKSRGKTKIIPYFEALKQQSQQIATAKDKYEWLVSRIVKNHNENWLSVSRKMQASPEYQDYVYLEGTQKAKKLFLQHIHRLKHEHIERRRKLYLAALPLAFEALIPNLDEIDHLSCIKAKKLLETKPEFLKWFVVLEETPWDATSHIDNMENERIPFDLMDTVPAEQLYEAHLEKLRNERKRVEMRRAFKENLETSPFITPGKPWEEARSFIMNEDFYQWLEESVYMDIYGKHQKQIIDKAKEEFQELLLEYSELFYELELDAKPSKEKMGVIQDVLGEEQRFKAIYKSSKQSVDALILKHIHFVYHPTKETCPSCPACVDAKIEHLISSRFIRPSDRNQKNSLSDPNIDRINLVILGKDALPESWPMEIRALCTNDDKYVIDGKMYELSLRPIEGNVRLPVNSFQTPTFQPHGCLCLYNSKESLSYVVESIEKSRESTLGRRDNHLVHLPLTLILVNKRGDTSGETLHSLIQQGQQIASKLQCVFLDPASAGIGYGRNINEKQISQVLKGLLDSKRNLNLVSSTASIKDLADVDLRIVMCLMCGDPFSADDILFPVLQSQTCKSSHCGSNNSVLLELPIGLHKKRIELSVLSYHSSFSIRKSRLVHGYIVFYSAKRKASLAMLRAFLCEVQDIIPIQLVALTDGAVDVLDNDLSREQLTEGEEIAQEIDGRFTSIPCSQPQHKLEIFHPFFKDVVEKKNIIEATHMYDNAAEACSTTEEVFNSPRAGSPLCNSNLQDSEEDIEPSYSLFREDTSLPSLSKDHSKLSMELEGNDGLSFIMSNFESKLNNKVPPPVKPKPPVHFEITKGDLSYLDQGHRDGQRKSVSSSPWLPQDGFDPSDYAEPMDAVVKPRNEEENIYSVPHDSTQGKIITIRNINKAQSNGSGNGSDSEMDTSSLERGRKVSIVSKPVLYRTRCTRLGRFASYRTSFSVGSDDELGPIRKKEEDQASQGYKGDNAVIPYETDEDPRRRNILRSLRRNTKKPKPKPRPSITKATWESNYFGVPLTTVVTPEKPIPIFIERCIEYIEATGLSTEGIYRVSGNKSEMESLQRQFDQDHNLDLAEKDFTVNTVAGAMKSFFSELPDPLVPYNMQIDLVEAHKINDREQKLHALKEVLKKFPKENHEVFKYVISHLNKVSHNNKVNLMTSENLSICFWPTLMRPDFSTMDALTATRTYQTIIELFIQQCPFFFYNRPITEPPGARPSSPSAVASTVPFLTSTPVTSQPSPPQSPPPTPQSPMQPLLPSQLQAEHTL

SEQ ID NO: 860008 - protein, 1500 aa, Homo sapiens; identical to SEQ ID NO: 860007

SEQ ID NO: 860009 - protein, 1516 aa, Homo sapiens
MMMARKQDVRIPTYNISVVGLSGTEKEKGQCGIGKSCLCNRFVRPSADEFHLDHTSVLSTSDFGGRVVNNDHFLYWGEVSRSLEDCVECKMHIVEQTEFIDDQTFQPHRSTALQPYIKRAAATKLASAEKLMYFCTDQLGLEQDFEQKQMPDGKLLVDGFLLGIDVSRGMNRNFDDQLKFVSNLYNQLAKTKKPIVVVLTKCDEGVERYIRDAHTFALSKKNLQVVETSARSNVNVDLAFSTLVQLIDKSRGKTKIIPYFEALKQQSQQIATAKDKYEWLVSRIVKNHNENWLSVSRKMQASPEYQDYVYLEGTQKAKKLFLQHIHRLKHEHIERRRKLYLAALPLAFEALIPNLDEIDHLSCIKAKKLLETKPEFLKWFVVLEETPWDATSHIDNMENERIPFDLMDTVPAEQLYEAHLEKLRNERKRVEMRRAFKENLETSPFITPGKPWEEARSFIMNEDFYQWLEESVYMDIYGKHQKQIIDKAKEEFQELLLEYSELFYELELDAKPSKEKMGVIQDVLGEEQRFKAIYKSSKQSVDALILKHIHFVYHPTKETCPSCPACVDAKIEHLISSRFIRPSDRNQKNSLSDPNIDRINLVILGKDALPESWPMEIRALCTNDDKYVIDGKMYELSLRPIEGNVRLPVNSFQTPTFQPHGCLCLYNSKESLSYVVESIEKSRESTLGRRDNHLVHLPLTLILVNKRGDTSGETLHSLIQQGQQIASKLQCVFLDPASAGIGYGRNINEKQISQVLKGLLDSKRNLNLVSSTASIKDLADVDLRIVMCLMCGDPFSADDILFPVLQSQTCKSSHCGSNNSVLLELPIGLHKKRIELSVLSYHSSFSIRKSRLVHGYIVFYSAKRKASLAMLRAFLCEVQDIIPIQLVALTDGAVDVLDNDLSREQLTEGEEIAQEIDGRFTSIPCSQPQHKLEIFHPFFKDVVEKKNIIEATHMYDNAAEACSTTEEVFNSPRAGSPLCNSNLQDSEEDIEPSYSLFREDTSLPSLSKDHSKLSMELEGNDGLSFIMSNFESKLNNKVPPPVKPKPPVHFEITKGDLSYLDQGHRDGQRKSVSSSPWLPQDGFDPSDYAEPMDAVVKPRNEEENIYSVPHDSTQGKIITIRNINKAQSNGSGNGSDSEMDTSSLERGRKVSIVSKPVLYRTRCTRLGRFASYRTSFSVGSDDELGPIRKKEEDQASQGYKGDNAVIPYETDEDPRRRNILRSLRRNTKKPKPKPRPSITKATWESNYFGVPLTTVVTPEKPIPIFIERCIEYIEATGLSTEGIYRVSGNKSEMESLQRQFDQDHNLDLAEKDFTVNTVAGAMKSFFSELPDPLVPYNMQIDLVEAHKINDREQKLHALKEVLKKFPKENHEVFKYVISHLNKVSHNNKVNLMTSENLSICFWPTLMRPDFSTMDALTATRTYQTIIELFIQQCPFFFYNRPITEPPGARPSSPSAVASTVPFLTSTPVTSQPSPPQSPPPTPQSPMQPLPADLGWPPPALPWRSRQRCYRPKLLFA

SEQ ID NO: 860010 - protein, 240 aa, Homo sapiens
AVGARKPQAHSAALQRGPGTQRWARPLGQCHCQVCQPWAQALGERVGLVSSKSPGLSSEKAHHRARPGVATSLGHERQGFGFLSPPEINDREQKLHALKEVLKKFPKENHEVFKYVISHLNKVSHNNKVNLMTSENLSICFWPTLMRPDFSTMDALTATRTYQTIIELFIQQCPFFFYNRPITEPPGARPSSPSAVASTVPFLTSTPVTSQPSPPQSPPPTPQSPMQPLLPSQLQAEHTL

SEQ ID NO: 860011 - protein, 175 aa, Homo sapiens
RWGPGSPRHTVPPFSGGLGHREINDREQKLHALKEVLKKFPKENHEVFKYVISHLNKVSHNNKVNLMTSENLSICFWPTLMRPDFSTMDALTATRTYQTIIELFIQQCPFFFYNRPITEPPGARPSSPSAVASTVPFLTSTPVTSQPSPPQSPPPTPQSPMQPLLPSQLQAEHTL

SEQ ID NO: 860012 - protein, 1374 aa, Homo sapiens
MMMARKQDVRIPTYNISVVGLSGTEKEKGQCGIGKSCLCNRFVRPSADEFHLDHTSVLSTSDFGGRVVNNDHFLYWGEVSRSLEDCVECKMHIVEQTEFIDDQTFQPHRSTALQPYIKRAAATKLASAEKLMYFCTDQLGLEQDFEQKQMPDGKLLVDGFLLGIDVSRGMNRNFDDQLKFVSNLYNQLAKTKKPIVVVLTKCDEGVERYIRDAHTFALSKKNLQVVETSARSNVNVDLAFSTLVQLIDKSRGKTKIIPYFEALKQQSQQIATAKDKYEWLVSRIVKNHNENWLSVSRKMQASPEYQDYVYLEGTQKAKKLFLQHIHRLKHEHIERRRKLYLAALPLAFEALIPNLDEIDHLSCIKAKKLLETKPEFLKWFVVLEETPWDATSHIDNMENERIPFDLMDTVPAEQLYEAHLEKLRNERKRVEMRRAFKENLETSPFITPGKPWEEARSFIMNEDFYQWLEESVYMDIYGKHQKQIIDKAKEEFQELLLEYSELFYELELDAKPSKEKMGVIQDVLGEEQRFKAIYKSSKQSVDALILKHIHFVYHPTKETCPSCPACVDAKIEHLISSRFIRPSDRNQKNSLSDPNIDRINLVILGKDALPESWPMEIRALCTNDDKYVIDGKMYELSLRPIEGNVRLPVNSFQTPTFQPHGCLCLYNSKESLSYVVESIEKSRESTLGRRDNHLVHLPLTLILVNKRGDTSGETLHSLIQQGQQIASKLQCVFLDPASAGIGYGRNINEKQISQVLKGLLDSKRNLNLVSSTASIKDLADVDLRIVMCLMCGDPFSADDILFPVLQSQTCKSSHCGSNNSVLLELPIGLHKKRIELSVLSYHSSFSIRKSRLVHGYIVFYSAKRKASLAMLRAFLCEVQDIIPIQLVALTDGAVDVLDNDLSREQLTEGEEIAQEIDGRFTSIPCSQPQHKLEIFHPFFKDVVEKKNIIEATHMYDNAAEACSTTEEVFNSPRAGSPLCNSNLQDSEEDIEPSYSLFREDTSLPSLSKDHSKLSMELEGNDGLSFIMSNFESKLNNKVPPPVKPKPPVHFEITKGDLSYLDQGHRDGQRKSVSSSPWLPQDGFDPSDYAEPMDAVVKPRNEEENIYSVPHDSTQGKIITIRNINKAQSNGSGNGSDSEMDTSSLERGRKVSIVSKPVLYRTRCTRLGRFASYRTSFSVGSDDELGPIRKKEEDQASQGYKGDNAVIPYETDEDPRRRNILRSLRRNTKKPKPKPRPSITKATWESNYFGVPLTTVVTPEKPIPIFIERCIEYIEATGLSTEGIYRVSGNKSEMESLQRQFDQDHNLDLAEKDFTVNTVAGAMKSFFSELPDPLVPYNMQIDLVEAHKINDREQKLHARHVWIASWQSTHGWLEE

SEQ ID NO: 860013 - protein, 1282 aa, Homo sapiens
MMMARKQDVRIPTYNISVVGLSGTEKEKGQCGIGKSCLCNRFVRPSADEFHLDHTSVLSTSDFGGRVVNNDHFLYWGEVSRSLEDCVECKMHIVEQTEFIDDQTFQPHRSTALQPYIKRAAATKLASAEKLMYFCTDQLGLEQDFEQKQMPDGKLLVDGFLLGIDVSRGMNRNFDDQLKFVSNLYNQLAKTKKPIVVVLTKCDEGVERYIRDAHTFALSKKNLQVVETSARSNVNVDLAFSTLVQLIDKSRGKTKIIPYFEALKQQSQQIATAKDKYEWLVSRIVKNHNENWLSVSRKMQASPEYQDYVYLEGTQKAKKLFLQHIHRLKHEHIERRRKLYLAALPLAFEALIPNLDEIDHLSCIKAKKLLETKPEFLKWFVVLEETPWDATSHIDNMENERIPFDLMDTVPAEQLYEAHLEKLRNERKRVEMRRAFKENLETSPFITPGKPWEEARSFIMNEDFYQWLEESVYMDIYGKHQKQIIDKAKEEFQELLLEYSELFYELELDAKPSKEKMGVIQDVLGEEQRFKAIYKSSKQSVDALILKHIHFVYHPTKETCPSCPACVDAKIEHLISSRFIRPSDRNQKNSLSDPNIDRINLVILGKDALPESWPMEIRALCTNDDKYVIDGKMYELSLRPIEGNVRLPVNSFQTPTFQPHGCLCLYNSKESLSYVVESIEKSRESTLGRRDNHLVHLPLTLILVNKRGDTSGETLHSLIQQGQQIASKLQCVFLDPASAGIGYGRNINEKQISQVLKGLLDSKRNLNLVSSTASIKDLADVDLRIVMCLMCGDPFSADDILFPVLQSQTCKSSHCGSNNSVLLELPIGLHKKRIELSVLSYHSSFSIRKSRLVHGYIVFYSAKRKASLAMLRAFLCEVQDIIPIQLVALTDGAVDVLDNDLSREQLTEGEEIAQEIDGRFTSIPCSQPQHKLEIFHPFFKDVVEKKNIIEATHMYDNAAEACSTTEEVFNSPRAGSPLCNSNLQDSEEDIEPSYSLFREDTSLPSLSKDHSKLSMELEGNDGLSFIMSNFESKLNNKVPPPVKPKPPVHFEITKGDLSYLDQGHRDGQRKSVSSSPWLPQDGFDPSDYAEPMDAVVKPRNEEENIYSVPHDSTQGKIITIRNINKAQSNGSGNGSDSEMDTSSLERGRKVSIVSKPVLYRTRCTRLGRFASYRTSFSVGSDDELGPIRKKEEDQASQGYKGDNAVIPYETDEDPRRRNILRSLRRNTKKPKPKPRPSITKATWESNYFGVPLTTVVTPEKPIPIFIERCIEYIEATGKSITS

SEQ ID NO: 860014 - protein, 191 aa, Homo sapiens
RWGPGSPRHTVPPFSGGLGHREINDREQKLHALKEVLKKFPKENHEVFKYVISHLNKVSHNNKVNLMTSENLSICFWPTLMRPDFSTMDALTATRTYQTIIELFIQQCPFFFYNRPITEPPGARPSSPSAVASTVPFLTSTPVTSQPSPPQSPPPTPQSPMQPLPADLGWPPPALPWRSRQRCYRPKLLFA

SEQ ID NO: 860015 - protein, 1500 aa, Homo sapiens; identical to SEQ ID NO: 860007

SEQ ID NO: 860016 - protein, 1500 aa, Homo sapiens; identical to SEQ ID NO: 860007

SEQ ID NO: 860017 - protein, 1522 aa, Homo sapiens; identical to SEQ ID NO: 860005

SEQ ID NO: 860018 - protein, 1492 aa, Homo sapiens
MMMARKQDVRIPTYNISVVGLSGTEKEKGQCGIGKSCLCNRFVRPSADEFHLDHTSVLSTSDFGGRVVNNDHFLYWGEVSRSLEDCVECKMHIVEQTEFIDDQTFQPHRSTALQPYIKRAAATKLASAEKLMYFCTDQLGLEQDFEQKQMPDGKLLVDGFLLGIDVSRGMNRNFDDQLKFVSNLYNQLAKTKKPIVVVLTKCDEGVERYIRDAHTFALSKKNLQVVETSARSNVNVDLAFSTLVQLIDKSRGKTKIIPYFEALKQQSQQIATAKDKYEWLVSRIVKNHNENWLSVSRKMQASPEYQDYVYLEGTQKAKKLFLQHIHRLKHEHIERRRKLYLAALPLAFEALIPNLDEIDHLSCIKAKKLLETKPEFLKWFVVLEETPWDATSHIDNMENERIPFDLMDTVPAEQLYEAHLEKLRNERKRVEMRRAFKENLETSPFITPGKPWEEARSFIMNEDFYQWLEESVYMDIYGKHQKQIIDKAKEEFQELLLEYSELFYELELDAKPSKEKMGVIQDVLGEEQRFKAIYKSSKQSVDALILKHIHFVYHPTKETCPSCPACVDAKIEHLISSRFIRPSDRNQKNSLSDPNIDRINLVILGKDALPESWPMEIRALCTNDDKYVIDGKMYELSLRPIEGNVRLPVNSFQTPTFQPHGCLCLYNSKESLSYVVESIEKSRESTLGRRDNHLVHLPLTLILVNKRGDTSGETLHSLIQQGQQIASKLQCVFLDPASAGIGYGRNINEKQISQVLKGLLDSKRNLNLVSSTASIKDLADVDLRIVMCLMCGDPFSADDILFPVLQSQTCKSSHCGSNNSVLLELPIGLHKKRIELSVLSYHSSFSIRKSRLVHGYIASLAMLRAFLCEVQDIIPIQLVALTDGAVDVLDNDLSREQLTEGEEIAQEIDGRFTSIPCSQPQHKLEIFHPFFKDVVEKKNIIEATHMYDNAAEACSTTEEVFNSPRAGSPLCNSNLQDSEEDIEPSYSLFREDTSLPSLSKDHSKLSMELEGNDGLSFIMSNFESKLNNKVPPPVKPKPPVHFEITKGDLSYLDQGHRDGQRKSVSSSPWLPQDGFDPSDYAEPMDAVVKPRNEEENIYSVPHDSTQGKIITIRNINKAQSNGSGNGSDSEMDTSSLERGRKVSIVSKPVLYRTRCTRLGRFASYRTSFSVGSDDELGPIRKKEEDQASQGYKGDNAVIPYETDEDPRRRNILRSLRRNTKKPKPKPRPSITKATWESNYFGVPLTTVVTPEKPIPIFIERCIEYIEATGLSTEGIYRVSGNKSEMESLQRQFDQDHNLDLAEKDFTVNTVAGAMKSFFSELPDPLVPYNMQIDLVEAHKINDREQKLHALKEVLKKFPKENHEVFKYVISHLNKVSHNNKVNLMTSENLSICFWPTLMRPDFSTMDALTATRTYQTIIELFIQQCPFFFYNRPITEPPGARPSSPSAVASTVPFLTSTPVTSQPSPPQSPPPTPQSPMQPLLPSQLQAEHTL

SEQ ID NO: 860019 - protein, 1500 aa, Homo sapiens; identical to SEQ ID NO: 860007

SEQ ID NO: 860020 - protein, 1483 aa, Homo sapiens
MMMARKQDVRIPTYNISVVGLSGTEKEKGQCGIGKSCLCNRFVRPSADEFHLDHTSVLSTSDFGGRVVNNDHFLYWGEVSRSLEDCVECKMHIVEQTEFIDDQTFQPHRSTALQPYIKRAAATKLASAEKLMYFCTDQLGLEQDFEQKQMPDGKLLVDGFLLGIDVSRGMNRNFDDQLKFVSNLYNQLAKTKKPIVVVLTKCDEGVERYIRDAHTFALSKKNLQVVETSARSNVNVDLAFSTLVQLIDKSRGKTKIIPYFEALKQQSQQIATAKDKYEWLVSRIVKNHNENWLSVSRKMQASPEYQDYVYLEGTQKAKKLFLQHIHRLKHEHIERRRKLYLAALPLAFEALIPNLDEIDHLSCIKAKKLLETKPEFLKWFVVLEETPWDATSHIDNMENERIPFDLMDTVPAEQLYEAHLEKLRNERKRVEMRRAFKENLETSPFITPGKPWEEARSFIMNEDFYQWLEESVYMDIYGKHQKQIIDKAKEEFQELLLEYSELFYELELDAKPSKEKMGVIQDVLGEEQRFKAIYKSSKQSVDALILKHIHFVYHPTKETCPSCPACVDAKIEHLISSRFIRPSDRNQKNSLSDPNIDRINLVILGKDALPESWPMEIRALCTNDDKYVIDGKMYELSLRPIEGNVRLPVNSFQTPTFQPHGCLCLYNSKESLSYVVESIEKSRESTLGRRDNHLVHLPLTLILVNKRGDTSGETLHSLIQQGQQIASKLQCVFLDPASAGIGYGRNINEKQISQVLKGLLDSKRNLNLVSSTASIKDLADVDLRIVMCLMCGDPFSADDILFPVLQSQTCKSSHCGSNNSVLLELPIGLHKKRIELSVLSYHSSFSIRKSRLVHGYIVFYSAKRKASLAMLRAFLCEVQDIIPIQLVALTDGAVDVLDNDLSREQLTEGEEIAQEIDGRFTSIPCSQPQHKLEIFHPFFKDVVEKKNIIEATHMYDNAAEACSTTEEVFNSPRAGSPLCNSNLQDSEEDIEPSYSLFREDTSLPSLSKDHSKLSMELEGNDGLSFIMSNFESKLNNKVPPPVKPKPPVHFEITKGDLSYLDQGHRDGQRKSVSSSPWLPQDGFDPSDYAEPMDAVVKPRNEEENIYSVPHDSTQGKIITIRNINKAQSNGSGNGSDSEMDTSSLERGRKVSIVSKPVLYRTRCTRLGRFASYRTSFSVGSDDELGPIRKKEEDQASQGYKGDNAVIPYETDEDPRRRNILRSLRRNTKKPKPKPRPSITKATWESNYFGVPLTTVVTPEKPIPIFIERCIEYIEATGLSTEGIYRVSGNKSEMESLQRQFDQDHNLDLAEKDFTVNTVAGAMKSFFSELPDPLVPYNMQIDLVEAHKINDREQKLHALKEVLKKFPKENHEVFKYVISHLNKVSHNNKVNLMTSENLSICFWPTLMRPDFSTMDALTATRTYQTIIELFIQQCPFFFYNRPITEPPGARPSSPSAVASTVPFLTSTPVTSQPSAPAARGAGSG

SEQ ID NO: 860021 - protein, 1455 aa, Homo sapiens
MMMARKQDVRIPTYNISVVGLSGTEKEKGQCGIGKSCLCNRFVRPSADEFHLDHTSVLSTSDFGGRVVNNDHFLYWGEVSRSLEDCVECKMHIVEQTEFIDDQTFQPHRSTALQPYIKRAAATKLASAEKLMYFCTDQLGLEQDFEQKQMPDGKLLVDGFLLGIDVSRGMNRNFDDQLKFVSNLYNQLAKTKKPIVVVLTKCDEGVERYIRDAHTFALSKKNLQVVETSARSNVNVDLAFSTLVQLIDKSRGKTKIIPYFEALKQQSQQIATAKDKYEWLVSRIVKNHNENWLSVSRKMQASPEYQDYVYLEGTQKAKKLFLQHIHRLKHEHIERRRKLYLAALPLAFEALIPNLDEIDHLSCIKAKKLLETKPEFLKWFVVLEETPWDATSHIDNMENERIPFDLMDTVPAEQLYEAHLEKLRNERKRVEMRRAFKENLETSPFITPGKPWEEARSFIMNEDFYQWLEESVYMDIYGKHQKQIIDKAKEEFQELLLEYSELFYELELDAKPSKEKMGVIQDVLGEEQRFKAIYKSSKQSVDALILKHIHFVYHPTKETCPSCPACVDAKIEHLISSRFIRPSDRNQKNSLSDPNIDRINLVILGKDALPESWPMEIRALCTNDDKYVIDGKMYELSLRPIEGNVRLPVNSFQTPTFQPHGCLCLYNSKESLSYVVESIEKSRESTLGRRDNHLVHLPLTLILVNKRGDTSGETLHSLIQQGQQIASKLQCVFLDPASAGIGYGRNINEKQISQVLKGLLDSKRNLNLVSSTASIKDLADVDLRIVMCLMCGDPFSADDILFPVLQSQTCKSSHCGSNNSVLLELPIGLHKKRIELSVLSYHSSFSIRKSRLVHGYIVFYSAKRKASLAMLRAFLCEVQDIIPIQLVALTDGAVDVLDNDLSREQLTEGEEIAQEIDGRFTSIPCSQPQHKLEIFHPFFKDVVEKKNIIEATHMYDNAAEACSTTEEVFNSPRAGSPLCNSNLQDSEEDIEPSYSLFREDTSLPSLSKDHSKLSMELEGNDGLSFIMSNFESKLNNKVPPPVKPKPPVHFEITKGDLSYLDQGHRDGQRKSVSSSPWLPQDGFDPSDYAEPMDAVVKPRNEEENIYSVPHDSTQGKIITIRNINKAQSNGSGNGSDSEMDTSSLERGRKVSIVSKPVLYRTRCTRLGRFASYRTSFSVGSDDELGPIRKKEEDQASQGYKGDNAVIPYETDEDPRRRNILRSLRRNTKKPKPKPRPSITKATWESNYFGVPLTTVVTPEKPIPIFIERCIEYIEATGLSTEGIYRVSGNKSEMESLQRQFDQDHNLDLAEKDFTVNTVAGAMKSFFSELPDPLVPYNMQIDLVEAHKINDREQKLHALKEVLKKFPKENHEVFKYVISHLNKVSHNNKVNLMTSENLSICFWPTLMRPDFSTMDALTATRTYQTIIELFIQQCSVANARRARGTEQEAVCHLGHC

SEQ ID NO: 860022 - protein, 1350 aa, Homo sapiens
MMMARKQDVRIPTYNISVVGLSGTEKEKGQCGIGKSCLCNRFVRPSADEFHLDHTSVLSTSDFGGRVVNNDHFLYWGEVSRSLEDCVECKMHIVEQTEFIDDQTFQPHRSTALQPYIKRAAATKLASAEKLMYFCTDQLGLEQDFEQKQMPDGKLLVDGFLLGIDVSRGMNRNFDDQLKFVSNLYNQLAKTKKPIVVVLTKCDEGVERYIRDAHTFALSKKNLQVVETSARSNVNVDLAFSTLVQLIDKSRGKTKIIPYFEALKQQSQQIATAKDKYEWLVSRIVKNHNENWLSVSRKMQASPEYQDYVYLEGTQKAKKLFLQHIHRLKHEHIERRRKLYLAALPLAFEALIPNLDEIDHLSCIKAKKLLETKPEFLKWFVVLEETPWDATSHIDNMENERIPFDLMDTVPAEQLYEAHLEKLRNERKRVEMRRAFKENLETSPFITPGKPWEEARSFIMNEDFYQWLEESVYMDIYGKHQKQIIDKAKEEFQELLLEYSELFYELELDAKPSKEKMGVIQDVLGEEQRFKAIYKSSKQSVDALILKHIHFVYHPTKETCPSCPACVDAKIEHLISSRFIRPSDRNQKNSLSDPNIDRINLVILGKDALPESWPMEIRALCTNDDKYVIDGKMYELSLRPIEGNVRLPVNSFQTPTFQPHGCLCLYNSKESLSYVVESIEKSRESTLGRRDNHLVHLPLTLILVNKRGDTSGETLHSLIQQGQQIASKLQCVFLDPASAGIGYGRNINEKQISQVLKGLLDSKRNLNLVSSTASIKDLADVDLRIVMCLMCGDPFSADDILFPVLQSQTCKSSHCGSNNSVLLELPIGLHKKRIELSVLSYHSSFSIRKSRLVHGYIVFYSAKRKASLAMLRAFLCEVQDIIPIQLVALTDGAVDVLDNDLSREQLTEGEEIAQEIDGRFTSIPCSQPQHKLEIFHPFFKDVVEKKNIIEATHMYDNAAEACSTTEEVFNSPRAGSPLCNSNLQDSEEDIEPSYSLFREDTSLPSLSKDHSKLSMELEGNDGLSFIMSNFESKLNNKVPPPVKPKPPVHFEITKGDLSYLDQGHRDGQRKSVSSSPWLPQDGFDPSDYAEPMDAVVKPRNEEENIYSVPHDSTQGKIITIRNINKAQSNGSGNGSDSEMDTSSLERGRKVSIVSKPVLYRTRCTRLGRFASYRTSFSVGSDDELGPIRKKEEDQASQGYKGDNAVIPYETDEDPRRRNILRSLRRNTKKPKPKPRPSITKATWESNYFGVPLTTVVTPEKPIPIFIERCIEYIEATGLSTEGIYRVSGNKSEMESLQRQFDQDHNLDLAEKDFTVNTVAGAMKSFFSELPDPLVPYNMQIDLVEAHSVTE

SEQ ID NO: 860023 - protein, 180 aa, Homo sapiens
MRGARSSERSAGGGAVPRAAGARAPWGPRNHNEDLGHLSADAPWPAVTMAPRKRSHHGLGFLCCFGGSDIPEINLRDNHPLQFMEFSSPIPNAEELNIRFAELVDELDLTDKNREAMFALPPEKKWQIYCSKKKVPSLTPLATSQGSWHGVALAALACSCIHLMFITCQPCSRCWRNNSE

SEQ ID NO: 860024 - protein, 101 aa, Homo sapiens
EVALAGRVRGGLGNPHLNFHLTCWLQKELGSTEDIYLASRKVKELSVIDGRRAQNCIILLSKLKLSNEEIRQAILKMDEQEDLAKDMLEQLLKFIQRVRGV

SEQ ID NO: 860025 - protein, 1180 aa, Homo sapiens
MAPRKRSHHGLGFLCCFGGSDIPEINLRDNHPLQFMEFSSPIPNAEELNIRFAELVDELDLTDKNREAMFALPPEKKWQIYCSKKKVPSLTPLATSQGSWHGVALAALACSCIHLMFITCQPVLGVGGTTVNKIEKGNSAVLELTLKEIGFSFSKRLKQDLLHPRTGACWETDKEAESGLSRACSQAWREQEDPNKLATSWPDYYIDRINSMAAMQSLYAFDEEETEMRNQVVEDLKTALRTQPMRFVTRFIELEGLTCLLNFLRSMDHATCESRIHTSLIGCIKALMNNSQGRAHVLAQPEAISTIAQSLRTENSKTKVAVLEILGAVCLVPGGHKKVLQAMLHYQVYAAERTRFQTLLNELDRSLGRYRDEVNLKTAIMSFINAVLNAGAGEDNLEFRLHLRYEFLMLGIQPVIDKLRQHENAILDKHLDFFEMVRNEDDLELARRFDMVHIDTKSASQMFELIHKKLKYTEAYPCLLSVLHHCLQMPYKRNGGYFQQWQLLDRILQQIVLQDERGVDPDLAPLENFNVKNIVNMLINENEVKQWRDQAEKFRKEHMELVSRLERKERECETKTLEKEEMMRTLNKMKDKLARESQELRQARGQVAELVAQLSELSTGPVSSPPPPGGPLTLSSSMTTNDLPPPPPPLPFACCPPPPPPPLPPGGPPTPPGAPPCLGMGLPLPQDPYPSSDVPLRKKRVPQPSHPLKSFNWVKLNEERVPGTVWNEIDDMQVFRILDLEDFEKMFSAYQRHQELITNPSQQKELGSTEDIYLASRKVKELSVIDGRRAQNCIILLSKLKLSNEEIRQAILKMDEQEDLAKDMLEQLLKFIPEKSDIDLLEEHKHEIERMARADRFLYEMSRIDHYQQRLQALFFKKKFQERLAEAKPKVEAILLASRELVRSKRLRQMLEVILAIGNFMNKGQRGGAYGFRVASLNKIADTKSSIDRNISLLHYLIMILEKHFPDILNMPSELQHLPEAAKVNLAELEKEVGNLRRGLRAVEVELEYQRRQVREPSDKFVPVMSDFITVSSFSFSELEDQLNEARDKFAKALMHFGEHDSKMQPDEFFGIFDTFLQAFSEARQDLEAMRRRKEEEERRARMEAMLKEQRERERWQRQRKVLAAGSSLEEGGEFDDLVSALRSGEVFDKDLCKLKRSRKRSGSQALEVTRERAINRLNY

SEQ ID NO: 860026 - protein, 1077 aa, Homo sapiens
MAPRKRSHHGLGFLCCFGGSDIPEINLRDNHPLQFMEFSSPIPNAEELNIRFAELVDELDLTDKNREAMFALPPEKKWQIYCSKKKEQEDPNKLATSWPDYYIDRINSMAAMQSLYAFDEEETEMRNQVVEDLKTALRTQPMRFVTRFIELEGLTCLLNFLRSMDHATCESRIHTSLIGCIKALMNNSQGRAHVLAQPEAISTIAQSLRTENSKTKVAVLEILGAVCLVPGGHKKVLQAMLHYQVYAAERTRFQTLLNELDRSLGRYRDEVNLKTAIMSFINAVLNAGAGEDNLEFRLHLRYEFLMLGIQPVIDKLRQHENAILDKHLDFFEMVRNEDDLELARRFDMVHIDTKSASQMFELIHKKLKYTEAYPCLLSVLHHCLQMPYKRNGGYFQQWQLLDRILQQIVLQDERGVDPDLAPLENFNVKNIVNMLINENEVKQWRDQAEKFRKEHMELVSRLERKERECETKTLEKEEMMRTLNKMKDKLARESQELRQARGQVAELVAQLSELSTGPVSSPPPPGGPLTLSSSMTTNDLPPPPPPLPFACCPPPPPPPLPPGGPPTPPGAPPCLGMGLPLPQDPYPSSDVPLRKKRVPQPSHPLKSFNWVKLNEERVPGTVWNEIDDMQVFRILDLEDFEKMFSAYQRHQELITNPSQQKELGSTEDIYLASRKVKELSVIDGRRAQNCIILLSKLKLSNEEIRQAILKMDEQEDLAKDMLEQLLKFIPEKSDIDLLEEHKHEIERMARADRFLYEMSRIDHYQQRLQALFFKKKFQERLAEAKPKVEAILLASRELVRSKRLRQMLEVILAIGNFMNKGQRGGAYGFRVASLNKIADTKSSIDRNISLLHYLIMILEKHFPDILNMPSELQHLPEAAKVNLAELEKEVGNLRRGLRAVEVELEYQRRQVREPSDKFVPVMSDFITVSSFSFSELEDQLNEARDKFAKALMHFGEHDSKMQPDEFFGIFDTFLQAFSEARQDLEAMRRRKEEEERRARMEAMLKEQRERERWQRQRKVLAAGSSLEEGGEFDDLVSALRSGEVFDKDLCKLKRSRKRSGSQALEVTRERAINRLNY

SEQ ID NO: 860027 - protein, 1180 aa, Homo sapiens; identical to SEQ ID NO: 860025

SEQ ID NO: 860028 - protein, 1171 aa, Homo sapiens
MAPRKRSHHGLGFLCCFGGSDIPEINLRDNHPLQFMEFSSPIPNAEELNIRFAELVDELDLTDKNREAMFALPPEKKWQIYCSKKKVPSLTPLATSQGSWHGVALAALACSCIHLMFITCQPVLGVGGTTVNKIEKGNSAVLELTLKEIGFSFSKRLKQDLLHPRTGACWETDKEAESGLSRACSQAWREQEDPNKLATSWPDYYIDRINSMAAMQSLYAFDEEETEMRNQVVEDLKTALRTQPMRFVTRFIELEGLTCLLNFLRSMDHATCESRIHTSLIGCIKALMNNSQGRAHVLAQPEAISTIAQSLRTENSKTKVAVLEILGAVCLVPGGHKKVLQAMLHYQVYAAERTRFQTLLNELDRSLGRYRDEVNLKTAIMSFINAVLNAGAGEDNLEFRLHLRYEFLMLGIQPVIDKLRQHENAILDKHLDFFEMVRNEDDLELARRFDMVHIDTKSASQMFELIHKKLKYTEAYPCLLSVLHHCLQMPYKRNGGYFQQWQLLDRILQQIVLQDERGVDPDLAPLENFNVKNIVNMLINENEVKQWRDQAEKFRKEHMELVSRLERKERECETKTLEKEEMMRTLNKMKDKLARESQELRQARGQVAELVAQLSELSTGPVSSPPPPGGPLTLSSSMTTNDLPPPPPPLPFACCPPPPPPPLPPGGPPTPPGAPPCLGMGLPLPQDPYPSSDVPLRKKRVPQPSHPLKSFNWVKLNEERVPGTVWNEIDDMQVFRILDLEDFEKMFSAYQRHQKELGSTEDIYLASRKVKELSVIDGRRAQNCIILLSKLKLSNEEIRQAILKMDEQEDLAKDMLEQLLKFIPEKSDIDLLEEHKHEIERMARADRFLYEMSRIDHYQQRLQALFFKKKFQERLAEAKPKVEAILLASRELVRSKRLRQMLEVILAIGNFMNKGQRGGAYGFRVASLNKIADTKSSIDRNISLLHYLIMILEKHFPDILNMPSELQHLPEAAKVNLAELEKEVGNLRRGLRAVEVELEYQRRQVREPSDKFVPVMSDFITVSSFSFSELEDQLNEARDKFAKALMHFGEHDSKMQPDEFFGIFDTFLQAFSEARQDLEAMRRRKEEEERRARMEAMLKEQRERERWQRQRKVLAAGSSLEEGGEFDDLVSALRSGEVFDKDLCKLKRSRKRSGSQALEVTRERAINRLNY

SEQ ID NO: 860029 - protein, 114 aa, Homo sapiens
IPEINLRDNHPLQFMEFSSPIPNAEELNIRFAELVVSERVGRDSDNGEEGGWRGRAGQRAGPLCWGLHLSKLLLGGDRPPGHLSYVGEPESLTGMDSIKCVPRRMVLPPLCIGL

SEQ ID NO: 860030 - protein, 1077 aa, Homo sapiens; identical to SEQ ID NO: 860026

SEQ ID NO: 860031 - protein, 1137 aa, Homo sapiens
MAWASCAASGAVTSPKSTSGTTTLCSSWSSPAPSRTQRSSTSALQSWWMNWISLTKTERLCLHCPLRRNGRSTAARRSPVLGVGGTTVNKIEKGNSAVLELTLKEIGFSFSKTLKAGPAASQDWGLLGDNKEAESGLSRACSQAWREQEDPNKLATSWPDYYIDRINSMAAMQSLYAFDEEETEMRNQVVEDLKTALRTQPMRFVTRFIELEGLTCLLNFLRSMDHATCESRIHTSLIGCIKALMNNSQGRAHVLAQPEAISTIAQSLRTENSKTKVAVLEILGAVCLVPGGHKKVLQAMLHYQVYAAERTRFQTLLNELDRSLGRYRDEVNLKTAIMSFINAVLNAGAGEDNLEFRLHLRYEFLMLGIQPVIDKLRQHENAILDKHLDFFEMVRNEDDLELARRFDMVHIDTKSASQMFELIHKKLKYTEAYPCLLSVLHHCLQMPYKRNGGYFQQWQLLDRILQQIVLQDERGVDPDLAPLENFNVKNIVNMLINENEVKQWRDQAEKFRKEHMELVSRLERKERECETKTLEKEEMMRTLNKMKDKLARESQELRQARGQVAELVAQLSELSTGPVSSPPPPGGPLTLSSSMTTNDLPPPPPPLPFACCPPPPPPPLPPGGPPTPPGAPPCLGMGLPLPQDPYPSSDVPLRKKRVPQPSHPLKSFNWVKLNEERVPGTVWNEIDDMQVFRILDLEDFEKMFSAYQRHQELITNPSQQKELGSTEDIYLASRKVKELSVIDGRRAQNCIILLSKLKLSNEEIRQAILKMDEQEDLAKDMLEQLLKFIPEKSDIDLLEEHKHEIERMARADRFLYEMSRIDHYQQRLQALFFKKKFQERLAEAKPKVEAILLASRELVRSKRLRQMLEVILAIGNFMNKGQRGGAYGFRVASLNKIADTKSSIDRNISLLHYLIMILEKHFPDILNMPSELQHLPEAAKVNLAELEKEVGNLRRGLRAVEVELEYQRRQVREPSDKFVPVMSDFITVSSFSFSELEDQLNEARDKFAKALMHFGEHDSKMQPDEFFGIFDTFLQAFSEARQDLEAMRRRKEEEERRARMEAMLKEQRERERWQRQRKVLAAGSSLEEGGEFDDLVSALRSGEVFDKDLCKLKRSRKRSGSQALEVTRERAINRLNY

SEQ ID NO: 860032 - protein, 894 aa, Homo sapiens
RASPAHFSSHVLAQPEAISTIAQSLRTENSKTKVAVLEILGAVCLVPGGHKKVLQAMLHYQVYAAERTRFQTLLNELDRSLGRYRDEVNLKTAIMSFINAVLNAGAGEDNLEFRLHLRYEFLMLGIQPVIDKLRQHENAILDKHLDFFEMVRNEDDLELARRFDMVHIDTKSASQMFELIHKKLKYTEAYPCLLSVLHHCLQMPYKRNGGYFQQWQLLDRILQQIVLQDERGVDPDLAPLENFNVKNIVNMLINENEVKQWRDQAEKFRKEHMELVSRLERKERECETKTLEKEEMMRTLNKMKDKLARESQELRQARGQVAELVAQLSELSTGPVSSPPPPGGPLTLSSSMTTNDLPPPPPPLPFACCPPPPPPPLPPGGPPTPPGAPPCLGMGLPLPQDPYPSSDVPLRKKRVPQPSHPLKSFNWVKLNEERVPGTVWNEIDDMQVFRILDLEDFEKMFSAYQRHQELITNPSQQKELGSTEDIYLASRKVKELSVIDGRRAQNCIILLSKLKLSNEEIRQAILKMDEQEDLAKDMLEQLLKFIPEKSDIDLLEEHKHEIERMARADRFLYEMSRIDHYQQRLQALFFKKKFQERLAEAKPKVEAILLASRELVRSKRLRQMLEVILAIGNFMNKGQRGGAYGFRVASLNKIADTKSSIDRNISLLHYLIMILEKHFPDILNMPSELQHLPEAAKVNLAELEKEVGNLRRGLRAVEVELEYQRRQVREPSDKFVPVMSDFITVSSFSFSELEDQLNEARDKFAKALMHFGEHDSKMQPDEFFGIFDTFLQAFSEARQDLEAMRRRKEEEERRARMEAMLKEQRERERWQRQRKVLAAGSSLEEGGEFDDLVSALRSGEVFDKDLCKLKRSRKRSGSQALEVTRERAINRLNY

SEQ ID NO: 860033 - protein, 1171 aa, Homo sapiens; identical to SEQ ID NO: 860028

SEQ ID NO: 860034 - protein, 756 aa, Homo sapiens
MELLRQHENAILDKHLDFFEMVRNEDDLELARRFDMVHIDTKSASQMFELIHKKLKYTEAYPCLLSVLHHCLQMPYKRNGGYFQQWQLLDRILQQIVLQDERGVDPDLAPLENFNVKNIVNMLINENEVKQWRDQAEKFRKEHMELVSRLERKERECETKTLEKEEMMRTLNKMKDKLARESQELRQARGQVAELVAQLSELSTGPVSSPPPPGGPLTLSSSMTTNDLPPPPPPLPFACCPPPPPPPLPPGGPPTPPGAPPCLGMGLPLPQDPYPSSDVPLRKKRVPQPSHPLKSFNWVKLNEERVPGTVWNEIDDMQVFRILDLEDFEKMFSAYQRHQKELGSTEDIYLASRKVKELSVIDGRRAQNCIILLSKLKLSNEEIRQAILKMDEQEDLAKDMLEQLLKFIPEKSDIDLLEEHKHEIERMARADRFLYEMSRIDHYQQRLQALFFKKKFQERLAEAKPKVEAILLASRELVRSKRLRQMLEVILAIGNFMNKGQRGGAYGFRVASLNKIADTKSSIDRNISLLHYLIMILEKHFPDILNMPSELQHLPEAAKVNLAELEKEVGNLRRGLRAVEVELEYQRRQVREPSDKFVPVMSDFITVSSFSFSELEDQLNEARDKFAKALMHFGEHDSKMQPDEFFGIFDTFLQAFSEARQDLEAMRRRKEEEERRARMEAMLKEQRERERWQRQRKVLAAGSSLEEGGEFDDLVSALRSGEVFDKDLCKLKRSRKRSGSQALEVTRERAINRLNY

SEQ ID NO: 860035 - protein, 1171 aa, Homo sapiens; identical to SEQ ID NO: 860028

SEQ ID NO: 860036 - protein, 1171 aa, Homo sapiens; identical to SEQ ID NO: 860028

SEQ ID NO: 860037 - protein, 107 aa, Homo sapiens
SPPFFTWYQHLGHKFGLVKSQTVTSNVALESPTAPQQRAALECLAPSHSSLLHINCSGPPTPSLTLASRQKPQQPLSSLQVATWNHVSTGVGELVPERSEGQSCPLH

SEQ ID NO: 860038 - protein, 1171 aa, Homo sapiens; identical to SEQ ID NO: 860028

SEQ ID NO: 860039 - protein, 436 aa, Homo sapiens [sequence omitted]

SEQ ID NO: 860040 - protein, 440 aa, Homo sapiens
MATRSCREKAQKLNEQHQLILSKLLREEDNKYCADCEAKGPRWASWNIGVFICIRCAGIHRNLGVHISRVKSVNLDQWTAEQIQCMQDMGNTKARLLYEANLPENFRRPQTDQAVEFFIRDKYEKKKYYDKNAIAITNKEKEKKKEEKKREKEPEKPAKPLTAEKLQKKDQQLEPKKSTSPKKAAEPTVDLLGLDGPAVAPVTNGNTTVPPLNDDLDIFGPMISNPLPATVMPPAQGTPSAPAAATLSTVTSGDLDLFTEQTTKSEEVAKKQLSKDSILSLYGTGTIQQQSTPGVFMGPTNIPFTSQAPAAFQGFPSMGVPVPAAPGLIGNVMGQSPSMMVGMPMPNGFMGNAQTGVMPLPQNVVGPQGGMVGQMGAPQSKFGLPQAQQPQWSLSQMNQQMAGMSISSATPTAGFGQPSSTTAGWSGSSSGQTLSTQLWK

SEQ ID NO: 860041 - protein, 297 aa, Homo sapiens
MATRSCREKAQKLNEQHQLILSKLLREEDNKYCADCEAKGPRWASWNIGVFICIRCAGIHRNLGVHISRVKSVNLDQWTAEQIQCMQDMGNTKARLLYEANLPENFRRPQTDQAVEFFIRDKYEKKKYYDKNAIAITNKEKEKKKEEKKREKEPEKPAKPLTAEKLQKKDQQLEPKKSTSPKKAAEPTVDLLGLDGPAVAPVTNGNTTVPPLNDDLDIFGPMISNPLPATVMPPAQGTPSAPAAATLSTVTSGDLDLFTEQTTKSEEVAKKQLSKDSILSLYGTGTIQQQSTPGNEF

SEQ ID NO: 860042 - protein, 355 aa, Homo sapiens [sequence omitted]

SEQ ID NO: 860043 - protein, 154 aa, Homo sapiens
MATRSCREKAQKLNEQHQLILSKLLREEDNKYCADCEAKGPRWASWNIGVFICIRCAGIHRNLGVHISRVKSVNLDQWTAEQIQCMQDMGNTKARLLYEANLPENFRRPQTDQAVEFFIRDKYEKKKYCRRKISNWSLKKVPALKKLRSPLWIF

SEQ ID NO: 860044 - protein, 337 aa, Homo sapiens
MLFLKLSVFRAVEFFIRDKYEKKKYYDKNAIAITNKEKEKKKEEKKREKEPEKPAKPLTAEKLQKKDQQLEPKKSTSPKKAAEPTVDLLGLDGPAVAPVTNGNTTVPPLNDDLDIFGPMISNPLPATVMPPAQGTPSAPAAATLSTVTSGDLDLFTEQTTKSEEVAKKQLSKDSILSLYGTGTIQQQSTPGVFMGPTNIPFTSQAPAAFQGFPSMGVPVPAAPGLIGNVMGQSPSMMVGMPMPNGFMGNAQTGVMPLPQNVVGPQGGMVGQMGAPQSKFGLPQAQQPQWSLSQMNQQMAGMSISSATPTAGFGQPSSTTAGWSGSSSGQTLSTQLWK

SEQ ID NO: 860045 - protein, 364 aa, Homo sapiens
MLFLKLSVFRAVEFFIRDKYEKKKYYDKNAIAITNISSSDAPLQPLVSSPSLQAAVDKNKLEKEKEKKKEEKKREKEPEKPAKPLTAEKLQKKDQQLEPKKSTSPKKAAEPTVDLLGLDGPAVAPVTNGNTTVPPLNDDLDIFGPMISNPLPATVMPPAQGTPSAPAAATLSTVTSGDLDLFTEQTTKSEEVAKKQLSKDSILSLYGTGTIQQQSTPGVFMGPTNIPFTSQAPAAFQGFPSMGVPVPAAPGLIGNVMGQSPSMMVGMPMPNGFMGNAQTGVMPLPQNVVGPQGGMVGQMGAPQSKFGLPQAQQPQWSLSQMNQQMAGMSISSATPTAGFGQPSSTTAGWSGSSSGQTLSTQLWK

SEQ ID NO: 860046 - protein, 440 aa, Homo sapiens; identical to SEQ ID NO: 860040

SEQ ID NO: 860047 - protein, 76 aa, Homo sapiens
EIIVDVTPKLQFNECLKNSNFICLSCNLEPLTMNQQMAGMSISSATPTAGFGQPSSTTAGWSGSSSGQTLSTQLWK

SEQ ID NO: 860048 - protein, 297 aa, Homo sapiens; identical to SEQ ID NO: 860041

SEQ ID NO: 860049 - protein, 467 aa, Homo sapiens
MATRSCREKAQKLNEQHQLILSKLLREEDNKYCADCEAKGPRWASWNIGVFICIRCAGIHRNLGVHISRVKSVNLDQWTAEQIQCMQDMGNTKARLLYEANLPENFRRPQTDQAVEFFIRDKYEKKKYYDKNAIAITNISSSDAPLQPLVSSPSLQAAVDKNKLEKEKEKKKEEKKREKEPEKPAKPLTAEKLQKKDQQLEPKKSTSPKKAAEPTVDLLGLDGPAVAPVTNGNTTVPPLNDDLDIFGPMISNPLPATVMPPAQGTPSAPAAATLSTVTSGDLDLFTEQTTKSEEVAKKQLSKDSILSLYGTGTIQQQSTPGVFMGPTNIPFTSQAPAAFQGFPSMGVPVPAAPGLIGNVMGQSPSMMVGMPMPNGFMGNAQTGVMPLPQNVVGPQGGMVGQMGAPQSKFGLPQAQQPQWSLSQMNQQMAGMSISSATPTAGFGQPSSTTAGWSGSSSGQTLSTQLWK

SEQ ID NO: 860050 - protein, 440 aa, Homo sapiens; identical to SEQ ID NO: 860040

SEQ ID NO: 860051 - protein, 250 aa, Homo sapiens
MATRSCREKAQKLNEQHQLILSKLLREEDNKYCADCEAKGPRWASWNIGVFICIRCAGIHRNLGVHISRVKSVNLDQWTAEQIQCMQDMGNTKARLLYEANLPENFRRPQTDQAVEFFIRDKYEKKKYYDKNAIAITNISSSDAPLQPLVSSPSLQAAVDKNKLEKEKEKKKEEKKREKEPEKPAKPLTAEKLQKKDQQLEPKKSTSPKKAAEPTVDLLGLVWRKIEKEKSERQLVEVEELTFMYCFPKN

SEQ ID NO: 860052 - protein, 70 aa, Homo sapiens
TQHTHSWLLTKENRKQADLYSSSLPDCKTMEMPTCPQTSVWSACAMKHSVAERQESPHSKEAADTGLHTV

SEQ ID NO: 860053 - protein, 90 aa, Homo sapiens
MQRTRQEEISRLMHIQKNADCTSFSELVENFKKTLSHTDPMVLDDFGTSLPFIDIYFSTLDYQDTTVHKLQELYVLDRACAESAALGILL

SEQ ID NO: 860054 - protein, 102 aa, Homo sapiens
MQRTRQEEISRLMHIQKNADCTSFSELVENFKKTLSHTDPMVLDDFGTSLPFIDIYFSTLDYQDTTVHKLQELYYEIVHVLSLMLEDLPQEKPQSLEKVDEK

SEQ ID NO: 860055 - protein, 102 aa, Homo sapiens; identical to SEQ ID NO: 860054

SEQ ID NO: 860056 - protein, 509 aa, Homo sapiens
MERRRLWGSIQSRYISMSVWTSPRRLVELAGQSLLKDEALAIAALELLPRELFPPLFMAAFDGRHSQTLKAMVQAWPFTCLPLGVLMKGQHLHLETFKAVLDGLDVLLAQEVRPRRWKLQVLDLRKNSHQDFWTVWSGNRASLYSFPEPEAAQPMTKKRKVDGLSTEAEQPFIPVEVLVDLFLKEGACDELFSYLIEKVKRKKNVLRLCCKKLKIFAMPMQDIKMILKMVQLDSIEDLEVTCTWKLPTLAKFSPYLGQMINLRRLLLSHIHASSYISPEKEEQYIAQFTSQFLSLQCLQALYVDSLFFLRGRLDQLLRHVMNPLETLSITNCRLSEGDVMHLSQSPSVSQLSVLSLSGVMLTDVSPEPLQALLERASATLQDLVFDECGITDDQLLALLPSLSHCSQLTTLSFYGNSISISALQSLLQHLIGLSNLTHVLYPVPLESYEDIHGTLHLERLAYLHARLRELLCELGRPSMVWLSANPCPHCGDRTFYDPEPILCPCFMPN

SEQ ID NO: 860057 - protein, 509 aa, Homo sapiens; identical to SEQ ID NO: 860056

SEQ ID NO: 860058 - protein, 509 aa, Homo sapiens; identical to SEQ ID NO: 860056

SEQ ID NO: 860059 - protein, 509 aa, Homo sapiens; identical to SEQ ID NO: 860056

SEQ ID NO: 860060 - protein, 509 aa, Homo sapiens; identical to SEQ ID NO: 860056

SEQ ID NO: 860061 - protein, 509 aa, Homo sapiens; identical to SEQ ID NO: 860056

SEQ ID NO: 860062 - protein, 509 aa, Homo sapiens; identical to SEQ ID NO: 860056

SEQ ID NO: 860063 - protein, 493 aa, Homo sapiens
MSVWTSPRRLVELAGQSLLKDEALAIAALELLPRELFPPLFMAAFDGRHSQTLKAMVQAWPFTCLPLGVLMKGQHLHLETFKAVLDGLDVLLAQEVRPRRWKLQVLDLRKNSHQDFWTVWSGNRASLYSFPEPEAAQPMTKKRKVDGLSTEAEQPFIPVEVLVDLFLKEGACDELFSYLIEKVKRKKNVLRLCCKKLKIFAMPMQDIKMILKMVQLDSIEDLEVTCTWKLPTLAKFSPYLGQMINLRRLLLSHIHASSYISPEKEEQYIAQFTSQFLSLQCLQALYVDSLFFLRGRLDQLLRHVMNPLETLSITNCRLSEGDVMHLSQSPSVSQLSVLSLSGVMLTDVSPEPLQALLERASATLQDLVFDECGITDDQLLALLPSLSHCSQLTTLSFYGNSISISALQSLLQHLIGLSNLTHVLYPVPLESYEDIHGTLHLERLAYLHARLRELLCELGRPSMVWLSANPCPHCGDRTFYDPEPILCPCFMPN

SEQ ID NO: 860064 - protein, 509 aa, Homo sapiens; identical to SEQ ID NO: 860056

SEQ ID NO: 860065 - protein, 509 aa, Homo sapiens; identical to SEQ ID NO: 860056

SEQ ID NO: 860066 - protein, 509 aa, Homo sapiens; identical to SEQ ID NO: 860056

SEQ ID NO: 860067 - protein, 509 aa, Homo sapiens; identical to SEQ ID NO: 860056

SEQ ID NO: 860068 - protein, 509 aa, Homo sapiens; identical to SEQ ID NO: 860056

SEQ ID NO: 860069 - protein, 509 aa, Homo sapiens; identical to SEQ ID NO: 860056

SEQ ID NO: 860070 - protein, 509 aa, Homo sapiens; identical to SEQ ID NO: 860056

SEQ ID NO: 860071 - protein, 509 aa, Homo sapiens; identical to SEQ ID NO: 860056

SEQ ID NO: 860072 - protein, 493 aa, Homo sapiens; identical to SEQ ID NO: 860063

SEQ ID NO: 860073 - protein, 163 aa, Homo sapiens
MERRRLWGSIQSRYISMSVWTSPRRLVELAGQSLLKDEALAIAALELLPRELFPPLFMAAFDGRHSQTLKAMVQAWPFTCLPLGVLMKGQHLHLETFKAVLDGLDVLLAQEVRPRRWKLQVLDLRKNSHQDFWTVWSGNRASLYSFPEPEAAQPMNNKWPLML

SEQ ID NO: 860074 - protein, 406 aa, Homo sapiens
MAFTERVNSSGNSLYNDDRNLLRIREKERRNQEAHQEKEAFPEKIPLFGEPYKTAKGDELSSRIQNMLGNYEEVKEFLSTKSHTHRLDASENRLGKPKYPLIPDKGSSIPSSSFHTSVHHQSIHTPASGPLSVGNISHNPKMAQPRTEPMPSLHAKSCGPPDSQHLTQDRLGQEGFGSSHHKKGDRRADGDHCASVTDSAPERELSPLISLPSPVPPLSPIHSNQQTLPRTQGSSKVHGSSNNSKGYCPAKSPKDLAVKVHDKETPQDSLVAPAQPPSQTFPPPSLPSKSVAMQQKPTAYVRPMDGQDQAPSESPELKPLPEDYRQQTFEKTDLKVPAKAKLTKLKMPSQSVEQTYSNEVHCVEEILKEKPPPVNKQENAGTLNILSTLSNGNSSKQKIPADGVHR

SEQ ID NO: 860075 - protein, 416 aa, Homo sapiens
PAADNSTELDMTDFVFQAAVPKTFQLQLMSPSSSIVTSIFTRGTITQVIKVLNPQKQQLCECGSSLHIITRGSAMQDLAEVYNFPLSPGNEGLAPFSFRTSPPVGSTKYPLIPDKGSSIPSSSFHTSVHHQSIHTPASGPLSVGNISHNPKMAQPRTEPMPSLHAKSCGPPDSQHLTQDRLGQEGFGSSHHKKGDRRADGDHCASVTDSAPERELSPLISLPSPVPPLSPIHSNQQTLPRTQGSSKVHGSSNNSKGYCPAKSPKDLAVKVHDKETPQDSLVAPAQPPSQTFPPPSLPSKSVAMQQKPTAYVRPMDGQDQAPSESPELKPLPEDYRQQTFEKTDLKVPAKAKLTKLKMPSQSVEQTYSNEVHCVEEILKEKPPPVNKQENAGTLNILSTLSNGNSSKQKIPADGVHR

SEQ ID NO: 860076 - protein, 406 aa, Homo sapiens; identical to SEQ ID NO: 860074

SEQ ID NO: 860077 - protein, 400 aa, Homo sapiens
MAFTERVNSSGNSLYNDDRNLLRIREKERRNQEAHQEKEAFPEKIPLFGEPYKTAKGDELSSRIQNMLGNYEEVKEFLSTKSHTHRLDASENRLGKPKYPLIPDKGSSIPSSSFHTSVHHQSIHTPASGPLSVGNISHNPKMAQPRTEPMPSLHAKSCGPPDSQHLTQDRLGQEGFGSSHHKKGDRRADGDHCASVTDSAPERELSPLISLPSPVPPLSPIHSNQQTLPRTQGSSKVHGSSNNSKGYCPAKSPKDLAVKVHDKETPQDSLVAPAQPPSQTFPPPSLPSKSVAMQQKPTAYVRPMDGQDQAPSESPELKPLPEDYRQQTFEKTDLKVPAKAKLTKLKMPSQSVEQTYSNEVHCVEEILKEMTHSWPPPLTAIHTPSTAEPSKFPFPTKVIP

SEQ ID NO: 860078 - protein, 194 aa, Homo sapiens
GDHCASVTDSAPERELSPLISLPSPVPPLSPIHSNQQTLPRTQGSSKVHGSSNNSKGYCPAKSPKDLAVKVHDKETPQDSLVAPAQPPSQTFPPPSLPSKSVAMQQKPTAYVRPMDGQDQAPSESPELKPLPEDYRQQTFEKTDLKVPAKAKLTKLKMPSQSVEVCGISYLGEFQFEDGFEMKMSGGCGARWGG

SEQ ID NO: 860079 - protein, 84 aa, Homo sapiens
PASERRARAAPAHSAAACARCGRSCTFASAVPQPSPGRRRSPASSALAPFPTATGQGRAEVTRAPDPGLEDGRVWKMNRLATLH

SEQ ID NO: 860080 - protein, 399 aa, Homo sapiens
MAAQSSLYNDDRNLLRIREKERRNQEAHQEKEAFPEKIPLFGEPYKTAKGDELSSRIQNMLGNYEEVKEFLSTKSHTHRLDASENRLGKPKYPLIPDKGSSIPSSSFHTSVHHQSIHTPASGPLSVGNISHNPKMAQPRTEPMPSLHAKSCGPPDSQHLTQDRLGQEGFGSSHHKKGDRRADGDHCASVTDSAPERELSPLISLPSPVPPLSPIHSNQQTLPRTQGSSKVHGSSNNSKGYCPAKSPKDLAVKVHDKETPQDSLVAPAQPPSQTFPPPSLPSKSVAMQQKPTAYVRPMDGQDQAPSESPELKPLPEDYRQQTFEKTDLKVPAKAKLTKLKMPSQSVEQTYSNEVHCVEEILKEKPPPVNKQENAGTLNILSTLSNGNSSKQKIPADGVHR

SEQ ID NO: 860081 - protein, 493 aa, Homo sapiens
LRSSWEYRHAPPSPANFVFLVEMGFLHVGQDGLELQTSGDPPASASQSAGITGVSHPVRLNCYQVLKAIAGSSNLVTDLIYEEKIPGVNILSKGTQADKGLYNDDRNLLRIREKERRNQEAHQEKEAFPEKIPLFGEPYKTAKGDELSSRIQNMLGNYEEVKEFLSTKSHTHRLDASENRLGKPKYPLIPDKGSSIPSSSFHTSVHHQSIHTPASGPLSVGNISHNPKMAQPRTEPMPSLHAKSCGPPDSQHLTQDRLGQEGFGSSHHKKGDRRADGDHCASVTDSAPERELSPLISLPSPVPPLSPIHSNQQTLPRTQGSSKVHGSSNNSKGYCPAKSPKDLAVKVHDKETPQDSLVAPAQPPSQTFPPPSLPSKSVAMQQKPTAYVRPMDGQDQAPSESPELKPLPEDYRQQTFEKTDLKVPAKAKLTKLKMPSQSVEQTYSNEVHCVEEILKEKPPPVNKQENAGTLNILSTLSNGNSSKQKIPADGVHR

SEQ ID NO: 860082 - protein, 454 aa, Homo sapiens
MAFTERVNSSGNSLYNDDRNLLRIREKERRNQEAHQEKEAFPEKIPLFGEPYKTAKGDELSSRIQNMLGNYEEVKEFLSTKSHTHRLDASENRLGKPKYPLIPDKGSSIPSSSFHTSVHHQSIHTPASGPLSVGNISHNPKMAQPRTEPMPSLHAKSCGPPDSQHLTQDRLGQEGFGSSHHKKGDRRADGDHCASVTDSAPERELSPLISLPSPVPPLSPIHSNQQTLPRTQGSSKVHGSSNNSKGYCPAKSPKDLAVKVHDKETPQDSLVAPAQPPSQTFPPPSLPSKSVAMQQKPTAYVRPMDGQDQAPSESPELKPLPEDYRQQTFEKTDLKVPAKAKLTKLKMPSQSVEQTYSNEVHCVEEILKEMTHSWPPPLTAIHTPSTAEPSKFPFPTKDSQHVSSVTQNQKQYDTSSKTHSNSQQGTSSMLEDDLQLSDSEDSDSEQTPEKPLNH

SEQ ID NO: 860083 - protein, 194 aa, Homo sapiens
MAASLVGKKIVFVTGNAKKLEEVVQILGDKFPCTLVAQKIDLPEYQGEPDEISIQKCQEAVRQVQGPVLVEDTCLCFNALGGLPGPYIKWFLEKLKPEGLHQLLAGFEDKSAYALCTFALSTGDPSQPVRLFRGRTSGRIVAPRGCQDFGWDPCFQPDGYEQTYAEMPKAEKNAVSHRFRALLELQEYFGSLAA

SEQ ID NO: 860084 - protein, 194 aa, Homo sapiens; identical to SEQ ID NO: 860083

SEQ ID NO: 860085 - protein, 194 aa, Homo sapiens; identical to SEQ ID NO: 860083

SEQ ID NO: 860086 - protein, 229 aa, Homo sapiens
MPTRPIRALGSGSAFPGTPGRKLSRSLPPPAGSFLSLDAKEFSVAQLGNRGSPWRPHVVQILGDKFPCTLVAQKIDLPEYQGEPDEISIQKCQEAVRQVQGPVLVEDTCLCFNALGGLPGPYIKWFLEKLKPEGLHQLLAGFEDKSAYALCTFALSTGDPSQPVRLFRGRTSGRIVAPRGCQDFGWDPCFQPDGYEQTYAEMPKAEKNAVSHRFRALLELQEYFGSLAA

SEQ ID NO: 860087 - protein, 236 aa, Homo sapiens
MHHHAQLILYFLVEMGFLHVGQAGFKLLTSGDPLASASQSAGITGVSHRAFPHFDEHQNGLRSLVVQILGDKFPCTLVAQKIDLPEYQGEPDEISIQKCQEAVRQVQGPVLVEDTCLCFNALGGLPGPYIKWFLEKLKPEGLHQLLAGFEDKSAYALCTFALSTGDPSQPVRLFRGRTSGRIVAPRGCQDFGWDPCFQPDGYEQTYAEMPKAEKNAVSHRFRALLELQEYFGSLAA

SEQ ID NO: 860088 - protein, 110 aa, Homo sapiens
MRSARLHSAPGTQASPCACSGAGPRAGSWHPEAARTLAGTPAFSLMDMSRRTQRCLRRRRTLSPIASGPCWSCRSTLAVWQLDFCSWRRPLRPGIWGGLAQNLPHRAGTP

SEQ ID NO: 860089 - protein, 110 aa, Homo sapiens; identical to SEQ ID NO: 860088

SEQ ID NO: 860090 - protein, 110 aa, Homo sapiens; identical to SEQ ID NO: 860088

SEQ ID NO: 860091 - protein, 87 aa, Homo sapiens
TDSPNSYWPLPSSCLSSGPSYTPVPPFLWQGRIVAPRGCQDFGWDPCFQPDGYEQTYAEMPKAEKNAVSHRFRALLELQEYFGSLAA

SEQ ID NO: 860092 - protein, 194 aa, Homo sapiens; identical to SEQ ID NO: 860083

SEQ ID NO: 860093 - protein, 110 aa, Homo sapiens; identical to SEQ ID NO: 860088

SEQ ID NO: 860094 - protein, 110 aa, Homo sapiens; identical to SEQ ID NO: 860088

SEQ ID NO: 860095 - protein, 153 aa, Homo sapiens
MAASLVGKKIVFVTGNAKKLEEVQGPVLVEDTCLCFNALGGLPGPYIKWFLEKLKPEGLHQLLAGFEDKSAYALCTFALSTGDPSQPVRLFRGRTSGRIVAPRGCQDFGWDPCFQPDGYEQTYAEMPKAEKNAVSHRFRALLELQEYFGSLAA

SEQ ID NO: 860096 - protein, 182 aa, Homo sapiens
MARLLWLLRGLTLGTAPRRAVRGQAGGGGPGTGPGLGEAGSLATCELPLAKSEWQKKLTPEQFYVTREKGTEPPFSGIYLNNKEAGMYHCVCCDSPLFSSEKKYCSGTGWPSFSEAHGTSGSDESHTGILRRLDTSLGSARTEVVCKQCEAHLGHVFPDGPGPNGQRFCINSVALKFKPRKH

SEQ ID NO: 860097 - protein, 115 aa, Homo sapiens
YLIYFQPFSGIYLNNKEAGMYHCVCCDSPLFSSEKKYCSGTGWPSFSEAHGTSGSDESHTGILRRLDTSLGSARTEVVCKQCEAHLGHVFPDGPGPNGQRFCINSVALKFKPRKH

SEQ ID NO: 860098 - protein, 182 aa, Homo sapiens; identical to SEQ ID NO: 860096

SEQ ID NO: 860099 - protein, 124 aa, Homo sapiens [sequence omitted]

SEQ ID NO: 860100 - protein, 159 aa, Homo sapiens
MARLLWLLRGLTLGTAPRRAVRGQAGGGGPGTGPGLGEAGSLATCELPLAKSEWQKKLTPEQFYVTREKGTEPPFSGIYLNNKEAGMYHCVCCDSPLFRSLLDIQKEVFSIKGSRSPSTSRGNGFDSEVLRKSTALALGGLRFPRLMVRLALMKATQGS

SEQ ID NO: 860101 - protein, 113 aa, Homo sapiens
MARLLWLLRGLTLGTAPRRAVRGQAGGGGPGTGPGLGEAGRTRVPQAPPPPTAFGFISPAAPGSLGPVQAGRCPPTKPSSARPSPPPARGSGTVDCKLGGGRVGTDPCENPRK

SEQ ID NO: 860102 - protein, 182 aa, Homo sapiens; identical to SEQ ID NO: 860096

SEQ ID NO: 860103 - protein, 103 aa, Homo sapiens
MARLLWLLRGLTLGTAPRRAVRGQAGGGGPGTGPGLGEAGSLATCELPLAKSEWQKKLTPEQFYVTREKGTEPPFSGIYLNNKEAGMYHCVCCDSPLFSVKLI

SEQ ID NO: 860104 - protein, 182 aa, Homo sapiens; identical to SEQ ID NO: 860096

SEQ ID NO: 860105 - protein, 159 aa, Homo sapiens; identical to SEQ ID NO: 860100

SEQ ID NO: 860106 - protein, 420 aa, Homo sapiens
MSLKFTNAKRIEGLDSNVWIEFTKLAADPSVVNLGQGFPDISPPTYVKEELSKIAAIDSLNQYTRGFGHPSLVKALSYLYEKLYQKQIDSNKEILVTVGAYGSLFNTIQALIDEGDEVILIVPFYDCYEPMVRMAGATPVFIPLRSKPVYGKRWSSSDWTLDPQELESKFNSKTKAIILNTPHNPLGKVYNREELQVIADLCIKYDTLCISDEVYEWLVYSGNKHLKIATFPGMWERTITIGSAGKTFSVTGWKLGWSIGPNHLIKHLQTVQQNTIYTCATPLQEALAQAFWIDIKRMDDPECYFNSLPKELEVKRDRMVRLLESVGLKPIVPDGGYFIIADVSLLDPDLSDMKNNEPYDYKFVKWMTKHKKLSAIPVSAFCNSETKSQFEKFVRFCFIKKDSTLDAAEEIIKAWSVQKS

SEQ ID NO: 860107 - protein, 454 aa, Homo sapiens
MFLAQRSLCSLSGRAKFLKTISSSKILGFSTSAKMSLKFTNAKRIEGLDSNVWIEFTKLAADPSVVNLGQGFPDISPPTYVKEELSKIAAIDSLNQYTRGFGHPSLVKALSYLYEKLYQKQIDSNKEILVTVGAYGSLFNTIQALIDEGDEVILIVPFYDCYEPMVRMAGATPVFIPLRSKPVYGKRWSSSDWTLDPQELESKFNSKTKAIILNTPHNPLGKVYNREELQVIADLCIKYDTLCISDEVYEWLVYSGNKHLKIATFPGMWERTITIGSAGKTFSVTGWKLGWSIGPNHLIKHLQTVQQNTIYTCATPLQEALAQAFWIDIKRMDDPECYFNSLPKELEVKRDRMVRLLESVGLKPIVPDGGYFIIADVSLLDPDLSDMKNNEPYDYKFVKWMTKHKKLSAIPVSAFCNSETKSQFEKFVRFCFIKKDSTLDAAEEIIKAWSVQKS

SEQ ID NO: 860108 - protein, 402 aa, Homo sapiens
MSLKFTNAKRIEGLDSNVWIEFTKLAADPSVVNLGQGFPDISPPTYVKEELSKIAAIDSLNQYTRGFGHPSLVKALSYLYEKLYPLFNTIQALIDEGDEVILIVPFYDCYEPMVRMAGATPVFIPLRSKPVYGKRWSSSDWTLDPQELESKFNSKTKAIILNTPHNPLGKVYNREELQVIADLCIKYDTLCISDEVYEWLVYSGNKHLKIATFPGMWERTITIGSAGKTFSVTGWKLGWSIGPNHLIKHLQTVQQNTIYTCATPLQEALAQAFWIDIKRMDDPECYFNSLPKELEVKRDRMVRLLESVGLKPIVPDGGYFIIADVSLLDPDLSDMKNNEPYDYKFVKWMTKHKKLSAIPVSAFCNSETKSQFEKFVRFCFIKKDSTLDAAEEIIKAWSVQKS

SEQ ID NO: 860109 - protein, 420 aa, Homo sapiens; identical to SEQ ID NO: 860106

SEQ ID NO: 860110 - protein, 405 aa, Homo sapiens
MSLKFTNAKRIEGLDSNVWIEFTKLAADPSVVNLGQGFPDISPPTYVKEELSKIAAIDSLNQYTRGFGHPSLVKALSYLYEKLYQKQIDSNKEILVTVGAYGSLFNTIQALIDEGDEVILIVPFYDCYEPMKPVYGKRWSSSDWTLDPQELESKFNSKTKAIILNTPHNPLGKVYNREELQVIADLCIKYDTLCISDEVYEWLVYSGNKHLKIATFPGMWERTITIGSAGKTFSVTGWKLGWSIGPNHLIKHLQTVQQNTIYTCATPLQEALAQAFWIDIKRMDDPECYFNSLPKELEVKRDRMVRLLESVGLKPIVPDGGYFIIADVSLLDPDLSDMKNNEPYDYKFVKWMTKHKKLSAIPVSAFCNSETKSQFEKFVRFCFIKKDSTLDAAEEIIKAWSVQKS

SEQ ID NO: 860111 - protein, 420 aa, Homo sapiens; identical to SEQ ID NO: 860106

SEQ ID NO: 860112 - protein, 237 aa, Homo sapiens
MSLKFTNAKRIEGLDSNVWIEFTKLAADPSVVNLGQGFPDISPPTYVKEELSKIAAIDSLNQYTRGFGHPSLVKALSYLYEKLYQKQIDSNKEILVTVGAYGSLFNTIQALIDEGDEVILIVPFYDCYEPMVRMAGATPVFIPLRSKPVYGKRWSSSDWTLDPQELESKFNSKTKAIILNTPHNPLGKVYNREELQVIADLCIKYDTLCISDEVYEWGVLEKLKKYFQVGRTTGIGK

SEQ ID NO: 860113 - protein, 420 aa, Homo sapiens; identical to SEQ ID NO: 860106

SEQ ID NO: 860114 - protein, 396 aa, Homo sapiens
MFLAQRSLCSLSGRAKFLKTISSSKILGFSTSAKMSLKFTNAKRIEGLDSNVWIEFTKLAADPSVVNLGQGFPDISPPTYVKEELSKIAAIDSVILIVPFYDCYEPMVRMAGATPVFIPLRSKPVYGKRWSSSDWTLDPQELESKFNSKTKAIILNTPHNPLGKVYNREELQVIADLCIKYDTLCISDEVYEWLVYSGNKHLKIATFPGMWERTITIGSAGKTFSVTGWKLGWSIGPNHLIKHLQTVQQNTIYTCATPLQEALAQAFWIDIKRMDDPECYFNSLPKELEVKRDRMVRLLESVGLKPIVPDGGYFIIADVSLLDPDLSDMKNNEPYDYKFVKWMTKHKKLSAIPVSAFCNSETKSQFEKFVRFCFIKKDSTLDAAEEIIKAWSVQKS

SEQ ID NO: 860115 - protein, 420 aa, Homo sapiens; identical to SEQ ID NO: 860106

SEQ ID NO: 860116 - protein, 32 aa, Homo sapiens
MQNTSIAPKRFLKFLCSPSLTLLICLCHHILV

SEQ ID NO: 860117 - protein, 1051 aa, Homo sapiens
PFRSRSACALLLGSPWFPGVLPLQAGAGAEDPALRGCRTMRWGLRPRGPGAAALATARSLWGTPRLPCSPGWQGATKRLLVRSVSGASNHQPNSNSGRYRDTVLLPQTSFPMKLLGRQQPDTELEIQQKCGFSELYSWQRERKVKTEFCLHDGPPYANGDPHVGHALNKILKDIANRFHMMNGSKIHFVPGWDCHGLPIEIKVLSELGREAQNLSAMEIRKKARSFAKAAIEKQKSAFIRWGIMADWNNCYYTFDGKYEAKQLRTFYQMYDKGLVYRSYKPVFWSPSSRTALAEAELEYNPEHVSRSIYVKFPLLKPSPKLASLIDGSSPVSILVWTTQPWTIPANEAVCYMPESKYAVVKCSKSGDLYVLAADKVASVASTLETTFETISTLSGVDLENGTCSHPLIPDKASPLLPANHVTMAKGTGLVHTAPAHGMEDYGVASQHNLPMDCLVDEDGVFTDVAGPELQNKAVLEEGTDVVIKMLQTAKNLLKEEKLVHSYPYDWRTKKPVVIRASKQWFINITDIKTAAKELLKKVKFIPGSALNGMVEMMDRRPYWCISRQRVWGVPIPVFHHKTKDEYLINSQTTEHIVKLVEQHGSDIWWTLPPEQLLPKEVLSEVGGPDALEYVPGQDILDIWFDSGTSWSYVLPGPDQRADLYLEGKDQLGGWFQSSLLTSVAARKRAPYKTVIVHGFTLGEKGEKMSKSLGNVIHPDVVVNGGQDQSKEPPYGADVLRWWVADSNVFTEVAIGPSVLNAARDDISKLRNTLRFLLGNVADFNPETDSIPVNDMYVIDQYMLHLLQDLANKITELYKQYDFGKVVRLLRTFYTRELSNFYFSIIKDRLYCEKENDPKRRSCQTALVEILDVIVRSFAPILPHLAEEVFQHIPYIKEPKSVFRTGWISTSSIWKKPGLEEAVESACAMRDSFLGSIPGKNAAEYKVITVIEPGLLFEIIEMLQSEETSSTSQLNELMMASESTLLAQEPREMTADVIELKGKFLINLEGGDIREESSYKVIVMPTTKEKCPRCWKYTAESSDTLCPRCAEVVSGK

SEQ ID NO: 860118 - protein, 1051 aa, Homo sapiens; identical to SEQ ID NO: 860117

SEQ ID NO: 860119 - protein, 1025 aa, Homo sapiens
PFRSRSACALLLGSPWFPGVLPLQAGAGAEDPALRGCRTMRWGLRPRGPGAAALATARSLWGTPRLPCSPGWQGATKRLLVRSVSGASNHQPNSNSGRYRDTVLLPQTSFPMKLLGRQQPDTELEIQQKCGFSELYSWQRERKVKTEFCLHDGPPYANGDPHVGHALNKILKDIANRFHMMNGSKIHFVPGWDCHGLPIEIKVLSELGREAQNLSAMEIRKKARSFAKAAIEKQKSAFIRWGIMADWNNCYYTFDGKYEAKQLRTFYQMYDKGLVYRSYKPVFWSPSSRTALAEAELEYNPEHVSRSIYVKFPLLKPSPKLASLIDGSSPVSILVWTTQPWTIPANEAVCYMPESKYAVVKCSKSGDLYVLAADKVASVASTLETTFETISTLSGVDLENGTCSHPLIPDKASPLLPANHVTMAKGTGLVHTAPAHGMEDYGVASQHNLPMDCLVDEDGVFTDVAGPELQNKAVLEEGTDVVIKMLQTAKNLLKEEKLVHSYPYDWRTKKPVVIRASKQWFINITDIKTAAKWCISRQRVWGVPIPVFHHKTKDEYLINSQTTEHIVKLVEQHGSDIWWTLPPEQLLPKEVLSEVGGPDALEYVPGQDILDIWFDSGTSWSYVLPGPDQRADLYLEGKDQLGGWFQSSLLTSVAARKRAPYKTVIVHGFTLGEKGEKMSKSLGNVIHPDVVVNGGQDQSKEPPYGADVLRWWVADSNVFTEVAIGPSVLNAARDDISKLRNTLRFLLGNVADFNPETDSIPVNDMYVIDQYMLHLLQDLANKITELYKQYDFGKVVRLLRTFYTRELSNFYFSIIKDRLYCEKENDPKRRSCQTALVEILDVIVRSFAPILPHLAEEVFQHIPYIKEPKSVFRTGWISTSSIWKKPGLEEAVESACAMRDSFLGSIPGKNAAEYKVITVIEPGLLFEIIEMLQSEETSSTSQLNELMMASESTLLAQEPREMTADVIELKGKFLINLEGGDIREESSYKVIVMPTTKEKCPRCWKYTAESSDTLCPRCAEVVSGK

SEQ ID NO: 860120 - protein, 261 aa, Homo sapiens
MYVIDQYMLHLLQDLANKITELYKQYDFGKVVRLLRTFYTRELSNFYFSIIKDRLYCEKENDPKRRSCQTALVEILDVIVRSFAPILPHLAEEVFQHIPYIKEPKSVFRTGWISTSSIWKKPGLEEAVESACAMRDSFLGSIPGKNAAEYKVITVIEPGLLFEIIEMLQSEETSSTSQLNELMMASESTLLAQEPREMTADVIELKGKFLINLEGGDIREESSYKVIVMPTTKEKCPRCWKYTAESSDTLCPRCAEVVSGK

SEQ ID NO: 860121 - protein, 779 aa, Homo sapiens
PFRSRSACALLLGSPWFPGVLPLQAGAGAEDPALRGCRTMRWGLRPRGPGAAALATARSLWGTPRLPCSPGWQGATKRLLVRSVSGASNHQPNSNSGRYRDTVLLPQTSFPMKLLGRQQPDTELEIQQKCGFSELYSWQRERKVKTEFCLHDGPPYANGDPHVGHALNKILKDIANRFHMMNGSKIHFVPGWDCHGLPIEIKVLSELGREAQNLSAMEIRKKARSFAKAAIEKQKSAFIRWGIMADWNNCYYTFDGKYEAKQLRTFYQMYDKGLVYRSYKPVFWSPSSRTALAEAELEYNPEHVSRSIYVKFPLLKPSPKLASLIDGSSPVSILVWTTQPWTIPANEAVCYMPESKYAVVKCSKSGDLYVLAADKVASVASTLETTFETISTLSGVDLENGTCSHPLIPDKASPLLPANHVTMAKGTGLVHTAPAHGMEDYGVASQHNLPMDCLVDEDGVFTDVAGPELQNKAVLEEGTDVVIKMLQTAKNLLKEEKLVHSYPYDWRTKKPVVIRASKQWFINITDIKTAAKELLKKVKFIPGSALNGMVEMMDRRPYWCISRQRVWGVPIPVFHHKTKDEYLINSQTTEHIVKLVEQHGSDIWWTLPPEQLLPKEVLSEVGGPDALEYVPGQDILDIWFDSGTSWSYVLPGPDQRADLYLEGKDQLGGWFQSSLLTSVAARKRAPYKTVIVHGFTLGEKGEKMSKSLGNVIHPDVVVNGGQDQSKEPPYGADVLRWWVADSNVFTEVAIGPSVLNAARDDISKWDYFGFLFWENLGCF

SEQ ID NO: 860122 - protein, 690 aa, Homo sapiens
PFRSRSACALLLGSPWFPGVLPLQAGAGAEDPALRGCRTMRWGLRPRGPGAAALATARSLWGTPRLPCSPGWQGATKRLLVRSVSGASNHQPNSNSGRYRDTVLLPQTSFPMKLLGRQQPDTELEIQQKCGFSELYSWQRERKVKTEFCLHDGPPYANGDPHVGHALNKILKDIANRFHMMNGSKIHFVPGWDCHGLPIEIKVLSELGREAQNLSAMEIRKKARSFAKAAIEKQKSAFIRWGIMADWNNCYYTFDGKYEAKQLRTFYQMYDKGLVYRSYKPVFWSPSSRTALAEAELEYNPEHVSRSIYVKFPLLKPSPKLASLIDGSSPVSILVWTTQPWTIPANEAVCYMPESKYAVVKCSKSGDLYVLAADKVASVASTLETTFETISTLSGVDLENGTCSHPLIPDKASPLLPANHVTMAKGTGLVHTAPAHGMEDYGVASQHNLPMDCLVDEDGVFTDVAGPELQNKAVLEEGTDVVIKMLQTAKNLLKEEKLVHSYPYDWRTKKPVVIRASKQWFINITDIKTAAKELLKKVKFIPGSALNGMVEMMDRRPYWCISRQRVWGVPIPVFHHKTKDEYLINSQTTEHIVKLVEQHGSDIWWTLPPEQLLPKEVLSEVGGPDALEYVPGQDILDIWFDSGTSWSYVLPGPDQRADLYLEGKDQLGGWFQSSLLTSVAARKRAPYNVL

SEQ ID NO: 860123 - protein, 545 aa, Homo sapiens
PFRSRSACALLLGSPWFPGVLPLQAGAGAEDPALRGCRTMRWGLRPRGPGAAALATARSLWGTPRLPCSPGWQGATKRLLVRSVSGASNHQPNSNSGRYRDTVLLPQTSFPMKLLGRQQPDTELEIQQKCGFSELYSWQRERKVKTEFCLHDGPPYANGDPHVGHALNKILKDIANRFHMMNGSKIHFVPGWDCHGLPIEIKVLSELGREAQNLSAMEIRKKARSFAKAAIEKQKSAFIRWGIMADWNNCYYTFDGKYEAKQLRTFYQMYDKGLVYRSYKPVFWSPSSRTALAEAELEYNPEHVSRSIYVKFPLLKPSPKLASLIDGSSPVSILVWTTQPWTIPANEAVCYMPESKYAVVKCSKSGDLYVLAADKVASVASTLETTFETISTLSGVDLENGTCSHPLIPDKASPLLPANHVTMAKGTGLVHTAPAHGMEDYGVASQHNLPMDCLVDEDGVFTDVAGPELQNKAVLEEGTDVVIKMLQTAKNLLKEEKLVHSYPYDWRTKKPVVIRASKQWFINITDIKTAAKNGKKIILTPDAGE

SEQ ID NO: 860124 - protein, 1033 aa, Homo sapiens
PFRSRSACALLLGSPWFPGVLPLQAGAGAEDPALRGCRTMRWGLRPRGPGAAALATARSLWGTPRLPCSPGWQGATKRLLVRSVSGASNHQPNSNSGRYRDTVLLPQTSFPMKLLGRQQPDTELEIQQKCGFSELYSWQRERKVKTEFCLHDGPPYANGDPHVGHALNKILKDIANRFHMMNGSKIHFVPGWDCHGLPIEIKVLSELGREAQNLSAMEIRKKARSFAKAAIEKQKSAFIRWGIMADWNNCYYTFDGKYEAKQLRTFYQMYDKGLVYRSYKPVFWSPSSRTALAEAELEYNPEHVSRSIYVKFPLLKPSPTQPWTIPANEAVCYMPESKYAVVKCSKSGDLYVLAADKVASVASTLETTFETISTLSGVDLENGTCSHPLIPDKASPLLPANHVTMAKGTGLVHTAPAHGMEDYGVASQHNLPMDCLVDEDGVFTDVAGPELQNKAVLEEGTDVVIKMLQTAKNLLKEEKLVHSYPYDWRTKKPVVIRASKQWFINITDIKTAAKELLKKVKFIPGSALNGMVEMMDRRPYWCISRQRVWGVPIPVFHHKTKDEYLINSQTTEHIVKLVEQHGSDIWWTLPPEQLLPKEVLSEVGGPDALEYVPGQDILDIWFDSGTSWSYVLPGPDQRADLYLEGKDQLGGWFQSSLLTSVAARKRAPYKTVIVHGFTLGEKGEKMSKSLGNVIHPDVVVNGGQDQSKEPPYGADVLRWWVADSNVFTEVAIGPSVLNAARDDISKLRNTLRFLLGNVADFNPETDSIPVNDMYVIDQYMLHLLQDLANKITELYKQYDFGKVVRLLRTFYTRELSNFYFSIIKDRLYCEKENDPKRRSCQTALVEILDVIVRSFAPILPHLAEEVFQHIPYIKEPKSVFRTGWISTSSIWKKPGLEEAVESACAMRDSFLGSIPGKNAAEYKVITVIEPGLLFEIIEMLQSEETSSTSQLNELMMASESTLLAQEPREMTADVIELKGKFLINLEGGDIREESSYKVIVMPTTKEKCPRCWKYTAESSDTLCPRCAEVVSGK

SEQ ID NO: 860125 - protein, 1051 aa, Homo sapiens; identical to SEQ ID NO: 860117

SEQ ID NO: 860126 - protein, 250 aa, Homo sapiens
SSAHAAYPNCTNTDLLVNDVHTAEAVEADLVETLFARPVYGDSGVCMHTPKPKRRSCQTALVEILDVIVRSFAPILPHLAEEVFQHIPYIKEPKSVFRTGWISTSSIWKKPGLEEAVESACAMRDSFLGSIPGKNAAEYKVITVIEPGLLFEIIEMLQSEETSSTSQLNELMMASESTLLAQEPREMTADVIELKGKFLINLEGGDIREESSYKVIVMPTTKEKCPRCWKYTAESSDTLCPRCAEVVSGK

SEQ ID NO: 860127 - protein, 688 aa, Homo sapiens
PFRSRSACALLLGSPWFPGVLPLQAGAGAEDPALRGCRTMRWGLRPRGPGAAALATARSLWGTPRLPCSPGWQGATKRLLVRSVSGASNHQPNSNSGRYRDTVLLPQTSFPMKLLGRQQPDTELEIQQKCGFSELYSWQRERKVKTEFCLHDGPPYANGDPHVGHALNKILKDIANRFHMMNGSKIHFVPGWDCHGLPIEIKVLSELGREAQNLSAMEIRKKARSFAKAAIEKQKSAFIRWGIMADWNNCYYTFDGKYEAKQLRTFYQMYDKGLVYRSYKPVFWSPSSRTALAEAELEYNPEHVSRSIYVKFPLLKPSPKLASLIDGSSPVSILVWTTQPWTIPANEAVCYMPESKYAVVKCSKSGDLYVLAADKVASVASTLETTFETISTLSGVDLENGTCSHPLIPDKASPLLPANHVTMAKGTGLVHTAPAHGMEDYGVASQHNLPMDCLVDEDGVFTDVAGPELQNKAVLEEGTDVVIKMLQTAKNLLKEEKLVHSYPYDWRTKKPVVIRASKQWFINITDIKTAAKELLKKVKFIPGSALNGMVEMMDRRPYWCISRQRVWGVPIPVFHHKTKDEYLINSQTTEHIVKLVEQHGSDIWWTLPPEQLLPKEVLSEVGGPDALEYVPGQDILDIWFDSGTSWSYVLPGPDQRADLYLEGKDQLGGWFQSSLLTSVAARKRAPYK

SEQ ID NO: 860128 - protein, 534 aa, Homo sapiens
PFRSRSACALLLGSPWFPGVLPLQAGAGAEDPALRGCRTMRWGLRPRGPGAAALATARSLWGTPRLPCSPGWQGATKRLLVRSVSGASNHQPNSNSGRYRDTVLLPQTSFPMKLLGRQQPDTELEIQQKCGFSELYSWQRERKVKTEFCLHDGPPYANGDPHVGHALNKILKDIANRFHMMNGSKIHFVPGWDCHGLPIEIKVLSELGREAQNLSAMEIRKKARSFAKAAIEKQKSAFIRWGIMADWNNCYYTFDGKYEAKQLRTFYQMYDKGLVYRSYKPVFWSPSSRTALAEAELEYNPEHVSRSIYVKFPLLKPSPKLASLIDGSSPVSILVWTTQPWTIPANEAVCYMPESKYAVVKCSKSGDLYVLAADKVASVASTLETTFETISTLSGVDLENGTCSHPLIPDKASPLLPANHVTMAKGTGLVHTAPAHGMEDYGVASQHNLPMDCLVDEDGVFTDVAGPELQNKAVLEEGTDVVIKMLQTAKNLLKEEKLVHSYPYDWRTKKPVVIRASKQWFINITDIKTAAKNC

SEQ ID NO: 860129 - protein, 296 aa, Homo sapiens
MARAAALLPSRSPPTPLLWPLLLLLLLETGAQDVRVQVLPEVRGQLGGTVELPCHLLPPVPGLYISLVTWQRPDAPANHQNVAASHFLGTWREVEQHTGLLPSLGLHGEPGELSSGDPERTPAPRDLVLAPAFPWPRDTQELINALEENKNKKKKPRKKNTHSRALWAFQSPYISHYKAYQALGTHPPGTDALGPKTPPSLIAPEIPIPHKGIFGHRVATVPSQKTLHISLARWKISGNLCAPTAVPPRGYTVCRLGQFRGVTPVCKSPVMLRQKLSPVEEPPVYAGAEGVRLKPP

SEQ ID NO: 860130 - protein, 88 aa, Homo sapiens
RGSPNSSSRTDGVTVTCKVEHESFEEPALIPVTLSVRCECIGGDPSPIKTAYTGFSKALSTLSLNVVYVGSLKPNSALPSCHCLHWLP

SEQ ID NO: 860131 - protein, 479 aa, Homo sapiens
MARAAALLPSRSPPTPLLWPLLLLLLLETGAQDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPRASPRDVGPLVWGAVGGTLLVLLLLAGGSLAFILLRVRRRRKSPGGAGGGASGDGGFYDPKAQVLGNGDPVFWTPVVPGPMEPDGKDEEEEEEEEKAEKGLMLPPPPALEDDMESQLDGSLISRRAVYV

SEQ ID NO: 860132 - protein, 538 aa, Homo sapiens
MARAAALLPSRSPPTPLLWPLLLLLLLETGAQDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGGIIGGIIAAIIATAVAATGILICRQQRKEQTLQGAEEDEDLEGPPSYKPPTPKAKLEAQEMPSQLFTLGASEHSPLKTPYFDAGASCTEQEMPRYHELPTLEERSGPLHPGATSLGSPIPVPPGPPAVEDVSLDLEDEEGEEEEEYLDKINPIYDALSYSSPSDSYQGKGFVMSRAMYV

SEQ ID NO: 860133 - protein, 538 aa, Homo sapiens; identical to SEQ ID NO: 860132

SEQ ID NO: 860134 - protein, 369 aa, Homo sapiens
MARAAALLPSRSPPTPLLWPLLLLLLLETGAQDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRALEDDMESQLDGSLISRRAVYV

SEQ ID NO: 860135 - protein, 290 aa, Homo sapiens
MARAAALLPSRSPPTPLLWPLLLLLLLETGAQDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSAWGARGAE

SEQ ID NO: 860136 - protein, 150 aa, Homo sapiens
MRLCGGLDDSDLVVSLLLLATEPDSVLEAHEMPSQLFTLGASEHSPLKTPYFDAGASCTEQEMPRYHELPTLEERSGPLHPGATSLGSPIPVPPGPPAVEDVSLDLEDEEGEEEEEYLDKINPIYDALSYSSPSDSYQGKGFVMSRAMYV

SEQ ID NO: 860137 - protein, 170 aa, Homo sapiens
EAGFESAEAVDSLFNTTFVCTVTNAVGMGRAEQVIFVRETPRASPRDVGPLVWGAVGGTLLVLLLLAGGSLAFILLRVRRRRKSPGGAGGGASGDGGFYDPKAQVLGNGDPVFWTPVVPGPMEPDGKDEEEEEEEEKAEKGLMLPPPPALEDDMESQLDGSLISRRAVYV

SEQ ID NO: 860138 - protein, 173 aa, Homo sapiens
MGCSTLELRQNQQEKLANHSCSTSTIPQGNTGLRPRHQLLRATPGSSSHFEEGSPPRTFTTTTKSEPDKDTIYEQQARDKHRMTLEITHITQVTTIWHHNMVQLATTTAHWQQTIESKPDPQWQGVPTEKHIPKQGKTGHQNRTNCVTPKYTANTEVEPIRNPRRIGRNERNQ

SEQ ID NO: 860139 - protein, 538 aa, Homo sapiens; identical to SEQ ID NO: 860132

SEQ ID NO: 860140 - protein, 443 aa, Homo sapiens
MARAAALLPSRSPPTPLLWPLLLLLLLETGAQDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGGIIGGIIAAIIATAVAATGILICRQQRKEQTLQGAEEDEEKCLDTMSCPPWKNGQDPCTLEPQAWGPPSRCLQGHLLWKTFPWI

SEQ ID NO: 860141 - protein, 538 aa, Homo sapiens; identical to SEQ ID NO: 860132

SEQ ID NO: 860142 - protein, 479 aa, Homo sapiens; identical to SEQ ID NO: 860131

SEQ ID NO: 860143 - protein, 506 aa, Homo sapiens
MARAAALLPSRSPPTPLLWPLLLLLLLETGAQDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGGIIGGIIAAIIATAVAATGILICRQQRKEQTLQGAEEDEDLEGPPSYKPPTPKAKLEAQEMPSQLFTLGASEHSPLKTPYFDAGASCTEQKCSIHELPLGEVGPALGPSWVPLRAPGLVGTFLFRWGGGNLDPFFCLPVSECCRFCP

SEQ ID NO: 860144 - protein, 390 aa, Homo sapiens [sequence omitted]

SEQ ID NO: 860145 - protein, 165 aa, Homo sapiens
MYELGLIGTEVHFVCTVTNAVGMGRAEQVIFVRETPRASPRDVGPLVWGAVGGTLLVLLLLAGGSLAFILLRVRRRRKSPGGAGGGASGDGGFYDPKAQVLGNGDPVFWTPVVPGPMEPDGKDEEEEEEEEKAEKGLMLPPPPALEDDMESQLDGSLISRRAVYV

SEQ ID NO: 860146 - protein, 139 aa, Homo sapiens [sequence omitted]

SEQ ID NO: 860147 - protein, 239 aa, Homo sapiens
TTLVPLKTPVCGVKKKAAVRESGSMSQSCHMLVMTISVGYFGLSLDTPNLHGDIFVNCFLSAMVEVPAYVLAWLLLQYLPRRYSMATALFLGGSVLLFMQLVPPDLYYLATVLVMVGKFGVTAAFSMVYVYTAELYPTVVRNMGVGVSSTASRLGSILSPYFVYLGAYDRFLPYILMGSLTILTAILTLFLPESFGTPLPDTIDQMLRVKGMKHRKTPSHTRMLKDGQERPTILKSTAF

SEQ ID NO: 860148 - protein, 365 aa, Homo sapiens
MRDYDEVTAFLGEWGPFQRLIFFLLSASIIPNGFTGLSSVFLIATPEHRCRVPDAANLSSAWRNHTVPLRLRDGREVPHSCRRYRLATIANFSALGLEPGRDVDLGQLEQESCLDGWEFSQDVYLSTIVTEWNLVCEDDWKAPLTISLFFVGVLLGSFISGQLSDRFGRKNVLFVTMGMQTGFSFLQIFSKNFEMFVVLFVLVGMGQISNYVAAFVLGTEILGKSVRIIFSTLGVCIFYAFGYMVLPLFAYFIRDWRMLLVALTMPGVLCVALWWFIPESPRWLISQGRFEEAEVIIRKAAKANGIVVPSTIFDPSELQDLSSKKQQSHNILDLLRTWNIRMVTIMSIMLWYVKETCLRLPDKAS

SEQ ID NO: 860149 - protein, 71 aa, Homo sapiens
CPCRHGPDLQLCGSICPGYGHQVGVEYLILYFTIIPSPTFLETAVMSLKGDRVSNKTSQSFLVNLTYRQGN

SEQ ID NO: 860150 - protein, 557 aa, Homo sapiens
MRDYDEVTAFLGEWGPFQRLIFFLLSASIIPNGFTGLSSVFLIATPEHRCRVPDAANLSSAWRNHTVPLRLRDGREVPHSCRRYRLATIANFSALGLEPGRDVDLGQLEQESCLDGWEFSQDVYLSTIVTEWNLVCEDDWKAPLTISLFFVGVLLGSFISGQLSDRFGRKNVLFVTMGMQTGFSFLQIFSKNFEMFVVLFVLVGMGQISNYVAAFVLGTEILGKSVRIIFSTLGVCIFYAFGYMVLPLFAYFIRDWRMLLVALTMPGVLCVALWWFIPESPRWLISQGRFEEAEVIIRKAAKANGIVVPSTIFDPSELQDLSSKKQQSHNILDLLRTWNIRMVTIMSIMLWMTISVGYFGLSLDTPNLHGDIFVNCFLSAMVEVPAYVLAWLLLQYLPRRYSMATALFLGGSVLLFMQLVPPDLYYLATVLVMVGKFGVTAAFSMVYVYTAELYPTVVRNMGVGVSSTASRLGSILSPYFVYLGAYDRFLPYILMGSLTILTAILTLFLPESFGTPLPDTIDQMLRVKGMKHRKTPSHTRMLKDGQERPTILKSTAF

SEQ ID NO: 860151 - protein, 581 aa, Homo sapiens
MRDYDEVTAFLGEWGPFQRLIFFLLSASIIPNGFTGLSSVFLIATPEHRCRVPDAANLSSAWRNHTVPLRLRDGREVPHSCRRYRLATIANFSALGLEPGRDVDLGQLEQESCLDGWEFSQDVYLSTIVTEQDSGAYNAMKNRMGKKPALCLPAQWNLVCEDDWKAPLTISLFFVGVLLGSFISGQLSDRFGRKNVLFVTMGMQTGFSFLQIFSKNFEMFVVLFVLVGMGQISNYVAAFVLGTEILGKSVRIIFSTLGVCIFYAFGYMVLPLFAYFIRDWRMLLVALTMPGVLCVALWWFIPESPRWLISQGRFEEAEVIIRKAAKANGIVVPSTIFDPSELQDLSSKKQQSHNILDLLRTWNIRMVTIMSIMLWMTISVGYFGLSLDTPNLHGDIFVNCFLSAMVEVPAYVLAWLLLQYLPRRYSMATALFLGGSVLLFMQLVPPDLYYLATVLVMVGKFGVTAAFSMVYVYTAELYPTVVRNMGVGVSSTASRLGSILSPYFVYLGAYDRFLPYILMGSLTILTAILTLFLPESFGTPLPDTIDQMLRVKGMKHRKTPSHTRMLKDGQERPTILKSTAF

SEQ ID NO: 860152 - protein, 245 aa, Homo sapiens
MLFLQLQDLSSKKQQSHNILDLLRTWNIRMVTIMSIMLWMTISVGYFGLSLDTPNLHGDIFVNCFLSAMVEVPAYVLAWLLLQYLPRRYSMATALFLGGSVLLFMQLVPPDLYYLATVLVMVGKFGVTAAFSMVYVYTAELYPTVVRNMGVGVSSTASRLGSILSPYFVYLGAYDRFLPYILMGSLTILTAILTLFLPESFGTPLPDTIDQMLRVKGMKHRKTPSHTRMLKDGQERPTILKSTAF

SEQ ID NO: 860153 - protein, 748 aa, Homo sapiens
MKTSPRRPLILKRRRLPLPVQNAPSETSEEEPKRSPAQQESNQAEASKEVAESNSCKFPAGIKIINHPTMPNTQVVAIPNNANIHSIITALTAKGKESGSSGPNKFILISCGGAPTQPPGLRPQTQTSYDAKRTEVTLETLGPKPAARDVNLPRPPGALCEQKRETCADGEAAGCTINNSLSNIQWLRKMSSDGLGSRSIKQEMEEKENCHLEQRQVKVEEPSRPSASWQNSVSERPPYSYMAMIQFAINSTERKRMTLKDIYTWIEDHFPYFKHIAKPGWKNSIRHNLSLHDMFVRETSANGKVSFWTIHPSANRYLTLDQVFKQQKRPNPELRRNMTIKTELPLGARRKMKPLLPRVSSYLVPIQFPVNQSLVLQPSVKVPLPLAASLMSSELARHSKRVRIAPKVLLAEEGIAPLSSAGPGKEEKLLFGEGFSPLLPVQTIKEEEIQPGEEMPHLARPIKVESPPLEEWPSPAPSFKEESSHSWEDSSQSPTPRPKKSYSGLRSPTRCVSEMLVIQHRERRERSRSRRKQHLLPPCVDEPELLFSEGPSTSRWAAELPFPADSSDPASQLSYSQEVGGPFKTPIKETLPISSTPSKSVLPRTPESWRLTPPAKVGGLDFSPVQTSQGASDPLPDPLGLMDLSTTPLQSAPPLESPQRLLSSEPLDLISVPFGNSSPSDIDVPKPGSPEPQVSGLAANRSLTEGLVLDTMNDSLSKILLDISFPGLDEDPLGPDNINWSQFIPELQ

SEQ ID NO: 860154 - protein, 761 aa, Homo sapiens
GRVGRPTLSATAGLPLPVQNAPSETSEEEPKRSPAQQESNQAEASKEVAESNSCKFPAGIKIINHPTMPNTQVVAIPNNANIHSIITALTAKGKESGSSGPNKFILISCGGAPTQPPGLRPQTQTSYDAKRTEVTLETLGPKPAARDVNLPRPPGALCEQKRETCADGEAAGCTINNSLSNIQWLRKMSSDGLGSRSIKQEMEEKENCHLEQRQVKVEEPSRPSASWQNSVSERPPYSYMAMIQFAINSTERKRMTLKDIYTWIEDHFPYFKHIAKPGWKNSIRHNLSLHDMFVRETSANGKVSFWTIHPSANRYLTLDQVFKPLDPGSPQLPEHLESQQKRPNPELRRNMTIKTELPLGARRKMKPLLPRVSSYLVPIQFPVNQSLVLQPSVKVPLPLAASLMSSELARHSKRVRIAPKVLLAEEGIAPLSSAGPGKEEKLLFGEGFSPLLPVQTIKEEEIQPGEEMPHLARPIKVESPPLEEWPSPAPSFKEESSHSWEDSSQSPTPRPKKSYSGLRSPTRCVSEMLVIQHRERRERSRSRRKQHLLPPCVDEPELLFSEGPSTSRWAAELPFPADSSDPASQLSYSQEVGGPFKTPIKETLPISSTPSKSVLPRTPESWRLTPPAKVGGLDFSPVQTSQGASDPLPDPLGLMDLSTTPLQSAPPLESPQRLLSSEPLDLISVPFGNSSPSDIDVPKPGSPEPQVSGLAANRSLTEGLVLDTMNDSLSKILLDISFPGLDEDPLGPDNINWSQFIPELQ

SEQ ID NO: 860155 - protein, 763 aa, Homo sapiens
MKTSPRRPLILKRRRLPLPVQNAPSETSEEEPKRSPAQQESNQAEASKEVAESNSCKFPAGIKIINHPTMPNTQVVAIPNNANIHSIITALTAKGKESGSSGPNKFILISCGGAPTQPPGLRPQTQTSYDAKRTEVTLETLGPKPAARDVNLPRPPGALCEQKRETCADGEAAGCTINNSLSNIQWLRKMSSDGLGSRSIKQEMEEKENCHLEQRQVKVEEPSRPSASWQNSVSERPPYSYMAMIQFAINSTERKRMTLKDIYTWIEDHFPYFKHIAKPGWKNSIRHNLSLHDMFVRETSANGKVSFWTIHPSANRYLTLDQVFKPLDPGSPQLPEHLESQQKRPNPELRRNMTIKTELPLGARRKMKPLLPRVSSYLVPIQFPVNQSLVLQPSVKVPLPLAASLMSSELARHSKRVRIAPKVLLAEEGIAPLSSAGPGKEEKLLFGEGFSPLLPVQTIKEEEIQPGEEMPHLARPIKVESPPLEEWPSPAPSFKEESSHSWEDSSQSPTPRPKKSYSGLRSPTRCVSEMLVIQHRERRERSRSRRKQHLLPPCVDEPELLFSEGPSTSRWAAELPFPADSSDPASQLSYSQEVGGPFKTPIKETLPISSTPSKSVLPRTPESWRLTPPAKVGGLDFSPVQTSQGASDPLPDPLGLMDLSTTPLQSAPPLESPQRLLSSEPLDLISVPFGNSSPSDIDVPKPGSPEPQVSGLAANRSLTEGLVLDTMNDSLSKILLDISFPGLDEDPLGPDNINWSQFIPELQ

SEQ ID NO: 860156 - protein, 470 aa, Homo sapiens [sequence omitted]

SEQ ID NO: 860157 - protein, 783 aa, Homo sapiens
MKTSPRRPLILKRRRLPLPVQNAPSETSEEEPKRSPAQQESNQAEASKEVAESNSCKFPAGIKIINHPTMPNTQVVAIPNNANIHSIITALTAKGKESGSSGPNKFILISCGGAPTQPPGLRPQTQTSYDAKRTEVTLETLGPKPAARDVNLPRPPGALCEQKRETCADGEAAGCTINNSLSNIQWLRKMSSDGLGSRSIKQEMEEKENCHLEQRQVKVEEPSRPSASWQNSVSERPPYSYMAMIQFAINSTERKRMTLKDIYTWIEDHFPYFKHIAKPGWKNSIRHNLSLHDMFVRETSANGKVSFWTIHPSANRYLTLDQVFKPLDPGSPQLPEHLESATHLPTHHSFGDCSLRPSPQQQKRPNPELRRNMTIKTELPLGARRKMKPLLPRVSSYLVPIQFPVNQSLVLQPSVKVPLPLAASLMSSELARHSKRVRIAPKVLLAEEGIAPLSSAGPGKEEKLLFGEGFSPLLPVQTIKEEEIQPGEEMPHLARPIKVESPPLEEWPSPAPSFKEESSHSWEDSSQSPTPRPKKSYSGLRSPTRCVSEMLVIQHRERRERSRSRRKQHLLPPCVDEPELLFSEGPSTSRWAAELPFPADSSDPASQLSYSQEVGGPFKTPIKETLPISSTPSKSVLPRTPESWRLTPPAKVGGLDFSPVQTSQGASDPLPDPLGLMDLSTTPLQSAPPLESPQRLLSSEPLDLISVPFGNSSPSDIDVPKPGSPEPQVSGLAANRSLTEGLVLDTMNDSLSKILLDISFPGLDEDPLGPDNINWSQFIPELQ

SEQ ID NO: 860158 - protein, 759 aa, Homo sapiens
MKTSPRRPLILKRRRLPLPVQNAPSETSEEEPKRSPAQQESNQAEASKEVAESNSCKFPAGIKIINHPTMPNTQVVAIPNNANIHSIITALTAKGKESGSSGPNKFILISCGGAPTQPPGLRPQTQTSYDAKRTEVTLETLGPKPAARDVNLPRPPGALCEQKRETCADGEAAGCTINNSLSNIQWLRKMSSDGLGSRSIKQEMEEKENCHLEQRQVKVEEPSRPSASWQNSVSERPPYSYMAMIQFAINSTERKRMTLKDIYTWIEDHFPYFKHIAKPGWKNSIRHNLSLHDMFVRETSANGKVSFWTIHPSANRYLTLDQVFKQQKRPNPELRRNMTIKTELPLGARRKMKPLLPRVSSYLVPIQFPVNQSLVLQPSVKVPLPLAASLMSSELARHSKRVRIAPKVFGEQVVFGYMVLLAEEGIAPLSSAGPGKEEKLLFGEGFSPLLPVQTIKEEEIQPGEEMPHLARPIKVESPPLEEWPSPAPSFKEESSHSWEDSSQSPTPRPKKSYSGLRSPTRCVSEMLVIQHRERRERSRSRRKQHLLPPCVDEPELLFSEGPSTSRWAAELPFPADSSDPASQLSYSQEVGGPFKTPIKETLPISSTPSKSVLPRTPESWRLTPPAKVGGLDFSPVQTSQGASDPLPDPLGLMDLSTTPLQSAPPLESPQRLLSSEPLDLISVPFGNSSPSDIDVPKPGSPEPQVSGLAANRSLTEGLVLDTMNDSLSKILLDISFPGLDEDPLGPDNINWSQFIPELQ

SEQ ID NO: 860159 - protein, 763 aa, Homo sapiens; identical to SEQ ID NO: 860155

SEQ ID NO: 860160 - protein, 763 aa, Homo sapiens; identical to SEQ ID NO: 860155

SEQ ID NO: 860161 - protein, 696 aa, Homo sapiens
MKTSPRRPLILKRRRLPLPVQNAPSETSEEEPKRSPAQQESNQAEASKEVAESNSCKFPAGIKIINHPTMPNTQVVAIPNNANIHSIITALTAKGKESGSSGPNKFILISCGGAPTQPPGLRPQTQTSYDAKRTEVTLETLGPKPAARDVNLPRPPGALCEQKRETCADGEAAGCTINNSLSNIQWLRKMSSDGLGSRSIKQEMEEKENCHLEQRQVKVEEPSRPSASWQNSVSERPPYSYMAMIQFAINSTERKRMTLKDIYTWIEDHFPYFKHIAKPGWKNSIRHNLSLHDMFVRETSANGKVSFWTIHPSANRYLTLDQVFKPLDPGSPQLPEHLESQQKRPNPELRRNMTIKTELPLGARRKMKPLLPRVSSYLVPIQFPVNQSLVLQPSVKVPLPLAASLMSSELARHSKRVRIAPKVLLAEEGIAPLSSAGPGKEEKLLFGEGFSPLLPVQTIKEEEIQPGEEMPHLARPIKVESPPLEEWPSPAPSFKEESSHSWEDSSQSPTPRPKKSYSGLRSPTRCVSEMLVIQHRERRERSRSRRKQHLLPPCVDEPELLFSEGPSTSRWAAELPFPADSSDPASQLSYSQEVGGPFKTPIKETLPISSTPSKSVLPRTPESWRLTPPAKVGGLDFSPVQTSQGASDPLPDPLGLMDLSTTPLQSAPPLESPQRLLSVHPKPLSEDSRQGLFCSS

SEQ ID NO: 860162 - protein, 115 aa, Homo sapiens
LSSEPFAVIQGGEHFAREWCSPLNPKHPSSSEPLDLISVPFGNSSPSDIDVPKPGSPEPQVSGLAANRSLTEGLVLDTMNDSLSKILLDISFPGLDEDPLGPDNINWSQFIPELQ

SEQ ID NO: 860163 - protein, 333 aa, Homo sapiens [sequence omitted]

SEQ ID NO: 860164 - protein, 296 aa, Homo sapiens [sequence omitted]

SEQ ID NO: 860165 - protein, 763 aa, Homo sapiens; identical to SEQ ID NO: 860155

SEQ ID NO: 860166 - protein, 801 aa, Homo sapiens
MKTSPRRPLILKRRRLPLPVQNAPSETSEEEPKRSPAQQESNQAEASKEVAESNSCKFPAGIKIINHPTMPNTQVVAIPNNANIHSIITALTAKGKESGSSGPNKFILISCGGAPTQPPGLRPQTQTSYDAKRTEVTLETLGPKPAARDVNLPRPPGALCEQKRETCADGEAAGCTINNSLSNIQWLRKMSSDGLGSRSIKQEMEEKENCHLEQRQVKVEEPSRPSASWQNSVSERPPYSYMAMIQFAINSTERKRMTLKDIYTWIEDHFPYFKHIAKPGWKNSIRHNLSLHDMFVRETSANGKVSFWTIHPSANRYLTLDQVFKPLDPGSPQLPEHLESQQKRPNPELRRNMTIKTELPLGARRKMKPLLPRVSSYLVPIQFPVNQSLVLQPSVKVPLPLAASLMSSELARHSKRVRIAPKVFGEQVVFGYMSKFFSGDLRDFGTPITSLFNFIFLCLSVLLAEEGIAPLSSAGPGKEEKLLFGEGFSPLLPVQTIKEEEIQPGEEMPHLARPIKVESPPLEEWPSPAPSFKEESSHSWEDSSQSPTPRPKKSYSGLRSPTRCVSEMLVIQHRERRERSRSRRKQHLLPPCVDEPELLFSEGPSTSRWAAELPFPADSSDPASQLSYSQEVGGPFKTPIKETLPISSTPSKSVLPRTPESWRLTPPAKVGGLDFSPVQTSQGASDPLPDPLGLMDLSTTPLQSAPPLESPQRLLSSEPLDLISVPFGNSSPSDIDVPKPGSPEPQVSGLAANRSLTEGLVLDTMNDSLSKILLDISFPGLDEDPLGPDNINWSQFIPELQ

SEQ ID NO: 860167 - protein, 641 aa, Homo sapiens
GRVGRPTLSATVRVTLETLGPKPAARDVNLPRPPGALCEQKRETCADGEAAGCTINNSLSNIQWLRKMSSDGLGSRSIKQEMEEKENCHLEQRQVKVEEPSRPSASWQNSVSERPPYSYMAMIQFAINSTERKRMTLKDIYTWIEDHFPYFKHIAKPGWKNSIRHNLSLHDMFVRETSANGKVSFWTIHPSANRYLTLDQVFKPLDPGSPQLPEHLESQQKRPNPELRRNMTIKTELPLGARRKMKPLLPRVSSYLVPIQFPVNQSLVLQPSVKVPLPLAASLMSSELARHSKRVRIAPKVLLAEEGIAPLSSAGPGKEEKLLFGEGFSPLLPVQTIKEEEIQPGEEMPHLARPIKVESPPLEEWPSPAPSFKEESSHSWEDSSQSPTPRPKKSYSGLRSPTRCVSEMLVIQHRERRERSRSRRKQHLLPPCVDEPELLFSEGPSTSRWAAELPFPADSSDPASQLSYSQEVGGPFKTPIKETLPISSTPSKSVLPRTPESWRLTPPAKVGGLDFSPVQTSQGASDPLPDPLGLMDLSTTPLQSAPPLESPQRLLSSEPLDLISVPFGNSSPSDIDVPKPGSPEPQVSGLAANRSLTEGLVLDTMNDSLSKILLDISFPGLDEDPLGPDNINWSQFIPELQ

SEQ ID NO: 860168 - protein, 763 aa, Homo sapiens; identical to SEQ ID NO: 860155

SEQ ID NO: 860169 - protein, 763 aa, Homo sapiens; identical to SEQ ID NO: 860155

SEQ ID NO: 860170 - protein, 763 aa, Homo sapiens; identical to SEQ ID NO: 860155

SEQ ID NO: 860171 - protein, 681 aa, Homo sapiens
MKTSPRRPLILKRRRLPLPVQNAPSETSEEEPKRSPAQQESNQAEASKEVAESNSCKFPAGIKIINHPTMPNTQVVAIPNNANIHSIITALTAKGKESGSSGPNKFILISCGGAPTQPPGLRPQTQTSYDAKRTEVTLETLGPKPAARDVNLPRPPGALCEQKRETCADGEAAGCTINNSLSNIQWLRKMSSDGLGSRSIKQEMEEKENCHLEQRQVKVEEPSRPSASWQNSVSERPPYSYMAMIQFAINSTERKRMTLKDIYTWIEDHFPYFKHIAKPGWKNSIRHNLSLHDMFVRETSANGKVSFWTIHPSANRYLTLDQVFKPLDPGSPQLPEHLESQQKRPNPELRRNMTIKTELPLGARRKMKPLLPRVSSYLVPIQFPVNQSLVLQPSVKVPLPLAASLMSSELARHSKRVRIAPKVLLAEEGIAPLSSAGPGKEEKLLFGEGFSPLLPVQTIKEEEIQPGEEMPHLARPIKVESPPLEEWPSPAPSFKEESSHSWEDSSQSPTPRPKKSYSGLRSPTRCVSEMLVIQHRERRERSRSRRKQHLLPPCVDEPELLFSEGPSTSRWAAELPFPADSSDPASQLSYSQEVGGPFKTRTCISSPRIVSQNLIWGYAPQIGAVSASQPQGLTCLPGWVSHLDGPVRRSGLTSAWIRLSPAAVLTFRGYAVGGEIKHPRV

SEQ ID NO: 860172 - protein, 432 aa, Homo sapiens [sequence omitted]

SEQ ID NO: 860173 - protein, 343 aa, Homo sapiens
MKTSPRRPLILKRRRLPLPVQNAPSETSEEEPKRSPAQQESNQAEASKEVAESNSCKFPAGIKIINHPTMPNTQVVAIPNNANIHSIITALTAKGKESGSSGPNKFILISCGGAPTQPPGLRPQTQTSYDAKRTEVTLETLGPKPAARDVNLPRPPGALCEQKRETCADGEAAGCTINNSLSNIQWLRKMSSDGLGSRSIKQEMEEKENCHLEQRQVKVEEPSRPSASWQNSVSERPPYSYMAMIQFAINSTERKRMTLKDIYTWIEDHFPYFKHIAKPGWKNSIRHNLSLHDMFVRETSANGKVSFWTIHPSANRYLTLDQVFKPLTQVSTMPRTEGILKND

SEQ ID NO: 860174 - protein, 169 aa, Homo sapiens
DFKTSKRHKEDQNPYVIFLCVLSGDRWFTLSLFPFQVLLAEEGIAPLSSAGPGKEEKLLFGEGFSPLLPVQTIKEEEIQPGEEMPHLARPIKVESPPLEEWPSPAPSFKEESSHSWEDSSQSPTPRPKKSYSGLRSPTRCVSEMLVIQHRERRERSRSRRKQHLLPPCV

SEQ ID NO: 860175 - protein, 391 aa, Homo sapiens
MALSKTFGQKPVKFQLEDDGEFYMIGSEVGNYLRMFRGSLYKRYPSLWRRLATVEERKKIVASSHDHGYTTLATSVTLLKASEVEEILDGNDEKYKAVSISTEPPTYLREQKAKRNSQWVPTLPNSSHHLDAVPCSTTINRNRMGRDKKRTFPLWCGCIAALTLRADSALVLRFDDHDPAVIHENASQPEVLVPIRLDMEIDGQKLRDAFTWNMNEKLMTPEMFSEILCDDLDLNPLTFVPAIASAIRQQIESYPTDSILEDQSDQRVIIKLNIHVGNISLVDQFEWDMSEKENSPEKFALKLCSELGLGGEFVTTIAYSIRGQLSWHQKTYAFSENPLPTVEIAIRNTGDADQWCPLLETLTDAEMEKKIRDQDRNTRRMRRLANTAPAW

SEQ ID NO: 860176 - protein, 228 aa, Homo sapiens
MAKVRGWVAGFDDHDPAVIHENASQPEVLVPIRLDMEIDGQKLRDAFTWNMNEKLMTPEMFSEILCDDLDLNPLTFVPAIASAIRQQIESYPTDSILEDQSDQRVIIKLNIHVGNISLVDQFEWDMSEKENSPEKFALKLCSELGLGGEFVTTIAYSIRGQLSWHQKTYAFSENPLPTVEIAIRNTGDADQWCPLLETLTDAEMEKKIRDQDRNTRRMRRLANTAPAW

SEQ ID NO: 860177 - protein, 374 aa, Homo sapiens
MMALSKTFGQKPVKFQLEDDGEFYMIGSEVGNYLRMFRGSLYKRYPSLWRRLATVEERKKIVASSHDHGYTTLATSVTLLKASEVEEILDGNDEKYKAVSISTEPPTYLREQKAKRNSQWVPTLPNSSHHLDAVPCSTTINRNRMGRDKKRTFPLCFDDHDPAVIHENASQPEVLVPIRLDMEIDGQKLRDAFTWNMNEKLMTPEMFSEILCDDLDLNPLTFVPAIASAIRQQIESYPTDSILEDQSDQRVIIKLNIHVGNISLVDQFEWDMSEKENSPEKFALKLCSELGLGGEFVTTIAYSIRGQLSWHQKTYAFSENPLPTVEIAIRNTGDADQWCPLLETLTDAEMEKKIRDQDRNTRRMRRLANTAPAW

SEQ ID NO: 860178 - protein, 383 aa, Homo sapiens
MMALSKTFGQKPVKFQLEDDGEFYMIGSEVGNYLRMFRGSLYKRYPSLWRRLATVEERKKIVASSHGKKTKPNTKDHGYTTLATSVTLLKASEVEEILDGNDEKYKAVSISTEPPTYLREQKAKRNSQWVPTLPNSSHHLDAVPCSTTINRNRMGRDKKRTFPLCFDDHDPAVIHENASQPEVLVPIRLDMEIDGQKLRDAFTWNMNEKLMTPEMFSEILCDDLDLNPLTFVPAIASAIRQQIESYPTDSILEDQSDQRVIIKLNIHVGNISLVDQFEWDMSEKENSPEKFALKLCSELGLGGEFVTTIAYSIRGQLSWHQKTYAFSENPLPTVEIAIRNTGDADQWCPLLETLTDAEMEKKIRDQDRNTRRMRRLANTAPAW

SEQ ID NO: 860179 - protein, 383 aa, Homo sapiens; identical to SEQ ID NO: 860178

SEQ ID NO: 860180 - protein, 374 aa, Homo sapiens; identical to SEQ ID NO: 860177

SEQ ID NO: 860181 - protein, 374 aa, Homo sapiens; identical to SEQ ID NO: 860177

SEQ ID NO: 860182 - protein, 298 aa, Homo sapiens
SVLMDTAPHLPLGLLFPEVGGGLCADGHSLVLLREQKAKRNSQWVPTLPNSSHHLDAVPCSTTINRNRMGRDKKRTFPLCFDDHDPAVIHENASQPEVLVPIRLDMEIDGQKLRDAFTWNMNEKLMTPEMFSEILCDDLDLNPLTFVPAIASAIRQQIESYPTDSILEDQSDQRVIIKLNIHVGNISLVDQFEWDMSEKENSPEKFALKLCSELGLGGEFVTTIAYSIRGQLSWHQKTYAFSENPLPTVEIAIRNTGDADQWCPLLETLTDAEMEKKIRDQDRNTRRMRRLANTAPAW

SEQ ID NO: 860183 - protein, 258 aa, Homo sapiens
CSEDTRLLSEYEHCESSWPCSTTINRNRMGRDKKRTFPLCFDDHDPAVIHENASQPEVLVPIRLDMEIDGQKLRDAFTWNMNEKLMTPEMFSEILCDDLDLNPLTFVPAIASAIRQQIESYPTDSILEDQSDQRVIIKLNIHVGNISLVDQFEWDMSEKENSPEKFALKLCSELGLGGEFVTTIAYSIRGQLSWHQKTYAFSENPLPTVEIAIRNTGDADQWCPLLETLTDAEMEKKIRDQDRNTRRMRRLANTAPAW

SEQ ID NO: 860184 - protein, 223 aa, Homo sapiens
MFTFSFDDHDPAVIHENASQPEVLVPIRLDMEIDGQKLRDAFTWNMNEKLMTPEMFSEILCDDLDLNPLTFVPAIASAIRQQIESYPTDSILEDQSDQRVIIKLNIHVGNISLVDQFEWDMSEKENSPEKFALKLCSELGLGGEFVTTIAYSIRGQLSWHQKTYAFSENPLPTVEIAIRNTGDADQWCPLLETLTDAEMEKKIRDQDRNTRRMRRLANTAPAW

SEQ ID NO: 860185 - protein, 419 aa, Homo sapiens
MMALSKTFGQKPVKFQLEDDGEFYMIGSEVGNYLRMFRGSLYKRYPSLWRRLATVEERKKIVASSHDHGYTTLATSVTLLKASEVEEILDGNDEKYKAVSISTEPPTYLREQKAKRNSQWVPTLPNSSHHLDAVPCSTTINRNRMGRDKKRTFPLCFDDHDPAVIHENASQPEVLVPIRLDMEIDGQKLRDAFTWNMNEKLMTPEMFSEILCDDLDLNPLTFVPAIASAIRQQIESYPTDSILEDQSDQRVIIKLNIHVGNISLVDQFEWDMSEKENSPEKFALKLCSELGLGGEFVTTIAYSIRGQLSWHQKTYAFSENPLPTVEIAIRNTGDADQWCPLLETLTDASAAAMMMMALSKTFGQKPVKFQLEDDGEFYMIGSEVGNYLRMFRGSLYKRYPSLWRRLPTVEERKKIVHRY

SEQ ID NO: 860186 - protein, 213 aa, Homo sapiens
MVQYYASSVRGARSPIRLDVRSMFAKLIDSNFWDIELEFNYILELFSEILCDDLDLNPLTFVPAIASAIRQQIESYPTDSILEDQSDQRVIIKLNIHVGNISLVDQFEWDMSEKENSPEKFALKLCSELGLGGEFVTTIAYSIRGQLSWHQKTYAFSENPLPTVEIAIRNTGDADQWCPLLETLTDAEMEKKIRDQDRNTRRMRRLANTAPAW

SEQ ID NO: 860187 - protein, 276 aa, Homo sapiens
MMALSKTFGQKPVKFQLEDDGEFYMIGSEVGNYLRMFRGSLYKRYPSLWRRLATVEERKKIVASSHDHGYTTLATSVTLLKASEVEEILDGNDEKYKAVSISTEPPTYLREQKAKRNSQWVPTLPNSSHHLDAVPCSTTINRNRMGRDKKRTFPLCFDDHDPAVIHENASQPEVLVPIRLDMEIDGQKLRDAFTWNMNGTRQSGLAGPGPNPCVLRGNSPVSCQLPVRQILDLTRRTSGHSFGGCGLWVQSWFCCCSLWIGPVNFGLFPHTEVGWP

SEQ ID NO: 860188 - protein, 188 aa, Homo sapiens
MMALSKTFGQKPVKFQLEDDGEFYMIGSEVGNYLRMFRGSLYKRYPSLWRRLATVEERKKIVASSHDHGYTTLATSVTLLKASEVEEILDGNDEKYKAVSISTEPPTYLREQKAKRNSQWVPTLPNSSHHLDAVPCSTTINRNRMGRDKKRTFPLCFDDHDPAVIHENASQPEVLVPIRLDMEIDGQG

SEQ ID NO: 860189 - protein, 174 aa, Homo sapiens
MALSKTFGQKPVKFQLEDDGEFYMIGSEVGNYLRMFRGSLYKRYPSLWRRLATVEERKKIVASSHDHGYTTLATSVTLLKASEVEEILDGNDEKYKAVSISTEPPTYLREQKAKRNSQWVPTLPNSSHHLDAVPCSTTINRNRMGRDKKRTFPLWCGCIAALTLRADSALVLQL

SEQ ID NO: 860190 - protein, 171 aa, Homo sapiens
ALWHQHGPARAVLSRTTSTASGPFLHLRDRETLGTKALLKVHFEGKPMGSWRQHLLWKGPGASSSSLEVQVTGASTGCQQCCWEEQGTEQGPKLSEDSPSIAGKVIPLTASPPRSENPLPTVEIAIRNTGDADQWCPLLETLTDAEMEKKIRDQDRNTRRMRRLANTAPAW

SEQ ID NO: 860191 - protein, 197 aa, Homo sapiens
MMALSKTFGQKPVKFQLEDDGEFYMIGSEVGNYLRMFRGSLYKRYPSLWRRLATVEERKKIVASSHGKKTKPNTKDHGYTTLATSVTLLKASEVEEILDGNDEKYKAVSISTEPPTYLREQKAKRNSQWVPTLPNSSHHLDAVPCSTTINRNRMGRDKKRTFPLCFDDHDPAVIHENASQPEVLVPIRLDMEIDGQG

SEQ ID NO: 860192 - protein, 221 aa, Homo sapiens
LDVLHPLGWLLCATATSRVTQCCLSVTDHGYTTLATSVTLLKASEVEEILDGNDEKYKAVSISTEPPTYLREQKAKRNSQWVPTLPNSSHHLDAVPCSTTINRNRMGRDKKRTFPLWCGCIAALTLRADSALVLQHVSVPSSPEKHSALTLCSPQRHSTSSPLNCCVSLTSRTLSIASLALSAVTLPCPPHLSGPSSGVTQGAVLGPFLCPQFHMSGPQPV

SEQ ID NO: 860193 - protein, 374 aa, Homo sapiens; identical to SEQ ID NO: 860177

SEQ ID NO: 860194 - protein, 374 aa, Homo sapiens; identical to SEQ ID NO: 860177

SEQ ID NO: 860195 - protein, 374 aa, Homo sapiens; identical to SEQ ID NO: 860177

SEQ ID NO: 860196 - protein, 374 aa, Homo sapiens; identical to SEQ ID NO: 860177

SEQ ID NO: 860197 - protein, 228 aa, Homo sapiens; identical to SEQ ID NO: 860176

SEQ ID NO: 860198 - protein, 355 aa, Homo sapiens
MMALSKTFGQKPVKFQLEDDGEFYMIGSEVGNYLRMFRGSLYKRYPSLWRRLATVEERKKIVASSHDHGYTTLATSVTLLKASEVEEILDGNDEKYKAVSISTEPPTYLREQKAKRNSQWVPTLPNSSHHLDAVPCSTTINRNRMGRDKKRTFPLCFDDHDPAVIHENASQPEVLVPIRLDMEIDGQKLRDAFTWNMNEKLMTPEMFSEILCDDLDLNPLTFVPAIASAIRQQIESYPTDSILEDQSDQRVIIKLNIHVGNISLVDQFEWDMSEKENSPEKFALKLCSELGLGGEFVTTIAYSIRGQLSWHQKTYAFSENPLPTVETTSVCSEVLCTRDTPHSGGDYPLWKRGRK

SEQ ID NO: 860199 - protein, 188 aa, Homo sapiens; identical to SEQ ID NO: 860188

SEQ ID NO: 860200 - protein, 260 aa, Homo sapiens
MMALSKTFGQKPVKFQLEDDGEFYMIGSEVGNYLRMFRGSLYKRYPSLWRRLATVEERKKIVASSHDHGYTTLATSVTLLKASEVEEILDGNDEKYKAVSISTEPPTYLREQKAKRNSQWVPTLPNSSHHLDAVPCSTTINRNRMGRDKKRTFPLWCGCIAALTLRADSALVLQHVSVPSSPEKHSALTLCSPQRHSTSSPLNCCVSLTSRTLSIASLALSAVTLPCPPHLSGPSSGVTQGAVLGPFLCPQFHMSGPQPV

SEQ ID NO: 860201 - protein, 306 aa, Homo sapiens
MAEVSIDQSKLPGVKEVCRDFAVLEDHTLAHSLQEQEIEHHLASNVQRNRLVQHDLQVAKQLQEEDLKAQAQLQKRYKDLEQQDCEIAQEIQEKLAIEAERRRIQEKKDEDIARLLQEKELQEEKKRKKHFPEFPATRAYADSYYYEDGGMKPRVMKEAVSTPSRMAHRDQEWYDAEIARKLQEEELLATQVDMRAAQVAQDEEIARLLMAEEKKAYKKAKEREKSSLDKRKQDPEWKPKTAKAANSKSKESDEPHHSKNERPARPPPPIMTDGEDADYTHFTNQQSSTRHFSKSESSHKGFHYKH

SEQ ID NO: 860202 - protein, 306 aa, Homo sapiens; identical to SEQ ID NO: 860201

SEQ ID NO: 860203 - protein, 306 aa, Homo sapiens; identical to SEQ ID NO: 860201

SEQ ID NO: 860204 - protein, 199 aa, Homo sapiens
MAEVSIDQSKLPGVKEVCRDFAVLEDHTLAHSLQEQEIEHHLASNVQRNRLVQHDLQVAKQLQEEDLKAQAQLQKRYKDLEQQDCEIAQEIQEKLAIEAERRRIQEKKDEDIARLLQEKELQEEKKRKKHFPEFPATRAYADSYYYEDGERIRERMNECGMCSASSVTQKGVQLQGPRRADGGLSNLGRAGQREAQLGK

SEQ ID NO: 860205 - protein, 306 aa, Homo sapiens; identical to SEQ ID NO: 860201

SEQ ID NO: 860206 - protein, 169 aa, Homo sapiens
MAEVSIDQSKLPGVKEVCRDFAVLEDHTLAHSLQEQEIEHHLASNVQRNRLVQHDLQVAKQLQEEDLKAQAQLQKRYKDLEQQDCEIAQEIQEKLAIEAERRRIQEKKDEDIARLLQEKELQEEKKRKKHFPEFPATRAYADSYYYEDGGNNSCIMIYSILRLNHKTPL

SEQ ID NO: 860207 - protein, 84 aa, Homo sapiens
RLEIGKNSLDTKIDFHPSPHKKQGFTARKLYMGGTMGKVSTEEGDTGPGLLHSQRVRSSSTSMTQVIEDSLDGSPGIMYITTNQ

SEQ ID NO: 860208 - protein, 607 aa, Homo sapiens
MPRKKPFSVKQKKKQLQDKRERKRGLQDGLRSSSNSRSGSRERREEQTDTSDGESVTHHIRRLNQQPSQGLGPRGYDPNRYRLHFERDSREEVERRKRAAREQVLQPVSAELLELDIREVYQPGSVLDFPRRPPWSYEMSKEQLMSQEERSFQDYLGKIHGAYSSEKLSYFEHNLETWRQLWRVLEMSDIVLLITDIRHPVVNFPPALYEYVTGELGLALVLVLNKVDLAPPALVVAWKHYFHQHYPQLHVVLFTSFPRDPRTPQDPSSVLKKSRRRGRGWTRALGPEQLLRACEAITVGKVDLSSWREKIARDVAGATWGNGSGEEEEEEDGPAVLVEQQTDSAMEPTGPTQERYKDGVVTIGCVGFPNVGKSSLINGLVGRKVVSVSRTPGHTRYFQTYFLTPSVKLCDCPGLIFPSLLPRQLQVLAGIYPIAQIQEPYTAVGYLASRIPVQALLHLRHPEAEDPSAEHPWCAWDICEAWAEKRGYKTAKAARNDVYRAANSLLRLAVDGRLSLCFHPPGYSEQKGTWESHPETTELVVLQGRVGPAGDEEEEEEEELSSSCEEEGEEDRDADEEGEGDEETPTSAPGSSLAGRNPYALLGEDEC

SEQ ID NO: 860209 - protein, 607 aa, Homo sapiens; identical to SEQ ID NO: 860208

SEQ ID NO: 860210 - protein, 607 aa, Homo sapiens; identical to SEQ ID NO: 860208

SEQ ID NO: 860211 - protein, 605 aa, Homo sapiens
MGERVLWPLRAGQHWRHRPLPAGLQDGLRSSSNSRSGSRERREEQTDTSDGESVTHHIRRLNQQPSQGLGPRGYDPNRYRLHFERDSREEVERRKRAAREQVLQPVSAELLELDIREVYQPGSVLDFPRRPPWSYEMSKEQLMSQEERSFQDYLGKIHGAYSSEKLSYFEHNLETWRQLWRVLEMSDIVLLITDIRHPVVNFPPALYEYVTGELGLALVLVLNKVDLAPPALVVAWKHYFHQHYPQLHVVLFTSFPRDPRTPQDPSSVLKKSRRRGRGWTRALGPEQLLRACEAITVGKVDLSSWREKIARDVAGATWGNGSGEEEEEEDGPAVLVEQQTDSAMEPTGPTQERYKDGVVTIGCVGFPNVGKSSLINGLVGRKVVSVSRTPGHTRYFQTYFLTPSVKLCDCPGLIFPSLLPRQLQVLAGIYPIAQIQEPYTAVGYLASRIPVQALLHLRHPEAEDPSAEHPWCAWDICEAWAEKRGYKTAKAARNDVYRAANSLLRLAVDGRLSLCFHPPGYSEQKGTWESHPETTELVVLQGRVGPAGDEEEEEEEELSSSCEEEGEEDRDADEEGEGDEETPTSAPGSSLAGRNPYALLGEDEC

SEQ ID NO: 860212 - protein, 521 aa, Homo sapiens
MPRKKPFSVKQKKKQLQDKRERKRGLQDGLRSSSNSRSGSRERREEQTDTSDGESVTHHIRRLNQQPSQGLGPRGYDPNRYRLHFERDSREEVERRKRAAREQVLQPVSAELLELDIREVYQPGSVLDFPRRPPWSYEMSKEQLMSQEERSFQDYLGKIHGAYSSEKLSYFEHNLETWRQLWRVLEMSDIVLLITDIRHPVVNFPPALYEYVTGELGLALVLVLNKVDLAPPALVVAWKHYFHQHYPQLHVVLFTSFPRDPRTPQDPSSVLKKSRRRGRGWTRALGPEQLLRACEAITVGKVDLSSWREKIARDVAGATWGNGSGEEEEEEDGPAVLVEQQTDSAMEPTGPTQERYKDGVVTIGCVGFPNVGKSSLINGLVGRKVVSVSRTPGHTRYFQTYFLTPSVKLCDCPGLIFPSLLPRQLQVLAGIYPIAQIQEPYTAVGYLASRIPVQALLHLRHPEAEDPSAEHPWCAWDICEAWAEKRGYKTAKAARNDVYRANNLYSQLGWQRGDTPRSVQK

SEQ ID NO: 860213 - protein, 262 aa, Homo sapiens
MEPTGPTQERYKDGVVTIGCVGFPNVGKSSLINGLVGRKVVSVSRTPGHTRYFQTYFLTPSVKLCDCPGLIFPSLLPRQLQVLAGIYPIAQIQEPYTAVGYLASRIPVQALLHLRHPEAEDPSAEHPWCAWDICEAWAEKRGYKTAKAARNDVYRAANSLLRLAVDGRLSLCFHPPGYSEQKGTWESHPETTELVVLQGRVGPAGDEEEEEEEELSSSCEEEGEEDRDADEEGEGDEETPTSAPGSSLAGRNPYALLGEDEC

SEQ ID NO: 860214 - protein, 288 aa, Homo sapiens
GSGDTVDGNNASRQPQELAGPDPPCSKPAPGPVQERYKDGVVTIGCVGFPNVGKSSLINGLVGRKVVSVSRTPGHTRYFQTYFLTPSVKLCDCPGLIFPSLLPRQLQVLAGIYPIAQIQEPYTAVGYLASRIPVQALLHLRHPEAEDPSAEHPWCAWDICEAWAEKRGYKTAKAARNDVYRAANSLLRLAVDGRLSLCFHPPGYSEQKGTWESHPETTELVVLQGRVGPAGDEEEEEEEELSSSCEEEGEEDRDADEEGEGDEETPTSAPGSSLAGRNPYALLGEDEC

SEQ ID NO: 860215 - protein, 216 aa, Homo sapiens
MPRKKPFSVKQKKKQLQDKRERKRGLQDGLRSSSNSRSGSRERREEQTDTSDGESVTHHIRRLNQQPSQGLGPRGYDPNRYRLHFERDSREEVERRKRAAREQVLQPVSAELLELDIREVYQPGSVLDFPRRPPWSYEMSKEQLMSQEERSFQDYLGKIHGAYSSEKLSYFEHNLETWRQLWRVLEMSDIVLLITDIRHPVVNFPPALYEYVTGLD

SEQ ID NO: 860216 - protein, 86 aa, Homo sapiens
MTGRVGKGKREGGTLRKVLSAHFPQVLAGIYPIAQIQEPYTAVGYLASRIPVQALLHLRHPEAEDPSAEHPWCAWDICEGEFHVPG

SEQ ID NO: 860217 - protein, 607 aa, Homo sapiens; identical to SEQ ID NO: 860208

SEQ ID NO: 860218 - protein, 304 aa, Homo sapiens
MPRKKPFSVKQKKKQLQDKRERKRGLQDGLRSSSNSRSGSRERREEQTDTSDGESVTHHIRRLNQQPSQGLGPRGYDPNRYRLHFERDSREEVERRKRAAREQVLQPVSAELLELDIREVYQPGSVLDFPRRPPWSYEMSKEQLMSQEERSFQDYLGKIHGAYSSEKLSYFEHNLETWRQLWRVLEMSDIVLLITDIRHPVVNFPPALYEYVTGELGLALVLVLNKVDLAPPALVVAWKHYFPSFPRDPRTPQDPSSVLKKSRRRGRGWTRALGPEQLLRAWSSRLIQQWSQLAQPKSATRMGW

SEQ ID NO: 860219 - protein, 517 aa, Homo sapiens
MPRKKPFSVKQKKKQLQDKRERKRGLQDGLRSSSNSRSGSRERREEQTDTSDGESVTHHIRRLNQQPSQGLGPRGYDPNRYRLHFERDSREEVERRKRAAREQVLQPVSAELLELDIREVYQPGSVLDFPRRPPWSYEMSKEQLMSQEERSFQDYLGKIHGAYSSEKLSYFEHNLETWRQLWRVLEMSDIVLLITDIRHPVVNFPPALYEYVTGELGLALVLVLNKVDLAPPALVVAWKHYFHQHYPQLHVVLFTSFPRDPRTPQDPSSVLKKSRRRGRGWTRALGPEQLLRACEAITVGKVDLSSWREKIARDVAGATWGNGSGEEEEEEDGPAVLVEQQTDSAMEPTGPTQERYKDGVVTIGCVGFPNVGKSSLINGLVGRKVVSVSRTPGHTRYFQTYFLTPSVKLCDCPGLIFPSLLPRQLQVLAGIYPIAQIQEPYTAVGYLASRIPVQALLHLRHPEAEDPSAEHPWCAWDICEGEFHVPGFAPPGFSCSSLPASPFTLPCLLSSPQRFCH

SEQ ID NO: 860220 - protein, 262 aa, Homo sapiens; identical to SEQ ID NO: 860213

SEQ ID NO: 860221 - protein, 469 aa, Homo sapiens
MSKEQLMSQEERSFQDYLGKIHGAYSSEKLSYFEHNLETWRQLWRVLEMSDIVLLITDIRHPVVNFPPALYEYVTGELGLALVLVLNKVDLAPPALVVAWKHYFHQHYPQLHVVLFTSFPRDPRTPQDPSSVLKKSRRRGRGWTRALGPEQLLRACEAITVGKVDLSSWREKIARDVAGATWGNGSGEEEEEEDGPAVLVEQQTDSAMEPTGPTQERYKDGVVTIGCVGFPNVGKSSLINGLVGRKVVSVSRTPGHTRYFQTYFLTPSVKLCDCPGLIFPSLLPRQLQVLAGIYPIAQIQEPYTAVGYLASRIPVQALLHLRHPEAEDPSAEHPWCAWDICEAWAEKRGYKTAKAARNDVYRAANSLLRLAVDGRLSLCFHPPGYSEQKGTWESHPETTELVVLQGRVGPAGDEEEEEEEELSSSCEEEGEEDRDADEEGEGDEETPTSAPGSSLAGRNPYALLGEDEC

SEQ ID NO: 860222 - protein, 454 aa, Homo sapiens
MPRKKPFSVKQKKKQLQDKRERKRGLQDGLRSSSNSRSGSRERREEQTDTSDGESVTHHIRRLNQQPSQGLGPRGYDPNRYRLHFERDSREEVERRKRAAREQVLQPVSAELLELDIREVYQPGSVLDFPRRPPWSYEMSKEQLMSQEERSFQDYLGKIHGAYSSEKLSYFEHNLETWRQLWRVLEMSDIVLLITDIRHPVVNFPPALYEYVTGELGLALVLVLNKVDLAPPALVVAWKHYFHQHYPQLHVVLFTSFPRDPRTPQDPSSVLKKSRRRGRGWTRALGPEQLLRACEAITVGKVDLSSWREKIARDVAGATWGNGSGEEEEEEDGPAVLVEQQTDSAMEPTGPTQERYKDGVVTIGCVGFPNVGKSSLINGLVGRKVVSVSRTPGHTRYFQTYFLTPSVKLCDCPGLIFPSLLPRQLQVLAGIYPIAQIQEPYTAVGYLASRIPSR

SEQ ID NO: 860223 - protein, 401 aa, Homo sapiens [sequence omitted]

SEQ ID NO: 860224 - protein, 136 aa, Homo sapiens
MPRKKPFSVKQKKKQLQDKRERKRGLQDGLRSSSNSRSGSRERREEQTDTSDGESVTHHIRRLNQQPSQGLGPRGYDPNRYRLHFERDSREEVERRKRAAREQVLQPVSAELLELDIREVYQPGSAGWPKPLCPAG

SEQ ID NO: 860225 - protein, 261 aa, Homo sapiens
MDGWMDVDGWMDGWMDVDGWMDGWMDVDGWMDGWMDVDGWMDGWMDVDGWMDGWMDVDGWMDGWMDVDGWMDGWMDVDGWMDGWMDVDGWMDGWMDVDGWMDGWMDVDGWMDGWMDVDGWMDGWMDVDGWMDGWMDVDGWMDGWMDVDGWMDGWMDVDGWMDGWMDVDGWMDGWMDVDGWMDGWMDVDGWMDGWMDVDGWMDGWMDVDGWMDGWMDVDGWMDGWMDVDGWMDGWMDVDGWMDGWMDGGWMDGWMGNKEIWL

SEQ ID NO: 860226 - protein, 331 aa, Homo sapiens
EIPASGWTQWFCTEALVMVAPVWYLVAAALLVGFILFLTRSRGRAASAGQEPLHNEELAGAGRVAQPGPLEPEEPRAGGRPRRRRDLGSRLQAQRRAQRVAWAEADENEEEAVILAQEEEGVEKPAETHLSGKIGAKKLRKLEEKQARKAQREAEEAEREERKRLESQREAEWKKEEERLRLEEEQKEEEERKAREEQAQREHEEYLKLKEAFVVEEEGVGETMTEEQSQSFLTEFINYIKQSKVVLLEDLASQVGLRTQDTINRIQDLLAEGTITGVIDDRGKFIYITPEELAAVANFIRQRGRVSIAELAQASNSLIAWGRESPAQAPA

SEQ ID NO: 860227 - protein, 585 aa, Homo sapiens
SCAGWGFRSALPGIGGRAATPFSRLQARVWPHPSLHPRELHTSKGLRPWPAHTPIRHRRGPFPLHLLGRPQGFSIPPSLAPEQVPGRGHLNIFCLSPTSWRSARRLQEIPEALSLPAKERAHSPSPIRSPIRRPCHWPGHRTDTPILPLSPHFWSAGGFVYVFSCSLGPQATSEHLRAPRSGRDTLREGGDPAGLPGGGSATAGKCTLWLGSQIKPQVVLGEKSVDSCRGYSMRAGDIRIGAPDRPAGKVEPGGERSIHTGPREGLSPRLGPSCGPGGKGLASQTEKSGPCAVGSRPLSRGAGQEPLHNEELAGAGRVAQPGPLEPEEPRAGGRPRRRRDLGSRLQAQRRAQRVAWAEADENEEEAVILAQEEEGVEKPAETHLSGKIGAKKLRKLEEKQARKAQREAEEAEREERKRLESQREAEWKKEEERLRLEEEQKEEEERKAREEQAQREHEEYLKLKEAFVVEEEGVGETMTEEQSQSFLTEFINYIKQSKVVLLEDLASQVGLRTQDTINRIQDLLAEGTITGVIDDRGKFIYITPEELAAVANFIRQRGRVSIAELAQASNSLIAWGRESPAQAPA

SEQ ID NO: 860228 - protein, 244 aa, Homo sapiens
RVPGGASAVPYLESVAAPLPLSLDSKPESQEEEGVEKPAETHLSGKIGAKKLRKLEEKQARKAQREAEEAEREERKRLESQREAEWKKEEERLRLEEEQKEEEERKAREEQAQREHEEYLKLKEAFVVEEEGVGETMTEEQSQSFLTEFINYIKQSKVVLLEDLASQVGLRTQDTINRIQDLLAEGTITGVIDDRGKFIYITPEELAAVANFIRQRGRVSIAELAQASNSLIAWGRESPAQAPA

SEQ ID NO: 860229 - protein, 315 aa, Homo sapiens
EIPASGWTQWFCTEALVMVAPVWYLVAAALLVGFILFLTRSRGRAASAGQEPLHNEELAGAGRVAQPGPLEPEEPRAGGRPRRRRDLGSRLQAQRRAQRVAWAEADENEEEAVILAQEEEGVEKPAETHLSGKIGAKKLRKLEEKQARKAQREAEEAEREERKRLESQREAEWKKEEERLRLEEEQKEEEERKAREEQAQREHEEYLKLKEAFVVEEEGVGETMTEEQSQSFLTEFINYIKQSKVVLLEDLASQVGLRTQVSPGTWPAVCSVARGLWLAERTCPKDRVLMHRLPCPQPRVSSAQKSPGTLGILHF

SEQ ID NO: 860230 - protein, 259 aa, Homo sapiens
RLVEAGCWFCTEALVMVAPVWYLVAAALLVGFILFLTRSRGRAASAGQEPLHNEELAGAGRVAQPGPLEPEEPRAGGRPRRRRDLGSRLQAQRRAQRVAWAEADENEEEAVILAQEEEGVEKPAETHLSGKIGAKKLRKLEEKQARKAQREAEEAEREERKRLESQREAEWKKEEERLRLEEEQKEEEERKAREEQAQREHEEYLKLKEAFVVEEEGVGETMTEEQSQSFLTEFINYIKQSKVVLLEDLASQVGLRTQV

SEQ ID NO: 860231 - protein, 331 aa, Homo sapiens; identical to SEQ ID NO: 860226

SEQ ID NO: 860232 - protein, 329 aa, Homo sapiens
RLVEAGCWFCTEALVMVAPVWYLVAAALLVGFILFLTRSRGRAASAGQEPLHNEELAGAGRVAQPGPLEPEEPRAGGRPRRRRDLGSRLQAQRRAQRVAWAEADENEEEAVILAQEEEGVEKPAETHLSGKIGAKKLRKLEEKQARKAQREAEEAEREERKRLESQREAEWKKEEERLRLEEEQKEEEERKAREEQAQREHEEYLKLKEAFVVEEEGVGETMTEEQSQSFLTEFINYIKQSKVVLLEDLASQVGLRTQDTINRIQDLLAEGTITGVIDDRGKFIYITPEELAAVANFIRQRGRVSIAELAQASNSLIAWGRESPAQAPA

SEQ ID NO: 860233 - protein, 328 aa, Homo sapiens
HDGSPREDTLVSRVSWPRVWYLVAAALLVGFILFLTRSRGRAASAGQEPLHNEELAGAGRVAQPGPLEPEEPRAGGRPRRRRDLGSRLQAQRRAQRVAWAEADENEEEAVILAQEEEGVEKPAETHLSGKIGAKKLRKLEEKQARKAQREAEEAEREERKRLESQREAEWKKEEERLRLEEEQKEEEERKAREEQAQREHEEYLKLKEAFVVEEEGVGETMTEEQSQSFLTEFINYIKQSKVVLLEDLASQVGLRTQDTINRIQDLLAEGTITGVIDDRGKFIYITPEELAAVANFIRQRGRVSIAELAQASNSLIAWGRESPAQAPA

SEQ ID NO: 860234 - protein, 315 aa, Homo sapiens; identical to SEQ ID NO: 860229

SEQ ID NO: 860235 - protein, 261 aa, Homo sapiens
EIPASGWTQWFCTEALVMVAPVWYLVAAALLVGFILFLTRSRGRAASAGQEPLHNEELAGAGRVAQPGPLEPEEPRAGGRPRRRRDLGSRLQAQRRAQRVAWAEADENEEEAVILAQEEEGVEKPAETHLSGKIGAKKLRKLEEKQARKAQREAEEAEREERKRLESQREAEWKKEEERLRLEEEQKEEEERKAREEQAQREHEEYLKLKEAFVVEEEGVGETMTEEQSQSFLTEFINYIKQSKVVLLEDLASQVGLRTQV

SEQ ID NO: 860236 - protein, 494 aa, Homo sapiens
ERKMAEPPSPVHCVAAAAPTATVSEKEPFGKLQLSSRDPPGSLSAKKVRTEEKKAPRRVNGEGGSGGNSRQLQPPAAPSPQSYGSPASWSFAPLSAAPSPSSSRSSFSFSAGTAVPSSASASLSQPVPRKLLVPPTLLHAQPHHLLLPAAAAAASANAKSRRPKEKREKERRRHGLGGAREAGGASREENGEVKPLPRDKIKDKIKERDKEKEREKKKHKVMNEIKKENGEVKILLKSGKEKPKTNIEDLQIKKVKKKKKKKHKENEKRKRPKMYSKSIQTICSGLLTDVEDQAAKGILNDNIKDYVGKNLDTKNYDSKIPENSEFPFVSLKEPRVQNNLKRLDTLEFKQLIHIEHQPNGGASVIHAYSNELSHLSPMEMERFAEEFVGLVFSENENSAAFYVMGIVHGAATYLPDFLDYFSFNFPNSPVKMEILGKKDIETTTMSNFHAQSLTVLQPGRQSETPSQKKRKKFMIMLSSRWEGETKNKYRRLTN

SEQ ID NO: 860237 - protein, 267 aa, Homo sapiens
MEFQKTFFPTGGKEKPKTNIEDLQIKKVKKKKKKKHKENEKRKRPKMYSKSIQTICSGLLTDVEDQAAKGILNDNIKDYVGKNLDTKNYDSKIPENSEFPFVSLKEPRVQNNLKRLDTLEFKQLIHIEHQPNGGASVIHAYSNELSHLSPMEMERFAEEFVGLVFSENENSAAFYVMGIVHGAATYLPDFLDYFSFNFPNSPVKMEILGKKDIETTTMSNFHAQSLTVLQPGRQSETPSQKKRKKFMIMLSSRWEGETKNKYRRLTN

SEQ ID NO: 860238 - protein, 466 aa, Homo sapiens
ERKMAEPPSPVHCVAAAAPTATVSEKEPFGKLQLSSRDPPGSLSAKKVRTEEKKAPRRVNGEGGSGGNSRQLQPPAAPSPQSYGRAVPSSASASLSQPVPRKLLVPPTLLHAQPHHLLLPAAAAAASANAKSRRPKEKREKERRRHGLGGAREAGGASREENGEVKPLPRDKIKDKIKERDKEKEREKKKHKVMNEIKKENGEVKILLKSGKEKPKTNIEDLQIKKVKKKKKKKHKENEKRKRPKMYSKSIQTICSGLLTDVEDQAAKGILNDNIKDYVGKNLDTKNYDSKIPENSEFPFVSLKEPRVQNNLKRLDTLEFKQLIHIEHQPNGGASVIHAYSNELSHLSPMEMERFAEEFVGLVFSENENSAAFYVMGIVHGAATYLPDFLDYFSFNFPNSPVKMEILGKKDIETTTMSNFHAQSLTVLQPGRQSETPSQKKRKKFMIMLSSRWEGETKNKYRRLTN

SEQ ID NO: 860239 - protein, 285 aa, Homo sapiens
GSPPPQDKVLNDRLQLLLVCCRLCTVESGGKEKPKTNIEDLQIKKVKKKKKKKHKENEKRKRPKMYSKSIQTICSGLLTDVEDQAAKGILNDNIKDYVGKNLDTKNYDSKIPENSEFPFVSLKEPRVQNNLKRLDTLEFKQLIHIEHQPNGGASVIHAYSNELSHLSPMEMERFAEEFVGLVFSENENSAAFYVMGIVHGAATYLPDFLDYFSFNFPNSPVKMEILGKKDIETTTMSNFHAQSLTVLQPGRQSETPSQKKRKKFMIMLSSRWEGETKNKYRRLTN

SEQ ID NO: 860240 - protein, 181 aa, Homo sapiens
MGRLSGGSRPLGILALLLLVIVCPLLCAFLDLSEEERAGPETFSRPQLPVIPPLCFLRQAKANLDKNKQTLEKENADLAGELRVLGQAKQEVEHKKKKLEAQVQELQSKCSDGERARAELNDKVHKLQVRRWRGGVVGSAGWCPVLWGGASSRLAEVSLAARQVLSSSCVPGGEAMISLFN

SEQ ID NO: 860241 - protein, 1453 aa, Homo sapiens
MAQKGQLSDDEKFLFVDKNFINSPVAQADWAAKRLVWVPSEKQGFEAASIKEEKGDEVVVELVENGKKVTVGKDDIQKMNPPKFSKVEDMAELTCLNEASVLHNLRERYFSGLIYTYSGLFCVVVNPYKHLPIYSEKIVDMYKGKKRHEMPPHIYAIADTAYRSMLQDREDQSILCTGESGAGKTENTKKVIQYLAVVASSHKGKKDTSITGELEKQLLQANPILEAFGNAKTVKNDNSSRFGKFIRINFDVTGYIVGANIETYLLEKSRAIRQARDERTFHIFYYMIAGAKEKMRSDLLLEGFNNYTFLSNGFVPIPAAQDDEMFQETVEAMAIMGFSEEEQLSILKVVSSVLQLGNIVFKKERNTDQASMPDNTAAQKVCHLMGINVTDFTRSILTPRIKVGRDVVQKAQTKEQADFAVEALAKATYERLFRWILTRVNKALDKTHRQGASFLGILDIAGFEIFEVNSFEQLCINYTNEKLQQLFNHTMFILEQEEYQREGIEWNFIDFGLDLQPCIELIERPNNPPGVLALLDEECWFPKATDKSFVEKLCTEQGSHPKFQKPKQLKDKTEFSIIHYAGKVDYNASAWLTKNMDPLNDNVTSLLNASSDKFVADLWKDVDRIVGLDQMAKMTESSLPSASKTKKGMFRTVGQLYKEQLGKLMTTLRNTTPNFVRCIIPNHEKRSGKLDAFLVLEQLRCNGVLEGIRICRQGFPNRIVFQEFRQRYEILAANAIPKGFMDGKQACILMIKALELDPNLYRIGQSKIFFRTGVLAHLEEERDLKITDVIMAFQAMCRGYLARKAFAKRQQQLTAMKVIQRNCAAYLKLRNWQWWRLFTKVKPLLQVTRQEEEMQAKEDELQKTKERQQKAENELKELEQKHSQLTEEKNLLQEQLQAETELYAEAEEMRVRLAAKKQELEEILHEMEARLEEEEDRGQQLQAERKKMAQQMLDLEEQLEEEEAARQKLQLEKVTAEAKIKKLEDEILVMDDQNNKLSKERKLLEERISDLTTNLAEEEEKAKNLTKLKNKHESMISELEVRLKKEEKSRQELEKLKRKLEGDASDFHEQIADLQAQIAELKMQLAKKEEELQAALARLDDEIAQKNNALKKIRELEGHISDLQEDLDSERAARNKAEKQKRDLGEELEALKTELEDTLDSTATQQELRAKREQEVTVLKKALDEETRSHEAQVQEMRQKHAQAVEELTEQLEQFKRAKANLDKNKQTLEKENADLAGELRVLGQAKQEVEHKKKKLEAQVQELQSKCSDGERARAELNDKVHKLQNEVESVTGMLNEAEGKAIKLAKDVASLSSQLQDTQELLQEETRQKLNVSTKLRQLEEERNSLQDQLDEEMEAKQNLERHISTLNIQLSDSKKKLQDFASTVEALEEGKKRFQKEIENLTQQYEEKAAAYDKLEKTKNRLQQELDDLVVDLDNQRQLVSNPGKEAEEI

SEQ ID NO: 860242 - protein, 1266 aa, Homo sapiens
MAQKGQLSDDEKFLFVDKNFINSPVAQADWAAKRLVWVPSEKQGFEAASIKEEKGDEVVVELVENGKKVTVGKDDIQKMNPPKFSKVEDMAELTCLNEASVLHNLRERYFSGLIYTYSGLFCVVVNPYKHLPIYSEKIVDMYKGKKRHEMPPHIYAIADTAYRSMLQDREDQSILCTGESGAGKTENTKKVIQYLAVVASSHKGKKDTSITGELEKQLLQANPILEAFGNAKTVKNDNSSRFGKFIRINFDVTGYIVGANIETYLLEKSRAIRQARDERTFHIFYYMIAGAKEKMRSDLLLEGFNNYTFLSNGFVPIPAAQDDEMFQETVEAMAIMGFSEEEQLSILKVVSSVLQLGNIVFKKERNTDQASMPDNTAAQKVCHLMGINVTDFTRSILTPRIKVGRDVVQKAQTKEQADFAVEALAKATYERLFRWILTRVNKALDKTHRQGASFLGILDIAGFEIFEVNSFEQLCINYTNEKLQQLFNHTMFILEQEEYQREGIEWNFIDFGLDLQPCIELIERPNNPPGVLALLDEECWFPKATDKSFVEKLCTEQGSHPKFQKPKQLKDKTEFSIIHYAGKVDYNASAWLTKNMDPLNDNVTSLLNASSDKFVADLWKDVDRIVGLDQMAKMTESSLPSASKTKKGMFRTVGQLYKEQLGKLMTTLRNTTPNFVRCIIPNHEKRSGKLDAFLVLEQLRCNGVLEGIRICRQGFPNRIVFQEFRQRYEILAANAIPKGFMDGKQACILMIKALELDPNLYRIGQSKIFFRTGVLAHLEEERDLKITDVIMAFQAMCRGYLARKAFAKRQQQLTAMKVIQRNCAAYLKLRNWQWWRLFTKVKPLLQVTRQEEEMQAKEDELQKTKERQQKAENELKELEQKHSQLTEEKNLLQEQLQAETELYAEAEEMRVRLAAKKQELEEILHEMEARLEEEEDRGQQLQAERKKMAQQMLDLEEQLEEEEAARQKLQLEKVTAEAKIKKLEDEILVMDDQNNKLSKERKLLEERISDLTTNLAEEEEKAKNLTKLKNKHESMISELEVRLKKEEKSRQELEKLKRKLEGDASDFHEQIADLQAQIAELKMQLAKKEEELQAALARLDDEIAQKNNALKKIRELEGHISDLQEDLDSERAARNKAEKQKRDLGEELEALKTELEDTLDSTATQQELRAKREQEVTVLKKALDEETRSHEAQVQEMRQKHAQAVEELTEQLEQFKRAKANLDKNKQTLEKENADLAGELRVLGQAKQEVEHKKKKLEAQVQTLSF

SEQ ID NO: 860243 - protein, 179 aa, Homo sapiens
RRISRQKLQLEKVTAEAKIKKLEDEILVMDDQKNKLSRRTENSLKERMSDLSDKSCRRGITGQESSKATDKSFVEKLCTEQGSHPKFQKPKQLKDKTEFSIIHYAGKVDYNASAWLTKNMDPLNDNVTSLLNASSDKFVADLWKDVDRIVGLDQMAKVGRSRGQKFETSLANMVKPHLY

SEQ ID NO: 860244 - protein, 82 aa, Homo sapiens
MRVRLAAKKQELEEILHEMEARLEEEEDRGQQLQAERKKMAQQMLDLEEQLEEEEAARQKLQLEKSRAEDQRRRGREFSSSR

SEQ ID NO: 860245 - protein, 131 aa, Homo sapiens
GTLLSGPEELEDELQATVDAKLRLESRKSRRFKGQFERDLSSPGTSRMRRRGGNCRDSFTSMQLHEYETELEDERKQRALAAAAKKKLEGDLKDLELQADSAIKGREEAIKQLRKLQAQMKDLKMGVMGWA

SEQ ID NO: 860246 - protein, 809 aa, Homo sapiens
SPPRPPPRLRPAYYCILLLLNSRPRRPTPNFVRCIIPNHEKRSGKLDAFLVLEQLRCNGVLEGIRICRQGFPNRIVFQEFRQRYEILAANAIPKGFMDGKQACILMIKALELDPNLYRIGQSKIFFRTGVLAHLEEERDLKITDVIMAFQAMCRGYLARKAFAKRQQQLTAMKVIQRNCAAYLKLRNWQWWRLFTKVKPLLQVTRQEEEMQAKEDELQKTKERQQKAENELKELEQKHSQLTEEKNLLQEQLQAETELYAEAEEMRVRLAAKKQELEEILHEMEARLEEEEDRGQQLQAERKKMAQQMLDLEEQLEEEEAARQKLQLEKVTAEAKIKKLEDEILVMDDQNNKLSKERKLLEERISDLTTNLAEEEEKAKNLTKLKNKHESMISELEVRLKKEEKSRQELEKLKRKLEGDASDFHEQIADLQAQIAELKMQLAKKEEELQAALARLDDEIAQKNNALKKIRELEGHISDLQEDLDSERAARNKAEKQKRDLGEELEALKTELEDTLDSTATQQELRAKREQEVTVLKKALDEETRSHEAQVQEMRQKHAQAVEELTEQLEQFKRAKANLDKNKQTLEKENADLAGELRVLGQAKQEVEHKKKKLEAQVQELQSKCSDGERARAELNDKVHKLQNEVESVTGMLNEAEGKAIKLAKDVASLSSQLQDTQELLQEETRQKLNVSTKLRQLEEERNSLQDQLDEEMEAKQNLERHISTLNIQLSDSKKKLQDFASTVEALEEGKKRFQKEIENLTQQYEEKAAAYDKLEKTKNRLQQELDDLVVDLDNQRQLVSNPGKEAEEI

SEQ ID NO: 860247 - protein, 593 aa, Homo sapiens
SPPRPPPRLRPAYYCILLLLNSRPRRPTPNFVRCIIPNHEKRSGKLDAFLVLEQLRCNGVLEGIRICRQGFPNRIVFQEFRQRYEILAANAIPKGFMDGKQACILMIKALELDPNLYRIGQSKIFFRTGVLAHLEEERDLKITDVIMAFQAMCRGYLARKAFAKRQQQLTAMKVIQRNCAAYLKLRNWQWWRLFTKVKPLLQVTRQEEEMQAKEDELQKTKERQQKAENELKELEQKHSQLTEEKNLLQEQLQAETELYAEAEEMRVRLAAKKQELEEILHEMEARLEEEEDRGQQLQAERKKMAQQMLDLEEQLEEEEAARQKLQLEKVTAEAKIKKLEDEILVMDDQNNKLSKERKLLEERISDLTTNLAEEEEKAKNLTKLKNKHESMISELEVRLKKEEKSRQELEKLKRKLEGDASDFHEQNEVESVTGMLNEAEGKAIKLAKDVASLSSQLQDTQELLQEETRQKLNVSTKLRQLEEERNSLQDQLDEEMEAKQNLERHISTLNIQLSDSKKKLQDFASTVEALEEGKKRFQKEIENLTQQYEEKAAAYDKLEKTKNRLQQELDDLVVDLDNQRQLVSNPGKEAEEI

SEQ ID NO: 860248 - protein, 809 aa, Homo sapiens; identical to SEQ ID NO: 860246

SEQ ID NO: 860249 - protein, 755 aa, Homo sapiens
SPPRPPPRLRPAYYCILLLLNSRPRRPTPNFVRCIIPNHEKRSGKLDAFLVLEQLRCNGVLEGIRICRQGFPNRIVFQEFRQRYEILAANAIPKGFMDGKQACILMIKALELDPNLYRIGQSKIFFRTGVLAHLEEERDLKITDVIMAFQAMCRGYLARKAFAKRQQQLTAMKVIQRNCAAYLKLRNWQWWRLFTKVKPLLQVTRQEEEMQAKEDELQKTKERQQKAENELKELEQKHSQLTEEKNLLQEQLQAETELYAEAEEMRVRLAAKKQELEEILHEMEARLEEEEDRGQQLQAERKKMAQQMLDLEEQLEEEEAARQKLQLEKVTAEAKIKKLEDEILVMDDQNNKLSKERKLLEERISDLTTNLAEEEEKAKNLTKLKNKHESMISELEVRLKKEEKSRQELEKLKRKLEGDASDFHEQIADLQAQIAELKMQLAKKEEELQAALARLDDEIAQKNNALKKIRELEGHISDLQEDLDSERAARNKAEKQKRDLGEELEALKTELEDTLDSTATQQELRAKREQEVTVLKKALDEETRSHEAQVQEMRQKHAQAVEELTEQLEQFKRAKANLDKNKQTLEKENADLAGELRVLGQAKQEVEHKKKKLEAQVQELQSKCSDGERARAELNDKVHKLQNEVESVTGMLNEAEGMEAKQNLERHISTLNIQLSDSKKKLQDFASTVEALEEGKKRFQKEIENLTQQYEEKAAAYDKLEKTKNRLQQELDDLVVDLDNQRQLVSNPGKEAEEI

SEQ ID NO: 860250 - protein, 1253 aa, Homo sapiens
SPPRPPPRLRPAYYCILLLLNSRPRRPTPNFVRCIIPNHEKRSGKLDAFLVLEQLRCNGVLEGIRICRQGFPNRIVFQEFRQRYEILAANAIPKGFMDGKQACILMIKALELDPNLYRIGQSKIFFRTGVLAHLEEERDLKITDVIMAFQAMCRGYLARKAFAKRQQQLTAMKVIQRNCAAYLKLRNWQWWRLFTKVKPLLQVTRQEEEMQAKEDELQKTKERQQKAENELKELEQKHSQLTEEKNLLQEQLQAETELYAEAEEMRVRLAAKKQELEEILHEMEARLEEEEDRGQQLQAERKKMAQQMLDLEEQLEEEEAARQKLQLEKVTAEAKIKKLEDEILVMDDQNNKLSKERKLLEERISDLTTNLAEEEEKAKNLTKLKNKHESMISELEVRLKKEEKSRQELEKLKRKLEGDASDFHEQIADLQAQIAELKMQLAKKEEELQAALARLDDEIAQKNNALKKIRELEGHISDLQEDLDSERAARNKAEKQKRDLGEELEALKTELEDTLDSTATQQELRAKREQEVTVLKKALDEETRSHEAQVQEMRQKHAQAVEELTEQLEQFKRAKANLDKNKQTLEKENADLAGELRVLGQAKQEVEHKKKKLEAQVQELQSKCSDGERARAELNDKVHKLQNEVESVTGMLNEAEGCHKASLDEEMEARWRPSRTWSATSPLSTSSSPTRRRSCRTLPAPWKLWKRGRRGSRRRSRTSPSSTRRRRPLMINWKRPRTGFSRSWTTWLLIWTTSGNSCPTLEKKQRKFDQLLAEEKNISSKYADERDRAEAEAREKETKALSLARALEEALEAKEELERTNKMLKAEMEDLVSSKDDVGKNVHELEKSKRALETQMEEMKTQLEELEDELQATEDAKLRLEVNMQALKGQFERDLQARDEQNEEKRRQLQRQLHEYETELEDERKQRALAAAAKKKLEGDLKDLELQADSAIKGREEAIKQLRKLQAQMKDFQRELEDARASRDEIFATAKENEKKAKSLEADLMQLQEDLAAAERARKQADLEKEELAEELASSLSGRNALQDEKRRLEARIAQLEEELEEEQGNMEAMSDRVRKATQQAEQLSNELATERSTAQKNESARQQLERQNKELRSKLHEMEGAVKSKFKSTIAALEAKIAQLEEQVEQEAREKQAATKSLKQKDKKLKEILLQVEDERKMAEQYKEQAEKGNARVKQLKRQLEEAEEESQRINANRRKLQRELDEATESNEAMGREVNALKSKLRGPPPQETSQ

SEQ ID NO: 860251 - protein, 809 aa, Homo sapiens; identical to SEQ ID NO: 860246

SEQ ID NO: 860252 - protein, 809 aa, Homo sapiens; identical to SEQ ID NO: 860246

SEQ ID NO: 860253 - protein, 809 aa, Homo sapiens; identical to SEQ ID NO: 860246

SEQ ID NO: 860254 - protein, 975 aa, Homo sapiens
SPPRPPPRLRPAYYCILLLLNSRPRRPTPNFVRCIIPNHEKRSGKLDAFLVLEQLRCNGVLEGIRICRQGFPNRIVFQEFRQRYEILAANAIPKGFMDGKQACILMIKALELDPNLYRIGQSKIFFRTGVLAHLEEERDLKITDVIMAFQAMCRGYLARKAFAKRQQQLTAMKVIQRNCAAYLKLRNWQWWRLFTKVKPLLQVTRQEEEMQAKEDELQKTKERQQKAENELKELEQKHSQLTEEKNLLQEQLQAETELYAEAEEMRVRLAAKKQELEEILHEMEARLEEEEDRGQQLQAERKKMAQQMLDLEEQLEEEEAARQKLQLEKVTAEAKIKKLEDEILVMDDQNNKLSKERKLLEERISDLTTNLAEEEEKAKNLTKLKNKHESMISELEVRLKKEEKSRQELEKLKRKLEGDASDFHEQIADLQAQIAELKMQLAKKEEELQAALARLDDEIAQKNNALKKIRELEGHISDLQEDLDSERAARNKAEKQKRDLGEELEALKTELEDTLDSTATQQELRAKREQEVTVLKKALDEETRSHEAQVQEMRQKHAQAVEELTEQLEQFKRAKANLDKNKQTLEKENADLAGELRVLGQAKQEVEHKKKKLEAQVQELQSKCSDGERARAELNDKVHKLQNEVESVTGMLNEAEGKAIKLAKDVASLSSQLQDTQEEAIKQLRKLQAQMKDFQRELEDARASRDEIFATAKENEKKAKSLEADLMQLQEDLAAAERARKQADLEKEELAEELASSLSGRNALQDEKRRLEARIAQLEEELEEEQGNMEAMSDRVRKATQQAEQLSNELATERSTAQKNESARQQLERQNKELRSKLHEMEGAVKSKFKSTIAALEAKIAQLEEQVEQEAREKQAATKSLKQKDKKLKEILLQVEDERKMAEQYKEQAEKGNARVKQLKRQLEEAEEESQRINANRRKLQRELDEATESNEAMGREVNALKSKLRGPPPQETSQ

SEQ ID NO: 860255 - protein, 809 aa, Homo sapiens; identical to SEQ ID NO: 860246

SEQ ID NO: 860256 - protein, 809 aa, Homo sapiens; identical to SEQ ID NO: 860246

SEQ ID NO: 860257 - protein, 809 aa, Homo sapiens; identical to SEQ ID NO: 860246

SEQ ID NO: 860258 - protein, 809 aa, Homo sapiens; identical to SEQ ID NO: 860246

SEQ ID NO: 860259 - protein, 809 aa, Homo sapiens; identical to SEQ ID NO: 860246

SEQ ID NO: 860260 - protein, 634 aa, Homo sapiens
SPPRPPPRLRPAYYCILLLLNSRPRRPTPNFVRCIIPNHEKRSGKLDAFLVLEQLRCNGVLEGIRICRQGFPNRIVFQEFRQRYEILAANAIPKGFMDGKQACILMIKALELDPNLYRIGQSKIFFRTGVLAHLEEERDLKITDVIMAFQAMCRGYLARKAFAKRQQQLTAMKVIQRNCAAYLKLRNWQWWRLFTKVKPLLQVTRQEEEMQAKEDELQKTKERQQKAENELKELEQKHSQLTEEKNLLQEQLQAETELYAEAEEMRVRLAAKKQELEEILHEMEARLEEEEDRGQQLQAERKKMAQQMLDLEEQLEEEEAARQKLQLEKVTAEAKIKKLEDEILVMDDQNNKLSKERKLLEERISDLTTNLAEEEEKAKNLTKLKNKHESMISELEVRLKKEEKSRQELEKLKRKLEGDASDFHEQIADLQAQIAELKMQLAKKEEELQAALARLDDEIAQKNNALKKIRELEGHISDLQEDLDSERAARNKAEKQKRDLGEELEALKTELEDTLDSTATQQELRAKREQEVTVLKKALDEETRSHEAQVQEMRQKHAQAVEELTEQLEQFKRAKANLDKNKRTLETQTSMEPRPVNKQLSTVLHHGKKTKNQNKQTKKTQQQPRTKQNPADCT

SEQ ID NO: 860261 - protein, 809 aa, Homo sapiens; identical to SEQ ID NO: 860246

SEQ ID NO: 860262 - protein, 809 aa, Homo sapiens; identical to SEQ ID NO: 860246

SEQ ID NO: 860263 - protein, 809 aa, Homo sapiens; identical to SEQ ID NO: 860246

SEQ ID NO: 860264 - protein, 775 aa, Homo sapiens
SPPRPPPRLRPAYYCILLLLNSRPRRPTPNFVRCIIPNHEKRSGKLDAFLVLEQLRCNGVLEGIRICRQGFPNRIVFQEFRQRYEILAANAIPKGFMDGKQACILMIKALELDPNLYRIGQSKIFFRTGVLAHLEEERDLKITDVIMAFQAMCRGYLARKAFAKRQQQLTAMKVIQRNCAAYLKLRNWQWWRLFTKVKPLLQVTRQEEEMQAKEDELQKTKERQQKAENELKELEQKHSQLTEEKNLLQEQLQAETELYAEAEEMRVRLAAKKQELEEILHEMEARLEEEEDRGQQLQAERKKMAQQMLDLEEQLEEEEAARQKLQLEKVTAEAKIKKLEDEILVMDDQNNKLSKERKLLEERISDLTTNLAEEEEKAKNLTKLKNKHESMISELEVRLKKEEKSRQELEKLKRKLEGDASDFHEQIADLQAQIAELKMQLAKKEEELQAALARLDDEIAQKNNALKKIRELEGHISDLQEDLDSERAARNKAEKQKRDLGEELEALKTELEDTLDSTATQQELRAKREQEVTVLKKALDEETRSHEAQVQEMRQKHAQAVEELTEQLEQFKRAKANLDKNKQTLEKENADLAGELRVLGQAKQEVEHKKKKLEAQVQELQSKCSDGERARAELNDKVHKLQNEVESVTGMLNEAEGKAIKLAKDVASLSSQLQDTQVSVLPHHPGDLGGGLPRGRSLGPLCIPFAGAASRRNPAEAQRVYEAAPAGGGAEQPARPAGRGDGGQAEPGAPHLHSQHPGACPVSLLPSWVLSTSLR

SEQ ID NO: 860265 - protein, 695 aa, Homo sapiens
SPPRPPPRLRPAYYCILLLLNSRPRRPTPNFVRCIIPNHEKRSGKLDAFLVLEQLRCNGVLEGIRICRQGFPNRIVFQEFRQRYEILAANAIPKGFMDGKQACILMIKALELDPNLYRIGQSKIFFRTGVLAHLEEERDLKITDVIMAFQAMCRGYLARKAFAKRQQQLTAMKVIQRNCAAYLKLRNWQWWRLFTKVKPLLQVTRQEEEMQAKEDELQKTKERQQKAENELKELEQKHSQLTEEKNLLQEQLQAETELYAEAEEMRVRLAAKKQELEEILHEMEARLEEEEDRGQQLQAERKKMAQQMLDLEEQLEEEEAARQKLQLEKVTAEAKIKKLEDEILVMDDQNNKLSKERKLLEERISDLTTNLAEEEEKAKNLTKLKNKHESMISELEVRLKKEEKSRQELEKLKRKLEGDASDFHEQIADLQAQIAELKMQLAKKEEELQAALARLDDEIAQKNNALKKIRELEGHISDLQEDLDSERAARNKAEKQKRDLGEELEALKTELEDTLDSTATQQELRAKREQEVTVLKKALDEETRSHEAQVQEMRQKHAQAVEELTEQLEQFKRAKANLDKNKQTLEKENADLAGELRVLGQAKQEVEHKKKKLEAQVQELQSKCSDGERARAELNDKVHKLQVRRWRGGVVGSAGWCPVLWGGASSRLAEVSLAARQVLSSSCVPGGEAMISLFN

SEQ ID NO: 860266 - protein, 49 aa, Homo sapiens
QVQDAAGQGSVDSRVWLHDPRTFSSPLPRAFAKRQQQLTAMKVIQRNCA

SEQ ID NO: 860267 - protein, 145 aa, Homo sapiens
MLVSPRTREIMRQPLPKQRDENPEGGTALPLGPQLSPPWVLLLVPSWPGQVGHPGRRFGALLRHGFWPQGSTALFDLCSPASWMRSWCWSSCGAMGCWKAFASAGRASPTGSSSRSSANGKSQGLAQVGQGVSGTGWRNGCWRYP

SEQ ID NO: 860268 - protein, 1453 aa, Homo sapiens; identical to SEQ ID NO: 860241

SEQ ID NO: 860269 - protein, 148 aa, Homo sapiens
ISADAHALCIVGQLFMECLRLGVLSDSSPTCLPQNNPPGVLALLDEECWFPKATDKSFVEKLCTEQGSHPKFQKPKQLKDKTEFSIIHYAGKVPATGPRGLCLRGPPVAAQRRDSLRVAEPWAAWKLQSHLLLSESQPSPIRNLSTHL

SEQ ID NO: 860270 - protein, 135 aa, Homo sapiens
SPPRPPPRLRPAYYCILLLLNSRPRRPTPNFVRCIIPNHEKRSGKLDAFLVLEQLRCNGVLEGIRICRQGFPNRIVFQEFRQRYEILAANAIPKGFMDGKQACILMIKALELDPNLYRSRAEDQRRRGREFSSSR

SEQ ID NO: 860271 - protein, 809 aa, Homo sapiens; identical to SEQ ID NO: 860246

SEQ ID NO: 860272 - protein, 809 aa, Homo sapiens; identical to SEQ ID NO: 860246

SEQ ID NO: 860273 - protein, 1403 aa, Homo sapiens
SPPRPPPRLRPAYYCILLLLNSRPRRPTPNFVRCIIPNHEKRSGKLDAFLVLEQLRCNGVLEGIRICRQGFPNRIVFQEFRQRYEILAANAIPKGFMDGKQACILMIKALELDPNLYRIGQSKIFFRTGVLAHLEEERDLKITDVIMAFQAMCRGYLARKAFAKRQQQLTAMKVIQRNCAAYLKLRNWQWWRLFTKVKPLLQVTRQEEEMQAKEDELQKTKERQQKAENELKELEQKHSQLTEEKNLLQEQLQAETELYAEAEEMRVRLAAKKQELEEILHEMEARLEEEEDRGQQLQAERKKMAQQMLDLEEQLEEEEAARQKLQLEKVTAEAKIKKLEDEILVMDDQNNKLSKERKLLEERISDLTTNLAEEEEKAKNLTKLKNKHESMISELEVRLKKEEKSRQELEKLKRKLEGDASDFHEQIADLQAQIAELKMQLAKKEEELQAALARLDDEIAQKNNALKKIRELEGHISDLQEDLDSERAARNKAEKQKRDLGEELEALKTELEDTLDSTATQQELRAKREQEVTVLKKALDEETRSHEAQVQEMRQKHAQAVEELTEQLEQFKRAKANLDKNKQTLEKENADLAGELRVLGQAKQEVEHKKKKLEAQVQELQSKCSDGERARAELNDKVHKLQNEVESVTGMLNEAEGKAIKLAKDVASLSSQLQDTQVSVLPHHPGDLGGGLSSGQVPGTSLHPFCRSCFKKKPGRSSTCLRSCASWRRSGTACKTSWTRRWRPSRTWSATSPLSTSRCLPRVLASFMGPLNFSALRSPAGRSRWSVGAMVLDPPASPAIGFLQRGDMVFASQSLWGQGQGPFMVPLSPYPGRCPCSSPTRRRSCRTLPAPWKLWKRGRRGSRRRSRTSPSSTRRRRPLMINWKRPRTGFSRSWTTWLLIWTTSGNSCPTLEKKQRKFDQLLAEEKNISSKYADERDRAEAEAREKETKALSLARALEEALEAKEELERTNKMLKAEMEDLVSSKDDVGKNVHELEKSKRALETQMEEMKTQLEELEDELQATEDAKLRLEVNMQALKGQFERDLQARDEQNEEKRRQLQRQLHEYETELEDERKQRALAAAAKKKLEGDLKDLELQADSAIKGREEAIKQLRKLQAQMKDFQRELEDARASRDEIFATAKENEKKAKSLEADLMQLQEDLAAAERARKQADLEKEELAEELASSLSGRNALQDEKRRLEARIAQLEEELEEEQGNMEAMSDRVRKATQQAEQLSNELATERSTAQKNESARQQLERQNKELRSKLHEMEGAVKSKFKSTIAALEAKIAQLEEQVEQEAREKQAATKSLKQKDKKLKEILLQVEDERKMAEQYKEQAEKGNARVKQLKRQLEEAEEESQRINANRRKLQRELDEATESNEAMGREVNALKSKLRGPPPQETSQ

SEQ ID NO: 860274 - protein, 1297 aa, Homo sapiens
SPPRPPPRLRPAYYCILLLLNSRPRRPTPNFVRCIIPNHEKRSGKLDAFLVLEQLRCNGVLEGIRICRQGFPNRIVFQEFRQRYEILAANAIPKGFMDGKQACILMIKALELDPNLYRIGQSKIFFRTGVLAHLEEERDLKITDVIMAFQAMCRGYLARKAFAKRQQQLTAMKVIQRNCAAYLKLRNWQWWRLFTKVKPLLQVTRQEEEMQAKEDELQKTKERQQKAENELKELEQKHSQLTEEKNLLQEQLQAETELYAEAEEMRVRLAAKKQELEEILHEMEARLEEEEDRGQQLQAERKKMAQQMLDLEEQLEEEEAARQKLQLEKVTAEAKIKKLEDEILVMDDQNNKLSKERKLLEERISDLTTNLAEEEEKAKNLTKLKNKHESMISELEVRLKKEEKSRQELEKLKRKLEGDASDFHEQIADLQAQIAELKMQLAKKEEELQAALARLDDEIAQKNNALKKIRELEGHISDLQEDLDSERAARNKAEKQKRDLGEELEALKTELEDTLDSTATQQELRAKREQEVTVLKKALDEETRSHEAQVQEMRQKHAQAVEELTEQLEQFKRAKANLDKNKQTLEKENADLAGELRVLGQAKQEVEHKKKKLEAQVQELQSKCSDGERARAELNDKVHKLQNEVESVTGMLNEAEGKAIKLAKDVASLSSQLQDTQELLQEETRQKLNVSTKLRQLEEERNSNAKTILDEEMEAMQNLEAPHLPLYNIQSSPTRRRSCRTLPAPWKLWKRGRRGSRRRSRTSPSSTRRRRPLMINWKRPRTGFSRSWTTWLLIWTTSGNSCPTLEKKQRKFDQLLAEEKNISSKYADERDRAEAEAREKETKALSLARALEEALEAKEELERTNKMLKAEMEDLVSSKDDVGKNVHELEKSKRALETQMEEMKTQLEELEDELQATEDAKLRLEVNMQALKGQFERDLQARDEQNEEKRRQLQRQLHEYETELEDERKQRALAAAAKKKLEGDLKDLELQADSAIKGREEAIKQLRKLQAQMKDFQRELEDARASRDEIFATAKENEKKAKSLEADLMQLQEDLAAAERARKQADLEKEELAEELASSLSGRNALQDEKRRLEARIAQLEEELEEEQGNMEAMSDRVRKATQQAEQLSNELATERSTAQKNESARQQLERQNKELRSKLHEMEGAVKSKFKSTIAALEAKIAQLEEQVEQEAREKQAATKSLKQKDKKLKEILLQVEDERKMAEQYKEQAEKGNARVKQLKRQLEEAEEESQRINANRRKLQRELDEATESNEAMGREVNALKSKLRGPPPQETSQ

SEQ ID NO: 860275 - protein, 809 aa, Homo sapiens; identical to SEQ ID NO: 860246

SEQ ID NO: 860276 - protein, 809 aa, Homo sapiens; identical to SEQ ID NO: 860246

SEQ ID NO: 860277 - protein, 809 aa, Homo sapiens; identical to SEQ ID NO: 860246

SEQ ID NO: 860278 - protein, 809 aa, Homo sapiens; identical to SEQ ID NO: 860246

SEQ ID NO: 860279 - protein, 809 aa, Homo sapiens; identical to SEQ ID NO: 860246

SEQ ID NO: 860280 - protein, 809 aa, Homo sapiens; identical to SEQ ID NO: 860246

SEQ ID NO: 860281 - protein, 809 aa, Homo sapiens; identical to SEQ ID NO: 860246

SEQ ID NO: 860282 - protein, 79 aa, Homo sapiens
GPAGQVGQYKEQAEKGNARVKQLKRQLEEAEEESQRINANRRKLQRELDEATESNEAMGREVNALKSKLRGPPPQETSQ

SEQ ID NO: 860283 - protein, 809 aa, Homo sapiens; identical to SEQ ID NO: 860246

SEQ ID NO: 860284 - protein, 809 aa, Homo sapiens; identical to SEQ ID NO: 860246

SEQ ID NO: 860285 - protein, 809 aa, Homo sapiens; identical to SEQ ID NO: 860246

SEQ ID NO: 860286 - protein, 809 aa, Homo sapiens; identical to SEQ ID NO: 860246

SEQ ID NO: 860287 - protein, 809 aa, Homo sapiens; identical to SEQ ID NO: 860246

SEQ ID NO: 860288 - protein, 813 aa, Homo sapiens
SPPRPPPRLRPAYYCILLLLNSRPRRPTPNFVRCIIPNHEKRSGKLDAFLVLEQLRCNGVLEGIRICRQGFPNRIVFQEFRQRYEILAANAIPKGFMDGKQACILMIKALELDPNLYRIGQSKIFFRTGVLAHLEEERDLKITDVIMAFQAMCRGYLARKAFAKRQQQLTAMKVIQRNCAAYLKLRNWQWWRLFTKVKPLLQVTRQEEEMQAKEDELQKTKERQQKAENELKELEQKHSQLTEEKNLLQEQLQAETELYAEAEEMRVRLAAKKQELEEILHEMEARLEEEEDRGQQLQAERKKMAQQMLDLEEQLEEEEAARQKLQLEKVTAEAKIKKLEDEILVMDDQNNKLSKERKLLEERISDLTTNLAEEEEKAKNLTKLKNKHESMISELEVRLKKEEKSRQELEKLKRKLEGDASDFHEQIADLQAQIAELKMQLAKKEEELQAALARLDDEIAQKNNALKKIRELEGHISDLQEDLDSERAARNKAEKQKRDLGEELEALKTELEDTLDSTATQQELRAKREQEVTVLKKALDEETRSHEAQVQEMRQKHAQAVEELTEQLEQFKRAKANLDKNKQTLEKENADLAGELRVLGQAKQEVEHKKKKLEAQVQELQSKCSDGERARAELNDKVHKLQNEVESVTGMLNEAEGKAIKLAKDVASLSSQLQDTQELLQEETRQKLNVSTKLRQLEEERNSLQDQLDEEMEAKQNLERHISTLNIQLSDSKKKLQDFASTVEALEEGKKRFQKEIENLTQQYEEKAAAYDKLEKTKNRLQQELDDLVVDLDNQRQLVSNHQHQDLQLPWFS

SEQ ID NO: 860289 - protein, 813 aa, Homo sapiens; identical to SEQ ID NO: 860288

SEQ ID NO: 860290 - protein, 456 aa, Homo sapiens
SPPRPPPRLRPAYYCILLLLNSRPRRPTPNFVRCIIPNHEKRSGKLDAFLVLEQLRCNGVLEGIRICRQGFPNRIVFQEFRQRYEILAANAIPKGFMDGKQACILMIKALELDPNLYRIGQSKIFFRTGVLAHLEEERDLKITDVIMAFQAMCRGYLARKAFAKRQQQLTAMKVIQRNCAAYLKLRNWQWWRLFTKVKPLLQVTRQEEEMQAKEDELQKTKERQQKAENELKELEQKHSQLTEEKNLLQEQLQAETELYAEAEEMRVRLAAKKQELEEILHEMEARLEEEEDRGQQLQAERKKMAQQMLDLEEQLEEEEAARQKLQLEKVTAEAKIKKLEDEILVMDDQNNKLSKERKLLEERISDLTTNLAEEEEKAKNLTKLKNKHESMISELEVRLKKEEKSRQELEKLKRKLEGDASDFHEQIADLQAQNPGSSSGPCSSERLHRQTRARAA

SEQ ID NO: 860291 - protein, 98 aa, Homo sapiens
VEIKKYVLLTLTCLPLLLGDLLLEGFNNYTFLSNGFVPIPAAQDDEMFQETVEAMAIMGFSEEEQLCKPHTLSLEGSLPGYQWNLLRTLLWSGQISAL

SEQ ID NO: 860292 - protein, 127 aa, Homo sapiens
THSRPFSSSHVPGISVRPRVSTKTPSSSFPISNMRILSASVQSVYPGGGLEVSWVLCLQTYSGLFCVVVNPYKHLPIYSEKIVDMYKGKKRHEMPPHIYAIADTAYRSMLQDREDQGCTGPAPGSPS

SEQ ID NO: 860293 - protein, 113 aa, Homo sapiens
DAEPRPVPAKLNPRSWPRTAGALPLRPPPLTMAVFHDEVEIEDFQYDEDSETYFYPCPCGDNFSITKEDLENGEDVATCPSCSLIIKVIYDKDQFVCGETVPAPSANKELVKC

SEQ ID NO: 860294 - protein, 88 aa, Homo sapiens
DAEPRPVPAKLNPRSWPRTAGALPLRPPPLTMAVFHDEVEIEDFQYDEDSETYFYPCPCGDNFSITKDQFVCGETVPAPSANKELVKC

SEQ ID NO: 860295 - protein, 88 aa, Homo sapiens; identical to SEQ ID NO: 860294

SEQ ID NO: 860296 - protein, 113 aa, Homo sapiens; identical to SEQ ID NO: 860293

SEQ ID NO: 860297 - protein, 92 aa, Homo sapiens
DAEPRPVPAKLNPRSWPRTAGALPLRPPPLTMAVFHDEVEIEDFQYDEDSETYFYPCPCGDNFSITKVTSGSRPAVHPSKRSLVPPVPSIIG

SEQ ID NO: 860298 - protein, 113 aa, Homo sapiens; identical to SEQ ID NO: 860293

SEQ ID NO: 860299 - protein, 113 aa, Homo sapiens; identical to SEQ ID NO: 860293

SEQ ID NO: 860300 - protein, 113 aa, Homo sapiens; identical to SEQ ID NO: 860293

SEQ ID NO: 860301 - protein, 103 aa, Homo sapiens
HTHCEPFQREEEVGGKYVPKKDDFFQALPGPLDLQFRQALAAGGFTHELAILLGPQGTKGIRDKGPSCQPMIPGLALFPYFHLFLTLRTFGTQWNQHFKVKMN

SEQ ID NO: 860302 - protein, 508 aa, Homo sapiens
RRGSGCARGRAGRGGRSRGRGQGRLRGFSRRRRQGEFPGSGHIGSIQPQPPGRSASRSRLVPVAAPALVPAHPPGAELAMAATDLERFSNAEPEPRSLSLGGHVGFDSLPDQLVSKSVTQGFSFNILCVGETGIGKSTLMNTLFNTTFETEEASHHEACVRLRPQTYDLQESNVQLKLTIVDAVGFGDQINKDESYRPIVDYIDAQFENYLQEELKIRRSLFDYHDTRIHVCLYFITPTGHSLKSLDLVTMKKLDSKVNIIPIIAKADTISKSELHKFKIKIMGELVSNGVQIYQFPTDDEAVAEINAVMNAHLPFAVVGSTEEVKVGNKLVRARQYPWGVVQVENENHCDFVKLREMLIRVNMEDLREQTHSRHYELYRRCKLEEMGFQDSDGDSQPFSLQETYEAKRKEFLSELQRKEEEMRQMFVNKVKETELELKEKERELHEKFEHLKRVHQEEKRKVEEKRRELEEETNAFNRRKAAVEALQSQALHATSQQPLRKDKDKKN

SEQ ID NO: 860303 - protein, 508 aa, Homo sapiens; identical to SEQ ID NO: 860302

SEQ ID NO: 860304 - protein, 508 aa, Homo sapiens; identical to SEQ ID NO: 860302

SEQ ID NO: 860305 - protein, 508 aa, Homo sapiens; identical to SEQ ID NO: 860302

SEQ ID NO: 860306 - protein, 562 aa, Homo sapiens
RRGSGCARGRAGRGGRSRGRGQGRLRGFSRRRRQGEFPGSGHIGSIQPQPPGRSASRSRLVPVAAPALVPAHPPGAELAMAATDLERFSNAEPEPRSLSLGGHVGFDSLPDQLVSKSVTQGFSFNILCVGETGIGKSTLMNTLFNTTFETEEASHHEACVRLRPQTYDLQESNVQLKLTIVDAVGFGDQINKDESYRPIVDYIDAQFENYLQEELKIRRSLFDYHDTRIHVCLYFITPTGHSLKSLDLVTMKKLDSKVNIIPIIAKADTISKSELHKFKIKIMGELVSNGVQIYQFPTDDEAVAEINAVMNAHLPFAVVGSTEEVKVGNKLVRARQYPWGVVQVENENHCDFVKLREMLIRVNMEDLREQTHSRHYELYRRCKLEEMGFQDSDGDSQPFSLQETYEAKRKEFLSELQRKEEEMRQMFVNKVKETELELKEKERELHEKFEHLKRVHQEEKRKVEEKRRELEEETNAFNRRKAAVEALQSQALHATSQQPLRKDKDKKNRSDIGAHQPGMSLSSSKVMMTKASVEPLNCSSWWPAIQCCSCLVRDATWREGFL

SEQ ID NO: 860307 - protein, 521 aa, Homo sapiens
RRGSGCARGRAGRGGRSRGRGQGRLRGFSRRRRQGEFPGSGHIGSIQPQPPGRSASRSRLVPVAAPALVPAHPPGAELAMAATDLERFSNAEPEPRSLSLGGHVGFDSLPDQLVSKSVTQGFSFNILCVGETGIGKSTLMNTLFNTTFETEEASHHEACVRLRPQTYDLQESNVQLKLTIVDAVGFGDQINKDESYRPIVDYIDAQFENYLQEELKIRRSLFDYHDTRIHVCLYFITPTGHSLKSLDLVTMKKLDSKVNIIPIIAKADTISKSELHKFKIKIMGELVSNGVQIYQFPTDDEAVAEINAVMNAHLPFAVVGSTEEVKVGNKLVRARQYPWGVVQVENENHCDFVKLREMLIRVNMEDLREQTHSRHYELYRRCKLEEMGFQDSDGDSQPFSLQETYEAKRKEFLSELQRKEEEMRQMFVNKVKETELELKEKERELHEKFEHLKRVHQEEKRKVEEKRRELEEETNAFNRRKAAVEALQSQALHATSQQPLRKDKDKKKASGWSSIYSVTIP

SEQ ID NO: 860308 - protein, 508 aa, Homo sapiens; identical to SEQ ID NO: 860302

SEQ ID NO: 860309 - protein, 61 aa, Homo sapiens
CVRLRPQTYDLQESNVQLKLTIVDAVGFGDQINKDESKRREGRPHPASSHPTYIGPYNSSP

SEQ ID NO: 860310 - protein, 521 aa, Homo sapiens; identical to SEQ ID NO: 860307

SEQ ID NO: 860311 - protein, 183 aa, Homo sapiens
GPLLSVENENHCDFVKLREMLIRVNMEDLREQTHSRHYELYRRCKLEEMGFQDSDGDSQPFSLQETYEAKRKEFLSELQRKEEEMRQMFVNKVKETELELKEKERELHEKFEHLKRVHQEEKRKVEEKRRELEEETNAFNRRKAAVEALQSQALHATSQQPLRKDKDKKKASGWSSIYSVTIP

SEQ ID NO: 860312 - protein, 128 aa, Homo sapiens
DASVRVSKKVNWHIQGKCGLPMAHLYGNFMLIRVNMEDLREQTHSRHYELYRRCKLEEMGFQDSDGDSQPFSLQETYEAKRKEFLSELQRKEEEMRQMFVNKVKETELELKEKEREMRPGDPAGSLDT

SEQ ID NO: 860313 - protein, 508 aa, Homo sapiens; identical to SEQ ID NO: 860302

SEQ ID NO: 860314 - protein, 508 aa, Homo sapiens
RRGSGCARGRAGRGGRSRGRGQGRLRGFSRRRRQGEFPGSGHIGSIQPQPPGRSASRSRLVPVAAPALVPAHPPGAELAMAATDLERFSNAEPEPRSLSLGGHVGFDSLPDQLVSKSVTQGFSFNILCVGETGIGKSTLMNTLFNTTFETEEASHHEACVRLRPQTYDLQESNVQLKLTIVDAVGFGDQINKDESYRPIVDYIDAQFENYLQEELKIRRSLFDYHDTRIHVCLYFITPTGHSLKSLDLVTMKKLDSKVNIIPIIAKADTISKSELHKFKIKIMGELVSNGVQIYQFPTDDEAVAEINAVMNAHLPFAVVGSTEEVKVGNKLVRARQYPWGVVQVENENHCDFVKLREMLIRVNMEDLREQTHSRHYELYRRCKLEEMGFQDSDGDSQPFSLQETYEAKRKEFLSELQRKEEEMRQMFVNKVKETELELKEKERELHEKFEHLKRVHQEEKRKVEEKRRELEEETNAFNRRKAAVEALQSQALHATSQQPLRKDKDKKK

SEQ ID NO: 860315 - protein, 354 aa, Homo sapiens
MTPGRCCLAADIQVETFIFTDGEDEALARHTGNVVITNCSAAHSRQALSCKMAVEYDRFIESGRKWFCHVDDDNYVNLRALLRLLASYPHTRDVYVGKPSLDRPIQAMERVSENKVRPVHFWFATGGAGFCISRGLALKMSPWASGGHFMNTAERIRLPDDCTIGYIVEALLGVPLIRSGLFHSHLENLQQVPTSELHEQVTLSYGMFENKRNAVHVKGPFSVEADPSRFRSIHCHLYPDTPWCPRTAIFYVAMAETQSLGAPGIQRAQGPCCAALASAFEAPLGPCLCVCVCMCVCVCVYCMPTRVAGCWAVLLCGGAGTSATYVPLLRGPVGCRACLEEGFVCRRPLRGQFC

SEQ ID NO: 860316 - protein, 258 aa, Homo sapiens
RPLAEPLAPRDVFIAVKTTKKFHRARLDLLLETWISRHKEMTFIFTDGEDEALARHTGNVVITNCSAAHSRQALSCKMAVEYDRFIESGRKWFCHVDDDNYVNLRALLRLLASYPHTRDVYVGKPSLDRPIQAMERVSENKVRPVHFWFATGGAGFCISRGLALKMSPWASGGHFMNTAERIRLPDDCTIGYIVEALLGVPLIRSGLFHSHLENLQQVPTSELHEQVTLSYGMFENKRNAVHVKGPFSVEADPSRWGN

SEQ ID NO: 860317 - protein, 272 aa, Homo sapiens
LKPIMDNLPLFSDNIIPPGLTHRKMAEPFSENKVRPVHFWFATGGAGFCISRGLALKMSPWASGGHFMNTAERIRLPDDCTIGYIVEALLGVPLIRSGLFHSHLENLQQVPTSELHEQVTLSYGMFENKRNAVHVKGPFSVEADPSRFRSIHCHLYPDTPWCPRTAIFYVAMAETQSLGAPGIQRAQGPCCAALASAFEAPLGPCLCVCVCMCVCVCVYCMPTRVAGCWAVLLCGGAGTSATYVPLLRGPVGCRACLEEGFVCRRPLRGQFC

SEQ ID NO: 860318 - protein, 380 aa, Homo sapiens
APLAEPLAPRDVFIAVKTTKKFHRARLDLLLETWISRHKEMTFIFTDGEDEALARHTGNVVITNCSAAHSRQALSCKMAVEYDRFIESGRKWFCHVDDDNYVNLRALLRLLASYPHTRDVYVGKPSLDRPIQAMERVSENKVRPVHFWFATGGAGFCISRGLALKMSPWASGGHFMNTAERIRLPDDCTIGYIVEALLGVPLIRSGLFHSHLENLQQVPTSELHEQVTLSYGMFENKRNAVHVKGPFSVEADPSRFRSIHCHLYPDTPWCPRTAIFYVAMAETQSLGAPGIQRAQGPCCAALASAFEAPLGPCLCVCVCMCVCVCVYCMPTRVAGCWAVLLCGGAGTSATYVPLLRGPVGCRACLEEGFVCRRPLRGQFC

SEQ ID NO: 860319 - protein, 380 aa, Homo sapiens
MSLSDWHLAVKLADQPLTPKSILRLPETELGEYSLGGYSISFLKQLIAGKLQESVPDPELIDLIYCGRKLKDDQTLDFYGIQPGSTVHVLRKSWPEPDQKPEPVDKVAAMREFRVLHTALHSSSSYREAVFKMLSNKESLDQIIVATPGLSSDPIALGVLQDKDLFSVFADPNMLDTLVPAHPALVNAIVLVLHSVAGSAPMPGTDSSSRSMPSSSYRDMPGGFLFEGLSDDEDDFHPNTRSTPSSSTPSSRPASLGYSGAAGPRPITQSELATALALASTPESSSHTPTPGTQGHSSGTSPMSSGVQSGTPITNDLFSQALQHALQASGQPSLQSQWQPQLQQLRDMGIQDDELSLRALQATGGDIQAALELIFAGGAP

SEQ ID NO: 860320 - protein, 419 aa, Homo sapiens [sequence omitted]

SEQ ID NO: 860321 - protein, 380 aa, Homo sapiens; identical to SEQ ID NO: 860319

SEQ ID NO: 860322 - protein, 380 aa, Homo sapiens; identical to SEQ ID NO: 860319

SEQ ID NO: 860323 - protein, 366 aa, Homo sapiens [sequence omitted]

SEQ ID NO: 860324 - protein, 283 aa, Homo sapiens
MSLSDWHLAVKLADQPLTPKSILRLPETELGEYSLGGYSISFLKQLIAGKLQESVPDPELIDLIYCGRKLKDDQTLDFYGIQPGSTVHVLRKSWPEPDQKPEPVDKVAAMREFRVLHTALHSSSSYREAVFKMLSNKESLDQIIVATPGLSSDPIALGVLQDKDLFSVFADPNMLDTLVPAHPALVNAIVLVLHSVAGSAPMPGTDSSSRSMPSSSYRDMPGGFLFEGLSDDEDDFHPSQWQPQLQQLRDMGIQDDELSLRALQATGGDIQAALELIFAGGAP

SEQ ID NO: 860325 - protein, 255 aa, Homo sapiens
MSLSDWHLAVKLADQPLTPKSILRLPETELGEYSLGGYSISFLKQLIAGKLQESVPDPELIDLIYCGRKLKDDQTLDFYGIQPGSTVHVLRKSWPEPDQKPEPVDKVAAMREFRVLHTALHSSSSYREAVFKMLSNKESLDQIIVATPGLSSDPIALGVLQDKDLFSVFADPNMLDTLVPAHPALVNAIVLVLHSVAGSAPMPGTDSSSRSMPSSSYRDMPGGFLFEGLSDDEDDFHPNTMYTPSSSSLSCRDPL

SEQ ID NO: 860326 - protein, 167 aa, Homo sapiens
MTITRTYLALQDSSAVRVSDLFSGVPCMPGRKRERERERMSLSDWHLAVKLADQPLTPKSILRLPETELGEYSLGGYSISFLKQLIAGKLQESVPDPELIDLIYCGRKLKDDQTLDFYGIQPGSTVHVLRKSWPEPDQKPEPVDKVAAMREFRVLHTACWAPAHHPE

SEQ ID NO: 860327 - protein, 167 aa, Homo sapiens; identical to SEQ ID NO: 860326

SEQ ID NO: 860328 - protein, 380 aa, Homo sapiens; identical to SEQ ID NO: 860319

SEQ ID NO: 860329 - protein, 380 aa, Homo sapiens; identical to SEQ ID NO: 860319

SEQ ID NO: 860330 - protein, 419 aa, Homo sapiens [sequence omitted]

SEQ ID NO: 860331 - protein, 360 aa, Homo sapiens
MSLSDWHLAVKLADQPLTPKSILRLPETELGEYSLGGYSISFLKQLIAGKLQESVPDPELIDLIYCGRKLKDDQTLDFYGIQPGSTVHVLRKSWPEPDQKPEPVDKVAAMREFRVLHTALHSSSSYREAVFKMLSNKESLDQIIVATPGLSSDPIALGVLQDKDLFSVFADPNMLDTLVPAHPALVNAIVLVLHSVAGSAPMPGTDSSSRSMPSSSYRDMPGGFLFEGLSDDEDDFHPNTRSTPSSSTPSSRPASLGYSGAAGPRPITQSELATALALASTPESSSHTPTPGTQTRVILRTHNVSGVNPEPYMFLAGLEASLGRLSRGPCGRMVRECLARPGDHRDFGPASAPERGGAPR

SEQ ID NO: 860332 - protein, 339 aa, Homo sapiens
MLLSASVNSISSMPSPVYQCRKALRRNMAVNCSELCRIRHESLSLSLSLSLSPRAADQKPEPVDKVAAMREFRVLHTALHSSSSYREAVFKMLSNKESLDQIIVATPGLSSDPIALGVLQDKDLFSVFADPNMLDTLVPAHPALVNAIVLVLHSVAGSAPMPGTDSSSRSMPSSSYRDMPGGFLFEGLSDDEDDFHPNTRSTPSSSTPSSRPASLGYSGAAGPRPITQSELATALALASTPESSSHTPTPGTQGHSSGTSPMSSGVQSGTPITNDLFSQALQHALQASGQPSLQSQWQPQLQQLRDMGIQDDELSLRALQATGGDIQAALELIFAGGAP

SEQ ID NO: 860333 - protein, 165 aa, Homo sapiens
SVRPPPGGFLFEGLSDDEDDFHPNTRSTPSSSTPSSRPASLGYSGAAGPRPITQSELATALALASTPESSSHTPTPGTQGHSSGTSPMSSGVQSGTPITNDLFSQALQHALQASGQPSLQSQWQPQLQQLRDMGIQDDELSLRALQATGGDIQAALELIFAGGAP

SEQ ID NO: 860334 - protein, 181 aa, Homo sapiens
MSLSDWHLAVKLADQPLTPKSILRLPETELGEYSLGGYSISFLKQLIAGKLQESVPDPELIDLIYCGRKLKDDQTLDFYGIQPGSTVHVLRKSWPEPDQKPEPVDKVAAMREFRVLHTALHSSSSYREAVFKMLSNKESLDQIIVATPGLSSDPIALGKCRTEFEEIGVVGKGENRRRQFL

SEQ ID NO: 860335 - protein, 204 aa, Homo sapiens
MKTTTRNSEETLANRRKEFINSLRLYRSFYGGLADQLCANELAAADGLPCWNGEDIVKSYTQRVVGNGIKAQSGNPEVKVKGIDPVINQIIDKLKHVVQLLQGRSPKPDKWELLQLGSGGGMVEQVSGDCDDEDGCGGSGSGEVKRTLKITDWMPDDMNFSDVKQIHQTDTGSTLDTTGAGCAVATESMTFTLISVVMLLPGIW

SEQ ID NO: 860336 - protein, 572 aa, Homo sapiens
MDAQTWPVGFRCLLLLALVGSARSEGVQTCEEVRKLFQWRLLGAVRGLPDSPRAGPDLQVCISKKPTCCTRKMEERYQIAARQDMQQFLQTSSSTLKFLISRNAAAFQETLETLIKQAENYTSILFCSTYRNMALEAAASVQEFFTDVGLYLFGADVNPEEFVNRFFDSLFPLVYNHLINPGVTDSSLEYSECIRMARRDVSPFGNIPQRVMGQMGRSLLPSRTFLQALNLGIEVINTTDYLHFSKECSRALLKMQYCPHCQGLALTKPCMGYCLNVMRGCLAHMAELNPHWHAYIRSLEELSDAMHGTYDIGHVLLNFHLLVNDAVLQAHLNGQKLLEQVNRICGRPVRTPTQSPRCSFDQSKEKHGMKTTTRNSEETLANRRKEFINSLRLYRSFYGGLADQLCANELAAADGLPCWNGEDIVKSYTQRVVGNGIKAQSGNPEVKVKGIDPVINQIIDKLKHVVQLLQGRSPKPDKWELLQLGSGGGMVEQVSGDCDDEDGCGGSGSGEVKRTLKITDWMPDDMNFSDVKQIHQTDTGSTLDTTGAGCAVATESMTFTLISVVMLLPGIW

SEQ ID NO: 860337 - protein, 229 aa, Homo sapiens
MIFTFMTRKSCCSKQVQRKYWRNCQKLTATGSAPFPLALQRFSVVWDACSEALIMFDKDNLDDMGYIVENDVIMHALTKQLEAVSDRVTVLYRSKAIRYTWPCPFPMADSSPWVHITLGDGSTFQTKLLIGADGHNSGVRQAVGIQNVSWNYDQSAVVATLHLSEATENNVAWQRFLPSGPIALLPLSDTLSSLVWSTSHEHAAELVSMDEEKFVDAVNSAFVSINLPS

SEQ ID NO: 860338 - protein, 393 aa, Homo sapiens
GRDWSALLRTHYVGGPAGVLSATAQVCTMAARLVSRCGAVRAAPHSGPLVSWRRWSGASTDTVYDVVVSGGGLVGAAMACALGYDIHFHDKKILLLEAGPKKVLEKLSETYSNRVSSISPGSATLLSSFGAWDHICNMRYRAFRRMQVWDACSEALIMFDKDNLDDMGYIVENDVIMHALTKQLEAVSDRVTVLYRSKAIRYTWPCPFPMADSSPWVHITLGDGSTFQTKLLIGADGHNSGVRQAVGIQNVSWNYDQSAVVATLHLSEATENNVAWQRFLPSGPIALLPLSDTLSSLVWSTSHEHAAELVSMDEEKFVDAVNSAFWSDADHTDFIDTAGAMLQYAVSLLKPTKVSARQLPPSVARVDAKSRVLFPLGLGHAAEYVRPRVALIG

SEQ ID NO: 860339 - protein, 496 aa, Homo sapiens
GRDWSALLRTHYVGGPAGVLSATAQVCTMAARLVSRCGAVRAAPHSGPLVSWRRWSGASTDTVYDVVVSGGGLVGAAMACALGYDIHFHDKKILLLEAGPKKVLEKLSETYSNRVSSISPGSATLLSSFGAWDHICNMRYRAFRRMQVWDACSEALIMFDKDNLDDMGYIVENDVIMHALTKQLEAVSDRVTVLYRSKAIRYTWPCPFPMADSSPWVHITLGDGSTFQTKLLIGADGHNSGVRQAVGIQNVSWNYDQSAVVATLHLSEATENNVAWQRFLPSGPIALLPLSDTLSSLVWSTSHEHAAELVSMDEEKFVDAVNSAFWSDADHTDFIDTAGAMLQYAVSLLKPTKVSARQLPPSVARVDAKSRVLFPLGLGHAAEYVRPRVALIGDAAHRVHPLAGQGVNMGFGDISSLAHHLSTAAFNGKDLGSVSHLTGYETERQRHNTALLAATDLLKRLYSTSASPLVLLRTWGLQATNAVSPLKEQIMAFASK

SEQ ID NO: 860340 - protein, 261 aa, Homo sapiens
GRDWSALLRTHYVGGPAGVLSATAQVCTMAARLVSRCGAVRAAPHSGPLVSWRRWSGASTDTVYDVVVSGGGLVGAAMACALGYDIHFHDKKILLLEAGPKKVLEKLSETYSNRVSSISPGSATLLSSFGAWDHICNMRYRAFRRMQVWDACSEALIMFDKDNLDDMGYIVENDVIMHALTKQLEAVSDRVTVLYRSKAIRYTWPCPFPMADSSPWVHITLGDGSTFQTKLLVVEDSYFARGLVYLHLILDSRDSGFRFKL

SEQ ID NO: 860341 - protein, 418 aa, Homo sapiens
ETGPRRHDESRESPSTTCPKTISQDMIFTFMTRKSCCSKQVQRKYWRNCQKLTATGSAPFPLALQRFSVVWDACSEALIMFDKDNLDDMGYIVENDVIMHALTKQLEAVSDRVTVLYRSKAIRYTWPCPFPMADSSPWVHITLGDGSTFQTKLLIGADGHNSGVRQAVGIQNVSWNYDQSAVVATLHLSEATENNVAWQRFLPSGPIALLPLSDTLSSLVWSTSHEHAAELVSMDEEKFVDAVNSAFWSDADHTDFIDTAGAMLQYAVSLLKPTKVSARQLPPSVARVDAKSRVLFPLGLGHAAEYVRPRVALIGDAAHRVHPLAGQGVNMGFGDISSLAHHLSTAAFNGKDLGSVSHLTGYETERQRHNTALLAATDLLKRLYSTSASPLVLLRTWGLQATNAVSPLKEQIMAFASK

SEQ ID NO: 860342 - protein, 105 aa, Homo sapiens [sequence omitted]

SEQ ID NO: 860343 - protein, 494 aa, Homo sapiens
GRDWSALLRTHYVGGPAGVLSATAQVCTMAARLVSRCGAVRAAPHSGPLVSWRRWSGASTDTVYDVVVSGGGLVGAAMACALGYDIHFHDKKILLLEAGPKKVLEKLSETYSNRVSSISPGSATLLSSFGAWDHICNMRYRAFRRMQVWDACSEALIMFDKDNLDDMGYIVENDVIMHALTKQLEAVSDRVTVLYRSKAIRYTWPCPFPMADSSPWVHITLGDGSTFQTKLLIGADGHNSGVRQAVGIQNVSWNYDQSAVVATLHLSEATENNVAWQRFLPSGPIALLPLSDTLSSLVWSTSHEHAAELVSMDEEKFVDAVNSAFWSDADHTDFIDTAGAMLQYAVSLLKPTKVSARQLPPSVARVDAKSRVLFPLGLGHAAEYVRPRVALIGDAAHRVHPLAGQGVNMGFGDISSLAHHLSTAAFNGKDLGSVSHLTGYETERQRHNTALLAATDLLKRLYSTSASPLVLLRTWGLQATNAVSPLKVRGCSEE

SEQ ID NO: 860344 - protein, 174 aa, Homo sapiens
GRDWSALLRTHYVGGPAGVLSATAQVCTMAARLVSRCGAVRAAPHSGPLVSWRRWSGASTDTVYDVVVSGGGLVGAAMACALGYDIHFHDKKILLLEAGPKKVLEKLSETYSNRVSSISPGSATLLSSFGAWDHICNMRYRAFRRMQVPLYLFNFVKMSWSVLRYRSPLSPSVL

SEQ ID NO: 860345 - protein, 496 aa, Homo sapiens; identical to SEQ ID NO: 860339

SEQ ID NO: 860346 - protein, 496 aa, Homo sapiens; identical to SEQ ID NO: 860339

SEQ ID NO: 860347 - protein, 412 aa, Homo sapiens
GRDWSALLRTHYVGGPAGVLSATAQVCTMAARLVSRCGAVRAAPHSGPLVSWRRWSGASTDTVYDVVVSGGGLVGAAMACALGYDIHFHDKKILLLEAGPKKVLEKLSETYSNRVSSISPGSATLLSSFGAWDHICNMRYRAFRRMQVWDACSEALIMFDKDNLDDMGYIVENDVIMHALTKQLEAVSDRVTVLYRSKAIRYTWPCPFPMADSSPWVHITLGDGSTFQTKLLIGADGHNSGVRQAVGIQNVSWNYDQSAVVATLHLSEATENNVAWQRFLPSGPIALLPLSDTLSSLVWSTSHEHAAELVSMDEEKFVDAVNSAFWSDADHTDFIDTAGAMLQYAVSLLKPTKVSARQLPPSVARVDAKSRVLFPLGLGHAAEYVRPRVALIGNRLWPLQANEYSSPKERLR

SEQ ID NO: 860348 - protein, 496 aa, Homo sapiens; identical to SEQ ID NO: 860339

SEQ ID NO: 860349 - protein, 496 aa, Homo sapiens; identical to SEQ ID NO: 860339

SEQ ID NO: 860350 - protein, 496 aa, Homo sapiens; identical to SEQ ID NO: 860339

SEQ ID NO: 860351 - protein, 334 aa, Homo sapiens
GRDWSALLRTHYVGGPAGVLSATAQVCTMAARLVSRCGAVRAAPHSGPLVSWRRWSGASTDTVYDVVVSGGGLVGAAMACALGYDIHFHDKKILLLEAGPKKVLEKLSETYSNRVSSISPGSATLLSSFGAWDHICNMRYRAFRRMQVWDACSEALIMFDKDNLDDMGYIVENDVIMHALTKQLEAVSDRVTVLYRSKAIRYTWPCPFPMADSSPWVHITLGDGSTFQTKLLIGADGHNSGVRQAVGIQNVSWNYDQSAVVATLHLSEATENNVAWQRFLPSGPIALLPLSDTLSSLVWSTSHEHAAELVSMDEEKFVDAVNSAFEQIMAFASK

SEQ ID NO: 860352 - protein, 491 aa, Homo sapiens
GQSLFSPHLTAPLRASGGSLRPPHGHFSWTEAAATVTAIVAAAVAARAMRGQGPPLSSFGVWLASRAASDPSRPRRQGYDIHFHDKKILLLEAGPKKVLEKLSETYSNRVSSISPGSATLLSSFGAWDHICNMRYRAFRRMQVWDACSEALIMFDKDNLDDMGYIVENDVIMHALTKQLEAVSDRVTVLYRSKAIRYTWPCPFPMADSSPWVHITLGDGSTFQTKLLIGADGHNSGVRQAVGIQNVSWNYDQSAVVATLHLSEATENNVAWQRFLPSGPIALLPLSDTLSSLVWSTSHEHAAELVSMDEEKFVDAVNSAFWSDADHTDFIDTAGAMLQYAVSLLKPTKVSARQLPPSVARVDAKSRVLFPLGLGHAAEYVRPRVALIGDAAHRVHPLAGQGVNMGFGDISSLAHHLSTAAFNGKDLGSVSHLTGYETERQRHNTALLAATDLLKRLYSTSASPLVLLRTWGLQATNAVSPLKEQIMAFASK

SEQ ID NO: 860353 - protein, 266 aa, Homo sapiens
MQIGADGHNSGVRQAVGIQNVSWNYDQSAVVATLHLSEATENNVAWQRFLPSGPIALLPLSDTLSSLVWSTSHEHAAELVSMDEEKFVDAVNSAFWSDADHTDFIDTAGAMLQYAVSLLKPTKVSARQLPPSVARVDAKSRVLFPLGLGHAAEYVRPRVALIGDAAHRVHPLAGQGVNMGFGDISSLAHHLSTAAFNGKDLGSVSHLTGYETERQRHNTALLAATDLLKRLYSTSASPLVLLRTWGLQATNAVSPLKEQIMAFASK

SEQ ID NO: 860354 - protein, 266 aa, Homo sapiens; identical to SEQ ID NO: 860353

SEQ ID NO: 860355 - protein, 496 aa, Homo sapiens; identical to SEQ ID NO: 860339

SEQ ID NO: 860356 - protein, 105 aa, Homo sapiens
MLQYAVSLLKPTKVSARQLPPSVARVDAKSRVLFPLGLGHAAEYVRPRVALIGDAAHRVHPLAGQGVNMGFGDISSLAHHLSTAAFNGKDLGKDSDTMGKYPEVI

SEQ ID NO: 860357 - protein, 112 aa, Homo sapiens
LSCCLSPVGGAFYSLCWAPCGKSPLLPLTSLLGLSQPRRCPRPPVFILGRNHRLSMPRVSLWGPLRPTVTLPYWAAPRPNRRCLKTFPGPGRPPNFFFFFFFLIWLKRAFYY

SEQ ID NO: 860358 - protein, 125 aa, Homo sapiens
KWRVLLKNTENNLLRNRMEGQGGAQVLVKSLWSIDPFFCRFWCLGPYLQHEIQSLSANAGAPLSFQFCQDVLVCLKISESTFSKCSVNVGGIRQGSHSVRGSGEKHSQENFLLILYFPTREADKL

SEQ ID NO: 860359 - protein, 556 aa, Homo sapiens
MEGPLSVFGDRSTGETIRSQNVMAAASIANIVKSSLGPVGLDKMLVDDIGDVTITNDGATILKLLEVEHPAAKVLCELADLQDKEVGDGTTSVVIIAAELLKNADELVKQKIHPTSVISGYRLACKEAVRYINENLIVNTDELGRDCLINAAKTSMSSKIIGINGDFFANMVVDAVLAIKYTDIRGQPRYPVNSVNILKAHGRSQMESMLISGYALNCVVGSQGMPKRIVNAKIACLDFSLQKTKMKLGVQVVITDPEKLDQIRQRESDITKERIQKILATGANVILTTGGIDDMCLKYFVEAGAMAVRRVLKRDLKRIAKASGATILSTLANLEGEETFEAAMLGQAEEVVQERICDDELILIKNTKARTSASIILRGANDFMCDEMERSLHDALCVVKRVLESKSVVPGGGAVEAALSIYLENYATSMGSREQLAIAEFARSLLVIPNTLAVNAAQDSTDLVAKLRAFHNEAQVNPERKNLKWIGLDLSNGKPRDNKQAGVFEPTIVKVKSLKFATEAAITILRIDDLIKLHPESKDDKHGSYEDAVHSGALND

SEQ ID NO: 860360 - protein, 38 aa, Homo sapiens
MSKKLAESEGKGWYSCTKWQSMKLVVITFFFFPRHQIP

SEQ ID NO: 860361 - protein, 556 aa, Homo sapiens; identical to SEQ ID NO: 860359

SEQ ID NO: 860362 - protein, 339 aa, Homo sapiens
MEGPLSVFGDRSTGETIRSQNVMAAASIANIVKSSLGPVGLDKMLVDDIGDVTITNDGATILKLLEVEHPAAKVLCELADLQDKEVGDGTTSVVIIAAELLKNADELVKQKIHPTSVISGYRLACKEAVRYINENLIVNTDELGRDCLINAAKTSMSSKIIGINGDFFANMVVDAVLAIKYTDIRGQPRYPVNSVNILKAHGRSQMESMLISGYALNCVVGSQGMPKRIVNAKIACLDFSLQKTKMKLGVQVVITDPEKLDQIRQRESDITKERIQKILATGANVILTTGGIDDMCLKYFVEAGAMAVRRVLKRDLKRIAKASGGMSCAGCHIKYFYYP

SEQ ID NO: 860363 - protein, 177 aa, Homo sapiens
MEGPLSVFGDRSTGETIRSQNVMAAASIANIVKSSLGPVGLDKMLVDDIGDVTITNDGATILKLLEVEHPAAKVLCELADLQDKEVGDGTTSVVIIAAELLKNADELVKQKIHPTSVISGYRLACKEAVRYINENLIVNTDELGRDCLINAAKTSMSSKIIGMYPCGCQIKFRLFKA

SEQ ID NO: 860364 - protein, 596 aa, Homo sapiens
SFSFPPCPAAGPGQPGSGWGGVLPSSSWDIARVRSTPSQPLLWSPVGRGAAILVARGVSRIRRVSLPSRWRGLCPCSVTAALGKRSAPKTDVTITNDGATILKLLEVEHPAAKVLCELADLQDKEVGDGTTSVVIIAAELLKNADELVKQKIHPTSVISGYRLACKEAVRYINENLIVNTDELGRDCLINAAKTSMSSKIIGINGDFFANMVVDAVLAIKYTDIRGQPRYPVNSVNILKAHGRSQMESMLISGYALNCVVGSQGMPKRIVNAKIACLDFSLQKTKMKLGVQVVITDPEKLDQIRQRESDITKERIQKILATGANVILTTGGIDDMCLKYFVEAGAMAVRRVLKRDLKRIAKASGATILSTLANLEGEETFEAAMLGQAEEVVQERICDDELILIKNTKARTSASIILRGANDFMCDEMERSLHDALCVVKRVLESKSVVPGGGAVEAALSIYLENYATSMGSREQLAIAEFARSLLVIPNTLAVNAAQDSTDLVAKLRAFHNEAQVNPERKNLKWIGLDLSNGKPRDNKQAGVFEPTIVKVKSLKFATEAAITILRIDDLIKLHPESKDDKHGSYEDAVHSGALND

SEQ ID NO: 860365 - protein, 513 aa, Homo sapiens
MLVDDIGDVTITNDGATILKLLEVEHPAAKVLCELADLQDKEVGDGTTSVVIIAAELLKNADELVKQKIHPTSVISGYRLACKEAVRYINENLIVNTDELGRDCLINAAKTSMSSKIIGINGDFFANMVVDAVLAIKYTDIRGQPRYPVNSVNILKAHGRSQMESMLISGYALNCVVGSQGMPKRIVNAKIACLDFSLQKTKMKLGVQVVITDPEKLDQIRQRESDITKERIQKILATGANVILTTGGIDDMCLKYFVEAGAMAVRRVLKRDLKRIAKASGATILSTLANLEGEETFEAAMLGQAEEVVQERICDDELILIKNTKARTSASIILRGANDFMCDEMERSLHDALCVVKRVLESKSVVPGGGAVEAALSIYLENYATSMGSREQLAIAEFARSLLVIPNTLAVNAAQDSTDLVAKLRAFHNEAQVNPERKNLKWIGLDLSNGKPRDNKQAGVFEPTIVKVKSLKFATEAAITILRIDDLIKLHPESKDDKHGSYEDAVHSGALND

SEQ ID NO: 860366 - protein, 534 aa, Homo sapiens [sequence omitted]

SEQ ID NO: 860367 - protein, 538 aa, Homo sapiens
MEGPLSVFGDRSTGETIRSQNVMAAASIANIVKSSLGPVGLDILKLLEVEHPAAKVLCELADLQDKEVGDGTTSVVIIAAELLKNADELVKQKIHPTSVISGYRLACKEAVRYINENLIVNTDELGRDCLINAAKTSMSSKIIGINGDFFANMVVDAVLAIKYTDIRGQPRYPVNSVNILKAHGRSQMESMLISGYALNCVVGSQGMPKRIVNAKIACLDFSLQKTKMKLGVQVVITDPEKLDQIRQRESDITKERIQKILATGANVILTTGGIDDMCLKYFVEAGAMAVRRVLKRDLKRIAKASGATILSTLANLEGEETFEAAMLGQAEEVVQERICDDELILIKNTKARTSASIILRGANDFMCDEMERSLHDALCVVKRVLESKSVVPGGGAVEAALSIYLENYATSMGSREQLAIAEFARSLLVIPNTLAVNAAQDSTDLVAKLRAFHNEAQVNPERKNLKWIGLDLSNGKPRDNKQAGVFEPTIVKVKSLKFATEAAITILRIDDLIKLHPESKDDKHGSYEDAVHSGALND

SEQ ID NO: 860368 - protein, 538 aa, Homo sapiens
MEGPLSVFGDRSTGETIRSQNVMAAASIANIVKSSLGPVGLDKMLVDDIGDVTITNDGATILKLLEVEHPAAKVLCELADLQDKEVGDGTTSVVIIAAELLKNADELVKQKIHPTSVISGYRLACKEAVRYINENLIVNTDELGRDCLINAAKTSMSSKIIGINGDFFANMVVDAVLAIKYTDIRGQPRYPVNSVNILKAHGRSQMESMLISGYALNCVVGSQGMPKRIVNAKIACLDFSLQKTKMKLGVQVVITDPEKLDQIRQRESDITKERIQKILATGANVILTTGGIDDMCLKYFVEAGAMAVRRVLKRDLKRIAKASGATILSTLANLEGEETFEAAMLGQAEEVVQERICDDELILIKNTKARTSASIILRGANDFMCDEMERSLHDALCVVKRVLESKSVVPGGGAVEAALSIYFARSLLVIPNTLAVNAAQDSTDLVAKLRAFHNEAQVNPERKNLKWIGLDLSNGKPRDNKQAGVFEPTIVKVKSLKFATEAAITILRIDDLIKLHPESKDDKHGSYEDAVHSGALND

SEQ ID NO: 860369 - protein, 339 aa, Homo sapiens; identical to SEQ ID NO: 860362

SEQ ID NO: 860370 - protein, 275 aa, Homo sapiens
MEGPLSVFGDRSTGETIRSQNVMAAASIANIVKSSLGPVGLDKMLVDDIGDVTITNDGATILKLLEVEHPAAKVLCELADLQDKEVGDGTTSVVIIAAELLKNADELVKQKIHPTSVISGYRLACKEAVRYINENLIVNTDELGRDCLINAAKTSMSSKIIGINGDFFANMVVDAVLAIKYTDIRGQPRYPVNSVNILKAHGRSQMESMLISGYALNCVVGSQGMPKRIVNAKIACLDFSLQKTKMKLGVQVVITDPEKLDQIRQRYVERLFLAF

SEQ ID NO: 860371 - protein, 194 aa, Homo sapiens
MVLATKARTSASIILRGANDFMCDEMERSLHDALCVVKRVLESKSVVPGGGAVEAALSIYLENYATSMGSREQLAIAEFARSLLVIPNTLAVNAAQDSTDLVAKLRAFHNEAQVNPERKNLKWIGLDLSNGKPRDNKQAGVFEPTIVKVKSLKFATEAAITILRIDDLIKLHPESKDDKHGSYEDAVHSGALND

SEQ ID NO: 860372 - protein, 364 aa, Homo sapiens
MEGPLSVFGDRSTGETIRSQNVMAAASIANIVKSSLGPVGLDTQLIGWTDYLRDCSAIPTRLAANPLTCQVTCDTYDTLPATPHTITTDDAWAWTRSKDQTTRPDAEDTYTTRRETNYARTQLPYTTTARLTIRQNPDKAHRRQYRTHHERHSHLQMRRTQQDDDDTPPDNNLQEGTNELEHGASSIDMELTGGHHAPIPVDPIHKQANSGTEQGDEATVRLPPWRQNDMPCTPQTRHKDKHDPHEPEPGAHRKQRGRTSRRKPTARHAPRGHHKSTKGAHSQHRPPGEPMHRPHGQGGDTPGERPRAPREERNTGRTEHTAEEQQREPTSSRRTEHPQRARTPRPQESPETDTTPRRTPTAGP

SEQ ID NO: 860373 - protein, 401 aa, Homo sapiens
MSSKIIGINGDFFANMVVDAVLAIKYTDIRGQPRYPVNSVNILKAHGRSQMESMLISGYALNCVVGSQGMPKRIVNAKIACLDFSLQKTKMKLGVQVVITDPEKLDQIRQRESDITKERIQKILATGANVILTTGGIDDMCLKYFVEAGAMAVRRVLKRDLKRIAKASGATILSTLANLEGEETFEAAMLGQAEEVVQERICDDELILIKNTKARTSASIILRGANDFMCDEMERSLHDALCVVKRVLESKSVVPGGGAVEAALSIYLENYATSMGSREQLAIAEFARSLLVIPNTLAVNAAQDSTDLVAKLRAFHNEAQVNPERKNLKWIGLDLSNGKPRDNKQAGVFEPTIVKVKSLKFATEAAITILRIDDLIKLHPESKDDKHGSYEDAVHSGALND

SEQ ID NO: 860374 - protein, 354 aa, Homo sapiens
MEGPLSVFGDRSTGETIRSQNGMPKRIVNAKIACLDFSLQKTKMKLGVQVVITDPEKLDQIRQRESDITKERIQKILATGANVILTTGGIDDMCLKYFVEAGAMAVRRVLKRDLKRIAKASGATILSTLANLEGEETFEAAMLGQAEEVVQERICDDELILIKNTKARTSASIILRGANDFMCDEMERSLHDALCVVKRVLESKSVVPGGGAVEAALSIYLENYATSMGSREQLAIAEFARSLLVIPNTLAVNAAQDSTDLVAKLRAFHNEAQVNPERKNLKWIGLDLSNGKPRDNKQAGVFEPTIVKVKSLKFATEAAITILRIDDLIKLHPESKDDKHGSYEDAVHSGALND

SEQ ID NO: 860375 - protein, 163 aa, Homo sapiens
QRPHAGCIVFKVYGKGCFYSTPTGNHRFGLQNYATSMGSREQLAIAEFARSLLVIPNTLAVNAAQDSTDLVAKLRAFHNEAQVNPERKNLKWIGLDLSNGKPRDNKQAGVFEPTIVKVKSLKFATEAAITILRIDDLIKLHPESKDDKHGSYEDAVHSGALND

SEQ ID NO: 860376 - protein, 293 aa, Homo sapiens [sequence omitted]

SEQ ID NO: 860377 - protein, 126 aa, Homo sapiens
MGHMLLPFRLGLGGPIGSGHQFFPWIHIGDLAGILTHALEANHVHGVLNGVAPSSATNAEFAQTFGAALGRRAFIPLPSAVVQAVFGRQRAIMLLEGQKVIPRRTLATGYQYSFPELGAALKEIVA

SEQ ID NO: 860378 - protein, 220 aa, Homo sapiens
MCTYVFSGFLFPMFLLQDAITKAPQPPKAWVLVTGVAYYQPSLTAEYDEDSPGGDFDFFSNLVTKWEAAARLPGDSTRQVVVRSGVVLGRGGGAMGHMLLPFRLGLGGPIGSGHQFFPWIHIGDLAGILTHALEANHVHGVLNGVAPSSATNAEFAQTFGAALGRRAFIPLPSAVVQAVFGRQRAIMLLEGQKVIPRRTLATGYQYSFPELGAALKEIVA

SEQ ID NO: 860379 - protein, 126 aa, Homo sapiens; identical to SEQ ID NO: 860377

SEQ ID NO: 860380 - protein, 126 aa, Homo sapiens; identical to SEQ ID NO: 860377

SEQ ID NO: 860381 - protein, 200 aa, Homo sapiens [sequence omitted]

SEQ ID NO: 860382 - protein, 200 aa, Homo sapiens [sequence omitted]

SEQ ID NO: 860383 - protein, 128 aa, Homo sapiens
MGWRRKRVPQRGRKAPPPQLHGNINNLYFPIRWRDRLHWDSPNPAAECQRPRSDVGLPKARARPDHVGKSILWKRVGGQSWAAQGGAGALCAFSDRMSSLHRGCRAAMPPSTWPERTSSTLSEGQPGP

SEQ ID NO: 860384 - protein, 163 aa, Homo sapiens
KDPSGLYFKGEAEPALEIIHARVVVRSGVVLGRGGGAMGHMLLPFRLGLGGPIGSGHQFFPWIHIGDLAGILTHALEANHVHGVLNGVAPSSATNAEFAQTFGAALGRRAFIPLPSAVVQAVFGRQRAIMLLEGQKVIPRRTLATGYQYSFPELGAALKEIVA

SEQ ID NO: 860385 - protein, 168 aa, Homo sapiens
MGRVRKGKQKPGGAVGSFKAEKTPVPSLFPALGVVLGRGGGAMGHMLLPFRLGLGGPIGSGHQFFPWIHIGDLAGILTHALEANHVHGVLNGVAPSSATNAEFAQTFGAALGRRAFIPLPSAVVQAVFGRQRAIMLLEGQKVIPRRTLATGYQYSFPELGAALKEIVA

SEQ ID NO: 860386 - protein, 89 aa, Homo sapiens
MGHMLLPFRLGLGGPIGSGHQFFPWIHIGDLAGILTHALEANHVHGVLNGVAPSSATNAEFAIPGVPGRQLILFHALSSCFAKRPHARG

SEQ ID NO: 860387 - protein, 126 aa, Homo sapiens; identical to SEQ ID NO: 860377

SEQ ID NO: 860388 - protein, 126 aa, Homo sapiens; identical to SEQ ID NO: 860377

SEQ ID NO: 860389 - protein, 168 aa, Homo sapiens; identical to SEQ ID NO: 860385

SEQ ID NO: 860390 - protein, 126 aa, Homo sapiens; identical to SEQ ID NO: 860377

SEQ ID NO: 860391 - protein, 126 aa, Homo sapiens; identical to SEQ ID NO: 860377

SEQ ID NO: 860392 - protein, 126 aa, Homo sapiens; identical to SEQ ID NO: 860377

SEQ ID NO: 860393 - protein, 126 aa, Homo sapiens; identical to SEQ ID NO: 860377

SEQ ID NO: 860394 - protein, 326 aa, Homo sapiens
MGWRRKRVPQRGRKAPPPQLHGNINNLYFPIRWRDRLHWDSPNPAAECQRPRSDVGLPKARARPDHVGKSILWKRVGGQSWAAQGGAGALCAFSDRMSSLHRGCRAAMPPSTWPERTSSTLSEAYYQPSLTAEYDEDSPGGDFDFFSNLVTKWEAAARLPGDSTRQVVVRSGVVLGRGGGAMGHMLLPFRLGLGGPIGSGHQFFPWIHIGDLAGILTHALEANHVHGVLNGVAPSSATNAEFAQRCGASCLWATACHHAAGGPEGDPTANTGHWLPVFLPRARGCLKGNCSLSRSWQGPEACSSQASRLGTVNRLSSSRELKPSGS

SEQ ID NO: 860395 - protein, 76 aa, Homo sapiens
ETFQKEVLGSRLETTQLLAKAITKAPQPPKAWVLVTGVGTPPKSPAPYIRQGNGVTQTSVAMHTPEHWSFPGKMTS

SEQ ID NO: 860396 - protein, 121 aa, Homo sapiens
MVIFAPLFAIFAFATCGGYSGGLRLSVDCVNKTESNLSIDIAFAYPFRLHQVTFEVPTCEGKERQKLALIGDSSSSAEFFVTVAVFAFLYSLAATVVYIFFQNKYRENNRGPLIQKVQSVG

SEQ ID NO: 860397 - protein, 263 aa, Homo sapiens [sequence omitted]

SEQ ID NO: 860398 - protein, 285 aa, Homo sapiens
MDPVSQLASAGTFRVLKEPLAFLRALELLFAIFAFATCGGYSGGLRLSVDCVNKTESNLSIDIAFAYPFRLHQVTFEVPTCEGKERQKLALIGDSSSSAEFFVTVAVFAFLYSLAATVVYIFFQNKYRENNRGPLIDFIVTVVFSFLWLVGSSAWAKGLSDVKVATDPKEVLLLMSACKQPSNKCMAIHSPVMSSLNTSVVFGFLNFILWAGNIWFVFKETGWHSSGQRYLSDPMEKHSSSYNQGGYNQDSYGSSSGYSQQASLGPTSDEFGQQPTGPTSFTNQI

SEQ ID NO: 860399 - protein, 300 aa, Homo sapiens
MVIFAPLFAIFAFATCGGYSGGLRLSVDCVNKTESNLSIDIAFAYPFRLHQVTFEVPTCEGKERQKLALIGDSSSSAEFFVTVAVFAFLYSLAATVVYIFFQNKYRENNRGPLIQKVQSVGVKSRAQFIITMQEAQDPDSQCATEVREVEKDFIVTVVFSFLWLVGSSAWAKGLSDVKVATDPKEVLLLMSACKQPSNKCMAIHSPVMSSLNTSVVFGFLNFILWAGNIWFVFKETGWHSSGQRYLSDPMEKHSSSYNQGGYNQDSYGSSSGYSQQASLGPTSDEFGQQPTGPTSFTNQI

SEQ ID NO: 860400 - protein, 263 aa, Homo sapiens [sequence omitted]

SEQ ID NO: 860401 - protein, 266 aa, Homo sapiens
MLSEMTNSRLFAIFAFATCGGYSGGLRLSVDCVNKTESNLSIDIAFAYPFRLHQVTFEVPTCEGKERQKLALIGDSSSSAEFFVTVAVFAFLYSLAATVVYIFFQNKYRENNRGPLIDFIVTVVFSFLWLVGSSAWAKGLSDVKVATDPKEVLLLMSACKQPSNKCMAIHSPVMSSLNTSVVFGFLNFILWAGNIWFVFKETGWHSSGQRYLSDPMEKHSSSYNQGGYNQDSYGSSSGYSQQASLGPTSDEFGQQPTGPTSFTNQI

SEQ ID NO: 860402 - protein, 245 aa, Homo sapiens
MVIFAPLFAIFAFATCGGYSGGLRLSVDCVNKTESNLSIDIAFAYPFRLHQVTFEVPTCEGKERQKLALIGDSSSSAEFFVTVAVFAFLYSLAATVVYIFFQNKYRVWLVGSSAWAKGLSDVKVATDPKEVLLLMSACKQPSNKCMAIHSPVMSSLNTSVVFGFLNFILWAGNIWFVFKETGWHSSGQRYLSDPMEKHSSSYNQGGYNQDSYGSSSGYSQQASLGPTSDEFGQQPTGPTSFTNQI

SEQ ID NO: 860403 - protein, 225 aa, Homo sapiens
MPLPVALQTRLAKRGILKHLEPEPEEEIIAEDYDDDPVDYEATRLEGLPPSWYKVFDPSCGLPYYWNADTDLVSWLSPHDPNSVVTKSAKKLRSSNADAEEKLDRSHDKSDRGHDKSDRSHEKLDRGHDKSDRGHDKSDRDRERGYDKVDRERERDRERDRDRGYDKADREEGKERRHHRREELAPYPKSKKAVSRKDEELDPMDPSSYSGRPPGHVVNRTPQAE

SEQ ID NO: 860404 - protein, 225 aa, Homo sapiens; identical to SEQ ID NO: 860403

SEQ ID NO: 860405 - protein, 252 aa, Homo sapiens
MPLPVALQTRLAKRGILKHLEPEPEEEIIAEDYDDDPVDYEATRLEGLPPSWYKVFDPSCGLPYYWNADTDLVSWLSPHDPNSVVTKSAKKLRSSNADAEEKLDRSHDKSDRGHDKSDRSHEKLDRGHDKSDRGHDKSDRDRERGYDKVDRERERDRERDRDRGYDKADREEGKERRHHRREELAPYPKSKKAVSRKDEELDPMDPSSYSGRPPHGSQDSQGMRPDGLNTGVGLFREAIIPRRPGMGASNSG

SEQ ID NO: 860406 - protein, 225 aa, Homo sapiens; identical to SEQ ID NO: 860403

SEQ ID NO: 860407 - protein, 225 aa, Homo sapiens; identical to SEQ ID NO: 860403

SEQ ID NO: 860408 - protein, 224 aa, Homo sapiens
MPLPVALQTRLAKRGILKHLEPEPEEEIIAEDYDDDPVDYEATRLEGLPPSWYKVFDPSCGLPYYWNADTDLVSWLSPHDPNSVVTKSAKKLRSSNADAEEKLDRSHDKSDRGHDKSDRSHEKLDRGHDKSDRGHDKSDRDRERGYDKVDRERERDRERDRDRGYDKADREEGKERRHHRREELAPYPKSKKGKLGRMGLGETNKVQGALREEAFPQKDAWTWG

SEQ ID NO: 860409 - protein, 224 aa, Homo sapiens; identical to SEQ ID NO: 860408

SEQ ID NO: 860410 - protein, 209 aa, Homo sapiens
MPLPVALQTRLAKRGILKHLEPEPEEEIIAEDYDDDPVDYEATSGLPYYWNADTDLVSWLSPHDPNSVVTKSAKKLRSSNADAEEKLDRSHDKSDRGHDKSDRSHEKLDRGHDKSDRGHDKSDRDRERGYDKVDRERERDRERDRDRGYDKADREEGKERRHHRREELAPYPKSKKAVSRKDEELDPMDPSSYSGRPPGHVVNRTPQAE

SEQ ID NO: 860411 - protein, 145 aa, Homo sapiens
MPLPVALQTRLAKRGILKHLEPEPEEEIIAEDYDDDPVDYEATRLEGLPPSWYKVFDPSCGLPYYWNADTDLVSWLSPHDPNSVVTKSAKKLRSSNADAEEKLDRSHDKSDRGHDKSDRSHEKLDRGHDKSDRGHDKSDRDRERG

SEQ ID NO: 860412 - protein, 151 aa, Homo sapiens
MPLPVALQTRLAKRGILKHLEPEPEEEIIAEDYDDDPVDYEATRLEGLPPSWYKVFDPSCGLPYYWNADTDLVSWLSPHDPNSVVTKSAKKLRSSNADAEEKLDRSHDKSDRGHDKSDRSHEKLDRGHDKSDRGHDKSDRDRERGYSKPKG

SEQ ID NO: 860413 - protein, 260 aa, Homo sapiens
MPLPVALQTRLAKRGILKHLEPEPEEEIIAEDYDDDPVDYEATRLEGLPPSWYKVFDPSCGLPYYWNADTDLVSWLSPHDPNSVVTKSAKKLRSSNADAEEKLDRSHDKSDRGHDKSDRSHEKLDRGHDKSDRGHDKSDRDRERGYDKVDRERERDRERDRDRGYDKADREEGKERRHHRREELAPYPKSKKAKDEELDPMHLSFIIKTPPGHGSQDSQGMRPDGLNTEWASSERRHPKAARHGSLEQRVEWPAVKNGAA

SEQ ID NO: 860414 - protein, 130 aa, Homo sapiens
MPLPVALQTRLAKRGILKHLEPEPEEEIIAEDYDDDPVDYEATRLEGLPPSWYKVFDPSCGLPYYWNADTDLVSWLSPHDPNSVVTKSAKKLRSSNAAVSRKDEELDPMDPSSYSGRPPGHVVNRTPQAE

SEQ ID NO: 860415 - protein, 225 aa, Homo sapiens; identical to SEQ ID NO: 860403

SEQ ID NO: 860416 - protein, 262 aa, Homo sapiens
MPLPVALQTRLAKRGILKHLEPEPEEEIIAEDYDDDPVDYEATRLEGLPPSWYKVFDPSCGLPYYWNADTDLVSWLSPHDPNSVVTKSAKKLRSSNADAEEKLDRSHDKSDRGHDKSDRSHEKLDRGHDKSDRGHDKSDRDRERGYDKVDRERERDRERDRDRGYDKADREEGKERRHHRREELAPYPKSKKAVSRKDEELDPMDPSSYSGRPPHGSQDSQGMRPDGLNTEWASSERRHPKAARHGSLEQRVEWPAVKNGAA

SEQ ID NO: 860417 - protein, 224 aa, Homo sapiens; identical to SEQ ID NO: 860408

SEQ ID NO: 860418 - protein, 211 aa, Homo sapiens
MPLPVALQTRLAKRGILKHLEPEPEEEIIAEDYDDDPVDYEATRLEGLPPSWYKVFDPSCGLPYYWNADTDLVSWLSPHDPNSVVTKSAKKLRSSNADAEEKLDRSHDKSDRGHDKSDRSHEKLDRGHDKSDRGHDKSDRDRERGYDKVDRERERDRERDRDRGYDKADREEGKERRHHRREELAPYPKSKKGKLGRMGLGETNKVQGALR

SEQ ID NO: 860419 - protein, 130 aa, Homo sapiens; identical to SEQ ID NO: 860414

SEQ ID NO: 860420 - protein, 1065 aa, Homo sapiens
MKILILGIFLFLCSTPAWAKEKHYYIGIIETTWDYASDHGEKKLISVDTEHSNIYLQNGPDRIGRLYKKALYLQYTDETFRTTIEKPVWLGFLGPIIKAETGDKVYVHLKNLASRPYTFHSHGITYYKEHEGAIYPDNTTDFQRADDKVYPGEQYTYMLLATEEQSPGEGDGNCVTRIYHSHIDAPKDIASGLIGPLIICKKDSLDKEKEKHIDREFVVMFSVVDENFSWYLEDNIKTYCSEPEKVDKDNEDFQESNRMYSVNGYTFGSLPGLSMCAEDRVKWYLFGMGNEVDVHAAFFHGQALTNKNYRIDTINLFPATLFDAYMVAQNPGEWMLSCQNLNHLKAGLQAFFQVQECNKSSSKDNIRGKHVRHYYIAAEEIIWNYAPSGIDIFTKENLTAPGSDSAVFFEQGTTRIGGSYKKLVYREYTDASFTNRKERGPEEEHLGILGPVIWAEVGDTIRVTFHNKGAYPLSIEPIGVRFNKNNEGTYYSPNYNPQSRSVPPSASHVAPTETFTYEWTVPKEVGPTNADPVCLAKMYYSAVDPTKDIFTGLIGPMKICKKGSLHANGRQKDVDKEFYLFPTVFDENESLLLEDNIRMFTTAPDQVDKEDEDFQESNKMHSMNGFMYGNQPGLTMCKGDSVVWYLFSAGNEADVHGIYFSGNTYLWRGERRDTANLFPQTSLTLHMWPDTEGTFNVECLTTDHYTGGMKQKYTVNQCRRQSEDSTFYLGERTYYIAAVEVEWDYSPQREWEKELHHLQEQNVSNAFLDKGEFYIGSKYKKVVYRQYTDSTFRVPVERKAEEEHLGILGPQLHADVGDKVKIIFKNMATRPYSIHAHGVQTESSTVTPTLPGETLTYVWKIPERSGAGTEDSACIPWAYYSTVDQVKDLYSGLIGPLIVCRRPYLKVFNPRRKLEFALLFLVFDENESWYLDDNIKTYSDHPEKVNKDDEEFIESNKMHAINGRMFGNLQGLTMHVGDEVNWYLMGMGNEIDLHTVHFHGHSFQYKHRGVYSSDVFDIFPGTYQTLEMFPRTPGIWLLHCHVTDHIHAGMETTYTVLQNEDTKSG

SEQ ID NO: 860421 - protein, 120 aa, Homo sapiens
MKILILGIFLFLCSTPAWAKEKHYYIGIIETTWDYASDHGEKKLISVDTEHSNIYLQNGPDRIGRLYKKALYLQYTDETFRTTIEKPVWLGFLGPIIKAETGDKVYVHLKEHEGAIYPDN

SEQ ID NO: 860422 - protein, 1065 aa, Homo sapiens; identical to SEQ ID NO: 860420

SEQ ID NO: 860423 - protein, 1047 aa, Homo sapiens
MKILILGIFLFLCSTPAWAKEKHYYIGIIETTWDYASDHGEKKLISVDTEHSNIYLQNGPDRIGRLYKKALYLQYTDETFRTTIEKPVWLGFLGPIIKAETGDKVYVHLKNLASRPYTFHSHGITYYKEHEGAIYPDNTTDFQRADDKVYPGEQYTYMLLATEEQSPGEGDGNCVTRIYHSHIDAPKDIASGLIGPLIICKKDSLDKEKEKHIDREFVVMFSVVDENFSWYLEDNIKTYCSEPEKVDKDNEDFQESNRMYSVNGYTFGSLPGLSMCAEDRFHGQALTNKNYRIDTINLFPATLFDAYMVAQNPGEWMLSCQNLNHLKAGLQAFFQVQECNKSSSKDNIRGKHVRHYYIAAEEIIWNYAPSGIDIFTKENLTAPGSDSAVFFEQGTTRIGGSYKKLVYREYTDASFTNRKERGPEEEHLGILGPVIWAEVGDTIRVTFHNKGAYPLSIEPIGVRFNKNNEGTYYSPNYNPQSRSVPPSASHVAPTETFTYEWTVPKEVGPTNADPVCLAKMYYSAVDPTKDIFTGLIGPMKICKKGSLHANGRQKDVDKEFYLFPTVFDENESLLLEDNIRMFTTAPDQVDKEDEDFQESNKMHSMNGFMYGNQPGLTMCKGDSVVWYLFSAGNEADVHGIYFSGNTYLWRGERRDTANLFPQTSLTLHMWPDTEGTFNVECLTTDHYTGGMKQKYTVNQCRRQSEDSTFYLGERTYYIAAVEVEWDYSPQREWEKELHHLQEQNVSNAFLDKGEFYIGSKYKKVVYRQYTDSTFRVPVERKAEEEHLGILGPQLHADVGDKVKIIFKNMATRPYSIHAHGVQTESSTVTPTLPGETLTYVWKIPERSGAGTEDSACIPWAYYSTVDQVKDLYSGLIGPLIVCRRPYLKVFNPRRKLEFALLFLVFDENESWYLDDNIKTYSDHPEKVNKDDEEFIESNKMHAINGRMFGNLQGLTMHVGDEVNWYLMGMGNEIDLHTVHFHGHSFQYKHRGVYSSDVFDIFPGTYQTLEMFPRTPGIWLLHCHVTDHIHAGMETTYTVLQNEDTKSG

SEQ ID NO: 860424 - protein, 1047 aa, Homo sapiens
MKILILGIFLFLCSTPAWAKEKHYYIGIIETTWDYASDHGEKKLISVDTEHSNIYLQNGPDRIGRLYKKALYLQYTDETFRTTIEKPVWLGFLGPIIKAETGDKVYVHLKNLASRPYTFHSHGITYYKEHEGAIYPDNTTDFQRADDKVYPGEQYTYMLLATEEQSPGEGDGNCVTRIYHSHIDAPKDIASGLIGPLIICKKDSLDKEKEKHIDREFVVMFSVVDENFSWYLEDNIKTYCSEPEKVDKDNEDFQESNRMYSVNGYTFGSLPGLSMCAEDRVKWYLFGMGNEVDVHAAFFHGQALTNKNYRIDTINLFPATLFDAYMVAQNPGEWMLSCQNLNHLKAGLQAFFQVQECNKSSSKDNIRGKHVRHYYIAAEEIIWNYAPSGIDIFTKENLTAPGSDSAVFFEQGTTRIGGSYKKLVYREYTDASFTNRKERGPEEEHLGILGPVIWAEVGDTIRVTFHNKGAYPLSIEPIGVRFNKNNEGTYYSPNYNPQSRSVPPSASHVAPTETFTYEWTVPKEVGPTNADPVCLAKMYYSAVDPTKDIFTGLIGPMKICKKGSLHANGRQKDVDKEFYLFPTVFDENESLLLEDNIRMFTTAPDQVDKEDEDFQESNKMHSMNGFMYGNQPGLTMCKGDSVVWYLFSAGNEADVHGIYFSGNTYLWRGERRDTANLFPQTSLTLHMWPDTEGTFNVECLTTDHYTGGMKQKYTVNQCRRQSEDSTFYLGERTYYIAAVEVEWDYSPQREWEGEFYIGSKYKKVVYRQYTDSTFRVPVERKAEEEHLGILGPQLHADVGDKVKIIFKNMATRPYSIHAHGVQTESSTVTPTLPGETLTYVWKIPERSGAGTEDSACIPWAYYSTVDQVKDLYSGLIGPLIVCRRPYLKVFNPRRKLEFALLFLVFDENESWYLDDNIKTYSDHPEKVNKDDEEFIESNKMHAINGRMFGNLQGLTMHVGDEVNWYLMGMGNEIDLHTVHFHGHSFQYKHRGVYSSDVFDIFPGTYQTLEMFPRTPGIWLLHCHVTDHIHAGMETTYTVLQNEDTKSG

SEQ ID NO: 860425 - protein, 1065 aa, Homo sapiens; identical to SEQ ID NO: 860420

SEQ ID NO: 860426 - protein, 867 aa, Homo sapiens
MKILILGIFLFLCSTPAWAKEKHYYIGIIETTWDYASDHGEKKLISVDTEHSNIYLQNGPDRIGRLYKKALYLQYTDETFRTTIEKPVWLGFLGPIIKAETGDKVYVHLKNLASRPYTFHSHGITYYKEHEGAIYPDNTTDFQRADDKVYPGEQYTYMLLATEEQSPGEGDGNCVTRIYHSHIDAPKDIASGLIGPLIICKKDSLDKEKEKHIDREFVVMFSVVDENFSWYLEDNIKTYCSEPEKVDKDNEDFQESNRMYSVNGYTFGSLPGLSMCAEDRVKWYLFGMGNEVDVHAAFFHGQALTNKNYRIDTINLFPATLFDAYMVAQNPGEWMLSCQNLNHLKAGLQAFFQVQECNKSSSKDNIRGKHVRHYYIAAEEIIWNYAPSGIDIFTKENLTAPGSDSAVFFEQGTTRIGGSYKKLVYREYTDASFTNRKERGPEEEHLGILGPVIWAEVGDTIRVTFHNKGAYPLSIEPIGVRFNKNNEGTYYSPNYNPQSRSVPPSASHVAPTETFTYEWTVPKEVGPTNADPVCLAKMYYSAVDPTKDIFTGLIGPMKICKKGSLHANGRQKDVDKEFYLFPTVFDENESLLLEDNIRMFTTAPDQVDKEDEDFQESNKMHSMNGFMYGNQPGLTMCKGDSVVWYLFSAGNEADVHGIYFSGNTYLWRGERRDTANLFPQTSLTLHMWPDTEGTFNVECLTTDHYTGGMKQKYTVNQCRRQSEDSTFYLGERTYYIAAVEVEWDYSPQREWEKELHHLQEQNVSNAFLDKGEFYIGSKYKKVVYRQYTDSTFRVPVERKAEEEHLGILGPQLHADVGDKVKIIFKNMATRPYSIHAHGVQTESSTVTPTLPGFCLYSMGLLFNCGSS

SEQ ID NO: 860427 - protein, 1065 aa, Homo sapiens; identical to SEQ ID NO: 860420

SEQ ID NO: 860428 - protein, 217 aa, Homo sapiens
MNLGETLTYVWKIPERSGAGTEDSACIPWAYYSTVDQVKDLYSGLIGPLIVCRRPYLKVFNPRRKLEFALLFLVFDENESWYLDDNIKTYSDHPEKVNKDDEEFIESNKMHAINGRMFGNLQGLTMHVGDEVNWYLMGMGNEIDLHTVHFHGHSFQYKHRGVYSSDVFDIFPGTYQTLEMFPRTPGIWLLHCHVTDHIHAGMETTYTVLQNEDTKSG

SEQ ID NO: 860429 - protein, 1009 aa, Homo sapiens
MKILILGIFLFLCSTPAWAKEKHYYIGIIETTWDYASDHGEKKLISVDTEHSNIYLQNGPDRIGRLYKKALYLQYTDETFRTTIEKPVWLGFLGPIIKAETGDKVYVHLKNLASRPYTFHSHGITYYKEHEGAIYPDNTTDFQRADDKVYPGEQYTYMLLATEEQSPGEGDGNCVTRIYHSHIDAPKDIASGLIGPLIICKKDSLDKEKEKHIDREFVVMFSVVDENFSWYLEDNIKTYCSEPEKVDKDNEDFQESNRMYSVNGYTFGSLPGLSMCAEDRVKWYLFGMGNEVDVHAAFFHGQALTNKNYRIDTINLFPATLFDAYMVAQNPGEWMLSCQNLNHLKAGLQAFFQVQECNKSSSKDNIRGKHVRHYYIAAEEIIWNYAPSGIDIFTKENLTAPGSDSAVFFEQGTTRIGGSYKKLVYREYTDASFTNRKERGPEEEHLGILGPVIWAEVGDTIRVTFHNKGAYPLSIEPIGVRFNKNNEGTYYSPNYNPQSRSVPPSASHVAPTETFTYEWTVPKEVGPTNADPVCLAKMYYSAVDPTKDIFTGLIGPMKICKKGSLHANGRQKDVDKEFYLFPTVFDENESLLLEDNIRMFTTAPDQVDKEDEDFQESNKMHSMNGFMYGNQPGLTMCKGDSVVWYLFSAGNEADVHGIYFSGNTYLWRGERRDTANLFPQTSLTLHMWPDTEGTFNVECLTTDHYTGGMKQKYTVNQCRRQSEDSTFYLGERTYYIAAVEVEWDYSPQREWEKELHHLQEQNVSNAFLDKGEFYIGSKYKKVVYRQYTDSTFRVPVERKAEEEHLGILGPQLHADVGDKVKIIFKNMATRPYSIHAHGVQTESSTVTPTLPGETLTYVWKIPERSGAGTEDSACIPWAYYSTVDQVKDLYSGLIGPLIVCRRPYLKVFNPRRKLEFALLFLVFDENESWYLDDNIKTYSDHPEKVNKDDEEFIESNKMHAINGRMFGNLQGLTMHVGDEVNWYLMGMGNEIDLHTTHTLKMEKNEQFFW

SEQ ID NO: 860430 - protein, 1090 aa, Homo sapiens
MKILILGIFLFLCSTPAWAKEKHYYIGIIETTWDYASDHGEKKLISVDTEHSNIYLQNGPDRIGRLYKKALYLQYTDETFRTTIEKPVWLGFLGPIIKAETGDKVYVHLKNLASRPYTFHSHGITYYKEHEGAIYPDNTTDFQRADDKVYPGEQYTYMLLATEEQSPGEGDGNCVTRIYHSHIDAPKDIASGLIGPLIICKKDSLDKEKEKHIDREFVVMFSVVDENFSWYLEDNIKTYCSEPEKVDKDNEDFQESNRMYSVNGYTFGSLPGLSMCAEDRVKWYLFGMGNEVDVHAAFFHGQALTNKNYRIDTINLFPATLFDAYMVAQNPGEWMLSCQNLNHLKAGLQAFFQVQECNKSSSKDNIRGKHVRHYYIAAEEIIWNYAPSGIDIFTKENLTAPGSDSAVFFEQGTTRIGGSYKKLVYREYTDASFTNRKERGPEEEHLGILGPVIWAEVGDTIRVTFHNKGAYPLSIEPIGVRFNKNNEGTYYSPNYNPQSRSVPPSASHVAPTETFTYEWTVPKEVGPTNADPVCLAKMYYSAVDPTKDIFTGLIGPMKICKKGSLHANGRQKDVDKEFYLFPTVFDENESLLLEDNIRMFTTAPDQVDKEDEDFQESNKMHSMNGFMYGNQPGLTMCKGDSVVWYLFSAGNEADVHGIYFSGNTYLWRGERRDTANLFPQTSLTLHMWPDTEGTFNVECLTTDHYTGGMKQKYTVNQCRRQSEDSTFYLGERTYYIAAVEVEWDYSPQREWEKELHHLQEQNVSNAFLDKGEFYIGSKYKKVVYRQYTDSTFRVPVERKAEEEHLGILGPQLHADVGDKVKIIFKNMATRPYSIHAHGVQTESSTVTPTLPGETLTYVWKIPERSGAGTEDSACIPWAYYSTVDQVKDLYSGLIGPLIVCRRPYLKVFNPRRKLEFALLFLVFDENESWYLDDNIKTYSDHPEKVNKDDEEFIESNKMHAINGRMFGNLQGLTMHVGDEVNWYLMGMGNEIDLHTVHFHGHSFQYKHRGVYSSDVFDIFPGTYQTLEMFPRTPGIWLLHCHVTDHIHAGMETTYTVLQNEASSETHRRIWNVIYPITVSVIILFQISTKE

SEQ ID NO: 860431 - protein, 1009 aa, Homo sapiens; identical to SEQ ID NO: 860429

SEQ ID NO: 860432 - protein, 1072 aa, Homo sapiens
MKILILGIFLFLCSTPAWAKEKHYYIGIIETTWDYASDHGEKKLISVDTEHSNIYLQNGPDRIGRLYKKALYLQYTDETFRTTIEKPVWLGFLGPIIKAETGDKVYVHLKNLASRPYTFHSHGITYYKEHEGAIYPDNTTDFQRADDKVYPGEQYTYMLLATEEQSPGEGDGNCVTRIYHSHIDAPKDIASGLIGPLIICKKDSLDKEKEKHIDREFVVMFSVVDENFSWYLEDNIKTYCSEPEKVDKDNEDFQESNRMYSVNGYTFGSLPGLSMCAEDRVKWYLFGMGNEVDVHAAFFHGQALTNKNYRIDTINLFPATLFDAYMVAQNPGEWMLSCQNLNHLKAGLQAFFQVQECNKSSSKDNIRGKHVRHYYIAAEEIIWNYAPSGIDIFTKENLTAPGSDSAVFFEQGTTRIGGSYKKLVYREYTDASFTNRKERGPEEEHLGILGPVIWAEVGDTIRVTFHNKGAYPLSIEPIGVRFNKNNEGTYYSPNYNPQSRSVPPSASHVAPTETFTYEWTVPKEVGPTNADPVCLAKMYYSAVDPTKDIFTGLIGPMKICKKGSLHANGRQKDVDKEFYLFPTVFDENESLLLEDNIRMFTTAPDQVDKEDEDFQESNKMHSMNGFMYGNQPGLTMCKGDSVVWYLFSAGNEADVHGIYFSGNTYLWRGERRDTANLFPQTSLTLHMWPDTEGTFNVECLTTDHYTGGMKQKYTVNQCRRQSEDSTFYLGERTYYIAAVEVEWDYSPQREWEKELHHLQEQNVSNAFLDKGEFYIGSKYKKVVYRQYTDSTFRVPVERKAEEEHLGILGPQLHADVGDKVKIIFKNMATRPYSIHAHGVQTESSTVTPTLPGETLTYVWKIPERSGAGTEDSACIPWAYYSTVDQVKDLYSGLIGPLIVCRRPYLKVFNPRRKLEFALLFLVFDENESWYLDDNIKTYSDHPEKVNKDDEEFIESNKMHAINGRMFGNLQGLTMHVGDEVNWYLMGMGNEIDLHTVHFHGHSFQYKHRGVYSSDVFDIFPGTYQTLEMFPRTPGIWLLHCHVTDHIHAGMETTYTVLQNEGEYPGSNSRSHI

SEQ ID NO: 860433 - protein, 1021 aa, Homo sapiens
MKILILGIFLFLCSTPAWAKEKHYYIGIIETTWDYASDHGEKKLISVDTEHSNIYLQNGPDRIGRLYKKALYLQYTDETFRTTIEKPVWLGFLGPIIKAETGDKVYVHLKNLASRPYTFHSHGITYYKEHEGAIYPDNTTDFQRADDKVYPGEQYTYMLLATEEQSPGEGDGNCVTRIYHSHIDAPKDIASGLIGPLIICKKDSLDKEKEKHIDREFVVMFSVVDENFSWYLEDNIKTYCSEPEKVDKDNEDFQESNRMYSVNGYTFGSLPGLSMCAEDRVKWYLFGMGNEVDVHAAFFHGQALTNKNYRIDTINLFPATLFDAYMVAQNPGEWMLSCQNLNHLKAGLQAFFQVQECNKSSSKDNIRGKHVRHYYIAAEEIIWNYAPSGIDIFTKENLTAPGSDSAVFFEQGTTRIGGSYKKLVYREYTDASFTNRKERGPEEEHLGILGPVIWAEVGDTIRVTFHNKGAYPLSIEPIGVRFNKNNEGTYYSPNYNPQSRSVPPSASHVAPTETFTYEWTVPKEVGPTNADPVCLAKMYYSAVDPTKDIFTGLIGPMKICKKGSLHANGRQKDVDKEFYLFPTVFDENESLLLEDNIRMFTTAPDQVDKEDEDFQESNKMHSMNGFMYGNQPGLTMCKGDSVVWYLFSAGNEADVHGIYFSGNTYLWRGERRDTANLFPQTSLTLHMWPDTEGTFNVECLTTDHYTGGMKQKYTVNQCRRQSEDSTFYLGERTYYIAAVEVEWDYSPQREWEKELHHLQEQNVSNAFLDKGEFYIGSKYKKVVYRQYTDSTFRVPVERKAEEEHLGILGPQLHADVGDKVKIIFKNMATRPYSIHAHGVQTESSTVTPTLPGETLTYVWKIPERSGAGTEDSACIPWAYYSTVDQVKDLYSGLIGPLIVCRRPYLKVFNPRRKLEFALLFLVFDENESWYLDDNIKTYSDHPEKVNKDDEEFIESNKMHAINGRMFGNLQGLTMHVGDEVNWYLMGMGNEIDLHTVHFHGHSFQYKKCFQEHLEFGYSTAM

SEQ ID NO: 860434 - protein, 917 aa, Homo sapiens
MKILILGIFLFLCSTPAWAKEKHYYIGIIETTWDYASDHGEKKLISVDTEHSNIYLQNGPDRIGRLYKKALYLQYTDETFRTTIEKPVWLGFLGPIIKAETGDKVYVHLKNLASRPYTFHSHGITYYKEHEGAIYPDNTTDFQRADDKVYPGEQYTYMLLATEEQSPGEGDGNCVTRIYHSHIDAPKDIASGLIGPLIICKKDSLDKEKEKHIDREFVVMFSVVDENFSWYLEDNIKTYCSEPEKVDKDNEDFQESNRMYSVNGYTFGSLPGLSMCAEDRVKWYLFGMGNEVDVHAAFFHGQALTNKNYRIDTINLFPATLFDAYMVAQNPGEWMLSCQNLNHLKAGLQAFFQVQECNKSSSKDNIRGKHVRHYYIAAEEIIWNYAPSGIDIFTKENLTAPGSDSAVFFEQGTTRIGGSYKKLVYREYTDASFTNRKERGPEEEHLGILGPVIWAEVGDTIRVTFHNKGAYPLSIEPIGVRFNKNNEGTYYSPNYNPQSRSVPPSASHVAPTETFTYEWTVPKEVGPTNADPVCLAKMYYSAVDPTKDIFTGLIGPMKICKKGSLHANGRQKDVDKEFYLFPTVFDENESLLLEDNIRMFTTAPDQVDKEDEDFQESNKMHSMNGFMYGNQPGLTMCKGDSVVWYLFSAGNEADVHGIYFSGNTYLWRGERRDTANLFPQTSLTLHMWPDTEGTFNVECLTTDHYTGGMKQKYTVNQCRRQSEDSTFYLGERTYYIAAVEVEWDYSPQREWEKELHHLQEQNVSNAFLDKGEFYIGSKYKKVVYRQYTDSTFRVPVERKAEEEHLGILGPQLHADVGDKVKIIFKNMATRPYSIHAHGVQTESSTVTPTLPGETLTYVWKIPERSGAGTEDSACIPRLLFVEIFLVRSVSSRSLAIGALVSIDRYLLKLSHSCVPSL

SEQ ID NO: 860435 - protein, 762 aa, Homo sapiens [sequence omitted]

SEQ ID NO: 860436 - protein, 654 aa, Homo sapiens
MKILILGIFLFLCSTPAWAKEKHYYIGIIETTWDYASDHGEKKLISVDTEHSNIYLQNGPDRIGRLYKKALYLQYTDETFRTTIEKPVWLGFLGPIIKAETGDKVYVHLKNLASRPYTFHSHGITYYKEHEGAIYPDNTTDFQRADDKVYPGEQYTYMLLATEEQSPGEGDGNCVTRIYHSHIDAPKDIASGLIGPLIICKKDSLDKEKEKHIDREFVVMFSVVDENFSWYLEDNIKTYCSEPEKVDKDNEDFQESNRMYSVNGYTFGSLPGLSMCAEDRVKWYLFGMGNEVDVHAAFFHGQALTNKNYRIDTINLFPATLFDAYMVAQNPGEWMLSCQNLNHLKAGLQAFFQVQECNKSSSKDNIRGKHVRHYYIAAEEIIWNYAPSGIDIFTKENLTAPGSDSAVFFEQGTTRIGGSYKKLVYREYTDASFTNRKERGPEEEHLGILGPVIWAEVGDTIRVTFHNKGAYPLSIEPIGVRFNKNNEGTYYSPNYNPQSRSVPPSASHVAPTETFTYEWTVPKEVGPTNADPVCLAKMYYSAVDPTKDIFTGLIGPMKICKKGSLHANGRQKDVDKEFYLFPTVFDENESLLLEDNIRMFTTAPDQVDKEDEDFQESNKMHCTVSTASSTNLPSYFSTAYVMLLTKQNVKSFAH

SEQ ID NO: 860437 - protein, 272 aa, Homo sapiens
SALPGLQHLGILGPQLHADVGDKVKIIFKNMATRPYSIHAHGVQTESSTVTPTLPGETLTYVWKIPERSGAGTEDSACIPWAYYSTVDQVKDLYSGLIGPLIVCRRPYLKVFNPRRKLEFALLFLVFDENESWYLDDNIKTYSDHYTGGMKQKYTVNQCRRQSEDSTFYLGERTYYIAAVEVEWDYSPQREWEKELHHLQEQNVSNAFLDKGEFYIGSKYKKVVYRQYTDSTFRVPVERKAEEEHLGILGPQLHADVGDKVKIIFSSTVTPT

SEQ ID NO: 860438 - protein, 1065 aa, Homo sapiens; identical to SEQ ID NO: 860420

SEQ ID NO: 860439 - protein, 636 aa, Homo sapiens
MKILILGIFLFLCSTPAWAKEKHYYIGIIETTWDYASDHGEKKLISVDTEHSNIYLQNGPDRIGRLYKKALYLQYTDETFRTTIEKPVWLGFLGPIIKAETGDKVYVHLKNLASRPYTFHSHGITYYKEHEGAIYPDNTTDFQRADDKVYPGEQYTYMLLATEEQSPGEGDGNCVTRIYHSHIDAPKDIASGLIGPLIICKKDSLDKEKEKHIDREFVVMFSVVDENFSWYLEDNIKTYCSEPEKVDKDNEDFQESNRMYSVNGYTFGSLPGLSMCAEDRVKWYLFGMGNEVDVHAAFFHGQALTNKNYRIDTINLFPATLFDAYMVAQNPGEWMLSCQNLNHLKAGLQAFFQVQECNKSSSKDNIRGKHVRHYYIAAEEIIWNYAPSGIDIFTKENLTAPGSDSAVFFEQGTTRIGGSYKKLVYREYTDASFTNRKERGPEEEHLGILGPVIWAEVGDTIRVTFHNKGAYPLSIEPIGVRFNKNNEGTYYSPNYNPQSRSVPPSASHVAPTETFTYEWTVPKEVGPTNADPVCLAKMYYSAVDPTKDIFTGLIGPMKICKKGSLHANGRQKDVDKEFYLFPTVFDENESLLLEDNIRMFTTAPDQVDKEDEDFQESNKMHLQRRFGRVVLIQRRK

SEQ ID NO: 860440 - protein, 528 aa, Homo sapiens
MYYSAVDPTKDIFTGLIGPMKICKKGSLHANGRQKDVDKEFYLFPTVFDENESLLLEDNIRMFTTAPDQVDKEDEDFQESNKMHSMNGFMYGNQPGLTMCKGDSVVWYLFSAGNEADVHGIYFSGNTYLWRGERRDTANLFPQTSLTLHMWPDTEGTFNVECLTTDHYTGGMKQKYTVNQCRRQSEDSTFYLGERTYYIAAVEVEWDYSPQREWEKELHHLQEQNVSNAFLDKGEFYIGSKYKKVVYRQYTDSTFRVPVERKAEEEHLGILGPQLHADVGDKVKIIFKNMATRPYSIHAHGVQTESSTVTPTLPGETLTYVWKIPERSGAGTEDSACIPWAYYSTVDQVKDLYSGLIGPLIVCRRPYLKVFNPRRKLEFALLFLVFDENESWYLDDNIKTYSDHPEKVNKDDEEFIESNKMHAINGRMFGNLQGLTMHVGDEVNWYLMGMGNEIDLHTVHFHGHSFQYKHRGVYSSDVFDIFPGTYQTLEMFPRTPGIWLLHCHVTDHIHAGMETTYTVLQNEDTKSG

SEQ ID NO: 860441 - protein, 1065 aa, Homo sapiens; identical to SEQ ID NO: 860420

SEQ ID NO: 860442 - protein, 836 aa, Homo sapiens
MKILILGIFLFLCSTPAWAKEKHYYIGIIETTWDYASDHGEKKLISVDTEHSNIYLQNGPDRIGRLYKKALYLQYTDETFRTTIEKPVWLGFLGPIIKAETGDKVYVHLKNLASRPYTFHSHGITYYKEHEGAIYPDNTTDFQRADDKVYPGEQYTYMLLATEEQSPGEGDGNCVTRIYHSHIDAPKDIASGLIGPLIICKKDSLDKEKEKHIDREFVVMFSVVDENFSWYLEDNIKTYCSEPEKVDKDNEDFQESNRMYSVNGYTFGSLPGLSMCAEDRVKWYLFGMGNEVDVHAAFFHGQALTNKNYRIDTINLFPATLFDAYMVAQNPGEWMLSCQNLNHLKAGLQAFFQVQECNKSSSKDNIRGKHVRHYYIAAEEIIWNYAPSGIDIFTKENLTAPGSDSAVFFEQGTTRIGGSYKKLVYREYTDASFTNRKERGPEEEHLGILGPVIWAEVGDTIRVTFHNKGAYPLSIEPIGVRFNKNNEGTYYSPNYNPQSRSVPPSASHVAPTETFTYEWTVPKEVGPTNADPVCLAKMYYSAVDPTKDIFTGLIGPMKICKKGSLHANGRQKDVDKEFYLFPTVFDENESLLLEDNIRMFTTAPDQVDKEDEDFQESNKMHSMNGFMYGNQPGLTMCKGDSVVWYLFSAGNEADVHGIYFSGNTYLWRGERRDTANLFPQTSLTLHMWPDTEGTFNVECLTTDHYTGGMKQKYTVNQCRRQSEDSTFYLGERTYYIAAVEVEWDYSPQREWEKELHHLQEQNVSNAFLDKGEFYIGSKYKKVVYRQYTDSTFRVPVERKAEEEHLGILGPQLHADVGDKVKIIFKNMGLLFNCGSS

SEQ ID NO: 860443 - protein, 1009 aa, Homo sapiens; identical to SEQ ID NO: 860429

SEQ ID NO: 860444 - protein, 1065 aa, Homo sapiens; identical to SEQ ID NO: 860420

SEQ ID NO: 860445 - protein, 1090 aa, Homo sapiens; identical to SEQ ID NO: 860430

SEQ ID NO: 860446 - protein, 1017 aa, Homo sapiens
MKILILGIFLFLCSTPAWAKEKHYYIGIIETTWDYASDHGEKKLISVDTEHSNIYLQNGPDRIGRLYKKALYLQYTDETFRTTIEKPVWLGFLGPIIKAETGDKVYVHLKNLASRPYTFHSHGITYYKEHEGAIYPDNTTDFQRADDKVYPGEQYTYMLLATEEQSPGEGDGNCVTRIYHSHIDAPKDIASGLIGPLIICKKDSLDKEKEKHIDREFVVMFSVVDENFSWYLEDNIKTYCSEPEKVDKDNEDFQESNRMYSVNGYTFGSLPGLSMCAEDRVKWYLFGMGNEVDVHAAFFHGQALTNKNYRIDTINLFPATLFDAYMVAQNPGEWMLSCQNLNHLKAGLQAFFQVQECNKSSSKDNIRGKHVRHYYIAAEEIIWNYAPSGIDIFTKENLTAPGSDSAVFFEQGTTRIGGSYKKLVYREYTDASFTNRKERGPEEEHLGILGPVIWAEVGDTIRVTFHNKGAYPLSIEPIGVRFNKNNEGTYYSPNYNPQSRSVPPSASHVAPTETFTYEWTVPKEVGPTNADPVCLAKMYYSAVDPTKDIFTGLIGPMKICKKGSLHANGRQKDVDKEFYLFPTVFDENESLLLEDNIRMFTTAPDQVDKEDEDFQESNKMHSMNGFMYGNQPGLTMCKGDSVVWYLFSAGNEADVHGIYFSGNTYLWRGERRDTANLFPQTSLTLHMWPDTEGTFNVECLTTDHYTGGMKQKYTVNQCRRQSEDSTFYLGERTYYIAAVEVEWDYSPQREWEKELHHLQEQNVSNAFLDKGEFYIGSKYKKVVYRQYTDSTFRVPVERKAEEEHLGILGPQLHADVGDKVKIIFKNMATRPYSIHAHGVQTESSTVTPTLPGETLTYVWKIPERSGAGTEDSACIPWAYYSTVDQVKDLYSGLIGPLIVCRRPYLKVFNPRRKLEFALLFLVFDENESWYLDDNIKTYSDHPEKVNKDDEEFIESNKMHAINGRMFGNLQGLTMHVGDEVNWYLMGMGNEIDLHTVHFHGHSFQYKHLLRLTGEYGM

SEQ ID NO: 860447 - protein, 1068 aa, Homo sapiens
MKILILGIFLFLCSTPAWAKEKHYYIGIIETTWDYASDHGEKKLISVDTEHSNIYLQNGPDRIGRLYKKALYLQYTDETFRTTIEKPVWLGFLGPIIKAETGDKVYVHLKNLASRPYTFHSHGITYYKEHEGAIYPDNTTDFQRADDKVYPGEQYTYMLLATEEQSPGEGDGNCVTRIYHSHIDAPKDIASGLIGPLIICKKDSLDKEKEKHIDREFVVMFSVVDENFSWYLEDNIKTYCSEPEKVDKDNEDFQESNRMYSVNGYTFGSLPGLSMCAEDRVKWYLFGMGNEVDVHAAFFHGQALTNKNYRIDTINLFPATLFDAYMVAQNPGEWMLSCQNLNHLKAGLQAFFQVQECNKSSSKDNIRGKHVRHYYIAAEEIIWNYAPSGIDIFTKENLTAPGSDSAVFFEQGTTRIGGSYKKLVYREYTDASFTNRKERGPEEEHLGILGPVIWAEVGDTIRVTFHNKGAYPLSIEPIGVRFNKNNEGTYYSPNYNPQSRSVPPSASHVAPTETFTYEWTVPKEVGPTNADPVCLAKMYYSAVDPTKDIFTGLIGPMKICKKGSLHANGRQKDVDKEFYLFPTVFDENESLLLEDNIRMFTTAPDQVDKEDEDFQESNKMHSMNGFMYGNQPGLTMCKGDSVVWYLFSAGNEADVHGIYFSGNTYLWRGERRDTANLFPQTSLTLHMWPDTEGTFNVECLTTDHYTGGMKQKYTVNQCRRQSEDSTFYLGERTYYIAAVEVEWDYSPQREWEKELHHLQEQNVSNAFLDKGEFYIGSKYKKVVYRQYTDSTFRVPVERKAEEEHLGILGPQLHADVGDKVKIIFKNMATRPYSIHAHGVQTESSTVTPTLPGETLTYVWKIPERSGAGTEDSACIPWAYYSTVDQVKDLYSGLIGPLIVCRRPYLKVFNPRRKLEFALLFLVFDENESWYLDDNIKTYSDHYTGGMKQKYTVNQCRRQSEDSTFYLGERTYYIAAVEVEWDYSPQREWEKELHHLQEQNVSNAFLDKGEFYIGSKYKKVVYRQYTDSTFRVPVERKAEEEHLGILGPQLHADVGDKVKIIFSSTVTPT

SEQ ID NO: 860448 - protein, 762 aa, Homo sapiens [sequence omitted]

SEQ ID NO: 860449 - protein, 345 aa, Homo sapiens
MKILILGIFLFLCSTPAWAKEKHYYIGIIETTWDYASDHGEKKLISVDTEHSNIYLQNGPDRIGRLYKKALYLQYTDETFRTTIEKPVWLGFLGPIIKAETGDKVYVHLKNLASRPYTFHSHGITYYKEHEGAIYPDNTTDFQRADDKVYPGEQYTYMLLATEEQSPGEGDGNCVTRIYHSHIDAPKDIASGLIGPLIICKKDSLDKEKEKHIDREFVVMFSVVDENFSWYLEDNIKTYCSEPEKVDKDNEDFQESNRMYSVNGYTFGSLPGLSMCAEDRVKWYLFGMGNEVDVHAAFFHGQALTNKNYRIDTINLFPATLFDAYMVAQNPGKNGMPPCSKLNPS

SEQ ID NO: 860450 - protein, 4183 aa, Homo sapiens
MGWRAPGALLLALLLHGRLLAVTHGLRAYDGLSLPEDIETVTASQMRWTHSYLSDDEDMLADSISGDDLGSGDLGSGDFQMVYFRALVNFTRSIEYSPQLEDAGSREFREVSEAVVDTLESEYLKIPGDQVVSVVFIKELDGWVFVELDVGSEGNADGAQIQEMLLRVISSGSVASYVTSPQGFQFRRLGTVPQFPRACTEAEFACHSYNECVALEYRCDRRPDCRDMSDELNCEEPVLGISPTFSLLVETTSLPPRPETTIMRQPPVTHAPQPLLPGSVRPLPCGPQEAACRNGHCIPRDYLCDGQEDCEDGSDELDCGPPPPCEPNEFPCGNGHCALKLWRCDGDFDCEDRTDEANCPTKRPEEVCGPTQFRCVSTNMCIPASFHCDEESDCPDRSDEFGCMPPQVVTPPRESIQASRGQTVTFTCVAIGVPTPFIINWRLNWGHIPSHPRVTVTSEGGRGTLIIRDVKESDQGAYTCEAMNARGMVFGIPDGVLELVPQRGPCPDGHFYLEHSAACLPCFCFGITSVCQSTRRFRDQIRLRFDQPDDFKGVNVTMPAQPGTPPLSSTQLQIDPSLHEFQLVDLSRRFLVHDSFWALPEQFLGNKVDSYGGSLRYNVRYELARGMLEPVQRPDVVLVGAGYRLLSRGHTPTQPGALNQRQVQFSEEHWVHESGRPVQRAELLQVLQSLEAVLIQTVYNTKMASVGLSDIAMDTTVTHATSHGRAHSVEECRCPIGYSGLSCESCDAHFTRVPGGPYLGTCSGCSCNGHASSCDPVYGHCLNCQHNTEGPQCNKCKAGFFGDAMKATATSCRPCPCPYIDASRRFSDTCFLDTDGQATCDACAPGYTGRRCESCAPGYEGNPIQPGGKCRPVNQEIVRCDERGSMGTSGEACRCKNNVVGRLCNECADGSFHLSTRNPDGCLKCFCMGVSRHCTSSSWSRAQLHGASEEPGHFSLTNAASTHTTNEGIFSPTPGELGFSSFHRLLSGPYFWSLPSRFLGDKVTSYGGELRFTVTQRSQPGSTPLHGQPLVVLQGNNIILEHHVAQEPSPGQPSTFIVPFREQAWQRPDGQPATREHLLMALAGIDTLLIRASYAQQPAESRVSGISMDVAVPEETGQDPALEVEQCSCPPGYRGPSCQDCDTGYTRTPSGLYLGTCERCSCHGHSEACEPETGACQGCQHHTEGPRCEQCQPGYYGDAQRGTPQDCQLCPCYGDPAAGQAAHTCFLDTDGHPTCDACSPGHSGRHCERCAPGYYGNPSQGQPCQRDSQVPGPIGCNCDPQGSVSSQCDAAGQCQCKAQVEGLTCSHCRPHHFHLSASNPDGCLPCFCMGITQQCASSAYTRHLISTHFAPGDFQGFALVNPQRNSRLTGEFTVEPVPEGAQLSFGNFAQLGHESFYWQLPETYQGDKVAAYGGKLRYTLSYTAGPQGSPLSDPDVQITGNNIMLVASQPALQGPERRSYEIMFREEFWRRPDGQPATREHLLMALADLDELLIRATFSSVPLVASISAVSLEVAQPGPSNRPRALEVEECRCPPGYIGLSCQDCAPGYTRTGSGLYLGHCELCECNGHSDLCHPETGACSQCQHNAAGEFCELCAPGYYGDATAGTPEDCQPCACPLTNPENMFSRTCESLGAGGYRCTACEPGYTGQYCEQCGPGYVGNPSVQGGQCLPETNQAPLVVEVHPARSIVPQGGSHSLRCQVSGSPPHYFYWSREDGRPVPSGTQQRHQGSELHFPSVQPSDAGVYICTCRNLHQSNTSRAELLVTEAPSKPITVTVEEQRSQSVRPGADVTFICTAKSKSPAYTLVWTRLHNGKLPTRAMDFNGILTIRNVQLSDAGTYVCTGSNMFAMDQGTATLHVQASGTLSAPVVSIHPPQLTVQPGQLAEFRCSATGSPTPTLEWTGGPGGQLPAKAQIHGGILRLPAVEPTDQAQYLCRAHSSAGQQVARAVLHVHGGGGPRVQVSPERTQVHAGRTVRLYCRAAGVPSATITWRKEGGSLPPQARSERTDIATLLIPAITTADAGFYLCVATSPAGTAQARIQVVVLSASDASPPPVKIESSSPSVTEGQTLDLNCVVAGSAHAQVTWYRRGGSLPPHTQVHGSRLRLPQVSPADSGEYVCRVENGSGPKEASITVSVLHGTHSGPSYTPVPGSTRPIRIEPSSSHVAEGQTLDLNCVVPGQAHAQVTWHKRGGSLPARHQTHGSLLRLHQVTPADSGEYVCHVVGTSGPLEASVLVTIEASVIPGPIPPVRIESSSSTVAEGQTLDLSCVVAGQAHAQVTWYKRGGSLPARHQVRGSRLYIFQASPADAGQYVCRASNGMEASITVTVTGTQGANLAYPAGSTQPIRIEPSSSQVAEGQTLDLNCVVPGQSHAQVTWHKRGGSLPVRHQTHGSLLRLYQASPADSGEYVCRVLGSSVPLEASVLVTIEPAGSVPALGVTPTVRIESSSSQVAEGQTLDLNCLVAGQAHAQVTWHKRGGSLPARHQVHGSRLRLLQVTPADSGEYVCRVVGSSGTQEASVLVTIQQRLSGSHSQGVAYPVRIESSSASLANGHTLDLNCLVASQAPHTITWYKRGGSLPSRHQIVGSRLRIPQVTPADSGEYVCHVSNGAGSRETSLIVTIQGSGSSHVPSVSPPIRIESSSPTVVEGQTLDLNCVVARQPQAIITWYKRGGSLPSRHQTHGSHLRLHQMSVADSGEYVCRANNNIDALEASIVISVSPSAGSPSAPGSSMPIRIESSSSHVAEGETLDLNCVVPGQAHAQVTWHKRGGSLPSHHQTRGSRLRLHHVSPADSGEYVCRVMGSSGPLEASVLVTIEASGSSAVHVPAPGGAPPIRIEPSSSRVAEGQTLDLKCVVPGQAHAQVTWHKRGGNLPARHQVHGPLLRLNQVSPADSGEYSCQVTGSSGTLEASVLVTIEPSSPGPIPAPGLAQPIYIEASSSHVTEGQTLDLNCVVPGQAHAQVTWYKRGGSLPARHQTHGSQLRLHLVSPADSGEYVCRAASGPGPEQEASFTVTVPPSEGSSYRLRSPVISIDPPSSTVQQGQDASFKCLIHDGAAPISLEWKTRNQELEDNVHISPNGSIITIVGTRPSNHGTYRCVASNAYGVAQSVVNLSVHGPPTVSVLPEGPVWVKVGKAVTLECVSAGEPRSSARWTRISSTPAKLEQRTYGLMDSHAVLQISSAKPSDAGTYVCLAQNALGTAQKQVEVIVDTGAMAPGAPQVQAEEAELTVEAGHTATLRCSATGSPAPTIHWSKLRSPLPWQHRLEGDTLIIPRVAQQDSGQYICNATSPAGHAEATIILHVESPPYATTVPEHASVQAGETVQLQCLAHGTPPLTFQWSRVGSSLPGRATARNELLHFERAAPEDSGRYRCRVTNKVGSAEAFAQLLVQGPPGSLPATSIPAGSTPTVQVTPQLETKSIGASVEFHCAVPSDRGTQLRWFKEGGQLPPGHSVQDGVLRIQNLDQSCQGTYICQAHGPWGKAQASAQLVIQALPSVLINIRTSVQTVVVGHAVEFECLALGDPKPQVTWSKVGGHLRPGIVQSGGVVRIAHVELADAGQYRCTATNAAGTTQSHVLLLVQALPQISMPQEVRVPAGSAAVFPCIASGYPTPDISWSKLDGSLPPDSRLENNMLMLPSVRPQDAGTYVCTATNRQGKVKAFAHLQVPERVVPYFTQTPYSFLPLPTIKDAYRKFEIKITFRPDSADGMLLYNGQKRVPGSPTNLANRQPDFISFGLVGGRPEFRFDAGSGMATIRHPTPLALGHFHTVTLLRSLTQGSLIVGDLAPVNGTSQGKFQGLDLNEELYLGGYPDYGAIPKAGLSSGFIGCVRELRIQGEEIVFHDLNLTAHGISHCPTCRDRPCQNGGQCHDSESSSYVCVCPAGFTGSRCEHSQALHCHPEACGPDATCVNRPDGRGYTCRCHLGRSGLRCEEGVTVTTPSLSGAGSYLALPALTNTHHELRLDVEFKPLAPDGVLLFSGGKSGPVEDFVSLAMVGGHLEFRYELGSGLAVLRSAEPLALGRWHRVSAERLNKDGSLRVNGGRPVLRSSPGKSQGLNLHTLLYLGGVEPSVPLSPATNMSAHFRGCVGEVSVNGKRLDLTYSFLGSQASGNAMIAPHVSASLANMVPRACPLASMSSSACVEMDSKETCVSTRRTPASSVNPVCMGAPARAPAASASLASLAHAANKALDMA

SEQ ID NO: 860451 - protein, 4183 aa, Homo sapiens; identical to SEQ ID NO: 860450

SEQ ID NO: 860452 - protein, 4200 aa, Homo sapiens
MGWRAPGALLLALLLHGRLLAVTHGLRAYDGLSLPEDIETVTASQMRWTHSYLSDDEDMLADSISGDDLGSGDLGSGDFQMVYFRALVNFTRSIEYSPQLEDAGSREFREVSEAVVDTLESEYLKIPGDQVVSVVFIKELDGWVFVELDVGSEGNADGAQIQEMLLRVISSGSVASYVTSPQGFQFRRLGTAQTPPPPPAAVAVAVTPVPQFPRACTEAEFACHSYNECVALEYRCDRRPDCRDMSDELNCEEPVLGISPTFSLLVETTSLPPRPETTIMRQPPVTHAPQPLLPGSVRPLPCGPQEAACRNGHCIPRDYLCDGQEDCEDGSDELDCGPPPPCEPNEFPCGNGHCALKLWRCDGDFDCEDRTDEANCPTKRPEEVCGPTQFRCVSTNMCIPASFHCDEESDCPDRSDEFGCMPPQVVTPPRESIQASRGQTVTFTCVAIGVPTPFIINWRLNWGHIPSHPRVTVTSEGGRGTLIIRDVKESDQGAYTCEAMNARGMVFGIPDGVLELVPQRGPCPDGHFYLEHSAACLPCFCFGITSVCQSTRRFRDQIRLRFDQPDDFKGVNVTMPAQPGTPPLSSTQLQIDPSLHEFQLVDLSRRFLVHDSFWALPEQFLGNKVDSYGGSLRYNVRYELARGMLEPVQRPDVVLVGAGYRLLSRGHTPTQPGALNQRQVQFSEEHWVHESGRPVQRAELLQVLQSLEAVLIQTVYNTKMASVGLSDIAMDTTVTHATSHGRAHSVEECRCPIGYSGLSCESCDAHFTRVPGGPYLGTCSGCSCNGHASSCDPVYGHCLNCQHNTEGPQCNKCKAGFFGDAMKATATSCRPCPCPYIDASRRFSDTCFLDTDGQATCDACAPGYTGRRCESCAPGYEGNPIQPGGKCRPVNQEIVRCDERGSMGTSGEACRCKNNVVGRLCNECADGSFHLSTRNPDGCLKCFCMGVSRHCTSSSWSRAQLHGASEEPGHFSLTNAASTHTTNEGIFSPTPGELGFSSFHRLLSGPYFWSLPSRFLGDKVTSYGGELRFTVTQRSQPGSTPLHGQPLVVLQGNNIILEHHVAQEPSPGQPSTFIVPFREQAWQRPDGQPATREHLLMALAGIDTLLIRASYAQQPAESRVSGISMDVAVPEETGQDPALEVEQCSCPPGYRGPSCQDCDTGYTRTPSGLYLGTCERCSCHGHSEACEPETGACQGCQHHTEGPRCEQCQPGYYGDAQRGTPQDCQLCPCYGDPAAGQAAHTCFLDTDGHPTCDACSPGHSGRHCERCAPGYYGNPSQGQPCQRDSQVPGPIGCNCDPQGSVSSQCDAAGQCQCKAQVEGLTCSHCRPHHFHLSASNPDGCLPCFCMGITQQCASSAYTRHLISTHFAPGDFQGFALVNPQRNSRLTGEFTVEPVPEGAQLSFGNFAQLGHESFYWQLPETYQGDKVAAYGGKLRYTLSYTAGPQGSPLSDPDVQITGNNIMLVASQPALQGPERRSYEIMFREEFWRRPDGQPATREHLLMALADLDELLIRATFSSVPLVASISAVSLEVAQPGPSNRPRALEVEECRCPPGYIGLSCQDCAPGYTRTGSGLYLGHCELCECNGHSDLCHPETGACSQCQHNAAGEFCELCAPGYYGDATAGTPEDCQPCACPLTNPENMFSRTCESLGAGGYRCTACEPGYTGQYCEQCGPGYVGNPSVQGGQCLPETNQAPLVVEVHPARSIVPQGGSHSLRCQVSGSPPHYFYWSREDGRPVPSGTQQRHQGSELHFPSVQPSDAGVYICTCRNLHQSNTSRAELLVTEAPSKPITVTVEEQRSQSVRPGADVTFICTAKSKSPAYTLVWTRLHNGKLPTRAMDFNGILTIRNVQLSDAGTYVCTGSNMFAMDQGTATLHVQASGTLSAPVVSIHPPQLTVQPGQLAEFRCSATGSPTPTLEWTGGPGGQLPAKAQIHGGILRLPAVEPTDQAQYLCRAHSSAGQQVARAVLHVHGGGGPRVQVSPERTQVHAGRTVRLYCRAAGVPSATITWRKEGGSLPPQARSERTDIATLLIPAITTADAGFYLCVATSPAGTAQARIQVVVLSASDASPPPVKIESSSPSVTEGQTLDLNCVVAGSAHAQVTWYRRGGSLPPHTQVHGSRLRLPQVSPADSGEYVCRVENGSGPKEASITVSVLHGTHSGPSYTPVPGSTRPIRIEPSSSHVAEGQTLDLNCVVPGQAHAQVTWHKRGGSLPARHQTHGSLLRLHQVTPADSGEYVCHVVGTSGPLEASVLVTIEASVIPGPIPPVRIESSSSTVAEGQTLDLSCVVAGQAHAQVTWYKRGGSLPARHQVRGSRLYIFQASPADAGQYVCRASNGMEASITVTVTGTQGANLAYPAGSTQPIRIEPSSSQVAEGQTLDLNCVVPGQSHAQVTWHKRGGSLPVRHQTHGSLLRLYQASPADSGEYVCRVLGSSVPLEASVLVTIEPAGSVPALGVTPTVRIESSSSQVAEGQTLDLNCLVAGQAHAQVTWHKRGGSLPARHQVHGSRLRLLQVTPADSGEYVCRVVGSSGTQEASVLVTIQQRLSGSHSQGVAYPVRIESSSASLANGHTLDLNCLVASQAPHTITWYKRGGSLPSRHQIVGSRLRIPQVTPADSGEYVCHVSNGAGSRETSLIVTIQGSGSSHVPSVSPPIRIESSSPTVVEGQTLDLNCVVARQPQAIITWYKRGGSLPSRHQTHGSHLRLHQMSVADSGEYVCRANNNIDALEASIVISVSPSAGSPSAPGSSMPIRIESSSSHVAEGETLDLNCVVPGQAHAQVTWHKRGGSLPSHHQTRGSRLRLHHVSPADSGEYVCRVMGSSGPLEASVLVTIEASGSSAVHVPAPGGAPPIRIEPSSSRVAEGQTLDLKCVVPGQAHAQVTWHKRGGNLPARHQVHGPLLRLNQVSPADSGEYSCQVTGSSGTLEASVLVTIEPSSPGPIPAPGLAQPIYIEASSSHVTEGQTLDLNCVVPGQAHAQVTWYKRGGSLPARHQTHGSQLRLHLVSPADSGEYVCRAASGPGPEQEASFTVTVPPSEGSSYRLRSPVISIDPPSSTVQQGQDASFKCLIHDGAAPISLEWKTRNQELEDNVHISPNGSIITIVGTRPSNHGTYRCVASNAYGVAQSVVNLSVHGPPTVSVLPEGPVWVKVGKAVTLECVSAGEPRSSARWTRISSTPAKLEQRTYGLMDSHAVLQISSAKPSDAGTYVCLAQNALGTAQKQVEVIVDTGAMAPGAPQVQAEEAELTVEAGHTATLRCSATGSPAPTIHWSKLRSPLPWQHRLEGDTLIIPRVAQQDSGQYICNATSPAGHAEATIILHVESPPYATTVPEHASVQAGETVQLQCLAHGTPPLTFQWSRVGSSLPGRATARNELLHFERAAPEDSGRYRCRVTNKVGSAEAFAQLLVQGPPGSLPATSIPAGSTPTVQVTPQLETKSIGASVEFHCAVPSDRGTQLRWFKEGGQLPPGHSVQDGVLRIQNLDQSCQGTYICQAHGPWGKAQASAQLVIQALPSVLINIRTSVQTVVVGHAVEFECLALGDPKPQVTWSKVGGHLRPGIVQSGGVVRIAHVELADAGQYRCTATNAAGTTQSHVLLLVQALPQISMPQEVRVPAGSAAVFPCIASGYPTPDISWSKLDGSLPPDSRLENNMLMLPSVRPQDAGTYVCTATNRQGKVKAFAHLQVPERVVPYFTQTPYSFLPLPTIKDAYRKFEIKITFRPDSADGMLLYNGQKRVPGSPTNLANRQPDFISFGLVGGRPEFRFDAGSGMATIRHPTPLALGHFHTVTLLRSLTQGSLIVGDLAPVNGTSQGKFQGLDLNEELYLGGYPDYGAIPKAGLSSGFIGCVRELRIQGEEIVFHDLNLTAHGISHCPTCRDRPCQNGGQCHDSESSSYVCVCPAGFTGSRCEHSQALHCHPEACGPDATCVNRPDGRGYTCRCHLGRSGLRCEEGVTVTTPSLSGAGSYLALPALTNTHHELRLDVEFKPLAPDGVLLFSGGKSGPVEDFVSLAMVGGHLEFRYELGSGLAVLRSAEPLALGRWHRVSAERLNKDGSLRVNGGRPVLRSSPGKSQGLNLHTLLYLGGVEPSVPLSPATNMSAHFRGCVGEVSVNGKRLDLTYSFLGSQASGNAMIAPHVSASLANMVPRACPLASMSSSACVEMDSKETCVSTRRTPASSVNPVCMGAPARAPAASASLASLAHAANKALDMA

SEQ ID NO: 860453 - protein, 4324 aa, Homo sapiens
LSVWDRGRGDFQMVYFRALVNFTRSIEYSPQLEDAGSREFREVSEAVVDTLESEYLKIPGDQVVSVVFIKELDGWVFVELDVGSEGNADGAQIQEMLLRVISSGSVASYVTSPQGFQFRRLGTVPQFPRACTEAEFACHSYNECVALEYRCDRRPDCRDMSDELNCEEPVLGISPTFSLLVETTSLPPRPETTIMRQPPVTHAPQPLLPGSVRPLPCGPQEAACRNGHCIPRDYLCDGQEDCEDGSDELDCGPPPPCEPNEFPCGNGHCALKLWRCDGDFDCEDRTDEANCPTKRPEEVCGPTQFRCVSTNMCIPASFHCDEESDCPDRSDEFGCMPPQVVTPPRESIQASRGQTVTFTCVAIGVPTPFIINWRLNWGHIPSHPRVTVTSEGGRGTLIIRDVKESDQGAYTCEAMNARGMVFGIPDGVLELVPQRGPCPDGHFYLEHSAACLPCFCFGITSVCQSTRRFRDQIRLRFDQPDDFKGVNVTMPAQPGTPPLSSTQLQIDPSLHEFQLVDLSRRFLVHDSFWALPEQFLGNKVDSYGGSLRYNVRYELARGMLEPVQRPDVVLVGAGYRLLSRGHTPTQPGALNQRQVQFSEEHWVHESGRPVQRAELLQVLQSLEAVLIQTVYNTKMASVGLSDIAMDTTVTHATSHGRAHSVEECRCPIGYSGLSCESCDAHFTRVPGGPYLGTCSGCSCNGHASSCDPVYGHCLNCQHNTEGPQCNKCKAGFFGDAMKATATSCRPCPCPYIDASRRFSDTCFLDTDGQATCDACAPGYTGRRCESCAPGYEGNPIQPGGKCRPVNQEIVRCDERGSMGTSGEACRCKNNVVGRLCNECADGSFHLSTRNPDGCLKCFCMGVSRHCTSSSWSRAQLHGASEEPGHFSLTNAASTHTTNEGIFSPTPGELGFSSFHRLLSGPYFWSLPSRFLGDKVTSYGGELRFTVTQRSQPGSTPLHGQPLVVLQGNNIILEHHVAQEPSPGQPSTFIVPFREQAWQRPDGQPATREHLLMALAGIDTLLIRASYAQQPAESRVSGISMDVAVPEETGQDPALEVEQCSCPPGYRGPSCQDCDTGYTRTPSGLYLGTCERCSCHGHSEACEPETGACQGCQHHTEGPRCEQCQPGYYGDAQRGTPQDCQLCPCYGDPAAGQAAHTCFLDTDGHPTCDACSPGHSGRHCERCAPGYYGNPSQGQPCQRDSQVPGPIGCNCDPQGSVSSQCDAAGQCQCKAQVEGLTCSHCRPHHFHLSASNPDGCLPCFCMGITQQCASSAYTRHLISTHFAPGDFQGFALVNPQRNSRLTGEFTVEPVPEGAQLSFGNFAQLGHESFYWQLPETYQGDKVAAYGGKLRYTLSYTAGPQGSPLSDPDVQITGNNIMLVASQPALQGPERRSYEIMFREEFWRRPDGQPATREHLLMALADLDELLIRATFSSVPLVASISAVSLEVAQPGPSNRPRALEVEECRCPPGYIGLSCQDCAPGYTRTGSGLYLGHCELCECNGHSDLCHPETGACSQCQHNAAGEFCELCAPGYYGDATAGTPEDCQPCACPLTNPENMFSRTCESLGAGGYRCTACEPGYTGQYCEQCGPGYVGNPSVQGGQCLPETNQAPLVVEVHPARSIVPQGGSHSLRCQVSGSPPHYFYWSREDGRPVPSGTQQRHQGSELHFPSVQPSDAGVYICTCRNLHQSNTSRAELLVTEAPSKPITVTVEEQRSQSVRPGADVTFICTAKSKSPAYTLVWTRLHNGKLPTRAMDFNGILTIRNVQLSDAGTYVCTGSNMFAMDQGTATLHVQASGTLSAPVVSIHPPQLTVQPGQLAEFRCSATGSPTPTLEWTGGPGGQLPAKAQIHGGILRLPAVEPTDQAQYLCRAHSSAGQQVARAVLHVHGGGGPRVQVSPERTQVHAGRTVRLYCRAAGVPSATITWRKEGGSLPPQARSERTDIATLLIPAITTADAGFYLCVATSPAGTAQARIQVVVLSASDASPPPVKIESSSPSVTEGQTLDLNCVVAGSAHAQVTWYRRGGSLPPHTQVHGSRLRLPQVSPADSGEYVCRVENGSGPKEASITVSVLHGTHSGPSYTPVPGSTRPIRIEPSSSHVAEGQTLDLNCVVPGQAHAQVTWHKRGGSLPARHQTHGSLLRLHQVTPADSGEYVCHVVGTSGPLEASVLVTIEASVIPGPIPPVRIESSSSTVAEGQTLDLSCVVAGQAHAQVTWYKRGGSLPARHQVRGSRLYIFQASPADAGQYVCRASNGMEASITVTVTGTQGANLAYPAGSTQPIRIEPSSSQVAEGQTLDLNCVVPGQSHAQVTWHKRGGSLPVRHQTHGSLLRLYQASPADSGEYVCRVLGSSVPLEASVLVTIEPAGSVPALGVTPTVRIESSSSQVAEGQTLDLNCLVAGQAHAQVTWHKRGGSLPARHQVHGSRLRLLQVTPADSGEYVCRVVGSSGTQEASVLVTIQQRLSGSHSQGVAYPVRIESSSASLANGHTLDLNCLVASQAPHTITWYKRGGSLPSRHQIVGSRLRIPQVTPADSGEYVCHVSNGAGSRETSLIVTIQGSGSSHVPSVSPPIRIESSSPTVVEGQTLDLNCVVARQPQAIITWYKRGGSLPSRHQTHGSHLRLHQMSVADSGEYVCRANNNIDALEASIVISVSPSAGSPSAPGSSMPIRIESSSSHVAEGETLDLNCVVPGQAHAQVTWHKRGGSLPSHHQTRGSRLRLHHVSPADSGEYVCRVMGSSGPLEASVLVTIEASGSSAVHVPAPGGAPPIRIEPSSSRVAEGQTLDLKCVVPGQAHAQVTWHKRGGNLPARHQVHGPLLRLNQVSPADSGEYSCQVTGSSGTLEASVLVTIEPSSPGPIPAPGLAQPIYIEASSSHVTEGQTLDLNCVVPGQAHAQVTWYKRGGSLPARHQTHGSQLRLHLVSPADSGEYVCRAASGPGPEQEASFTVTVPPSEGSSYRLRSPVISIDPPSSTVQQGQDASFKCLIHDGAAPISLEWKTRNQELEDNVHISPNGSIITIVGTRPSNHGTYRCVASNAYGVAQSVVNLSVHGPPTVSVLPEGPVWVKVGKAVTLECVSAGEPRSSARWTRISSTPAKLEQRTYGLMDSHAVLQISSAKPSDAGTYVCLAQNALGTAQKQVEVIVDTGAMAPGAPQVQAEEAELTVEAGHTATLRCSATGSPAPTIHWSKLRSPLPWQHRLEGDTLIIPRVAQQDSGQYICNATSPAGHAEATIILHVESPPYATTVPEHASVQAGETVQLQCLAHGTPPLTFQWSRVGSSLPGRATARNELLHFERAAPEDSGRYRCRVTNKVGSAEAFAQLLVQGPPGSLPATSIPAGSTPTVQVTPQLETKSIGASVEFHCAVPSDRGTQLRWFKEGGQLPPGHSVQDGVLRIQNLDQSCQGTYICQAHGPWGKAQASAQLVIQALPSVLINIRTSVQTVVVGHAVEFECLALGDPKPQVTWSKVGGHLRPGIVQSGGVVRIAHVELADAGQYRCTATNAAGTTQSHVLLLVQALPQISMPQEVRVPAGSAAVFPCIASGYPTPDISWSKLDGSLPPDSRLENNMLMLPSVRPQDAGTYVCTATNRQGKVKAFAHLQVPERVVPYFTQTPYSFLPLPTIKDAYRKFEIKITFRPDSADGMLLYNGQKRVPGSPTNLANRQPDFISFGLVGGRPEFRFDAGSGMATIRHPTPLALGHFHTVTLLRSLTQGSLIVGDLAPVNGTSQGKFQGLDLNEELYLGGYPDYGAIPKAGLSSGFIGCVRELRIQGEEIVFHDLNLTAHGISHCPTCRDRPCQNGGQCHDSESSSYVCVCPAGFTGSRCEHSQALHCHPEACGPDATCVNRPDGRGYTCRCHLGRSGLRCEEGVTVTTPSLSGAGSYLALPALTNTHHELRLDVEFKPLAPDGVLLFSGGKSGPVEDFVSLAMVGGHLEFRYELGSGLAVLRSAEPLALGRWHRVSAERLNKDGSLRVNGGRPVLRSSPGKSQGLNLHTLLYLGGVEPSVPLSPATNMSAHFRGCVGEVSVNGKRLDLTYSFLGSQGIGQCYDSSPCERQPCQHGATCMPAGEYEFQCLCRDGFKGDLCEHEENPCQLREPCLHGGTCQGTRCLCLPGFSGPRCQQGSGHGIAESDWHLEGSGGNDAPGQYGAYFHDDGFLAFPGHVFSRSLPEVPETIELEVRTSTASGLLLWQGVEVGEAGQGKDFISLGLQDGHLVFRYQLGSGEARLVSEDPINDGEWHRVTALREGRRGSIQVDGEELVSGRSPGPNVAVNAKGSVYIGGAPDVATLTGGRFSSGITGCVKNLVLHSARPGAPPPQPLDLQHRAQAGANTRPCPS

SEQ ID NO: 860454 - protein, 3815 aa, Homo sapiens
MGQGTRDNDHSNSFQPYPALNIHSASDRTFWCNGNVACLHSSNKIATKRFNEASTIKKLNSGRPVQRAELLQVLQSLEAVLIQTVYNTKMASVGLSDIAMDTTVTHATSHGRAHSVEECRCLSRQELGTTETLARIEEKRQGLTVLQRLFWSCPHRCPIGYSGLSCESCDAHFTRVPGGPYLGTCSGCSCNGHASSCDPVYGHCLNCQHNTEGPQCNKCKAGFFGDAMKATATSCRPCPCPYIDASRRFSDTCFLDTDGQATCDACAPGYTGRRCESCAPGYEGNPIQPGGKCRPVNQEIVRCDERGSMGTSGEACRCKNNVVGRLCNECADGSFHLSTRNPDGCLKCFCMGVSRHCTSSSWSRAQLHGASEEPGHFSLTNAASTHTTNEGIFSPTPGELGFSSFHRLLSGPYFWSLPSRFLGDKVTSYGGELRFTVTQRSQPGSTPLHGQPLVVLQGNNIILEHHVAQEPSPGQPSTFIVPFREQAWQRPDGQPATREHLLMALAGIDTLLIRASYAQQPAESRVSGISMDVAVPEETGQDPALEVEQCSCPPGYRGPSCQDCDTGYTRTPSGLYLGTCERCSCHGHSEACEPETGACQGCQHHTEGPRCEQCQPGYYGDAQRGTPQDCQLCPCYGDPAAGQAAHTCFLDTDGHPTCDACSPGHSGRHCERCAPGYYGNPSQGQPCQRDSQVPGPIGCNCDPQGSVSSQCDAAGQCQCKAQVEGLTCSHCRPHHFHLSASNPDGCLPCFCMGITQQCASSAYTRHLISTHFAPGDFQGFALVNPQRNSRLTGEFTVEPVPEGAQLSFGNFAQLGHESFYWQLPETYQGDKVAAYGGKLRYTLSYTAGPQGSPLSDPDVQITGNNIMLVASQPALQGPERRSYEIMFREEFWRRPDGQPATREHLLMALADLDELLIRATFSSVPLVASISAVSLEVAQPGPSNRPRALEVEECRCPPGYIGLSCQDCAPGYTRTGSGLYLGHCELCECNGHSDLCHPETGACSQCQHNAAGEFCELCAPGYYGDATAGTPEDCQPCACPLTNPENMFSRTCESLGAGGYRCTACEPGYTGQYCEQCGPGYVGNPSVQGGQCLPETNQAPLVVEVHPARSIVPQGGSHSLRCQVSGSPPHYFYWSREDGRPVPSGTQQRHQGSELHFPSVQPSDAGVYICTCRNLHQSNTSRAELLVTEAPSKPITVTVEEQRSQSVRPGADVTFICTAKSKSPAYTLVWTRLHNGKLPTRAMDFNGILTIRNVQLSDAGTYVCTGSNMFAMDQGTATLHVQASGTLSAPVVSIHPPQLTVQPGQLAEFRCSATGSPTPTLEWTGGPGGQLPAKAQIHGGILRLPAVEPTDQAQYLCRAHSSAGQQVARAVLHVHGGGGPRVQVSPERTQVHAGRTVRLYCRAAGVPSATITWRKEGGSLPPQARSERTDIATLLIPAITTADAGFYLCVATSPAGTAQARIQVVVLSASDASPPPVKIESSSPSVTEGQTLDLNCVVAGSAHAQVTWYRRGGSLPPHTQVHGSRLRLPQVSPADSGEYVCRVENGSGPKEASITVSVLHGTHSGPSYTPVPGSTRPIRIEPSSSHVAEGQTLDLNCVVPGQAHAQVTWHKRGGSLPARHQTHGSLLRLHQVTPADSGEYVCHVVGTSGPLEASVLVTIEASVIPGPIPPVRIESSSSTVAEGQTLDLSCVVAGQAHAQVTWYKRGGSLPARHQVRGSRLYIFQASPADAGQYVCRASNGMEASITVTVTGTQGANLAYPAGSTQPIRIEPSSSQVAEGQTLDLNCVVPGQSHAQVTWHKRGGSLPVRHQTHGSLLRLYQASPADSGEYVCRVLGSSVPLEASVLVTIEPAGSVPALGVTPTVRIESSSSQVAEGQTLDLNCLVAGQAHAQVTWHKRGGSLPARHQVHGSRLRLLQVTPADSGEYVCRVVGSSGTQEASVLVTIQQRLSGSHSQGVAYPVRIESSSASLANGHTLDLNCLVASQAPHTITWYKRGGSLPSRHQIVGSRLRIPQVTPADSGEYVCHVSNGAGSRETSLIVTIQGSGSSHVPSVSPPIRIESSSPTVVEGQTLDLNCVVARQPQAIITWYKRGGSLPSRHQTHGSHLRLHQMSVADSGEYVCRANNNIDALEASIVISVSPSAGSPSAPGSSMPIRIESSSSHVAEGETLDLNCVVPGQAHAQVTWHKRGGSLPSHHQTRGSRLRLHHVSPADSGEYVCRVMGSSGPLEASVLVTIEASGSSAVHVPAPGGAPPIRIEPSSSRVAEGQTLDLKCVVPGQAHAQVTWHKRGGNLPARHQVHGPLLRLNQVSPADSGEYSCQVTGSSGTLEASVLVTIEPSSPGPIPAPGLAQPIYIEASSSHVTEGQTLDLNCVVPGQAHAQVTWYKRGGSLPARHQTHGSQLRLHLVSPADSGEYVCRAASGPGPEQEASFTVTVPPSEGSSYRLRSPVISIDPPSSTVQQGQDASFKCLIHDGAAPISLEWKTRNQELEDNVHISPNGSIITIVGTRPSNHGTYRCVASNAYGVAQSVVNLSVHGPPTVSVLPEGPVWVKVGKAVTLECVSAGEPRSSARWTRISSTPAKLEQRTYGLMDSHAVLQISSAKPSDAGTYVCLAQNALGTAQKQVEVIVDTGAMAPGAPQVQAEEAELTVEAGHTATLRCSATGSPAPTIHWSKLRSPLPWQHRLEGDTLIIPRVAQQDSGQYICNATSPAGHAEATIILHVESPPYATTVPEHASVQAGETVQLQCLAHGTPPLTFQWSRVGSSLPGRATARNELLHFERAAPEDSGRYRCRVTNKVGSAEAFAQLLVQGPPGSLPATSIPAGSTPTVQVTPQLETKSIGASVEFHCAVPSDRGTQLRWFKEGGQLPPGHSVQDGVLRIQNLDQSCQGTYICQAHGPWGKAQASAQLVIQALPSVLINIRTSVQTVVVGHAVEFECLALGDPKPQVTWSKVGGHLRPGIVQSGGVVRIAHVELADAGQYRCTATNAAGTTQSHVLLLVQALPQISMPQEVRVPAGSAAVFPCIASGYPTPDISWSKLDGSLPPDSRLENNMLMLPSVRPQDAGTYVCTATNRQGKVKAFAHLQVPERVVPYFTQTPYSFLPLPTIKDAYRKFEIKITFRPDSADGMLLYNGQKRVPGSPTNLANRQPDFISFGLVGGRPEFRFDAGSGMATIRHPTPLALGHFHTVTLLRSLTQGSLIVGDLAPVNGTSQGKFQGLDLNEELYLGGYPDYGAIPKAGLSSGFIGCVRELRIQGEEIVFHDLNLTAHGISHCPTCRDRPCQNGGQCHDSESSSYVCVCPAGFTGSRCEHSQALHCHPEACGPDATCVNRPDGRGYTCRCHLGRSGLRCEEGVTVTTPSLSGAGSYLALPALTNTHHELRLDVEFKPLAPDGVLLFSGGKSGPVEDFVSLAMVGGHLEFRYELGSGLAVLRSAEPLALGRWHRVSAERLNKDGSLRVNGGRPVLRSSPGKSQGLNLHTLLYLGGVEPSVPLSPATNMSAHFRGCVGEVSVNGKRLDLTYSFLGSQGIGQCYDSSPCERQPCQHGATCMPAGEYEFQCLCRDGFKGDLCEHEENPCQLREPCLHGGTCQGTRCLCLPGFSGPRCQQGSGHGIAESDWHLEGSGGNDAPGQYGAYFHDDGFLAFPGHVFSRSLPEVPETIELEVRTSTASGLLLWQGVEVGEAGQGKDFISLGLQDGHLVFRYQLGSGEARLVSEDPINDGEWHRVTALREGRRGSIQVDGEELVSGRSPGPNVAVNAKGSVYIGGAPDVATLTGGRFSSGITGCVKNLVLHSARPGAPPPQPLDLQHRAQAGANTRPCPS

SEQ ID NO: 860455 - protein, 3325 aa, Homo sapiens
TGLSGGLIRPCQWRTPGVPGTEPALLFTLGLVTPRVSGISMDVAVPEETGQDPALEVEQCSCPPGYRGPSCQDCDTGYTRTPSGLYLGTCERCSCHGHSEACEPETGACQGCQHHTEGPRCEQCQPGYYGDAQRGTPQDCQLCPCYGDPAAGQAAHTCFLDTDGHPTCDACSPGHSGRHCERCAPGYYGNPSQGQPCQRDSQVPGPIGCNCDPQGSVSSQCDAAGQCQCKAQVEGLTCSHCRPHHFHLSASNPDGCLPCFCMGITQQCASSAYTRHLISTHFAPGDFQGFALVNPQRNSRLTGEFTVEPVPEGAQLSFGNFAQLGHESFYWQLPETYQGDKVAAYGGKLRYTLSYTAGPQGSPLSDPDVQITGNNIMLVASQPALQGPERRSYEIMFREEFWRRPDGQPATREHLLMALADLDELLIRATFSSVPLVASISAVSLEVAQPGPSNRPRALEVEECRCPPGYIGLSCQDCAPGYTRTGSGLYLGHCELCECNGHSDLCHPETGACSQCQHNAAGEFCELCAPGYYGDATAGTPEDCQPCACPLTNPENMFSRTCESLGAGGYRCTACEPGYTGQYCEQCGPGYVGNPSVQGGQCLPETNQAPLVVEVHPARSIVPQGGSHSLRCQVSGSPPHYFYWSREDGRPVPSGTQQRHQGSELHFPSVQPSDAGVYICTCRNLHQSNTSRAELLVTEAPSKPITVTVEEQRSQSVRPGADVTFICTAKSKSPAYTLVWTRLHNGKLPTRAMDFNGILTIRNVQLSDAGTYVCTGSNMFAMDQGTATLHVQASGTLSAPVVSIHPPQLTVQPGQLAEFRCSATGSPTPTLEWTGGPGGQLPAKAQIHGGILRLPAVEPTDQAQYLCRAHSSAGQQVARAVLHVHGGGGPRVQVSPERTQVHAGRTVRLYCRAAGVPSATITWRKEGGSLPPQARSERTDIATLLIPAITTADAGFYLCVATSPAGTAQARIQVVVLSASDASPPPVKIESSSPSVTEGQTLDLNCVVAGSAHAQVTWYRRGGSLPPHTQVHGSRLRLPQVSPADSGEYVCRVENGSGPKEASITVSVLHGTHSGPSYTPVPGSTRPIRIEPSSSHVAEGQTLDLNCVVPGQAHAQVTWHKRGGSLPARHQTHGSLLRLHQVTPADSGEYVCHVVGTSGPLEASVLVTIEASVIPGPIPPVRIESSSSTVAEGQTLDLSCVVAGQAHAQVTWYKRGGSLPARHQVRGSRLYIFQASPADAGQYVCRASNGMEASITVTVTGTQGANLAYPAGSTQPIRIEPSSSQVAEGQTLDLNCVVPGQSHAQVTWHKRGGSLPVRHQTHGSLLRLYQASPADSGEYVCRVLGSSVPLEASVLVTIEPAGSVPALGVTPTVRIESSSSQVAEGQTLDLNCLVAGQAHAQVTWHKRGGSLPARHQVHGSRLRLLQVTPADSGEYVCRVVGSSGTQEASVLVTIQQRLSGSHSQGVAYPVRIESSSASLANGHTLDLNCLVASQAPHTITWYKRGGSLPSRHQIVGSRLRIPQVTPADSGEYVCHVSNGAGSRETSLIVTIQGSGSSHVPSVSPPIRIESSSPTVVEGQTLDLNCVVARQPQAIITWYKRGGSLPSRHQTHGSHLRLHQMSVADSGEYVCRANNNIDALEASIVISVSPSAGSPSAPGSSMPIRIESSSSHVAEGETLDLNCVVPGQAHAQVTWHKRGGSLPSHHQTRGSRLRLHHVSPADSGEYVCRVMGSSGPLEASVLVTIEASGSSAVHVPAPGGAPPIRIEPSSSRVAEGQTLDLKCVVPGQAHAQVTWHKRGGNLPARHQVHGPLLRLNQVSPADSGEYSCQVTGSSGTLEASVLVTIEPSSPGPIPAPGLAQPIYIEASSSHVTEGQTLDLNCVVPGQAHAQVTWYKRGGSLPARHQTHGSQLRLHLVSPADSGEYVCRAASGPGPEQEASFTVTVPPSEGSSYRLRSPVISIDPPSSTVQQGQDASFKCLIHDGAAPISLEWKTRNQELEDNVHISPNGSIITIVGTRPSNHGTYRCVASNAYGVAQSVVNLSVHGPPTVSVLPEGPVWVKVGKAVTLECVSAGEPRSSARWTRISSTPAKLEQRTYGLMDSHAVLQISSAKPSDAGTYVCLAQNALGTAQKQVEVIVDTGAMAPGAPQVQAEEAELTVEAGHTATLRCSATGSPAPTIHWSKLRSPLPWQHRLEGDTLIIPRVAQQDSGQYICNATSPAGHAEATIILHVESPPYATTVPEHASVQAGETVQLQCLAHGTPPLTFQWSRVGSSLPGRATARNELLHFERAAPEDSGRYRCRVTNKVGSAEAFAQLLVQGPPGSLPATSIPAGSTPTVQVTPQLETKSIGASVEFHCAVPSDRGTQLRWFKEGGQLPPGHSVQDGVLRIQNLDQSCQGTYICQAHGPWGKAQASAQLVIQALPSVLINIRTSVQTVVVGHAVEFECLALGDPKPQVTWSKVGGHLRPGIVQSGGVVRIAHVELADAGQYRCTATNAAGTTQSHVLLLVQALPQISMPQEVRVPAGSAAVFPCIASGYPTPDISWSKLDGSLPPDSRLENNMLMLPSVRPQDAGTYVCTATNRQGKVKAFAHLQVPERVVPYFTQTPYSFLPLPTIKDAYRKFEIKITFRPDSADGMLLYNGQKRVPGSPTNLANRQPDFISFGLVGGRPEFRFDAGSGMATIRHPTPLALGHFHTVTLLRSLTQGSLIVGDLAPVNGTSQGKFQGLDLNEELYLGGYPDYGAIPKAGLSSGFIGCVRELRIQGEEIVFHDLNLTAHGISHCPTCRDRPCQNGGQCHDSESSSYVCVCPAGFTGSRCEHSQALHCHPEACGPDATCVNRPDGRGYTCRCHLGRSGLRCEEGVTVTTPSLSGAGSYLALPALTNTHHELRLDVEFKPLAPDGVLLFSGGKSGPVEDFVSLAMVGGHLEFRYELGSGLAVLRSAEPLALGRWHRVSAERLNKDGSLRVNGGRPVLRSSPGKSQGLNLHTLLYLGGVEPSVPLSPATNMSAHFRGCVGEVSVNGKRLDLTYSFLGSQGIGQCYDSSPCERQPCQHGATCMPAGEYEFQCLCRDGFKGDLCEHEENPCQLREPCLHGGTCQGTRCLCLPGFSGPRCQQGSGHGIAESDWHLEGSGGNDAPGQYGAYFHDDGFLAFPGHVFSRSLPEVPETIELEVRTSTASGLLLWQGVEVGEAGQGKDFISLGLQDGHLVFRYQLGSGEARLVSEDPINDGEWHRVTALREGRRGSIQVDGEELVSGRSPGPNVAVNAKGSVYIGGAPDVATLTGGRFSSGITGCVKNLVLHSARPGAPPPQPLDLQHRAQAGANTRPCPS

SEQ ID NO: 860456 - protein, 4272 aa, Homo sapiens
MGWRAPGALLLALLLHGRLLAVTHGLRAYDGLSLPEDIETVTASQMRWTHSYLSDDEDMLADSISGDDLGSGDLGSGDFQMVYFRALVNFTRSIEYSPQLEDAGSREFREVSEAVVDTLESEYLKIPGDQVVSVVFIKELDGWVFVELDVGSEGNADGAQIQEMLLRVISSGSVASYVTSPQGFQFRRLGTVPQFPRACTEAEFACHSYNECVALEYRCDRRPDCRDMSDELNCEEPVLGISPTFSLLVETTSLPPRPETTIMRQPPVTHAPQPLLPGSVRPLPCGPQEAACRNGHCIPRDYLCDGQEDCEDGSDELDCGPPPPCEPNEFPCGNGHCALKLWRCDGDFDCEDRTDEANCPTKRPEEVCGPTQFRCVSTNMCIPASFHCDEESDCPDRSDEFGCMPPQVVTPPRESIQASRGQTVTFTCVAIGVPTPFIINWRLNWGHIPSHPRVTVTSEGGRGTLIIRDVKESDQGAYTCEAMNARGMVFGIPDGVLELVPQRGPCPDGHFYLEHSAACLPCFCFGITSVCQSTRRFRDQIRLRFDQPDDFKGVNVTMPAQPGTPPLSSTQLQIDPSLHEFQLVDLSRRFLVHDSFWALPEQFLGNKVDSYGGSLRYNVRYELARGMLEPVQRPDVVLVGAGYRLLSRGHTPTQPGALNQRQVQFSEEHWVHESGRPVQRAELLQVLQSLEAVLIQTVYNTKMASVGLSDIAMDTTVTHATSHGRAHSVEECRCPIGYSGLSCESCDAHFTRVPGGPYLGTCSGCSCNGHASSCDPVYGHCLNCQHNTEGPQCNKCKAGFFGDAMKATATSCRPCPCPYIDASRRFSDTCFLDTDGQATCDACAPGYTGRRCESCAPGYEGNPIQPGGKCRPVNQEIVRCDERGSMGTSGEACRCKNNVVGRLCNECADGSFHLSTRNPDGCLKCFCMGVSRHCTSSSWSRAQLHGASEEPGHFSLTNAASTHTTNEGIFSPTPGELGFSSFHRLLSGPYFWSLPSRFLGDKVTSYGGELRFTVTQRSQPGSTPLHGQPLVVLQGNNIILEHHVAQEPSPGQPSTFIVPFREQAWQRPDGQPATREHLLMALAGIDTLLIRASYAQQPAESRVSGISMDVAVPEETGQDPALEVEQCSCPPGYRGPSCQDCDTGYTRTPSGLYLGTCERCSCHGHSEACEPETGACQGCQHHTEGPRCEQCQPGYYGDAQRGTPQDCQLCPCYGDPAAGQAAHTCFLDTDGHPTCDACSPGHSGRHCERCAPGYYGNPSQGQPCQRDSQVPGPIGCNCDPQGSVSSQCDAAGQCQCKAQVEGLTCSHCRPHHFHLSASNPDGCLPCFCMGITQQCASSAYTRHLISTHFAPGDFQGFALVNPQRNSRLTGEFTVEPVPEGAQLSFGNFAQLGHESFYWQLPETYQGDKVAAYGGKLRYTLSYTAGPQGSPLSDPDVQITGNNIMLVASQPALQGPERRSYEIMFREEFWRRPDGQPATREHLLMALADLDELLIRATFSSVPLVASISAVSLEVAQPGPSNRPRALEVEECRCPPGYIGLSCQDCAPGYTRTGSGLYLGHCELCECNGHSDLCHPETGACSQCQHNAAGEFCELCAPGYYGDATAGTPEDCQPCACPLTNPENMFSRTCESLGAGGYRCTACEPGYTGQYCEQCGPGYVGNPSVQGGQCLPETNQAPLVVEVHPARSIVPQGGSHSLRCQVSGSPPHYFYWSREDGRPVPSGTQQRHQGSELHFPSVQPSDAGVYICTCRNLHQSNTSRAELLVTEAPSKPITVTVEEQRSQSVRPGADVTFICTAKSKSPAYTLVWTRLHNGKLPTRAMDFNGILTIRNVQLSDAGTYVCTGSNMFAMDQGTATLHVQASGTLSAPVVSIHPPQLTVQPGQLAEFRCSATGSPTPTLEWTGGPGGQLPAKAQIHGGILRLPAVEPTDQAQYLCRAHSSAGQQVARAVLHVHGGGGPRVQVSPERTQVHAGRTVRLYCRAAGVPSATITWRKEGGSLPPQARSERTDIATLLIPAITTADAGFYLCVATSPAGTAQARIQVVVLSASDASPPPVKIESSSPSVTEGQTLDLNCVVAGSAHAQVTWYRRGGSLPPHTQVHGSRLRLPQVSPADSGEYVCRVENGSGPKEASITVSVLHGTHSGPSYTPVPGSTRPIRIEPSSSHVAEGQTLDLNCVVPGQAHAQVTWHKRGGSLPARHQTHGSLLRLHQVTPADSGEYVCHVVGTSGPLEASVLVTIEASVIPGPIPPVRIESSSSTVAEGQTLDLSCVVAGQAHAQVTWYKRGGSLPARHQVRGSRLYIFQASPADAGQYVCRASNGMEASITVTVTGTQGANLAYPAGSTQPIRIEPSSSQVAEGQTLDLNCVVPGQSHAQVTWHKRGGSLPVRHQTHGSLLRLYQASPADSGEYVCRVLGSSVPLEASVLVTIEPAGSVPALGVTPTVRIESSSSQVAEGQTLDLNCLVAGQAHAQVTWHKRGGSLPARHQVHGSRLRLLQVTPADSGEYVCRVVGSSGTQEASVLVTIQQRLSGSHSQGVAYPVRIESSSASLANGHTLDLNCLVASQAPHTITWYKRGGSLPSRHQIVGSRLRIPQVTPADSGEYVCHVSNGAGSRETSLIVTIQGSGSSHVPSVSPPIRIESSSPTVVEGQTLDLNCVVARQPQAIITWYKRGGSLPSRHQTHGSHLRLHQMSVADSGEYVCRANNNIDALEASIVISVSPSAGSPSAPGSSMPIRIESSSSHVAEGETLDLNCVVPGQAHAQVTWHKRGGSLPSHHQTRGSRLRLHHVSPADSGEYVCRVMGSSGPLEASVLVTIEASGSSAVHVPAPGGAPPIRIEPSSSRVAEGQTLDLKCVVPGQAHAQVTWHKRGGNLPARHQVHGPLLRLNQVSPADSGEYSCQVTGSSGTLEASVLVTIEPSSPGPIPAPGLAQPIYIEASSSHVTEGQTLDLNCVVPGQAHAQVTWYKRGGSLPARHQTHGSQLRLHLVSPADSGEYVCRAASGPGPEQEASFTVTVPPSEGSSYRLRSPVISIDPPSSTVQQGQDASFKCLIHDGAAPISLEWKTRNQELEDNVHISPNGSIITIVGTRPSNHGTYRCVASNAYGVAQSVVNLSVHGPPTVSVLPEGPVWVKVGKAVTLECVSAGEPRSSARWTRISSTPAKLEQRTYGLMDSHAVLQISSAKPSDAGTYVCLAQNALGTAQKQVEVIVDTGAMAPGAPQVQAEEAELTVEAGHTATLRCSATGSPAPTIHWSKLRSPLPWQHRLEGDTLIIPRVAQQDSGQYICNATSPAGHAEATIILHVESPPYATTVPEHASVQAGETVQLQCLAHGTPPLTFQWSRVGSSLPGRATARNELLHFERAAPEDSGRYRCRVTNKVGSAEAFAQLLVQGPPGSLPATSIPAGSTPTVQVTPQLETKSIGASVEFHCAVPSDRGTQLRWFKEGGQLPPGHSVQDGVLRIQNLDQSCQGTYICQAHGPWGKAQASAQLVIQALPSVLINIRTSVQTVVVGHAVEFECLALGDPKPQVTWSKVGGHLRPGIVQSGGVVRIAHVELADAGQYRCTATNAAGTTQSHVLLLVQALPQISMPQEVRVPAGSAAVFPCIASGYPTPDISWSKLDGSLPPDSRLENNMLMLPSVRPQDAGTYVCTATNRQGKVKAFAHLQVPERVVPYFTQTPYSFLPLPTIKDAYRKFEIKITFRPDSADGMLLYNGQKRVPGSPTNLANRQPDFISFGLVGGRPEFRFDAGSGMATIRHPTPLALGHFHTVTLLRSLTQGSLIVGDLAPVNGTSQGKFQGLDLNEELYLGGYPDYGAIPKAGLSSGFIGCVRELRIQGEEIVFHDLNLTAHGISHCPTCRDRPCQNGGQCHDSESSSYVCVCPAGFTGSRCEHSQALHCHPEACGPDATCVNRPDGRGYTCRCHLGRSGLRCEEGVTVTTPSLSGAGSYLALPALTNTHHELRLDVEFKPLAPDGVLLFSGGKSGPVEDFVSLAMVGGHLEFRYELGSGLAVLRSAEPLALGRWHRVSAERLNKDGSLRVNGGRPVLRSSPGKSQGLNLHTLLYLGGVEPSVPLSPATNMSAHFRGCVGEVSVNGKRLDLTYSFLGSQGIGQCYDSSPCERQPCQHGATCMPAGEYEFQCLCRDGFKGDLCEHEENPCQLREPCLHGGTCQGTRCLCLPGFSGPRCQQGSGHGIAESDWHLEGSGGNDAPGQYGAYFHDDGFLAFPGHVFSRSLPEVPETIELEVRTSTASGLLLWQGVEVGEAGQGKDFISAGANTRPCPS

SEQ ID NO: 860457 - protein, 1058 aa, Homo sapiens
ELRILTSCDVPVAPLLAAFVESSMRFGQKLSRCQHYVSCKDLQNLIHVPAGPPGSLPATSIPAGSTPTVQVTPQLETKSIGASVEFHCAVPSDRGTQLRWFKEGGQLPPGHSVQDGVLRIQNLDQSCQGTYICQAHGPWGKAQASAQLVIQALPSVLINIRTSVQTVVVGHAVEFECLALGDPKPQVTWSKVGGHLRPGIVQSGGVVRIAHVELADAGQYRCTATNAAGTTQSHVLLLVQALPQISMPQEVRVPAGSAAVFPCIASGYPTPDISWSKLDGSLPPDSRLENNMLMLPSVRPQDAGTYVCTATNRQGKVKAFAHLQVPERVVPYFTQTPYSFLPLPTIKDAYRKFEIKITFRPDSADGMLLYNGQKRVPGSPTNLANRQPDFISFGLVGGRPEFRFDAGSGMATIRHPTPLALGHFHTVTLLRSLTQGSLIVGDLAPVNGTSQGKFQGLDLNEELYLGGYPDYGAIPKAGLSSGFIGCVRELRIQGEEIVFHDLNLTAHGISHCPTCRDRPCQNGGQCHDSESSSYVCVCPAGFTGSRCEHSQALHCHPEACGPDATCVNRPDGRGYTCRCHLGRSGLRCEEGVTVTTPSLSGAGSYLALPALTNTHHELRLDVEFKPLAPDGVLLFSGGKSGPVEDFVSLAMVGGHLEFRYELGSGLAVLRSAEPLALGRWHRVSAERLNKDGSLRVNGGRPVLRSSPGKSQGLNLHTLLYLGGVEPSVPLSPATNMSAHFRGCVGEVSVNGKRLDLTYSFLGSQGIGQCYDSSPCERQPCQHGATCMPAGEYEFQCLCRDGFKGDLCEHEENPCQLREPCLHGGTCQGTRCLCLPGFSGPRCQQGSGHGIAESDWHLEGSGGNDAPGQYGAYFHDDGFLAFPGHVFSRSLPEVPETIELEVRTSTASGLLLWQGVEVGEAGQGKDFISLGLQDGHLVFRYQLGSGEARLVSEDPINDGEWHRVTALREGRRGSIQVDGEELVSGRSPGPNVAVNAKGSVYIGGAPDVATLTGGRFSSGITGCVKNLVLHSARPGAPPPQPLDLQHRAQAGANTRPCPS

SEQ ID NO: 860458 - protein, 4183 aa, Homo sapiens; identical to SEQ ID NO: 860450

SEQ ID NO: 860459 - protein, 311 aa, Homo sapiens
NSHPSTLNNARYEAWVKSAEATGYSSPCERQPCQHGATCMPAGEYEFQCLCRDGFKGDLCEHEENPCQLREPCLHGGTCQGTRCLCLPGFSGPRCQQGSGHGIAESDWHLEGSGGNDAPGQYGAYFHDDGFLAFPGHVFSRSLPEVPETIELEVRTSTASGLLLWQGVEVGEAGQGKDFISLGLQDGHLVFRYQLGSGEARLVSEDPINDGEWHRVTALREGRRGSIQVDGEELVSGRSPGPNVAVNAKGSVYIGGAPDVATLTGGRFSSGITGCVKNLVLHSARPGAPPPQPLDLQHRAQAGANTRPCPS

SEQ ID NO: 860460 - protein, 4183 aa, Homo sapiens; identical to SEQ ID NO: 860450

SEQ ID NO: 860461 - protein, 232 aa, Homo sapiens
MVEAGVNRRLVLWPRCQQGSGHGIAESDWHLEGSGGNDAPGQYGAYFHDDGFLAFPGHVFSRSLPEVPETIELEVRTSTASGLLLWQGVEVGEAGQGKDFISLGLQDGHLVFRYQLGSGEARLVSEDPINDGEWHRVTALREGRRGSIQVDGEELVSGRSPGPNVAVNAKGSVYIGGAPDVATLTGGRFSSGITGCVKNLVLHSARPGAPPPQPLDLQHRAQAGANTRPCPS

SEQ ID NO: 860462 - protein, 207 aa, Homo sapiens [sequence omitted]

SEQ ID NO: 860463 - protein, 3704 aa, Homo sapiens
MGWRAPGALLLALLLHGRLLAVTHGLRAYDGLSLPEDIETVTASQMRWTHSYLSDDEDMLADSISGDDLGSGDLGSGDFQMVYFRALVNFTRSIEYSPQLEDAGSREFREVSEAVVDTLESEYLKIPGDQVVSVVFIKELDGWVFVELDVGSEGNADGAQIQEMLLRVISSGSVASYVTSPQGFQFRRLGTVPQFPRACTEAEFACHSYNECVALEYRCDRRPDCRDMSDELNCEEPVLGISPTFSLLVETTSLPPRPETTIMRQPPVTHAPQPLLPGSVRPLPCGPQEAACRNGHCIPRDYLCDGQEDCEDGSDELDCGPPPPCEPNEFPCGNGHCALKLWRCDGDFDCEDRTDEANCPTKRPEEVCGPTQFRCVSTNMCIPASFHCDEESDCPDRSDEFGCMPPQVVTPPRESIQASRGQTVTFTCVAIGVPTPFIINWRLNWGHIPSHPRVTVTSEGGRGTLIIRDVKESDQGAYTCEAMNARGMVFGIPDGVLELVPQRGPCPDGHFYLEHSAACLPCFCFGITSVCQSTRRFRDQIRLRFDQPDDFKGVNVTMPAQPGTPPLSSTQLQIDPSLHEFQLVDLSRRFLVHDSFWALPEQFLGNKVDSYGGSLRYNVRYELARGMLEPVQRPDVVLVGAGYRLLSRGHTPTQPGALNQRQVQFSEEHWVHESGRPVQRAELLQVLQSLEAVLIQTVYNTKMASVGLSDIAMDTTVTHATSHGRAHSVEECRCPIGYSGLSCESCDAHFTRVPGGPYLGTCSGCSCNGHASSCDPVYGHCLNCQHNTEGPQCNKCKAGFFGDAMKATATSCRPCPCPYIDASRRFSDTCFLDTDGQATCDACAPGYTGRRCESCAPGYEGNPIQPGGKCRPVNQEIVRCDERGSMGTSGEACRCKNNVVGRLCNECADGSFHLSTRNPDGCLKCFCMGVSRHCTSSSWSRAQLHGASEEPGHFSLTNAASTHTTNEGIFSPTPGELGFSSFHRLLSGPYFWSLPSRFLGDKVTSYGGELRFTVTQRSQPGSTPLHGQPLVVLQGNNIILEHHVAQEPSPGQPSTFIVPFREQAWQRPDGQPATREHLLMALAGIDTLLIRASYAQQPAESRVSGISMDVAVPEETGQDPALEVEQCSCPPGYRGPSCQDCDTGYTRTPSGLYLGTCERCSCHGHSEACEPETGACQGCQHHTEGPRCEQCQPGYYGDAQRGTPQDCQLCPCYGDPAAGQAAHTCFLDTDGHPTCDACSPGHSGRHCERCAPGYYGNPSQGQPCQRDSQVPGPIGCNCDPQGSVSSQCDAAGQCQCKAQVEGLTCSHCRPHHFHLSASNPDGCLPCFCMGITQQCASSAYTRHLISTHFAPGDFQGFALVNPQRNSRLTGEFTVEPVPEGAQLSFGNFAQLGHESFYWQLPETYQGDKVAAYGGKLRYTLSYTAGPQGSPLSDPDVQITGNNIMLVASQPALQGPERRSYEIMFREEFWRRPDGQPATREHLLMALADLDELLIRATFSSVPLVASISAVSLEVAQPGPSNRPRALEVEECRCPPGYIGLSCQDCAPGYTRTGSGLYLGHCELCECNGHSDLCHPETGACSQCQHNAAGEFCELCAPGYYGDATAGTPEDCQPCACPLTNPENMFSRTCESLGAGGYRCTACEPGYTGQYCEQCGPGYVGNPSVQGGQCLPETNQAPLVVEVHPARSIVPQGGSHSLRCQVSGSPPHYFYWSREDGRPVPSGTQQRHQGSELHFPSVQPSDAGVYICTCRNLHQSNTSRAELLVTEAPSKPITVTVEEQRSQSVRPGADVTFICTAKSKSPAYTLVWTRLHNGKLPTRAMDFNGILTIRNVQLSDAGTYVCTGSNMFAMDQGTATLHVQASGTLSAPVVSIHPPQLTVQPGQLAEFRCSATGSPTPTLEWTGGPGGQLPAKAQIHGGILRLPAVEPTDQAQYLCRAHSSAGQQVARAVLHVHGGGGPRVQVSPERTQVHAGRTVRLYCRAAGVPSATITWRKEGGSLPPQARSERTDIATLLIPAITTADAGFYLCVATSPAGTAQARIQVVVLSASDASPPPVKIESSSPSVTEGQTLDLNCVVAGSAHAQVTWYRRGGSLPPHTQVHGSRLRLPQVSPADSGEYVCRVENGSGPKEASITVSVLHGTHSGPSYTPVPGSTRPIRIEPSSSHVAEGQTLDLNCVVPGQAHAQVTWHKRGGSLPARHQTHGSLLRLHQVTPADSGEYVCHVVGTSGPLEASVLVTIEASVIPGPIPPVRIESSSSTVAEGQTLDLSCVVAGQAHAQVTWYKRGGSLPARHQVRGSRLYIFQASPADAGQYVCRASNGMEASITVTVTGTQGANLAYPAGSTQPIRIEPSSSQVAEGQTLDLNCVVPGQSHAQVTWHKRGGSLPVRHQTHGSLLRLYQASPADSGEYVCRVLGSSVPLEASVLVTIEPAGSVPALGVTPTVRIESSSSQVAEGQTLDLNCLVAGQAHAQVTWHKRGGSLPARHQVHGSRLRLLQVTPADSGEYVCRVVGSSGTQEASVLVTIQQRLSGSHSQGVAYPVRIESSSASLANGHTLDLNCLVASQAPHTITWYKRGGSLPSRHQIVGSRLRIPQVTPADSGEYVCHVSNGAGSRETSLIVTIQGSGSSHVPSVSPPIRIESSSPTVVEGQTLDLNCVVARQPQAIITWYKRGGSLPSRHQTHGSHLRLHQMSVADSGEYVCRANNNIDALEASIVISVSPSAGSPSAPGSSMPIRIESSSSHVAEGETLDLNCVVPGQAHAQVTWHKRGGSLPSHHQTRGSRLRLHHVSPADSGEYVCRVMGSSGPLEASVLVTIEASGSSAVHVPAPGGAPPIRIEPSSSRVAEGQTLDLKCVVPGQAHAQVTWHKRGGNLPARHQVHGPLLRLNQVSPADSGEYSCQVTGSSGTLEASVLVTIEPSSPGPIPAPGLAQPIYIEASSSHVTEGQTLDLNCVVPGQAHAQVTWYKRGGSLPARHQTHGSQLRLHLVSPADSGEYVCRAASGPGPEQEASFTVTVPPSEGSSYRLRSPVISIDPPSSTVQQGQDASFKCLIHDGAAPISLEWKTRNQELEDNVHISPNGSIITIVGTRPSNHGTYRCVASNAYGVAQSVVNLSVHGPPTVSVLPEGPVWVKVGKAVTLECVSAGEPRSSARWTRISSTPAKLEQRTYGLMDSHAVLQISSAKPSDAGTYVCLAQNALGTAQKQVEVIVDTGAMAPGAPQVQAEEAELTVEAGHTATLRCSATGSPAPTIHWSKLRSPLPWQHRLEGDTLIIPRVAQQDSGQYICNATSPAGHAEATIILHVESPPYATTVPEHASVQAGETVQLQCLAHGTPPLTFQWSRVGSSLPGRATARNELLHFERAAPEDSGRYRCRVTNKVGSAEAFAQLLVQGPPGSLPATSIPAGSTPTVQVTPQLETKSIGASVEFHCAVPSDRGTQLRWFKEGGQLPPGHSVQDGVLRIQNLDQSCQGTYICQAHGPWGKAQASAQLVIQALPSVLINIRTSVQTVVVGHAVEFECLALGDPKPQVTWSKVGGHLRPGIVQSGGVVRIAHVELADAGQYRCTATNAAGTTQSHVLLLVQALPQISMPQEVRVPAGSAAVFPCIASGYPTPDISWSKLDGSLPPDSRLENNMLMLPSVRPQDAGTYVCTATNRQGKVKAFAHLQVPERVVPYFTQTPYSFLPLPTIKDAYRKFEIKITFRPDSADGEQEG

SEQ ID NO: 860464 - protein, 3449 aa, Homo sapiens
MGWRAPGALLLALLLHGRLLAVTHGLRAYDGLSLPEDIETVTASQMRWTHSYLSDDEDMLADSISGDDLGSGDLGSGDFQMVYFRALVNFTRSIEYSPQLEDAGSREFREVSEAVVDTLESEYLKIPGDQVVSVVFIKELDGWVFVELDVGSEGNADGAQIQEMLLRVISSGSVASYVTSPQGFQFRRLGTVPQFPRACTEAEFACHSYNECVALEYRCDRRPDCRDMSDELNCEEPVLGISPTFSLLVETTSLPPRPETTIMRQPPVTHAPQPLLPGSVRPLPCGPQEAACRNGHCIPRDYLCDGQEDCEDGSDELDCGPPPPCEPNEFPCGNGHCALKLWRCDGDFDCEDRTDEANCPTKRPEEVCGPTQFRCVSTNMCIPASFHCDEESDCPDRSDEFGCMPPQVVTPPRESIQASRGQTVTFTCVAIGVPTPFIINWRLNWGHIPSHPRVTVTSEGGRGTLIIRDVKESDQGAYTCEAMNARGMVFGIPDGVLELVPQRGPCPDGHFYLEHSAACLPCFCFGITSVCQSTRRFRDQIRLRFDQPDDFKGVNVTMPAQPGTPPLSSTQLQIDPSLHEFQLVDLSRRFLVHDSFWALPEQFLGNKVDSYGGSLRYNVRYELARGMLEPVQRPDVVLVGAGYRLLSRGHTPTQPGALNQRQVQFSEEHWVHESGRPVQRAELLQVLQSLEAVLIQTVYNTKMASVGLSDIAMDTTVTHATSHGRAHSVEECRCPIGYSGLSCESCDAHFTRVPGGPYLGTCSGCSCNGHASSCDPVYGHCLNCQHNTEGPQCNKCKAGFFGDAMKATATSCRPCPCPYIDASRRFSDTCFLDTDGQATCDACAPGYTGRRCESCAPGYEGNPIQPGGKCRPVNQEIVRCDERGSMGTSGEACRCKNNVVGRLCNECADGSFHLSTRNPDGCLKCFCMGVSRHCTSSSWSRAQLHGASEEPGHFSLTNAASTHTTNEGIFSPTPGELGFSSFHRLLSGPYFWSLPSRFLGDKVTSYGGELRFTVTQRSQPGSTPLHGQPLVVLQGNNIILEHHVAQEPSPGQPSTFIVPFREQAWQRPDGQPATREHLLMALAGIDTLLIRASYAQQPAESRVSGISMDVAVPEETGQDPALEVEQCSCPPGYRGPSCQDCDTGYTRTPSGLYLGTCERCSCHGHSEACEPETGACQGCQHHTEGPRCEQCQPGYYGDAQRGTPQDCQLCPCYGDPAAGQAAHTCFLDTDGHPTCDACSPGHSGRHCERCAPGYYGNPSQGQPCQRDSQVPGPIGCNCDPQGSVSSQCDAAGQCQCKAQVEGLTCSHCRPHHFHLSASNPDGCLPCFCMGITQQCASSAYTRHLISTHFAPGDFQGFALVNPQRNSRLTGEFTVEPVPEGAQLSFGNFAQLGHESFYWQLPETYQGDKVAAYGGKLRYTLSYTAGPQGSPLSDPDVQITGNNIMLVASQPALQGPERRSYEIMFREEFWRRPDGQPATREHLLMALADLDELLIRATFSSVPLVASISAVSLEVAQPGPSNRPRALEVEECRCPPGYIGLSCQDCAPGYTRTGSGLYLGHCELCECNGHSDLCHPETGACSQCQHNAAGEFCELCAPGYYGDATAGTPEDCQPCACPLTNPENMFSRTCESLGAGGYRCTACEPGYTGQYCEQCGPGYVGNPSVQGGQCLPETNQAPLVVEVHPARSIVPQGGSHSLRCQVSGSPPHYFYWSREDGRPVPSGTQQRHQGSELHFPSVQPSDAGVYICTCRNLHQSNTSRAELLVTEAPSKPITVTVEEQRSQSVRPGADVTFICTAKSKSPAYTLVWTRLHNGKLPTRAMDFNGILTIRNVQLSDAGTYVCTGSNMFAMDQGTATLHVQASGTLSAPVVSIHPPQLTVQPGQLAEFRCSATGSPTPTLEWTGGPGGQLPAKAQIHGGILRLPAVEPTDQAQYLCRAHSSAGQQVARAVLHVHGGGGPRVQVSPERTQVHAGRTVRLYCRAAGVPSATITWRKEGGSLPPQARSERTDIATLLIPAITTADAGFYLCVATSPAGTAQARIQVVVLSASDASPPPVKIESSSPSVTEGQTLDLNCVVAGSAHAQVTWYRRGGSLPPHTQVHGSRLRLPQVSPADSGEYVCRVENGSGPKEASITVSVLHGTHSGPSYTPVPGSTRPIRIEPSSSHVAEGQTLDLNCVVPGQAHAQVTWHKRGGSLPARHQTHGSLLRLHQVTPADSGEYVCHVVGTSGPLEASVLVTIEASVIPGPIPPVRIESSSSTVAEGQTLDLSCVVAGQAHAQVTWYKRGGSLPARHQVRGSRLYIFQASPADAGQYVCRASNGMEASITVTVTGTQGANLAYPAGSTQPIRIEPSSSQVAEGQTLDLNCVVPGQSHAQVTWHKRGGSLPVRHQTHGSLLRLYQASPADSGEYVCRVLGSSVPLEASVLVTIEPAGSVPALGVTPTVRIESSSSQVAEGQTLDLNCLVAGQAHAQVTWHKRGGSLPARHQVHGSRLRLLQVTPADSGEYVCRVVGSSGTQEASVLVTIQQRLSGSHSQGVAYPVRIESSSASLANGHTLDLNCLVASQAPHTITWYKRGGSLPSRHQIVGSRLRIPQVTPADSGEYVCHVSNGAGSRETSLIVTIQGSGSSHVPSVSPPIRIESSSPTVVEGQTLDLNCVVARQPQAIITWYKRGGSLPSRHQTHGSHLRLHQMSVADSGEYVCRANNNIDALEASIVISVSPSAGSPSAPGSSMPIRIESSSSHVAEGETLDLNCVVPGQAHAQVTWHKRGGSLPSHHQTRGSRLRLHHVSPADSGEYVCRVMGSSGPLEASVLVTIEASGSSAVHVPAPGGAPPIRIEPSSSRVAEGQTLDLKCVVPGQAHAQVTWHKRGGNLPARHQVHGPLLRLNQVSPADSGEYSCQVTGSSGTLEASVLVTIEPSSPGPIPAPGLAQPIYIEASSSHVTEGQTLDLNCVVPGQAHAQVTWYKRGGSLPARHQTHGSQLRLHLVSPADSGEYVCRAASGPGPEQEASFTVTVPPSEGSSYRLRSPVISIDPPSSTVQQGQDASFKCLIHDGAAPISLEWKTRNQELEDNVHISPNGSIITIVGTRPSNHGTYRCVASNAYGVAQSVVNLSVHGPPTVSVLPEGPVWVKVGKAVTLECVSAGEPRSSARWTRISSTPAKLEQRTYGLMDSHAVLQISSAKPSDAGTYVCLAQNALGTAQKQVEVIVDTGAMAPGAPQVQAEEAELTVEAGHTATLRCSATGSPAPTIHWSKLRSPLPWQHRLEGDTLIIPRVAQQDSGQYICNATSPAGHAEATIILHVESPPYATTVPEHASVQAGETVQLQCLAHGTPPLTFQWSRVGSSLPGRATARNELLHFERAAPEDSGRYRCRVTNKVGSAEAFAQLLVQGPPGSLPATSIPAGSTPTVQVTPQLETKSIGASVEFHCAVPSDRGTQLRWFKEGGQLPPGREWMS

SEQ ID NO: 860465 - protein, 3432 aa, Homo sapiens
MGWRAPGALLLALLLHGRLLAVTHGLRAYDGLSLPEDIETVTASQMRWTHSYLSDDEDMLADSISGDDLGSGDLGSGDFQMVYFRALVNFTRSIEYSPQLEDAGSREFREVSEAVVDTLESEYLKIPGDQVVSVVFIKELDGWVFVELDVGSEGNADGAQIQEMLLRVISSGSVASYVTSPQGFQFRRLGTVPQFPRACTEAEFACHSYNECVALEYRCDRRPDCRDMSDELNCEEPVLGISPTFSLLVETTSLPPRPETTIMRQPPVTHAPQPLLPGSVRPLPCGPQEAACRNGHCIPRDYLCDGQEDCEDGSDELDCGPPPPCEPNEFPCGNGHCALKLWRCDGDFDCEDRTDEANCPTKRPEEVCGPTQFRCVSTNMCIPASFHCDEESDCPDRSDEFGCMPPQVVTPPRESIQASRGQTVTFTCVAIGVPTPFIINWRLNWGHIPSHPRVTVTSEGGRGTLIIRDVKESDQGAYTCEAMNARGMVFGIPDGVLELVPQRGPCPDGHFYLEHSAACLPCFCFGITSVCQSTRRFRDQIRLRFDQPDDFKGVNVTMPAQPGTPPLSSTQLQIDPSLHEFQLVDLSRRFLVHDSFWALPEQFLGNKVDSYGGSLRYNVRYELARGMLEPVQRPDVVLVGAGYRLLSRGHTPTQPGALNQRQVQFSEEHWVHESGRPVQRAELLQVLQSLEAVLIQTVYNTKMASVGLSDIAMDTTVTHATSHGRAHSVEECRCPIGYSGLSCESCDAHFTRVPGGPYLGTCSGCSCNGHASSCDPVYGHCLNCQHNTEGPQCNKCKAGFFGDAMKATATSCRPCPCPYIDASRRFSDTCFLDTDGQATCDACAPGYTGRRCESCAPGYEGNPIQPGGKCRPVNQEIVRCDERGSMGTSGEACRCKNNVVGRLCNECADGSFHLSTRNPDGCLKCFCMGVSRHCTSSSWSRAQLHGASEEPGHFSLTNAASTHTTNEGIFSPTPGELGFSSFHRLLSGPYFWSLPSRFLGDKVTSYGGELRFTVTQRSQPGSTPLHGQPLVVLQGNNIILEHHVAQEPSPGQPSTFIVPFREQAWQRPDGQPATREHLLMALAGIDTLLIRASYAQQPAESRVSGISMDVAVPEETGQDPALEVEQCSCPPGYRGPSCQDCDTGYTRTPSGLYLGTCERCSCHGHSEACEPETGACQGCQHHTEGPRCEQCQPGYYGDAQRGTPQDCQLCPCYGDPAAGQAAHTCFLDTDGHPTCDACSPGHSGRHCERCAPGYYGNPSQGQPCQRDSQVPGPIGCNCDPQGSVSSQCDAAGQCQCKAQVEGLTCSHCRPHHFHLSASNPDGCLPCFCMGITQQCASSAYTRHLISTHFAPGDFQGFALVNPQRNSRLTGEFTVEPVPEGAQLSFGNFAQLGHESFYWQLPETYQGDKVAAYGGKLRYTLSYTAGPQGSPLSDPDVQITGNNIMLVASQPALQGPERRSYEIMFREEFWRRPDGQPATREHLLMALADLDELLIRATFSSVPLVASISAVSLEVAQPGPSNRPRALEVEECRCPPGYIGLSCQDCAPGYTRTGSGLYLGHCELCECNGHSDLCHPETGACSQCQHNAAGEFCELCAPGYYGDATAGTPEDCQPCACPLTNPENMFSRTCESLGAGGYRCTACEPGYTGQYCEQCGPGYVGNPSVQGGQCLPETNQAPLVVEVHPARSIVPQGGSHSLRCQVSGSPPHYFYWSREDGRPVPSGTQQRHQGSELHFPSVQPSDAGVYICTCRNLHQSNTSRAELLVTEAPSKPITVTVEEQRSQSVRPGADVTFICTAKSKSPAYTLVWTRLHNGKLPTRAMDFNGILTIRNVQLSDAGTYVCTGSNMFAMDQGTATLHVQASGTLSAPVVSIHPPQLTVQPGQLAEFRCSATGSPTPTLEWTGGPGGQLPAKAQIHGGILRLPAVEPTDQAQYLCRAHSSAGQQVARAVLHVHGGGGPRVQVSPERTQVHAGRTVRLYCRAAGVPSATITWRKEGGSLPPQARSERTDIATLLIPAITTADAGFYLCVATSPAGTAQARIQVVVLSASDASPPPVKIESSSPSVTEGQTLDLNCVVAGSAHAQVTWYRRGGSLPPHTQVHGSRLRLPQVSPADSGEYVCRVENGSGPKEASITVSVLHGTHSGPSYTPVPGSTRPIRIEPSSSHVAEGQTLDLNCVVPGQAHAQVTWHKRGGSLPARHQTHGSLLRLHQVTPADSGEYVCHVVGTSGPLEASVLVTIEASVIPGPIPPVRIESSSSTVAEGQTLDLSCVVAGQAHAQVTWYKRGGSLPARHQVRGSRLYIFQASPADAGQYVCRASNGMEASITVTVTGTQGANLAYPAGSTQPIRIEPSSSQVAEGQTLDLNCVVPGQSHAQVTWHKRGGSLPVRHQTHGSLLRLYQASPADSGEYVCRVLGSSVPLEASVLVTIEPAGSVPALGVTPTVRIESSSSQVAEGQTLDLNCLVAGQAHAQVTWHKRGGSLPARHQVHGSRLRLLQVTPADSGEYVCRVVGSSGTQEASVLVTIQQRLSGSHSQGVAYPVRIESSSASLANGHTLDLNCLVASQAPHTITWYKRGGSLPSRHQIVGSRLRIPQVTPADSGEYVCHVSNGAGSRETSLIVTIQGSGSSHVPSVSPPIRIESSSPTVVEGQTLDLNCVVARQPQAIITWYKRGGSLPSRHQTHGSHLRLHQMSVADSGEYVCRANNNIDALEASIVISVSPSAGSPSAPGSSMPIRIESSSSHVAEGETLDLNCVVPGQAHAQVTWHKRGGSLPSHHQTRGSRLRLHHVSPADSGEYVCRVMGSSGPLEASVLVTIEASGSSAVHVPAPGGAPPIRIEPSSSRVAEGQTLDLKCVVPGQAHAQVTWHKRGGNLPARHQVHGPLLRLNQVSPADSGEYSCQVTGSSGTLEASVLVTIEPSSPGPIPAPGLAQPIYIEASSSHVTEGQTLDLNCVVPGQAHAQVTWYKRGGSLPARHQTHGSQLRLHLVSPADSGEYVCRAASGPGPEQEASFTVTVPPSEGSSYRLRSPVISIDPPSSTVQQGQDASFKCLIHDGAAPISLEWKTRNQELEDNVHISPNGSIITIVGTRPSNHGTYRCVASNAYGVAQSVVNLSVHGPPTVSVLPEGPVWVKVGKAVTLECVSAGEPRSSARWTRISSTPAKLEQRTYGLMDSHAVLQISSAKPSDAGTYVCLAQNALGTAQKQVEVIVDTGAMAPGAPQVQAEEAELTVEAGHTATLRCSATGSPAPTIHWSKLRSPLPWQHRLEGDTLIIPRVAQQDSGQYICNATSPAGHAEATIILHVESPPYATTVPEHASVQAGETVQLQCLAHGTPPLTFQWSRVGSSLPGRATARNELLHFERAAPEDSGRYRCRVTNKVGSAEAFAQLLVQESRTWTRAAKGRIYARPMDLGGRPRPVPSWLSKVGGWLQASAKSREQR

SEQ ID NO: 860466 - protein, 1422 aa, Homo sapiens
MGWRAPGALLLALLLHGRLLAVTHGLRAYDGLSLPEDIETVTASQMRWTHSYLSDDEDMLADSISGDDLGSGDLGSGDFQMVYFRALVNFTRSIEYSPQLEDAGSREFREVSEAVVDTLESEYLKIPGDQVVSVVFIKELDGWVFVELDVGSEGNADGAQIQEMLLRVISSGSVASYVTSPQGFQFRRLGTVPQFPRACTEAEFACHSYNECVALEYRCDRRPDCRDMSDELNCEEPVLGISPTFSLLVETTSLPPRPETTIMRQPPVTHAPQPLLPGSVRPLPCGPQEAACRNGHCIPRDYLCDGQEDCEDGSDELDCGPPPPCEPNEFPCGNGHCALKLWRCDGDFDCEDRTDEANCPTKRPEEVCGPTQFRCVSTNMCIPASFHCDEESDCPDRSDEFGCMPPQVVTPPRESIQASRGQTVTFTCVAIGVPTPFIINWRLNWGHIPSHPRVTVTSEGGRGTLIIRDVKESDQGAYTCEAMNARGMVFGIPDGVLELVPQRGPCPDGHFYLEHSAACLPCFCFGITSVCQSTRRFRDQIRLRFDQPDDFKGVNVTMPAQPGTPPLSSTQLQIDPSLHEFQLVDLSRRFLVHDSFWALPEQFLGNKVDSYGGSLRYNVRYELARGMLEPVQRPDVVLVGAGYRLLSRGHTPTQPGALNQRQVQFSEEHWVHESGRPVQRAELLQVLQSLEAVLIQTVYNTKMASVGLSDIAMDTTVTHATSHGRAHSVEECRCPIGYSGLSCESCDAHFTRVPGGPYLGTCSGCSCNGHASSCDPVYGHCLNCQHNTEGPQCNKCKAGFFGDAMKATATSCRPCPCPYIDASRRFSDTCFLDTDGQATCDACAPGYTGRRCESCAPGYEGNPIQPGGKCRPVNQEIVRCDERGSMGTSGEACRCKNNVVGRLCNECADGSFHLSTRNPDGCLKCFCMGVSRHCTSSSWSRAQLHGASEEPGHFSLTNAASTHTTNEGIFSPTPGELGFSSFHRLLSGPYFWSLPSRFLGDKVTSYGGELRFTVTQRSQPGSTPLHGQPLVVLQGNNIILEHHVAQEPSPGQPSTFIVPFREQAWQRPDGQPATREHLLMALAGIDTLLIRASYAQQPAESRVSGISMDVAVPEETGQDPALEVEQCSCPPGYRGPSCQDCDTGYTRTPSGLYLGTCERCSCHGHSEACEPETGACQGCQHHTEGPRCEQCQPGYYGDAQRGTPQDCQLCPCYGDPAAGQAAHTCFLDTDGHPTCDACSPGHSGRHCERCAPGYYGNPSQGQPCQRDSQVPGPIGCNCDPQGSVSSQCDAAGQCQCKAQVEGLTCSHCRPHHFHLSASNPDGCLPCFCMGITQQCASSAYTRHLISTHFAPGDFQGFALVNPQRNSRLTGEFTVEPVPEGAQLSFGNFAQLGHESFYWQLPETYQGDKVGPSQAPGSAVTQT

SEQ ID NO: 860467 - protein, 852 aa, Homo sapiens
MGWRAPGALLLALLLHGRLLAVTHGLRAYDGLSLPEDIETVTASQMRWTHSYLSDDEDMLADSISGDDLGSGDLGSGDFQMVYFRALVNFTRSIEYSPQLEDAGSREFREVSEAVVDTLESEYLKIPGDQVVSVVFIKELDGWVFVELDVGSEGNADGAQIQEMLLRVISSGSVASYVTSPQGFQFRRLGTVPQFPRACTEAEFACHSYNECVALEYRCDRRPDCRDMSDELNCEEPVLGISPTFSLLVETTSLPPRPETTIMRQPPVTHAPQPLLPGSVRPLPCGPQEAACRNGHCIPRDYLCDGQEDCEDGSDELDCGPPPPCEPNEFPCGNGHCALKLWRCDGDFDCEDRTDEANCPTKRPEEVCGPTQFRCVSTNMCIPASFHCDEESDCPDRSDEFGCMPPQVVTPPRESIQASRGQTVTFTCVAIGVPTPFIINWRLNWGHIPSHPRVTVTSEGGRGTLIIRDVKESDQGAYTCEAMNARGMVFGIPDGVLELVPQRGPCPDGHFYLEHSAACLPCFCFGITSVCQSTRRFRDQIRLRFDQPDDFKGVNVTMPAQPGTPPLSSTQLQIDPSLHEFQLVDLSRRFLVHDSFWALPEQFLGNKVDSYGGSLRYNVRYELARGMLEPVQRPDVVLVGAGYRLLSRGHTPTQPGALNQRQVQFSEEHWVHESGRPVQRAELLQVLQSLEAVLIQTVYNTKMASVGLSDIAMDTTVTHATSHGRAHSVEECRCPIGYSGLSCESCDAHFTRVPGGPYLGTCSGCSCNGHASSCDPVYGHCLNCQHNTEGPQCNKCKAGFFGDAMKATATSCRPCPCPYIDASRRFSDTCFLDTDSIQRLRAYQRPRAFKAS

SEQ ID NO: 860468 - protein, 224 aa, Homo sapiens
MGWRAPGALLLALLLHGRLLAVTHGLRAYDGLSLPEDIETVTASQMRWTHSYLSDDEDMLADSISGDDLGSGDLGSGDFQMVYFRALVNFTRSIEYSPQLEDAGSREFREVSEAVVDTLESEYLKIPGDQVVSVVFIKELDGWVFVELDVGSEGNADGAQIQEMLLRVISSGSVASYVTSPQGFQFRRLGTGEPILVSGIASSRLVGSPFSVSAIGSQLGLAHH

SEQ ID NO: 860469 - protein, 102 aa, Homo sapiens
MFSALLLGAALQNGGQCHDSESSSYVCVCPAGFTGSRCEHSQALHCHPGTHPDRQSVSPQGLPLPFAASPYPPPSQPLGHFHTPHSHLSTLHSSHVPIPHLC

SEQ ID NO: 860470 - protein, 115 aa, Homo sapiens
RSEASQCPQDVAQAWPRANAQCWKVGLRHRWEVGPWSRGPRPGPSVLVHLQLDGSLPPDSRLENNMLMLPSVRPQDAGTYVCTATNRQGKVKAFAHLQVPGKTPPLRIGSALPTP

SEQ ID NO: 860471 - protein, 139 aa, Homo sapiens
CIDHASSCDPVVWPLARIAARSSNVPQDSPCTPVLCGVAMKATATSCRPCPCPYIDASRRFSDTCFLDTDGQATCDACAPGYTGRRCESCAPGYEGNPIQPGGKCRPVNQEIVRCDERGSMGTSGEACRCKATRLKLRL

SEQ ID NO: 860472 - protein, 4183 aa, Homo sapiens; identical to SEQ ID NO: 860450

SEQ ID NO: 860473 - protein, 3512 aa, Homo sapiens
RVMRSGDGDSERLRCKNNVVGRLCNECADGSFHLSTRNPDGCLKCFCMGVSRHCTSSSWSRAQLHGASEEPGHFSLTNAASTHTTNEGIFSPTPGELGFSSFHRLLSGPYFWSLPSRFLGDKVTSYGGELRFTVTQRSQPGSTPLHGQPLVVLQGNNIILEHHVAQEPSPGQPSTFIVPFREQAWQRPDGQPATREHLLMALAGIDTLLIRASYAQQPAESRVSGISMDVAVPEETGQDPALEVEQCSCPPGYRGPSCQDCDTGYTRTPSGLYLGTCERCSCHGHSEACEPETGACQGCQHHTEGPRCEQCQPGYYGDAQRGTPQDCQLCPCYGDPAAGQAAHTCFLDTDGHPTCDACSPGHSGRHCERCAPGYYGNPSQGQPCQRDSQVPGPIGCNCDPQGSVSSQCDAAGQCQCKAQVEGLTCSHCRPHHFHLSASNPDGCLPCFCMGITQQCASSAYTRHLISTHFAPGDFQGFALVNPQRNSRLTGEFTVEPVPEGAQLSFGNFAQLGHESFYWQLPETYQGDKVAAYGGKLRYTLSYTAGPQGSPLSDPDVQITGNNIMLVASQPALQGPERRSYEIMFREEFWRRPDGQPATREHLLMALADLDELLIRATFSSVPLVASISAVSLEVAQPGPSNRPRALEVEECRCPPGYIGLSCQDCAPGYTRTGSGLYLGHCELCECNGHSDLCHPETGACSQCQHNAAGEFCELCAPGYYGDATAGTPEDCQPCACPLTNPENMFSRTCESLGAGGYRCTACEPGYTGQYCEQCGPGYVGNPSVQGGQCLPETNQAPLVVEVHPARSIVPQGGSHSLRCQVSGSPPHYFYWSREDGRPVPSGTQQRHQGSELHFPSVQPSDAGVYICTCRNLHQSNTSRAELLVTEAPSKPITVTVEEQRSQSVRPGADVTFICTAKSKSPAYTLVWTRLHNGKLPTRAMDFNGILTIRNVQLSDAGTYVCTGSNMFAMDQGTATLHVQASGTLSAPVVSIHPPQLTVQPGQLAEFRCSATGSPTPTLEWTGGPGGQLPAKAQIHGGILRLPAVEPTDQAQYLCRAHSSAGQQVARAVLHVHGGGGPRVQVSPERTQVHAGRTVRLYCRAAGVPSATITWRKEGGSLPPQARSERTDIATLLIPAITTADAGFYLCVATSPAGTAQARIQVVVLSASDASPPPVKIESSSPSVTEGQTLDLNCVVAGSAHAQVTWYRRGGSLPPHTQVHGSRLRLPQVSPADSGEYVCRVENGSGPKEASITVSVLHGTHSGPSYTPVPGSTRPIRIEPSSSHVAEGQTLDLNCVVPGQAHAQVTWHKRGGSLPARHQTHGSLLRLHQVTPADSGEYVCHVVGTSGPLEASVLVTIEASVIPGPIPPVRIESSSSTVAEGQTLDLSCVVAGQAHAQVTWYKRGGSLPARHQVRGSRLYIFQASPADAGQYVCRASNGMEASITVTVTGTQGANLAYPAGSTQPIRIEPSSSQVAEGQTLDLNCVVPGQSHAQVTWHKRGGSLPVRHQTHGSLLRLYQASPADSGEYVCRVLGSSVPLEASVLVTIEPAGSVPALGVTPTVRIESSSSQVAEGQTLDLNCLVAGQAHAQVTWHKRGGSLPARHQVHGSRLRLLQVTPADSGEYVCRVVGSSGTQEASVLVTIQQRLSGSHSQGVAYPVRIESSSASLANGHTLDLNCLVASQAPHTITWYKRGGSLPSRHQIVGSRLRIPQVTPADSGEYVCHVSNGAGSRETSLIVTIQGSGSSHVPSVSPPIRIESSSPTVVEGQTLDLNCVVARQPQAIITWYKRGGSLPSRHQTHGSHLRLHQMSVADSGEYVCRANNNIDALEASIVISVSPSAGSPSAPGSSMPIRIESSSSHVAEGETLDLNCVVPGQAHAQVTWHKRGGSLPSHHQTRGSRLRLHHVSPADSGEYVCRVMGSSGPLEASVLVTIEASGSSAVHVPAPGGAPPIRIEPSSSRVAEGQTLDLKCVVPGQAHAQVTWHKRGGNLPARHQVHGPLLRLNQVSPADSGEYSCQVTGSSGTLEASVLVTIEPSSPGPIPAPGLAQPIYIEASSSHVTEGQTLDLNCVVPGQAHAQVTWYKRGGSLPARHQTHGSQLRLHLVSPADSGEYVCRAASGPGPEQEASFTVTVPPSEGSSYRLRSPVISIDPPSSTVQQGQDASFKCLIHDGAAPISLEWKTRNQELEDNVHISPNGSIITIVGTRPSNHGTYRCVASNAYGVAQSVVNLSVHGPPTVSVLPEGPVWVKVGKAVTLECVSAGEPRSSARWTRISSTPAKLEQRTYGLMDSHAVLQISSAKPSDAGTYVCLAQNALGTAQKQVEVIVDTGAMAPGAPQVQAEEAELTVEAGHTATLRCSATGSPAPTIHWSKLRSPLPWQHRLEGDTLIIPRVAQQDSGQYICNATSPAGHAEATIILHVESPPYATTVPEHASVQAGETVQLQCLAHGTPPLTFQWSRVGSSLPGRATARNELLHFERAAPEDSGRYRCRVTNKVGSAEAFAQLLVQGPPGSLPATSIPAGSTPTVQVTPQLETKSIGASVEFHCAVPSDRGTQLRWFKEGGQLPPGHSVQDGVLRIQNLDQSCQGTYICQAHGPWGKAQASAQLVIQALPSVLINIRTSVQTVVVGHAVEFECLALGDPKPQVTWSKVGGHLRPGIVQSGGVVRIAHVELADAGQYRCTATNAAGTTQSHVLLLVQALPQISMPQEVRVPAGSAAVFPCIASGYPTPDISWSKLDGSLPPDSRLENNMLMLPSVRPQDAGTYVCTATNRQGKVKAFAHLQVPERVVPYFTQTPYSFLPLPTIKDAYRKFEIKITFRPDSADGMLLYNGQKRVPGSPTNLANRQPDFISFGLVGGRPEFRFDAGSGMATIRHPTPLALGHFHTVTLLRSLTQGSLIVGDLAPVNGTSQGKFQGLDLNEELYLGGYPDYGAIPKAGLSSGFIGCVRELRIQGEEIVFHDLNLTAHGISHCPTCRDRPCQNGGQCHDSESSSYVCVCPAGFTGSRCEHSQALHCHPEACGPDATCVNRPDGRGYTCRCHLGRSGLRCEEGVTVTTPSLSGAGSYLALPALTNTHHELRLDVEFKPLAPDGVLLFSGGKSGPVEDFVSLAMVGGHLEFRYELGSGLAVLRSAEPLALGRWHRVSAERLNKDGSLRVNGGRPVLRSSPGKSQGLNLHTLLYLGGVEPSVPLSPATNMSAHFRGCVGEVSVNGKRLDLTYSFLGSQGIGQCYDSSPCERQPCQHGATCMPAGEYEFQCLCRDGFKGDLCEHEENPCQLREPCLHGGTCQGTRCLCLPGFSGPRCQQGSGHGIAESDWHLEGSGGNDAPGQYGAYFHDDGFLAFPGHVFSRSLPEVPETIELEVRTSTASGLLLWQGVEVGEAGQGKDFISLGLQDGHLVFRYQLGSGEARLVSEDPINDGEWHRVTALREGRRGSIQVDGEELVSGRSPGPNVAVNAKGSVYIGGAPDVATLTGGRFSSGITGCVKNLVLHSARPGAPPPQPLDLQHRAQAGANTRPCPS

SEQ ID NO: 860474 - protein, 3193 aa, Homo sapiens
YPVTPTRELRCAPATETCCRQAAHTCFLDTDGHPTCDACSPGHSGRHCERCAPGYYGNPSQGQPCQRDSQVPGPIGCNCDPQGSVSSQCDAAGQCQCKAQVEGLTCSHCRPHHFHLSASNPDGCLPCFCMGITQQCASSAYTRHLISTHFAPGDFQGFALVNPQRNSRLTGEFTVEPVPEGAQLSFGNFAQLGHESFYWQLPETYQGDKVAAYGGKLRYTLSYTAGPQGSPLSDPDVQITGNNIMLVASQPALQGPERRSYEIMFREEFWRRPDGQPATREHLLMALADLDELLIRATFSSVPLVASISAVSLEVAQPGPSNRPRALEVEECRCPPGYIGLSCQDCAPGYTRTGSGLYLGHCELCECNGHSDLCHPETGACSQCQHNAAGEFCELCAPGYYGDATAGTPEDCQPCACPLTNPENMFSRTCESLGAGGYRCTACEPGYTGQYCEQCGPGYVGNPSVQGGQCLPETNQAPLVVEVHPARSIVPQGGSHSLRCQVSGSPPHYFYWSREDGRPVPSGTQQRHQGSELHFPSVQPSDAGVYICTCRNLHQSNTSRAELLVTEAPSKPITVTVEEQRSQSVRPGADVTFICTAKSKSPAYTLVWTRLHNGKLPTRAMDFNGILTIRNVQLSDAGTYVCTGSNMFAMDQGTATLHVQASGTLSAPVVSIHPPQLTVQPGQLAEFRCSATGSPTPTLEWTGGPGGQLPAKAQIHGGILRLPAVEPTDQAQYLCRAHSSAGQQVARAVLHVHGGGGPRVQVSPERTQVHAGRTVRLYCRAAGVPSATITWRKEGGSLPPQARSERTDIATLLIPAITTADAGFYLCVATSPAGTAQARIQVVVLSASDASPPPVKIESSSPSVTEGQTLDLNCVVAGSAHAQVTWYRRGGSLPPHTQVHGSRLRLPQVSPADSGEYVCRVENGSGPKEASITVSVLHGTHSGPSYTPVPGSTRPIRIEPSSSHVAEGQTLDLNCVVPGQAHAQVTWHKRGGSLPARHQTHGSLLRLHQVTPADSGEYVCHVVGTSGPLEASVLVTIEASVIPGPIPPVRIESSSSTVAEGQTLDLSCVVAGQAHAQVTWYKRGGSLPARHQVRGSRLYIFQASPADAGQYVCRASNGMEASITVTVTGTQGANLAYPAGSTQPIRIEPSSSQVAEGQTLDLNCVVPGQSHAQVTWHKRGGSLPVRHQTHGSLLRLYQASPADSGEYVCRVLGSSVPLEASVLVTIEPAGSVPALGVTPTVRIESSSSQVAEGQTLDLNCLVAGQAHAQVTWHKRGGSLPARHQVHGSRLRLLQVTPADSGEYVCRVVGSSGTQEASVLVTIQQRLSGSHSQGVAYPVRIESSSASLANGHTLDLNCLVASQAPHTITWYKRGGSLPSRHQIVGSRLRIPQVTPADSGEYVCHVSNGAGSRETSLIVTIQGSGSSHVPSVSPPIRIESSSPTVVEGQTLDLNCVVARQPQAIITWYKRGGSLPSRHQTHGSHLRLHQMSVADSGEYVCRANNNIDALEASIVISVSPSAGSPSAPGSSMPIRIESSSSHVAEGETLDLNCVVPGQAHAQVTWHKRGGSLPSHHQTRGSRLRLHHVSPADSGEYVCRVMGSSGPLEASVLVTIEASGSSAVHVPAPGGAPPIRIEPSSSRVAEGQTLDLKCVVPGQAHAQVTWHKRGGNLPARHQVHGPLLRLNQVSPADSGEYSCQVTGSSGTLEASVLVTIEPSSPGPIPAPGLAQPIYIEASSSHVTEGQTLDLNCVVPGQAHAQVTWYKRGGSLPARHQTHGSQLRLHLVSPADSGEYVCRAASGPGPEQEASFTVTVPPSEGSSYRLRSPVISIDPPSSTVQQGQDASFKCLIHDGAAPISLEWKTRNQELEDNVHISPNGSIITIVGTRPSNHGTYRCVASNAYGVAQSVVNLSVHGPPTVSVLPEGPVWVKVGKAVTLECVSAGEPRSSARWTRISSTPAKLEQRTYGLMDSHAVLQISSAKPSDAGTYVCLAQNALGTAQKQVEVIVDTGAMAPGAPQVQAEEAELTVEAGHTATLRCSATGSPAPTIHWSKLRSPLPWQHRLEGDTLIIPRVAQQDSGQYICNATSPAGHAEATIILHVESPPYATTVPEHASVQAGETVQLQCLAHGTPPLTFQWSRVGSSLPGRATARNELLHFERAAPEDSGRYRCRVTNKVGSAEAFAQLLVQGPPGSLPATSIPAGSTPTVQVTPQLETKSIGASVEFHCAVPSDRGTQLRWFKEGGQLPPGHSVQDGVLRIQNLDQSCQGTYICQAHGPWGKAQASAQLVIQALPSVLINIRTSVQTVVVGHAVEFECLALGDPKPQVTWSKVGGHLRPGIVQSGGVVRIAHVELADAGQYRCTATNAAGTTQSHVLLLVQALPQISMPQEVRVPAGSAAVFPCIASGYPTPDISWSKLDGSLPPDSRLENNMLMLPSVRPQDAGTYVCTATNRQGKVKAFAHLQVPERVVPYFTQTPYSFLPLPTIKDAYRKFEIKITFRPDSADGMLLYNGQKRVPGSPTNLANRQPDFISFGLVGGRPEFRFDAGSGMATIRHPTPLALGHFHTVTLLRSLTQGSLIVGDLAPVNGTSQGKFQGLDLNEELYLGGYPDYGAIPKAGLSSGFIGCVRELRIQGEEIVFHDLNLTAHGISHCPTCRDRPCQNGGQCHDSESSSYVCVCPAGFTGSRCEHSQALHCHPEACGPDATCVNRPDGRGYTCRCHLGRSGLRCEEGVTVTTPSLSGAGSYLALPALTNTHHELRLDVEFKPLAPDGVLLFSGGKSGPVEDFVSLAMVGGHLEFRYELGSGLAVLRSAEPLALGRWHRVSAERLNKDGSLRVNGGRPVLRSSPGKSQGLNLHTLLYLGGVEPSVPLSPATNMSAHFRGCVGEVSVNGKRLDLTYSFLGSQGIGQCYDSSPCERQPCQHGATCMPAGEYEFQCLCRDGFKGDLCEHEENPCQLREPCLHGGTCQGTRCLCLPGFSGPRCQQGSGHGIAESDWHLEGSGGNDAPGQYGAYFHDDGFLAFPGHVFSRSLPEVPETIELEVRTSTASGLLLWQGVEVGEAGQGKDFISLGLQDGHLVFRYQLGSGEARLVSEDPINDGEWHRVTALREGRRGSIQVDGEELVSGRSPGPNVAVNAKGSVYIGGAPDVATLTGGRFSSGITGCVKNLVLHSARPGAPPPQPLDLQHRAQAGANTRPCPS

SEQ ID NO: 860475 - protein, 2511 aa, Homo sapiens
MVELLLLPGRKTPLPPLEWTGGPGGQLPAKAQIHGGILRLPAVEPTDQAQYLCRAHSSAGQQVARAVLHVHGGGGPRVQVSPERTQVHAGRTVRLYCRAAGVPSATITWRKEGGSLPPQARSERTDIATLLIPAITTADAGFYLCVATSPAGTAQARIQVVVLSASDASPPPVKIESSSPSVTEGQTLDLNCVVAGSAHAQVTWYRRGGSLPPHTQVHGSRLRLPQVSPADSGEYVCRVENGSGPKEASITVSVLHGTHSGPSYTPVPGSTRPIRIEPSSSHVAEGQTLDLNCVVPGQAHAQVTWHKRGGSLPARHQTHGSLLRLHQVTPADSGEYVCHVVGTSGPLEASVLVTIEASVIPGPIPPVRIESSSSTVAEGQTLDLSCVVAGQAHAQVTWYKRGGSLPARHQVRGSRLYIFQASPADAGQYVCRASNGMEASITVTVTGTQGANLAYPAGSTQPIRIEPSSSQVAEGQTLDLNCVVPGQSHAQVTWHKRGGSLPVRHQTHGSLLRLYQASPADSGEYVCRVLGSSVPLEASVLVTIEPAGSVPALGVTPTVRIESSSSQVAEGQTLDLNCLVAGQAHAQVTWHKRGGSLPARHQVHGSRLRLLQVTPADSGEYVCRVVGSSGTQEASVLVTIQQRLSGSHSQGVAYPVRIESSSASLANGHTLDLNCLVASQAPHTITWYKRGGSLPSRHQIVGSRLRIPQVTPADSGEYVCHVSNGAGSRETSLIVTIQGSGSSHVPSVSPPIRIESSSPTVVEGQTLDLNCVVARQPQAIITWYKRGGSLPSRHQTHGSHLRLHQMSVADSGEYVCRANNNIDALEASIVISVSPSAGSPSAPGSSMPIRIESSSSHVAEGETLDLNCVVPGQAHAQVTWHKRGGSLPSHHQTRGSRLRLHHVSPADSGEYVCRVMGSSGPLEASVLVTIEASGSSAVHVPAPGGAPPIRIEPSSSRVAEGQTLDLKCVVPGQAHAQVTWHKRGGNLPARHQVHGPLLRLNQVSPADSGEYSCQVTGSSGTLEASVLVTIEPSSPGPIPAPGLAQPIYIEASSSHVTEGQTLDLNCVVPGQAHAQVTWYKRGGSLPARHQTHGSQLRLHLVSPADSGEYVCRAASGPGPEQEASFTVTVPPSEGSSYRLRSPVISIDPPSSTVQQGQDASFKCLIHDGAAPISLEWKTRNQELEDNVHISPNGSIITIVGTRPSNHGTYRCVASNAYGVAQSVVNLSVHGPPTVSVLPEGPVWVKVGKAVTLECVSAGEPRSSARWTRISSTPAKLEQRTYGLMDSHAVLQISSAKPSDAGTYVCLAQNALGTAQKQVEVIVDTGAMAPGAPQVQAEEAELTVEAGHTATLRCSATGSPAPTIHWSKLRSPLPWQHRLEGDTLIIPRVAQQDSGQYICNATSPAGHAEATIILHVESPPYATTVPEHASVQAGETVQLQCLAHGTPPLTFQWSRVGSSLPGRATARNELLHFERAAPEDSGRYRCRVTNKVGSAEAFAQLLVQGPPGSLPATSIPAGSTPTVQVTPQLETKSIGASVEFHCAVPSDRGTQLRWFKEGGQLPPGHSVQDGVLRIQNLDQSCQGTYICQAHGPWGKAQASAQLVIQALPSVLINIRTSVQTVVVGHAVEFECLALGDPKPQVTWSKVGGHLRPGIVQSGGVVRIAHVELADAGQYRCTATNAAGTTQSHVLLLVQALPQISMPQEVRVPAGSAAVFPCIASGYPTPDISWSKLDGSLPPDSRLENNMLMLPSVRPQDAGTYVCTATNRQGKVKAFAHLQVPERVVPYFTQTPYSFLPLPTIKDAYRKFEIKITFRPDSADGMLLYNGQKRVPGSPTNLANRQPDFISFGLVGGRPEFRFDAGSGMATIRHPTPLALGHFHTVTLLRSLTQGSLIVGDLAPVNGTSQGKFQGLDLNEELYLGGYPDYGAIPKAGLSSGFIGCVRELRIQGEEIVFHDLNLTAHGISHCPTCRDRPCQNGGQCHDSESSSYVCVCPAGFTGSRCEHSQALHCHPEACGPDATCVNRPDGRGYTCRCHLGRSGLRCEEGVTVTTPSLSGAGSYLALPALTNTHHELRLDVEFKPLAPDGVLLFSGGKSGPVEDFVSLAMVGGHLEFRYELGSGLAVLRSAEPLALGRWHRVSAERLNKDGSLRVNGGRPVLRSSPGKSQGLNLHTLLYLGGVEPSVPLSPATNMSAHFRGCVGEVSVNGKRLDLTYSFLGSQGIGQCYDSSPCERQPCQHGATCMPAGEYEFQCLCRDGFKGDLCEHEENPCQLREPCLHGGTCQGTRCLCLPGFSGPRCQQGSGHGIAESDWHLEGSGGNDAPGQYGAYFHDDGFLAFPGHVFSRSLPEVPETIELEVRTSTASGLLLWQGVEVGEAGQGKDFISLGLQDGHLVFRYQLGSGEARLVSEDPINDGEWHRVTALREGRRGSIQVDGEELVSGRSPGPNVAVNAKGSVYIGGAPDVATLTGGRFSSGITGCVKNLVLHSARPGAPPPQPLDLQHRAQAGANTRPCPS

SEQ ID NO: 860476 - protein, 2458 aa, Homo sapiens
DLLIGESGEQVAGSAPRAWGGGPRVQVSPERTQVHAGRTVRLYCRAAGVPSATITWRKEGGSLPPQARSERTDIATLLIPAITTADAGFYLCVATSPAGTAQARIQVVVLSASDASPPPVKIESSSPSVTEGQTLDLNCVVAGSAHAQVTWYRRGGSLPPHTQVHGSRLRLPQVSPADSGEYVCRVENGSGPKEASITVSVLHGTHSGPSYTPVPGSTRPIRIEPSSSHVAEGQTLDLNCVVPGQAHAQVTWHKRGGSLPARHQTHGSLLRLHQVTPADSGEYVCHVVGTSGPLEASVLVTIEASVIPGPIPPVRIESSSSTVAEGQTLDLSCVVAGQAHAQVTWYKRGGSLPARHQVRGSRLYIFQASPADAGQYVCRASNGMEASITVTVTGTQGANLAYPAGSTQPIRIEPSSSQVAEGQTLDLNCVVPGQSHAQVTWHKRGGSLPVRHQTHGSLLRLYQASPADSGEYVCRVLGSSVPLEASVLVTIEPAGSVPALGVTPTVRIESSSSQVAEGQTLDLNCLVAGQAHAQVTWHKRGGSLPARHQVHGSRLRLLQVTPADSGEYVCRVVGSSGTQEASVLVTIQQRLSGSHSQGVAYPVRIESSSASLANGHTLDLNCLVASQAPHTITWYKRGGSLPSRHQIVGSRLRIPQVTPADSGEYVCHVSNGAGSRETSLIVTIQGSGSSHVPSVSPPIRIESSSPTVVEGQTLDLNCVVARQPQAIITWYKRGGSLPSRHQTHGSHLRLHQMSVADSGEYVCRANNNIDALEASIVISVSPSAGSPSAPGSSMPIRIESSSSHVAEGETLDLNCVVPGQAHAQVTWHKRGGSLPSHHQTRGSRLRLHHVSPADSGEYVCRVMGSSGPLEASVLVTIEASGSSAVHVPAPGGAPPIRIEPSSSRVAEGQTLDLKCVVPGQAHAQVTWHKRGGNLPARHQVHGPLLRLNQVSPADSGEYSCQVTGSSGTLEASVLVTIEPSSPGPIPAPGLAQPIYIEASSSHVTEGQTLDLNCVVPGQAHAQVTWYKRGGSLPARHQTHGSQLRLHLVSPADSGEYVCRAASGPGPEQEASFTVTVPPSEGSSYRLRSPVISIDPPSSTVQQGQDASFKCLIHDGAAPISLEWKTRNQELEDNVHISPNGSIITIVGTRPSNHGTYRCVASNAYGVAQSVVNLSVHGPPTVSVLPEGPVWVKVGKAVTLECVSAGEPRSSARWTRISSTPAKLEQRTYGLMDSHAVLQISSAKPSDAGTYVCLAQNALGTAQKQVEVIVDTGAMAPGAPQVQAEEAELTVEAGHTATLRCSATGSPAPTIHWSKLRSPLPWQHRLEGDTLIIPRVAQQDSGQYICNATSPAGHAEATIILHVESPPYATTVPEHASVQAGETVQLQCLAHGTPPLTFQWSRVGSSLPGRATARNELLHFERAAPEDSGRYRCRVTNKVGSAEAFAQLLVQGPPGSLPATSIPAGSTPTVQVTPQLETKSIGASVEFHCAVPSDRGTQLRWFKEGGQLPPGHSVQDGVLRIQNLDQSCQGTYICQAHGPWGKAQASAQLVIQALPSVLINIRTSVQTVVVGHAVEFECLALGDPKPQVTWSKVGGHLRPGIVQSGGVVRIAHVELADAGQYRCTATNAAGTTQSHVLLLVQALPQISMPQEVRVPAGSAAVFPCIASGYPTPDISWSKLDGSLPPDSRLENNMLMLPSVRPQDAGTYVCTATNRQGKVKAFAHLQVPERVVPYFTQTPYSFLPLPTIKDAYRKFEIKITFRPDSADGMLLYNGQKRVPGSPTNLANRQPDFISFGLVGGRPEFRFDAGSGMATIRHPTPLALGHFHTVTLLRSLTQGSLIVGDLAPVNGTSQGKFQGLDLNEELYLGGYPDYGAIPKAGLSSGFIGCVRELRIQGEEIVFHDLNLTAHGISHCPTCRDRPCQNGGQCHDSESSSYVCVCPAGFTGSRCEHSQALHCHPEACGPDATCVNRPDGRGYTCRCHLGRSGLRCEEGVTVTTPSLSGAGSYLALPALTNTHHELRLDVEFKPLAPDGVLLFSGGKSGPVEDFVSLAMVGGHLEFRYELGSGLAVLRSAEPLALGRWHRVSAERLNKDGSLRVNGGRPVLRSSPGKSQGLNLHTLLYLGGVEPSVPLSPATNMSAHFRGCVGEVSVNGKRLDLTYSFLGSQGIGQCYDSSPCERQPCQHGATCMPAGEYEFQCLCRDGFKGDLCEHEENPCQLREPCLHGGTCQGTRCLCLPGFSGPRCQQGSGHGIAESDWHLEGSGGNDAPGQYGAYFHDDGFLAFPGHVFSRSLPEVPETIELEVRTSTASGLLLWQGVEVGEAGQGKDFISLGLQDGHLVFRYQLGSGEARLVSEDPINDGEWHRVTALREGRRGSIQVDGEELVSGRSPGPNVAVNAKGSVYIGGAPDVATLTGGRFSSGITGCVKNLVLHSARPGAPPPQPLDLQHRAQAGANTRPCPS

SEQ ID NO: 860477 - protein, 2847 aa, Homo sapiens
MGETQGPGPQFSVLCPSSVHLCNNSIQKHLEYSCHRHPLLPPEPQISDLCAPGYYGDATAGTPEDCQPCACPLTNPENMFSRTCESLGAGGYRCTACEPGYTGQYCEQCGPGYVGNPSVQGGQCLPETNQAPLVVEVHPARSIVPQGGSHSLRCQVSGSPPHYFYWSREDGRPVPSGTQQRHQGSELHFPSVQPSDAGVYICTCRNLHQSNTSRAELLVTEAPSKPITVTVEEQRSQSVRPGADVTFICTAKSKSPAYTLVWTRLHNGKLPTRAMDFNGILTIRNVQLSDAGTYVCTGSNMFAMDQGTATLHVQASGTLSAPVVSIHPPQLTVQPGQLAEFRCSATGSPTPTLEWTGGPGGQLPAKAQIHGGILRLPAVEPTDQAQYLCRAHSSAGQQVARAVLHVHGGGGPRVQVSPERTQVHAGRTVRLYCRAAGVPSATITWRKEGGSLPPQARSERTDIATLLIPAITTADAGFYLCVATSPAGTAQARIQVVVLSASDASPPPVKIESSSPSVTEGQTLDLNCVVAGSAHAQVTWYRRGGSLPPHTQVHGSRLRLPQVSPADSGEYVCRVENGSGPKEASITVSVLHGTHSGPSYTPVPGSTRPIRIEPSSSHVAEGQTLDLNCVVPGQAHAQVTWHKRGGSLPARHQTHGSLLRLHQVTPADSGEYVCHVVGTSGPLEASVLVTIEASVIPGPIPPVRIESSSSTVAEGQTLDLSCVVAGQAHAQVTWYKRGGSLPARHQVRGSRLYIFQASPADAGQYVCRASNGMEASITVTVTGTQGANLAYPAGSTQPIRIEPSSSQVAEGQTLDLNCVVPGQSHAQVTWHKRGGSLPVRHQTHGSLLRLYQASPADSGEYVCRVLGSSVPLEASVLVTIEPAGSVPALGVTPTVRIESSSSQVAEGQTLDLNCLVAGQAHAQVTWHKRGGSLPARHQVHGSRLRLLQVTPADSGEYVCRVVGSSGTQEASVLVTIQQRLSGSHSQGVAYPVRIESSSASLANGHTLDLNCLVASQAPHTITWYKRGGSLPSRHQIVGSRLRIPQVTPADSGEYVCHVSNGAGSRETSLIVTIQGSGSSHVPSVSPPIRIESSSPTVVEGQTLDLNCVVARQPQAIITWYKRGGSLPSRHQTHGSHLRLHQMSVADSGEYVCRANNNIDALEASIVISVSPSAGSPSAPGSSMPIRIESSSSHVAEGETLDLNCVVPGQAHAQVTWHKRGGSLPSHHQTRGSRLRLHHVSPADSGEYVCRVMGSSGPLEASVLVTIEASGSSAVHVPAPGGAPPIRIEPSSSRVAEGQTLDLKCVVPGQAHAQVTWHKRGGNLPARHQVHGPLLRLNQVSPADSGEYSCQVTGSSGTLEASVLVTIEPSSPGPIPAPGLAQPIYIEASSSHVTEGQTLDLNCVVPGQAHAQVTWYKRGGSLPARHQTHGSQLRLHLVSPADSGEYVCRAASGPGPEQEASFTVTVPPSEGSSYRLRSPVISIDPPSSTVQQGQDASFKCLIHDGAAPISLEWKTRNQELEDNVHISPNGSIITIVGTRPSNHGTYRCVASNAYGVAQSVVNLSVHGPPTVSVLPEGPVWVKVGKAVTLECVSAGEPRSSARWTRISSTPAKLEQRTYGLMDSHAVLQISSAKPSDAGTYVCLAQNALGTAQKQVEVIVDTGAMAPGAPQVQAEEAELTVEAGHTATLRCSATGSPAPTIHWSKLRSPLPWQHRLEGDTLIIPRVAQQDSGQYICNATSPAGHAEATIILHVESPPYATTVPEHASVQAGETVQLQCLAHGTPPLTFQWSRVGSSLPGRATARNELLHFERAAPEDSGRYRCRVTNKVGSAEAFAQLLVQGPPGSLPATSIPAGSTPTVQVTPQLETKSIGASVEFHCAVPSDRGTQLRWFKEGGQLPPGHSVQDGVLRIQNLDQSCQGTYICQAHGPWGKAQASAQLVIQALPSVLINIRTSVQTVVVGHAVEFECLALGDPKPQVTWSKVGGHLRPGIVQSGGVVRIAHVELADAGQYRCTATNAAGTTQSHVLLLVQALPQISMPQEVRVPAGSAAVFPCIASGYPTPDISWSKLDGSLPPDSRLENNMLMLPSVRPQDAGTYVCTATNRQGKVKAFAHLQVPERVVPYFTQTPYSFLPLPTIKDAYRKFEIKITFRPDSADGMLLYNGQKRVPGSPTNLANRQPDFISFGLVGGRPEFRFDAGSGMATIRHPTPLALGHFHTVTLLRSLTQGSLIVGDLAPVNGTSQGKFQGLDLNEELYLGGYPDYGAIPKAGLSSGFIGCVRELRIQGEEIVFHDLNLTAHGISHCPTCRDRPCQNGGQCHDSESSSYVCVCPAGFTGSRCEHSQALHCHPEACGPDATCVNRPDGRGYTCRCHLGRSGLRCEEGVTVTTPSLSGAGSYLALPALTNTHHELRLDVEFKPLAPDGVLLFSGGKSGPVEDFVSLAMVGGHLEFRYELGSGLAVLRSAEPLALGRWHRVSAERLNKDGSLRVNGGRPVLRSSPGKSQGLNLHTLLYLGGVEPSVPLSPATNMSAHFRGCVGEVSVNGKRLDLTYSFLGSQGIGQCYDSSPCERQPCQHGATCMPAGEYEFQCLCRDGFKGDLCEHEENPCQLREPCLHGGTCQGTRCLCLPGFSGPRCQQGSGHGIAESDWHLEGSGGNDAPGQYGAYFHDDGFLAFPGHVFSRSLPEVPETIELEVRTSTASGLLLWQGVEVGEAGQGKDFISLGLQDGHLVFRYQLGSGEARLVSEDPINDGEWHRVTALREGRRGSIQVDGEELVSGRSPGPNVAVNAKGSVYIGGAPDVATLTGGRFSSGITGCVKNLVLHSARPGAPPPQPLDLQHRAQAGANTRPCPS

SEQ ID NO: 860478 - protein, 932 aa, Homo sapiens
NSHPSTLNNARYEAWVKSAEATGYQALPSVLINIRTSVQTVVVGHAVEFECLALGDPKPQVTWSKVGGHLRPGIVQSGGVVRIAHVELADAGQYRCTATNAAGTTQSHVLLLVQALPQISMPQEVRVPAGSAAVFPCIASGYPTPDISWSKLDGSLPPDSRLENNMLMLPSVRPQDAGTYVCTATNRQGKVKAFAHLQVPERVVPYFTQTPYSFLPLPTIKDAYRKFEIKITFRPDSADGMLLYNGQKRVPGSPTNLANRQPDFISFGLVGGRPEFRFDAGSGMATIRHPTPLALGHFHTVTLLRSLTQGSLIVGDLAPVNGTSQGKFQGLDLNEELYLGGYPDYGAIPKAGLSSGFIGCVRELRIQGEEIVFHDLNLTAHGISHCPTCRDRPCQNGGQCHDSESSSYVCVCPAGFTGSRCEHSQALHCHPEACGPDATCVNRPDGRGYTCRCHLGRSGLRCEEGVTVTTPSLSGAGSYLALPALTNTHHELRLDVEFKPLAPDGVLLFSGGKSGPVEDFVSLAMVGGHLEFRYELGSGLAVLRSAEPLALGRWHRVSAERLNKDGSLRVNGGRPVLRSSPGKSQGLNLHTLLYLGGVEPSVPLSPATNMSAHFRGCVGEVSVNGKRLDLTYSFLGSQGIGQCYDSSPCERQPCQHGATCMPAGEYEFQCLCRDGFKGDLCEHEENPCQLREPCLHGGTCQGTRCLCLPGFSGPRCQQGSGHGIAESDWHLEGSGGNDAPGQYGAYFHDDGFLAFPGHVFSRSLPEVPETIELEVRTSTASGLLLWQGVEVGEAGQGKDFISLGLQDGHLVFRYQLGSGEARLVSEDPINDGEWHRVTALREGRRGSIQVDGEELVSGRSPGPNVAVNAKGSVYIGGAPDVATLTGGRFSSGITGCVKNLVLHSARPGAPPPQPLDLQHRAQAGANTRPCPS

SEQ ID NO: 860479 - protein, 4183 aa, Homo sapiens; identical to SEQ ID NO: 860450

SEQ ID NO: 860480 - protein, 408 aa, Homo sapiens
MVGGHLEFRYELGSGLAVLRSAEPLALGRWHRVSAERLNKDGSLRVNGGRPVLRSSPGKSQGLNLHTLLYLGGVEPSVPLSPATNMSAHFRGCVGEVSVNGKRLDLTYSFLGSQGIGQCYDSSPCERQPCQHGATCMPAGEYEFQCLCRDGFKGDLCEHEENPCQLREPCLHGGTCQGTRCLCLPGFSGPRCQQGSGHGIAESDWHLEGSGGNDAPGQYGAYFHDDGFLAFPGHVFSRSLPEVPETIELEVRTSTASGLLLWQGVEVGEAGQGKDFISLGLQDGHLVFRYQLGSGEARLVSEDPINDGEWHRVTALREGRRGSIQVDGEELVSGRSPGPNVAVNAKGSVYIGGAPDVATLTGGRFSSGITGCVKNLVLHSARPGAPPPQPLDLQHRAQAGANTRPCPS

SEQ ID NO: 860481 - protein, 4183 aa, Homo sapiens; identical to SEQ ID NO: 860450

SEQ ID NO: 860482 - protein, 4183 aa, Homo sapiens; identical to SEQ ID NO: 860450

SEQ ID NO: 860483 - protein, 207 aa, Homo sapiens [sequence omitted]

SEQ ID NO: 860484 - protein, 3494 aa, Homo sapiens
MGWRAPGALLLALLLHGRLLAVTHGLRAYDGLSLPEDIETVTASQMRWTHSYLSDDEDMLADSISGDDLGSGDLGSGDFQMVYFRALVNFTRSIEYSPQLEDAGSREFREVSEAVVDTLESEYLKIPGDQVVSVVFIKELDGWVFVELDVGSEGNADGAQIQEMLLRVISSGSVASYVTSPQGFQFRRLGTVPQFPRACTEAEFACHSYNECVALEYRCDRRPDCRDMSDELNCEEPVLGISPTFSLLVETTSLPPRPETTIMRQPPVTHAPQPLLPGSVRPLPCGPQEAACRNGHCIPRDYLCDGQEDCEDGSDELDCGPPPPCEPNEFPCGNGHCALKLWRCDGDFDCEDRTDEANCPTKRPEEVCGPTQFRCVSTNMCIPASFHCDEESDCPDRSDEFGCMPPQVVTPPRESIQASRGQTVTFTCVAIGVPTPFIINWRLNWGHIPSHPRVTVTSEGGRGTLIIRDVKESDQGAYTCEAMNARGMVFGIPDGVLELVPQRGPCPDGHFYLEHSAACLPCFCFGITSVCQSTRRFRDQIRLRFDQPDDFKGVNVTMPAQPGTPPLSSTQLQIDPSLHEFQLVDLSRRFLVHDSFWALPEQFLGNKVDSYGGSLRYNVRYELARGMLEPVQRPDVVLVGAGYRLLSRGHTPTQPGALNQRQVQFSEEHWVHESGRPVQRAELLQVLQSLEAVLIQTVYNTKMASVGLSDIAMDTTVTHATSHGRAHSVEECRCPIGYSGLSCESCDAHFTRVPGGPYLGTCSGCSCNGHASSCDPVYGHCLNCQHNTEGPQCNKCKAGFFGDAMKATATSCRPCPCPYIDASRRFSDTCFLDTDGQATCDACAPGYTGRRCESCAPGYEGNPIQPGGKCRPVNQEIVRCDERGSMGTSGEACRCKNNVVGRLCNECADGSFHLSTRNPDGCLKCFCMGVSRHCTSSSWSRAQLHGASEEPGHFSLTNAASTHTTNEGIFSPTPGELGFSSFHRLLSGPYFWSLPSRFLGDKVTSYGGELRFTVTQRSQPGSTPLHGQPLVVLQGNNIILEHHVAQEPSPGQPSTFIVPFREQAWQRPDGQPATREHLLMALAGIDTLLIRASYAQQPAESRVSGISMDVAVPEETGQDPALEVEQCSCPPGYRGPSCQDCDTGYTRTPSGLYLGTCERCSCHGHSEACEPETGACQGCQHHTEGPRCEQCQPGYYGDAQRGTPQDCQLCPCYGDPAAGQAAHTCFLDTDGHPTCDACSPGHSGRHCERCAPGYYGNPSQGQPCQRDSQVPGPIGCNCDPQGSVSSQCDAAGQCQCKAQVEGLTCSHCRPHHFHLSASNPDGCLPCFCMGITQQCASSAYTRHLISTHFAPGDFQGFALVNPQRNSRLTGEFTVEPVPEGAQLSFGNFAQLGHESFYWQLPETYQGDKVAAYGGKLRYTLSYTAGPQGSPLSDPDVQITGNNIMLVASQPALQGPERRSYEIMFREEFWRRPDGQPATREHLLMALADLDELLIRATFSSVPLVASISAVSLEVAQPGPSNRPRALEVEECRCPPGYIGLSCQDCAPGYTRTGSGLYLGHCELCECNGHSDLCHPETGACSQCQHNAAGEFCELCAPGYYGDATAGTPEDCQPCACPLTNPENMFSRTCESLGAGGYRCTACEPGYTGQYCEQCGPGYVGNPSVQGGQCLPETNQAPLVVEVHPARSIVPQGGSHSLRCQVSGSPPHYFYWSREDGRPVPSGTQQRHQGSELHFPSVQPSDAGVYICTCRNLHQSNTSRAELLVTEAPSKPITVTVEEQRSQSVRPGADVTFICTAKSKSPAYTLVWTRLHNGKLPTRAMDFNGILTIRNVQLSDAGTYVCTGSNMFAMDQGTATLHVQASGTLSAPVVSIHPPQLTVQPGQLAEFRCSATGSPTPTLEWTGGPGGQLPAKAQIHGGILRLPAVEPTDQAQYLCRAHSSAGQQVARAVLHVHGGGGPRVQVSPERTQVHAGRTVRLYCRAAGVPSATITWRKEGGSLPPQARSERTDIATLLIPAITTADAGFYLCVATSPAGTAQARIQVVVLSASDASPPPVKIESSSPSVTEGQTLDLNCVVAGSAHAQVTWYRRGGSLPPHTQVHGSRLRLPQVSPADSGEYVCRVENGSGPKEASITVSVLHGTHSGPSYTPVPGSTRPIRIEPSSSHVAEGQTLDLNCVVPGQAHAQVTWHKRGGSLPARHQTHGSLLRLHQVTPADSGEYVCHVVGTSGPLEASVLVTIEASVIPGPIPPVRIESSSSTVAEGQTLDLSCVVAGQAHAQVTWYKRGGSLPARHQVRGSRLYIFQASPADAGQYVCRASNGMEASITVTVTGTQGANLAYPAGSTQPIRIEPSSSQVAEGQTLDLNCVVPGQSHAQVTWHKRGGSLPVRHQTHGSLLRLYQASPADSGEYVCRVLGSSVPLEASVLVTIEPAGSVPALGVTPTVRIESSSSQVAEGQTLDLNCLVAGQAHAQVTWHKRGGSLPARHQVHGSRLRLLQVTPADSGEYVCRVVGSSGTQEASVLVTIQQRLSGSHSQGVAYPVRIESSSASLANGHTLDLNCLVASQAPHTITWYKRGGSLPSRHQIVGSRLRIPQVTPADSGEYVCHVSNGAGSRETSLIVTIQGSGSSHVPSVSPPIRIESSSPTVVEGQTLDLNCVVARQPQAIITWYKRGGSLPSRHQTHGSHLRLHQMSVADSGEYVCRANNNIDALEASIVISVSPSAGSPSAPGSSMPIRIESSSSHVAEGETLDLNCVVPGQAHAQVTWHKRGGSLPSHHQTRGSRLRLHHVSPADSGEYVCRVMGSSGPLEASVLVTIEASGSSAVHVPAPGGAPPIRIEPSSSRVAEGQTLDLKCVVPGQAHAQVTWHKRGGNLPARHQVHGPLLRLNQVSPADSGEYSCQVTGSSGTLEASVLVTIEPSSPGPIPAPGLAQPIYIEASSSHVTEGQTLDLNCVVPGQAHAQVTWYKRGGSLPARHQTHGSQLRLHLVSPADSGEYVCRAASGPGPEQEASFTVTVPPSEGSSYRLRSPVISIDPPSSTVQQGQDASFKCLIHDGAAPISLEWKTRNQELEDNVHISPNGSIITIVGTRPSNHGTYRCVASNAYGVAQSVVNLSVHGPPTVSVLPEGPVWVKVGKAVTLECVSAGEPRSSARWTRISSTPAKLEQRTYGLMDSHAVLQISSAKPSDAGTYVCLAQNALGTAQKQVEVIVDTGAMAPGAPQVQAEEAELTVEAGHTATLRCSATGSPAPTIHWSKLRSPLPWQHRLEGDTLIIPRVAQQDSGQYICNATSPAGHAEATIILHVESPPYATTVPEHASVQAGETVQLQCLAHGTPPLTFQWSRVGSSLPGRATARNELLHFERAAPEDSGRYRCRVTNKVGSAEAFAQLLVQGPPGSLPATSIPAGSTPTVQVTPQLETKSIGASVEFHCAVPSDRGTQLRWFKEGGQLPPGHSVQDGVLRIQNLDQSCQGTYICQAHGPWGKAQASAQLVIQGRRVASGLC

SEQ ID NO: 860485 - protein, 1853 aa, Homo sapiens
MGWRAPGALLLALLLHGRLLAVTHGLRAYDGLSLPEDIETVTASQMRWTHSYLSDDEDMLADSISGDDLGSGDLGSGDFQMVYFRALVNFTRSIEYSPQLEDAGSREFREVSEAVVDTLESEYLKIPGDQVVSVVFIKELDGWVFVELDVGSEGNADGAQIQEMLLRVISSGSVASYVTSPQGFQFRRLGTVPQFPRACTEAEFACHSYNECVALEYRCDRRPDCRDMSDELNCEEPVLGISPTFSLLVETTSLPPRPETTIMRQPPVTHAPQPLLPGSVRPLPCGPQEAACRNGHCIPRDYLCDGQEDCEDGSDELDCGPPPPCEPNEFPCGNGHCALKLWRCDGDFDCEDRTDEANCPTKRPEEVCGPTQFRCVSTNMCIPASFHCDEESDCPDRSDEFGCMPPQVVTPPRESIQASRGQTVTFTCVAIGVPTPFIINWRLNWGHIPSHPRVTVTSEGGRGTLIIRDVKESDQGAYTCEAMNARGMVFGIPDGVLELVPQRGPCPDGHFYLEHSAACLPCFCFGITSVCQSTRRFRDQIRLRFDQPDDFKGVNVTMPAQPGTPPLSSTQLQIDPSLHEFQLVDLSRRFLVHDSFWALPEQFLGNKVDSYGGSLRYNVRYELARGMLEPVQRPDVVLVGAGYRLLSRGHTPTQPGALNQRQVQFSEEHWVHESGRPVQRAELLQVLQSLEAVLIQTVYNTKMASVGLSDIAMDTTVTHATSHGRAHSVEECRCPIGYSGLSCESCDAHFTRVPGGPYLGTCSGCSCNGHASSCDPVYGHCLNCQHNTEGPQCNKCKAGFFGDAMKATATSCRPCPCPYIDASRRFSDTCFLDTDGQATCDACAPGYTGRRCESCAPGYEGNPIQPGGKCRPVNQEIVRCDERGSMGTSGEACRCKNNVVGRLCNECADGSFHLSTRNPDGCLKCFCMGVSRHCTSSSWSRAQLHGASEEPGHFSLTNAASTHTTNEGIFSPTPGELGFSSFHRLLSGPYFWSLPSRFLGDKVTSYGGELRFTVTQRSQPGSTPLHGQPLVVLQGNNIILEHHVAQEPSPGQPSTFIVPFREQAWQRPDGQPATREHLLMALAGIDTLLIRASYAQQPAESRVSGISMDVAVPEETGQDPALEVEQCSCPPGYRGPSCQDCDTGYTRTPSGLYLGTCERCSCHGHSEACEPETGACQGCQHHTEGPRCEQCQPGYYGDAQRGTPQDCQLCPCYGDPAAGQAAHTCFLDTDGHPTCDACSPGHSGRHCERCAPGYYGNPSQGQPCQRDSQVPGPIGCNCDPQGSVSSQCDAAGQCQCKAQVEGLTCSHCRPHHFHLSASNPDGCLPCFCMGITQQCASSAYTRHLISTHFAPGDFQGFALVNPQRNSRLTGEFTVEPVPEGAQLSFGNFAQLGHESFYWQLPETYQGDKVAAYGGKLRYTLSYTAGPQGSPLSDPDVQITGNNIMLVASQPALQGPERRSYEIMFREEFWRRPDGQPATREHLLMALADLDELLIRATFSSVPLVASISAVSLEVAQPGPSNRPRALEVEECRCPPGYIGLSCQDCAPGYTRTGSGLYLGHCELCECNGHSDLCHPETGACSQCQHNAAGEFCELCAPGYYGDATAGTPEDCQPCACPLTNPENMFSRTCESLGAGGYRCTACEPGYTGQYCEQCGPGYVGNPSVQGGQCLPETNQAPLVVEVHPARSIVPQGGSHSLRCQVSGSPPHYFYWSREDGRPVPSGTQQRHQGSELHFPSVQPSDAGVYICTCRNLHQSNTSRAELLVTEAPSKPITVTVEEQRSQSVRPGADVTFICTAKSKSPAYTLVWTRLHNGKLPTRAMDFNGILTIRNVQLSDAGEMDPLLHSRPTGQPTL

SEQ ID NO: 860486 - protein, 1345 aa, Homo sapiens
MGWRAPGALLLALLLHGRLLAVTHGLRAYDGLSLPEDIETVTASQMRWTHSYLSDDEDMLADSISGDDLGSGDLGSGDFQMVYFRALVNFTRSIEYSPQLEDAGSREFREVSEAVVDTLESEYLKIPGDQVVSVVFIKELDGWVFVELDVGSEGNADGAQIQEMLLRVISSGSVASYVTSPQGFQFRRLGTVPQFPRACTEAEFACHSYNECVALEYRCDRRPDCRDMSDELNCEEPVLGISPTFSLLVETTSLPPRPETTIMRQPPVTHAPQPLLPGSVRPLPCGPQEAACRNGHCIPRDYLCDGQEDCEDGSDELDCGPPPPCEPNEFPCGNGHCALKLWRCDGDFDCEDRTDEANCPTKRPEEVCGPTQFRCVSTNMCIPASFHCDEESDCPDRSDEFGCMPPQVVTPPRESIQASRGQTVTFTCVAIGVPTPFIINWRLNWGHIPSHPRVTVTSEGGRGTLIIRDVKESDQGAYTCEAMNARGMVFGIPDGVLELVPQRGPCPDGHFYLEHSAACLPCFCFGITSVCQSTRRFRDQIRLRFDQPDDFKGVNVTMPAQPGTPPLSSTQLQIDPSLHEFQLVDLSRRFLVHDSFWALPEQFLGNKVDSYGGSLRYNVRYELARGMLEPVQRPDVVLVGAGYRLLSRGHTPTQPGALNQRQVQFSEEHWVHESGRPVQRAELLQVLQSLEAVLIQTVYNTKMASVGLSDIAMDTTVTHATSHGRAHSVEECRCPIGYSGLSCESCDAHFTRVPGGPYLGTCSGCSCNGHASSCDPVYGHCLNCQHNTEGPQCNKCKAGFFGDAMKATATSCRPCPCPYIDASRRFSDTCFLDTDGQATCDACAPGYTGRRCESCAPGYEGNPIQPGGKCRPVNQEIVRCDERGSMGTSGEACRCKNNVVGRLCNECADGSFHLSTRNPDGCLKCFCMGVSRHCTSSSWSRAQLHGASEEPGHFSLTNAASTHTTNEGIFSPTPGELGFSSFHRLLSGPYFWSLPSRFLGDKVTSYGGELRFTVTQRSQPGSTPLHGQPLVVLQGNNIILEHHVAQEPSPGQPSTFIVPFREQAWQRPDGQPATREHLLMALAGIDTLLIRASYAQQPAESRVSGISMDVAVPEETGQDPALEVEQCSCPPGYRGPSCQDCDTGYTRTPSGLYLGTCERCSCHGHSEACEPETGACQGCQHHTEGPRCEQCQPGYYGDAQRGTPQDCQLCPCYGDPAAGQAAHTCFLDTDGHPTCDACSPGHSGRHCERCAPGYYGNPSQGQPCQRDSQVPGPIGCNCDPQGSVSSQCDAAGQCQCKVSPNPCPCGACSAPLPRPCGEIRQHLVEAETWAWGAGHGGQGRGCPGL

SEQ ID NO: 860487 - protein, 903 aa, Homo sapiens
MGWRAPGALLLALLLHGRLLAVTHGLRAYDGLSLPEDIETVTASQMRWTHSYLSDDEDMLADSISGDDLGSGDLGSGDFQMVYFRALVNFTRSIEYSPQLEDAGSREFREVSEAVVDTLESEYLKIPGDQVVSVVFIKELDGWVFVELDVGSEGNADGAQIQEMLLRVISSGSVASYVTSPQGFQFRRLGTVPQFPRACTEAEFACHSYNECVALEYRCDRRPDCRDMSDELNCEEPVLGISPTFSLLVETTSLPPRPETTIMRQPPVTHAPQPLLPGSVRPLPCGPQEAACRNGHCIPRDYLCDGQEDCEDGSDELDCGPPPPCEPNEFPCGNGHCALKLWRCDGDFDCEDRTDEANCPTKRPEEVCGPTQFRCVSTNMCIPASFHCDEESDCPDRSDEFGCMPPQVVTPPRESIQASRGQTVTFTCVAIGVPTPFIINWRLNWGHIPSHPRVTVTSEGGRGTLIIRDVKESDQGAYTCEAMNARGMVFGIPDGVLELVPQRGPCPDGHFYLEHSAACLPCFCFGITSVCQSTRRFRDQIRLRFDQPDDFKGVNVTMPAQPGTPPLSSTQLQIDPSLHEFQLVDLSRRFLVHDSFWALPEQFLGNKVDSYGGSLRYNVRYELARGMLEPVQRPDVVLVGAGYRLLSRGHTPTQPGALNQRQVQFSEEHWVHESGRPVQRAELLQVLQSLEAVLIQTVYNTKMASVGLSDIAMDTTVTHATSHGRAHSVEECRCPIGYSGLSCESCDAHFTRVPGGPYLGTCSGCSCNGHASSCDPVYGHCLNCQHNTEGPQCNKCKAGFFGDAMKATATSCRPCPCPYIDASRRFSDTCFLDTDGQATCDACAPGYTGRRCESCAPGYEGNPIQPGGKCRPVSEYGCHHPLTPTSQPNLGCTPGTLPPCPSS

SEQ ID NO: 860488 - protein, 74 aa, Homo sapiens
WGSSPPLSLFNKSSWLGMVECGPALQPSAPGSQVEQPLITSSFPAQTPPPPPAAVAVAVTPGESVSQAEAQPGS

SEQ ID NO: 860489 - protein, 189 aa, Homo sapiens
TLPSTALQPGARPAAAAFAAATGPSSSSFGSQDEETESQRGEVTCPRSQQLSLLPGLPGPPAAAPAWAMSSSDEETLSERSCRSERSCRSERSYRSERSGSLSPCPPGDTLPWNLPLHEQKKRKSQDSVLDPAERAVVRVADALPSTSFCFPHCSLLRNAAAVSPIRSKRKSKTKRRKPQSFCDCVVWL

SEQ ID NO: 860490 - protein, 113 aa, Homo sapiens
MERVQIQSNRENLEQAFEVAERLGVTRLLDAEDVDVPSPDEKSVITYVSSIYDAFPKVPEGGEGISATEVDSRWQEYQSRVDSLIPWIKQHTILMSDKTFPQNPVELKVKSRT

SEQ ID NO: 860491 - protein, 4344 aa, Homo sapiens
MFPVLWAGIPWRDVGSLQPLPPGFKQFCTSASRVAVITDERDRVQKKTFTKWVNKHLMKVRKHINDLYEDLRDGHNLISLLEVLSGIKLPREKGRMRFHRLQNVQIALDFLKQRQVKLVNIRNDDITDGNPKLTLGLIWTIILHFQISDIYISGESGDMSAKEKLLLWTQKVTAGYTGIKCTNFSSCWSDGKMFNALIHRYRPDLVDMERVQIQSNRENLEQAFEVAERLGVTRLLDAEDVDVPSPDEKSVITYVSSIYDAFPKVPEGGEGISATEVDSRWQEYQSRVDSLIPWIKQHTILMSDKTFPQNPVELKALYNQYIHFKETEILAKEREKGRIEELYKLLEVWIEFGRIKLPQGYHPNDVEEEWGKLIIEMLEREKSLRPAVERLELLLQIANKIQNGALNCEEKLTLAKNTLQADAAHLESGQPVQCESDVIMYIQECEGLIRQLQVDLQILRDENYYQLEELAFRVMRLQDELVTLRLECTNLYRKGHFTSLELVPPSTLTTTHLKAEPLTKATHSSSTSWFRKPMTRAELVAISSSEDEGNLRFVYELLSWVEEMQMKLERAEWGNDLPSVELQLETQQHIHTSVEELGSSVKEARLYEGKMSQNFHTSYAETLGKLETQYCKLKETSSFRMRHLQSLHKFVSRATAELIWLNEKEEEELAYDWSDNNSNISAKRNYFSELTMELEEKQDVFRSLQDTAELLSLENHPAKQTVEAYSAAVQSQLQWMKQLCLCVEQHVKENTAYFQFFSDARELESFLRNLQDSIKRKYSCDHNTSLSRLEDLLQDSMDEKEQLIQSKSSVASLVGRSKTIVQLKPRSPDHVLKNTISVKAVCDYRQIEITICKNDECVLEDNSQRTKWKVISPTGNEAMVPSVCFLIPPPNKDAIEMASRVEQSYQKVMALWHQLHVNTKSLISWNYLRKDLDLVQTWNLEKLRSSAPGECHQIMKNLQAHYEDFLQDSRDSVLFSVADRLRLEEEVEACKARFQHLMKSMENEDKEETVAKMYISELKNIRLRLEEYEQRVVKRIQSLASSRTDRDAWQDNALRIAEQEHTQEDLQQLRSDLDAVSMKCDSFLHQSPSSSSVPTLRSELNLLVEKMDHVYGLSTVYLNKLKTVDVIVRSIQDAELLVKGYEIKLSQEEVVLADLSALEAHWSTLRHWLSDVKDKNSVFSVLDEEIAKAKVVAEQMSRLTPERNLDLERYQEKGSQLQERWHRVIAQLEIRQSELESIQEVLGDYRACHGTLIKWIEETTAQQEMMKPGQAEDSRVLSEQLSQQTALFAEIERNQTKLDQCQKFSQQYSTIVKDYELQLMTYKAFVESQQKSPGKRRRMLSSSDAITQEFMDLRTRYTALVTLTTQHVKYISDALRRLEEEEKVVEEEKQEHVEKVKELLGWVSTLARNTQGKATSSETKESTDIEKAILEQQVLSEELTTKKEQVSEAIKTSQIFLAKHGHKLSEKEKKQISEQLNALNKAYHDLCDGSANQLQQLQSQLAHQTEQKTLQKQQNTCHQQLEDLCSWVGQAERALAGHQGRTTQQDLSALQKNQSDLKDLQDDIQNRATSFATVVKDIEGFMEENQTKLSPRELTALREKLHQAKEQYEALQEETRVAQKELEEAVTSALQQETEKSKAAKELAENKKKIDALLDWVTSVGSSGGQLLTNLPGMEQLSGASLEKGALDTTDGYMGVNQAPEKLDKQCEMMKARHQELLSQQQNFILATQSAQAFLDQHGHNLTPEEQQMLQQKLGELKEQYSTSLAQSEAELKQVQTLQDELQKFLQDHKEFESWLERSEKELENMHKGGSSPETLPSLLKRQGSFSEDVISHKGDLRFVTISGQKVLDMENSFKEGKEPSEIGNLVKDKLKDATERYTALHSKCTRLGSHLNMLLGQYHQFQNSADSLQAWMQACEANVEKLLSDTVASDPGVLQEQLATTKQLQEELAEHQVPVEKLQKVARDIMEIEGEPAPDHRHVQETTDSILSHFQSLSYSLAERSSLLQKAIAQSQSVQESLESLLQSIGEVEQNLEGKQVSSLSSGVIQEALATNMKLKQDIARQKSSLEATREMVTRFMETADSTTAAVLQGKLAEVSQRFEQLCLQQQEKESSLKKLLPQAEMFEHLSGKLQQFMENKSRMLASGNQPDQDITHFFQQIQELNLEMEDQQENLDTLEHLVTELSSCGFALDLCQHQDRVQNLRKDFTELQKTVKEREKDASSCQEQLDEFRKLVRTFQKWLKETEGSIPPTETSMSAKELEKQIEHLKSLLDDWASKGTLVEEINCKGTSLENLIMEITAPDSQGKTDLTEIQCDMSDVNLKYEKLGGVLHERQESLQAILNRMEEVHKEANSVLQWLESKEEVLKSMDAMSSPTKTETVKAQAESNKAFLAELEQNSPKIQKVKEALAGLLVTYPNSQEAENWKKIQEELNSRWERATEVTVARQRQLEESASHLACFQAAESQLRPWLMEKELMMGVLGPLSIDPNMLNAQKQQVQFMLKEFEARRQQHEQLNEAAQGILTGPGDVSLSTSQVQKELQSINQKWVELTDKLNSRSSQIDQAIVKSTQYQELLQDLSEKVRAVGQRLSVQSAISTQPEAVKQQLEETSEIRSDLEQLDHEVKEAQTLCDELSVLIGEQYLKDELKKRLETVALPLQGLEDLAADRINRLQAALASTQQFQQMFDELRTWLDDKQSQQAKNCPISAKLERLQSQLQENEEFQKSLNQHSGSYEVIVAEGESLLLSVPPGEEKRTLQNQLVELKNHWEELSKKTADRQSRLKDCMQKAQKYQWHVEDLVPWIEDCKAKMSELRVTLDPVQLESSLLRSKAMLNEVEKRRSLLEILNSAADILINSSEADEDGIRDEKAGINQNMDAVTEELQAKTGSLEEMTQRLREFQESFKNIEKKVEGAKHQLEIFDALGSQACSNKNLEKLRAQQEVLQALEPQVDYLRNFTQGLVEDAPDGSDASQLLHQAEVAQQEFLEVKQRVNSGCVMMENKLEGIGQFHCRVREMFSQLADLDDELDGMGAIGRDTDSLQSQIEDVRLFLNKIHVLKLDIEASEAECRHMLEEEGTLDLLGLKRELEALNKQCGKLTERGKARQEQLELTLGRVEDFYRKLKGLNDATTAAEEAEALQWVVGTEVEIINQQLADFKMFQKEQVDPLQMKLQQVNGLGQGLIQSAGKDCDVQGLEHDMEEINARWNTLNKKVAQRIAQLQEALLHCGKFQDALEPLLSWLADTEELIANQKPPSAEYKVVKAQIQEQKLLQRLLDDRKATVDMLQAEGGRIAQSAELADREKITGQLESLESRWTELLSKAAARQKQLEDILVLAKQFHETAEPISDFLSVTEKKLANSEPVGTQTAKIQQQIIRHKALEEDIENHATDVHQAVKIGQSLSSLTSPAEQGVLSEKIDSLQARYSEIQDRCCRKAALLDQALSNARLFGEDEVEVLNWLAEVEDKLSSVFVKDFKQDVLHRQHADHLALNEEIVNRKKNVDQAIKNGQALLKQTTGEEVLLIQEKLDGIKTRYADITVTSSKALRTLEQARQLATKFQSTYEELTGWLREVEEELATSGGQSPTGEQIPQFQQRQKELKKEVMEHRLVLDTVNEVSRALLELVPWRAREGLDKLVSDANEQYKLVSDTIGQRVDEIDAAIQRSQQYEQAADAELAWVAETKRKLMALGPIRLEQDQTTAQLQVQKAFSIDIIRHKDSMDELFSHRSEIFGTCGEEQKTVLQEKTESLIQQYEAISLLNSERYARLERAQVLVNQFWETYEELSPWIEETRALIAQLPSPAIDHEQLRQQQEEMRQLRESIAEHKPHIDKLLKIGPQLKELNPEEGEMVEEKYQKAENMYAQIKEEVRQRALALDEAVSQSTQITEFHDKIEPMLETLENLSSRLRMPPLIPAEVDKIRECISDNKSATVELEKLQPSFEALKRRGEELIGRSQGADKDLAAKEIQDKLDQMVFFWEDIKARAEEREIKFLDVLELAEKFWYDMAALLTTIKDTQDIVHDLESPGIDPSIIKQQVEAAETIKEETDGLHEELEFIRILGADLIFACGETEKPEVRKSIDEMNNAWENLNKTWKERLEKLEDAMQAAVQYQDTLQAMFDWLDNTVIKLCTMPPVGTDLNTVKDQLNEMKEFKVEVYQQQIEMEKLNHQGELMLKKATDETDRDIIREPLTELKHLWENLGEKIAHRQHKLEGALLALGQFQHALEELMSWLTHTEELLDAQRPISGDPKVIEVELAKHHVLKNDVLAHQATVETVNKAGNELLESSAGDDASSLRSRLEAMNQCWESVLQKTEEREQQLQSTLQQAQGFHSEIEDFLLELTENGEPAFCI

SEQ ID NO: 860492 - protein, 4344 aa, Homo sapiens; identical to SEQ ID NO: 860491

SEQ ID NO: 860493 - protein, 3830 aa, Homo sapiens
GGGDGRRKRGGGKGGRGRGGGGGFKRGRGGKERGGGGGGGNQAKKSREISLKEFGCKDQRKPRMSSDAKEFISIINPHNLKGKSLGQVSLTHPYSECDFKLKEVARNNMGNDTNEEQEKAVTKIEIISHMKQSTSCLDSEEIRENQGEVILEVQETYCETSGKLPSEQVLQQPMNARVKSKREKREVIVEESIRTCKPAFLSEEKLYQETAIRDEHDSHIKSQPREMTSSEKGKEADTEMGFSITFKIEESSSQVVPQGISVKHLDALTLFSSKQANEGKVNNLSLCLTLKPEENLSREIACGAQSEPFPCMTPRPEGLHYQESDGKAQVTGPSQISKTDKSFQGTTRQETNYQDSWVTSKTKETKHQISSSNECKEKSYQEVSFDPARGLKLEEITVSRPDSKEVRYLEFSDRKDLHHQGSKSDDKLCGTLKSEIATQELTGEKFLEMANPNVAGLEAGSIEDIVTQRGSRVLGSFLPEKLFKGVSQKENTGQQNAIISPTVLETSEEKTVSLTVCSAVKTEKTPQEKLRESPGSEQTPFMTAPEGKGNGGVNPEPFRATQNVFTRQLCLEHDEKLVSYLSLLRNIEMRTKQIQPLELNLAELQDLLCQAKVLERELKDLTTLVSQELECVNQIIISQPQEVPAQLLKALEKDAKNLQKSLSSVSDTWNSRLLHFQNAVEIEKTKVLNQHTQLEGRLQDLRAWVGNKNLILNSKGSNSEIDVDSLNLCLQQYEDLKQPMAERKAQLDALAFDIQFFISEHAQDLSPQQNRQMLRLLNELQRSFQDILEQTAAQVDALQGHLQQMEQEALVKTLQKQQNTCHQQLEDLCSWVGQAERALAGHQGRTTQQDLSALQKNQSDLKDLQDDIQNRATSFATVVKDIEGFMEENQTKLSPRELTALREKLHQAKEQYEALQEETRVAQKELEEAVTSALQQETEKSKAAKELAENKKKIDALLDWVTSVGSSGGQLLTNLPGMEQLSGASLEKGALDTTDGYMGVNQAPEKLDKQCEMMKARHQELLSQQQNFILATQSAQAFLDQHGHNLTPEEQQMLQQKLGELKEQYSTSLAQSEAELKQVQTLQDELQKFLQDHKEFESWLERSEKELENMHKGGSSPETLPSLLKRQGSFSEDVISHKGDLRFVTISGQKVLDMENSFKEGKEPSEIGNLVKDKLKDATERYTALHSKCTRLGSHLNMLLGQYHQFQNSADSLQAWMQACEANVEKLLSDTVASDPGVLQEQLATTKQLQEELAEHQVPVEKLQKVARDIMEIEGEPAPDHRHVQETTDSILSHFQSLSYSLAERSSLLQKAIAQSQSVQESLESLLQSIGEVEQNLEGKQVSSLSSGVIQEALATNMKLKQDIARQKSSLEATREMVTRFMETADSTTAAVLQGKLAEVSQRFEQLCLQQQEKESSLKKLLPQAEMFEHLSGKLQQFMENKSRMLASGNQPDQDITHFFQQIQELNLEMEDQQENLDTLEHLVTELSSCGFALDLCQHQDRVQNLRKDFTELQKTVKEREKDASSCQEQLDEFRKLVRTFQKWLKETEGSIPPTETSMSAKELEKQIEHLKSLLDDWASKGTLVEEINCKGTSLENLIMEITAPDSQGKTDLTEIQCDMSDVNLKYEKLGGVLHERQESLQAILNRMEEVHKEANSVLQWLESKEEVLKSMDAMSSPTKTETVKAQAESNKAFLAELEQNSPKIQKVKEALAGLLVTYPNSQEAENWKKIQEELNSRWERATEVTVARQRQLEESASHLACFQAAESQLRPWLMEKELMMGVLGPLSIDPNMLNAQKQQVQFMLKEFEARRQQHEQLNEAAQGILTGPGDVSLSTSQVQKELQSINQKWVELTDKLNSRSSQIDQAIVKSTQYQELLQDLSEKVRAVGQRLSVQSAISTQPEAVKQQLEETSEIRSDLEQLDHEVKEAQTLCDELSVLIGEQYLKDELKKRLETVALPLQGLEDLAADRINRLQAALASTQQFQQMFDELRTWLDDKQSQQAKNCPISAKLERLQSQLQENEEFQKSLNQHSGSYEVIVAEGESLLLSVPPGEEKRTLQNQLVELKNHWEELSKKTADRQSRLKDCMQKAQKYQWHVEDLVPWIEDCKAKMSELRVTLDPVQLESSLLRSKAMLNEVEKRRSLLEILNSAADILINSSEADEDGIRDEKAGINQNMDAVTEELQAKTGSLEEMTQRLREFQESFKNIEKKVEGAKHQLEIFDALGSQACSNKNLEKLRAQQEVLQALEPQVDYLRNFTQGLVEDAPDGSDASQLLHQAEVAQQEFLEVKQRVNSGCVMMENKLEGIGQFHCRVREMFSQLADLDDELDGMGAIGRDTDSLQSQIEDVRLFLNKIHVLKLDIEASEAECRHMLEEEGTLDLLGLKRELEALNKQCGKLTERGKARQEQLELTLGRVEDFYRKLKGLNDATTAAEEAEALQWVVGTEVEIINQQLADFKMFQKEQVDPLQMKLQQVNGLGQGLIQSAGKDCDVQGLEHDMEEINARWNTLNKKVAQRIAQLQEALLHCGKFQDALEPLLSWLADTEELIANQKPPSAEYKVVKAQIQEQKLLQRLLDDRKATVDMLQAEGGRIAQSAELADREKITGQLESLESRWTELLSKAAARQKQLEDILVLAKQFHETAEPISDFLSVTEKKLANSEPVGTQTAKIQQQIIRHKALEEDIENHATDVHQAVKIGQSLSSLTSPAEQGVLSEKIDSLQARYSEIQDRCCRKAALLDQALSNARLFGEDEVEVLNWLAEVEDKLSSVFVKDFKQDVLHRQHADHLALNEEIVNRKKNVDQAIKNGQALLKQTTGEEVLLIQEKLDGIKTRYADITVTSSKALRTLEQARQLATKFQSTYEELTGWLREVEEELATSGGQSPTGEQIPQFQQRQKELKKEVMEHRLVLDTVNEVSRALLELVPWRAREGLDKLVSDANEQYKLVSDTIGQRVDEIDAAIQRSQQYEQAADAELAWVAETKRKLMALGPIRLEQDQTTAQLQVQKAFSIDIIRHKDSMDELFSHRSEIFGTCGEEQKTVLQEKTESLIQQYEAISLLNSERYARLERAQVLVNQFWETYEELSPWIEETRALIAQLPSPAIDHEQLRQQQEEMRQLRESIAEHKPHIDKLLKIGPQLKELNPEEGEMVEEKYQKAENMYAQIKEEVRQRALALDEAVSQSTQITEFHDKIEPMLETLENLSSRLRMPPLIPAEVDKIRECISDNKSATVELEKLQPSFEALKRRGEELIGRSQGADKDLAAKEIQDKLDQMVFFWEDIKARAEEREIKFLDVLELAEKFWYDMAALLTTIKDTQDIVHDLESPGIDPSIIKQQVEAAETIKEETDGLHEELEFIRILGADLIFACGETEKPEVRKSIDEMNNAWENLNKTWKERLEKLEDAMQAAVQYQDTLQAMFDWLDNTVIKLCTMPPVGTDLNTVKDQLNEMKEFKVEVYQQQIEMEKLNHQGELMLKKATDETDRDIIREPLTELKHLWENLGEKIAHRQHKLEGALLALGQFQHALEELMSWLTHTEELLDAQRPISGDPKVIEVELAKHHVLKNDVLAHQATVETVNKAGNELLESSAGDDASSLRSRLEAMNQCWESVLQKTEEREQQLQSTLQQAQGFHSEIEDFLLELTRMESQLSASKPTGGLPETAREQLDTHMELYSQLKAKEETYNQLLDKGRLMLLSRDDSGSGSKTEQSVALLEQKWHVVSSKMEERKSKLEEALNLATEFQNSLQEFINWLTLAEQSLNIASPPSLILNTVLSQIEEHKVFANEVNAHRDQIIELDQTGNQLKFLSQKQDVVLIKNLLVSVQSRWEKGCPAIY

SEQ ID NO: 860494 - protein, 1780 aa, Homo sapiens
VIEDPGYPIMLDTVNEVSRALLELVPWRAREGLDKLVSDANEQYKLVSDTIGQRVDEIDAAIQRSQQYEQAADAELAWVAETKRKLMALGPIRLEQDQTTAQLQVQKAFSIDIIRHKDSMDELFSHRSEIFGTCGEEQKTVLQEKTESLIQQYEAISLLNSERYARLERAQVLVNQFWETYEELSPWIEETRALIAQLPSPAIDHEQLRQQQEEMRQLRESIAEHKPHIDKLLKIGPQLKELNPEEGEMVEEKYQKAENMYAQIKEEVRQRALALDEAVSQSTQITEFHDKIEPMLETLENLSSRLRMPPLIPAEVDKIRECISDNKSATVELEKLQPSFEALKRRGEELIGRSQGADKDLAAKEIQDKLDQMVFFWEDIKARAEEREIKFLDVLELAEKFWYDMAALLTTIKDTQDIVHDLESPGIDPSIIKQQVEAAETIKEETDGLHEELEFIRILGADLIFACGETEKPEVRKSIDEMNNAWENLNKTWKERLEKLEDAMQAAVQYQDTLQAMFDWLDNTVIKLCTMPPVGTDLNTVKDQLNEMKEFKVEVYQQQIEMEKLNHQGELMLKKATDETDRDIIREPLTELKHLWENLGEKIAHRQHKLEGALLALGQFQHALEELMSWLTHTEELLDAQRPISGDPKVIEVELAKHHVLKNDVLAHQATVETVNKAGNELLESSAGDDASSLRSRLEAMNQCWESVLQKTEEREQQLQSTLQQAQGFHSEIEDFLLELTRMESQLSASKPTGGLPETAREQLDTHMELYSQLKAKEETYNQLLDKGRLMLLSRDDSGSGSKTEQSVALLEQKWHVVSSKMEERKSKLEEALNLATEFQNSLQEFINWLTLAEQSLNIASPPSLILNTVLSQIEEHKVFANEVNAHRDQIIELDQTGNQLKFLSQKQDVVLIKNLLVSVQSRWEKVVQRSIERGRSLDDARKRAKQFHEAWKKLIDWLEDAESHLDSELEISNDPDKIKLQLSKHKEFQKTLGGKQPVYDTTIRTGRALKEKTLLPEDTQKLDNFLGEVRDKWDTVCGKSVERQHKLEEALLFSGQFMDALQALVDWLYKVEPQLAEDQPVHGDLDLVMNLMDAHKVFQKELGKRTGTVQVLKRSGRELIENSRDDTTWVKGQLQELSTRWDTVCKLSVSKQSRLEQALKQAEVFRDTVHMLLEWLSEAEQTLRFRGALPDDTEALQSLIDTHKEFMKKVEEKRVDVNSAVAMGEVILAVCHPDCITTIKHWITIIRARFEEVLTWAKQHQQRLETALSELVANAELLEELLAWIQWAETTLIQRDQEPIPQNIDRVKALIAEHQTFMEEMTRKQPDVDRVTKTYKRKNIEPTHAPFIEKSRSGGRKSLSQPTPPPMPILSQSEAKNPRINQLSARWQQVWLLALERQRKLNDALDRLEELKEFANFDFDVWRKKYMRWMNHKKSRVMDFFRRIDKDQDGKITRQEFIDGILASKFPTTKLEMTAVADIFDRDGDGYIDYYEFVAALHPNKDAYRPTTDADKIEDEVTRQVAQCKCAKRFQVEQIGENKYRFGDSQQLRLVRILRSTVMVRVGGGWMALDEFLVKNDPCRARGRTNIELREKFILPEGASQGMTPFRSRGRRSKPSSRAASPTRSSSSASQSNHSCTSMPSSPATPASGTKVIPSSGSKLKRPTPTFHSSRTSLAGDTSNSSSPASTGAKTNRADPKKSASRPGSRAGSRAGSRASSRRGSDASDFDLLETQSACSDTSESSAAGGQGNSRRGLNKPSKIPTMSKKTTTASPRTPGPKR

SEQ ID NO: 860495 - protein, 4308 aa, Homo sapiens
MFPVLWAGIPWRDVGSLQPLPPGFKQFCTSASRVAVITDERDRVQKKTFTKWVNKHLMKVRKHINDLYEDLRDGHNLISLLEVLSGIKLPREKGRMRFHRLQNVQIALDFLKQRQVKLVNIRNDDITDGNPKLTLGLIWTIILHFQISDIYISGESGDMSAKEKLLLWTQKVTAGYTGIKCTNFSSCWSDGKMFNALIHRYRPDLVDMERVQIQSNRENLEQAFEVAERLGVTRLLDAEDVDVPSPDEKSVITYVSSIYDAFPKVPEGGEGISATEVDSRWQEYQSRVDSLIPWIKQHTILMSDKTFPQNPVELKALYNQYIHFKETEILAKEREKGRIEELYKLLEVWIEFGRIKLPQGYHPNDVEEEWGKLIIEMLEREKSLRPAVERLELLLQIANKIQNGALNCEEKLTLAKNTLQADAAHLESGQPVQCESDVIMYIQECEGLIRQLQVDLQILRDENYYQLEELAFRVMRLQDELVTLRLECTNLYRKGHFTSLELVPPSTLTTTHLKAEPLTKATHSSSTSWFRKPMTRAELVAISSSEDEGNLRFVYELLSWVEEMQMKLERAEWGNDLPSVELQLETQQHIHTSVEELGSSVKEARLYEGKMSQNFHTSYAETLGKLETQYCKLKETSSFRMRHLQSLHKFVSRATAELIWLNEKEEEELAYDWSDNNSNISAKRNYFSELTMELEEKQDVFRSLQDTAELLSLENHPAKQTVEAYSAAVQSQLQWMKQLCLCVEQHVKENTAYFQFFSDARELESFLRNLQDSIKRKYSCDHNTSLSRLEDLLQDSMDEKEQLIQSKSSVASLVGRSKTIVQLKPRSPDHVLKNTISVKAVCDYRQIEITICKNDECVLEDNSQRTKWKVISPTGNEAMVPSVCFLIPPPNKDAIEMASRVEQSYQKVMALWHQLHVNTKSLISWNYLRKDLDLVQTWNLEKLRSSAPGECHQIMKNLQAHYEDFLQDSRDSVLFSVADRLRLEEEVEACKARFQHLMKSMENEDKEETVAKMYISELKNIRLRLEEYEQRVVKRIQSLASSRTDRDAWQDNALRIAEQEHTQEDLQQLRSDLDAVSMKCDSFLHQSPSSSSVPTLRSELNLLVEKMDHVYGLSTVYLNKLKTVDVIVRSIQDAELLVKGYEIKLSQEEVVLADLSALEAHWSTLRHWLSDVKDKNSVFSVLDEEIAKAKVVAEQMSRLTPERNLDLERYQEKGSQLQERWHRVIAQLEIRQSELESIQEVLGDYRACHGTLIKWIEETTAQQEMMKPGQAEDSRVLSEQLSQQTALFAEIERNQTKLDQCQKFSQQYSTIVKDYELQLMTYKAFVESQQKSPGKRRRMLSSSDAITQEFMDLRTRYTALVTLTTQHVKYISDALRRLEEEEKVVEEEKQEHVEKVKELLGWVSTLARNTQGKATSSETKESTDIEKAILEQQVLSEELTTKKEQVSEAIKTSQIFLAKHGHKLSEKEKKQISEQLNALNKAYHDLCDGSANQLQQLQSQLAHQTEQKTLQKQQNTCHQQLEDLCSWVGQAERALAGHQGRTTQQDLSALQKNQSDLKDLQDDIQNRATSFATVVKDIEGFMEENQTKLSPRELTALREKLHQAKEQYEALQEETRVAQKELEEAVTSALQQETEKSKAAKELAENKKKIDALLDWVTSVGSSGGQLLTNLPGMEQLSGASLEKGALDTTDGYMGVNQAPEKLDKQCEMMKARHQELLSQQQNFILATQSAQAFLDQHGHNLTPEEQQMLQQKLGELKEQYSTSLAQSEAELKQVQTLQDELQKFLQDHKEFESWLERSEKELENMHKGGSSPETLPSLLKRQGSFSEDVISHKGDLRFVTISGQKVLDMENSFKEGKEPSEIGNLVKDKLKDATERYTALHSKCTRLGSHLNMLLGQYHQFQNSADSLQAWMQACEANVEKLLSDTVASDPGVLQEQLATTKQLQEELAEHQVPVEKLQKVARDIMEIEGEPAPDHRHVQETTDSILSHFQSLSYSLAERSSLLQKAIAQSQSVQESLESLLQSIGEVEQNLEGKQVSSLSSGVIQEALATNMKLKQDIARQKSSLEATREMVTRFMETADSTTAAVLQGKLAEVSQRFEQLCLQQQEKESSLKKLLPQAEMFEHLSGKLQQFMENKSRMLASGNQPDQDITHFFQQIQELNLEMEDQQENLDTLEHLVTELSSCGFALDLCQHQDRVQNLRKDFTELQKTVKEREKDASSCQEQLDEFRKLVRTFQKWLKETEGSIPPTETSMSAKELEKQIEHLKSLLDDWASKGTLVEEINCKGTSLENLIMEITAPDSQGKTDLTEIQCDMSDVNLKYEKLGGVLHERQESLQAILNRMEEVHKEANSVLQWLESKEEVLKSMDAMSSPTKTETVKAQAESNKAFLAELEQNSPKIQKVKEALAGLLVTYPNSQEAENWKKIQEELNSRWERATEVTVARQRQLEESASHLACFQAAESQLRPWLMEKELMMGVLGPLSIDPNMLNAQKQQVQFMLKEFEARRQQHEQLNEAAQGILTGPGDVSLSTSQVQKELQSINQKWVELTDKLNSRSSQIDQAIVKSTQYQELLQDLSEKVRAVGQRLSVQSAISTQPEAVKQQLEETSEIRSDLEQLDHEVKEAQTLCDELSVLIGEQYLKDELKKRLETVALPLQGLEDLAADRINRLQAALASTQQFQQMFDELRTWLDDKQSQQAKNCPISAKLERLQSQLQENEEFQKSLNQHSGSYEVIVAEGESLLLSVPPGEEKRTLQNQLVELKNHWEELSKKTADRQSRLKDCMQKAQKYQWHVEDLVPWIEDCKAKMSELRVTLDPVQLESSLLRSKAMLNEVEKRRSLLEILNSAADILINSSEADEDGIRDEKAGINQNMDAVTEELQAKTGSLEEMTQRLREFQESFKNIEKKVEGAKHQLEIFDALGSQACSNKNLEKLRAQQEVLQALEPQVDYLRNFTQGLVEDAPDGSDASQLLHQAEVAQQEFLEVKQRVNSGCVMMENKLEGIGQFHCRVREMFSQLADLDDELDGMGAIGRDTDSLQSQIEDVRLFLNKIHVLKLDIEASEAECRHMLEEEGTLDLLGLKRELEALNKQCGKLTERGKARQEQLELTLGRVEDFYRKLKGLNDATTAAEEAEALQWVVGTEVEIINQQLADFKMFQKEQVDPLQMKLQQVNGLGQGLIQSAGKDCDVQGLEHDMEEINARWNTLNKKVAQRIAQLQEALLHCGKFQDALEPLLSWLADTEELIANQKPPSAEYKVVKAQIQEQKLLQRLLDDRKATVDMLQAEGGRIAQSAELADREKITGQLESLESRWTELLSKAAARQKQLEDILVLAKQFHETAEPISDFLSVTEKKLANSEPVGTQTAKIQQQIIRHKALEEDIENHATDVHQAVKIGQSLSSLTSPAEQGVLSEKIDSLQARYSEIQDRCCRKAALLDQALSNARLFGEDEVEVLNWLAEVEDKLSSVFVKDFKQDVLHRQHADHLALNEEIVNRKKNVDQAIKNGQALLKQTTGEEVLLIQEKLDGIKTRYADITVTSSKALRTLEQARQLATKFQSTYEELTGWLREVEEELATSGGQSPTGEQIPQFQQRQKELKKEVMEHRLVLDTVNEVSRALLELVPWRAREGLDKLVSDANEQYKLVSDTIGQRVDEIDAAIQRSQQYEQAADAELAWVAETKRKLMALGPIRLEQDQTTAQLQVQKAFSIDIIRHKDSMDELFSHRSEIFGTCGEEQKTVLQEKTESLIQQYEAISLLNSERYARLERAQVLVNQFWETYEELSPWIEETRALIAQLPSPAIDHEQLRQQQEEMRQLRESIAEHKPHIDKLLKIGPQLKELNPEEGEMVEEKYQKAENMYAQIKEEVRQRALALDEAVSQSTQITEFHDKIEPMLETLENLSSRLRMPPLIPAEVDKIRECISDNKSATVELEKLQPSFEALKRRGEELIGRSQGADKDLAAKEIQDKLDQMVFFWEDIKARAEEREIKFLDVLELAEKFWYDMAALLTTIKDTQDIVHDLESPGIDPSIIKQQVEAAETIKEETDGLHEELEFIRILGADLIFACGETEKPEVRKSIDEMNNAWENLNKTWKERLEKLEDAMQAAVQYQDTLQAMFDWLDNTVIKLCTMPPVGTDLNTVKDQLNEMKEFKVEVYQQQIEMEKLNHQGELMLKKATDETDRDIIREPLTELKHLWENLGEKIAHRQHKLEGALLALGQFQHALEELMSWLTHTEELLDAQRPISGDPKVIEVELAKHHVLKNDVLAHQATVETVNKAGNELLESSAGDDASSLRSRLEAMNQDCTSHLEAARE

SEQ ID NO: 860496 - protein, 4308 aa, Homo sapiens; identical to SEQ ID NO: 860495

SEQ ID NO: 860497 - protein, 4308 aa, Homo sapiens; identical to SEQ ID NO: 860495

SEQ ID NO: 860498 - protein, 4368 aa, Homo sapiens
MFPVLWAGIPWRDVGSLQPLPPGFKQFCTSASRVAVITDERDRVQKKTFTKWVNKHLMKVRKHINDLYEDLRDGHNLISLLEVLSGIKLPREKGRMRFHRLQNVQIALDFLKQRQVKLVNIRNDDITDGNPKLTLGLIWTIILHFQISDIYISGESGDMSAKEKLLLWTQKVTAGYTGIKCTNFSSCWSDGKMFNALIHRYRPDLVDMERVQIQSNRENLEQAFEVAERLGVTRLLDAEDVDVPSPDEKSVITYVSSIYDAFPKVPEGGEGISATEVDSRWQEYQSRVDSLIPWIKQHTILMSDKTFPQNPVELKALYNQYIHFKETEILAKEREKGRIEELYKLLEVWIEFGRIKLPQGYHPNDVEEEWGKLIIEMLEREKSLRPAVERLELLLQIANKIQNGALNCEEKLTLAKNTLQADAAHLESGQPVQCESDVIMYIQECEGLIRQLQVDLQILRDENYYQLEELAFRVMRLQDELVTLRLECTNLYRKGHFTSLELVPPSTLTTTHLKAEPLTKATHSSSTSWFRKPMTRAELVAISSSEDEGNLRFVYELLSWVEEMQMKLERAEWGNDLPSVELQLETQQHIHTSVEELGSSVKEARLYEGKMSQNFHTSYAETLGKLETQYCKLKETSSFRMRHLQSLHKFVSRATAELIWLNEKEEEELAYDWSDNNSNISAKRNYFSELTMELEEKQDVFRSLQDTAELLSLENHPAKQTVEAYSAAVQSQLQWMKQLCLCVEQHVKENTAYFQFFSDARELESFLRNLQDSIKRKYSCDHNTSLSRLEDLLQDSMDEKEQLIQSKSSVASLVGRSKTIVQLKPRSPDHVLKNTISVKAVCDYRQIEITICKNDECVLEDNSQRTKWKVISPTGNEAMVPSVCFLIPPPNKDAIEMASRVEQSYQKVMALWHQLHVNTKSLISWNYLRKDLDLVQTWNLEKLRSSAPGECHQIMKNLQAHYEDFLQDSRDSVLFSVADRLRLEEEVEACKARFQHLMKSMENEDKEETVAKMYISELKNIRLRLEEYEQRVVKRIQSLASSRTDRDAWQDNALRIAEQEHTQEDLQQLRSDLDAVSMKCDSFLHQSPSSSSVPTLRSELNLLVEKMDHVYGLSTVYLNKLKTVDVIVRSIQDAELLVKGYEIKLSQEEVVLADLSALEAHWSTLRHWLSDVKDKNSVFSVLDEEIAKAKVVAEQMSRLTPERNLDLERYQEKGSQLQERWHRVIAQLEIRQSELESIQEVLGDYRACHGTLIKWIEETTAQQEMMKPGQAEDSRVLSEQLSQQTALFAEIERNQTKLDQCQKFSQQYSTIVKDYELQLMTYKAFVESQQKSPGKRRRMLSSSDAITQEFMDLRTRYTALVTLTTQHVKYISDALRRLEEEEKVVEEEKQEHVEKVKELLGWVSTLARNTQGKATSSETKESTDIEKAILEQQVLSEELTTKKEQVSEAIKTSQIFLAKHGHKLSEKEKKQISEQLNALNKAYHDLCDGSANQLQQLQSQLAHQTEQKTLQKQQNTCHQQLEDLCSWVGQAERALAGHQGRTTQQDLSALQKNQSDLKDLQDDIQNRATSFATVVKDIEGFMEENQTKLSPRELTALREKLHQAKEQYEALQEETRVAQKELEEAVTSALQQETEKSKAAKELAENKKKIDALLDWVTSVGSSGGQLLTNLPGMEQLSGASLEKGALDTTDGYMGVNQAPEKLDKQCEMMKARHQELLSQQQNFILATQSAQAFLDQHGHNLTPEEQQMLQQKLGELKEQYSTSLAQSEAELKQVQTLQDELQKFLQDHKEFESWLERSEKELENMHKGGSSPETLPSLLKRQGSFSEDVISHKGDLRFVTISGQKVLDMENSFKEGKEPSEIGNLVKDKLKDATERYTALHSKCTRLGSHLNMLLGQYHQFQNSADSLQAWMQACEANVEKLLSDTVASDPGVLQEQLATTKQLQEELAEHQVPVEKLQKVARDIMEIEGEPAPDHRHVQETTDSILSHFQSLSYSLAERSSLLQKAIAQSQSVQESLESLLQSIGEVEQNLEGKQVSSLSSGVIQEALATNMKLKQDIARQKSSLEATREMVTRFMETADSTTAAVLQGKLAEVSQRFEQLCLQQQEKESSLKKLLPQAEMFEHLSGKLQQFMENKSRMLASGNQPDQDITHFFQQIQELNLEMEDQQENLDTLEHLVTELSSCGFALDLCQHQDRVQNLRKDFTELQKTVKEREKDASSCQEQLDEFRKLVRTFQKWLKETEGSIPPTETSMSAKELEKQIEHLKSLLDDWASKGTLVEEINCKGTSLENLIMEITAPDSQGKTDLTEIQCDMSDVNLKYEKLGGVLHERQESLQAILNRMEEVHKEANSVLQWLESKEEVLKSMDAMSSPTKTETVKAQAESNKAFLAELEQNSPKIQKVKEALAGLLVTYPNSQEAENWKKIQEELNSRWERATEVTVARQRQLEESASHLACFQAAESQLRPWLMEKELMMGVLGPLSIDPNMLNAQKQQVQFMLKEFEARRQQHEQLNEAAQGILTGPGDVSLSTSQVQKELQSINQKWVELTDKLNSRSSQIDQAIVKSTQYQELLQDLSEKVRAVGQRLSVQSAISTQPEAVKQQLEETSEIRSDLEQLDHEVKEAQTLCDELSVLIGEQYLKDELKKRLETVALPLQGLEDLAADRINRLQAALASTQQFQQMFDELRTWLDDKQSQQAKNCPISAKLERLQSQLQENEEFQKSLNQHSGSYEVIVAEGESLLLSVPPGEEKRTLQNQLVELKNHWEELSKKTADRQSRLKDCMQKAQKYQWHVEDLVPWIEDCKAKMSELRVTLDPVQLESSLLRSKAMLNEVEKRRSLLEILNSAADILINSSEADEDGIRDEKAGINQNMDAVTEELQAKTGSLEEMTQRLREFQESFKNIEKKVEGAKHQLEIFDALGSQACSNKNLEKLRAQQEVLQALEPQVDYLRNFTQGLVEDAPDGSDASQLLHQAEVAQQEFLEVKQRVNSGCVMMENKLEGIGQFHCRVREMFSQLADLDDELDGMGAIGRDTDSLQSQIEDVRLFLNKIHVLKLDIEASEAECRHMLEEEGTLDLLGLKRELEALNKQCGKLTERGKARQEQLELTLGRVEDFYRKLKGLNDATTAAEEAEALQWVVGTEVEIINQQLADFKMFQKEQVDPLQMKLQQVNGLGQGLIQSAGKDCDVQGLEHDMEEINARWNTLNKKVAQRIAQLQEALLHCGKFQDALEPLLSWLADTEELIANQKPPSAEYKVVKAQIQEQKLLQRLLDDRKATVDMLQAEGGRIAQSAELADREKITGQLESLESRWTELLSKAAARQKQLEDILVLAKQFHETAEPISDFLSVTEKKLANSEPVGTQTAKIQQQIIRHKALEEDIENHATDVHQAVKIGQSLSSLTSPAEQGVLSEKIDSLQARYSEIQDRCCRKAALLDQALSNARLFGEDEVEVLNWLAEVEDKLSSVFVKDFKQDVLHRQHADHLALNEEIVNRKKNVDQAIKNGQALLKQTTGEEVLLIQEKLDGIKTRYADITVTSSKALRTLEQARQLATKFQSTYEELTGWLREVEEELATSGGQSPTGEQIPQFQQRQKELKKEVMEHRLVLDTVNEVSRALLELVPWRAREGLDKLVSDANEQYKLVSDTIGQRVDEIDAAIQRSQQYEQAADAELAWVAETKRKLMALGPIRLEQDQTTAQLQVQKAFSIDIIRHKDSMDELFSHRSEIFGTCGEEQKTVLQEKTESLIQQYEAISLLNSERYARLERAQVLVNQFWETYEELSPWIEETRALIAQLPSPAIDHEQLRQQQEEMRQLRESIAEHKPHIDKLLKIGPQLKELNPEEGEMVEEKYQKAENMYAQIKEEVRQRALALDEAVSQSTQITEFHDKIEPMLETLENLSSRLRMPPLIPAEVDKIRECISDNKSATVELEKLQPSFEALKRRGEELIGRSQGADKDLAAKEIQDKLDQMVFFWEDIKARAEEREIKFLDVLELAEKFWYDMAALLTTIKDTQDIVHDLESPGIDPSIIKQQVEAAETIKEETDGLHEELEFIRILGADLIFACGETEKPEVRKSIDEMNNAWENLNKTWKERLEKLEDAMQAAVQYQDTLQAMFDWLDNTVIKLCTMPPVGTDLNTVKDQLNEMKEFKVEVYQQQIEMEKLNHQGELMLKKATDETDRDIIREPLTELKHLWENLGEKIAHRQHKLEGALLALGQFQHALEELMSWLTHTEELLDAQRPISGDPKVIEVELAKHHVLKNDVLAHQATVETVNKAGNELLESSAGDDASSLRSRLEAMNQDCYVTFRGSERVAESRSELHMPQCPASYAMLVYSLVAAVQWRASFLHLSPQEDFLKLLGNSLIHIWNSIPS

SEQ ID NO: 860499 - protein, 743 aa, Homo sapiens
RGSHPTVLLGDLDLVTELMDAHKVFQKELGKRTGTVQVLKRSGRELIENSRDDTTWVKGQLQELSTRWDTVCKLSVSKQSRLEQALKQAEVFRDTVHMLLEWLSEAEQTLRFRGALPDDTEALQSLIDTHKEFMKKVEEKRVDVNSAVAMGEVILAVCHPDCITTIKHWITIIRARFEEVLTWAKQHQQRLETALSELVANAELLEELLAWIQWAETTLIQRDQEPIPQNIDRVKALIAEHQTFMEEMTRKQPDVDRVTKTYKRKNIEPTHAPFIEKSRSGGRKSLSQPTPPPMPILSQSEAKNPRINQLSARWQQVWLLALERQRKLNDALDRLEELKEFANFDFDVWRKKYMRWMNHKKSRVMDFFRRIDKDQDGKITRQEFIDGILASKFPTTKLEMTAVADIFDRDGDGYIDYYEFVAALHPNKDAYRPTTDADKIEDEVTRQVAQCKCAKRFQVEQIGENKYRFGDSQQLRLVRILRSTVMVRVGGGWMALDEFLVKNDPCRARGRTNIELREKFILPEGASQGMTPFRSRGRRSKPSSRAASPTRSSSSASQSNHSCTSMPSSPATPASGTKTSLQFSRCYDKPWLVNSKAGTPIRDSHSPDLQLPTPEVIPSSGSKLKRPTPTFHSSRTSLAGDTSNSSSPASTGAKTNRADPKKSASRPGSRAGSRAGSRASSRRGSDASDFDLLETQSACSDTSESSAAGGQGNSRRGLNKPSKIPTMSKKTTTASPRTPGPKR

SEQ ID NO: 860500 - protein, 258 aa, Homo sapiens
LQDLIVICNQVQQSGENKYRFGDSQQLRLVRILRSTVMVRVGGGWMALDEFLVKNDPCRARGRTNIELREKFILPEGASQGMTPFRSRGRRSKPSSRAASPTRSSSSASQSNHSCTSMPSSPATPASGTKVIPSSGSKLKRPTPTFHSSRTSLAGDTSNSSSPASTGAKTNRADPKKSASRPGSRAGSRAGSRASSRRGSDASDFDLLETQSACSDTSESSAAGGQGNSRRGLNKPSKIPTMSKKTTTASPRTPGPKR

SEQ ID NO: 860501 - protein, 4308 aa, Homo sapiens; identical to SEQ ID NO: 860495

SEQ ID NO: 860502 - protein, 4308 aa, Homo sapiens; identical to SEQ ID NO: 860495

SEQ ID NO: 860503 - protein, 4308 aa, Homo sapiens; identical to SEQ ID NO: 860495

SEQ ID NO: 860504 - protein, 4308 aa, Homo sapiens; identical to SEQ ID NO: 860495

SEQ ID NO: 860505 - protein, 4308 aa, Homo sapiens; identical to SEQ ID NO: 860495

SEQ ID NO: 860506 - protein, 4308 aa, Homo sapiens; identical to SEQ ID NO: 860495

SEQ ID NO: 860507 - protein, 4068 aa, Homo sapiens
MFPVLWAGIPWRDVGSLQPLPPGFKQFCTSASRVAVITDERDRVQKKTFTKWVNKHLMKVRKHINDLYEDLRDGHNLISLLEVLSGIKLPREKGRMRFHRLQNVQIALDFLKQRQVKLVNIRNDDITDGNPKLTLGLIWTIILHFQISDIYISGESGDMSAKEKLLLWTQKVTAGYTGIKCTNFSSCWSDGKMFNALIHRYRPDLVDMERVQIQSNRENLEQAFEVAERLGVTRLLDAEDVDVPSPDEKSVITYVSSIYDAFPKVPEGGEGISATEVDSRWQEYQSRVDSLIPWIKQHTILMSDKTFPQNPVELKALYNQYIHFKETEILAKEREKGRIEELYKLLEVWIEFGRIKLPQGYHPNDVEEEWGKLIIEMLEREKSLRPAVERLELLLQIANKIQNGALNCEEKLTLAKNTLQADAAHLESGQPVQCESDVIMYIQECEGLIRQLQVDLQILRDENYYQLEELAFRVMRLQDELVTLRLECTNLYRKGHFTSLELVPPSTLTTTHLKAEPLTKATHSSSTSWFRKPMTRAELVAISSSEDEGNLRFVYELLSWVEEMQMKLERAEWGNDLPSVELQLETQQHIHTSVEELGSSVKEARLYEGKMSQNFHTSYAETLGKLETQYCKLKETSSFRMRHLQSLHKFVSRATAELIWLNEKEEEELAYDWSDNNSNISAKRNYFSELTMELEEKQDVFRSLQDTAELLSLENHPAKQTVEAYSAAVQSQLQWMKQLCLCVEQHVKENTAYFQFFSDARELESFLRNLQDSIKRKYSCDHNTSLSRLEDLLQDSMDEKEQLIQSKSSVASLVGRSKTIVQLKPRSPDHVLKNTISVKAVCDYRQIEITICKNDECVLEDNSQRTKWKVISPTGNEAMVPSVCFLIPPPNKDAIEMASRVEQSYQKVMALWHQLHVNTKSLISWNYLRKDLDLVQTWNLEKLRSSAPGECHQIMKNLQAHYEDFLQDSRDSVLFSVADRLRLEEEVEACKARFQHLMKSMENEDKEETVAKMYISELKNIRLRLEEYEQRVVKRIQSLASSRTDRDAWQDNALRIAEQEHTQEDLQQLRSDLDAVSMKCDSFLHQSPSSSSVPTLRSELNLLVEKMDHVYGLSTVYLNKLKTVDVIVRSIQDAELLVKGYEIKLSQEEVVLADLSALEAHWSTLRHWLSDVKDKNSVFSVLDEEIAKAKVVAEQMSRLTPERNLDLERYQEKGSQLQERWHRVIAQLEIRQSELESIQEVLGDYRACHGTLIKWIEETTAQQEMMKPGQAEDSRVLSEQLSQQTALFAEIERNQTKLDQCQKFSQQYSTIVKDYELQLMTYKAFVESQQKSPGKRRRMLSSSDAITQEFMDLRTRYTALVTLTTQHVKYISDALRRLEEEEKVVEEEKQEHVEKVKELLGWVSTLARNTQGKATSSETKESTDIEKAILEQQVLSEELTTKKEQVSEAIKTSQIFLAKHGHKLSEKEKKQISEQLNALNKAYHDLCDGSANQLQQLQSQLAHQTEQKTLQKQQNTCHQQLEDLCSWVGQAERALAGHQGRTTQQDLSALQKNQSDLKDLQDDIQNRATSFATVVKDIEGFMEENQTKLSPRELTALREKLHQAKEQYEALQEETRVAQKELEEAVTSALQQETEKSKAAKELAENKKKIDALLDWVTSVGSSGGQLLTNLPGMEQLSGASLEKGALDTTDGYMGVNQAPEKLDKQCEMMKARHQELLSQQQNFILATQSAQAFLDQHGHNLTPEEQQMLQQKLGELKEQYSTSLAQSEAELKQVQTLQDELQKFLQDHKEFESWLERSEKELENMHKGGSSPETLPSLLKRQGSFSEDVISHKGDLRFVTISGQKVLDMENSFKEGKEPSEIGNLVKDKLKDATERYTALHSKCTRLGSHLNMLLGQYHQFQNSADSLQAWMQACEANVEKLLSDTVASDPGVLQEQLATTKQLQEELAEHQVPVEKLQKVARDIMEIEGEPAPDHRHVQETTDSILSHFQSLSYSLAERSSLLQKAIAQSQSVQESLESLLQSIGEVEQNLEGKQVSSLSSGVIQEALATNMKLKQDIARQKSSLEATREMVTRFMETADSTTAAVLQGKLAEVSQRFEQLCLQQQEKESSLKKLLPQAEMFEHLSGKLQQFMENKSRMLASGNQPDQDITHFFQQIQELNLEMEDQQENLDTLEHLVTELSSCGFALDLCQHQDRVQNLRKDFTELQKTVKEREKDASSCQEQLDEFRKLVRTFQKWLKETEGSIPPTETSMSAKELEKQIEHLKSLLDDWASKGTLVEEINCKGTSLENLIMEITAPDSQGKTDLTEIQCDMSDVNLKYEKLGGVLHERQESLQAILNRMEEVHKEANSVLQWLESKEEVLKSMDAMSSPTKTETVKAQAESNKAFLAELEQNSPKIQKVKEALAGLLVTYPNSQEAENWKKIQEELNSRWERATEVTVARQRQLEESASHLACFQAAESQLRPWLMEKELMMGVLGPLSIDPNMLNAQKQQVQFMLKEFEARRQQHEQLNEAAQGILTGPGDVSLSTSQVQKELQSINQKWVELTDKLNSRSSQIDQAIVKSTQYQELLQDLSEKVRAVGQRLSVQSAISTQPEAVKQQLEETSEIRSDLEQLDHEVKEAQTLCDELSVLIGEQYLKDELKKRLETVALPLQGLEDLAADRINRLQAALASTQQFQQMFDELRTWLDDKQSQQAKNCPISAKLERLQSQLQENEEFQKSLNQHSGSYEVIVAEGESLLLSVPPGEEKRTLQNQLVELKNHWEELSKKTADRQSRLKDCMQKAQKYQWHVEDLVPWIEDCKAKMSELRVTLDPVQLESSLLRSKAMLNEVEKRRSLLEILNSAADILINSSEADEDGIRDEKAGINQNMDAVTEELQAKTGSLEEMTQRLREFQESFKNIEKKVEGAKHQLEIFDALGSQACSNKNLEKLRAQQEVLQALEPQVDYLRNFTQGLVEDAPDGSDASQLLHQAEVAQQEFLEVKQRVNSGCVMMENKLEGIGQFHCRVREMFSQLADLDDELDGMGAIGRDTDSLQSQIEDVRLFLNKIHVLKLDIEASEAECRHMLEEEGTLDLLGLKRELEALNKQCGKLTERGKARQEQLELTLGRVEDFYRKLKGLNDATTAAEEAEALQWVVGTEVEIINQQLADFKMFQKEQVDPLQMKLQQVNGLGQGLIQSAGKDCDVQGLEHDMEEINARWNTLNKKVAQRIAQLQEALLHCGKFQDALEPLLSWLADTEELIANQKPPSAEYKVVKAQIQEQKLLQRLLDDRKATVDMLQAEGGRIAQSAELADREKITGQLESLESRWTELLSKAAARQKQLEDILVLAKQFHETAEPISDFLSVTEKKLANSEPVGTQTAKIQQQIIRHKALEEDIENHATDVHQAVKIGQSLSSLTSPAEQGVLSEKIDSLQARYSEIQDRCCRKAALLDQALSNARLFGEDEVEVLNWLAEVEDKLSSVFVKDFKQDVLHRQHADHLALNEEIVNRKKNVDQAIKNGQALLKQTTGEEVLLIQEKLDGIKTRYADITVTSSKALRTLEQARQLATKFQSTYEELTGWLREVEEELATSGGQSPTGEQIPQFQQRQKELKKEVMEHRLVLDTVNEVSRALLELVPWRAREGLDKLVSDANEQYKLVSDTIGQRVDEIDAAIQRSQQYEQAADAELAWVAETKRKLMALGPIRLEQDQTTAQLQVQKAFSIDIIRHKDSMDELFSHRSEIFGTCGEEQKTVLQEKTESLIQQYEAISLLNSERYARLERAQVLVNQFWETYEELSPWIEETRALIAQLPSPAIDHEQLRQQQEEMRQLRESIAEHKPHIDKLLKIGPQLKELNPEEGEMVEEKYQKAENMYAQIKEEVRQRALALDEAVSQSTQITEFHDKIEPMLETLENLSSRLRMPPLIPAEVDKIRECISDNKSATVELEKLQPSFEALKRRGEELIGRSQGADKDLAAKEIQDKLDQMVFFWEDIKARAEEREIKFLDVLELAEKFWYDMAALLTTIKDTQDIVHDLESPGIDPSIIKQQVEAAETIKEETDGLHEELEFIRILGADLIFACGEMKLYQ

SEQ ID NO: 860508 - protein, 3724 aa, Homo sapiens
MFPVLWAGIPWRDVGSLQPLPPGFKQFCTSASRVAVITDERDRVQKKTFTKWVNKHLMKVRKHINDLYEDLRDGHNLISLLEVLSGIKLPREKGRMRFHRLQNVQIALDFLKQRQVKLVNIRNDDITDGNPKLTLGLIWTIILHFQISDIYISGESGDMSAKEKLLLWTQKVTAGYTGIKCTNFSSCWSDGKMFNALIHRYRPDLVDMERVQIQSNRENLEQAFEVAERLGVTRLLDAEDVDVPSPDEKSVITYVSSIYDAFPKVPEGGEGISATEVDSRWQEYQSRVDSLIPWIKQHTILMSDKTFPQNPVELKALYNQYIHFKETEILAKEREKGRIEELYKLLEVWIEFGRIKLPQGYHPNDVEEEWGKLIIEMLEREKSLRPAVERLELLLQIANKIQNGALNCEEKLTLAKNTLQADAAHLESGQPVQCESDVIMYIQECEGLIRQLQVDLQILRDENYYQLEELAFRVMRLQDELVTLRLECTNLYRKGHFTSLELVPPSTLTTTHLKAEPLTKATHSSSTSWFRKPMTRAELVAISSSEDEGNLRFVYELLSWVEEMQMKLERAEWGNDLPSVELQLETQQHIHTSVEELGSSVKEARLYEGKMSQNFHTSYAETLGKLETQYCKLKETSSFRMRHLQSLHKFVSRATAELIWLNEKEEEELAYDWSDNNSNISAKRNYFSELTMELEEKQDVFRSLQDTAELLSLENHPAKQTVEAYSAAVQSQLQWMKQLCLCVEQHVKENTAYFQFFSDARELESFLRNLQDSIKRKYSCDHNTSLSRLEDLLQDSMDEKEQLIQSKSSVASLVGRSKTIVQLKPRSPDHVLKNTISVKAVCDYRQIEITICKNDECVLEDNSQRTKWKVISPTGNEAMVPSVCFLIPPPNKDAIEMASRVEQSYQKVMALWHQLHVNTKSLISWNYLRKDLDLVQTWNLEKLRSSAPGECHQIMKNLQAHYEDFLQDSRDSVLFSVADRLRLEEEVEACKARFQHLMKSMENEDKEETVAKMYISELKNIRLRLEEYEQRVVKRIQSLASSRTDRDAWQDNALRIAEQEHTQEDLQQLRSDLDAVSMKCDSFLHQSPSSSSVPTLRSELNLLVEKMDHVYGLSTVYLNKLKTVDVIVRSIQDAELLVKGYEIKLSQEEVVLADLSALEAHWSTLRHWLSDVKDKNSVFSVLDEEIAKAKVVAEQMSRLTPERNLDLERYQEKGSQLQERWHRVIAQLEIRQSELESIQEVLGDYRACHGTLIKWIEETTAQQEMMKPGQAEDSRVLSEQLSQQTALFAEIERNQTKLDQCQKFSQQYSTIVKDYELQLMTYKAFVESQQKSPGKRRRMLSSSDAITQEFMDLRTRYTALVTLTTQHVKYISDALRRLEEEEKVVEEEKQEHVEKVKELLGWVSTLARNTQGKATSSETKESTDIEKAILEQQVLSEELTTKKEQVSEAIKTSQIFLAKHGHKLSEKEKKQISEQLNALNKAYHDLCDGSANQLQQLQSQLAHQTEQKTLQKQQNTCHQQLEDLCSWVGQAERALAGHQGRTTQQDLSALQKNQSDLKDLQDDIQNRATSFATVVKDIEGFMEENQTKLSPRELTALREKLHQAKEQYEALQEETRVAQKELEEAVTSALQQETEKSKAAKELAENKKKIDALLDWVTSVGSSGGQLLTNLPGMEQLSGASLEKGALDTTDGYMGVNQAPEKLDKQCEMMKARHQELLSQQQNFILATQSAQAFLDQHGHNLTPEEQQMLQQKLGELKEQYSTSLAQSEAELKQVQTLQDELQKFLQDHKEFESWLERSEKELENMHKGGSSPETLPSLLKRQGSFSEDVISHKGDLRFVTISGQKVLDMENSFKEGKEPSEIGNLVKDKLKDATERYTALHSKCTRLGSHLNMLLGQYHQFQNSADSLQAWMQACEANVEKLLSDTVASDPGVLQEQLATTKQLQEELAEHQVPVEKLQKVARDIMEIEGEPAPDHRHVQETTDSILSHFQSLSYSLAERSSLLQKAIAQSQSVQESLESLLQSIGEVEQNLEGKQVSSLSSGVIQEALATNMKLKQDIARQKSSLEATREMVTRFMETADSTTAAVLQGKLAEVSQRFEQLCLQQQEKESSLKKLLPQAEMFEHLSGKLQQFMENKSRMLASGNQPDQDITHFFQQIQELNLEMEDQQENLDTLEHLVTELSSCGFALDLCQHQDRVQNLRKDFTELQKTVKEREKDASSCQEQLDEFRKLVRTFQKWLKETEGSIPPTETSMSAKELEKQIEHLKSLLDDWASKGTLVEEINCKGTSLENLIMEITAPDSQGKTDLTEIQCDMSDVNLKYEKLGGVLHERQESLQAILNRMEEVHKEANSVLQWLESKEEVLKSMDAMSSPTKTETVKAQAESNKAFLAELEQNSPKIQKVKEALAGLLVTYPNSQEAENWKKIQEELNSRWERATEVTVARQRQLEESASHLACFQAAESQLRPWLMEKELMMGVLGPLSIDPNMLNAQKQQVQFMLKEFEARRQQHEQLNEAAQGILTGPGDVSLSTSQVQKELQSINQKWVELTDKLNSRSSQIDQAIVKSTQYQELLQDLSEKVRAVGQRLSVQSAISTQPEAVKQQLEETSEIRSDLEQLDHEVKEAQTLCDELSVLIGEQYLKDELKKRLETVALPLQGLEDLAADRINRLQAALASTQQFQQMFDELRTWLDDKQSQQAKNCPISAKLERLQSQLQENEEFQKSLNQHSGSYEVIVAEGESLLLSVPPGEEKRTLQNQLVELKNHWEELSKKTADRQSRLKDCMQKAQKYQWHVEDLVPWIEDCKAKMSELRVTLDPVQLESSLLRSKAMLNEVEKRRSLLEILNSAADILINSSEADEDGIRDEKAGINQNMDAVTEELQAKTGSLEEMTQRLREFQESFKNIEKKVEGAKHQLEIFDALGSQACSNKNLEKLRAQQEVLQALEPQVDYLRNFTQGLVEDAPDGSDASQLLHQAEVAQQEFLEVKQRVNSGCVMMENKLEGIGQFHCRVREMFSQLADLDDELDGMGAIGRDTDSLQSQIEDVRLFLNKIHVLKLDIEASEAECRHMLEEEGTLDLLGLKRELEALNKQCGKLTERGKARQEQLELTLGRVEDFYRKLKGLNDATTAAEEAEALQWVVGTEVEIINQQLADFKMFQKEQVDPLQMKLQQVNGLGQGLIQSAGKDCDVQGLEHDMEEINARWNTLNKKVAQRIAQLQEALLHCGKFQDALEPLLSWLADTEELIANQKPPSAEYKVVKAQIQEQKLLQRLLDDRKATVDMLQAEGGRIAQSAELADREKITGQLESLESRWTELLSKAAARQKQLEDILVLAKQFHETAEPISDFLSVTEKKLANSEPVGTQTAKIQQQIIRHKALEEDIENHATDVHQAVKIGQSLSSLTSPAEQGVLSEKIDSLQARYSEIQDRCCRKAALLDQALSNARLFGEDEVEVLNWLAEVEDKLSSVFVKDFKQDVLHRQHADHLALNEEIVNRKKNVDQAIKNGQALLKQTTGEEVLLIQEKLDGIKTRYADITVTSSKALRTLEQARQLATKFQSTYEELTGWLREVEEELATSGGQSPTGEQIPQFQQRQKELKKEVMEHRLVLDTVNEVSRALLELVPWRAREGLDKLVSDANEQYKLVSDTIGQRVDEIDAAIQRSQQEILLCLLLALFASGLIHRVCVTTCFIFSMVGLYYINKISSTLYQAAAPVLTPAKVTGKSKKRN

SEQ ID NO: 860509 - protein, 843 aa, Homo sapiens
MFPVLWAGIPWRDVGSLQPLPPGFKQFCTSASRVAVITDERDRVQKKTFTKWVNKHLMKVRKHINDLYEDLRDGHNLISLLEVLSGIKLPREKGRMRFHRLQNVQIALDFLKQRQVKLVNIRNDDITDGNPKLTLGLIWTIILHFQISDIYISGESGDMSAKEKLLLWTQKVTAGYTGIKCTNFSSCWSDGKMFNALIHRYRPDLVDMERVQIQSNRENLEQAFEVAERLGVTRLLDAEDVDVPSPDEKSVITYVSSIYDAFPKVPEGGEGISATEVDSRWQEYQSRVDSLIPWIKQHTILMSDKTFPQNPVELKALYNQYIHFKETEILAKEREKGRIEELYKLLEVWIEFGRIKLPQGYHPNDVEEEWGKLIIEMLEREKSLRPAVERLELLLQIANKIQNGALNCEEKLTLAKNTLQADAAHLESGQPVQCESDVIMYIQECEGLIRQLQVDLQILRDENYYQLEELAFRVMRLQDELVTLRLECTNLYRKGHFTSLELVPPSTLTTTHLKAEPLTKATHSSSTSWFRKPMTRAELVAISSSEDEGNLRFVYELLSWVEEMQMKLERAEWGNDLPSVELQLETQQHIHTSVEELGSSVKEARLYEGKMSQNFHTSYAETLGKLETQYCKLKETSSFRMRHLQSLHKFVSRATAELIWLNEKEEEELAYDWSDNNSNISAKRNYFSELTMELEEKQDVFRSLQDTAELLSLENHPAKQTVEAYSAAVQSQLQWMKQLCLCVEQHVKENTAYFQFFSDARELESFLRNLQDSIKRKYSCDHNTSLSRLEDLLQDSMVGVASVGMITSEKESKPYQLLLFISLKAPGQWAIVVIKFGLHSNRV

SEQ ID NO: 860510 - protein, 49 aa, Homo sapiens
MKNLQAHYEDFLQDSRDSVLFSVADRLRLEEEVEACKARFQHLMKSMEN

SEQ ID NO: 860511 - protein, 4344 aa, Homo sapiens; identical to SEQ ID NO: 860491

SEQ ID NO: 860512 - protein, 4344 aa, Homo sapiens; identical to SEQ ID NO: 860491

SEQ ID NO: 860513 - protein, 4344 aa, Homo sapiens; identical to SEQ ID NO: 860491

SEQ ID NO: 860514 - protein, 2255 aa, Homo sapiens
GEVQLASHGECPGTLLNILQCTGESSYNQQLADFKMFQKEQVDPLQMKLQQVNGLGQGLIQSAGKDCDVQGLEHDMEEINARWNTLNKKVAQRIAQLQEALLHCGKFQDALEPLLSWLADTEELIANQKPPSAEYKVVKAQIQEQKLLQRLLDDRKATVDMLQAEGGRIAQSAELADREKITGQLESLESRWTELLSKAAARQKQLEDILVLAKQFHETAEPISDFLSVTEKKLANSEPVGTQTAKIQQQIIRHKALEEDIENHATDVHQAVKIGQSLSSLTSPAEQGVLSEKIDSLQARYSEIQDRCCRKAALLDQALSNARLFGEDEVEVLNWLAEVEDKLSSVFVKDFKQDVLHRQHADHLALNEEIVNRKKNVDQAIKNGQALLKQTTGEEVLLIQEKLDGIKTRYADITVTSSKALRTLEQARQLATKFQSTYEELTGWLREVEEELATSGGQSPTGEQIPQFQQRQKELKKEVMEHRLVLDTVNEVSRALLELVPWRAREGLDKLVSDANEQYKLVSDTIGQRVDEIDAAIQRSQQYEQAADAELAWVAETKRKLMALGPIRLEQDQTTAQLQVQKAFSIDIIRHKDSMDELFSHRSEIFGTCGEEQKTVLQEKTESLIQQYEAISLLNSERYARLERAQVLVNQFWETYEELSPWIEETRALIAQLPSPAIDHEQLRQQQEEMRQLRESIAEHKPHIDKLLKIGPQLKELNPEEGEMVEEKYQKAENMYAQIKEEVRQRALALDEAVSQSTQITEFHDKIEPMLETLENLSSRLRMPPLIPAEVDKIRECISDNKSATVELEKLQPSFEALKRRGEELIGRSQGADKDLAAKEIQDKLDQMVFFWEDIKARAEEREIKFLDVLELAEKFWYDMAALLTTIKDTQDIVHDLESPGIDPSIIKQQVEAAETIKEETDGLHEELEFIRILGADLIFACGETEKPEVRKSIDEMNNAWENLNKTWKERLEKLEDAMQAAVQYQDTLQAMFDWLDNTVIKLCTMPPVGTDLNTVKDQLNEMKEFKVEVYQQQIEMEKLNHQGELMLKKATDETDRDIIREPLTELKHLWENLGEKIAHRQHKLEGALLALGQFQHALEELMSWLTHTEELLDAQRPISGDPKVIEVELAKHHVLKNDVLAHQATVETVNKAGNELLESSAGDDASSLRSRLEAMNQCWESVLQKTEEREQQLQSTLQQAQGFHSEIEDFLLELTRMESQLSASKPTGGLPETAREQLDTHMELYSQLKAKEETYNQLLDKGRLMLLSRDDSGSGSKTEQSVALLEQKWHVVSSKMEERKSKLEEALNLATEFQNSLQEFINWLTLAEQSLNIASPPSLILNTVLSQIEEHKVFANEVNAHRDQIIELDQTGNQLKFLSQKQDVVLIKNLLVSVQSRWEKVVQRSIERGRSLDDARKRAKQFHEAWKKLIDWLEDAESHLDSELEISNDPDKIKLQLSKHKEFQKTLGGKQPVYDTTIRTGRALKEKTLLPEDTQKLDNFLGEVRDKWDTVCGKSVERQHKLEEALLFSGQFMDALQALVDWLYKVEPQLAEDQPVHGDLDLVMNLMDAHKVFQKELGKRTGTVQVLKRSGRELIENSRDDTTWVKGQLQELSTRWDTVCKLSVSKQSRLEQALKQAEVFRDTVHMLLEWLSEAEQTLRFRGALPDDTEALQSLIDTHKEFMKKVEEKRVDVNSAVAMGEVILAVCHPDCITTIKHWITIIRARFEEVLTWAKQHQQRLETALSELVANAELLEELLAWIQWAETTLIQRDQEPIPQNIDRVKALIAEHQTFMEEMTRKQPDVDRVTKTYKRKNIEPTHAPFIEKSRSGGRKSLSQPTPPPMPILSQSEAKNPRINQLSARWQQVWLLALERQRKLNDALDRLEELKEFANFDFDVWRKKYMRWMNHKKSRVMDFFRRIDKDQDGKITRQEFIDGILASKFPTTKLEMTAVADIFDRDGDGYIDYYEFVAALHPNKDAYRPTTDADKIEDEVTRQVAQCKCAKRFQVEQIGENKYRFGDSQQLRLVRILRSTVMVRVGGGWMALDEFLVKNDPCRARGRTNIELREKFILPEGASQGMTPFRSRGRRSKPSSRAASPTRSSSSASQSNHSCTSMPSSPATPASGTKVIPSSGSKLKRPTPTFHSSRTSLAGDTSNSSSPASTGAKTNRADPKKSASRPGSRAGSRAGSRASSRRGSDASDFDLLETQSACSDTSESSAAGGQGNSRRGLNKPSKIPTMSKKTTTASPRTPGPKR

SEQ ID NO: 860515 - protein, 4308 aa, Homo sapiens; identical to SEQ ID NO: 860495

SEQ ID NO: 860516 - protein, 4308 aa, Homo sapiens; identical to SEQ ID NO: 860495

SEQ ID NO: 860517 - protein, 4308 aa, Homo sapiens; identical to SEQ ID NO: 860495

SEQ ID NO: 860518 - protein, 4308 aa, Homo sapiens; identical to SEQ ID NO: 860495

SEQ ID NO: 860519 - protein, 4308 aa, Homo sapiens; identical to SEQ ID NO: 860495

SEQ ID NO: 860520 - protein, 4308 aa, Homo sapiens; identical to SEQ ID NO: 860495

SEQ ID NO: 860521 - protein, 4308 aa, Homo sapiens; identical to SEQ ID NO: 860495

SEQ ID NO: 860522 - protein, 4308 aa, Homo sapiens; identical to SEQ ID NO: 860495

SEQ ID NO: 860523 - protein, 2315 aa, Homo sapiens
MFPVLWAGIPWRDVGSLQPLPPGFKQFCTSASRVAVITDERDRVQKKTFTKWVNKHLMKVRKHINDLYEDLRDGHNLISLLEVLSGIKLPREKGRMRFHRLQNVQIALDFLKQRQVKLVNIRNDDITDGNPKLTLGLIWTIILHFQISDIYISGESGDMSAKEKLLLWTQKVTAGYTGIKCTNFSSCWSDGKMFNALIHRYRPDLVDMERVQIQSNRENLEQAFEVAERLGVTRLLDAEDVDVPSPDEKSVITYVSSIYDAFPKVPEGGEGISATEVDSRWQEYQSRVDSLIPWIKQHTILMSDKTFPQNPVELKALYNQYIHFKETEILAKEREKGRIEELYKLLEVWIEFGRIKLPQGYHPNDVEEEWGKLIIEMLEREKSLRPAVERLELLLQIANKIQNGALNCEEKLTLAKNTLQADAAHLESGQPVQCESDVIMYIQECEGLIRQLQVDLQILRDENYYQLEELAFRVMRLQDELVTLRLECTNLYRKGHFTSLELVPPSTLTTTHLKAEPLTKATHSSSTSWFRKPMTRAELVAISSSEDEGNLRFVYELLSWVEEMQMKLERAEWGNDLPSVELQLETQQHIHTSVEELGSSVKEARLYEGKMSQNFHTSYAETLGKLETQYCKLKETSSFRMRHLQSLHKFVSRATAELIWLNEKEEEELAYDWSDNNSNISAKRNYFSELTMELEEKQDVFRSLQDTAELLSLENHPAKQTVEAYSAAVQSQLQWMKQLCLCVEQHVKENTAYFQFFSDARELESFLRNLQDSIKRKYSCDHNTSLSRLEDLLQDSMDEKEQLIQSKSSVASLVGRSKTIVQLKPRSPDHVLKNTISVKAVCDYRQIEITICKNDECVLEDNSQRTKWKVISPTGNEAMVPSVCFLIPPPNKDAIEMASRVEQSYQKVMALWHQLHVNTKSLISWNYLRKDLDLVQTWNLEKLRSSAPGECHQIMKNLQAHYEDFLQDSRDSVLFSVADRLRLEEEVEACKARFQHLMKSMENEDKEETVAKMYISELKNIRLRLEEYEQRVVKRIQSLASSRTDRDAWQDNALRIAEQEHTQEDLQQLRSDLDAVSMKCDSFLHQSPSSSSVPTLRSELNLLVEKMDHVYGLSTVYLNKLKTVDVIVRSIQDAELLVKGYEIKLSQEEVVLADLSALEAHWSTLRHWLSDVKDKNSVFSVLDEEIAKAKVVAEQMSRLTPERNLDLERYQEKGSQLQERWHRVIAQLEIRQSELESIQEVLGDYRACHGTLIKWIEETTAQQEMMKPGQAEDSRVLSEQLSQQTALFAEIERNQTKLDQCQKFSQQYSTIVKDYELQLMTYKAFVESQQKSPGKRRRMLSSSDAITQEFMDLRTRYTALVTLTTQHVKYISDALRRLEEEEKVVEEEKQEHVEKVKELLGWVSTLARNTQGKATSSETKESTDIEKAILEQQVLSEELTTKKEQVSEAIKTSQIFLAKHGHKLSEKEKKQISEQLNALNKAYHDLCDGSANQLQQLQSQLAHQTEQKTLQKQQNTCHQQLEDLCSWVGQAERALAGHQGRTTQQDLSALQKNQSDLKDLQDDIQNRATSFATVVKDIEGFMEENQTKLSPRELTALREKLHQAKEQYEALQEETRVAQKELEEAVTSALQQETEKSKAAKELAENKKKIDALLDWVTSVGSSGGQLLTNLPGMEQLSGASLEKGALDTTDGYMGVNQAPEKLDKQCEMMKARHQELLSQQQNFILATQSAQAFLDQHGHNLTPEEQQMLQQKLGELKEQYSTSLAQSEAELKQVQTLQDELQKFLQDHKEFESWLERSEKELENMHKGGSSPETLPSLLKRQGSFSEDVISHKGDLRFVTISGQKVLDMENSFKEGKEPSEIGNLVKDKLKDATERYTALHSKCTRLGSHLNMLLGQYHQFQNSADSLQAWMQACEANVEKLLSDTVASDPGVLQEQLATTKQLQEELAEHQVPVEKLQKVARDIMEIEGEPAPDHRHVQETTDSILSHFQSLSYSLAERSSLLQKAIAQSQSVQESLESLLQSIGEVEQNLEGKQVSSLSSGVIQEALATNMKLKQDIARQKSSLEATREMVTRFMETADSTTAAVLQGKLAEVSQRFEQLCLQQQEKESSLKKLLPQAEMFEHLSGKLQQFMENKSRMLASGNQPDQDITHFFQQIQELNLEMEDQQENLDTLEHLVTELSSCGFALDLCQHQDRVQNLRKDFTELQKTVKEREKDASSCQEQLDEFRKLVRTFQKWLKETEGSIPPTETSMSAKELEKQIEHLKSLLDDWASKGTLVEEINCKGTSLENLIMEITAPDSQGKTGEYRLFKI

SEQ ID NO: 860524 - protein, 4308 aa, Homo sapiens; identical to SEQ ID NO: 860495

SEQ ID NO: 860525 - protein, 3893 aa, Homo sapiens
MFPVLWAGIPWRDVGSLQPLPPGFKQFCTSASRVAVITDERDRVQKKTFTKWVNKHLMKVRKHINDLYEDLRDGHNLISLLEVLSGIKLPREKGRMRFHRLQNVQIALDFLKQRQVKLVNIRNDDITDGNPKLTLGLIWTIILHFQISDIYISGESGDMSAKEKLLLWTQKVTAGYTGIKCTNFSSCWSDGKMFNALIHRYRPDLVDMERVQIQSNRENLEQAFEVAERLGVTRLLDAEDVDVPSPDEKSVITYVSSIYDAFPKVPEGGEGISATEVDSRWQEYQSRVDSLIPWIKQHTILMSDKTFPQNPVELKALYNQYIHFKETEILAKEREKGRIEELYKLLEVWIEFGRIKLPQGYHPNDVEEEWGKLIIEMLEREKSLRPAVERLELLLQIANKIQNGALNCEEKLTLAKNTLQADAAHLESGQPVQCESDVIMYIQECEGLIRQLQVDLQILRDENYYQLEELAFRVMRLQDELVTLRLECTNLYRKGHFTSLELVPPSTLTTTHLKAEPLTKATHSSSTSWFRKPMTRAELVAISSSEDEGNLRFVYELLSWVEEMQMKLERAEWGNDLPSVELQLETQQHIHTSVEELGSSVKEARLYEGKMSQNFHTSYAETLGKLETQYCKLKETSSFRMRHLQSLHKFVSRATAELIWLNEKEEEELAYDWSDNNSNISAKRNYFSELTMELEEKQDVFRSLQDTAELLSLENHPAKQTVEAYSAAVQSQLQWMKQLCLCVEQHVKENTAYFQFFSDARELESFLRNLQDSIKRKYSCDHNTSLSRLEDLLQDSMDEKEQLIQSKSSVASLVGRSKTIVQLKPRSPDHVLKNTISVKAVCDYRQIEITICKNDECVLEDNSQRTKWKVISPTGNEAMVPSVCFLIPPPNKDAIEMASRVEQSYQKVMALWHQLHVNTKSLISWNYLRKDLDLVQTWNLEKLRSSAPGECHQIMKNLQAHYEDFLQDSRDSVLFSVADRLRLEEEVEACKARFQHLMKSMENEDKEETVAKMYISELKNIRLRLEEYEQRVVKRIQSLASSRTDRDAWQDNALRIAEQEHTQEDLQQLRSDLDAVSMKCDSFLHQSPSSSSVPTLRSELNLLVEKMDHVYGLSTVYLNKLKTVDVIVRSIQDAELLVKGYEIKLSQEEVVLADLSALEAHWSTLRHWLSDVKDKNSVFSVLDEEIAKAKVVAEQMSRLTPERNLDLERYQEKGSQLQERWHRVIAQLEIRQSELESIQEVLGDYRACHGTLIKWIEETTAQQEMMKPGQAEDSRVLSEQLSQQTALFAEIERNQTKLDQCQKFSQQYSTIVKDYELQLMTYKAFVESQQKSPGKRRRMLSSSDAITQEFMDLRTRYTALVTLTTQHVKYISDALRRLEEEEKVVEEEKQEHVEKVKELLGWVSTLARNTQGKATSSETKESTDIEKAILEQQVLSEELTTKKEQVSEAIKTSQIFLAKHGHKLSEKEKKQISEQLNALNKAYHDLCDGSANQLQQLQSQLAHQTEQKTLQKQQNTCHQQLEDLCSWVGQAERALAGHQGRTTQQDLSALQKNQSDLKDLQDDIQNRATSFATVVKDIEGFMEENQTKLSPRELTALREKLHQAKEQYEALQEETRVAQKELEEAVTSALQQETEKSKAAKELAENKKKIDALLDWVTSVGSSGGQLLTNLPGMEQLSGASLEKGALDTTDGYMGVNQAPEKLDKQCEMMKARHQELLSQQQNFILATQSAQAFLDQHGHNLTPEEQQMLQQKLGELKEQYSTSLAQSEAELKQVQTLQDELQKFLQDHKEFESWLERSEKELENMHKGGSSPETLPSLLKRQGSFSEDVISHKGDLRFVTISGQKVLDMENSFKEGKEPSEIGNLVKDKLKDATERYTALHSKCTRLGSHLNMLLGQYHQFQNSADSLQAWMQACEANVEKLLSDTVASDPGVLQEQLATTKQLQEELAEHQVPVEKLQKVARDIMEIEGEPAPDHRHVQETTDSILSHFQSLSYSLAERSSLLQKAIAQSQSVQESLESLLQSIGEVEQNLEGKQVSSLSSGVIQEALATNMKLKQDIARQKSSLEATREMVTRFMETADSTTAAVLQGKLAEVSQRFEQLCLQQQEKESSLKKLLPQAEMFEHLSGKLQQFMENKSRMLASGNQPDQDITHFFQQIQELNLEMEDQQENLDTLEHLVTELSSCGFALDLCQHQDRVQNLRKDFTELQKTVKEREKDASSCQEQLDEFRKLVRTFQKWLKETEGSIPPTETSMSAKELEKQIEHLKSLLDDWASKGTLVEEINCKGTSLENLIMEITAPDSQGKTDLTEIQCDMSDVNLKYEKLGGVLHERQESLQAILNRMEEVHKEANSVLQWLESKEEVLKSMDAMSSPTKTETVKAQAESNKAFLAELEQNSPKIQKVKEALAGLLVTYPNSQEAENWKKIQEELNSRWERATEVTVARQRQLEESASHLACFQAAESQLRPWLMEKELMMGVLGPLSIDPNMLNAQKQQVQFMLKEFEARRQQHEQLNEAAQGILTGPGDVSLSTSQVQKELQSINQKWVELTDKLNSRSSQIDQAIVKSTQYQELLQDLSEKVRAVGQRLSVQSAISTQPEAVKQQLEETSEIRSDLEQLDHEVKEAQTLCDELSVLIGEQYLKDELKKRLETVALPLQGLEDLAADRINRLQAALASTQQFQQMFDELRTWLDDKQSQQAKNCPISAKLERLQSQLQENEEFQKSLNQHSGSYEVIVAEGESLLLSVPPGEEKRTLQNQLVELKNHWEELSKKTADRQSRLKDCMQKAQKYQWHVEDLVPWIEDCKAKMSELRVTLDPVQLESSLLRSKAMLNEVEKRRSLLEILNSAADILINSSEADEDGIRDEKAGINQNMDAVTEELQAKTGSLEEMTQRLREFQESFKNIEKKVEGAKHQLEIFDALGSQACSNKNLEKLRAQQEVLQALEPQVDYLRNFTQGLVEDAPDGSDASQLLHQAEVAQQEFLEVKQRVNSGCVMMENKLEGIGQFHCRVREMFSQLADLDDELDGMGAIGRDTDSLQSQIEDVRLFLNKIHVLKLDIEASEAECRHMLEEEGTLDLLGLKRELEALNKQCGKLTERGKARQEQLELTLGRVEDFYRKLKGLNDATTAAEEAEALQWVVGTEVEIINQQLADFKMFQKEQVDPLQMKLQQVNGLGQGLIQSAGKDCDVQGLEHDMEEINARWNTLNKKVAQRIAQLQEALLHCGKFQDALEPLLSWLADTEELIANQKPPSAEYKVVKAQIQEQKLLQRLLDDRKATVDMLQAEGGRIAQSAELADREKITGQLESLESRWTELLSKAAARQKQLEDILVLAKQFHETAEPISDFLSVTEKKLANSEPVGTQTAKIQQQIIRHKALEEDIENHATDVHQAVKIGQSLSSLTSPAEQGVLSEKIDSLQARYSEIQDRCCRKAALLDQALSNARLFGEDEVEVLNWLAEVEDKLSSVFVKDFKQDVLHRQHADHLALNEEIVNRKKNVDQAIKNGQALLKQTTGEEVLLIQEKLDGIKTRYADITVTSSKALRTLEQARQLATKFQSTYEELTGWLREVEEELATSGGQSPTGEQIPQFQQRQKELKKEVMEHRLVLDTVNEVSRALLELVPWRAREGLDKLVSDANEQYKLVSDTIGQRVDEIDAAIQRSQQYEQAADAELAWVAETKRKLMALGPIRLEQDQTTAQLQVQKAFSIDIIRHKDSMDELFSHRSEIFGTCGEEQKTVLQEKTESLIQQYEAISLLNSERYARLERAQVLVNQFWETYEELSPWIEETRALIAQLPSPAIDHEQLRQQQEEMRQLRESIAEHKPHIDKLLKIGPQLKELNPEEGEMVEEKYQKAENMYAQIKEEVRQRALALDEAVSQSTQVCVCLTLITLNCLLF

SEQ ID NO: 860526 - protein, 3525 aa, Homo sapiens
MFPVLWAGIPWRDVGSLQPLPPGFKQFCTSASRVAVITDERDRVQKKTFTKWVNKHLMKVRKHINDLYEDLRDGHNLISLLEVLSGIKLPREKGRMRFHRLQNVQIALDFLKQRQVKLVNIRNDDITDGNPKLTLGLIWTIILHFQISDIYISGESGDMSAKEKLLLWTQKVTAGYTGIKCTNFSSCWSDGKMFNALIHRYRPDLVDMERVQIQSNRENLEQAFEVAERLGVTRLLDAEDVDVPSPDEKSVITYVSSIYDAFPKVPEGGEGISATEVDSRWQEYQSRVDSLIPWIKQHTILMSDKTFPQNPVELKALYNQYIHFKETEILAKEREKGRIEELYKLLEVWIEFGRIKLPQGYHPNDVEEEWGKLIIEMLEREKSLRPAVERLELLLQIANKIQNGALNCEEKLTLAKNTLQADAAHLESGQPVQCESDVIMYIQECEGLIRQLQVDLQILRDENYYQLEELAFRVMRLQDELVTLRLECTNLYRKGHFTSLELVPPSTLTTTHLKAEPLTKATHSSSTSWFRKPMTRAELVAISSSEDEGNLRFVYELLSWVEEMQMKLERAEWGNDLPSVELQLETQQHIHTSVEELGSSVKEARLYEGKMSQNFHTSYAETLGKLETQYCKLKETSSFRMRHLQSLHKFVSRATAELIWLNEKEEEELAYDWSDNNSNISAKRNYFSELTMELEEKQDVFRSLQDTAELLSLENHPAKQTVEAYSAAVQSQLQWMKQLCLCVEQHVKENTAYFQFFSDARELESFLRNLQDSIKRKYSCDHNTSLSRLEDLLQDSMDEKEQLIQSKSSVASLVGRSKTIVQLKPRSPDHVLKNTISVKAVCDYRQIEITICKNDECVLEDNSQRTKWKVISPTGNEAMVPSVCFLIPPPNKDAIEMASRVEQSYQKVMALWHQLHVNTKSLISWNYLRKDLDLVQTWNLEKLRSSAPGECHQIMKNLQAHYEDFLQDSRDSVLFSVADRLRLEEEVEACKARFQHLMKSMENEDKEETVAKMYISELKNIRLRLEEYEQRVVKRIQSLASSRTDRDAWQDNALRIAEQEHTQEDLQQLRSDLDAVSMKCDSFLHQSPSSSSVPTLRSELNLLVEKMDHVYGLSTVYLNKLKTVDVIVRSIQDAELLVKGYEIKLSQEEVVLADLSALEAHWSTLRHWLSDVKDKNSVFSVLDEEIAKAKVVAEQMSRLTPERNLDLERYQEKGSQLQERWHRVIAQLEIRQSELESIQEVLGDYRACHGTLIKWIEETTAQQEMMKPGQAEDSRVLSEQLSQQTALFAEIERNQTKLDQCQKFSQQYSTIVKDYELQLMTYKAFVESQQKSPGKRRRMLSSSDAITQEFMDLRTRYTALVTLTTQHVKYISDALRRLEEEEKVVEEEKQEHVEKVKELLGWVSTLARNTQGKATSSETKESTDIEKAILEQQVLSEELTTKKEQVSEAIKTSQIFLAKHGHKLSEKEKKQISEQLNALNKAYHDLCDGSANQLQQLQSQLAHQTEQKTLQKQQNTCHQQLEDLCSWVGQAERALAGHQGRTTQQDLSALQKNQSDLKDLQDDIQNRATSFATVVKDIEGFMEENQTKLSPRELTALREKLHQAKEQYEALQEETRVAQKELEEAVTSALQQETEKSKAAKELAENKKKIDALLDWVTSVGSSGGQLLTNLPGMEQLSGASLEKGALDTTDGYMGVNQAPEKLDKQCEMMKARHQELLSQQQNFILATQSAQAFLDQHGHNLTPEEQQMLQQKLGELKEQYSTSLAQSEAELKQVQTLQDELQKFLQDHKEFESWLERSEKELENMHKGGSSPETLPSLLKRQGSFSEDVISHKGDLRFVTISGQKVLDMENSFKEGKEPSEIGNLVKDKLKDATERYTALHSKCTRLGSHLNMLLGQYHQFQNSADSLQAWMQACEANVEKLLSDTVASDPGVLQEQLATTKQLQEELAEHQVPVEKLQKVARDIMEIEGEPAPDHRHVQETTDSILSHFQSLSYSLAERSSLLQKAIAQSQSVQESLESLLQSIGEVEQNLEGKQVSSLSSGVIQEALATNMKLKQDIARQKSSLEATREMVTRFMETADSTTAAVLQGKLAEVSQRFEQLCLQQQEKESSLKKLLPQAEMFEHLSGKLQQFMENKSRMLASGNQPDQDITHFFQQIQELNLEMEDQQENLDTLEHLVTELSSCGFALDLCQHQDRVQNLRKDFTELQKTVKEREKDASSCQEQLDEFRKLVRTFQKWLKETEGSIPPTETSMSAKELEKQIEHLKSLLDDWASKGTLVEEINCKGTSLENLIMEITAPDSQGKTDLTEIQCDMSDVNLKYEKLGGVLHERQESLQAILNRMEEVHKEANSVLQWLESKEEVLKSMDAMSSPTKTETVKAQAESNKAFLAELEQNSPKIQKVKEALAGLLVTYPNSQEAENWKKIQEELNSRWERATEVTVARQRQLEESASHLACFQAAESQLRPWLMEKELMMGVLGPLSIDPNMLNAQKQQVQFMLKEFEARRQQHEQLNEAAQGILTGPGDVSLSTSQVQKELQSINQKWVELTDKLNSRSSQIDQAIVKSTQYQELLQDLSEKVRAVGQRLSVQSAISTQPEAVKQQLEETSEIRSDLEQLDHEVKEAQTLCDELSVLIGEQYLKDELKKRLETVALPLQGLEDLAADRINRLQAALASTQQFQQMFDELRTWLDDKQSQQAKNCPISAKLERLQSQLQENEEFQKSLNQHSGSYEVIVAEGESLLLSVPPGEEKRTLQNQLVELKNHWEELSKKTADRQSRLKDCMQKAQKYQWHVEDLVPWIEDCKAKMSELRVTLDPVQLESSLLRSKAMLNEVEKRRSLLEILNSAADILINSSEADEDGIRDEKAGINQNMDAVTEELQAKTGSLEEMTQRLREFQESFKNIEKKVEGAKHQLEIFDALGSQACSNKNLEKLRAQQEVLQALEPQVDYLRNFTQGLVEDAPDGSDASQLLHQAEVAQQEFLEVKQRVNSGCVMMENKLEGIGQFHCRVREMFSQLADLDDELDGMGAIGRDTDSLQSQIEDVRLFLNKIHVLKLDIEASEAECRHMLEEEGTLDLLGLKRELEALNKQCGKLTERGKARQEQLELTLGRVEDFYRKLKGLNDATTAAEEAEALQWVVGTEVEIINQQLADFKMFQKEQVDPLQMKLQQVNGLGQGLIQSAGKDCDVQGLEHDMEEINARWNTLNKKVAQRIAQLQEALLHCGKFQDALEPLLSWLADTEELIANQKPPSAEYKVVKAQIQEQKLLQRLLDDRKATVDMLQAEGGRIAQSAELADREKITGQLESLESRWTELLSKAAARQKQLEDILVLAKQFHETAEPISDFLSVTEKKLANSEPVGTQTAKIQQQIIRHKALEEDIENHATDVHQAVKIGQSLSSLTSPAEQGVLSEKIDSLQARYSEIQDRCCRKAALLDQALSNARLFGEDEVEVLNWLAEVEDKLSSVFVKDFKQDVLHRQHADHLVFMFPFLLVMLFCYFVILIHVSLHLFFFLHYKHFNFILYTSA

SEQ ID NO: 860527 - protein, 689 aa, Homo sapiens
GGGDGRRKRGGGKGGRGRGGGGGFKRGRGGKERGGGGGGGNQAKKSREISLKEFGCKDQRKPRMSSDAKEFISIINPHNLKGKSLGQVSLTHPYSECDFKLKEVARNNMGNDTNEEQEKAVTKIEIISHMKQSTSCLDSEEIRENQGEVILEVQETYCETSGKLPSEQVLQQPMNARVKSKREKREVIVEESIRTCKPAFLSEEKLYQETAIRDEHDSHIKSQPREMTSSEKGKEADTEMGFSITFKIEESSSQVVPQGISVKHLDALTLFSSKQANEGKVNNLSLCLTLKPEENLSREIACGAQSEPFPCMTPRPEGLHYQESDGKAQVTGPSQISKTDKSFQGTTRQETNYQDSWVTSKTKETKHQISSSNECKEKSYQEVSFDPARGLKLEEITVSRPDSKEVRYLEFSDRKDLHHQGSKSDDKLCGTLKSEIATQELTGEKFLEMANPNVAGLEAGSIEDIVTQRGSRVLGSFLPEKLFKGVSQKENTGQQNAIISPTVLETSEEKTVSLTVCSAVKTEKTPQEKLRESPGSEQTPFMTAPEGKGNGGVNPEPFRATQNVFTRQLCLEHDEKLVSYLSLLRNIEMRTKQIQPLELNLAELQDLLCQAKVLERELKDLTTYVSRAAEPQEQEFGKSAWIRDYSSGGSSRTLDAQDRSFPPQTAELWVQPREAQHQDEELRRIPVWK

SEQ ID NO: 860528 - protein, 5938 aa, Homo sapiens
MQKGLLDQDTGLVLLESQVIMSGLIAPETGENLSLEEGIARNLINPQMYQQLRELQDALALISRLTESRGPLSVVEAIEKRIISETVGLKILEAHLATGGFSLSPSENCINLEEAFHQGLISAWLHSVLESYLRTSKNLIDPNTAEKIGLLDLMQRCIVHQESGFKLLPVKQLAGGMVSLKSGRKVSIFRAVQEGLIDRQVTVRLLEAQLFAGGIVDPRTGHRLTVEEAVRHNLIDQDMACAILIRQLQTGGIIDTVTGQRLTIDEAVSNDLVAAKIALVILESLWSFMGLLWPESGEILPITDALEQGIVSTELAHKILSNRQHIKALFLPATTEILSWKKAIESGILDRDLANNLKSICIPDVMPHMQLADSAEQNINPGAAVLPCSKSHPKATASQSENLLFQLMTHSYINVQNGQRLLLLDKELMETLTSRDEYQTSPPKVVEIGHQRQKTPEGLQESANVKISGTFSSGWTVRLPEFQFSSQNKEYPDREDCTTEKGKKTTVETEDSSVENPEQDLFVEQKERNPNIDALKVINKVKLEVQRQLIGTQREDQTAVSVRENASRGHLLTIPPAEAEGVPLVVDKDVFSVETPKKEHQPLRNTSFTCQNEQAHTLETEYIHDETGGSHIKPQSKKLQVQVKKTLGIKLELKSETDGNVHPLDKKEMLKKTFLAKDDHKESQEAQNIAGGSMMMSEKTDEEDSGREIFLSCSHPLELLEEATLNVLSAQLLDGGIFHEQTGQKLLLNEAISRGIVPSHTAVKLMEKLNMFQGFFDSQTCESLTTEEVINEGLMDEKLLHNVLMADKAISGVLDPRTQTLCSVKDAVTVGLLDKETATRILERQVVTGGIIDLKRGKKVSVTLASTLGLVDVADQPELINLEKASKGRDAEKTVRERLISLQMETTGLIDPDSKAPLTVVQSIDRGLLEREEAVRLLTKQVVDGGIIHHISGMRLSVDNAFRHGLIGEDLAEKLKRVENLNIHQIFNPETKENISLPKAIKLDLITSDLKREIQEVQAFTGNFVDLISGQRLTLAEAKKEGLLTNEAVLSPGMMHGIVDPENCRIVPYSELVKKCKIDIESGQRYLEVIPFSDIKDGVSDKVLTLSQAIQLGKVDFASTLKVLEAQANTGGIIDTATGKRLTLASALEEKLVDENMVRIIASHQVLNGGIVDIFSDQRVTLVEAIEKRLISPELANMIQIDSSEFSDHRAQIEKQEGIEVCALQNEFLGKDMLIACNQTAEMSCNKVEESERLFQVENQSAQEKVKVRVSDGEQAKKSREISLKEFGCKDQRKPRMSSDAKEFISIINPHNLKGKSLGQVSLTHPYSECDFKLKEVARNNMGNDTNEEQEKAVTKIEIISHMKQSTSCLDSEEIRENQGEVILEVQETYCETSGKLPSEQVLQQPMNARVKSKREKREVIVEESIRTCKPAFLSEEKLYQETAIRDEHDSHIKSQPREMTSSEKGKEADTEMGFSITFKIEESSSQVVPQGISVKHLDALTLFSSKQANEGKVNNLSLCLTLKPEENLSREIACGAQSEPFPCMTPRPEGLHYQESDGKAQVTGPSQISKTDKSFQGTTRQETNYQDSWVTSKTKETKHQISSSNECKEKSYQEVSFDPARGLKLEEITVSRPDSKEVRYLEFSDRKDLHHQGSKSDDKLCGTLKSEIATQELTGEKFLEMANPNVAGLEAGSIEDIVTQRGSRVLGSFLPEKLFKGVSQKENTGQQNAIISPTVLETSEEKTVSLTVCSAVKTEKTPQEKLRESPGSEQTPFMTAPEGKGNGGVNPEPFRATQNVFTRQLCLEHDEKLVSYLSLLRNIEMRTKQIQPLELNLAELQDLLCQAKVLERELKDLTTLVSQELECVNQIIISQPQEVPAQLLKALEKDAKNLQKSLSSVSDTWNSRLLHFQNAVEIEKTKVLNQHTQLEGRLQDLRAWVGNKNLILNSKGSNSEIDVDSLNLCLQQYEDLKQPMAERKAQLDALAFDIQFFISEHAQDLSPQQNRQMLRLLNELQRSFQDILEQTAAQVDALQGHLQQMEQEALVKTLQKQQNTCHQQLEDLCSWVGQAERALAGHQGRTTQQDLSALQKNQSDLKDLQDDIQNRATSFATVVKDIEGFMEENQTKLSPRELTALREKLHQAKEQYEALQEETRVAQKELEEAVTSALQQETEKSKAAKELAENKKKIDALLDWVTSVGSSGGQLLTNLPGMEQLSGASLEKGALDTTDGYMGVNQAPEKLDKQCEMMKARHQELLSQQQNFILATQSAQAFLDQHGHNLTPEEQQMLQQKLGELKEQYSTSLAQSEAELKQVQTLQDELQKFLQDHKEFESWLERSEKELENMHKGGSSPETLPSLLKRQGSFSEDVISHKGDLRFVTISGQKVLDMENSFKEGKEPSEIGNLVKDKLKDATERYTALHSKCTRLGSHLNMLLGQYHQFQNSADSLQAWMQACEANVEKLLSDTVASDPGVLQEQLATTKQLQEELAEHQVPVEKLQKVARDIMEIEGEPAPDHRHVQETTDSILSHFQSLSYSLAERSSLLQKAIAQSQSVQESLESLLQSIGEVEQNLEGKQVSSLSSGVIQEALATNMKLKQDIARQKSSLEATREMVTRFMETADSTTAAVLQGKLAEVSQRFEQLCLQQQEKESSLKKLLPQAEMFEHLSGKLQQFMENKSRMLASGNQPDQDITHFFQQIQELNLEMEDQQENLDTLEHLVTELSSCGFALDLCQHQDRVQNLRKDFTELQKTVKEREKDASSCQEQLDEFRKLVRTFQKWLKETEGSIPPTETSMSAKELEKQIEHLKSLLDDWASKGTLVEEINCKGTSLENLIMEITAPDSQGKTGSILPSVGSSVGSVNGYHTCKDLTEIQCDMSDVNLKYEKLGGVLHERQESLQAILNRMEEVHKEANSVLQWLESKEEVLKSMDAMSSPTKTETVKAQAESNKAFLAELEQNSPKIQKVKEALAGLLVTYPNSQEAENWKKIQEELNSRWERATEVTVARQRQLEESASHLACFQAAESQLRPWLMEKELMMGVLGPLSIDPNMLNAQKQQVQFMLKEFEARRQQHEQLNEAAQGILTGPGDVSLSTSQVQKELQSINQKWVELTDKLNSRSSQIDQAIVKSTQYQELLQDLSEKVRAVGQRLSVQSAISTQPEAVKQQLEETSEIRSDLEQLDHEVKEAQTLCDELSVLIGEQYLKDELKKRLETVALPLQGLEDLAADRINRLQAALASTQQFQQMFDELRTWLDDKQSQQAKNCPISAKLERLQSQLQENEEFQKSLNQHSGSYEVIVAEGESLLLSVPPGEEKRTLQNQLVELKNHWEELSKKTADRQSRLKDCMQKAQKYQWHVEDLVPWIEDCKAKMSELRVTLDPVQLESSLLRSKAMLNEVEKRRSLLEILNSAADILINSSEADEDGIRDEKAGINQNMDAVTEELQAKTGSLEEMTQRLREFQESFKNIEKKVEGAKHQLEIFDALGSQACSNKNLEKLRAQQEVLQALEPQVDYLRNFTQGLVEDAPDGSDASQLLHQAEVAQQEFLEVKQRVNSGCVMMENKLEGIGQFHCRVREMFSQLADLDDELDGMGAIGRDTDSLQSQIEDVRLFLNKIHVLKLDIEASEAECRHMLEEEGTLDLLGLKRELEALNKQCGKLTERGKARQEQLELTLGRVEDFYRKLKGLNDATTAAEEAEALQWVVGTEVEIINQQLADFKMFQKEQVDPLQMKLQQVNGLGQGLIQSAGKDCDVQGLEHDMEEINARWNTLNKKVAQRIAQLQEALLHCGKFQDALEPLLSWLADTEELIANQKPPSAEYKVVKAQIQEQKLLQRLLDDRKATVDMLQAEGGRIAQSAELADREKITGQLESLESRWTELLSKAAARQKQLEDILVLAKQFHETAEPISDFLSVTEKKLANSEPVGTQTAKIQQQIIRHKALEEDIENHATDVHQAVKIGQSLSSLTSPAEQGVLSEKIDSLQARYSEIQDRCCRKAALLDQALSNARLFGEDEVEVLNWLAEVEDKLSSVFVKDFKQDVLHRQHADHLALNEEIVNRKKNVDQAIKNGQALLKQTTGEEVLLIQEKLDGIKTRYADITVTSSKALRTLEQARQLATKFQSTYEELTGWLREVEEELATSGGQSPTGEQIPQFQQRQKELKKEVMEHRLVLDTVNEVSRALLELVPWRAREGLDKLVSDANEQYKLVSDTIGQRVDEIDAAIQRSQQYEQAADAELAWVAETKRKLMALGPIRLEQDQTTAQLQVQKAFSIDIIRHKDSMDELFSHRSEIFGTCGEEQKTVLQEKTESLIQQYEAISLLNSERYARLERAQVLVNQFWETYEELSPWIEETRALIAQLPSPAIDHEQLRQQQEEMRQLRESIAEHKPHIDKLLKIGPQLKELNPEEGEMVEEKYQKAENMYAQIKEEVRQRALALDEAVSQSTQITEFHDKIEPMLETLENLSSRLRMPPLIPAEVDKIRECISDNKSATVELEKLQPSFEALKRRGEELIGRSQGADKDLAAKEIQDKLDQMVFFWEDIKARAEEREIKFLDVLELAEKFWYDMAALLTTIKDTQDIVHDLESPGIDPSIIKQQVEAAETIKEETDGLHEELEFIRILGADLIFACGETEKPEVRKSIDEMNNAWENLNKTWKERLEKLEDAMQAAVQYQDTLQAMFDWLDNTVIKLCTMPPVGTDLNTVKDQLNEMKEFKVEVYQQQIEMEKLNHQGELMLKKATDETDRDIIREPLTELKHLWENLGEKIAHRQHKLEGALLALGQFQHALEELMSWLTHTEELLDAQRPISGDPKVIEVELAKHHVLKNDVLAHQATVETVNKAGNELLESSAGDDASSLRSRLEAMNQCWESVLQKTEEREQQLQSTLQQAQGFHSEIEDFLLELTRMESQLSASKPTGGLPETAREQLDTHMELYSQLKAKEETYNQLLDKGRLMLLSRDDSGSGSKTEQSVALLEQKWHVVSSKMEERKSKLEEALNLATEFQNSLQEFINWLTLAEQSLNIASPPSLILNTVLSQIEEHKVFANEVNAHRDQIIELDQTGNQLKFLSQKQDVVLIKNLLVSVQSRWEKVVQRSIERGRSLDDARKRAKQFHEAWKKLIDWLEDAESHLDSELEISNDPDKIKLQLSKHKEFQKTLGGKQPVYDTTIRTGRALKEKTLLPEDTQKLDNFLGEVRDKWDTVCGKSVERQHKLEEALLFSGQFMDALQALVDWLYKVEPQLAEDQPVHGDLDLVMNLMDAHKVFQKELGKRTGTVQVLKRSGRELIENSRDDTTWVKGQLQELSTRWDTVCKLSVSKQSRLEQALKQAEVFRDTVHMLLEWLSEAEQTLRFRGALPDDTEALQSLIDTHKEFMKKVEEKRVDVNSAVAMGEVILAVCHPDCITTIKHWITIIRARFEEVLTWAKQHQQRLETALSELVANAELLEELLAWIQWAETTLIQRDQEPIPQNIDRVKALIAEHQTFMEEMTRKQPDVDRVTKTYKRKNIEPTHAPFIEKSRSGGRKSLSQPTPPPMPILSQSEAKNPRINQLSARWQQVWLLALERQRKLNDALDRLEELKEFANFDFDVWRKKYMRWMNHKKSRVMDFFRRIDKDQDGKITRQEFIDGILASKFPTTKLEMTAVADIFDRDGDGYIDYYEFVAALHPNKDAYRPTTDADKIEDEVTRQVAQCKCAKRFQVEQIGENKYRFFLGNQFGDSQQLRLVRILRSTVMVRVGGGWMALDEFLVKNDPCRARGRTNIELREKFILPEGASQGMTPFRSRGRRSKPSSRAASPTRSSSSASQSNHSCTSMPSSPATPASGTKVIPSSGSKLKRPTPTFHSSRTSLAGDTSNSSSPASTGAKTNRADPKKSASRPGSRAGSRAGSRASSRRGSDASDFDLLETQSACSDTSESSAAGGQGNSRRGLNKPSKIPTMSKKTTTASPRTPGPKR

SEQ ID NO: 860529 - protein, 673 aa, Homo sapiens
MEGARARGAQLRLGERVRPVGRRSAPGRSRFRQPWRPGASDSAPPAGTMAQSRVLLLLLLLPPQLHLGPVLAVRAPGFGRSGGHSLSPEENEFAEEEPVLVLSPEEPGPGPAAVSCPRDCACSQEGVVDCGGIDLREFPGDLPEHTNHLSLQNNQLEKIYPEELSRLHRLETLNLQNNRLTSRGLPEKAFEHLTNLNYLYLANNKLTLDPRFLPNALISVDFAANYLTKIYGLTFGQKPNLRSVYLHNNKLADAGLPDNMFNGSSNVEVLILSSNFLRHVPKHLPPALYKLHLKNNKLEKIPPGAFSELSSLRELYLQNNYLTDEGLDNETFWKLSSLEYLDLSSNNLSRVPAGLPRSLVLLHLEKNAIRSVDANVLTPIRSLEYLLLHSNQLREQGIHPLAFQGLKRLHTVHLYNNALERVPSGLPRRVRTLMILHNQITGIGREDFATTYFLEELNLSYNRITSPQVHRDAFRKLRLLRSLDLSGNRLHTLPPGLPRNVHVLKVKRNELAALARGALAGMAQLRELYLTSNRLRSRALGPRAWVDLAHLQVGVPDSLWSPLQLLDIAGNQLTEIPEGLPESLEYLYLQNNKISAVPANAFDSTPNLKGIFLRFNKLAVGSVVDSAFRRLKHLQVLDIEGNLEFGDISKDRGRLGKEKEEEEEEEEEEEETR

SEQ ID NO: 860530 - protein, 390 aa, Homo sapiens
MPHISDAHKAKNNKLEKIPPGAFSELSSLRELYLQNNYLTDEGLDNETFWKLSSLEYLDLSSNNLSRVPAGLPRSLVLLHLEKNAIRSVDANVLTPIRSLEYLLLHSNQLREQGIHPLAFQGLKRLHTVHLYNNALERVPSGLPRRVRTLMILHNQITGIGREDFATTYFLEELNLSYNRITSPQVHRDAFRKLRLLRSLDLSGNRLHTLPPGLPRNVHVLKVKRNELAALARGALAGMAQLRELYLTSNRLRSRALGPRAWVDLAHLQVGVPDSLWSPLQLLDIAGNQLTEIPEGLPESLEYLYLQNNKISAVPANAFDSTPNLKGIFLRFNKLAVGSVVDSAFRRLKHLQVLDIEGNLEFGDISKDRGRLGKEKEEEEEEEEEEEETR

SEQ ID NO: 860531 - protein, 181 aa, Homo sapiens
LFQKGGWQVLPCTTHTFTSLEPTMHLLGKQGKTHTTHTHMHKSCANSPPKPMPQTALAPARISHSSSPSALSICPSVPWRRHKGIHALWPGACHPLELTKAGFYSFPILWGQEPSGLLAWPGPPCSSRCWAVTLLRVPPCHALAGHRHFSNGQAQWRQDGRAPWVLLGPWGRSEAEVMGLG

SEQ ID NO: 860532 - protein, 673 aa, Homo sapiens; identical to SEQ ID NO: 860529

SEQ ID NO: 860533 - protein, 635 aa, Homo sapiens
MEGARARGAQLRLGERVRPVGRRSAPGRSRFRQPWRPGASDSAPPAGTMAQSRVLLLLLLLPPQLHLGPVLAVRAPGFGRSGGHSLSPEENEFAEEEPVLVLSPEEPGPGPAAVSCPRDCACSQEGVVDCGGIDLREFPGDLPEHTNHLSLQNNQLEKIYPEELSRLHRLETLNLQNNRLTSRGLPEKAFEHLTNLNYLYLANNKLTLDPRFLPNALISVDFAANYLTKIYGLTFGQKPNLRSVYLHNNKLADAGLPDNMFNGSSNVEVLILSSNFLRHVPKHLPPALYKLHLKNNKLEKIPPGAFSELSSLRELYLQNNYLTDEGLDNETFWKLSSLEYLDLSSNNLSRVPAGLPRSLVLLHLEKNAIRSVDANVLTPIRSLEYLLLHSNQLREQGIHPLAFQGLKRLHTVHLYNNALERVPSGLPRRVRTLMILHNQITGIGREDFATTYFLEELNLSYNRITSPQVHRDAFRKLRLLRSLDLSGNRLHTLPPGLPRNVHVLKVKRNELAALARGALAGMAQLRELYLTSNRLRSRALGPRAWVDLAHLQNNKISAVPANAFDSTPNLKGIFLRFNKLAVGSVVDSAFRRLKHLQVLDIEGNLEFGDISKDRGRLGKEKEEEEEEEEEEEETR

SEQ ID NO: 860534 - protein, 142 aa, Homo sapiens
MHKSCANSPPKPMPQTALAPARISHSSSPSALSICPSVPWRRHKGIHALWPGACHPLELTKAGFYSFPILWGQEPSGLLAWPGPPCSSRCWAVTLLRVPPCHALAGHRHFSNGQAQWRQDGRAPWVLLGPWGRSEAEVMGLG

SEQ ID NO: 860535 - protein, 124 aa, Homo sapiens
MEGARARGAQLRLGERVRPVGRRSAPGRSRFRQPWRPGASDSAPPAGTMAQSRVLLLLLLLPPQLHLGPVLAVRAPGFGRSGGHSLSPEENEFAEEEPVLVLSPEEPGPGLAHPAPPGAGQSLC

SEQ ID NO: 860536 - protein, 149 aa, Homo sapiens
MRYNEKELQALSRQPAEMAAELGMRGPKKGSVLKRRLVKLVVNFLFYFRTDEAEPVGALLLERCRVVREEPGTFSISFIEDPERKYHFECSSEEQCQEWMEALRRASYEFMRRSLIFYRNEIRKVTGKDPLEQFGISEEARFQLSGLQA

SEQ ID NO: 860537 - protein, 135 aa, Homo sapiens
AVDSKTAVGVKGRGMKAAGVRGMKPVQDSGDTLVDMAYYTGHTHKDYSPWAWAFGNTQDILDRWDRVVPAPVEEELSQAFVMELAQQSQPPLEMEQQQKELDLLEAQVVEAWVWAGAAFYETAQQAALPGAPGST

SEQ ID NO: 860538 - protein, 149 aa, Homo sapiens; identical to SEQ ID NO: 860536

SEQ ID NO: 860539 - protein, 82 aa, Homo sapiens
DTLRATLSLPPPAPGRSRKGCQPSLGCLDSVPPWSGLFQFNGYVTTVRLSYQPVPRPRQQPRVASATQRRRAAWLAQGAQAH

SEQ ID NO: 860540 - protein, 174 aa, Homo sapiens
MRYNEKELQALSRQPAEMAAELGMRGPKKGSVLKRRLVKLVVNFLFYFRTDEAEPVGALLLERCRVVREEPGTFSISFIEDPERKYHFECSSEEQCQEWMEALRRASYEFMRRSLIFYRNEIRKVTGKVCAGLQRAGVGLQVAEAVLQPWLMATRPPHRTPWNSSAYPRRPGSS

SEQ ID NO: 860541 - protein, 241 aa, Homo sapiens
LVEASPCPPCITSVPTFPLLHRRQAEFRAHPDNPFLLHFIILFAYFLRQGLGMSPRLECSGAISAPCNFPLSGSSDSPASASRVAGTTGTRHHAQLIFVFLVETGFRHIGQAALELLTSGDPPTSASQSAGITVLSHRTRPSLFLRQDLLFPRLECSGVITAHCSLNPLGSSSPPTSDSGVAGPTRPHHHTWLIFVFVEMGILPCHPGWSRTPELKQSSHLGLSKRWDYRHEPPHLATTSF

SEQ ID NO: 860542 - protein, 142 aa, Homo sapiens
MAGPRCAGALALGVLPCLRPEDIFGAGPSLSGDGGREGAARVPVPRGAMRYNEKELQALSRQPAEMAAELGMRGPKKGSVLKRRLVKLVVNFLFYFRTDEAEPVGALLLERCRVVREEPGTFSITTSSCGEASSSTGTKSGR

SEQ ID NO: 860543 - protein, 149 aa, Homo sapiens; identical to SEQ ID NO: 860536

SEQ ID NO: 860544 - protein, 277 aa, Homo sapiens
MRYNEKELQALSRQPAEMAAELGMRGPKKGSVLKRRLVKLVVNFLFYFRTDEAEPVGALLLERCRVVREEPGTFSISFIEDPERKYHFECSSEEQCQEWMEALRRASYEFMRRSLIFYRNEIRKVTGKKHQGTHDRPAPHRRACCEPWTAEKYKSKCTCSTCPRRPHSTIAQHMASCVTAQAPSHARAQPTPRRVNSLGVHSAGVKVKSSGQAPGRSGRGSGRGEASEECGGDGPAFGTGAARRGSRPGGVSENGVRRCQRLVSTKRVEAGAGLGTR

SEQ ID NO: 860545 - protein, 65 aa, Homo sapiens
MRYNEKELQALSRQPAEMAAELGMRGPKKGSVSGTRETETVPGAGGRGRGLGGGAGGRSPGRGAG

SEQ ID NO: 860546 - protein, 241 aa, Homo sapiens; identical to SEQ ID NO: 860541

SEQ ID NO: 860547 - protein, 149 aa, Homo sapiens; identical to SEQ ID NO: 860536

SEQ ID NO: 860548 - protein, 149 aa, Homo sapiens; identical to SEQ ID NO: 860536

SEQ ID NO: 860549 - protein, 122 aa, Homo sapiens
MARGSCLWLWVGPTTGVPSPGFIEDPERKYHFECSSEEQCQEWMEALRRARWGQAVVGTAGVGTAAMQSGHLTPCHPFPQLRVHAEKPHLLQERNPEGDGQGVCRAAEGRGGAAGGRGSPPA

SEQ ID NO: 860550 - protein, 102 aa, Homo sapiens
SWLWRTDPACLLSSVSICHSGMATKCSSPWCMPGSFAHSIPQIAWTREHTPGGHVTGRRLVQRAVQGECAKTGHLLGRRPIARKEVIFLSGHSLFLYTRALQ

SEQ ID NO: 860551 - protein, 872 aa, Homo sapiens
RARGSERRRQRRKRRGRRASGSEVVEAAEAAAEAAAARDWARLEAARVRAPQQAPISRLDHPPAARTPGPRSLCPGSDPGAQPGAVTLRRRRRGRAGPGWGAVALDPRLPDRWREMSNPGTRRNGSSIKIRLTVLCAKNLAKKDFFRLPDPFAKIVVDGSGQCHSTDTVKNTLDPKWNQHYDLYVGKTDSITISVWNHKKIHKKQGAGFLGCVRLLSNAISRLKDTGYQRLDLCKLNPSDTDAVRGQIVVSLQTRDRIGTGGSVVDCRGLLENEGTVYEDSGPGRPLSCFMEEPAPYTDSTGAAAGGGNCRFVESPSQDQRLQAQRLRNPDVRGSLQTPQNRPHGHQSPELPEGYEQRTTVQGQVYFLHTQTGVSTWHDPRIPSPSGTIPGGDAAFLYEFLLQGHTSEPRDLNSVNCDELGPLPPGWEVRSTVSGRIYFVDHNNRTTQFTDPRLHHIMNHQCQLKEPSQPLPLPSEGSLEDEELPAQRYERDLVQKLKVLRHELSLQQPQAGHCRIEVSREEIFEESYRQIMKMRPKDLKKRLMVKFRGEEGLDYGGVAREWLYLLCHEMLNPYYGLFQYSTDNIYMLQINPDSSINPDHLSYFHFVGRIMGLAVFHGHYINGGFTVPFYKQLLGKPIQLSDLESVDPELHKSLVWILENDITPVLDHTFCVEHNAFGRILQHELKPNGRNVPVTEENKKEYVRLYVNWRFMRGIEAQFLALQKGFNELIPQHLLKPFDQKELELIIGGLDKIDLNDWKSNTRLKHCVADSNIVRWFWQAVETFDEERRARLLQFVTGSTRVPLQGFKALQGSTGAAGPRLFTIHLIDANTDNLPKAHTCFNRIDIPPYESYEKLYEKLLTAVEETCGFAVE

SEQ ID NO: 860552 - protein, 93 aa, Homo sapiens
SGTLFPRSLGTARDSHIGRHHADKFVFSGAPYQDHLSYFHFVGRIMGLAVFHGHYINGGFTVPFYKQLLGKPIQLSDLESVDPELHKSLVWIL

SEQ ID NO: 860553 - protein, 846 aa, Homo sapiens
RARGSERRRQRRKRRGRRASGSEVVEAAEAAAEAAAARDWARLEAARVRAPQQAPISRLDHPPAARTPGPRSLCPGSDPGAQPGAVTLRRRRRGRAGPGWGAVALDPRLPDRWREMSNPGTRRNGSSIKIRLTVLCAKNLAKKDFFRLPDPFAKIVVDGSGQCHSTDTVKNTLDPKWNQHYDLYVGKTDSITISVWNHKKIHKKQGAGFLGCVRLLSNAISRLKDTGYQRLDLCKLNPSDTDAVRGQIVVSLQTRDRIGTGGSVVDCRGLLENEGTVYEDSGPGRPLSCFMEEPAPYTDSTGAAAGGGNCRFVESPSQDQRLQAQRLRNPDVRGSLQTPQNRPHGHQSPELPEGYEQRTTVQGQVYFLHTQTGVSTWHDPRIPRDLNSVNCDELGPLPPGWEVRSTVSGRIYFVDHNNRTTQFTDPRLHHIMNHQCQLKEPSQPLPLPSEGSLEDEELPAQRYERDLVQKLKVLRHELSLQQPQAGHCRIEVSREEIFEESYRQIMKMRPKDLKKRLMVKFRGEEGLDYGGVAREWLYLLCHEMLNPYYGLFQYSTDNIYMLQINPDSSINPDHLSYFHFVGRIMGLAVFHGHYINGGFTVPFYKQLLGKPIQLSDLESVDPELHKSLVWILENDITPVLDHTFCVEHNAFGRILQHELKPNGRNVPVTEENKKEYVRLYVNWRFMRGIEAQFLALQKGFNELIPQHLLKPFDQKELELIIGGLDKIDLNDWKSNTRLKHCVADSNIVRWFWQAVETFDEERRARLLQFVTGSTRVPLQGFKALQGSTGAAGPRLFTIHLIDANTDNLPKAHTCFNRIDIPPYESYEKLYEKLLTAVEETCGFAVE

SEQ ID NO: 860554 - protein, 717 aa, Homo sapiens
MGLPVLCAKNLAKKDFFRLPDPFAKIVVDGSGQCHSTDTVKNTLDPKWNQHYDLYVGKTDSITISVWNHKKIHKKQGAGFLGCVRLLSNAISRLKDTGYQRLDLCKLNPSDTDAVRGQIVVSLQTRDRIGTGGSVVDCRGLLENEGTVYEDSGPGRPLSCFMEEPAPYTDSTGAAAGGGNCRFVESPSQDQRLQAQRLRNPDVRGSLQTPQNRPHGHQSPELPEGYEQRTTVQGQVYFLHTQTGVSTWHDPRIPRDLNSVNCDELGPLPPGWEVRSTVSGRIYFVDHNNRTTQFTDPRLHHIMNHQCQLKEPSQPLPLPSEGSLEDEELPAQRYERDLVQKLKVLRHELSLQQPQAGHCRIEVSREEIFEESYRQIMKMRPKDLKKRLMVKFRGEEGLDYGGVAREWLYLLCHEMLNPYYGLFQYSTDNIYMLQINPDSSINPDHLSYFHFVGRIMGLAVFHGHYINGGFTVPFYKQLLGKPIQLSDLESVDPELHKSLVWILENDITPVLDHTFCVEHNAFGRILQHELKPNGRNVPVTEENKKEYVRLYVNWRFMRGIEAQFLALQKGFNELIPQHLLKPFDQKELELIIGGLDKIDLNDWKSNTRLKHCVADSNIVRWFWQAVETFDEERRARLLQFVTGSTRVPLQGFKALQGSTGAAGPRLFTIHLIDANTDNLPKAHTCFNRIDIPPYESYEKLYEKLLTAVEETCGFAVE

SEQ ID NO: 860555 - protein, 846 aa, Homo sapiens; identical to SEQ ID NO: 860553

SEQ ID NO: 860556 - protein, 111 aa, Homo sapiens [sequence omitted]

SEQ ID NO: 860557 - protein, 156 aa, Homo sapiens
RARGSERRRQRRKRRGRRASGSEVVEAAEAAAEAAAARDWARLEAARVRAPQQAPISRLDHPPAARTPGPRSLCPGSDPGAQPGAVTLRRRRRGRAGPGWGAVALDPRLPDRWREMSNPGTRRNGSSIKIRLTELVRFFHLFNPRADHEVKSRRLQ

SEQ ID NO: 860558 - protein, 664 aa, Homo sapiens
MLCAKNLAKKDFFRLPDPFAKIVVDGSGQCHSTDTVKNTLDPKWNQHYDLYVGKTDSITISVWNHKKIHKKQGAGFLGCVRLLSNAISRLKDTGYQRLDLCKLNPSDTDAVRGQIVVSLQTRDRIGTGGSVVDCRGLLENEGTVYEDSGPGRPLSCFMEEPAPYTDSTGAAAGGGNCRFVESPSQDQRLQAQRLRNPDVRGSLQTPQNRPHGHQSPELPEGYEQRTTVQGQVYFLHTQTGVSTWHDPRIPRDLNSVNCDELGPLPPGWEVRSTVSGRIYFVDHNNRTTQFTDPRLHHIMNHQCQLKEPSQPLPLPSEGSLEDEELPAQRYERDLVQKLKVLRHELSLQQPQAGHCRIEVSREEIFEESYRQIMKMRPKDLKKRLMVKFRGEEGLDYGGVAREWLYLLCHEMLNPYYGLFQYSTDNIYMLQINPDSSINPDHLSYFHFVGRIMGLAVFHGHYINGGFTVPFYKQLLGKPIQLSDLESVDPELHKSLVWILENDITPVLDHTFCVEHNAFGRILQHELKPNGRNVPVTEENKKEYVRLYVNWRFMRGIEAQFLALQKGFNELIPQHLLKPFDQKELELIIGGLDKIDLNDWKSNTRLKHCVADSNIVRWFWQAVETFDEERRARLLQFVTGSTRVPLQGFKALQGSTAGALPRLVD

SEQ ID NO: 860559 - protein, 142 aa, Homo sapiens
MKERCMKTPGLGGRSAASWRNQPLTQIAPVLLLEEGIAGSWSPQVKIKDFRHSGFETLMCEVHYRRPRTDHTATSPRNCPKATNKEQQSRAKFTFCIHRLELARGTTPGYQVPRGPFLGEMQLFYTNSFYKAIHLSPETLTV

SEQ ID NO: 860560 - protein, 499 aa, Homo sapiens
MLCAKNLAKKDFFRLPDPFAKIVVDGSGQCHSTDTVKNTLDPKWNQHYDLYVGKTDSITISVWNHKKIHKKQGAGFLGCVRLLSNAISRLKDTGYQRLDLCKLNPSDTDAVRGQIVVSLQTRDRIGTGGSVVDCRGLLENEGTVYEDSGPGRPLSCFMEEPAPYTDSTGAAAGGGNCRFVESPSQDQRLQAQRLRNPDVRGSLQTPQNRPHGHQSPELPEGYEQRTTVQGQVYFLHTQTGVSTWHDPRIPRDLNSVNCDELGPLPPGWEVRSTVSGRIYFVDHNNRTTQFTDPRLHHIMNHQCQLKEPSQPLPLPSEGSLEDEELPAQRYERDLVQKLKVLRHELSLQQPQAGHCRIEVSREEIFEESYRQIMKMRPKDLKKRLMVKFRGEEGLDYGGVAREWLYLLCHEMLNPYYGLFQYSTDNIYMLQINPDSSINPDHLSYFHFVGRIMGLAVFHGHYINGGFTVPFYKQLLGKPIQLSDLESVDPELHKSLVWIL

SEQ ID NO: 860561 - protein, 713 aa, Homo sapiens
MLCAKNLAKKDFFRLPDPFAKIVVDGSGQCHSTDTVKNTLDPKWNQHYDLYVGKTDSITISVWNHKKIHKKQGAGFLGCVRLLSNAISRLKDTGYQRLDLCKLNPSDTDAVRGQIVVSLQTRDRIGTGGSVVDCRGLLENEGTVYEDSGPGRPLSCFMEEPAPYTDSTGAAAGGGNCRFVESPSQDQRLQAQRLRNPDVRGSLQTPQNRPHGHQSPELPEGYEQRTTVQGQVYFLHTQTGVSTWHDPRIPRDLNSVNCDELGPLPPGWEVRSTVSGRIYFVDHNNRTTQFTDPRLHHIMNHQCQLKEPSQPLPLPSEGSLEDEELPAQRYERDLVQKLKVLRHELSLQQPQAGHCRIEVSREEIFEESYRQIMKMRPKDLKKRLMVKFRGEEGLDYGGVAREWLYLLCHEMLNPYYGLFQYSTDNIYMLQINPDSSINPDHLSYFHFVGRIMGLAVFHGHYINGGFTVPFYKQLLGKPIQLSDLESVDPELHKSLVWILENDITPVLDHTFCVEHNAFGRILQHELKPNGRNVPVTEENKKEYVRLYVNWRFMRGIEAQFLALQKGFNELIPQHLLKPFDQKELELIIGGLDKIDLNDWKSNTRLKHCVADSNIVRWFWQAVETFDEERRARLLQFVTGSTRVPLQGFKALQGSTGAAGPRLFTIHLIDANTDNLPKAHTCFNRIDIPPYESYEKLYEKLLTAVEETCGFAVE

SEQ ID NO: 860562 - protein, 161 aa, Homo sapiens [sequence omitted]

SEQ ID NO: 860563 - protein, 111 aa, Homo sapiens [sequence omitted]

SEQ ID NO: 860564 - protein, 846 aa, Homo sapiens; identical to SEQ ID NO: 860553

SEQ ID NO: 860565 - protein, 846 aa, Homo sapiens; identical to SEQ ID NO: 860553

SEQ ID NO: 860566 - protein, 156 aa, Homo sapiens; identical to SEQ ID NO: 860557

SEQ ID NO: 860567 - protein, 125 aa, Homo sapiens
MEPDGTYEPGFVGIRFCQECNNMLYPKEDKENRILLYACRNCDYQQEADNSCIYVNKITHEVDELTQIIADVSQDPTLPRTEDHPCQKCGHKEAVFFQSHSARAEDAMRLYYVCTAPHCGHRWTE

SEQ ID NO: 860568 - protein, 103 aa, Homo sapiens
MLYPKEDKENRILLYACRNCDYQQEADNSCIYVNKITHEVDELTQIIADVSQDPTLPRTEDHPCQKCGHKEAVFFQSHSARAEDAMRLYYVCTAPHCGHRWTE

SEQ ID NO: 860569 - protein, 134 aa, Homo sapiens
MEPDGTYEPGFVGIRFCQECNNMLYPKEDKENRILLYACRNCDYQQEADNSCIYVNKITHEVDELTQIIADVSQDPTLPRTEDHPCQKLSVQLVLGRCGHKEAVFFQSHSARAEDAMRLYYVCTAPHCGHRWTE

SEQ ID NO: 860570 - protein, 207 aa, Homo sapiens
MEPDGTYEPGFVGIRFCQECNNMLYPKEDKENRILLYAVSAGVFPGRSTCSQRGPALPPASVMDSLFALRCTSSDPDSHVLPIPKESPVVISSGITLPSPPNLVWNPSVTPFPPHSPSRECRNCDYQQEADNSCIYVNKITHEVDELTQIIADVSQDPTLPRTEDHPCQKCGHKEAVFFQSHSARAEDAMRLYYVCTAPHCGHRWTE

SEQ ID NO: 860571 - protein, 87 aa, Homo sapiens
ANPEGPSIVHGSSNSGPGKDQNRRRRLKPGGRSGKSSPSPRRVNSRMRTGLQPSQAPWLLSWMLSVLRFTMRIVFPALAPDPYYSVN

SEQ ID NO: 860572 - protein, 125 aa, Homo sapiens; identical to SEQ ID NO: 860567

SEQ ID NO: 860573 - protein, 125 aa, Homo sapiens; identical to SEQ ID NO: 860567

SEQ ID NO: 860574 - protein, 87 aa, Homo sapiens; identical to SEQ ID NO: 860571

SEQ ID NO: 860575 - protein, 103 aa, Homo sapiens; identical to SEQ ID NO: 860568

SEQ ID NO: 860576 - protein, 143 aa, Homo sapiens
MDRARHSGSRSGCRRGRVARTQIVEAEDAATVVPPDAREGLQEAAPDTLCATGSLVPSDFPLPPGPTSGCGCRPSPTHAGGSRPFALPAASACYGPGKHLGIPFLHRDPSQLKLIHSCGSTMQLTQILSKQSSQVGDPQESLH

SEQ ID NO: 860577 - protein, 143 aa, Homo sapiens; identical to SEQ ID NO: 860576

SEQ ID NO: 860578 - protein, 169 aa, Homo sapiens
MDRARHSGSRSGCRRGRVARTQIVEAEDAATVVPPDAREGLQEAAPDTLCATGSLVPSDFPLPPGPTSGCGCRPSPTHAGGSRPFALPAASACYGPGKHLGIPFLHRDPSQASARLTVPESSKHALGLGPGRYIWEGLKLIHSCGSTMQLTQILSKQSSQVGDPQESLH

SEQ ID NO: 860579 - protein, 143 aa, Homo sapiens; identical to SEQ ID NO: 860576

SEQ ID NO: 860580 - protein, 143 aa, Homo sapiens; identical to SEQ ID NO: 860576

SEQ ID NO: 860581 - protein, 143 aa, Homo sapiens; identical to SEQ ID NO: 860576

SEQ ID NO: 860582 - protein, 143 aa, Homo sapiens; identical to SEQ ID NO: 860576

SEQ ID NO: 860583 - protein, 143 aa, Homo sapiens; identical to SEQ ID NO: 860576

SEQ ID NO: 860584 - protein, 143 aa, Homo sapiens; identical to SEQ ID NO: 860576

SEQ ID NO: 860585 - protein, 143 aa, Homo sapiens; identical to SEQ ID NO: 860576

SEQ ID NO: 860586 - protein, 198 aa, Homo sapiens
MDRARHSGSRSGCRRGRVARTQIVEAEDAATVVPPDAREGLQEAAPDTLCATGSLVPSDFPLPPGPTSGCGCRPSPTHAGGSRPFALPAASACYGPGKHLGIPFLHRDPSQASARLTVPESSKHALGLGPGRYIWEGVGGWVDRRGRIVSTLSQVAEASETFPSWIWGQRSAVKADTFLWVNYATNSDFEVNNKSLYL

SEQ ID NO: 860587 - protein, 165 aa, Homo sapiens
KSKQKSAVEVEPSWRTSTKAVQRRNVRLEPPHRVPTGALGSGAVRRGPPFSRPQNGRSTNSLHRALGKAPGTQRQPMKTATGAVPCRTTGVELPRTLGVHPLHQCSLDVRHGVKGDYFGALTFNDCSTGFQICMGLAASLFWQIFPIWKGSIYPMPVPPLYLGSN

SEQ ID NO: 860588 - protein, 85 aa, Homo sapiens
LQLRVRNPGVDYYYYNVGGVDPNLGHISTSMLLRHDSSASYVYRYFATVPPLRCAGEGGVTVSCVGALRDICCVLLLGCFSPHVQ

SEQ ID NO: 860589 - protein, 240 aa, Homo sapiens
MDRARHSGSRSGCRRGRVARTQIVEAEDAATVVPPDAREGLQEAAPDTLCATGSLVPSDFPLPPGPTSGCGCRPSPTHAGGSRPFALPAASACYGPGKHLGIPFLHRDPSQASARLTVPESSKHALGLGPGRYIWEGVGGWVDRRGRIVSTLSQVAEASETFPSWIWGQRSAGIDKITLFAIPLGAQMRIESEKNGTWALGVGGGESRTPCALFLRRLEKKLFKMSDRPYSVQSSLKSFT

SEQ ID NO: 860590 - protein, 143 aa, Homo sapiens; identical to SEQ ID NO: 860576

SEQ ID NO: 860591 - protein, 160 aa, Homo sapiens
MDRARHSGSRSGCRRGRVARTQIVEAEDAATVVPPDAREGLQEAAPDTLCATGSLVPSDFPLPPGPTSGCGCRPSPTHAGGSRPFALPAASACYGPGKHLGIPFLHRDPSQLRPPKPSLAGFGDRGALLKLIHSCGSTMQLTQILSKQSSQVGDPQESLH

SEQ ID NO: 860592 - protein, 143 aa, Homo sapiens; identical to SEQ ID NO: 860576

SEQ ID NO: 860593 - protein, 143 aa, Homo sapiens; identical to SEQ ID NO: 860576

SEQ ID NO: 860594 - protein, 143 aa, Homo sapiens; identical to SEQ ID NO: 860576

SEQ ID NO: 860595 - protein, 143 aa, Homo sapiens; identical to SEQ ID NO: 860576

SEQ ID NO: 860596 - protein, 143 aa, Homo sapiens; identical to SEQ ID NO: 860576

SEQ ID NO: 860597 - protein, 143 aa, Homo sapiens; identical to SEQ ID NO: 860576

SEQ ID NO: 860598 - protein, 81 aa, Homo sapiens
GGGREGRRPPEGLQIPATASAVAGLAVPCGSGGDGGLGGGGGCCCGGDGGAAMRRERGQTQPDSGIRALQNTHHIAPEVAW

SEQ ID NO: 860599 - protein, 1196 aa, Homo sapiens
MASVWKRLQRVGKHASKFQFVASYQELMVECTKKWQPDKLVVVWTRRSRRKSSKAHSWQPGIKNPYRGVVVWPVPENIEITVTLFKDPHAEEFEDKEWTFVIENESPSGRRKALATSSINMKQYASPMPTQTDVKLKFKPLSKKVVSAALQFSLSCIFLREGKATDEDMQSLASLMSMKQADIGNLDDFEEDNEDDDENRVNQEEKAAKITELINKLNFLDEAEKDLATVNSNPFDDPDAAELNPFGDPDSEEPITETASPRKTEDSFYNNSYNPFKEVQTPQYLNPFDEPEAFVTIKDSPPQSTKRKNIRPVDMSKYLYADSSKTEEEELDESNPFYEPKSTPPPNNLVNPVQELETERRVKRKAPAPPVLSPKTGVLNENTVSAGKDLSTSPKPSPIPSPVLGRKPNASQSLLVWCKEVTKNYRGVKITNFTTSWRNGLSFCAILHHFRPDLIDYKSLNPQDIKENNKKAYDGFASIGISRLLEPSDMVLLAIPDKLTVMTYLYQIRAHFSGQELNVVQIEENSSKSTYKVGNYETDTNSSVDQEKFYAELSDLKREPELQQPISGAVDFLSQDDSVFVNDSGVGESESEHQTPDDHLSPSTASPYCRRTKSDTEPQKSQQSSGRTSGSDDPGICSNTDSTQAQVLLGKKRLLKAETLELSDLYVSDKKKDMSPPFICEETDEQKLQTLDIGSNLEKEKLENSRSLECRSDPESPIKKTSLSPTSKLGYSYSRDLDLAKKKHASLRQTESDPDADRTTLNHADHSSKIVQHRLLSRQEELKERARVLLEQARRDAALKAGNKHNTNTATPFCNRQLSDQQDEERRRQLRERARQLIAEARSGVKMSELPSYGEMAAEKLKERSKASGDENDNIEIDTNEEIPEGFVVGGGDELTNLENDLDTPEQNSKLVDLKLKKLLEVQPQVANSPSSAAQKAVTESSEQDMKSGTEDLRTERLQKTTERFRNPVVFSKDSTVRKTQLQSFSQYIENRPEMKRQRSIQEDTKKGNEEKAAITETQRKPSEDEVLNKGFKDTSQYVVGELAALENEQKQIDTRAALVEKRLRYLMDTGRNTEEEEAMMQEWFMLVNKKNALIRRMNQLSLLEKEHDLERRYELLNRELRAMLAIEDWQKTEAQKRREQLLLDELVALVNKRDALVRDLDAQEKQAEEEDEHLERTLEQNKGKMAKKEEKCVLQ

SEQ ID NO: 860600 - protein, 1069 aa, Homo sapiens
MASVWKRLQRVGKHASKFQFVASYQELMVECTKKWQPDKLVVVWTRRSRRKSSKAHSWQPGIKNPYRGVVVWPVPENIEITVTLFKDPHAEEFEDKEWTFVIENESPSGRRKALATSSINMKQYASPMPTQTDVKLKFKPLSKKVVSAALQFSLSCIFLREGKATDEDMQSLASLMSMKQADIGNLDDFEEDNEDDDENRVNQEEKAAKITELINKLNFLDEAEKDLATVNSNPFDDPDAAELNPFGDPDSEEPITETASPRKTEDSFYNNSYNPFKEVQTPQYLNPFDEPEAFVTIKDSPPQSTKRKNIRPVDMSKYLYADSSKTEEEELDESNPFYEPKSTPPPNNLVNPVQELETERRVKRKAPAPPVLSPKTGVLNENTVSAGKDLSTSPKPSPIPSPVLGRKPNASQSLLVWCKEVTKNYRGVKITNFTTSWRNGLSFCAILHHFRPDLIDYKSLNPQDIKENNKKAYDGFASIGISRLLEPSDMVLLAIPDKLTVMTYLYQIRAHFSGQELNVVQIEENSSKSTYKVGNYETDTNSSVDQEKFYAELSDLKREPELQQPISGAVDFLSQDDSVFVNDSGVGESESEHQTPDDHLSPSTASPYCRRTKSDTEPQKSQQSSGRTSGSDDPGICSNTDSTQAQVLLGKKRLLKAETLELSDLYVSDKKKDMSPPFICEETDEQKLQTLDIGSNLEKEKLENSRSLECRSDPESPIKKTSLSPTSKLGYSYSRDLDLAKKKHASLRQTESDPDADRTTLNHADHSSKIVQHRLLSRQEELKERARVLLEQARRDAALKAGNKHNTNTATPFCNRQLSDSGTEDLRTERLQKTTERFRNPVVFSKDSTVRKTQLQSFSQYIENRPEMKRQRSIQEDTKKGNEEKAAITETQRKPSEDEVLNKGFKDTSQYVVGELAALENEQKQIDTRAALVEKRLRYLMDTGRNTEEEEAMMQEWFMLVNKKNALIRRMNQLSLLEKEHDLERRYELLNRELRAMLAIEDWQKTEAQKRREQLLLDELVALVNKRDALVRDLDAQEKQAEEEDEHLERTLEQNKGKMAKKEEKCVLQ

SEQ ID NO: 860601 - protein, 1112 aa, Homo sapiens
MASVWKRLQRVGKHASKFQFVASYQELMVECTKKWQPDKLVVVWTRRSRRKSSKAHSWQPGIKNPYRGVVVWPVPENIEITVTLFKDPHAEEFEDKEWTFVIENESPSGRRKALATSSINMKQYASPMPTQTDVKLKFKPLSKKVVSAALQFSLSCIFLREGKATDEDMQSLASLMSMKQADIGNLDDFEEDNEDDDENRVNQEEKAAKITELINKLNFLDEAEKDLATVNSNPFDDPDAAELNPFGDPDSEEPITETASPRKTEDSFYNNSYNPFKEVQTPQYLNPFDEPEAFVTIKDSPPQSTKRKNIRPVDMSKYLYADSSKTEEEELDESNPFYEPKSTPPPNNLVNPVQELETERRVKRKAPAPPVLSPKTGVLNENTVSAGKDLSTSPKPSPIPSPVLGRKPNASQSLLVWCKEVTKNYRGVKITNFTTSWRNGLSFCAILHHFRPDLIDYKSLNPQDIKENNKKAYDGFASIGISRLLEPSDMVLLAIPDKLTVMTYLYQIRAHFSGQELNVVQIEENSSKSTYKVGNYETDTNSSVDQEKFYAELSDLKREPELQQPISGAVDFLSQDDSVFVNDSGVGESESEHQTPDDHLSPSTASPYCRRTKSDTEPQKSQQSSGRTSGSDDPGICSNTDSTQAQVLLGKKRLLKAETLELSDLYVSDKKKDMSPPFICEETDEQKLQTLDIGSNLEKEKLENSRSLECRSDPESPIKKTSLSPTSKLGYSYSRDLDLAKKKHASLRQTESDPDADRTTLNHADHSSKIVQQQDEERRRQLRERARQLIAEARSGVKMSELPSYGEMAAEKLKERSKASGEQNSKLVDLKLKKLLEVQPQVANSPSSAAQKAVTESSEQDMKSGTEDLRTERLQKTTERFRNPVVFSKDSTVRKTQLQSFSQYIENRPEMKRQRSIQEDTKKGNEEKAAITETQRKPSEDEVLNKGFKDTSQYVVGELAALENEQKQIDTRAALVEKRLRYLMDTGRNTEEEEAMMQEWFMLVNKKNALIRRMNQLSLLEKEHDLERRYELLNRELRAMLAIEDWQKTEAQKRREQLLLDELVALVNKRDALVRDLDAQEKQAEEEDEHLERTLEQNKGKMAKKEEKCVLQ

SEQ ID NO: 860602 - protein, 1112 aa, Homo sapiens; identical to SEQ ID NO: 860601

SEQ ID NO: 860603 - protein, 108 aa, Homo sapiens
MRSSGTWTRRRSSEWAVGSGRGWATCRGAEKCAESSIQRSREGRGSLPLAWCSPFPLGIQILGDGGVLLCPPRRKIILFPVCPVCLTSRAEEEDEHLERTLEQNKGKM

SEQ ID NO: 860604 - protein, 132 aa, Homo sapiens
MHASNARPDQRSRIRLLARDDVSGTEDLRTERLQKTTERFRNPVVFSKDSTVRKTQLQSFSQYIENRPEMKRQRSIQEDTKKGNEEKAAITETQRKPSEDEVLNKKIKISQTWWCAPVVSATQEAEAGGLLD

SEQ ID NO: 860605 - protein, 1196 aa, Homo sapiens; identical to SEQ ID NO: 860599

SEQ ID NO: 860606 - protein, 1196 aa, Homo sapiens; identical to SEQ ID NO: 860599

SEQ ID NO: 860607 - protein, 937 aa, Homo sapiens
MASVWKRLQRVGKHASKFQFVASYQELMVECTKKWQPDKLVVVWTRRSRRKSSKAHSWQPGIKNPYRGVVVWPVPENIEITVTLFKDPHAEEFEDKEWTFVIENESPSGRRKALATSSINMKQYASPMPTQTDVKLKFKPLSKKVVSAALQFSLSCIFLREGKATDEDMQSLASLMSMKQADIGNLDDFEEDNEDDDENRVNQEEKAAKITELINKLNFLDEAEKDLATVNSNPFDDPDAAELNPFGDPDSEEPITETASPRKTEDSFYNNSYNPFKEVQTPQYLNPFDEPEAFVTIKDSPPQSTKRKNIRPVDMSKYLYADSSKTEEEELDESNPFYEPKSTPPPNNLVNPVQELETERRVKRKAPAPPVLSPKTGVLNENTVSAGKDLSTSPKPSPIPSPVLGRKPNASQSLLVWCKEVTKNYRGVKITNFTTSWRNGLSFCAILHHFRPDLIDYKSLNPQDIKENNKKAYDGFASIGISRLLEPSDMTESDPDADRTTLNHADHSSKIVQHRLLSRQEELKERARVLLEQARRDAALKAGNKHNTNTATPFCNRQLSDQQDEERRRQLRERARQLIAEARSGVKMSELPSYGEMAAEKLKERSKASGDENDNIEIDTNEEIPEGFVVGGGDELTNLENDLDTPEQNSKLVDLKLKKLLEVQPQVANSPSSAAQKAVTESSEQDMKSGTEDLRTERLQKTTERFRNPVVFSKDSTVRKTQLQSFSQYIENRPEMKRQRSIQEDTKKGNEEKAAITETQRKPSEDEVLNKGFKDTSQYVVGELAALENEQKQIDTRAALVEKRLRYLMDTGRNTEEEEAMMQEWFMLVNKKNALIRRMNQLSLLEKEHDLERRYELLNRELRAMLAIEDWQKTEAQKRREQLLLDELVALVNKRDALVRDLDAQEKQAEEEDEHLERTLEQNKGKMAKKEEKCVLQ

SEQ ID NO: 860608 - protein, 947 aa, Homo sapiens
MASVWKRLQRVGKHASKFQFVASYQELMVECTKKWQPDKLVVVWTRRSRRKSSKAHSWQPGIKNPYRGVVVWPVPENIEITVTLFKDPHAEEFEDKEWTFVIENESPSGRRKALATSSINMKQYASPMPTQTDVKLKFKPLSKKVVSAALQFSLSCIFLREGKATDEDMQSLASLMSMKQADIGNLDDFEEDNEDDDENRVNQEEKAAKITELINKLNFLDEAEKDLATVNSNPFDDPDAAELNPFGDPDSEEPITETASPRKTEDSFYNNSYNPFKEVQTPQYLNPFDEPEAFVTIKDSPPQSTKRKNIRPVDMSKYLYADSSKTEEEELDESNPFYEPKSTPPPNNLVNPVQELETERRVKRKAPAPPVLSPKTGVLNENTVSAGKDLSTSPKPSPIPSPVLGRKPNASQSLLVWCKEVTKNYRGVKITNFTTSWRNGLSFCAILHHFRPDLIDYKSLNPQDIKENNKKAYDGFASIGISRLLEPSDMVLLAIPDKLTVMTYLYQIRAHFSGQELNVVQIEENSSKSTYKVGNYETDTNSSVDQEKFYAELSDLKREPELQQPISGAVDFLSQDDSVFVNDSGVGESESEHQTPDDHLSPSTASPYCRRTKSDTEPQKSQQSSGRTSGSDDPGICSNTDSTQAQVLLGKKRLLKAETLELSDLYVSDKKKDMSPPFICEETDEQKLQTLDIGSNLEKEKLENSRSLECRSDPESPIKKTSLSPTSKLGYSYSRDLDLAKKKHASLRQTESDPDADRTTLNHADHSSKIVQQQDEERRRQLRERARQLIAEARSGVKMSELPSYGEMAAEKLKERSKASGEQNSKLVDLKLKKLLEVQPQVANSPSSAAQKAVTESSEQDMKSGTEDLRTERLQKTTERFRNPVVFSKDSTVRKTQLQSFSQYIENRPEMKRQRSIQEDTKKGNEEKAAITETQRKPSEDEVLNVY

SEQ ID NO: 860609 - protein, 77 aa, Homo sapiens
MINFIFYTNRLLRMVLKNYKRNELTVQKFYNYYTCVLFGGWEMYFYIVANHFIFVNLNLMGLFFFISLDVRFYSLFK

SEQ ID NO: 860610 - protein, 103 aa, Homo sapiens
VRGTGGRPSGQLVGGGSRPAQSRFTRRRLEPDRAEKERLLQIASKNSSGNWSWQACSQPWAPGAQDTAYHTAVWQMAVVLGWGCGVAGLVCWQSKWMEKLEML

SEQ ID NO: 860611 - protein, 142 aa, Homo sapiens
MPRGSRSAASRPASRPAAPSAHPPAHPPPSAAAPAPAPSGQPGLMAQMATTAAGVAVGSAVGHVMGSALTGAFSGGSSEPSQPAVQQAPTPAAPQPLQMGPCAYEIRQFLDCSTTQSDLSLCEGFSEALKQCKYYHGLSSLP

SEQ ID NO: 860612 - protein, 108 aa, Homo sapiens
PAVTSAAAFVPATAPLPPSLRSPGSHRRHHASGKPQRGLPASQPPRRALCPPARAPTALGSRPRMGPCAYEIRQFLDCSTTQSDLSLCEGFSEALKQCKYYHGLSSLP

SEQ ID NO: 860613 - protein, 142 aa, Homo sapiens; identical to SEQ ID NO: 860611

SEQ ID NO: 860614 - protein, 159 aa, Homo sapiens
MPRGSRSAASRPASRPAAPSAHPPAHPPPSAAAPAPAPSGQPGLMAQMATTAAGVAVGSAVGHVMGSALTGAFSGGSSEPSQPAVQQAPTPAAPQPLQMGPCAYEIRQFLDCSTTQSDLSLCEGFSEALKQCKYYHATSTPRRQPDHNTRLYPDSWDWK

SEQ ID NO: 860615 - protein, 131 aa, Homo sapiens
PCAYEIRQFLDCSTTQSDLSLCEGFSEALKQCKYYHVSEWTPTQAGRGRGQPSSCTCRLTTSLCCPSLPRSELPALKRSVQTRGPVLHPPLPLADSQTTTPDCTQIAGIGSEEVSHPTDNPRHKCAIKSLF

SEQ ID NO: 860616 - protein, 98 aa, Homo sapiens
PAVTSAAAFVPATAPLPPSLRSPGSHRRHHASGKPQRGLPASQAPTPAAPQPLQMGPCAYEIRQFLDCSTTQSDLSLCEGFSEALKQCKYYHGLSSLP

SEQ ID NO: 860617 - protein, 133 aa, Homo sapiens
VVCSPAFSILVCGFFSLIVVPPLPLVGVSSSSNMIRLVFARGSSSLLGVWFFDPAAASSPASFYYSCALLFRGRPLSLSHKVCGVAVAFLWGRLPRGGFFCWGAPPALSSFFFCLFLFVVFFCFVFVCFCLFF

SEQ ID NO: 860618 - protein, 147 aa, Homo sapiens
PAVTSAAAFVPATAPLPPSLRSPGSHRRHHASGKPQRGLPASQPPRRALCPPARAPTALGSRPSPRPFGPAGAHGSDGDHGRRGSRGLGCGTRHGQRPDRSLQRGELGALPACCPAGWGPAPMRSGSSWTVPPLRVTCPCVRASARP

SEQ ID NO: 860619 - protein, 442 aa, Homo sapiens
MSYNGLHQRVFKELKLLTLCSISSQIGPPEVALTTDEKSISVVLTAPEKWKRNPEDLPVSMQQIYSNLKYNVSVLNTKSNRTWSQCVTNHTLVLTWLEPNTLYCVHVESFVPGPPRRAQPSEKQCARTLKDQSSEFKAKIIFWYVLPISITVFLFSVMGYSIYRYIHVGKEKHPANLILIYGNEFDKRFFVPAEKIVINFITLNISDDSKISHQDMSLLGKSSDVSSLNDPQPSGNLRPPQEEEEVKHLGYASHLMEIFCDSEENTEGTSLTQQESLSRTIPPDKTVIEYEYDVRTTDICAGPEEQELSLQEEVSTQGTLLESQAALAVLGPQTLQYSYTPQLQDLDPLAQEHTDSEEGPEEEPSTTLVDWDPQTGRLCIPSLSSFDQDSEGCEPSEGDGLGEEGLLSRLYEEPAPDRPPGENETYLMQFMEEWGLYVQMEN

SEQ ID NO: 860620 - protein, 420 aa, Homo sapiens
MSYNGLHQRVFKELKLLTLCSISSPEKWKRNPEDLPVSMQQIYSNLKYNVSVLNTKSNRTWSQCVTNHTLVLTWLEPNTLYCVHVESFVPGPPRRAQPSEKQCARTLKDQSSEFKAKIIFWYVLPISITVFLFSVMGYSIYRYIHVGKEKHPANLILIYGNEFDKRFFVPAEKIVINFITLNISDDSKISHQDMSLLGKSSDVSSLNDPQPSGNLRPPQEEEEVKHLGYASHLMEIFCDSEENTEGTSLTQQESLSRTIPPDKTVIEYEYDVRTTDICAGPEEQELSLQEEVSTQGTLLESQAALAVLGPQTLQYSYTPQLQDLDPLAQEHTDSEEGPEEEPSTTLVDWDPQTGRLCIPSLSSFDQDSEGCEPSEGDGLGEEGLLSRLYEEPAPDRPPGENETYLMQFMEEWGLYVQMEN

SEQ ID NO: 860621 - protein, 68 aa, Homo sapiens
RGRACLVPGSLPSLPSQPGPWGALGTAAAEGLLSRLYEEPAPDRPPGENETYLMQFMEEWGLYVQMEN

SEQ ID NO: 860622 - protein, 209 aa, Homo sapiens
MRAPGRPALRPLPLPPLLLLLLAAPWGRAVPCVSGGLPKPANITFLSINMKNVLQWTPPEGLQGVKVTYTVQYFIYGQKKWLNKSECRNINRTYCDLSAETSDYEHQYYAKVKAIWGTKCSKWAESGRFYPFLETQIGPPEVALTTDEKSISVVLTAPEKWKRNPEDLPVSMQQIYSNLKYNVSVLNTKSNRTVSLKWNGAYIHVPLCS

SEQ ID NO: 860623 - protein, 553 aa, Homo sapiens
MRAPGRPALRPLPLPPLLLLLLAAPWGRAVPCVSGGLPKPANITFLSINMKNVLQWTPPEGLQGVKVTYTVQYFIYGQKKWLNKSECRNINRTYCDLSAETSDYEHQYYAKVKAIWGTKCSKWAESGRFYPFLETQIGPPEVALTTDEKSISVVLTAPEKWKRNPEDLPVSMQQIYSNLKYNVSVLNTKSNRTWSQCVTNHTLVLTWLEPNTLYCVHVESFVPGPPRRAQPSEKQCARTLKDQSSEFKAKIIFWYVLPISITVFLFSVMGYSIYRYIHVGKEKHPANLILIYGNEFDKRFFVPAEKIVINFITLNISDDSKISHQDMSLLGKSSDVSSLNDPQPSGNLRPPQEEEEVKHLGYASHLMEIFCDSEENTEGTSLTQQESLSRTIPPDKTVIEYEYDVRTTDICAGPEEQELSLQEEVSTQGTLLESQAALAVLGPQTLQYSYTPQLQDLDPLAQEHTDSEEGPEEEPSTTLVDWDPQTGRLCIPSLSSFDQDSEGCEPSEGDGLGEEGLLSRLYEEPAPDRPPGENETYLMQFMEEWGLYVQMEN

SEQ ID NO: 860624 - protein, 420 aa, Homo sapiens; identical to SEQ ID NO: 860620

SEQ ID NO: 860625 - protein, 553 aa, Homo sapiens; identical to SEQ ID NO: 860623

SEQ ID NO: 860626 - protein, 381 aa, Homo sapiens
MRAPGRPALRPLPLPPLLLLLLAAPWGRAVPCVSGGLPKPANITFLSINMKNVLQWTPPEGLQGVKVTYTVQYFIYGQKKWLNKSECRNINRTYCDLSAETSDYEHQYYAKVKAIWGTKCSKWAESGRFYPFLETQIGPPEVALTTDEKSISVVLTAPEKWKRNPEDLPVSMQQIYSNLKYNVSVLNTKSNRTWSQCVTNHTLVLTWLEPNTLYCVHVESFVPGPPRRAQPSEKQCARTLKDQSSEFKAKIIFWYVLPISITVFLFSVMGYSIYRYIHVGKEKHPANLILIYGNEFDKRFFVPAEKIVINFITLNISDDSKISHQDMSLLGKSSDVSSLNDPQPSGETLEGPLQGKEGRRVGNNLRGNWLSAIWNWRKFFW

SEQ ID NO: 860627 - protein, 171 aa, Homo sapiens [sequence omitted]

SEQ ID NO: 860628 - protein, 184 aa, Homo sapiens
MESFSSKSLALQAEKKLLSKMAGRSVAHLFIDETSSEVLDELYRVSKEYTHSRPQAQRVIKDLIKVAIKVAVLHRNGSFGPSELALATRFRQKLRQGAMTALSFGEVDFTFEAAVLAGLLTECRDVLLELVEHHLTPKSHGRIRHVFDHFSDPGLLTALYGPDFTQHLGKICDGLRKLLDEGKL

SEQ ID NO: 860629 - protein, 228 aa, Homo sapiens
MSPFLFRDDMKDLTVFLNSLTPKFYVALTGTSSLISGLIFIFEWWYFHKHGTSFIEQVSVSHLQPLMGGTESSISEPGSPSRNRENETSRQNLSECKVWRNPLNLFRGAEYRRYTWVTGKEPLTYYDMNLSAQDHQTFFTCDTDFLRPSDTVMQKAWRERNPPARIKAAYQALELNNDCATAYVLLAEEEATTIVDAERLFKQALKAGETIYRQSQQCQHQSPQHEAQ

SEQ ID NO: 860630 - protein, 152 aa, Homo sapiens
MGGTESSISEPGSPSRNRENETSRQNLSECKVWRNPLNLFRGAEYRRYTWVTGKEPLTYYDMNLSAQDHQTFFTCDTDFLRPSDTVMQKAWRERNPPARIKAAYQALELNNEYKPSKVSSNLLHSSTVEDKDCFRKILSRNSLQKRIKHSRN

SEQ ID NO: 860631 - protein, 218 aa, Homo sapiens
MSPFLFRDDMKDLTVFLNSLTPKFYVALTGTSSLISGLIFIFEWWYFHKHGTSFIEQVSVSHLQPLMGGTESSISEPGSPSRNRENETSRQNLSECKVWRNPLNLFRGAEYRRYTWVTGKEPLTYYDMNLSAQDHQTFFTCDTDFLRPSDTVMQKAWRERNPPARIKAAYQALELNNEYKPSKVSSNLLHSSTVEDKDCFRKILSRNSLQKRIKHSRN

SEQ ID NO: 860632 - protein, 152 aa, Homo sapiens; identical to SEQ ID NO: 860630

SEQ ID NO: 860633 - protein, 163 aa, Homo sapiens
MADRGGVGEAAAVGASPASVPGLNPTLGWRERLRAGLAGTGASLWFVAGLGLLYALRIPLRLCENLAAVTVFLNSLTPKFYVALTGTSSLISGLIFIFEWWYFHKHGTSFIEQVSVSHLQPLMGGTESSISEPGSPSRNRENETSRQNLSGDYFSNVFSELCI

SEQ ID NO: 860634 - protein, 274 aa, Homo sapiens
MADRGGVGEAAAVGASPASVPGLNPTLGWRERLRAGLAGTGASLWFVAGLGLLYALRIPLRLCENLAAVTVFLNSLTPKFYVALTGTSSLISGLIFIFEWWYFHKHGTSFIEQVSVSHLQPLMGGTESSISEPGSPSRNRENETSRQNLSECKVWRNPLNLFRGAEYRRYTWVTGKEPLTYYDMNLSAQDHQTFFTCDTDFLRPSDTVMQKAWRERNPPARIKAAYQALELNNEYKPSKVSSNLLHSSTVEDKDCFRKILSRNSLQKRIKHSRN

SEQ ID NO: 860635 - protein, 284 aa, Homo sapiens
MADRGGVGEAAAVGASPASVPGLNPTLGWRERLRAGLAGTGASLWFVAGLGLLYALRIPLRLCENLAAVTVFLNSLTPKFYVALTGTSSLISGLIFIFEWWYFHKHGTSFIEQVSVSHLQPLMGGTESSISEPGSPSRNRENETSRQNLSECKVWRNPLNLFRGAEYRRYTWVTGKEPLTYYDMNLSAQDHQTFFTCDTDFLRPSDTVMQKAWRERNPPARIKAAYQALELNNDCATAYVLLAEEEATTIVDAERLFKQALKAGETIYRQSQQCQHQSPQHEAQ

SEQ ID NO: 860636 - protein, 260 aa, Homo sapiens
MADRGGVGEAAAVGASPASVPGLNPTLGWRERLRAGLAGTGASLWFVAGLGLLYALRIPLRLCENLAAVTVFLNSLTPKFYVALTGTSSLISGLIFIFEWWYFHKHGTSFIEQVSVSHLQPLMGGTESSISEPGSPSRNRENETSRQNLSDGISLLLPRLECNVAILAHCNLHLPGSSDSPAPASRVAGITSTCHHARVIFVFLVEMGFRHVGQTGLKPLTSDDSSTSASQSAGITGMSHQAWPILSSFLSTFIAPYLGP

SEQ ID NO: 860637 - protein, 166 aa, Homo sapiens
MADRGGVGEAAAVGASPASVPGLNPTLGWRERLRAGLAGTGASLWFVAGLGLLYALRIPLRLCENLAAVTVFLNSLTPKFYVALTGTSSLISGLIFIFEWWYFHKHGTSFIEQVSVSHLQPLMGGTESSISEPGSPSRNRENETSRQNLSGSLGGDQVMRAVPSGM

SEQ ID NO: 860638 - protein, 219 aa, Homo sapiens
MADRGGVGEAAAVGASPASVPGLNPTLGWRERLRAGLAGTGASLWFVAGLGLLYALRIPLRLCENLAAVTVFLNSLTPKFYVALTGTSSLISGLIFIFEWWYFHKHGTSFIEQVSVSHLQPLMGGTESSISEPGSPSRNRENETSRQNLSECKVWRNPLNLFRGAEYRSCATAYVLLAEEEATTIVDAERLFKQALKAGETIYRQSQQCQHQSPQHEAQ

SEQ ID NO: 860639 - protein, 162 aa, Homo sapiens
MGGTESSISEPGSPSRNRENETSRQNLSECKVWRNPLNLFRGAEYRRYTWVTGKEPLTYYDMNLSAQDHQTFFTCDTDFLRPSDTVMQKAWRERNPPARIKAAYQALELNNDCATAYVLLAEEEATTIVDAERLFKQALKAGETIYRQSQQCQHQSPQHEAQ

SEQ ID NO: 860640 - protein, 274 aa, Homo sapiens; identical to SEQ ID NO: 860634

SEQ ID NO: 860641 - protein, 152 aa, Homo sapiens; identical to SEQ ID NO: 860630

SEQ ID NO: 860642 - protein, 271 aa, Homo sapiens
KLGRIREAVKIMRDLMKEFPPLTMLNIHENLLESLLELQAYPDVQAVLAKYDDISLPKSAAICYTAALLKTRTVSEKFSPETASRRGLSTAEINAVEAIHRAVEFNPHVPKYLLEMKSLILPPEHILKRGDSEAIAYAFFHLQHWKQIEGALNLLQCTWEGTFRMIPYPLEKGHLFYPYPSCTETADRELLPTFHHVSVYPKKELPLFIHFTAGFCSSTAMIAILTHQFPEIMGIFAKAVLGLWCPQPWASSGFEENTQDLKSEDLGLSSG

SEQ ID NO: 860643 - protein, 152 aa, Homo sapiens; identical to SEQ ID NO: 860630

SEQ ID NO: 860644 - protein, 80 aa, Homo sapiens
RKPSDGITAAAVGRTRPETPTKRAPCQLCAGVTSPNASARARAPGSRVCLSDCIFKFIDTQILCGTYRDLFIDIRTNIYI

SEQ ID NO: 860645 - protein, 154 aa, Homo sapiens
MADRGGVGEAAAVGASPASVPGLNPTLGWRERLRAGLAGTGASLWFVAGLGLLYALRIPLRLCENLAAVTVFLNSLTPKFYVALTGTSSLISGLIFIFEWWYFHKHGTSFIEQVSVSHLQPLMGGTESSISEPGSPSRNRENETSRQNLSDTLG

SEQ ID NO: 860646 - protein, 274 aa, Homo sapiens; identical to SEQ ID NO: 860634

SEQ ID NO: 860647 - protein, 138 aa, Homo sapiens
MGGTESSISEPGSPSRNRENETSRQNLSDGISLLLPRLECNVAILAHCNLHLPGSSDSPAPASRVAGITSTCHHARVIFVFLVEMGFRHVGQTGLKPLTSDDSSTSASQSAGITGMSHQAWPILSSFLSTFIAPYLGP

SEQ ID NO: 860648 - protein, 1923 aa, Homo sapiens
MAAGTWSPCRRAAAAERTRGVRGARSRPGPGHERAVLESPSRGARPRPSGRPASLAMARLADYFVLVAFGPHPRGSGEGQGQILQRFPEKDWEDNPFPQGIELFCQPSGWQLCPERNPPTFFVAVLTDINSERHYCACLTFWEPAEPSQETTRVEDATEREEEGDEGGQTHLSPTAPAPSAQLFAPKTLVLVSRLDHTEVFRNSLGLIYAIHVEGLNVCLENVIGNLLTCTVPLAGGSQRTISLGAGDRQVIQTPLADSLPVSRCSVALLFRQLGITNVLSLFCAALTEHKVLFLSRSYQRLADACRGLLALLFPLRYSFTYVPILPAQLLEVLSTPTPFIIGVNAAFQAETQELLDVIVADLDGGTVTIPECVHIPPLPEPLQSQTHSVLSMVLDPELELADLAFPPPTTSTSSLKMQDKELRAVFLRLFAQLLQGYRWCLHVVRIHPEPVIRFHKAAFLGQRGLVEDDFLMKVLEGMAFAGFVSERGVPYRPTDLFDELVAHEVARMRADENHPQRVLRHVQELAEQLYKNENPYPAVAMHKVQRPGESSHLRRVPRPFPRLDEGTVQWIVDQAAAKMQGAPPAVKAERRTTVPSGPPMTAILERCSGLHVNSARRLEVVRNCISYVFEGKMLEAKKLLPAVLRALKGRAARRCLAQELHLHVQQNRAVLDHQQFDFVVRMMNCCLQDCTSLDEHGIAAALLPLVTAFCRKLSPGVTQFAYSCVQEHVVWSTPQFWEAMFYGDVQTHIRALYLEPTEDLAPAQEVGEAPSQEDERSALDVASEQRRLWPTLSREKQQELVQKEESTVFSQAIHYANRMSYLLLPLDSSKSRLLRERAGLGDLESASNSLVTNSMAGSVAESYDTESGFEDAETCDVAGAVVRFINRFVDKVCTESGVTSDHLKGLHVMVPDIVQMHIETLEAVQRESRRLPPIQKPKLLRPRLLPGEECVLDGLRVYLLPDGREEGAGGSAGGPALLPAEGAVFLTTYRVIFTGMPTDPLVGEQVVVRSFPVAALTKEKRISVQTPVDQLLQDGLQLRSCTFQLLKMAFDEEVGSDSAELFRKQLHKLRYPPDIRATFAFTLGSAHTPGRPPRVTKDKGPSLRTLSRNLVKNAKKTIGRQHVTRKKYNPPSWEHRGQPPPEDQEDEISVSEELEPSTLTPSSALKPSDRMTMSSLVERACCRDYQRLGLGTLSSSLSRAKSEPFRISPVNRMYAICRSYPGLLIVPQSVQDNALQRVSRCYRQNRFPVVCWRSGRSKAVLLRSGGLHGKGVVGLFKAQNAPSPGQSQADSSSLEQEKYLQAVVSSMPRYADASGRNTLSGFSSAHMGSHGKWGSVRTSGRSSGLGTDVGSRLAGRDALAPPQANGGPPDPGFLRPQRAALYILGDKAQLKGVRSDPLQQWELVPIEVFEARQVKASFKKLLKACVPGCPAAEPSPASFLRSLEDSEWLIQIHKLLQVSVLVVELLDSGSSVLVGLEDGWDITTQVVSLVQLLSDPFYRTLEGFRLLVEKEWLSFGHRFSHRGAHTLAGQSSGFTPVFLQFLDCVHQVHLQFPMEFEFSQFYLKFLGYHHVSRRFRTFLLDSDYERIELGLLYEEKGERRGQVPCRSVWEYVDRLSKRTPVFHNYMYAPEDAEVLRPYSNVSNLKVWDFYTEETLAEGPPYDWELAQGPPEPPEEERSDGGAPQSRRRVVWPCYDSCPRAQPDAISRLLEELQRLETELGQPAERWKDTWDRVKAAQRLEGRPDGRGTPSSLLVSTAPHHRRSLGVYLQEGPVGSTLSLSLDSDQSSGSTTSGSRQAARRSTSTLYSQFQTAESENRSYEGTLYKKGAFMKPWKARWFVLDKTKHQLRYYDHRVDTECKGVIDLAEVEAVAPGTPTMGAPKTVDEKAFFDVKTTRRVYNFCAQDVPSAQQWVDRIQSCLSDA

SEQ ID NO: 860649 - protein, 1750 aa, Homo sapiens
HQTPAPVWPAVCTEDAVSDVLTWKNPGVRNSLGLIYAIHVEGLNVCLENVIGNLLTCTVPLAGGSQRTISLGAGDRQVIQTPLADSLPVSRCSVALLFRQLGITNVLSLFCAALTEHKVLFLSRSYQRLADACRGLLALLFPLRYSFTYVPILPAQLLEVLSTPTPFIIGVNAAFQAETQELLDVIVADLDGGTVTIPECVHIPPLPEPLQSQTHSVLSMVLDPELELADLAFPPPTTSTSSLKMQDKELRAVFLRLFAQLLQGYRWCLHVVRIHPEPVIRFHKAAFLGQRGLVEDDFLMKVLEGMAFAGFVSERGVPYRPTDLFDELVAHEVARMRADENHPQRVLRHVQELAEQLYKNENPYPAVAMHKVQRPGESSHLRRVPRPFPRLDEGTVQWIVDQAAAKMQGAPPAVKAERRTTVPSGPPMTAILERCSGLHVNSARRLEVVRNCISYVFEGKMLEAKKLLPAVLRALKGRAARRCLAQELHLHVQQNRAVLDHQQFDFVVRMMNCCLQDCTSLDEHGIAAALLPLVTAFCRKLSPGVTQFAYSCVQEHVVWSTPQFWEAMFYGDVQTHIRALYLEPTEDLAPAQEVGEAPSQEDERSALDVASEQRRLWPTLSREKQQELVQKEESTVFSQAIHYANRMSYLLLPLDSSKSRLLRERAGLGDLESASNSLVTNSMAGSVAESYDTESGFEDAETCDVAGAVVRFINRFVDKVCTESGVTSDHLKGLHVMVPDIVQMHIETLEAVQRESRRLPPIQKPKLLRPRLLPGEECVLDGLRVYLLPDGREEGAGGSAGGPALLPAEGAVFLTTYRVIFTGMPTDPLVGEQVVVRSFPVAALTKEKRISVQTPVDQLLQDGLQLRSCTFQLLKMAFDEEVGSDSAELFRKQLHKLRYPPDIRATFAFTLGSAHTPGRPPRVTKDKGPSLRTLSRNLVKNAKKTIGRQHVTRKKYNPPSWEHRGQPPPEDQEDEISVSEELEPSTLTPSSALKPSDRMTMSSLVERACCRDYQRLGLGTLSSSLSRAKSEPFRISPVNRMYAICRSYPGLLIVPQSVQDNALQRVSRCYRQNRFPVVCWRSGRSKAVLLRSGGLHGKGVVGLFKAQNAPSPGQSQADSSSLEQEKYLQAVVSSMPRYADASGRNTLSGFSSAHMGSHGKWGSVRTSGRSSGLGTDVGSRLAGRDALAPPQANGGPPDPGFLRPQRAALYILGDKAQLKGVRSDPLQQWELVPIEVFEARQVKASFKKLLKACVPGCPAAEPSPASFLRSLEDSEWLIQIHKLLQVSVLVVELLDSGSSVLVGLEDGWDITTQVVSLVQLLSDPFYRTLEGFRLLVEKEWLSFGHRFSHRGAHTLAGQSSGFTPVFLQFLDCVHQVHLQFPMEFEFSQFYLKFLGYHHVSRRFRTFLLDSDYERIELGLLYEEKGERRGQVPCRSVWEYVDRLSKRTPVFHNYMYAPEDAEVLRPYSNVSNLKVWDFYTEETLAEGPPYDWELAQGPPEPPEEERSDGGAPQSRRRVVWPCYDSCPRAQPDAISRLLEELQRLETELGQPAERWKDTWDRVKAAQRLEGRPDGRGTPSSLLVSTAPHHRRSLGVYLQEGPVGSTLSLSLDSDQSSGSTTSGSRQAARRSTSTLYSQFQTAESENRSYEGTLYKKGAFMKPWKARWFVLDKTKHQLRYYDHRVDTECKGVIDLAEVEAVAPGTPTMGAPKTVDEKAFFDVKTTRRVYNFCAQDVPSAQQWVDRIQSCLSDA

SEQ ID NO: 860650 - protein, 1661 aa, Homo sapiens
AQGPLQASLLPLGITNVLSLFCAALTEHKVLFLSRSYQRLADACRGLLALLFPLRYSFTYVPILPAQLLEVLSTPTPFIIGVNAAFQAETQELLDVIVADLDGGTVTIPECVHIPPLPEPLQSQTHSVLSMVLDPELELADLAFPPPTTSTSSLKMQDKELRAVFLRLFAQLLQGYRWCLHVVRIHPEPVIRFHKAAFLGQRGLVEDDFLMKVLEGMAFAGFVSERGVPYRPTDLFDELVAHEVARMRADENHPQRVLRHVQELAEQLYKNENPYPAVAMHKVQRPGESSHLRRVPRPFPRLDEGTVQWIVDQAAAKMQGAPPAVKAERRTTVPSGPPMTAILERCSGLHVNSARRLEVVRNCISYVFEGKMLEAKKLLPAVLRALKGRAARRCLAQELHLHVQQNRAVLDHQQFDFVVRMMNCCLQDCTSLDEHGIAAALLPLVTAFCRKLSPGVTQFAYSCVQEHVVWSTPQFWEAMFYGDVQTHIRALYLEPTEDLAPAQEVGEAPSQEDERSALDVASEQRRLWPTLSREKQQELVQKEESTVFSQAIHYANRMSYLLLPLDSSKSRLLRERAGLGDLESASNSLVTNSMAGSVAESYDTESGFEDAETCDVAGAVVRFINRFVDKVCTESGVTSDHLKGLHVMVPDIVQMHIETLEAVQRESRRLPPIQKPKLLRPRLLPGEECVLDGLRVYLLPDGREEGAGGSAGGPALLPAEGAVFLTTYRVIFTGMPTDPLVGEQVVVRSFPVAALTKEKRISVQTPVDQLLQDGLQLRSCTFQLLKMAFDEEVGSDSAELFRKQLHKLRYPPDIRATFAFTLGSAHTPGRPPRVTKDKGPSLRTLSRNLVKNAKKTIGRQHVTRKKYNPPSWEHRGQPPPEDQEDEISVSEELEPSTLTPSSALKPSDRMTMSSLVERACCRDYQRLGLGTLSSSLSRAKSEPFRISPVNRMYAICRSYPGLLIVPQSVQDNALQRVSRCYRQNRFPVVCWRSGRSKAVLLRSGGLHGKGVVGLFKAQNAPSPGQSQADSSSLEQEKYLQAVVSSMPRYADASGRNTLSGFSSAHMGSHGKWGSVRTSGRSSGLGTDVGSRLAGRDALAPPQANGGPPDPGFLRPQRAALYILGDKAQLKGVRSDPLQQWELVPIEVFEARQVKASFKKLLKACVPGCPAAEPSPASFLRSLEDSEWLIQIHKLLQVSVLVVELLDSGSSVLVGLEDGWDITTQVVSLVQLLSDPFYRTLEGFRLLVEKEWLSFGHRFSHRGAHTLAGQSSGFTPVFLQFLDCVHQVHLQFPMEFEFSQFYLKFLGYHHVSRRFRTFLLDSDYERIELGLLYEEKGERRGQVPCRSVWEYVDRLSKRTPVFHNYMYAPEDAEVLRPYSNVSNLKVWDFYTEETLAEGPPYDWELAQGPPEPPEEERSDGGAPQSRRRVVWPCYDSCPRAQPDAISRLLEELQRLETELGQPAERWKDTWDRVKAAQRLEGRPDGRGTPSSLLVSTAPHHRRSLGVYLQEGPVGSTLSLSLDSDQSSGSTTSGSRQAARRSTSTLYSQFQTAESENRSYEGTLYKKGAFMKPWKARWFVLDKTKHQLRYYDHRVDTECKGVIDLAEVEAVAPGTPTMGAPKTVDEKAFFDVKTTRRVYNFCAQDVPSAQQWVDRIQSCLSDA

SEQ ID NO: 860651 - protein, 1503 aa, Homo sapiens
TPGSESGRTWRRRWSFRPLLSFSWPSWVPCLQSPGGKAAFLGQRGLVEDDFLMKVLEGMAFAGFVSERGVPYRPTDLFDELVAHEVARMRADENHPQRVLRHVQELAEQLYKNENPYPAVAMHKVQRPGESSHLRRVPRPFPRLDEGTVQWIVDQAAAKMQGAPPAVKAERRTTVPSGPPMTAILERCSGLHVNSARRLEVVRNCISYVFEGKMLEAKKLLPAVLRALKGRAARRCLAQELHLHVQQNRAVLDHQQFDFVVRMMNCCLQDCTSLDEHGIAAALLPLVTAFCRKLSPGVTQFAYSCVQEHVVWSTPQFWEAMFYGDVQTHIRALYLEPTEDLAPAQEVGEAPSQEDERSALDVASEQRRLWPTLSREKQQELVQKEESTVFSQAIHYANRMSYLLLPLDSSKSRLLRERAGLGDLESASNSLVTNSMAGSVAESYDTESGFEDAETCDVAGAVVRFINRFVDKVCTESGVTSDHLKGLHVMVPDIVQMHIETLEAVQRESRRLPPIQKPKLLRPRLLPGEECVLDGLRVYLLPDGREEGAGGSAGGPALLPAEGAVFLTTYRVIFTGMPTDPLVGEQVVVRSFPVAALTKEKRISVQTPVDQLLQDGLQLRSCTFQLLKMAFDEEVGSDSAELFRKQLHKLRYPPDIRATFAFTLGSAHTPGRPPRVTKDKGPSLRTLSRNLVKNAKKTIGRQHVTRKKYNPPSWEHRGQPPPEDQEDEISVSEELEPSTLTPSSALKPSDRMTMSSLVERACCRDYQRLGLGTLSSSLSRAKSEPFRISPVNRMYAICRSYPGLLIVPQSVQDNALQRVSRCYRQNRFPVVCWRSGRSKAVLLRSGGLHGKGVVGLFKAQNAPSPGQSQADSSSLEQEKYLQAVVSSMPRYADASGRNTLSGFSSAHMGSHGKWGSVRTSGRSSGLGTDVGSRLAGRDALAPPQANGGPPDPGFLRPQRAALYILGDKAQLKGVRSDPLQQWELVPIEVFEARQVKASFKKLLKACVPGCPAAEPSPASFLRSLEDSEWLIQIHKLLQVSVLVVELLDSGSSVLVGLEDGWDITTQVVSLVQLLSDPFYRTLEGFRLLVEKEWLSFGHRFSHRGAHTLAGQSSGFTPVFLQFLDCVHQVHLQFPMEFEFSQFYLKFLGYHHVSRRFRTFLLDSDYERIELGLLYEEKGERRGQVPCRSVWEYVDRLSKRTPVFHNYMYAPEDAEVLRPYSNVSNLKVWDFYTEETLAEGPPYDWELAQGPPEPPEEERSDGGAPQSRRRVVWPCYDSCPRAQPDAISRLLEELQRLETELGQPAERWKDTWDRVKAAQRLEGRPDGRGTPSSLLVSTAPHHRRSLGVYLQEGPVGSTLSLSLDSDQSSGSTTSGSRQAARRSTSTLYSQFQTAESENRSYEGTLYKKGAFMKPWKARWFVLDKTKHQLRYYDHRVDTECKGVIDLAEVEAVAPGTPTMGAPKTVDEKAFFDVKTTRRVYNFCAQDVPSAQQWVDRIQSCLSDA

SEQ ID NO: 860652 - protein, 2013 aa, Homo sapiens
MAAGTWSPCRRAAAAERTRGVRGARSRPGPGHERAVLESPSRGARPRPSGRPASLAMARLADYFVLVAFGPHPRGSGEGQGQILQRFPEKDWEDNPFPQGIELFCQPSGWQLCPERNPPTFFVAVLTDINSERHYCACLTFWEPAEPSQETTRVEDATEREEEGDEGGQTHLSPTAPAPSAQLFAPKTLVLVSRLDHTEVFRNSLGLIYAIHVEGLNVCLENVIGNLLTCTVPLAGGSQRTISLGAGDRQVIQTPLADSLPVSRCSVALLFRQLGITNVLSLFCAALTEHKVLFLSRSYQRLADACRGLLALLFPLRYSFTYVPILPAQLLEVLSTPTPFIIGVNAAFQAETQELLDVIVADLDGGTVTIPECVHIPPLPEPLQSQTHSVLSMVLDPELELADLAFPPPTTSTSSLKMQDKELRAVFLRLFAQLLQGYRWCLHVVRIHPEPVIRFHKAAFLGQRGLVEDDFLMKVLEGMAFAGFVSERGVPYRPTDLFDELVAHEVARMRADENHPQRVLRHVQELAEQLYKNENPYPAVAMHKVQRPGESSHLRRVPRPFPRLDEGTVQWIVDQAAAKMQGAPPAVKAERRTTVPSGPPMTAILERCSGLHVNSARRLEVVRNCISYVFEGKMLEAKKLLPAVLRALKGRAARRCLAQELHLHVQQNRAVLDHQQFDFVVRMMNCCLQDCTSLDEHGIAAALLPLVTAFCRKLSPGVTQFAYSCVQEHVVWSTPQFWEAMFYGDVQTHIRALYLEPTEDLAPAQEVGEAPSQEDERSALDVASEQRRLWPTLSREKQQELVQKEESTVFSQAIHYANRMSYLLLPLDSSKSRLLRERAGLGDLESASNSLVTNSMAGSVAESYDTESGFEDAETCDVAGAVVRFINRFVDKVCTESGVTSDHLKGLHVMVPDIVQMHIETLEAVQRESRRLPPIQKPKLLRPRLLPGEECVLDGLRVYLLPDGREEGAGGSAGGPALLPAEGAVFLTTYRVIFTGMPTDPLVGEQVVVRSFPVAALTKEKRISVQTPVDQLLQDGLQLRSCTFQLLKMAFDEEVGSDSAELFRKQLHKLRYPPDIRATFAFTLGSAHTPGRPPRVTKDKGPSLRTLSRNLVKNAKKTIGRQHVTRKKYNPPSWEHRGQPPPEDQEDEISVSEELEPSTLTPSSALKPSDRMTMSSLVERACCRDYQRLGLGTLSSSLSRAKSEPFRISPVNRMYAICRSYPGLLIVPQSVQDNALQRVSRCYRQNRFPVVCWRSGRSKAVLLRSGGLHGKGVVGLFKAQNAPSPGQSQADSSSLEQEKYLQAVVSSMPRYADASGRNTLSGFSSAHMGSHVPSPRARVTTLSNPMAASASRRTAPRGTVPSLRRPASPYLVLAASVCTELLRALMSPSTPDTNDPSPEPHQPQVSGALAPFGCLPGISFTGKWGSVRTSGRSSGLGTDVGSRLAGRDALAPPQANGGPPDPGFLRPQRAALYILGDKAQLKGVRSDPLQQWELVPIEVFEARQVKASFKKLLKACVPGCPAAEPSPASFLRSLEDSEWLIQIHKLLQVSVLVVELLDSGSSVLVGLEDGWDITTQVVSLVQLLSDPFYRTLEGFRLLVEKEWLSFGHRFSHRGAHTLAGQSSGFTPVFLQFLDCVHQVHLQFPMEFEFSQFYLKFLGYHHVSRRFRTFLLDSDYERIELGLLYEEKGERRGQVPCRSVWEYVDRLSKRTPVFHNYMYAPEDAEVLRPYSNVSNLKVWDFYTEETLAEGPPYDWELAQGPPEPPEEERSDGGAPQSRRRVVWPCYDSCPRAQPDAISRLLEELQRLETELGQPAERWKDTWDRVKAAQRLEGRPDGRGTPSSLLVSTAPHHRRSLGVYLQEGPVGSTLSLSLDSDQSSGSTTSGSRQAARRSTSTLYSQFQTAESENRSYEGTLYKKGAFMKPWKARWFVLDKTKHQLRYYDHRVDTECKGVIDLAEVEAVAPGTPTMGAPKTVDEKAFFDVKTTRRVYNFCAQDVPSAQQWVDRIQSCLSDA

SEQ ID NO: 860653 - protein, 1973 aa, Homo sapiens
MAAGTWSPCRRAAAAERTRGVRGARSRPGPGHERAVLESPSRGARPRPSGRPASLAMARLADYFVLVAFGPHPRGSGEGQGQILQRFPEKDWEDNPFPQGIELFCQPSGWQLCPERNPPTFFVAVLTDINSERHYCACLTFWEPAEPSQETTRVEDATEREEEGDEGGQTHLSPTAPAPSAQLFAPKTLVLVSRLDHTEVFRNSLGLIYAIHVEGLNVCLENVIGNLLTCTVPLAGGSQRTISLGAGDRQVIQTPLADSLPVSRCSVALLFRQLGITNVLSLFCAALTEHKVLFLSRSYQRLADACRGLLALLFPLRYSFTYVPILPAQLLEVLSTPTPFIIGVNAAFQAETQELLDVIVADLDGGTVTIPECVHIPPLPEPLQSQTHSVLSMVLDPELELADLAFPPPTTSTSSLKMQDKELRAVFLRLFAQLLQGYRWCLHVVRIHPEPVIRFHKAAFLGQRGLVEDDFLMKVLEGMAFAGFVSERGVPYRPTDLFDELVAHEVARMRADENHPQRVLRHVQELAEQLYKNENPYPAVAMHKVQRPGESSHLRRVPRPFPRLDEGTVQWIVDQAAAKMQGAPPAVKAERRTTVPSGPPMTAILERCSGLHVNSARRLEVVRNCISYVFEGKMLEAKKLLPAVLRALKGRAARRCLAQELHLHVQQNRAVLDHQQFDFVVRMMNCCLQDCTSLDEHGIAAALLPLVTAFCRKLSPGVTQFAYSCVQEHVVWSTPQFWEAMFYGDVQTHIRALYLEPTEDLAPAQEVGEAPSQEDERSALDVASEQRRLWPTLSREKQQELVQKEESTVFSQAIHYANRMSYLLLPLDSSKSRLLRERAGLGDLESASNSLVTNSMAGSVAESYDTESGFEDAETCDVAGAVVRFINRFVDKVCTESGVTSDHLKGLHVMVPDIVQMHIETLEAVQRESRRLPPIQKPKLLRPRLLPGEECVLDGLRVYLLPDGREEGAGGSAGGPALLPAEGAVFLTTYRVIFTGMPTDPLVGEQVVVRSFPVAALTKEKRISVQTPVDQLLQDGLQLRSCTFQLLKMAFDEEVGSDSAELFRKQLHKLRYPPDIRATFAFTLGSAHTPGRPPRVTKDKGPSLRTLSRNLVKNAKKTIGRQHVTRKKYNPPSWEHRGQPPPEDQEDEISVSEELEPSTLTPSSALKPSDRMTMSSLVERACCRDYQRLGLGTLSSSLSRAKSEPFRISPVNRMYAICRSYPGLLIVPQSVQDNALQRVSRCYRQNRFPVVCWRSGRSKAVLLRSGGLHGKGVVGLFKAQNAPSPGQSQADSSSLEQEKYLQAVVSSMPRYADASGRNTLSGFSSAHMGSHVPSPRARVTTLSNPMAASASRRTAPRGKWGSVRTSGRSSGLGTDVGSRLAGRDALAPPQANGGPPDPGFLRPQRAALYILGDKAQLKGVRSDPLQQWELVPIEVFEARQVKASFKKLLKACVPGCPAAEPSPASFLRSLEDSEWLIQIHKLLQVSVLVVELLDSGSSVLVGLEDGWDITTQVVSLVQLLSDPFYRTLEGFRLLVEKEWLSFGHRFSHRGAHTLAGQSSGFTPVFLQFLDCVHQVHLQFPMEFEFSQFYLKFLGYHHVSRRFRTFLLDSDYERIELGMWGVGAGAARVRRAPGSVLLLCRGLLYEEKGERRGQVPCRSVWEYVDRLSKRTPVFHNYMYAPEDAEVLRPYSNVSNLKVWDFYTEETLAEGPPYDWELAQGPPEPPEEERSDGGAPQSRRRVVWPCYDSCPRAQPDAISRLLEELQRLETELGQPAERWKDTWDRVKAAQRLEGRPDGRGTPSSLLVSTAPHHRRSLGVYLQEGPVGSTLSLSLDSDQSSGSTTSGSRQAARRSTSTLYSQFQTAESENRSYEGTLYKKGAFMKPWKARWFVLDKTKHQLRYYDHRVDTECKGVIDLAEVEAVAPGTPTMGAPKTVDEKAFFDVKTTRRVYNFCAQDVPSAQQWVDRIQSCLSDA

SEQ ID NO: 860654 - protein, 1949 aa, Homo sapiens
MAAGTWSPCRRAAAAERTRGVRGARSRPGPGHERAVLESPSRGARPRPSGRPASLAMARLADYFVLVAFGPHPRGSGEGQGQILQRFPEKDWEDNPFPQGIELFCQPSGWQLCPERNPPTFFVAVLTDINSERHYCACLTFWEPAEPSQETTRVEDATEREEEGDEGGQTHLSPTAPAPSAQLFAPKTLVLVSRLDHTEVFRNSLGLIYAIHVEGLNVCLENVIGNLLTCTVPLAGGSQRTISLGAGDRQVIQTPLADSLPVSRCSVALLFRQLGITNVLSLFCAALTEHKVLFLSRSYQRLADACRGLLALLFPLRYSFTYVPILPAQLLEVLSTPTPFIIGVNAAFQAETQELLDVIVADLDGGTVTIPECVHIPPLPEPLQSQTHSVLSMVLDPELELADLAFPPPTTSTSSLKMQDKELRAVFLRLFAQLLQGYRWCLHVVRIHPEPVIRFHKAAFLGQRGLVEDDFLMKVLEGMAFAGFVSERGVPYRPTDLFDELVAHEVARMRADENHPQRVLRHVQELAEQLYKNENPYPAVAMHKVQRPGESSHLRRVPRPFPRLDEGTVQWIVDQAAAKMQGAPPAVKAERRTTVPSGPPMTAILERCSGLHVNSARRLEVVRNCISYVFEGKMLEAKKLLPAVLRALKGRAARRCLAQELHLHVQQNRAVLDHQQFDFVVRMMNCCLQDCTSLDEHGIAAALLPLVTAFCRKLSPGVTQFAYSCVQEHVVWSTPQFWEAMFYGDVQTHIRALYLEPTEDLAPAQEVGEAPSQEDERSALDVASEQRRLWPTLSREKQQELVQKEESTVFSQAIHYANRMSYLLLPLDSSKSRLLRERAGLGDLESASNSLVTNSMAGSVAESYDTESGFEDAETCDVAGAVVRFINRFVDKVCTESGVTSDHLKGLHVMVPDIVQMHIETLEAVQRESRRLPPIQKPKLLRPRLLPGEECVLDGLRVYLLPDGREEGAGGSAGGPALLPAEGAVFLTTYRVIFTGMPTDPLVGEQVVVRSFPVAALTKEKRISVQTPVDQLLQDGLQLRSCTFQLLKMAFDEEVGSDSAELFRKQLHKLRYPPDIRATFAFTLGSAHTPGRPPRVTKDKGPSLRTLSRNLVKNAKKTIGRQHVTRKKYNPPSWEHRGQPPPEDQEDEISVSEELEPSTLTPSSALKPSDRMTMSSLVERACCRDYQRLGLGTLSSSLSRAKSEPFRISPVNRMYAICRSYPGLLIVPQSVQDNALQRVSRCYRQNRFPVVCWRSGRSKAVLLRSGGLHGKGVVGLFKAQNAPSPGQSQADSSSLEQEKYLQAVVSSMPRYADASGRNTLSGFSSAHMGSHVPSPRARVTTLSNPMAASASRRTAPRGKWGSVRTSGRSSGLGTDVGSRLAGRDALAPPQANGGPPDPGFLRPQRAALYILGDKAQLKGVRSDPLQQWELVPIEVFEARQVKASFKKLLKACVPGCPAAEPSPASFLRSLEDSEWLIQIHKLLQVSVLVVELLDSGSSVLVGLEDGWDITTQVVSLVQLLSDPFYRTLEGFRLLVEKEWLSFGHRFSHRGAHTLAGQSSGFTPVFLQFLDCVHQVHLQFPMEFEFSQFYLKFLGYHHVSRRFRTFLLDSDYERIELGLLYEEKGERRGQVPCRSVWEYVDRLSKRTPVFHNYMYAPEDAEVLRPYSNVSNLKVWDFYTEETLAEGPPYDWELAQGPPEPPEEERSDGGAPQSRRRVVWPCYDSCPRAQPDAISRLLEELQRLETELGQPAERWKDTWDRVKAAQRLEGRPDGRGTPSSLLVSTAPHHRRSLGVYLQEGPVGSTLSLSLDSDQSSGSTTSGSRQAARRSTSTLYSQFQTAESENRSYEGTLYKKGAFMKPWKARWFVLDKTKHQLRYYDHRVDTECKGVIDLAEVEAVAPGTPTMGAPKTVDEKAFFDVKTTRRVYNFCAQDVPSAQQWVDRIQSCLSDA

SEQ ID NO: 860655 - protein, 1949 aa, Homo sapiens; identical to SEQ ID NO: 860654

SEQ ID NO: 860656 - protein, 1884 aa, Homo sapiens
MAAGTWSPCRRAAAAERTRGVRGARSRPGPGHERAVLESPSRGARPRPSGRPASLAMARLADYFVLVAFGPHPRGSGEGQGQILQRFPEKDWEDNPFPQGIELFCQPSGWQLCPERNPPTFFVAVLTDINSERHYCACLTFWEPAEPSQETTRVEDATEREEEGDEGGQTHLSPTAPAPSAQLFAPKTLVLVSRLDHTEVFRNSLGLIYAIHVEGLNVCLENVIGNLLTCTVPLAGGSQRTISLGAGDRQVIQTPLADSLPVSRCSVALLFRQLGITNVLSLFCAALTEHKVLFLSRSYQRLADACRGLLALLFPLRYSFTYVPILPAQLLEVLSTPTPFIIGVNAAFQAETQELLDVIVADLDGGTVTIPECVHIPPLPEPLQSQTHSVLSMVLDPELELADLAFPPPTTSTSSLKMQDKELRAVFLRLFAQLLQGYRWCLHVVRIHPEPVIRFHKAAFLGQRGLVEDDFLMKVLEGMAFAGFVSERGVPYRPTDLFDELVAHEVARMRADENHPQRVLRHVQELAEQLYKNENPYPAVAMHKVQRPGESSHLRRVPRPFPRLDEGTVQWIVDQAAAKMQGAPPAVKAERRTTVPSGPPMTAILERCSGLHVNSARRLEVVRNCISYVFEGKMLEAKKLLPAVLRALKGRAARRCLAQELHLHVQQNRAVLDHQQFDFVVRMMNCCLQDCTSLDEHGIAAALLPLVTAFCRKLSPGVTQFAYSCVQEHVVWSTPQFWEAMFYGDVQTHIRALYLEPTEDLAPAQEVGEAPSQEDERSALDVASEQRRLWPTLSREKQQELVQKEESTVFSQAIHYANRMSYLLLPLDSSKSRLLRERAGLGDLESASNSLVTNSMAGSVAESYDTESGFEDAETCDVAGAVVRFINRFVDKVCTESGVTSDHLKGLHVMVPDIVQMHIETLEAVQRESRRLPPIQKPKLLRPRLLPGEECVLDGLRVYLLPDGREEGAGGSAGGPALLPAEGAVFLTTYRVIFTGMPTDPLVGEQVVVRSFPVAALTKEKRISVQTPVDQLLQDGLQLRSCTFQLLKMAFDEEVGSDSAELFRKQLHKLRYPPDIRATFAFTLGSAHTPGRPPRVTKDKGPSLRTLSRNLVKNAKKTIGRQHVTRKKYNPPSWEHRGQPPPEDQEDEISVSEELEPSTLTPSSALKPSDRMTMSSLVERACCRDYQRLGLGTLSSSLSRAKSEPFRISPVNRMYAICRSYPGLLIVPQSVQDNALQRVSRCYRQNRFPVVCWRSGRSKAVLLRSGGLHGKGVVGLFKAQNAPSPGQSQADSSSLEQEKYLQAVVSSMPRYADASGRNTLSGFSSAHMGSHVPSPRARVTTLSNPMAASASRRTAPRGKWGSVRTSGRSSGLGTDVGSRLAGRDALAPPQANGGPPDPGFLRPQRAALYILGDKAQLKGVRSDPLQQWELVPIEVFEARQVKASFKKLLKACVPGCPAAEPSPASFLRSLEDSEWLIQIHKLLQVSVLVVELLDSGSSVLVGLEDGWDITTQVVSLVQLLSDPFYRTLEGFRLLVEKEWLSFGHRFSHRGAHTLAGQSSGFTPVFLQFLDCVHQVHLQFPMEFEFSQFYLKFLGYHHVSRRFRTFLLDSDYERIELGLLYEEKGERRGQVPCRSVWEYVDRLSKRTPVFHNYMYAPEDAEVLRPYSNVSNLKVWDFYTEETLAEGPPYDWELAQGPPEPPEEERSDGGAPQSRRRVVWPCYDSCPRAQPDAISRLLEELQRLETELGQPAERWKDTWDRVKAAQRLEGRPDGRGTPSSLLVSTAPHHRRSLGVYLQEGPVGSTLSLSLDSDQSSGSTTSGSRQAARRSTSTLYSQFQTAESENRSYEGTLYKKGAFMKPWKARWFVLDKTKHQPRPRPAPPGRP

SEQ ID NO: 860657 - protein, 1889 aa, Homo sapiens
MAAGTWSPCRRAAAAERTRGVRGARSRPGPGHERAVLESPSRGARPRPSGRPASLAMARLADYFVLVAFGPHPRGSGEGQGQILQRFPEKDWEDNPFPQGIELFCQPSGWQLCPERNPPTFFVAVLTDINSERHYCACLTFWEPAEPSQETTRVEDATEREEEGDEGGQTHLSPTAPAPSAQLFAPKTLVLVSRLDHTEVFRNSLGLIYAIHVEGLNVCLENVIGNLLTCTVPLAGGSQRTISLGAGDRQVIQTPLADSLPVSRCSVALLFRQLGITNVLSLFCAALTEHKVLFLSRSYQRLADACRGLLALLFPLRYSFTYVPILPAQLLEVLSTPTPFIIGVNAAFQAETQELLDVIVADLDGGTVTIPECVHIPPLPEPLQSQTHSVLSMVLDPELELADLAFPPPTTSTSSLKMQDKELRAVFLRLFAQLLQGYRWCLHVVRIHPEPVIRFHKAAFLGQRGLVEDDFLMKVLEGMAFAGFVSERGVPYRPTDLFDELVAHEVARMRADENHPQRVLRHVQELAEQLYKNENPYPAVAMHKVQRPGESSHLRRVPRPFPRLDEGTVQWIVDQAAAKMQGAPPAVKAERRTTVPSGPPMTAILERCSGLHVNSARRLEVVRNCISYVFEGKMLEAKKLLPAVLRALKGRAARRCLAQELHLHVQQNRAVLDHQQFDFVVRMMNCCLQDCTSLDEHGIAAALLPLVTAFCRKLSPGVTQFAYSCVQEHVVWSTPQFWEAMFYGDVQTHIRALYLEPTEDLAPAQEVGEAPSQEDERSALDVASEQRRLWPTLSREKQQELVQKEESTVFSQAIHYANRMSYLLLPLDSSKSRLLRERAGLGDLESASNSLVTNSMAGSVAESYDTESGFEDAETCDVAGAVVRFINRFVDKVCTESGVTSDHLKGLHVMVPDIVQMHIETLEAVQRESRRLPPIQKPKLLRPRLLPGEECVLDGLRVYLLPDGREEGAGGSAGGPALLPAEGAVFLTTYRVIFTGMPTDPLVGEQVVVRSFPVAALTKEKRISVQTPVDQLLQDGLQLRSCTFQLLKMAFDEEVGSDSAELFRKQLHKLRYPPDIRATFAFTLGSAHTPGRPPRVTKDKGPSLRTLSRNLVKNAKKTIGRQHVTRKKYNPPSWEHRGQPPPEDQEDEISVSEELEPSTLTPSSALKPSDRMTMSSLVERACCRDYQRLGLGTLSSSLSRAKSEPFRISPVNRMYAICRSYPGLLIVPQSVQDNALQRVSRCYRQNRFPVVCWRSGRSKAVLLRSGGLHGKGVVGLFKAQNAPSPGQSQADSSSLEQEKYLQAVVSSMPRYADASGRNTLSGFSSAHMGSHVPSPRARVTTLSNPMAASASRRTAPRGKWGSVRTSGRSSGLGTDVGSRLAGRDALAPPQANGGPPDPGFLRPQRAALYILGDKAQLKGVRSDPLQQWELVPIEVFEARQVKASFKKLLKACVPGCPAAEPSPASFLRSLEDSEWLIQIHKLLQVSVLVVELLDSGSSVLVGLEDGWDITTQVVSLVQLLSDPFYRTLEGFRLLVEKEWLSFGHRFSHRGAHTLAGQSSGFTPVFLQFLDCVHQVHLQFPMEFEFSQFYLKFLGYHHVSRRFRTFLLDSDYERIELGLLYEEKGERRGQVPCRSVWEYVDRLSKRTPVFHNYMYAPEDAEVLRPYSNVSNLKVWDFYTEETLAEGPPYDWELAQGPPEPPEEERSDGGAPQSRRRVVWPCYDSCPRAQPDAISRLLEELQRLETELGQPAERWKDTWDRVKAAQRLEGRPDGRGTPSSLLVSTAPHHRRSLGVYLQEGPVGSTLSLSLDSDQSSGSTTSGSRQAARRSTSTLYSQFQTAESENRSYEGTLYKKGAFMKPWKARWFVLDKTKHQLRYYTTVDTNVQVHAR

SEQ ID NO: 860658 - protein, 1860 aa, Homo sapiens
MAAGTWSPCRRAAAAERTRGVRGARSRPGPGHERAVLESPSRGARPRPSGRPASLAMARLADYFVLVAFGPHPRGSGEGQGQILQRFPEKDWEDNPFPQGIELFCQPSGWQLCPERNPPTFFVAVLTDINSERHYCACLTFWEPAEPSQETTRVEDATEREEEGDEGGQTHLSPTAPAPSAQLFAPKTLVLVSRLDHTEVFRNSLGLIYAIHVEGLNVCLENVIGNLLTCTVPLAGGSQRTISLGAGDRQVIQTPLADSLPVSRCSVALLFRQLGITNVLSLFCAALTEHKVLFLSRSYQRLADACRGLLALLFPLRYSFTYVPILPAQLLEVLSTPTPFIIGVNAAFQAETQELLDVIVADLDGGTVTIPECVHIPPLPEPLQSQTHSVLSMVLDPELELADLAFPPPTTSTSSLKMQDKELRAVFLRLFAQLLQGYRWCLHVVRIHPEPVIRFHKAAFLGQRGLVEDDFLMKVLEGMAFAGFVSERGVPYRPTDLFDELVAHEVARMRADENHPQRVLRHVQELAEQLYKNENPYPAVAMHKVQRPGESSHLRRVPRPFPRLDEGTVQWIVDQAAAKMQGAPPAVKAERRTTVPSGPPMTAILERCSGLHVNSARRLEVVRNCISYVFEGKMLEAKKLLPAVLRALKGRAARRCLAQELHLHVQQNRAVLDHQQFDFVVRMMNCCLQDCTSLDEHGIAAALLPLVTAFCRKLSPGVTQFAYSCVQEHVVWSTPQFWEAMFYGDVQTHIRALYLEPTEDLAPAQEVGEAPSQEDERSALDVASEQRRLWPTLSREKQQELVQKEESTVFSQAIHYANRMSYLLLPLDSSKSRLLRERAGLGDLESASNSLVTNSMAGSVAESYDTESGFEDAETCDVAGAVVRFINRFVDKVCTESGVTSDHLKGLHVMVPDIVQMHIETLEAVQRESRRLPPIQKPKLLRPRLLPGEECVLDGLRVYLLPDGREEGAGGSAGGPALLPAEGAVFLTTYRVIFTGMPTDPLVGEQVVVRSFPVAALTKEKRISVQTPVDQLLQDGLQLRSCTFQLLKMAFDEEVGSDSAELFRKQLHKLRYPPDIRATFAFTLGSAHTPGRPPRVTKDKGPSLRTLSRNLVKNAKKTIGRQHVTRKKYNPPSWEHRGQPPPEDQEDEISVSEELEPSTLTPSSALKPSDRMTMSSLVERACCRDYQRLGLGTLSSSLSRAKSEPFRISPVNRMYAICRSYPGLLIVPQSVQDNALQRVSRCYRQNRFPVVCWRSGRSKAVLLRSGGLHGKGVVGLFKAQNAPSPGQSQADSSSLEQEKYLQAVVSSMPRYADASGRNTLSGFSSAHMGSHVPSPRARVTTLSNPMAASASRRTAPRGKWGSVRTSGRSSGLGTDVGSRLAGRDALAPPQANGGPPDPGFLRPQRAALYILGDKAQLKGVRSDPLQQWELVPIEVFEARQVKASFKKLLKACVPGCPAAEPSPASFLRSLEDSEWLIQIHKLLQVSVLVVELLDSGSSVLVGLEDGWDITTQVVSLVQLLSDPFYRTLEGFRLLVEKEWLSFGHRFSHRGAHTLAGQSSGFTPVFLQFLDCVHQVHLQFPMEFEFSQFYLKFLGYHHVSRRFRTFLLDSDYERIELGLLYEEKGERRGQVPCRSVWEYVDRLSKRTPVFHNYMYAPEDAEVLRPYSNVSNLKVWDFYTEETLAEGPPYDWELAQGPPEPPEEERSDGGAPQSRRRVVWPCYDSCPRAQPDAISRLLEELQRLETELGQPAERWKDTWDRVKAAQRLEGRPDGRGTPSSLLVSTAPHHRRSLGVYLQEGPVGSTLSLSLDSDQSSGSTTSGSRQAARRSTSTLYSQFQTAESENRSYEGTLYNILTPGRYQ

SEQ ID NO: 860659 - protein, 961 aa, Homo sapiens
RGSPSFTGMPRTPCIGEQVVVRSFPVAALTKEKRISVQTPVDQLLQDGLQLRSCTFQLLKMAFDEEVGSDSAELFRKQLHKLRYPPDIRATFAFTLGSAHTPGRPPRVTKDKGPSLRTLSRNLVKNAKKTIGRQHVTRKKYNPPSWEHRGQPPPEDQEDEISVSEELEPSTLTPSSALKPSDRMTMSSLVERACCRDYQRLGLGTLSSSLSRAKSEPFRISPVNRMYAICRSYPGLLIVPQSVQDNALQRVSRCYRQNRFPVVCWRSGRSKAVLLRSGGLHGKGVVGLFKAQNAPSPGQSQADSSSLEQEKYLQAVVSSMPRYADASGRNTLSGFSSAHMGSHVPSPRARVTTLSNPMAASASRRTAPRGKWGSVRTSGRSSGLGTDVGSRLAGRDALAPPQANGGPPDPGFLRPQRAALYILGDKAQLKGVRSDPLQQWELVPIEVFEARQVKASFKKLLKACVPGCPAAEPSPASFLRSLEDSEWLIQIHKLLQVSVLVVELLDSGSSVLVGLEDGWDITTQVVSLVQLLSDPFYRTLEGFRLLVEKEWLSFGHRFSHRGAHTLAGQSSGFTPVFLQFLDCVHQVHLQFPMEFEFSQFYLKFLGYHHVSRRFRTFLLDSDYERIELGLLYEEKGERRGQVPCRSVWEYVDRLSKRTPVFHNYMYAPEDAEVLRPYSNVSNLKVWDFYTEETLAEGPPYDWELAQGPPEPPEEERSDGGAPQSRRRVVWPCYDSCPRAQPDAISRLLEELQRLETELGQPAERWKDTWDRVKAAQRLEGRPDGRGTPSSLLVSTAPHHRRSLGVYLQEGPVGSTLSLSLDSDQSSGSTTSGSRQAARRSTSTLYSQFQTAESENRSYEGTLYKKGAFMKPWKARWFVLDKTKHQLRYYDHRVDTECKGVIDLAEVEAVAPGTPTMGAPKTVDEKAFFDVKTTRRVYNFCAQDVPSAQQWVDRIQSCLSDA

SEQ ID NO: 860660 - protein, 533 aa, Homo sapiens
GTFLLDSDYERIELGLLYEEKGERRGQVPCRSVWEYVDRLSKRTPVFHNYTLLWGRRSVGGRIHKLLQVSVLVVELLDSGSSVLVGLEDGWDITTQVVSLVQLLSDPFYRTLEGFRLLVEKEWLSFGHRFSHRGAHTLAGQSSGFTPVFLQFLDCVHQVHLQFPMEFEFSQFYLKFLGYHHVSRRFRTFLLDSDYERIELGLLYEEKGERRGQVPCRSVWEYVDRLSKRTPVFHNYMYAPEDAEVLRPYSNVSNLKVWDFYTEETLAEGPPYDWELAQGPPEPPEEERSDGGAPQSRRRVVWPCYDSCPRAQPDAISRLLEELQRLETELGQPAERWKDTWDRVKAAQRLEGRPDGRGTPSSLLVSTAPHHRRSLGVYLQEGPVGSTLSLSLDSDQSSGSTTSGSRQAARRSTSTLYSQFQTAESENRSYEGTLYKKGAFMKPWKARWFVLDKTKHQLRYYDHRVDTECKGVIDLAEVEAVAPGTPTMGAPKTVDEKAFFDVKTTRRVYNFCAQDVPSAQQWVDRIQSCLSDA

SEQ ID NO: 860661 - protein, 154 aa, Homo sapiens
APTLSNGPSCRYTPSDQSSGSTTSGSRQAARRSTSTLYSQFQTAESENRSYEGTLYKKGAFMKPWKARWFVLDKTKHQLRYYDHRVDTECKGVIDLAEVEAVAPGTPTMGAPKTVDEKAFFDVKTTRRVYNFCAQDVPSAQQWVDRIQSCLSDA

SEQ ID NO: 860662 - protein, 114 aa, Homo sapiens
RPRLLPGEECVLDGLRVYLLPDGREEGAGGSAGGPALLPAEGAVFLTTYRVIFTGMPTDPLGEPADSLALSPPLPQVFGMDGLSLPPSPFSRGFWVPVGNGPLSAPSPPTWDSP

SEQ ID NO: 860663 - protein, 87 aa, Homo sapiens
VSDQVVGGTHGGGGSADSGLLQLRYYDHRVDTECKGVIDLAEVEAVAPGTPTMGAPKTVDEKAFFDVSLGRGLGEGRGSAVWGLRSQ

SEQ ID NO: 860664 - protein, 1923 aa, Homo sapiens; identical to SEQ ID NO: 860648

SEQ ID NO: 860665 - protein, 1486 aa, Homo sapiens
NRLERLGYRPRRSLSSRLHKAAFLGQRGLVEDDFLMKVLEGMAFAGFVSERGVPYRPTDLFDELVAHEVARMRADENHPQRVLRHVQELAEQLYKNENPYPAVAMHKVQRPGESSHLRRVPRPFPRLDEGTVQWIVDQAAAKMQGAPPAVKAERRTTVPSGPPMTAILERCSGLHVNSARRLEVVRNCISYVFEGKMLEAKKLLPAVLRALKGRAARRCLAQELHLHVQQNRAVLDHQQFDFVVRMMNCCLQDCTSLDEHGIAAALLPLVTAFCRKLSPGVTQFAYSCVQEHVVWSTPQFWEAMFYGDVQTHIRALYLEPTEDLAPAQEVGEAPSQEDERSALDVASEQRRLWPTLSREKQQELVQKEESTVFSQAIHYANRMSYLLLPLDSSKSRLLRERAGLGDLESASNSLVTNSMAGSVAESYDTESGFEDAETCDVAGAVVRFINRFVDKVCTESGVTSDHLKGLHVMVPDIVQMHIETLEAVQRESRRLPPIQKPKLLRPRLLPGEECVLDGLRVYLLPDGREEGAGGSAGGPALLPAEGAVFLTTYRVIFTGMPTDPLVGEQVVVRSFPVAALTKEKRISVQTPVDQLLQDGLQLRSCTFQLLKMAFDEEVGSDSAELFRKQLHKLRYPPDIRATFAFTLGSAHTPGRPPRVTKDKGPSLRTLSRNLVKNAKKTIGRQHVTRKKYNPPSWEHRGQPPPEDQEDEISVSEELEPSTLTPSSALKPSDRMTMSSLVERACCRDYQRLGLGTLSSSLSRAKSEPFRISPVNRMYAICRSYPGLLIVPQSVQDNALQRVSRCYRQNRFPVVCWRSGRSKAVLLRSGGLHGKGVVGLFKAQNAPSPGQSQADSSSLEQEKYLQAVVSSMPRYADASGRNTLSGFSSAHMGSHGKWGSVRTSGRSSGLGTDVGSRLAGRDALAPPQANGGPPDPGFLRPQRAALYILGDKAQLKGVRSDPLQQWELVPIEVFEARQVKASFKKLLKACVPGCPAAEPSPASFLRSLEDSEWLIQIHKLLQVSVLVVELLDSGSSVLVGLEDGWDITTQVVSLVQLLSDPFYRTLEGFRLLVEKEWLSFGHRFSHRGAHTLAGQSSGFTPVFLQFLDCVHQVHLQFPMEFEFSQFYLKFLGYHHVSRRFRTFLLDSDYERIELGLLYEEKGERRGQVPCRSVWEYVDRLSKRTPVFHNYMYAPEDAEVLRPYSNVSNLKVWDFYTEETLAEGPPYDWELAQGPPEPPEEERSDGGAPQSRRRVVWPCYDSCPRAQPDAISRLLEELQRLETELGQPAERWKDTWDRVKAAQRLEGRPDGRGTPSSLLVSTAPHHRRSLGVYLQEGPVGSTLSLSLDSDQSSGSTTSGSRQAARRSTSTLYSQFQTAESENRSYEGTLYKKGAFMKPWKARWFVLDKTKHQLRYYDHRVDTECKGVIDLAEVEAVAPGTPTMGAPKTVDEKAFFDVKTTRRVYNFCAQDVPSAQQWVDRIQSCLSDA

SEQ ID NO: 860666 - protein, 1949 aa, Homo sapiens; identical to SEQ ID NO: 860654

SEQ ID NO: 860667 - protein, 1938 aa, Homo sapiens
MAAGTWSPCRRAAAAERTRGVRGARSRPGPGHERAVLESPSRGARPRPSGRPASLAMARLADYFVLVAFGPHPRGSGEGQGQILQRFPEKDWEDNPFPQGIELFCQPSGWQLCPERNPPTFFVAVLTDINSERHYCACLTFWEPAEPSQETTRVEDATEREEEGDEGGQTHLSPTAPAPSAQLFAPKTLVLVSRLDHTEVFRNSLGLIYAIHVEGLNVCLENVIGNLLTCTVPLAGGSQRTISLGAGDRQVIQTPLADSLPVSRCSVALLFRQLGITNVLSLFCAALTEHKVLFLSRSYQRLADACRGLLALLFPLRYSFTYVPILPAQLLEVLSTPTPFIIGVNAAFQAETQELLDVIVADLDGGTVTIPECVHIPPLPEPLQSQTHSVLSMVLDPELELADLAFPPPTTSTSSLKMQDKELRAVFLRLFAQLLQGYRWCLHVVRIHPEPVIRFHKAAFLGQRGLVEDDFLMKVLEGMAFAGFVSERGVPYRPTDLFDELVAHEVARMRADENHPQRVLRHVQELAEQLYKNENPYPAVAMHKVQRPGESSHLRRVPRPFPRLDEGTVQWIVDQAAAKMQGAPPAVKAERRTTVPSGPPMTAILERCSGLHVNSARRLEVVRNCISYVFEGKMLEAKKLLPAVLRALKGRAARRCLAQELHLHVQQNRAVLDHQQFDFVVRMMNCCLQDCTSLDEHGIAAALLPLVTAFCRKLSPGVTQFAYSCVQEHVVWSTPQFWEAMFYGDVQTHIRALYLEPTEDLAPAQEVGEAPSQEDERSALDVASEQRRLWPTLSREKQQELVQKEESTVFSQAIHYANRMSYLLLPLDSSKSRLLRERAGLGDLESASNSLVTNSMAGSVAESYDTESGFEDAETCDVAGAVVRFINRFVDKVCTESGVTSDHLKGLHVMVPDIVQMHIETLEAVQRESRRLPPIQKPKLLRPRLLPGEECVLDGLRVYLLPDGREEGAGGSAGGPALLPAEGAVFLTTYRVIFTGMPTDPLVGEQVVVRSFPVAALTKEKRISVQTPVDQLLQDGLQLRSCTFQLLKMAFDEEVGSDSAELFRKQLHKLRYPPDIRATFAFTLGSAHTPGRPPRVTKDKGPSLRTLSRNLVKNAKKTIGRQHVTRKKYNPPSWEHRGQPPPEDQEDEISVSEELEPSTLTPSSALKPSDRMTMSSLVERACCRDYQRLGLGTLSSSLSRAKSEPFRISPVNRMYAICRSYPGLLIVPQSVQDNALQRVSRCYRQNRFPVVCWRSGRSKAVLLRSGGLHGKGVVGLFKAQNAPSPGQSQADSSSLEQEKYLQAVVSSMPRYADASGRNTLSGFSSAHMGSHVPSPRARVTTLSNPMAASASRRTAPRGKWGSVRTSGRSSGLGTDVGSRLAGRDALAPPQANGGPPDPGFLRPQRAALYILGDKAQLKGVRSDPLQQWELVPIEVFEARQVKASFKKLLKACVPGCPAAEPSPASFLRSLEDSEWLIQIHKLLQVSVLVVELLDSGSSVLVGLEDGWDITTQVVSLVQLLSDPFYRTLEGFRLLVEKEWLSFGHRFSHRGAHTLAGQSSGFTPVFLQFLDCVHQVHLQFPMEFEFSQFYLKFLGYHHVSRRFRTFLLDSDYERIELGLLYEEKGERRGQVPCRSVWEYVDRLSKRTPVFHNYMYAPEDAEVLRPYSNVSNLKVWDFYTEETLAEGPPYDWELAQGPPEPPEEERSDGGAPQSRRRVVWPCYDSCPRAQPDAISRLLEELQRLETELGQPAERWKDTWDRVKAAQRLEGRPDGRGTPSSLLVSTAPHHRRSLGVYLQEGPVGSTLSLSLDSDQSSGSTTSGSRQAARRSTSTLYSQFQTAESENRSYEGTLYKKGAFMKPWKARWFVLDKTKHQLRYYDHRVDTECKGVIDLAEVEAVAPGTPTMGAPKTVDEKAFFDVSLGRGLGEGRGSAVWGLRSQ

SEQ ID NO: 860668 - protein, 1949 aa, Homo sapiens; identical to SEQ ID NO: 860654

SEQ ID NO: 860669 - protein, 1949 aa, Homo sapiens; identical to SEQ ID NO: 860654

SEQ ID NO: 860670 - protein, 1886 aa, Homo sapiens
MAAGTWSPCRRAAAAERTRGVRGARSRPGPGHERAVLESPSRGARPRPSGRPASLAMARLADYFVLVAFGPHPRGSGEGQGQILQRFPEKDWEDNPFPQGIELFCQPSGWQLCPERNPPTFFVAVLTDINSERHYCACLTFWEPAEPSQETTRVEDATEREEEGDEGGQTHLSPTAPAPSAQLFAPKTLVLVSRLDHTEVFRNSLGLIYAIHVEGLNVCLENVIGNLLTCTVPLAGGSQRTISLGAGDRQVIQTPLADSLPVSRCSVALLFRQLGITNVLSLFCAALTEHKVLFLSRSYQRLADACRGLLALLFPLRYSFTYVPILPAQLLEVLSTPTPFIIGVNAAFQAETQELLDVIVADLDGGTVTIPECVHIPPLPEPLQSQTHSVLSMVLDPELELADLAFPPPTTSTSSLKMQDKELRAVFLRLFAQLLQGYRWCLHVVRIHPEPVIRFHKAAFLGQRGLVEDDFLMKVLEGMAFAGFVSERGVPYRPTDLFDELVAHEVARMRADENHPQRVLRHVQELAEQLYKNENPYPAVAMHKVQRPGESSHLRRVPRPFPRLDEGTVQWIVDQAAAKMQGAPPAVKAERRTTVPSGPPMTAILERCSGLHVNSARRLEVVRNCISYVFEGKMLEAKKLLPAVLRALKGRAARRCLAQELHLHVQQNRAVLDHQQFDFVVRMMNCCLQDCTSLDEHGIAAALLPLVTAFCRKLSPGVTQFAYSCVQEHVVWSTPQFWEAMFYGDVQTHIRALYLEPTEDLAPAQEVGEAPSQEDERSALDVASEQRRLWPTLSREKQQELVQKEESTVFSQAIHYANRMSYLLLPLDSSKSRLLRERAGLGDLESASNSLVTNSMAGSVAESYDTESGFEDAETCDVAGAVVRFINRFVDKVCTESGVTSDHLKGLHVMVPDIVQMHIETLEAVQRESRRLPPIQKPKLLRPRLLPGEECVLDGLRVYLLPDGREEGAGGSAGGPALLPAEGAVFLTTYRVIFTGMPTDPLVGEQVVVRSFPVAALTKEKRISVQTPVDQLLQDGLQLRSCTFQLLKMAFDEEVGSDSAELFRKQLHKLRYPPDIRATFAFTLGSAHTPGRPPRVTKDKGPSLRTLSRNLVKNAKKTIGRQHVTRKKYNPPSWEHRGQPPPEDQEDEISVSEELEPSTLTPSSALKPSDRMTMSSLVERACCRDYQRLGLGTLSSSLSRAKSEPFRISPVNRMYAICRSYPGLLIVPQSVQDNALQRVSRCYRQNRFPVVCWRSGRSKAVLLRSGGLHGKGVVGLFKAQNAPSPGQSQADSSSLEQEKYLQAVVSSMPRYADASGRNTLSGFSSAHMGSHVPSPRARVTTLSNPMAASASRRTAPRGKWGSVRTSGRSSGLGTDVGSRLAGRDALAPPQANGGPPDPGFLRPQRAALYILGDKAQLKGVRSDPLQQWELVPIEVFEARQVKASFKKLLKACVPGCPAAEPSPASFLRSLEDSEWLIQIHKLLQVSVLVVELLDSGSSVLVGLEDGWDITTQVVSLVQLLSDPFYRTLEGFRLLVEKEWLSFGHRFSHRGAHTLAGQSSGFTPVFLQFLDCVHQVHLQFPMEFEFSQFYLKFLGYHHVSRRFRTFLLDSDYERIELGLLYEEKGERRGQVPCRSVWEYVDRLSKRTPVFHNYMYAPEDAEVLRPYSNVSNLKVWDFYTEETLAEGPPYDWELAQGPPEPPEEERSDGGAPQSRRRVVWPCYDSCPRAQPDAISRLLEELQRLETELGQPAERWKDTWDRVKAAQRLEGRPDGRGTPSSLLVSTAPHHRRSLGVYLQEGPVGSTLSLSLDSDQSSGSTTSGSRQAARRSTSTLYSQFQTAESENRSYEGTLYKKGAFMKPWKARWFVLDKTKHQLRYYDHSRKTGIL

SEQ ID NO: 860671 - protein, 1380 aa, Homo sapiens
EDGGGNLVPCRRAAAAERTRGVRGARSRPGPGHERAVLESPSRGARPRPSGRPASLAMARLADYFVLVAFGPHPRGSGEGQGQILQRFPEKDWEDNPFPQGIELFCQPSGWQLCPERNPPTFFVAVLTDINSERHYCACLTFWEPAEPSQETTRVEDATEREEEGDEGGQTHLSPTAPAPSAQLFAPKTLVLVSRLDHTEVFRNSLGLIYAIHVEGLNVCLENVIGNLLTCTVPLAGGSQRTISLGAGDRQVIQTPLADSLPVSRCSVALLFRQLGITNVLSLFCAALTEHKVLFLSRSYQRLADACRGLLALLFPLRYSFTYVPILPAQLLEVLSTPTPFIIGVNAAFQAETQELLDVIVADLDGGTVTIPECVHIPPLPEPLQSQTHSVLSMVLDPELELADLAFPPPTTSTSSLKMQDKELRAVFLRLFAQLLQGYRWCLHVVRIHPEPVIRFHKAAFLGQRGLVEDDFLMKVLEGMAFAGFVSERGVPYRPTDLFDELVAHEVARMRADENHPQRVLRHVQELAEQLYKNENPYPAVAMHKVQRPGESSHLRRVPRPFPRLDEGTVQWIVDQAAAKMQGAPPAVKAERRTTVPSGPPMTAILERCSGLHVNSARRLEVVRNCISYVFEGKMLEAKKLLPAVLRALKGRAARRCLAQELHLHVQQNRAVLDHQQFDFVVRMMNCCLQDCTSLDEHGIAAALLPLVTAFCRKLSPGVTQFAYSCVQEHVVWSTPQFWEAMFYGDVQTHIRALYLEPTEDLAPAQEVGEAPSQEDERSALDVASEQRRLWPTLSREKQQELVQKEESTVFSQAIHYANRMSYLLLPLDSSKSRLLRERAGLGDLESASNSLVTNSMAGSVAESYDTESGFEDAETCDVAGAVVRFINRFVDKVCTESGVTSDHLKGLHVMVPDIVQMHIETLEAVQRESRRLPPIQKPKLLRPRLLPGEECVLDGLRVYLLPDGREEGAGGSAGGPALLPAEGAVFLTTYRVIFTGMPTDPLVGEQVVVRSFPVAALTKEKRISVQTPVDQLLQDGLQLRSCTFQLLKMAFDEEVGSDSAELFRKQLHKLRYPPDIRATFAFTLGSAHTPGRPPRVTKDKGPSLRTLSRNLVKNAKKTIGRQHVTRKKYNPPSWEHRGQPPPEDQEDEISVSEELEPSTLTPSSALKPSDRMTMSSLVERACCRDYQRLGLGTLSSSLSRAKSEPFRISPVNRMYAICRSYPGLLIVPQSVQDNALQRVSRCYRQNRFPVVCWRSGRSKAVLLRSGGLHGKGVVGLFKAQNAPSPGQSQADSSSLEQEKYLQAVVSSMPRYADASGRNTLSGFSSAHMGSHVPSPRARSPRCPTPWRPRPPDGPHPEVSGAVSGPVDAAVALAPMWAPG

SEQ ID NO: 860672 - protein, 786 aa, Homo sapiens
SQAVTASKDMSTGPPGRACCRDYQRLGLGTLSSSLSRAKSEPFRISPVNRMYAICRSYPGLLIVPQSVQDNALQRVSRCYRQNRFPVVCWRSGRSKAVLLRSGGLHGKGVVGLFKAQNAPSPGQSQADSSSLEQEKYLQAVVSSMPRYADASGRNTLSGFSSAHMGSHVPSPRARVTTLSNPMAASASRRTAPRGKWGSVRTSGRSSGLGTDVGSRLAGRDALAPPQANGGPPDPGFLRPQRAALYILGDKAQLKGVRSDPLQQWELVPIEVFEARQVKASFKKLLKACVPGCPAAEPSPASFLRSLEDSEWLIQIHKLLQVSVLVVELLDSGSSVLVGLEDGWDITTQVVSLVQLLSDPFYRTLEGFRLLVEKEWLSFGHRFSHRGAHTLAGQSSGFTPVFLQFLDCVHQVHLQFPMEFEFSQFYLKFLGYHHVSRRFRTFLLDSDYERIELGLLYEEKGERRGQVPCRSVWEYVDRLSKRTPVFHNYMYAPEDAEVLRPYSNVSNLKVWDFYTEETLAEGPPYDWELAQGPPEPPEEERSDGGAPQSRRRVVWPCYDSCPRAQPDAISRLLEELQRLETELGQPAERWKDTWDRVKAAQRLEGRPDGRGTPSSLLVSTAPHHRRSLGVYLQEGPVGSTLSLSLDSDQSSGSTTSGSRQAARRSTSTLYSQFQTAESENRSYEGTLYKKGAFMKPWKARWFVLDKTKHQLRYYDHRVDTECKGVIDLAEVEAVAPGTPTMGAPKTVDEKAFFDVKTTRRVYNFCAQDVPSAQQWVDRIQSCLSDA

SEQ ID NO: 860673 - protein, 1115 aa, Homo sapiens
MAAGTWSPCRRAAAAERTRGVRGARSRPGPGHERAVLESPSRGARPRPSGRPASLAMARLADYFVLVAFGPHPRGSGEGQGQILQRFPEKDWEDNPFPQGIELFCQPSGWQLCPERNPPTFFVAVLTDINSERHYCACLTFWEPAEPSQETTRVEDATEREEEGDEGGQTHLSPTAPAPSAQLFAPKTLVLVSRLDHTEVFRNSLGLIYAIHVEGLNVCLENVIGNLLTCTVPLAGGSQRTISLGAGDRQVIQTPLADSLPVSRCSVALLFRQLGITNVLSLFCAALTEHKVLFLSRSYQRLADACRGLLALLFPLRYSFTYVPILPAQLLEVLSTPTPFIIGVNAAFQAETQELLDVIVADLDGGTVTIPECVHIPPLPEPLQSQTHSVLSMVLDPELELADLAFPPPTTSTSSLKMQDKELRAVFLRLFAQLLQGYRWCLHVVRIHPEPVIRFHKAAFLGQRGLVEDDFLMKVLEGMAFAGFVSERGVPYRPTDLFDELVAHEVARMRADENHPQRVLRHVQELAEQLYKNENPYPAVAMHKVQRPGESSHLRRVPRPFPRLDEGTVQWIVDQAAAKMQGAPPAVKAERRTTVPSGPPMTAILERCSGLHVNSARRLEVVRNCISYVFEGKMLEAKKLLPAVLRALKGRAARRCLAQELHLHVQQNRAVLDHQQFDFVVRMMNCCLQDCTSLDEHGIAAALLPLVTAFCRKLSPGVTQFAYSCVQEHVVWSTPQFWEAMFYGDVQTHIRALYLEPTEDLAPAQEVGEAPSQEDERSALDVASEQRRLWPTLSREKQQELVQKEESTVFSQAIHYANRMSYLLLPLDSSKSRLLRERAGLGDLESASNSLVTNSMAGSVAESYDTESGFEDAETCDVAGAVVRFINRFVDKVCTESGVTSDHLKGLHVMVPDIVQMHIETLEAVQRESRRLPPIQKPKLLRPRLLPGEECVLDGLRVYLLPDGREEGAGGSAGGPALLPAEGAVFLTTYRVIFTGMPTDPLVGEQVVVRSFPVAALTKEKRISVQTPVDQLLQDGLQLRSCTFQLLKMAFDEEVGSDSAELFRKQLHKLRYPPDIRATFAFTLGSAHTPGRPPRVTAEHRAGRWPRYSPQWACK

SEQ ID NO: 860674 - protein, 113 aa, Homo sapiens
ALYLEPTEDLAPAQVRRDSLGWGLGARGWGSVAPAHACGAVEEVGEAPSQEDERSALDVASEQRRLWPTLSREKQQELVQKEESTVFSQAIHYANRMSYLLLPLDSSKSRLLR

SEQ ID NO: 860675 - protein, 156 aa, Homo sapiens
GGAWGVGVLPREEREAQQGPGSPNQAEVQPGWSRLPCPPRWASSVRCPLLCVRGLLFLTGCFWDNGHLYREDQTSPAPGLRCLNWLDAQSGLASAPVSGAGNHSYCRNPDEDPRGPWCYVSGEAGVPEKRPCEDLRCPGTCPGPRESPLLALTGSG

SEQ ID NO: 860676 - protein, 173 aa, Homo sapiens
MLLAWVQAFLVSNMLLAEAYGSGGCFWDNGHLYREDQTSPAPGLRCLNWLDAQSGLASAPVSGAGNHSYCRNPDEDPRGPWCYVSGEAGVPEKRPCEDLRCPETTSQALPAFTTEIQEASEGPGADEVQVFAPANALPARSEAAAVQPVIGISQRVRMNSKEKKDLGTLGGRI

SEQ ID NO: 860677 - protein, 202 aa, Homo sapiens
ASTPELTASTSCGYIGRGLQRSCNREGPWEIARIWTDKDVGETTSQALPAFTTEIQEASEGPGADEVQVFAPANALPARSEAAAVQPVIGISQRVRMNSKEKKDLGTLGYVLGITMMVIIIAIGAGIILGYSYKRGKDLKEQHDQKVCEREMQRITLPLSAFTNPTCEIVDEKTVVVHTSQTPVDPQEGSTPLMGQAGTPGA

SEQ ID NO: 860678 - protein, 263 aa, Homo sapiens
MLLAWVQAFLVSNMLLAEAYGSGGCFWDNGHLYREDQTSPAPGLRCLNWLDAQSGLASAPVSGAGNHSYCRNPDEDPRGPWCYVSGEAGVPEKRPCEDLRCPETTSQALPAFTTEIQEASEGPGADEVQVFAPANALPARSEAAAVQPVIGISQRVRMNSKEKKDLGTLGYVLGITMMVIIIAIGAGIILGYSYKRGKDLKEQHDQKVCEREMQRITLPLSAFTNPTCEIVDEKTVVVHTSQTPVDPQEGSTPLMGQAGTPGA

SEQ ID NO: 860679 - protein, 263 aa, Homo sapiens; identical to SEQ ID NO: 860678

SEQ ID NO: 860680 - protein, 263 aa, Homo sapiens; identical to SEQ ID NO: 860678

SEQ ID NO: 860681 - protein, 263 aa, Homo sapiens; identical to SEQ ID NO: 860678

SEQ ID NO: 860682 - protein, 263 aa, Homo sapiens; identical to SEQ ID NO: 860678

SEQ ID NO: 860683 - protein, 331 aa, Homo sapiens
GGAWGVGVLPREEREAQQGPGSPNQAEVQPGWSRLPCPPRWASSVRCPLLCVRGLLFLTGCFWDNGHLYREDQTSPAPGLRCLNWLDAQSGLASAPVSGKCPPGDGAGAGGRRPRSRCQPRQHISFSPLLGAGNHSYCRNPDEDPRGPWCYVSGEAGVPEKRPCEDLRCPETTSQALPAFTTEIQEASEGPGADEVQVFAPANALPARSEAAAVQPVIGISQRVRMNSKEKKDLGTLGYVLGITMMVIIIAIGAGIILGYSYKRGKDLKEQHDQKVCEREMQRITLPLSAFTNPTCEIVDEKTVVVHTSQTPVDPQEGSTPLMGQAGTPGA

SEQ ID NO: 860684 - protein, 263 aa, Homo sapiens; identical to SEQ ID NO: 860678

SEQ ID NO: 860685 - protein, 120 aa, Homo sapiens
MLLAWVQAFLVSNMLLAEAYGSGGCFWDNGHLYREDQTSPAPGLRCLNWLDAQSGLASAPVSGAGNHSYCRNPDEDPRGPWCYVSGEAGVPEKRPCEDLRCPGTCPGPRESPLLALTGSG

SEQ ID NO: 860686 - protein, 690 aa, Homo sapiens
MEKILQMAEGIDIGEMPSYDLVLSKPSKGQKRHLSTCDGQNPPKKQAGSKFHARPRFEPVHFVASSSKDERQEDPYGPQTKEVNEQTHFASMPRDIYQDYTQDSFSIQDGNSQYCDSSGFILTKDQPVTANMYFDSGNPAPSTTSQQANSQSTPEPSPSQTFPESVVAEKQYFIEKLTATIWKNLSNPEMTSGSDKINYTYMLTRCIQACKTNPEYIYAPLKEIPPADIPKNKKLLTDGYACEVRCQNIYLTTGYAGSKNGSRDRATELAVKLLQKRIEVRVVRRKFKHTFGEDLVVCQIGMSSYEFPPALKPPEDLVVLGKDASGQPIFNASAKHWTNFVITENANDAIGILNNSASFNKMSIEYKYEMMPNRTWRCRVFLQDHCLAEGYGTKKTSKHAAADEALKILQKTQPTYPSVKSSQCHTGSSPRGSGKKKDIKDLVVYENSSNPVCTLNDTAQFNRMTVEYVYERMTGLRWKCKVILESEVIAEAVGVKKTVKYEAAGEAVKTLKKTQPTVINNLKKGAVEDVISRNEIQGRSAEEAYKQQIKEDNIGNQLLRKMGWTGGGLGKSGEGIREPISVKEQHKREGLGLDVERVNKIAKRDIEQIIRNYARSESHTDLTFSRELTNDERKQIHQIAQKYGLKSKSHGVGHDRYLVVGRKRRKEDLLDQLKQEGQVGHYELVMPQAN

SEQ ID NO: 860687 - protein, 705 aa, Homo sapiens
MGFMLPLIFRYSPRLMEKILQMAEGIDIGEMPSYDLVLSKPSKGQKRHLSTCDGQNPPKKQAGSKFHARPRFEPVHFVASSSKDERQEDPYGPQTKEVNEQTHFASMPRDIYQDYTQDSFSIQDGNSQYCDSSGFILTKDQPVTANMYFDSGNPAPSTTSQQANSQSTPEPSPSQTFPESVVAEKQYFIEKLTATIWKNLSNPEMTSGSDKINYTYMLTRCIQACKTNPEYIYAPLKEIPPADIPKNKKLLTDGYACEVRCQNIYLTTGYAGSKNGSRDRATELAVKLLQKRIEVRVVRRKFKHTFGEDLVVCQIGMSSYEFPPALKPPEDLVVLGKDASGQPIFNASAKHWTNFVITENANDAIGILNNSASFNKMSIEYKYEMMPNRTWRCRVFLQDHCLAEGYGTKKTSKHAAADEALKILQKTQPTYPSVKSSQCHTGSSPRGSGKKKDIKDLVVYENSSNPVCTLNDTAQFNRMTVEYVYERMTGLRWKCKVILESEVIAEAVGVKKTVKYEAAGEAVKTLKKTQPTVINNLKKGAVEDVISRNEIQGRSAEEAYKQQIKEDNIGNQLLRKMGWTGGGLGKSGEGIREPISVKEQHKREGLGLDVERVNKIAKRDIEQIIRNYARSESHTDLTFSRELTNDERKQIHQIAQKYGLKSKSHGVGHDRYLVVGRKRRKEDLLDQLKQEGQVGHYELVMPQAN

SEQ ID NO: 860688 - protein, 750 aa, Homo sapiens
EPVLEQWRYSHESDWQWALRRSFICRHLHSYPGAALDQLLALSAAWTNHVFLGCRYSPRLMEKILQMAEGIDIGEMPSYDLVLSKPSKGQKRHLSTCDGQNPPKKQAGSKFHARPRFEPVHFVASSSKDERQEDPYGPQTKEVNEQTHFASMPRDIYQDYTQDSFSIQDGNSQYCDSSGFILTKDQPVTANMYFDSGNPAPSTTSQQANSQSTPEPSPSQTFPESVVAEKQYFIEKLTATIWKNLSNPEMTSGSDKINYTYMLTRCIQACKTNPEYIYAPLKEIPPADIPKNKKLLTDGYACEVRCQNIYLTTGYAGSKNGSRDRATELAVKLLQKRIEVRVVRRKFKHTFGEDLVVCQIGMSSYEFPPALKPPEDLVVLGKDASGQPIFNASAKHWTNFVITENANDAIGILNNSASFNKMSIEYKYEMMPNRTWRCRVFLQDHCLAEGYGTKKTSKHAAADEALKILQKTQPTYPSVKSSQCHTGSSPRGSGKKKDIKDLVVYENSSNPVCTLNDTAQFNRMTVEYVYERMTGLRWKCKVILESEVIAEAVGVKKTVKYEAAGEAVKTLKKTQPTVINNLKKGAVEDVISRNEIQGRSAEEAYKQQIKEDNIGNQLLRKMGWTGGGLGKSGEGIREPISVKEQHKREGLGLDVERVNKIAKRDIEQIIRNYARSESHTDLTFSRELTNDERKQIHQIAQKYGLKSKSHGVGHDRYLVVGRKRRKEDLLDQLKQEGQVGHYELVMPQAN

SEQ ID NO: 860689 - protein, 193 aa, Homo sapiens
EPVLEQWRYSHESDWQWALRRSFICRHLHSYPGAALDQLLALSAAWTNHVFLGCRYSPRLMEKILQMAEGIDIGEMPSYDLVLSKPSKGQKRHLSTCDGQNPPKKQAGSKFHARPRFEPVHFVASSSKDERQEDPYGPQTKEVNEQTHFASMPRDIYQDYTQDSFSIQDGNSQYCDSSGPSLKKLIKPEKPTL

SEQ ID NO: 860690 - protein, 390 aa, Homo sapiens
MVEADRPGKLFIGGLNTETNEKALETVFGKYGRIVEVLLIKDRETNKSRGFAFVTFESPADAKDAARDMNGKSLDGKAIKVEQATKPSFERGRHGPPPPPRSRGPPRGFGAGRGGSGGTRGPPSRGGHMDDGGYSMNFNMSSSRGPLPVKRGPPPRSGGPSPKRSAPSGLVRSSSGMGGRAPLSRGRDSYGGPPRREPLPSRRDVYLSPRDDGYSTKDSYSSRDYPSSRDTRDYAPPPRDYTYRDYGHSSSRDDYPSRGYGDRDGYGRDRDYSDHPSGGSYRDSYESYGNSRSAPLTRGPPPSYGGSSRYDDYSSSRDGYGGSRDSYSSSRSDLYSSCDRVGRQERGLPPSVERGYPSSRDSYSSSSRGAPRGAGPGGSRSDRGGGRSRY

SEQ ID NO: 860691 - protein, 322 aa, Homo sapiens
MNGKSLDGKAIKVEQATKPSFERGRHGPPPPPRSRGPPRGFGAGRGGSGGTRGPPSRGGHMDDGGYSMNFNMSSSRGPLPVKRGPPPRSGGPSPKRSAPSGLVRSSSGMGGRAPLSRGRDSYGGPPRREPLPSRRDVYLSPRDDGYSTKDSYSSRDYPSSRDTRDYAPPPRDYTYRDYGHSSSRDDYPSRGYGDRDGYGRDRDYSDHPSGGSYRDSYESYGNSRSAPLTRGPPPSYGGSSRYDDYSSSRDGYGGSRDSYSSSRSDLYSSCDRVGRQERGLPPSVERGYPSSRDSYSSSSRGAPRGAGPGGSRSDRGGGRSRY

SEQ ID NO: 860692 - protein, 291 aa, Homo sapiens
MVEADRPGKLFIGGLNTETNEKALETVFGKYGRIVEVLLIKDRETNKSRGFAFVTFESPADAKDAARDMNGKSTFTGNFLGREKPSRWQQATKPSFESALYVTRLGGIPAPSHRCFRPKEGRITKNLRWGGAARSQAFFNATVPSHSTWLPFFQSGPKNRGAWGTPQGAGVAPSFGGGNTMAPVPPPPHRRATVGTPNGRGGGWENPPPGFFPRPPPFPTGGAGNDPHFGAPTSWSKPPGRWPLRAVTRPPTLLYTTSFFYVRTAQIRAESTKQTPQMQAHIYSKYDDHSY

SEQ ID NO: 860693 - protein, 390 aa, Homo sapiens; identical to SEQ ID NO: 860690

SEQ ID NO: 860694 - protein, 286 aa, Homo sapiens
KKQAGQLWERGVSDSCCQQAPGQSEKEGQIPSKSQRRQLTLSANAQVLSDSVPPVPVPRMACTKTLQQSQPISAGATTTTTAVAPAGGHSGSTECDLECLVCREPYSCPRLPKLLACQHAFCAICLKLLLCVQDNTWSITCPLCRKVTAVPGGLICSLRDHEAVVGQLAQPCTEVSLCPQGLVDPADLAAGHPSLVGEDGQDEVSANHVAARRLAAHLLLLALLIILIGPFIYPGVLRWVLTFIIALALLMSTLFCCLPSTRGSCWPSSRTLFCREQKHSHISSIA

SEQ ID NO: 860695 - protein, 649 aa, Homo sapiens
MASVSALTEELDSITSELHAVEIQIQELTERQQELIQKKKVLTKKIKQCLEDSDAGASNEYDSSPAAWNKEDFPWSGKVKDILQNVFKLEKFRPLQLETINVTMAGKEVFLVMPTGGGKSLCYQLPALCSDGFTLVICPLISLMEDQLMVLKQLGISATMLNASSSKEHVKWVHAEMVNKNSELKLIYVTPEKIAKSKMFMSRLEKAYEARRFTRIAVDEVHCCSQWGHDFRPDYKALGILKRQFPNASLIGLTATATNHVLTDAQKILCIEKCFTFTASFNRPNLYYEVRQKPSNTEDFIEDIVKLINGRYKGQSGIIYCFSQKDSEQVTVSLQNLGIHAGAYHANLEPEDKTTVHRKWSANEIQVVVATVAFGMGIDKPDVRFVIHHSMSKSMENYYQESGRAGRDDMKADCILYYGFGDIFRISSMVVMENVGQQKLYEMVSYCQNISKCRRVLMAQHFDEVWNSEACNKMCDNCCKDSAFERKNITEYCRDLIKILKQAEELNEKLTPLKLIDSWMGKGAAKLRVAGVVAPTLPREDLEKIIAHFLIQQYLKEDYSFTAYATISYLKIGPKANLLNNEAHAITMQVTKSTQNSFRAESSQTCHSEQGDKKMEEKNSGNFQKKAANMLQQSGSKNTGAKKRKIDDA

SEQ ID NO: 860696 - protein, 649 aa, Homo sapiens; identical to SEQ ID NO: 860695

SEQ ID NO: 860697 - protein, 649 aa, Homo sapiens; identical to SEQ ID NO: 860695

SEQ ID NO: 860698 - protein, 649 aa, Homo sapiens; identical to SEQ ID NO: 860695

SEQ ID NO: 860699 - protein, 649 aa, Homo sapiens; identical to SEQ ID NO: 860695

SEQ ID NO: 860700 - protein, 649 aa, Homo sapiens; identical to SEQ ID NO: 860695

SEQ ID NO: 860701 - protein, 649 aa, Homo sapiens; identical to SEQ ID NO: 860695

SEQ ID NO: 860702 - protein, 603 aa, Homo sapiens [sequence omitted]

SEQ ID NO: 860703 - protein, 1231 aa, Homo sapiens
MIAAPEIPTDFNLLQESETHFSSDTDFEDIEGKNQKQGKGKTCKKGKKGPAEKGKGGNGGGKPPSGPNRMNGHHQQNGVENMMLFEVVKMGKSAMQSVVDDWIESYKHDRDIALLDLINFFIQCSGCKGVVTAEMFRHMQNSEIIRKMTEEFDEDSGDYPLTMAGPQWKKFKSSFCEFIGVLVRQCQYSIIYDEYMMDTVISLLTGLSDSQVRAFRHTSTLAAMKLMTALVNVALNLSINMDNTQRQYEAERNKMIGKRANERLELLLQKRKELQENQDEIENMMNAIFKGVFVHRYRDAIAEIRAICIEEIGIWMKMYSDAFLNDSYLKYVGWTMHDKQGEVRLKCLTALQGLYYNKELNSKLELFTSRFKDRIVSMTLDKEYDVAVQAIKLLTLVLQSSEEVLTAEDCENVYHLVYSAHRPVAVAAGEFLYKKLFSRRDPEEDGMMKRRGRQGPNANLVKTLVFFFLESELHEHAAYLVDSMWDCATELLKDWECMNSLLLEEPLSGEEALTDRQESALIEIMLCTIRQAAECHPPVGRGTGKRVLTAKEKKTQLDDRTKITELFAVALPQLLAKYSVDAEKVTNLLQLPQYFDLEIYTTGRLEKHLDALLRQIRNIVEKHTDTDVLEACSKTYHALCNEEFTIFNRVDISRSQLIDELADKFNRLLEDFLQEGEEPDEDDAYQVLSTLKRITAFHNAHDLSKWDLFACNYKLLKTGIENGDMPEQIVIHALQCTHYVILWQLAKITESSSTKEDLLRLKKQMRVFCQICQHYLTNVNTTVKEQAFTILCDILMIFSHQIMSGGRDMLEPLVYTPDSSLQSELLSFILDHVFIEQDDDNNSADGQQEDEASKIEALHKRRNLLAAFCKLIVYTVVEMNTAADIFKQYMKYYNDYGDIIKETMSKTRQIDKIQCAKTLILSLQQLFNEMIQENGYNFDRSSSTFSGIKELARRFALTFGLDQLKTREAIAMLHKDGIEFAFKEPNPQGESHPPLNLAFLDILSEFSSKLLRQDKRTVYVYLEKFMTFQMSLRREDVWLPLMSYRNSLLAGGDDDTMSVISGISSRGSTVRSKKSKPSTGKRKVVEGMQLSLTEESSSSDSMWLSREQTLHTPVMMQTPQLTSTIMREPKRLRPEDSFMSVYPMQTEHHQTPLDYNRRGTSLMEDDEEPIVEDVMMSSEGRIEDLNEGMDFDTMDIDLPPSKNRRERTELKPDFFDPASIMDESVLGVSMF

SEQ ID NO: 860704 - protein, 1231 aa, Homo sapiens; identical to SEQ ID NO: 860703

SEQ ID NO: 860705 - protein, 1223 aa, Homo sapiens
SSSSFHHSILLWISTTEELFVEKFSSCYCYWRITCKKGKKGPAEKGKGGNGGGKPPSGPNRMNGHHQQNGVENMMLFEVVKMGKSAMQSVVDDWIESYKHDRDIALLDLINFFIQCSGCKGVVTAEMFRHMQNSEIIRKMTEEFDEDSGDYPLTMAGPQWKKFKSSFCEFIGVLVRQCQYSIIYDEYMMDTVISLLTGLSDSQVRAFRHTSTLAAMKLMTALVNVALNLSINMDNTQRQYEAERNKMIGKRANERLELLLQKRKELQENQDEIENMMNAIFKGVFVHRYRDAIAEIRAICIEEIGIWMKMYSDAFLNDSYLKYVGWTMHDKQGEVRLKCLTALQGLYYNKELNSKLELFTSRFKDRIVSMTLDKEYDVAVQAIKLLTLVLQSSEEVLTAEDCENVYHLVYSAHRPVAVAAGEFLYKKLFSRRDPEEDGMMKRRGRQGPNANLVKTLVFFFLESELHEHAAYLVDSMWDCATELLKDWECMNSLLLEEPLSGEEALTDRQESALIEIMLCTIRQAAECHPPVGRGTGKRVLTAKEKKTQLDDRTKITELFAVALPQLLAKYSVDAEKVTNLLQLPQYFDLEIYTTGRLEKHLDALLRQIRNIVEKHTDTDVLEACSKTYHALCNEEFTIFNRVDISRSQLIDELADKFNRLLEDFLQEGEEPDEDDAYQVLSTLKRITAFHNAHDLSKWDLFACNYKLLKTGIENGDMPEQIVIHALQCTHYVILWQLAKITESSSTKEDLLRLKKQMRVFCQICQHYLTNVNTTVKEQAFTILCDILMIFSHQIMSGGRDMLEPLVYTPDSSLQSELLSFILDHVFIEQDDDNNSADGQQEDEASKIEALHKRRNLLAAFCKLIVYTVVEMNTAADIFKQYMKYYNDYGDIIKETMSKTRQIDKIQCAKTLILSLQQLFNEMIQENGYNFDRSSSTFSGIKELARRFALTFGLDQLKTREAIAMLHKDGIEFAFKEPNPQGESHPPLNLAFLDILSEFSSKLLRQDKRTVYVYLEKFMTFQMSLRREDVWLPLMSYRNSLLAGGDDDTMSVISGISSRGSTVRSKKSKPSTGKRKVVEGMQLSLTEESSSSDSMWLSREQTLHTPVMMQTPQLTSTIMREPKRLRPEDSFMSVYPMQTEHHQTPLDYNRRGTSLMEDDEEPIVEDVMMSSEGRIEDLNEGMDFDTMDIDLPPSKNRRERTELKPDFFDPASIMDESVLGVSMF

SEQ ID NO: 860706 - protein, 1231 aa, Homo sapiens; identical to SEQ ID NO: 860703

SEQ ID NO: 860707 - protein, 873 aa, Homo sapiens
LLLPRPIISSAWWGNCWGRRLASISPSLPRPDFGQFSSGNKSSEEVLTAEDCENVYHLVYSAHRPVAVAAGEFLYKKLFSRRDPEEDGMMKRRGRQGPNANLVKTLVFFFLESELHEHAAYLVDSMWDCATELLKDWECMNSLLLEEPLSGEEALTDRQESALIEIMLCTIRQAAECHPPVGRGTGKRVLTAKEKKTQLDDRTKITELFAVALPQLLAKYSVDAEKVTNLLQLPQYFDLEIYTTGRLEKHLDALLRQIRNIVEKHTDTDVLEACSKTYHALCNEEFTIFNRVDISRSQLIDELADKFNRLLEDFLQEGEEPDEDDAYQVLSTLKRITAFHNAHDLSKWDLFACNYKLLKTGIENGDMPEQIVIHALQCTHYVILWQLAKITESSSTKEDLLRLKKQMRVFCQICQHYLTNVNTTVKEQAFTILCDILMIFSHQIMSGGRDMLEPLVYTPDSSLQSELLSFILDHVFIEQDDDNNSADGQQEDEASKIEALHKRRNLLAAFCKLIVYTVVEMNTAADIFKQYMKYYNDYGDIIKETMSKTRQIDKIQCAKTLILSLQQLFNEMIQENGYNFDRSSSTFSGIKELARRFALTFGLDQLKTREAIAMLHKDGIEFAFKEPNPQGESHPPLNLAFLDILSEFSSKLLRQDKRTVYVYLEKFMTFQMSLRREDVWLPLMSYRNSLLAGGDDDTMSVISGISSRGSTVRSKKSKPSTGKRKVVEGMQLSLTEESSSSDSMWLSREQTLHTPVMMQTPQLTSTIMREPKRLRPEDSFMSVYPMQTEHHQTPLDYNRRGTSLMEDDEEPIVEDVMMSSEGRIEDLNEGMDFDTMDIDLPPSKNRRERTELKPDFFDPASIMDESVLGVSMF

SEQ ID NO: 860708 - protein, 859 aa, Homo sapiens
DLSIPSEARLRHELSCSCPRNSLRRKKSSEEVLTAEDCENVYHLVYSAHRPVAVAAGEFLYKKLFSRRDPEEDGMMKRRGRQGPNANLVKTLVFFFLESELHEHAAYLVDSMWDCATELLKDWECMNSLLLEEPLSGEEALTDRQESALIEIMLCTIRQAAECHPPVGRGTGKRVLTAKEKKTQLDDRTKITELFAVALPQLLAKYSVDAEKVTNLLQLPQYFDLEIYTTGRLEKHLDALLRQIRNIVEKHTDTDVLEACSKTYHALCNEEFTIFNRVDISRSQLIDELADKFNRLLEDFLQEGEEPDEDDAYQVLSTLKRITAFHNAHDLSKWDLFACNYKLLKTGIENGDMPEQIVIHALQCTHYVILWQLAKITESSSTKEDLLRLKKQMRVFCQICQHYLTNVNTTVKEQAFTILCDILMIFSHQIMSGGRDMLEPLVYTPDSSLQSELLSFILDHVFIEQDDDNNSADGQQEDEASKIEALHKRRNLLAAFCKLIVYTVVEMNTAADIFKQYMKYYNDYGDIIKETMSKTRQIDKIQCAKTLILSLQQLFNEMIQENGYNFDRSSSTFSGIKELARRFALTFGLDQLKTREAIAMLHKDGIEFAFKEPNPQGESHPPLNLAFLDILSEFSSKLLRQDKRTVYVYLEKFMTFQMSLRREDVWLPLMSYRNSLLAGGDDDTMSVISGISSRGSTVRSKKSKPSTGKRKVVEGMQLSLTEESSSSDSMWLSREQTLHTPVMMQTPQLTSTIMREPKRLRPEDSFMSVYPMQTEHHQTPLDYNRRGTSLMEDDEEPIVEDVMMSSEGRIEDLNEGMDFDTMDIDLPPSKNRRERTELKPDFFDPASIMDESVLGVSMF

SEQ ID NO: 860709 - protein, 1213 aa, Homo sapiens
MIAAPEIPTDFNLLQESETHFSSDTDFEDIEGKNQKQGKGKTCKKGKKGPAEKGKGGNGGGKPPSGPNRMNGHHQQNGVENMMLFEVVKMGKSAMQSVVDDWIESYKHDRDIALLDLINFFIQCSGCKGVVTAEMFRHMQNSEIIRKMTEEFDEDSGDYPLTMAGPQWKKFKSSFCEFIGVLVRQCQYSIIYDEYMMDTVISLLTGLSDSQVRAFRHTSTLAAMKLMTALVNVALNLSINMDNTQRQYEAERNKMIGKRANERLELLLQKRKELQENQDEIENMMNAIFKGVFVHRYRDAIAEIRAICIEEIGIWMKMYSDAFLNDSYLKYVGWTMHDKQGEVRLKCLTALQGLYYNKELNSKLELFTSRFKDRIVSMTLDKEYDVAVQAIKLLTLVLQSSEEVLTAEDCENVYHLVYSAHRPVAVAAGEFLYKKLFSRRDPEEDGMMKRRGRQGPNANLVKTLVFFFLESELHEHAAYLVDSMWDCATELLKDWECMNSLLLEEPLSGEEALTDRQESALIEIMLCTIRQAAECHPPVGRGTGKRVLTAKEKKTQLDDRTKITELFAVALPQLLAKYSVDAEKVTNLLQLPQYFDLEIYTTGRLEKHLDALLRQIRNIVEKHTDTDVLEACSKTYHALCNEEFTIFNRVDISRSQLIDELADKFNRLLEDFLQEGEEPDEDDAYQVLSTLKRITAFHNAHDLSKWDLFACNYKLLKTGIENGDMPEQIVIHALQCTHYVILWQLAKITESSSTKEDLLRLKKQMRVFCQICQHYLTNVNTTVKEQAFTILCDILMIFSHQIMSGGRDMLEPLVYTPDSSLQSELLSFILDHVFIEQDDDNNSADGQQEDEASKIEALHKRRNLLAAFCKLIVYTVVEMNTAADIFKQYMKYYNDYGDIIKETMSKTRQIDKIQCAKTLILSLQQLFNEMIQENGYNFDRSSSTFSGIKELARRFALTFGLDQLKTREAIAMLHKDGIEFAFKEPNPQGESHPPLNLAFLDILSEFSSKLLRQDKRTVYVYLEKFMTFQMSLRREDVWLPLMSYRNSLLAGGDDDTMSVISGISSRGSTVRSKKSKPSTGKRKVVEGMQLSLTEESSSSDSMWLSREQTLHTPVMMQTPQLTSTIMREPNHQTPLDYNRRGTSLMEDDEEPIVEDVMMSSEGRIEDLNEGMDFDTMDIDLPPSKNRRERTELKPDFFDPASIMDESVLGVSMF

SEQ ID NO: 860710 - protein, 1162 aa, Homo sapiens
MNGHHQQNGVENMMLFEVVKMGKSAMQSVVDDWIESYKHDRDIALLDLINFFIQCSGCKGVVTAEMFRHMQNSEIIRKMTEEFDEDSGDYPLTMAGPQWKKFKSSFCEFIGVLVRQCQYSIIYDEYMMDTVISLLTGLSDSQVRAFRHTSTLAAMKLMTALVNVALNLSINMDNTQRQYEAERNKMIGKRANERLELLLQKRKELQENQDEIENMMNAIFKGVFVHRYRDAIAEIRAICIEEIGIWMKMYSDAFLNDSYLKYVGWTMHDKQGEVRLKCLTALQGLYYNKELNSKLELFTSRFKDRIVSMTLDKEYDVAVQAIKLLTLVLQSSEEVLTAEDCENVYHLVYSAHRPVAVAAGEFLYKKLFSRRDPEEDGMMKRRGRQGPNANLVKTLVFFFLESELHEHAAYLVDSMWDCATELLKDWECMNSLLLEEPLSGEEALTDRQESALIEIMLCTIRQAAECHPPVGRGTGKRVLTAKEKKTQLDDRTKITELFAVALPQLLAKYSVDAEKVTNLLQLPQYFDLEIYTTGRLEKHLDALLRQIRNIVEKHTDTDVLEACSKTYHALCNEEFTIFNRVDISRSQLIDELADKFNRLLEDFLQEGEEPDEDDAYQVLSTLKRITAFHNAHDLSKWDLFACNYKLLKTGIENGDMPEQIVIHALQCTHYVILWQLAKITESSSTKEDLLRLKKQMRVFCQICQHYLTNVNTTVKEQAFTILCDILMIFSHQIMSGGRDMLEPLVYTPDSSLQSELLSFILDHVFIEQDDDNNSADGQQEDEASKIEALHKRRNLLAAFCKLIVYTVVEMNTAADIFKQYMKYYNDYGDIIKETMSKTRQIDKIQCAKTLILSLQQLFNEMIQENGYNFDRSSSTFSGIKELARRFALTFGLDQLKTREAIAMLHKDGIEFAFKEPNPQGESHPPLNLAFLDILSEFSSKLLRQDKRTVYVYLEKFMTFQMSLRREDVWLPLMSYRNSLLAGGDDDTMSVISGISSRGSTVRSKKSKPSTGKRKVVEGMQLSLTEESSSSDSMWLSREQTLHTPVMMQTPQLTSTIMREPKRLRPEDSFMSVYPMQTEHHQTPLDYNRRGTSLMEDDEEPIVEDVMMSSEGRIEDLNEGMDFDTMDIDLPPSKNRRERTELKPDFFDPASIMDESVLGVSMF

SEQ ID NO: 860711 - protein, 869 aa, Homo sapiens
MIAAPEIPTDFNLLQESETHFSSDTDFEDIEGKNQKQGKGKTCKKGKKGPAEKGKGGNGGGKPPSGPNRMNGHHQQNGVENMMLFEVVKMGKSAMQSVVDDWIESYKHDRDIALLDLINFFIQCSGCKGVVTAEMFRHMQNSEIIRKMTEEFDEDSGDYPLTMAGPQWKKFKSSFCEFIGVLVRQCQYSIIYDEYMMDTVISLLTGLSDSQVRAFRHTSTLAAMKLMTALVNVALNLSINMDNTQRQYEAERNKMIGKRANERLELLLQKRKELQENQDEIENMMNAIFKGVFVHRYRDAIAEIRAICIEEIGIWMKMYSDAFLNDSYLKYVGWTMHDKQGEVRLKCLTALQGLYYNKELNSKLELFTSRFKDRIVSMTLDKEYDVAVQAIKLLTLVLQSSEEVLTAEDCENVYHLVYSAHRPVAVAAGEFLYKKLFSRRDPEEDGMMKRRGRQGPNANLVKTLVFFFLESELHEHAAYLVDSMWDCATELLKDWECMNSLLLEEPLSGEEALTDRQESALIEIMLCTIRQAAECHPPVGRGTGKRVLTAKEKKTQLDDRTKITELFAVALPQLLAKYSVDAEKVTNLLQLPQYFDLEIYTTGRLEKHLDALLRQIRNIVEKHTDTDVLEACSKTYHALCNEEFTIFNRVDISRSQLIDELADKFNRLLEDFLQEGEEPDEDDAYQVLSTLKRITAFHNAHDLSKWDLFACNYKLLKTGIENGDMPEQIVIHALQCTHYVILWQLAKITESSSTKEDLLRLKKQMRVFCQICQHYLTNVNTTVKEQAFTILCDILMIFSHQIMSGGRDMLEPLVYTPDSSLQSELLSFILDHVFIEQDDDNNSADGTKTGASCSHQVVILYCWVLRNQG

SEQ ID NO: 860712 - protein, 615 aa, Homo sapiens
MIAAPEIPTDFNLLQESETHFSSDTDFEDIEGKNQKQGKGKTCKKGKKGPAEKGKGGNGGGKPPSGPNRMNGHHQQNGVENMMLFEVVKMGKSAMQSVVDDWIESYKHDRDIALLDLINFFIQCSGCKGVVTAEMFRHMQNSEIIRKMTEEFDEDSGDYPLTMAGPQWKKFKSSFCEFIGVLVRQCQYSIIYDEYMMDTVISLLTGLSDSQVRAFRHTSTLAAMKLMTALVNVALNLSINMDNTQRQYEAERNKMIGKRANERLELLLQKRKELQENQDEIENMMNAIFKGVFVHRYRDAIAEIRAICIEEIGIWMKMYSDAFLNDSYLKYVGWTMHDKQGEVRLKCLTALQGLYYNKELNSKLELFTSRFKDRIVSMTLDKEYDVAVQAIKLLTLVLQSSEEVLTAEDCENVYHLVYSAHRPVAVAAGEFLYKKLFSRRDPEEDGMMKRRGRQGPNANLVKTLVFFFLESELHEHAAYLVDSMWDCATELLKDWECMNSLLLEEPLSGEEALTDRQESALIEIMLCTIRQAAECHPPVGRGTGKRVLTAKEKKTQLDDRTKITELFAVALPQLLAKYSLWGISRDPPYRVEYYLTNYKGQLYLPSPISKQFLNN

SEQ ID NO: 860713 - protein, 1162 aa, Homo sapiens; identical to SEQ ID NO: 860710

SEQ ID NO: 860714 - protein, 1162 aa, Homo sapiens; identical to SEQ ID NO: 860710

SEQ ID NO: 860715 - protein, 1162 aa, Homo sapiens; identical to SEQ ID NO: 860710

SEQ ID NO: 860716 - protein, 1231 aa, Homo sapiens; identical to SEQ ID NO: 860703

SEQ ID NO: 860717 - protein, 1268 aa, Homo sapiens
MIAAPEIPTDFNLLQESETHFSSDTDFEDIEGKNQKQGKGKTCKKGKKGPAEKGKGGNGGGKPPSGPNRMNGHHQQNGVENMMLFEVVKMGKSAMQSVVDDWIESYKHDRDIALLDLINFFIQCSGCKGVVTAEMFRHMQNSEIIRKMTEEFDEDSGDYPLTMAGPQWKKFKSSFCEFIGVLVRQCQYSIIYDEYMMDTVISLLTGLSDSQVRAFRHTSTLAAMKLMTALVNVALNLSINMDNTQRQYEAERNKMIGKRANERLELLLQKRKELQENQDEIENMMNAIFKGVFVHRYRDAIAEIRAICIEEIGIWMKMYSDAFLNDSYLKYVGWTMHDKQGEVRLKCLTALQGLYYNKELNSKLELFTSRFKDRIVSMTLDKEYDVAVQAIKLLTLVLQSSEEVLTAEDCENVYHLVYSAHRPVAVAAGEFLYKKLFSRRDPEEDGMMKRRGRQGPNANLVKTLVFFFLESELHEHAAYLVDSMWDCATELLKDWECMNSLLLEEPLSGEEALTDRQESALIEIMLCTIRQAAECHPPVGRGTGKRVLTAKEKKTQLDDRTKITELFAVALPQLLAKYSVDAEKVTNLLQLPQYFDLEIYTTGRLEKHLDALLRQIRNIVEKHTDTDVLEACSKTYHALCNEEFTIFNRVDISRSQLIDELADKFNRLLEDFLQEGEEPDEDDAYQVLSTLKRITAFHNAHDLSKWDLFACNYKLLKTGIENGDMPEQIVIHALQCTHYVILWQLAKITESSSTKEDLLRLKKQMRVFCQICQHYLTNVNTTVKEQAFTILCDILMIFSHQIMSGGRDMLEPLVYTPDSSLQSELLSFILDHVFIEQDDDNNSADGQQEDEASKIEALHKRRNLLAAFCKLIVYTVVEMNTAADIFKQYMKYYNDYGDIIKETMSKTRQIDKIQCAKTLILSLQQLFNEMIQENGYNFDRSSSTFSGIKELARRFALTFGLDQLKTREAIAMLHKDGIEFAFKEPNPQGESHPPLNLAFLDILSEFSSKLLRQDKRTVYVYLEKFMTFQMSLRREDVWLPLMSYRNSLLAGGDDDTMSVISGISSRGSTVRSKKSKPSTGKRKVVEGMQLSLTEESSSSDSMWLSREQTLHTPVMMQTPQLTSTIMREPKRLRPEDSFMSVYPMQTEHHQTPLDYNTQVTWMLAQRQQEEARQQQERAAMSYVKLRTNLQHAIRRGTSLMEDDEEPIVEDVMMSSEGRIEDLNEGMDFDTMDIDLPPSKNRRERTELKPDFFDPASIMDESVLGVSMF

SEQ ID NO: 860718 - protein, 280 aa, Homo sapiens
MASKRPGYSDEVRTQEINIAMLHKDGIEFAFKEPNPQGESHPPLNLAFLDILSEFSSKLLRQDKRTVYVYLEKFMTFQMSLRREDVWLPLMSYRNSLLAGGDDDTMSVISGISSRGSTVRSKKSKPSTGKRKVVEGMQLSLTEESSSSDSMWLSREQTLHTPVMMQTPQLTSTIMREPKRLRPEDSFMSVYPMQTEHHQTPLDYNRRGTSLMEDDEEPIVEDVMMSSEGRIEDLNEGMDFDTMDIDLPPSKNRRERTELKPDFFDPASIMDESVLGVSMF

SEQ ID NO: 860719 - protein, 1162 aa, Homo sapiens; identical to SEQ ID NO: 860710

SEQ ID NO: 860720 - protein, 172 aa, Homo sapiens
METRPRLGATCLLGFSFLLLVISSDGHNGLGKGFGDHIHWRTLEDGKKEAAASGLPLMVIIHKSWCGACKALKPKFAESTEISELSHNFVMVNLEDEEEPKDEDFSPDGGYIPRILFLDPSGKVHPEIINENGNPSYKYFYVSAEQVVQGMKEAQERLTGDAFRKKHLEDEL

SEQ ID NO: 860721 - protein, 172 aa, Homo sapiens; identical to SEQ ID NO: 860720

SEQ ID NO: 860722 - protein, 172 aa, Homo sapiens; identical to SEQ ID NO: 860720

SEQ ID NO: 860723 - protein, 172 aa, Homo sapiens; identical to SEQ ID NO: 860720

SEQ ID NO: 860724 - protein, 71 aa, Homo sapiens
AGDLEDPGSSMHGESFWDPSGKVHPEIINENGNPSYKYFYVSAEQVVQGMKEAQERLTGDAFRKKHLEDEL

SEQ ID NO: 860725 - protein, 172 aa, Homo sapiens; identical to SEQ ID NO: 860720

SEQ ID NO: 860726 - protein, 172 aa, Homo sapiens; identical to SEQ ID NO: 860720

SEQ ID NO: 860727 - protein, 172 aa, Homo sapiens; identical to SEQ ID NO: 860720

SEQ ID NO: 860728 - protein, 205 aa, Homo sapiens
QTDVTSVDHSGLYFQFRAWVCHMSLSVPLDLQDKKTRPRLGATCLLGFSFLLLVISSDGHNGLGKGFGDHIHWRTLEDGKKEAAASGLPLMVIIHKSWCGACKALKPKFAESTEISELSHNFVMVNLEDEEEPKDEDFSPDGGYIPRILFLDPSGKVHPEIINENGNPSYKYFYVSAEQVVQGMKEAQERLTGDAFRKKHLEDEL

SEQ ID NO: 860729 - protein, 2036 aa, Homo sapiens
VSGVSVAMETRSSKTRRSLASRTNECQGTMWAPTSPPAGSSSPSQPTWKSSLYSSLAYSEAFHYSFAARPRRLTQLALAQRPEPQLLRLRPSSLRTQDISHLLTGVFRNLYSAEVIGDEVSASLIKARGSENERHEEFVDQLQQIRELYKQRLDEFEMLERHITQAQARAIAENERVMSQAGVQDLESLVRLPPVKSVSRWCIDSELLRKHHLISPEDYYTDTVPFHSAPKGISLPGCSKLTFSCEKRSVQKKELNKKLEDSCRKKLAEFEDELDHTVDSLTWNLTPKAKERTREPLKKASQPRNKNWMNHLRVPQRELDRLLLARMESRNHFLKNPRFFPPNTRYGGKSLVFPPKKPAPIGEFQSTEPEQSCADTPVFLAKPPIGFFTDYEIGPVYEMVIALQNTTTTSRYLRVLPPSTPYFALGLGMFPGKGGMVAPGMTCQYIVQFFPDCLGDFDDFILVETQSAHTLLIPLQARRPPPVLTLSPVLDCGYCLIGGVKMTRFICKNVGFSVGRFCIMPKTSWPPLSFKAIATVGFVEQPPFGILPSVFELAPGHAILVEVLFSPKSLGKAEQTFIIMCDNCQIKELVTIGIGQLIALDLIYISGEKSQPDPGELTDLTAQHFIRFEPENLRSTARKQLIIRNATHVELAFYWQIMKPNLQPLMPGETFSMDSIKCYPDKETAFSIMPRKGVLSPHTDHEFILSFSPHEVQMVSSQYATHGWIMYLDPPPVFLNHTEATAGPTEVLSCPGQHLAELGWSTHLVCRVKQLILSGPDPRLTPSAARPLAGFLRSGCLPHVYYGKKHYHPHPYHSIPRESEVQGPEGQVSTALAPAWREALWATVGKKGIRAGHEKDAPGAIVSGFGAEMSDPASGPSIQLPRCLSWEGVVLLDTLRGFVSIRKAFASCTQAQLRQAPESWLMFWQQTSLFLRREEGGSREATLGFQKVLLMARLRGGRIPAMPQPSPGQPAGTQWCFQGTVFALQLRDFHSVLQMVLEEVPEPVSSEAESLGHSSYSVDDVIVLEIEVKGSVEPFQVLLEPYALIIPGENYIGINVKKAFKMWNNSKSPIRYLWGKISDCHIIEVEPGTGVIEPSEVGDFELNFTGGVPGPTSQDLLCEIEDSPSPVVLHIEAVFKGPALIINVSALQFGLLRLGQKATNSIQIRNVSQLPATWRMKESPVSLQERPEDVSPFDIEPSSGQLHSLGECRVDITLEALHCQHLETVLELEVENGAWSYLPVYAEVQKPHVYLQSSQVEVRNLYLGVPTKTTITLINGTLLPTQFHWGKLLGHQAEFCMVTVSPKHGLLGPSEECQLKLELTAHTQEELTHLALPCHVSGMKKPLVLGISGKPQGLQVAITISKESSDCSTEQWPGHPKELRLDFGSAVPLRTRVTRQLILTNRSPIRTRFSLKFEYFGSPQNSLSKKTSLPNMPPALLKTVRMQEHLAKREQLDFMESMLSHGKGAAFFPHFSQGMLGPYQQLCIDITGCANMWGEYWDNLICTVGDLLPEVIPVHMAAVGCPISSLRTTSYTIDQAQKEPAMRFGTQVSGGDTVTRTLRLNNSSPCDIRLDWETYVPEDKEDRLVELLVFYGPPFPLRDQAGNELVCPDTPEGGCLLWSPGPSSSSEFSHETDSSVEGSSSASNRVAQKLISVILQAHEGVPSGHLYCISPKQVVVPAGGSSTIYISFTPMVLSPEILHKVECTGYALGFMSLDSKVEREIPRKRHRLQDFAVGPLKLDLHSYVRPAQLSVELDYGGSMEFQCQASDLIPEQPCSGVLSELVTTHHLKLTNTTEIPHYFRLMVSRPFSVSQDGASQDHRAPGPGQKQECEEETASADKQLVLQAQENMLVNVSFSLSLELLSYQKLPADQTLPGVDIQQSASGEREMVFTQNLLLEYTNQTTQVVPLRAVVAVPELQLSTSWVDFGTCFVSQQRVREVYLMNLSGCRSYWTMLMGQQEPAKAAVAFRVSPNSGLLEARSANAPPTSIALQVFFTARSSELYESTMVVEGVLGEKSCTLRLRGQGSYDERYMLPHQP

SEQ ID NO: 860730 - protein, 1698 aa, Homo sapiens
VSGVSVAMETRSSKTRRSLASRTNECQGTMWAPTSPPAGSSSPSQPTWKSSLYSSLAYSEAFHYSFAARPRRLTQLALAQRPEPQLLRLRPSSLRTQDISHLLTGVFRNLYSAEVIGDEVSASLIKARGSENERHEEFVDQLQQIRELYKQRLDEFEMLERHITQAQARAIAENERVMSQAGVQDLESLVRLPPVKSVSRWCIDSELLRKHHLISPEDYYTDTVPFHSAPKGISLPGCSKLTFSCEKRSVQKKELNKKLEDSCRKKLAEFEDELDHTVDSLTWNLTPKAKERTREPLKKASQPRNKNWMNHLRVPQRELDRLLLARMESRNHFLKNPRFFPPNTRYGGKSLVFPPKKPAPIGEFQSTEPEQSCADTPVFLAKPPIGFFTDYEIGPVYEMVIALQNTTTTSRYLRVLPPSTPYFALGLGMFPGKGGMVAPGMTCQYIVQFFPDCLGDFDDFILVETQSAHTLLIPLQARRPPPVLTLSPVLDCGYCLIGGVKMTRFICKNVGFSVGRFCIMPKTSWPPLSFKAIATVGFVEQPPFGILPSVFELAPGHAILVEVLFSPKSLGKAEQTFIIMCDNCQIKELVTIGIGQLIALDLIYISGEKSQPDPGELTDLTAQHFIRFEPENLRSTARKQLIIRNAYLRDFHSVLQMVLEEVPEPVSSEAESLGHSSYSVDDVIVLEIEVKGSVEPFQVLLEPYALIIPGENYIGINVKKAFKMWNNSKSPIRYLWGKISDCHIIEVEPGTGVIEPSEVGDFELNFTGGVPGPTSQDLLCEIEDSPSPVVLHIEAVFKGPALIINVSALQFGLLRLGQKATNSIQIRNVSQLPATWRMKESPVSLQERPEDVSPFDIEPSSGQLHSLGECRVDITLEALHCQHLETVLELEVENGAWSYLPVYAEVQKPHVYLQSSQVEVRNLYLGVPTKTTITLINGTLLPTQFHWGKLLGHQAEFCMVTVSPKHGLLGPSEECQLKLELTAHTQEELTHLALPCHVSGMKKPLVLGISGKPQGLQVAITISKESSDCSTEQWPGHPKELRLDFGSAVPLRTRVTRQLILTNRSPIRTRFSLKFEYFGSPQNSLSKKTSLPNMPPALLKTVRMQEHLAKREQLDFMESMLSHGKGAAFFPHFSQGMLGPYQQLCIDITGCANMWGEYWDNLICTVGDLLPEVIPVHMAAVGCPISSLRTTSYTIDQAQKEPAMRFGTQVSGGDTVTRTLRLNNSSPCDIRLDWETYVPEDKEDRLVELLVFYGPPFPLRDQAGNELVCPDTPEGGCLLWSPGPSSSSEFSHETDSSVEGSSSASNRVAQKLISVILQAHEGVPSGHLYCISPKQVVVPAGGSSTIYISFTPMVLSPEILHKVECTGYALGFMSLDSKVEREIPRKRHRLQDFAVGPLKLDLHSYVRPAQLSVELDYGGSMEFQCQASDLIPEQPCSGVLSELVTTHHLKLTNTTEIPHYFRLMVSRPFSVSQDGASQDHRAPGPGQKQECEEETASADKQLVLQAQENMLVNVSFSLSLELLSYQKLPADQTLPGVDIQQSASGEREMVFTQNLLLEYTNQTTQVVPLRAVVAVPELQLSTSWVDFGTCFVSQQRVREVYLMNLSGCRSYWTMLMGQQEPAKAAVAFRVSPNSGLLEARSANAPPTSIALQVFFTARSSELYESTMVVEGVLGEKSCTLRLRGQGSYDERYMLPHQP

SEQ ID NO: 860731 - protein, 126 aa, Homo sapiens
LPPTSVAAQVLSELVTTHHLKLTNTTEIPHYFRLMVSRPFSVSQDGASQDHRAPGPGQKQECEEETASADKQLVLQAQENMLVSGGVCSPCLNGTPSHVYRQHPCTPPSGACTQTQTACLTLPYPA

SEQ ID NO: 860732 - protein, 1992 aa, Homo sapiens
VSGVSVAMETRSSKTRRSLASRTNECQGTMWAPTSPPAGSSSPSQPTWKSSLYSSLAYSEAFHYSFAARPRRLTQLALAQRPEPQLLRLRPSSLRTQDISHLLTGVFRNLYSAEVIGDEVSASLIKARGSENERHEEFVDQLQQIRELYKQRLDEFEMLERHITQAQARAIAENERVMSQAGVQDLESLVRLPPVKSVSRWCIDSELLRKHHLISPEDYYTDTVPFHSAPKGISLPGCSKLTFSCEKRSVQKKELNKKLEDSCRKKLAEFEDELDHTVDSLTWNLTPKAKERTREPLKKASQPRNKNWMNHLRVPQRELDRLLLARMESRNHFLKNPRFFPPNTRYGGKSLVFPPKKPAPIGEFQSTEPEQSCADTPVFLAKPPIGFFTDYEIGPVYEMVIALQNTTTTSRYLRVLPPSTPYFALGLGMFPGKGGMVAPGMTCQYIVQFFPDCLGDFDDFILVETQSAHTLLIPLQARRPPPVLTLSPVLDCGYCLIGGVKMTRFICKNVGFSVGRFCIMPKTSWPPLSFKAIATVGFVEQPPFGILPSVFELAPGHAILVEVLFSPKSLGKAEQTFIIMCDNCQIKELVTIGIGQLIALDLIYISGEKSQPDPGELTDLTAQHFIRFEPENLRSTARKQLIIRNATHVELAFYWQIMKPNLQPLMPGETFSMDSIKCYPDKETAFSIMPRKGVLSPHTDHEFILSFSPHEVQMVSSQYATHGWIMYLDPPPVFLNHTEATAGPTEVLSCPGQHLAELGWSTHLVCRVKQLILSGPDPRLTPSAARPLAGFLRSGCLPHVYYGKKHYHPHPYHSIPRESEVQGPEGQVSTALAPAWREALWATVGKKGIRAGHEKDAPGAIVSGFGAEMSDPASGPSIQLPRCLSWEGVVLLDTLRGFVSIRKAFASCTQAQLRQAPESWLMFWQQTSLFLRREEGGSREATLGFQKVLLMARLRGGRIPAMPQPSPGQPAGTQWCFQGTVFALQLRDFHSVLQMVLEEVPEPVSSEAESLGHSSYSVDDVIVLEIEVKGSVEPFQVLLEPYALIIPGENYIGINVKKAFKMWNNSKSPIRYLWGKISDCHIIEVEPGTGVIEPSEVGDFELNFTGGVPGPTSQDLLCEIEDSPSPVVLHIEAVFKPFSLVLLRLGQKATNSIQIRNVSQLPATWRMKESPVSLQERPEDVSPFDIEPSSGQLHSLGECRVDITLEALHCQHLETVLELEVENGAWSYLPVYAEVQKPHVYLQSSQVEVRNLYLGVPTKTTITLINGTLLPTQFHWGKLLGHQAEFCMVTVSPKHGLLGPSEECQLKLELTAHTQEELTHLALPCHVSGMKKPLVLGISGKPQGLQVAITISKESSDCSTEQWPGHPKELRLDFGSAVPLRTRVTRQLILTNRSPIRTRFSLKFEYFGSPQNSLSKKTSLPNMPPALLKTVRMQEHLAKREQLGCANMWGEYWDNLICTVGDLLPEVIPVHMAAVGCPISSLRTTSYTIDQAQKEPAMRFGTQVSGGDTVTRTLRLNNSSPCDIRLDWETYVPEDKEDRLVELLVFYGPPFPLRDQAGNELVCPDTPEGGCLLWSPGPSSSSEFSHETDSSVEGSSSASNRVAQKLISVILQAHEGVPSGHLYCISPKQVVVPAGGSSTIYISFTPMVLSPEILHKVECTGYALGFMSLDSKVEREIPRKRHRLQDFAVGPLKLDLHSYVRPAQLSVELDYGGSMEFQCQASDLIPEQPCSGVLSELVTTHHLKLTNTTEIPHYFRLMVSRPFSVSQDGASQDHRAPGPGQKQECEEETASADKQLVLQAQENMLVNVSFSLSLELLSYQKLPADQTLPGVDIQQSASGEREMVFTQNLLLEYTNQTTQVVPLRAVVAVPELQLSTSWVDFGTCFVSQQRVREVYLMNLSGCRSYWTMLMGQQEPAKAAVAFRVSPNSGLLEARSANAPPTSIALQVFFTARSSELYESTMVVEGVLGEKSCTLRLRGQGSYDERYMLPHQP

SEQ ID NO: 860733 - protein, 899 aa, Homo sapiens
RGQGCRYPGLAHMRPSNWEPCQHAAGQGRFVQSLRPLSASWVGRKGGSVVGSSMKQESEDEAWCLGSFCMPTQDGSLGRAKGGVLHSTNGQQDSVFSTEQWPGHPKELRLDFGSAVPLRTRVTRQLILTNRSPIRTRFSLKFEYFGSPQNSLSKKTSLPNMPPALLKTVRMQEHLAKREQLDFMESMLSHGKGAAFFPHFSQGMLGPYQQLCIDITGCANMWGEYWDNLICTVGDLLPEVIPVHMAAVGCPISSLRTTSYTIDQAQKEPAMRFGTQVSGGDTVTRTLRLNNSSPCDIRLDWETYVPEDKEDRLVELLVFYGPPFPLRDQAGNELVCPDTPEGGCLLWSPGPSSSSEFSHETDSSVEGSSSASNRVAQKLISVILQAHEGVPSGHLYCISPKQVVVPAGGSSTIYISFTPMVLSPEILHKVECTGYALGFMSLDSKVSSSGLGWGPQPLLPPGEHAAYSAQGSAVIRLGLSEVEREIPRKRHRLQDFAVGPLKLDLHSYVRPAQWSQLGCPISFHPHGVHPHQALVEPGRVLRAKGRAWVEKSAEEPRERLARGWMSRVGAARRPQAPGLPQQCLLLGRLSVELDYGGSMEFQCQASDLIPEQPCSGVLSELVTTHHLKLTNTTEIPHYFRLMVSRPFSVSQDGASQDHRAPGPGQKQECEEETASADKQLVLQAQENMLVNVSFSLSLELLSYQKLPADQTLPGVDIQQSASGEREMVFTQNLLLEYTNQTTQVVPLRAVVAVPELQLSTSWVDFGTCFVSQQRVREVYLMNLSGCRSYWTMLMGVVSCTSPRWWWKVCSVRSPAPCGSGAKAPMMRDTCCLTSPEAPPQPSAPGPSWRKNIAQGLGAALQHKDTDLGTWGPLGSSWNGRTPFHNGLSLGPHDLSSELT

SEQ ID NO: 860734 - protein, 1762 aa, Homo sapiens
VSGVSVAMETRSSKTRRSLASRTNECQGTMWAPTSPPAGSSSPSQPTWKSSLYSSLAYSEAFHYSFAARPRRLTQLALAQRPEPQLLRLRPSSLRTQDISHLLTGVFRNLYSAEVIGDEVSASLIKARGSENERHEEFVDQLQQIRELYKQRLDEFEMLERHITQAQARAIAENERVMSQAGVQDLESLVRLPPVKSVSRWCIDSELLRKHHLISPEDYYTDTVPFHSAPKGISLPGCSKLTFSCEKRSVQKKELNKKLEDSCRKKLAEFEDELDHTVDSLTWNLTPKAKERTREPLKKASQPRNKNWMNHLRVPQRELDRLLLARMESRNHFLKNPRFFPPNTRYGGKSLVFPPKKPAPIGEFQSTEPEQSCADTPVFLAKPPIGFFTDYEIGPVYEMVIALQNTTTTSRYLRVLPPSTPYFALGLGMFPGKGGMVAPGMTCQYIVQFFPDCLGDFDDFILVETQSAHTLLIPLQARRPPPVLTLSPVLDCGYCLIGGVKMTRFICKNVGFSVGRFCIMPKTSWPPLSFKAIATVGFVEQPPFGILPSVFELAPGHAILVEVLFSPKSLGKAEQTFIIMCDNCQIKELVTIGIGQLIALDLIYISGEKSQPDPGELTDLTAQHFIRFEPENLRSTARKQLIIRNATHVELAFYWQIMKPNLQPLMPGETFSMDSIKCYPDKETAFSIMPRKGVLSPHTDHEFILSFSPHELRDFHSVLQMVLEEVPEPVSSEAESLGHSSYSVDDVIVLEIEVKGSVEPFQVLLEPYALIIPGENYIGINVKKAFKMWNNSKSPIRYLWGKISDCHIIEVEPGTGVIEPSEVGDFELNFTGGVPGPTSQDLLCEIEDSPSPVVLHIEAVFKGPALIINVSALQFGLLRLGQKATNSIQIRNVSQLPATWRMKESPVSLQERPEDVSPFDIEPSSGQLHSLGECRVDITLEALHCQHLETVLELEVENGAWSYLPVYAEVQKPHVYLQSSQVEVRNLYLGVPTKTTITLINGTLLPTQFHWGKLLGHQAEFCMVTVSPKHGLLGPSEECQLKLELTAHTQEELTHLALPCHVSGMKKPLVLGISGKPQGLQVAITISKESSDCSTEQWPGHPKELRLDFGSAVPLRTRVTRQLILTNRSPIRTRFSLKFEYFGSPQNSLSKKTSLPNMPPALLKTVRMQEHLAKREQLDFMESMLSHGKGAAFFPHFSQGMLGPYQQLCIDITGCANMWGEYWDNLICTVGDLLPEVIPVHMAAVGCPISSLRTTSYTIDQAQKEPAMRFGTQVSGGDTVTRTLRLNNSSPCDIRLDWETYVPEDKEDRLVELLVFYGPPFPLRDQAGNELVCPDTPEGGCLLWSPGPSSSSEFSHETDSSVEGSSSASNRVAQKLISVILQAHEGVPSGHLYCISPKQVVVPAGGSSTIYISFTPMVLSPEILHKVECTGYALGFMSLDSKVEREIPRKRHRLQDFAVGPLKLDLHSYVRPAQLSVELDYGGSMEFQCQASDLIPEQPCSGVLSELVTTHHLKLTNTTEIPHYFRLMVSRPFSVSQDGASQDHRAPGPGQKQECEEETASADKQLVLQAQENMLVNVSFSLSLELLSYQKLPADQTLPGVDIQQSASGEREMVFTQNLLLEYTNQTTQVVPLRAVVAVPELQLSTSWVDFGTCFVSQQRVREVYLMNLSGCRSYWTMLMGQQEPAKAAVAFRVSPNSGLLEARSANAPPTSIALQVFFTARSSELYESTMVVEGVLGEKSCTLRLRGQGSYDERYMLPHQP

SEQ ID NO: 860735 - protein, 1732 aa, Homo sapiens
VSGVSVAMETRSSKTRRSLASRTNECQGTMWAPTSPPAGSSSPSQPTWKSSLYSSLAYSEAFHYSFAARPRRLTQLALAQRPEPQLLRLRPSSLRTQDISHLLTGVFRNLYSAEVIGDEVSASLIKARGSENERHEEFVDQLQQIRELYKQRLDEFEMLERHITQAQARAIAENERVMSQAGVQDLESLVRLPPVKSVSRWCIDSELLRKHHLISPEDYYTDTVPFHSAPKGISLPGCSKLTFSCEKRSVQKKELNKKLEDSCRKKLAEFEDELDHTVDSLTWNLTPKAKERTREPLKKASQPRNKNWMNHLRVPQRELDRLLLARMESRNHFLKNPRFFPPNTRYGGKSLVFPPKKPAPIGEFQSTEPEQSCADTPVFLAKPPIGFFTDYEIGPVYEMVIALQNTTTTSRYLRVLPPSTPYFALGLGMFPGKGGMVAPGMTCQYIVQFFPDCLGDFDDFILVETQSAHTLLIPLQARRPPPVLTLSPVLDCGYCLIGGVKMTRFICKNVGFSVGRFCIMPKTSWPPLSFKAIATVGFVEQPPFGILPSVFELAPGHAILVEEIGQLIALDLIYISGEKSQPDPGELTDLTAQHFIRFEPENLRSTARKQLIIRNATHVELAFYWQIMKPNLQPLMPGETFSMDSIKCYPDKETAFSIMPRKGVLSPHTDHEFILSFSPHELRDFHSVLQMVLEEVPEPVSSEAESLGHSSYSVDDVIVLEIEVKGSVEPFQVLLEPYALIIPGENYIGINVKKAFKMWNNSKSPIRYLWGKISDCHIIEVEPGTGVIEPSEVGDFELNFTGGVPGPTSQDLLCEIEDSPSPVVLHIEAVFKGPALIINVSALQFGLLRLGQKATNSIQIRNVSQLPATWRMKESPVSLQERPEDVSPFDIEPSSGQLHSLGECRVDITLEALHCQHLETVLELEVENGAWSYLPVYAEVQKPHVYLQSSQVEVRNLYLGVPTKTTITLINGTLLPTQFHWGKLLGHQAEFCMVTVSPKHGLLGPSEECQLKLELTAHTQEELTHLALPCHVSGMKKPLVLGISGKPQGLQVAITISKESSDCSTEQWPGHPKELRLDFGSAVPLRTRVTRQLILTNRSPIRTRFSLKFEYFGSPQNSLSKKTSLPNMPPALLKTVRMQEHLAKREQLDFMESMLSHGKGAAFFPHFSQGMLGPYQQLCIDITGCANMWGEYWDNLICTVGDLLPEVIPVHMAAVGCPISSLRTTSYTIDQAQKEPAMRFGTQVSGGDTVTRTLRLNNSSPCDIRLDWETYVPEDKEDRLVELLVFYGPPFPLRDQAGNELVCPDTPEGGCLLWSPGPSSSSEFSHETDSSVEGSSSASNRVAQKLISVILQAHEGVPSGHLYCISPKQVVVPAGGSSTIYISFTPMVLSPEILHKVECTGYALGFMSLDSKVEREIPRKRHRLQDFAVGPLKLDLHSYVRPAQLSVELDYGGSMEFQCQASDLIPEQPCSGVLSELVTTHHLKLTNTTEIPHYFRLMVSRPFSVSQDGASQDHRAPGPGQKQECEEETASADKQLVLQAQENMLVNVSFSLSLELLSYQKLPADQTLPGVDIQQSASGEREMVFTQNLLLEYTNQTTQVVPLRAVVAVPELQLSTSWVDFGTCFVSQQRVREVYLMNLSGCRSYWTMLMGQQEPAKAAVAFRVSPNSGLLEARSANAPPTSIALQVFFTARSSELYESTMVVEGVLGEKSCTLRLRGQGSYDERYMLPHQP

SEQ ID NO: 860736 - protein, 1785 aa, Homo sapiens
VSGVSVAMETRSSKTRRSLASRTNECQGTMWAPTSPPAGSSSPSQPTWKSSLYSSLAYSEAFHYSFAARPRRLTQLALAQRPEPQLLRLRPSSLRTQDISHLLTGVFRNLYSAEVIGDEVSASLIKARGSENERHEEFVDQLQQIRELYKQRLDEFEMLERHITQAQARAIAENERVMSQAGVQDLESLVRLPPVKSVSRWCIDSELLRKHHLISPEDYYTDTVPFHSAPKGISLPGCSKLTFSCEKRSVQKKELNKKLEDSCRKKLAEFEDELDHTVDSLTWNLTPKAKERTREPLKKASQPRNKNWMNHLRVPQRELDRLLLARMESRNHFLKNPRFFPPNTRYGGKSLVFPPKKPAPIGEFQSTEPEQSCADTPVFLAKPPIGFFTDYEIGPVYEMVIALQNTTTTSRYLRVLPPSTPYFALGLGMFPGKGGMVAPGMTCQYIVQFFPDCLGDFDDFILVETQSAHTLLIPLQARRPPPVLTLSPVLDCGYCLIGGVKMTRFICKNVGFSVGRFCIMPKTSWPPLSFKAIATVGFVEQPPFGILPSVFELAPGHAILVEVLFSPKSLGKAEQTFIIMCDNCQIKELVTIGIGQLIALDLIYISGEKSQPDPGELTDLTAQHFIRFEPENLRSTARKQLIIRNATHVELAFYWQIMKPNLQPLMPGETFSMDSIKCYPDKETAFSIMPRKGVLSPHTDHEFILSFSPHELRDFHSVLQMVLEEVPEPVSSEAESLGHSSYSVDDVIVLEIEVKGSVEPFQVLLEPYALIIPGENYIGINVKKAFKMWNNSKSPIRYLWGKISDCHIIEVEPGTGVIEPSEVGDFELNFTGGVPGPTSQDLLCEIEDSPSPVVLHIEAVFKGPALIINVSALQFGLLRLGQKATNSIQIRNVSQLPATWRMKESPVSLQERPEDVSPFDIEPSSGQLHSLGECRVDITLEALHCQHLETVLELEVENGAWSYLPVYAEVQKPHVYLQSSQVEVRNLYLGVPTKTTITLINGTLLPTQFHWGKLLGHQAEFCMVTVSPKHGLLGPSEECQLKLELTAHTQEELTHLALPCHVSGMKKPLVLGISGKPQGLQVAITISKESSDCSTEQWPGHPKELRLDFGSAVPLRTRVTRQLILTNRSPIRTRFSLKFEYFGSPQNSLSKKTSLPNMPPALLKTVRMQEHLAKREQLDFMESMLSHGKGAAFFPHFSQGMLGPYQQLCIDITGCANMWGEYWDNLICTVGDLLPEVIPVHMAAVGCPISSLRTTSYTIDQAQKEPAMRFGTQVSGGDTVTRTLRLNNSSPCDIRLDWETYVPEDKEDRLVELLVFYGPPFPLRDQAGNELVCPDTPEGGCLLWSPGPSSSSEFSHETDSSVEGSSSASNRVAQKLISVILQAHEGVPSGHLYCISPKQVVVPAGGSSTIYISFTPMVLSPEILHKVECTGYALGFMSLDSKVEREIPRKRHRLQDFAVGPLKLDLHSYVRPAQLSVELDYGGSMEFQCQASDLIPEQPCSGVLSELVTTHHLKLTNTTEIPHYFRLMVSRPFSVSQDGASQDHRAPGPGQKQECEEETASADKQLVLQAQENMLVNVSFSLSLELLSYQKLPADQTLPGVDIQQSASGEREMVFTQNLLLEYTNQTTQVVPLRAVVAVPELQLSTSWVDFGTCFVSQQRVREVYLMNLSGCRSYWTMLMGVVSCTSPRWWWKVCSVRSPAPCGSGAKAPMMRDTCCLTSPEAPPQPSAPGPSWRKNIAQGLGAALQHKDTDLGTWGPLGSSWNGRTPFHNGLSLGPHDLSSELT

SEQ ID NO: 860737 - protein, 2170 aa, Homo sapiens
VSGVSVAMETRSSKTRRSLASRTNECQGTMWAPTSPPAGSSSPSQPTWKSSLYSSLAYSEAFHYSFAARPRRLTQLALAQRPEPQLLRLRPSSLRTQDISHLLTGVFRNLYSAEVIGDEVSASLIKARGSENERHEEFVDQLQQIRELYKQRLDEFEMLERHITQAQARAIAENERVMSQAGVQDLESLVRLPPVKSVSRWCIDSELLRKHHLISPEDYYTDTVPFHSAPKGISLPGCSKLTFSCEKRSVQKKELNKKLEDSCRKKLAEFEDELDHTVDSLTWNLTPKAKERTREPLKKASQPRNKNWMNHLRVPQRELDRLLLARMESRNHFLKNPRFFPPNTRYGGKSLVFPPKKPAPIGEFQSTEPEQSCADTPVFLAKPPIGFFTDYEIGPVYEMVIALQNTTTTSRYLRVLPPSTPYFALGLGMFPGKGGMVAPGMTCQYIVQFFPDCLGDFDDFILVETQSAHTLLIPLQARRPPPVLTLSPVLDCGYCLIGGVKMTRFICKNVGFSVGRFCIMPKTSWPPLSFKAIATVGFVEQPPFGILPSVFELAPGHAILVEVLFSPKSLGKAEQTFIIMCDNCQIKELVTIGIGQLIALDLIYISGEKSQPDPGELTDLTAQHFIRFEPENLRSTARKQLIIRNATHVELAFYWQIMKPNLQPLMPGETFSMDSIKCYPDKETAFSIMPRKGVLSPHTDHEFILSFSPHEVQMVSSQYATHGWIMYLDPPPVFLNHTEATAGPTEVLSCPGQHLAELGWSTHLVCRVKQLILSGPDPRLTPSAARPLAGFLRSGCLPHVYYGKKHYHPHPYHSIPRESEVQGPEGQVSTALAPAWREALWATVGKKGIRAGHEKDAPGAIVSGFGAEMSDPASGPSIQLPRCLSWEGVVLLDTLRGFVSIRKAFASCTQAQLRQAPESWLMFWQQTSLFLRREEGGSREATLGFQKVLLMARLRGGRIPAMPQPSPGQPAGTQWCFQGTVFALQLRDFHSVLQMVLEEVPEPVSSEAESLGHSSYSVDDVIVLEIEVKGSVEPFQVLLEPYALIIPGENYIGINVKKAFKMWNNSKSPIRYLWGKISDCHIIEVEPGTGVIEPSEVGDFELNFTGGVPGPTSQDLLCEIEDSPSPVVLHIEAVFKGPALIINVSALQFGLLRLGQKATNSIQIRNVSQLPATWRMKESPVSLQERPEDVSPFDIEPSSGQLHSLGECRVDITLEALHCQHLETVLELEVENGAWSYLPVYAEVQKPHVYLQSSQVEVRNLYLGVPTKTTITLINGTLLPTQFHWGKLLGHQAEFCMVTVSPKHGLLGPSEECQLKLELTAHTQEELTHLALPCHVSGMKKPLVLGISGKPQGLQVAITISKESSDCSTEQWPGHPKELRLDFGSAVPLRTRVTRQLILTNRSPIRTRFSLKFEYFGSPQNSLSKKTSLPNMPPALLKTVRMQEHLAKREQLDFMESMLSHGKGAAFFPHFSQGMLGPYQQLCIDITGCANMWGEYWDNLICTVGDLLPEVIPVHMAAVGCPISSLRTTSYTIDQAQKEPAMRFGTQVSGGDTVTRTLRLNNSSPCDIRLDWETYVPEDKEDRLVELLVFYGPPFPLRDQAGNELVCPDTPEGGCLLWSPGPSSSSEFSHETDSSVEGSSSASNRVAQKLISVILQAHEGVPSGHLYCISPKQVVVPAGGSSTIYISFTPMVLSPEILHKVECTGYALGFMSLDSKVSSSGLGWGPQPLLPPGYHAAYSAQGSAVIRLGLSEVEREIPRKRHRLQDFAVGPLKLDLHSYVRPAQLSQLGCPISFHPHGVHPHQALVEPGRVLRAKGRAWVEKSAEEPRERLARGWMSRVGAARRPQAPGLPQQCLLLGRLSVELDYGGSMEFQCQASDLIPEQPCSGVLSELVTTHHLKLTNTTEIPHYFRLMVSRPFSVSQDGASQDHRAPGPGQKQECEEETASADKQLVLQAQENMLVNVSFSLSLELLSYQKLPADQTLPGVDIQQSASGEREMVFTQNLLLEYTNQTTQVVPLRAVVAVPELQLSTSWVDFGTCFVSQQRVREVYLMNLSGCRSYWTMLMGVVSCTSPRWWWKVCSVRSPAPCGSGAKAPMMRDTCCLTSPEAPPQPSAPGPSWRKNIAQGLGAALQHKDTDLGTWGPLGSSWNGRTPFHNGLSLGPHDLSSELT

SEQ ID NO: 860738 - protein, 43 aa, Homo sapiens
MGWELSALAGQWAWDSAKAAVSMPGGPCWGQQYHLHLLHPYGA

SEQ ID NO: 860739 - protein, 1637 aa, Homo sapiens
MAGVGPGGYAAEFVPPPECPVFEPSWEEFTDPLSFIGRIRPLAEKTGICKIRPPKDWQPPFACEVKSFRFTPRVQRLNELEAMTRVRLDFLDQLAKFWELQGSTLKIPVVERKILDLYALSKIVASKGGFEMVTKEKKWSKVGSRLGYLPGKGTGSLLKSHYERILYPYELFQSGVSLMGVQMPNLDLKEKVEPEVLSTDTQTSPEPGTRMNILPKRTRRVKTQSESGDVSRNTELKKLQIFGAGPKVVGLAMGTKDKEDEVTRRRKVTNRSDAFNMQMRQRKGTLSVNFVDLYVCMFCGRGNNEDKLLLCDGCDDSYHTFCLIPPLPDVPKGDWRCPKCVAEECSKPREAFGFEQAVREYTLQSFGEMADNFKSDYFNMPVHMVPTELVEKEFWRLVSSIEEDVIVEYGADISSKDFGSGFPVKDGRRKILPEEEEYALSGWNLNNMPVLEQSVLAHINVDISGMKVPWLYVGMCFSSFCWHIEDHWSYSINYLHWGEPKTWYGVPSHAAEQLEEVMRELAPELFESQPDLLHQLVTIMNPNVLMEHGVPVYRTNQCAGEFVVTFPRAYHSGFNQGYNFAEAVNFCTADWLPIGRQCVNHYRRLRRHCVFSHEELIFKMAADPECLDVGLAAMVCKELTLMTEEETRLRESVVQMGVLMSEEEVFELVPDDERQCSACRTTCFLSALTCSCNPERLVCLYHPTDLCPCPMQKKCLRYRYPLEDLPSLLYGVKVRAQSYDTWVSRVTEALSANFNHKKDLIELRVMLEDAEDRKYPENDLFRKLRDAVKEAETCASVAQLLLSKKQKHRQSPDSGRTRTKLTVEELKAFVQQLFSLPCVISQARQVKNLLDDVEEFHERAQEAMMDETPDSSKLQMLIDMGSSLYVELPELPRLKQELQQARWLDEVRLTLSDPQQVTLDVMKKLIDSGVGLAPHHAVEKAMAELQELLTVSERWEEKAKVCLQARPRHSVASLESIVNEAKNIPAFLPNVLSLKEALQKAREWTAKVEAIQSGSNYAYLEQLESLSAKGRPIPVRLEALPQVESQVAAARAWRERTGRTFLKKNSSHTLLQVLSPRTDIGVYGSGKNRRKKVKELIEKEKEKDLDLEPLSDLEEGLEETRDTAMVVAVFKEREQKEIEAMHSLRAANLAKMTMVDRIEEVKFCICRKTASGFMLQCELCKDWFHNSCVPLPKSSSQKKGSSWQAKEVKFLCPLCMRSRRPRLETILSLLVSLQKLPVRLPEGEALQCLTERAMSWQDRARQALATDELSSALAKLSVLSQRMVEQAAREKTEKIISAELQKAAANPDLQGHLPSFQQSAFNRVVSSVSSSPRQTMDYDDEETDSDEDIRETYGYDMKDTASVKSSSSLEPNLFCDEEIPIKSEEVVTHMWTAPSFCAEHAYSSASKSCSQGSSSTPRKQPRKSPLVPRSLEPPVLELSPGAKAQLEELMMVGDLLEVSLDETQHIWRILQATHPPSEDRFLHIMEDDSMEEKPLKVKGKDSSEKKRKRKLEKVEQLFGEGKQKSKELKKMDKPRKKKLKLGADKSKELNKLAKKLAKEEERKKKKEKAAAAKVELVKESTEKKREKKVLDIPSKYDWSGAEESDDENAVCAAQNCQRPCKDKGVVFVTEEEKNKKY

SEQ ID NO: 860740 - protein, 1629 aa, Homo sapiens
MAGVGPGGYAAEFVPPPECPVFEPSWEEFTDPLSFIGRIRPLAEKTGICKIRPPKDWQPPFACEVKSFRFTPRVQRLNELEAMTRVRLDFLDQLAKFWELQGSTLKIPVVERKILDLYALSKIVASKGGFEMVTKEKKWSKVGSRLGYLPGKGTGSLLKSHYERILYPYELFQSGVSLMGVQMPNLDLKEKVEPEVLSTDTQTSPEPGTRMNILPKRTRRVKTQSESGDVSRNTELKKLQIFGAGPKVVGLAMGTKDKEDEVTRRRKVTNRSDAFNMQMRQRKGTLSVNFVDLYVCMFCGRGNNEDKLLLCDGCDDSYHTFCLIPPLPDVPKGDWRCPKCVAEECSKPREAFGFEQAVREYTLQSFGEMADNFKSDYFNMPVHMVPTELVEKEFWRLVSSIEEDVIVEYGADISSKDFGSGFPVKDGRRKILPEEEEYALSGWNLNNMPVLEQSVLAHINVDISGMKVPWLYVGMCFSSFCWHIEDHWSYSINYLHWGEPKTWYGVPSHAAEQLEEVMRELAPELFESQPDLLHQLVTIMNPNVLMEHGVPVYRTNQCAGEFVVTFPRAYHSGFNQGYNFAEAVNFCTADWLPIGRQCVNHYRRLRRHCVFSHEELIFKMAADPECLDVGLAAMVCKELTLMTEEETRLRESVVQMGVLMSEEEVFELVPDDERQCSACRTTCFLSALTCSCNPERLVCLYHPTDLCPCPMQKKCLRYRYPLEDLPSLLYGVKVRAQSYDTWVSRVTEALSANFNHKKDLIELRVMLEDAEDRKYPENDLFRKLRDAVKEAETCASVAQLLLSKKQKHRQSPDSGRTRTKLTVEELKAFVQQLFSLPCVISQARQVKNLLDDVEEFHERAQEAMMDETPDSSKLQMLIDMGSSLYVELPELPRLKQELQQARWLDEVRLTLSDPQQVTLDVMKKLIDSGVGLAPHHAVEKAMAELQELLTVSERWEEKAKVCLQARPRHSVASLESIVNEAKNIPAFLPNVLSLKEALQKAREWTAKVEAIQSGSNYAYLEQLESLSAKGRPIPVRLEALPQVESQVAAARAWRERTGRTFLKKNSSHTLLQVLSPRTDIGVYGSGKNRRKKVKELIEKEKEKDLDLEPLSDLEEGLEETRDTAMVVAVFKEREQKEIEAMHSLRAANLAKMTMVDRIEEVKFCICRKTASGFMLQCELCKDWFHNSCVPLPKSSSQKKGSSWQAKEVKFLCPLCMRSRRPRLETILSLLVSLQKLPVRLPEGEALQCLTERAMSWQDRARQALATDELSSALAKLSVLSQRMVEQAAREKTEKIISAELQKAAANPDLQGHLPSFQQSAFNRVVSSVSSSPRQTMDYDDEETDSDEDIRETYGYDMKDTASVKSSSSLEPNLFCDEEIPIKSEEVVTHMWTAPSFCAEHAYSSASKSCSQGSSSTPRKQPRKSPLVPRSLEPPVLELSPGAKAQLEELMMVGDLLEVSLDETQHIWRILQATHPPSEDRFLHIMEDDSMEEKPLKVKGKDSSEKKRKRKLEKVEQLFGEGKQKSKELKKMDKPRKKKLKLGADKSKELNKLAKKLAKEEERKKKKEKAAAAKVELVKESTEKKREKKVLDIPSKYDWSGAEESDDENAVCAAQNCQRPCKDKVSSNCL

SEQ ID NO: 860741 - protein, 1412 aa, Homo sapiens
MAGVGPGGYAAEFVPPPECPVFEPSWEEFTDPLSFIGRIRPLAEKTGICKIRPPKDWQPPFACEVKSFRFTPRVQRLNELEAMTRVRLDFLDQLAKFWELQGSTLKIPVVERKILDLYALSKIVASKGGFEMVTKEKKWSKVGSRLGYLPGKGTGSLLKSHYERILYPYELFQSGVSLMGVQMPNLDLKEKVEPEVLSTDTQTSPEPGTRMNILPKRTRRVKTQSESGDVSRNTELKKLQIFGAGPKVVGLAMGTKDKEDEVTRRRKVTNRSDAFNMQMRQRKGTLSVNFVDLYVCMFCGRGNNEDKLLLCDGCDDSYHTFCLIPPLPDVPKGDWRCPKCVAEECSKPREAFGFEQAVREYTLQSFGEMADNFKSDYFNMPVHMVPTELVEKEFWRLVSSIEEDVIVEYGADISSKDFGSGFPVKDGRRKILPEEEEYALSGWNLNNMPVLEQSVLAHINVDISGMKVPWLYVGMCFSSFCWHIEDHWSYSINYLHWGEPKTWYGVPSHAAEQLEEVMRELAPELFESQPDLLHQLVTIMNPNVLMEHGVPVYRTNQCAGEFVVTFPRAYHSGFNQGYNFAEAVNFCTADWLPIGRQCVNHYRRLRRHCVFSHEELIFKMAADPECLDVGLAAMVCKELTLMTEEETRLRESVVQMGVLMSEEEVFELVPDDERQCSACRTTCFLSALTCSCNPERLVCLYHPTDLCPCPMQKKCLRYRYPLEDLPSLLYGVKVRAQSYDTWVSRVTEALSANFNHKKDLIELRVMLEDAEDRKYPENDLFRKLRDAVKEAETCASVAQLLLSKKQKHRQSPDSGRTRTKLTVEELKAFVQQLFSLPCVISQARQVKNLLDDVEEFHERAQEAMMDETPDSSKLQMLIDMGSSLYVELPELPRLKQELQQARWLDEVRLTLSDPQQVTLDVMKKLIDSGVGLAPHHAVEKAMAELQELLTVSERWEEKAKVCLQARPRHSVASLESIVNEAKNIPAFLPNVLSLKEALQKAREWTAKVEAIQSGSNYAYLEQLESLSAKGRPIPVRLEALPQVESQVAAARAWRERTGRTFLKKNSSHTLLQVLSPRTDIGVYGSGKNRRKKVKELIEKEKEKDLDLEPLSDLEEGLEETRDTAMVVAVFKEREQKEIEAMHSLRAANLAKMTMVDRIEEVKFCICRKTASGFMLQCELCKDWFHNSCVPLPKSSSQKKGSSWQAKEVKFLCPLCMRSRRPRLETILSLLVSLQKLPVRLPEGEALQCLTERAMSWQDRARQALATDELSSALAKLSVLSQRMVEQAAREKTEKIISAELQKAAANPDLQGHLPSFQQSAFNRVVSSVSSSPRQTMDYDDEETDSDEDIRETYGYDMKDTASVKSSSSLEPNLFCDEEIPIKSEEVVTHMWTAPSFCAEHAYSSASKSCSQV

SEQ ID NO: 860742 - protein, 608 aa, Homo sapiens
MAGVGPGGYAAEFVPPPECPVFEPSWEEFTDPLSFIGRIRPLAEKTGICKIRPPKDWQPPFACEVKSFRFTPRVQRLNELEAMTRVRLDFLDQLAKFWELQGSTLKIPVVERKILDLYALSKIVASKGGFEMVTKEKKWSKVGSRLGYLPGKGTGSLLKSHYERILYPYELFQSGVSLMGVQMPNLDLKEKVEPEVLSTDTQTSPEPGTRMNILPKRTRRVKTQSESGDVSRNTELKKLQIFGAGPKVVGLAMGTKDKEDEVTRRRKVTNRSDAFNMQMRQRKGTLSVNFVDLYVCMFCGRGNNEDKLLLCDGCDDSYHTFCLIPPLPDVPKGDWRCPKCVAEECSKPREAFGFEQAVREYTLQSFGEMADNFKSDYFNMPVHMVPTELVEKEFWRLVSSIEEDVIVEYGADISSKDFGSGFPVKDGRRKILPEEEEYALSGWNLNNMPVLEQSVLAHINVDISGMKVPWLYVGMCFSSFCWHIEDHWSYSINYLHWGEPKTWYGVPSHAAEQLEEVMRELAPELFESQPDLLHQLVTIMNPNVLMEHGVPVSLLVSSFSCLFVCLFFLFSFFLKQGLALLPRLECSGTMIAHCSLSLLSSSSSPASA

SEQ ID NO: 860743 - protein, 1691 aa, Homo sapiens
MAGVGPGGYAAEFVPPPECPVFEPSWEEFTDPLSFIGRIRPLAEKTGICKIRPPKDWQPPFACEVKSFRFTPRVQRLNELEAMTRVRLDFLDQLAKFWELQGSTLKIPVVERKILDLYALSKIVASKGGFEMVTKEKKWSKVGSRLGYLPGKGTGSLLKSHYERILYPYELFQSGVSLMGVQMPNLDLKEKVEPEVLSTDTQTSPEPGTRMNILPKRTRRVKTQSESGDVSRNTELKKLQIFGAGPKVVGLAMGTKDKEDEVTRRRKVTNRSDAFNMQMRQRKGTLSVNFVDLYVCMFCGRGNNEDKLLLCDGCDDSYHTFCLIPPLPDVPKGDWRCPKCVAEECSKPREAFGFEQAVREYTLQSFGEMADNFKSDYFNMPVHMVPTELVEKEFWRLVSSIEEDVIVEYGADISSKDFGSGFPVKDGRRKILPEEEEYALSGWNLNNMPVLEQSVLAHINVDISGMKVPWLYVGMCFSSFCWHIEDHWSYSINYLHWGEPKTWYGVPSHAAEQLEEVMRELAPELFESQPDLLHQLVTIMNPNVLMEHGVPVYRTNQCAGEFVVTFPRAYHSGFNQGYNFAEAVNFCTADWLPIGRQCVNHYRRLRRHCVFSHEELIFKMAADPECLDVGLAAMVCKELTLMTEEETRLRESVVQMGVLMSEEEVFELVPDDERQCSACRTTCFLSALTCSCNPERLVCLYHPTDLCPCPMQKKCLRYRYPLEDLPSLLYGVKVRAQSYDTWVSRVTEALSANFNHKKDLIELRVMLEDAEDRKYPENDLFRKLRDAVKEAETCASVAQLLLSKKQKHRQSPDSGRTRTKLTVEELKAFVQQLFSLPCVISQARQVKNLLDDVEEFHERAQEAMMDETPDSSKLQMLIDMGSSLYVELPELPRLKQELQQARWLDEVRLTLSDPQQVTLDVMKKLIDSGVGLAPHHAVEKAMAELQELLTVSERWEEKAKVCLQARPRHSVASLESIVNEAKNIPAFLPNVLSLKEALQKAREWTAKVEAIQSGSNYAYLEQLESLSAKGRPIPVRLEALPQVESQVAAARAWRERTGRTFLKKNSSHTLLQVLSPRTDIGVYGSGKNRRKKVKELIEKEKEKDLDLEPLSDLEEGLEETRDTAMVVAVFKEREQKEIEAMHSLRAANLAKMTMVDRIEEVKFCICRKTASGFMLQCELCKDWFHNSCVPLPKSSSQKKGSSWQAKEVKFLCPLCMRSRRPRLETILSLLVSLQKLPVRLPEGEALQCLTERAMSWQDRARQALATDELSSALAKLSVLSQRMVEQAAREKTEKIISAELQKAAANPDLQGHLPSFQQSAFNRVVSSVSSSPRQTMDYDDEETDSDEDIRETYGYDMKDTASVKSSSSLEPNLFCDEEIPIKSEEVVTHMWTAPSFCAEHAYSSASKSCSQGSSSTPRKQPRKSPLVPRSLEPPVLELSPGAKAQLEELMMVGDLLEVSLDETQHIWRILQATHPPSEDRFLHIMEDDSMEEKPLKVKGKDSSEKKRKRKLEKVEQLFGEGKQKSKELKKMDKPRKKKLKLGADKSKELNKLAKKLAKEEERKKKKEKAAAAKVELVKESTEKKREKKVLDIPSKYDWSGAEESDDENAVCAAQNCQRPCKDKVDWVQCDGGCDEWFHQVCVGVSPEMAENEDYICINCAKKQGPVSPGPAPPPSFIMSYKLPMEDLKETS

SEQ ID NO: 860744 - protein, 809 aa, Homo sapiens
MAGVGPGGYAAEFVPPPECPVFEPSWEEFTDPLSFIGRIRPLAEKTGICKIRPPKDWQPPFACEVKSFRFTPRVQRLNELEAMTRVRLDFLDQLAKFWELQGSTLKIPVVERKILDLYALSKIVASKGGFEMVTKEKKWSKVGSRLGYLPGKGTGSLLKSHYERILYPYELFQSGVSLMGVQMPNLDLKEKVEPEVLSTDTQTSPEPGTRMNILPKRTRRVKTQSESGDVSRNTELKKLQIFGAGPKVVGLAMGTKDKEDEVTRRRKVTNRSDAFNMQMRQRKGTLSVNFVDLYVCMFCGRGNNEDKLLLCDGCDDSYHTFCLIPPLPDVPKGDWRCPKCVAEECSKPREAFGFEQAVREYTLQSFGEMADNFKSDYFNMPVHMVPTELVEKEFWRLVSSIEEDVIVEYGADISSKDFGSGFPVKDGRRKILPEEEEYALSGWNLNNMPVLEQSVLAHINVDISGMKVPWLYVGMCFSSFCWHIEDHWSYSINYLHWGEPKTWYGVPSHAAEQLEEVMRELAPELFESQPDLLHQLVTIMNPNVLMEHGVPVYRTNQCAGEFVVTFPRAYHSGFNQGYNFAEAVNFCTADWLPIGRQCVNHYRRLRRHCVFSHEELIFKMAADPECLDVGLAAMVCKELTLMTEEETRLRESVVQMGVLMSEEEVFELVPDDERQCSACRTTCFLSALTCSCNPERLVCLYHPTDLCPCPMQKKCLRYRYPLEDLPSLLYGVKVRAQSYDTWVSRVTEALSANFNHKKDLIELRVMLEDAEDRKYPENDLFRKLRDAVKEAETCASVAQLLLSKKQKHR

SEQ ID NO: 860745 - protein, 496 aa, Homo sapiens
MAGVGPGGYAAEFVPPPECPVFEPSWEEFTDPLSFIGRIRPLAEKTGICKIRPPKDWQPPFACEVKSFRFTPRVQRLNELEAMTRVRLDFLDQLAKFWELQGSTLKIPVVERKILDLYALSKIVASKGGFEMVTKEKKWSKVGSRLGYLPGKGTGSLLKSHYERILYPYELFQSGVSLMGVQMPNLDLKEKVEPEVLSTDTQTSPEPGTRMNILPKRTRRVKTQSESGDVSRNTELKKLQIFGAGPKVVGLAMGTKDKEDEVTRRRKVTNRSDAFNMQMRQRKGTLSVNFVDLYVCMFCGRGNNEDKLLLCDGCDDSYHTFCLIPPLPDVPKGDWRCPKCVAEECSKPREAFGFEQAVREYTLQSFGEMADNFKSDYFNMPVHMVPTELVEKEFWRLVSSIEEDVIVEYGADISSKDFGSGFPVKDGRRKILPEEEEYALSGWNLNNMPVLEQSVLAHINVDISGMKVPWLYVGMCFSSFCWHIEDHWSYSINYLH

SEQ ID NO: 860746 - protein, 343 aa, Homo sapiens
MAEQLSPGKAVDQVCTFLFKKPGRKGAAGRRKRPACDPEPGESGSSSDEGCTVVRPEKKRVTHNPMIQKTRDSGKQKAAYGDLSSEEEEENEPESLGVVYKSTRSAKPVGPEDMGATAVYELDTEKERDAQAIFERSQKIQEELRGKEDDKIYRGINNYQKYMKPKDTSMGNASSGMVRKGPIRAPEHLRATVRWDYQPDICKDYKETGFCGFGDSCKFLHDRSDYKHGWQIERELDEGRYGVYEDENYEVGSDDEEIPFKCFICRQSFQNPVVTKCRHYFCESCALQHFRTTPRCYVCDQQTNGVFNPAKELIAKLEKHRATGEGGASDLPEDPDEDAIPIT

SEQ ID NO: 860747 - protein, 328 aa, Homo sapiens
MAEQLSPGKAVDQVCTFLFKKPGRKGAAGRRKRPACDPEPGESGSSSDEGCTVVRPEKKRVTHNPMIQKTRDSGKQKAAYGDLSSEEEEENEPESLGVVYKSTRSAKPVGPEDMGATAVYELDTEKERDAQAIFERSQKIQEELRGKEDDKIYRGINNYQKYMKPKDTSMGNASSGMVRKGPIRAPEHLRATVRWDYQPDICKDYKETGFCGFGDSCKFLHDRSDYKHGWQIERELDEGRYGVYEDENYEVGSDDEEIPFKCFICRQSFQNPVVTKCRHYFCESCALQHFRTTPRCYVCDQQTNGVFNPAKELIAKLEKHRATGEHPQ

SEQ ID NO: 860748 - protein, 343 aa, Homo sapiens; identical to SEQ ID NO: 860746

SEQ ID NO: 860749 - protein, 169 aa, Homo sapiens
MAEQLSPGKAVDQVCTFLFKKPGRKGAAGRRKRPACDPEPGESGSSSDEGCTVVRPEKKRVTHNPMIQKTRDSGKQKAAYGDLSSEEEEENEPESLGVVYKSTRSAKPVGPEDMGATAVYELDTEKERDAQAIFERSQKIQAGLSSQNQQGFQAVYIIIHANTNVTEFT

SEQ ID NO: 860750 - protein, 106 aa, Homo sapiens
MSTNNMSDPRRPNKVLRYKPPPSECNPALDDPTPDYMNLLGMIFSMCGLMLKLKWCAWVAVYCSFISFANSRSSEDTKQMMSSFMLSISAVVMSYLQNPQPMTPPW

SEQ ID NO: 860751 - protein, 83 aa, Homo sapiens
DKSPAAMYRLRRALNDCWHDLSMCGLMLKLKWCAWVAVYCSFISFANSRSSEDTKQMMSSFMLSISAVVMSYLQNPQPMTPPW

SEQ ID NO: 860752 - protein, 76 aa, Homo sapiens
PREPAETDADNDCGMTACRLCELKWCAWVAVYCSFISFANSRSSEDTKQMMSSFMLSISAVVMSYLQNPQPMTPPW

SEQ ID NO: 860753 - protein, 106 aa, Homo sapiens; identical to SEQ ID NO: 860750

SEQ ID NO: 860754 - protein, 106 aa, Homo sapiens; identical to SEQ ID NO: 860750

SEQ ID NO: 860755 - protein, 106 aa, Homo sapiens; identical to SEQ ID NO: 860750

SEQ ID NO: 860756 - protein, 41 aa, Homo sapiens
LPTHLPFPSLKWCAWVAVYCSFISFANSRSSEDTKQMMSSF

SEQ ID NO: 860757 - protein, 106 aa, Homo sapiens; identical to SEQ ID NO: 860750

SEQ ID NO: 860758 - protein, 98 aa, Homo sapiens
EAGGGPGMKTKALTIKSYGSQLPPARSPASSTVSAAALEAAALAQGKPCSQDSFLAALNRSVRKIPRLRNPRLGVTLLLFFLTYFLFITSGFIILAFR

SEQ ID NO: 860759 - protein, 106 aa, Homo sapiens; identical to SEQ ID NO: 860750

SEQ ID NO: 860760 - protein, 106 aa, Homo sapiens; identical to SEQ ID NO: 860750

SEQ ID NO: 860761 - protein, 104 aa, Homo sapiens
MSDPRRPNKVLRYKPPPSECNPALDDPTPDYMNLLGMIFSMCGLMLKLKWCAWVAVYCSFISFANSRSSEDTKQMMSSFMCDLPYRTSDSLSKGWGDPSLAILD

SEQ ID NO: 860762 - protein, 597 aa, Homo sapiens
MQWPPPWRRSPLVSATPPPGPTRGLLCPRRVSEAGDSSTEGARTGHRHYVTPAESAMEGRSQPLPSLRPASPTNAPAHGRGSDCTAKEPPLANVCRQNYGAAQDPVEPAGRRSASHVTGSSLGKAEVACGRRWRWAELLADTSWSPAGRATEMKVKMLSRNPDNYVRETKLDLQRVPRNYDPALHPFEVPREYIRALNATKLERVFAKPFLASLDGHRDGVNCLAKHPEKLATVLSGACDGEVRIWNLTQRNCIRTIQAHEGFVRGICTRFCGTSFFTVGDDKTVKQWKMDGPGYGDEEEPLHTILGKTVYTGIDHHWKEAVFATCGQQVDIWDEQRTNPICSMTWGFDSISSVKFNPIETFLLGSCASDRNIVLYDMRQATPLKKVILDMRTNTICWNPMEAFIFTAANEDYNLYTFDMRALDTPVMVHMDHVSAVLDVDYSPTGKEFVSASFDKSIRIFPVDKSRSREVYHTKRMQHVICVKWTSDSKYIMCGSDEMNIRLWKANASEKLGVLTSREKAAKDYNQKLKEKFQHYPHIKRIARHRHLPKSIYSQIQEQRIMKEARRRKEVNRIKHSKPGSVPLVSEKKKHVVAVVK

SEQ ID NO: 860763 - protein, 337 aa, Homo sapiens
MQWPPPWRRSPLVSATPPPGPTRGLLCPRRVSEAGDSSTEGARTGHRHYVTPAESAMEGRSQPLPSLRPASPTNAPAHGRGSDCTAKEPPLANVCRQNYGAAQDPVEPAGRRSASHVTGSSLGKAEVACGRRWRWAELLADTSWSPAGRATEMKVKMLSRNPDNYVRETKLDLQRVPRNYDPALHPFEVPREYIRALNATKLERVFAKPFLASLDGHRDGVNCLAKHPEKLATVLSGACDGEVGDDKTVKQWKMDGPGYGDEEEPLHTILGKTVYTGIDHHWKEAVFATCGQQVDIWDEQRTNPICSMTWGFDSISSVKFNPIEVMFFFKYVLLIMA

SEQ ID NO: 860764 - protein, 285 aa, Homo sapiens
KDFNLELAIKTRIISDGLKYSLATGNWGDQKKAHQARAGVSQVLNRLTFASTLSHLRRLNSPIGRDGKLTPLKKVILDMRTNTICWNPMEAFIFTAANEDYNLYTFDMRALDTPVMVHMDHVSAVLDVDYSPTGKEFVSASFDKSIRIFPVDKSRSREVYHTKRMQHVICVKWTSDSKYIMCGSDEMNIRLWKANASEKLGVLTSREKAAKDYNQKLKEKFQHYPHIKRIARHRHLPKSIYSQIQEQRIMKEARRRKEVNRIKHSKPGSVPLVSEKKKHVVAVVK

SEQ ID NO: 860765 - protein, 337 aa, Homo sapiens; identical to SEQ ID NO: 860763

SEQ ID NO: 860766 - protein, 121 aa, Homo sapiens
MQHVICVKWTSDSKYIMCGSDEMNIRLWKANASEKLGVLTSREKAAKDYNQKLKEKFQHYPHIKRIARHRHLPKSIYSQIQEQRIMKEARRRKEVNRIKHSKPGSVPLVSEKKKHVVAVVK

SEQ ID NO: 860767 - protein, 373 aa, Homo sapiens
MQWPPPWRRSPLVSATPPPGPTRGLLCPRRVSEAGDSSTEGARTGHRHYVTPAESAMEGRSQPLPSLRPASPTNAPAHGRGSDCTAKEPPLANVCRQNYGAAQDPVEPAGRRSASHVTGSSLGKAEVACGRRWRWAELLADTSWSPAGRATEMKVKMLSRNPDNYVRETKLDLQRVPRNYDPALHPFEVPREYIRALNATKLERVFAKPFLASLDGHRDGVNCLAKHPEKLATVLSGACDGEVRIWNLTQRNCIRTIQAHEGFVRGICTRFCGTSFFTVGDDKTVKQWKMDGPGYGDEEEPLHTILGKTVYTGIDHHWKEAVFATCGQQVDIWDEQRTNPICSMTWGFDSISSVKFNPIEVMFFFKYVLLIMA

SEQ ID NO: 860768 - protein, 337 aa, Homo sapiens; identical to SEQ ID NO: 860763

SEQ ID NO: 860769 - protein, 337 aa, Homo sapiens; identical to SEQ ID NO: 860763

SEQ ID NO: 860770 - protein, 742 aa, Homo sapiens
LKKQFACDVDKRGPRWVRNPGRPPRFGPPALVPWAGGAGKAGAWRALRGPEAGAGGGGGLGAAAMPTWGARPASPDRFAVSAEAENKVREQQPHVERIFSVGVSVLPKDCPDNPHIWLQLEGPKENASRAKEYLKGLCSPELQDEIHYPPKLHCIFLGAQGFFLDCLAWSTSAHLVPRAPGSLMISGLTEAFVMAQSRVEELAERLSWDFTPGPSSGASQCTGVLRDFSALLQSPGDAHREALLQLPLAVQEELLSLVQEASSGQGPGALASWEGRSSALLGAQCQGVRAPPSDGRESLDTGSMGPGDCRGARGDTYAVEKEGGKQGGPREMDLGWKELPGEEAWEREVALRPQSVGGGARESAPLKGKALGKEEIALGGGGFCVHREPPGAHGSCHRAAQSRGASLLQRLHNGNASPPRVPSPPPAPEPPWHCGDRGDCGDRGDVGDRGDKQQGMARGRGPQWKRGARGGNLVTGTQRFKEALQDPFTLCLANVPGQPDLRHIVIDGSNVAMVHGLQHYFSSRGIAIAVQYFWDRGHRDITVFVPQWRFSKDAKVRESHFLQKLYSLSLLSLTPSRVMDGKRISSYDDRFMVKLAEETDGIIVSNDQFRDLAEESEKWMAIIRERLLPFTFVGNLFMVPDDPLGRNGPTLDEFLKKPARTQGSSKAQHPSRGFAEHGKQQQGREEEKGSGGIRKTRETERLRRQLLEVFWGQDHKVDFILQREPYCRDINQLSEALLSLNF

SEQ ID NO: 860771 - protein, 700 aa, Homo sapiens
TQETVCVRCGQERSPLGLGAAAMPTWGARPASPDRFAVSAEAENKVREQQPHVERIFSVGVSVLPKDCPDNPHIWLQLEGPKENASRAKEYLKGLCSPELQDEIHYPPKLHCIFLGAQGFFLDCLAWSTSAHLVPRAPGSLMISGLTEAFVMAQSRVEELAERLSWDFTPGPSSGASQCTGVLRDFSALLQSPGDAHREALLQLPLAVQEELLSLVQEASSGQGPGALASWEGRSSALLGAQCQGVRAPPSDGRESLDTGSMGPGDCRGARGDTYAVEKEGGKQGGPREMDLGWKELPGEEAWEREVALRPQSVGGGARESAPLKGKALGKEEIALGGGGFCVHREPPGAHGSCHRAAQSRGASLLQRLHNGNASPPRVPSPPPAPEPPWHCGDRGDCGDRGDVGDRGDKQQGMARGRGPQWKRGARGGNLVTGTQRFKEALQDPFTLCLANVPGQPDLRHIVIDGSNVAMVHGLQHYFSSRGIAIAVQYFWDRGHRDITVFVPQWRFSKDAKVRESHFLQKLYSLSLLSLTPSRVMDGKRISSYDDRFMVKLAEETDGIIVSNDQFRDLAEESEKWMAIIRERLLPFTFVGNLFMVPDDPLGRNGPTLDEFLKKPARTQGSSKAQHPSRGFAEHGKQQQGREEEKGSGGIRKTRETERLRRQLLEVFWGQDHKVDFILQREPYCRDINQLSEALLSLNF

SEQ ID NO: 860772 - protein, 742 aa, Homo sapiens; identical to SEQ ID NO: 860770

SEQ ID NO: 860773 - protein, 133 aa, Homo sapiens
SDRYEEELRSAWQYQRSLLPFTFVGNLFMVPDDPLGRNGPTLDEFLKKPARTQGSSKAQHPSRGFAEHGKQQQGREEEKGSGGIRKTRETERLRRQLLEVFWGQDHKVDFILQREPYCRDINQLSEALLSLNF

SEQ ID NO: 860774 - protein, 742 aa, Homo sapiens; identical to SEQ ID NO: 860770

SEQ ID NO: 860775 - protein, 724 aa, Homo sapiens
GEKGGMKPPAHWTGGLQPELQGSPAGWDSTEGWTWGDGEHGLGAAAMPTWGARPASPDRFAVSAEAENKVREQQPHVERIFSVGVSVLPKDCPDNPHIWLQLEGPKENASRAKEYLKGLCSPELQDEIHYPPKLHCIFLGAQGFFLDCLAWSTSAHLVPRAPGSLMISGLTEAFVMAQSRVEELAERLSWDFTPGPSSGASQCTGVLRDFSALLQSPGDAHREALLQLPLAVQEELLSLVQEASSGQGPGALASWEGRSSALLGAQCQGVRAPPSDGRESLDTGSMGPGDCRGARGDTYAVEKEGGKQGGPREMDLGWKELPGEEAWEREVALRPQSVGGGARESAPLKGKALGKEEIALGGGGFCVHREPPGAHGSCHRAAQSRGASLLQRLHNGNASPPRVPSPPPAPEPPWHCGDRGDCGDRGDVGDRGDKQQGMARGRGPQWKRGARGGNLVTGTQRFKEALQDPFTLCLANVPGQPDLRHIVIDGSNVAMVHGLQHYFSSRGIAIAVQYFWDRGHRDITVFVPQWRFSKDAKVRESHFLQKLYSLSLLSLTPSRVMDGKRISSYDDRFMVKLAEETDGIIVSNDQFRDLAEESEKWMAIIRERLLPFTFVGNLFMVPDDPLGRNGPTLDEFLKKPARTQGSSKAQHPSRGFAEHGKQQQGREEEKGSGGIRKTRETERLRRQLLEVFWGQDHKVDFILQREPYCRDINQLSEALLSLNF

SEQ ID NO: 860776 - protein, 742 aa, Homo sapiens; identical to SEQ ID NO: 860770

SEQ ID NO: 860777 - protein, 742 aa, Homo sapiens; identical to SEQ ID NO: 860770

SEQ ID NO: 860778 - protein, 599 aa, Homo sapiens
LKKQFACDVDKRGPRWVRNPGRPPRFGPPALVPWAGGAGKAGAWRALRGPEAGAGGGGGLGAAAMPTWGARPASPDRFAVSAEAENKVREQQPHVERIFSVGVSVLPKDCPDNPHIWLQLEGPKENASRAKEYLKGLCSPELQDEIHYPPKLHCIFLGAQGFFLDCLAWSTSAHLVPRAPGSLMISGLTEAFVMAQSRVEELAERLSWDFTPGPSSGASQCTGVLRDFSALLQSPGDAHREALLQLPLAVQEELLSLVQEASSGQGPGALASWEGRSSALLGAQCQGVRAPPSDGRESLDTGSMGPGDCRGARGDTYAVEKEGGKQGGPREMDLGWKELPGEEAWEREVALRPQSVGGGARESAPLKGKALGKEEIALGGGGFCVHREPPGAHGSCHRAAQSRGASLLQRLHNGNASPPRVPSPPPAPEPPWHCGDRGDCGDRGDVGDRGDKQQGMARGRGPQWKRGARGGNLVTGTQRFKEALQDPFTLCLANVPGQPDLRHIVIDGSNVAMVHGLQHYFSSRGIAIAVQYFWDRGHRDITVFVPQWRFSKDAKVRESHFLQKLYSLSLLSLTPSRVMDGKRISSYDDRYLLLSWPQA

SEQ ID NO: 860779 - protein, 2517 aa, Homo sapiens
MKEICRICARELCGNQRRWIFHTASKLNLQVLLSHVLGKDVPRDGKAEFACSKCAFMLDRIYRFDTVIARIEALSIERLQKLLLEKDRLKFCIASMYRKNNDDSGAEIKAGNGTVDMSVLPDARYSALLQEDFAYSGFECWVENEDQIQEPHSCHGSEGPGNRPRRCRGCAALRVADSDYEAICKVPRKVARSISCGPSSRWSTSICTEEPALSEVGPPDLASTKVPPDGESMEEETPGSSVESLDASVQASPPQQKDEETERSAKELGKCDCCSDDQAPQHGCNHKLELALSMIKGLDYKPIQSPRGSRLPIPVKSSLPGAKPGPSMTDGVSSGFLNRSLKPLYKTPVSYPLELSDLQELWDDLCEDYLPLRVQPMTEELLKQQKLNSHETTITQQSVSDSHLAELQEKIQQTEATNKILQEKLNEMSYELKCAQESSQKQDGTIQNLKETLKSRERETEELYQVIEGQNDTMAKLREMLHQSQLGQLHSSEGTSPAQQQVALLDLQSALFCSQLEIQKLQRVVRQKERQLADAKQCVQFVEAAAHESEQQKEASWKHNQELRKALQQLQEELQNKSQQLRAWEAEKYNEIRTQEQNIQHLNHSLSHKEQLLQEFRELLQYRDNSDKTLEANEMLLEKLRQRIHDKAVALERAIDEKFSALEEKEKELRQLRLAVRERDHDLERLRDVLSSNEATMQSMESLLRAKGLEVEQLSTTCQNLQWLKEEMETKFSRWQKEQESIIQQLQTSLHDRNKEVEDLSATLLCKLGPGQSEIAEELCQRLQRKERMLQDLLSDRNKQVLEHEMEIQGLLQSVSTREQESQAAAEKLVQALMERNSELQALRQYLGGRDSLMSQAPISNQQAEVTPTGRLGKQTDQGSMQIPSRDDSTSLTAKEDVSIPRSTLGDLDTVAGLEKELSNAKEELELMAKKERESQMELSALQSMMAVQEEELQVQAADMESLTRNIQIKEDLIKDLQMQLVDPEDIPAMERLTQEVLLLREKVASVESQGQEISGNRRQQLLLMLEGLVDERSRLNEALQAERQLYSSLVKFHAHPESSERDRTLQVELEGAQVLRSRLEEVLGRSLERLNRLETLAAIGGAAAGDDTEDTSTEFTDSIEEEAAHHSHQQLVKVALEKSLATVETQNPSFSPPSPMGGDSNRCLQEEMLHLRAEFHQHLEEKRKAEEELKELKAQIEEAGFSSVSHIRNTMLSLCLENAELKEQMGEAMSDGWEIEEDKEKGEVMVETVVTKEGLSESSLQAEFRKLQGKLKNAHNIINLLKEQLVLSSKEGNSKLTPELLVHLTSTIERINTELVGSPGKHQHQEEGNVTVRPFPRPQSLDLGATFTVDAHQLDNQSQPRDPGPQSAFSLPGSTQHLRSQLSQCKQRYQDLQEKLLLSEATVFAQANELEKYRVMLTGESLVKQDSKQIQVDLQDLGYETCGRSENEAEREETTSPECEEHNSLKEMVLMEGLCSEQGRRGSTLASSSERKPLENQLGKQEEFRVYGKSENILVLRKDIKDLKAQLQNANKVIQNLKSRVRSLSVTSDYSSSLERPRKLRAVGTLEGSSPHSVPDEDEGWLSDGTGAFYSPGLQAKKDLESLIQRVSQLEAQLPKNGLEEKLAEELRSASWPGKYDSLIQDQARELSYLRQKIREGRGICYLITRHAKDTVKSFEDLLRSNDIDYYLGQSFREQLAQGSQLTERLTSKLSTKDHKSEKDQAGLEPLALRLSRELQEKEKVIEVLQAKLDARSLTPSSSHALSDSHRSPSSTSFLSDELEACSDMDIVSEYTHYEEKKASPSHSDSIHHSSHSAVLSSKPSSTSASQGAKAESNSNPISLPTPQNTPKEANQAHSGFHFHSIPKLASLPQAPLPSAPSSFLPFSPTGPLLLGCCETPVVSLAEAQQELQMLQKQLGESASTVPPASTATLLSNDLEADSSYYLNSAQPHSPPRGTIELGRILEPGYLGSSGKWDVMRPQKGSVSGDLSSGSSVYQLNSKPTGADLLEEHLGEIRNLRQRLEESICINDRLREQLEHRLTSTARGRGSTSNFYSQGLESIPQLCNENRVLREDNRRLQAQLSHVSREHSQETESLREALLSSRSHLQELEKELEHQKVERQQLLEDLREKQQEVLHFREERLSLQENDSSGPCLSLVRLQHKLVLLQQQCEEKQQLFESLQSELQIYEALYGNSKKGLKAYSLDACHQIPLSSDLSHLVAEVRALRGQLEQSIQGNNCLRLQLQQQLESGAGKASLSPSSINQNFPASTDPGNKQLLLQDSAVSPPVRDVGMNSPALVFPSSASSTPGSETPIINRANGLGLDTSPVMKTPPKLEGDATDGSFANKHGRHVIGHIDDYSALRQQIAEGKLLVKKIVSLVRSACSFPGLEAQGTEVLGSKGIHELRSSTSALHHALEESASLLTMFWRAALPSTHIPVLPGKVGESTERELLELRTKVSKQERLLQSTTEHLKNANQQKESMEQFIVSQLTRTHDVLKKARTNLEVKSLRALPCTPAL

SEQ ID NO: 860780 - protein, 2141 aa, Homo sapiens
MTEELLKQQKLNSHETTITQQSVSDSHLAELQEKIQQTEATNKILQEKLNEMSYELKCAQESSQKQDGTIQNLKETLKSRERETEELYQVIEGQNDTMAKLREMLHQSQLGQLHSSEGTSPAQQQVALLDLQSALFCSQLEIQKLQRVVRQKERQLADAKQCVQFVEAAAHESEQQKEASWKHNQELRKALQQLQEELQNKSQQLRAWEAEKYNEIRTQEQNIQHLNHSLSHKEQLLQEFRELLQYRDNSDKTLEANEMLLEKLRQRIHDKAVALERAIDEKFSALEEKEKELRQLRLAVRERDHDLERLRDVLSSNEATMQSMESLLRAKGLEVEQLSTTCQNLQWLKEEMETKFSRWQKEQESIIQQLQTSLHDRNKEVEDLSATLLCKLGPGQSEIAEELCQRLQRKERMLQDLLSDRNKQVLEHEMEIQGLLQSVSTREQESQAAAEKLVQALMERNSELQALRQYLGGRDSLMSQAPISNQQAEVTPTGRLGKQTDQGSMQIPSRDDSTSLTAKEDVSIPRSTLGDLDTVAGLEKELSNAKEELELMAKKERESQMELSALQSMMAVQEEELQVQAADMESLTRNIQIKEDLIKDLQMQLVDPEDIPAMERLTQEVLLLREKVASVESQGQEISGNRRQQLLLMLEGLVDERSRLNEALQAERQLYSSLVKFHAHPESSERDRTLQVELEGAQVLRSRLEEVLGRSLERLNRLETLAAIGGAAAGDDTEDTSTEFTDSIEEEAAHHSHQQLVKVALEKSLATVETQNPSFSPPSPMGGDSNRCLQEEMLHLRAEFHQHLEEKRKAEEELKELKAQIEEAGFSSVSHIRNTMLSLCLENAELKEQMGEAMSDGWEIEEDKEKGEVMVETVVTKEGLSESSLQAEFRKLQGKLKNAHNIINLLKEQLVLSSKEGNSKLTPELLVHLTSTIERINTELVGSPGKHQHQEEGNVTVRPFPRPQSLDLGATFTVDAHQLDNQSQPRDPGPQSAFSLPGSTQHLRSQLSQCKQRYQDLQEKLLLSEATVFAQANELEKYRVMLTGESLVKQDSKQIQVDLQDLGYETCGRSENEAEREETTSPECEEHNSLKEMVLMEGLCSEQGRRGSTLASSSERKPLENQLGKQEEFRVYGKSENILVLRKDIKDLKAQLQNANKVIQNLKSRVRSLSVTSDYSSSLERPRKLRAVGTLEGSSPHSVPDEDEGWLSDGTGAFYSPGLQAKKDLESLIQRVSQLEAQLPKNGLEEKLAEELRSASWPGKYDSLIQDQARELSYLRQKIREGRGICYLITRHAKDTVKSFEDLLRSNDIDYYLGQSFREQLAQGSQLTERLTSKLSTKDHKSEKDQAGLEPLALRLSRELQEKEKVIEVLQAKLDARSLTPSSSHALSDSHRSPSSTSFLSDELEACSDMDIVSEYTHYEEKKASPSHSDSIHHSSHSAVLSSKPSSTSASQGAKAESNSNPISLPTPQNTPKEANQAHSGFHFHSIPKLASLPQAPLPSAPSSFLPFSPTGPLLLGCCETPVVSLAEAQQELQMLQKQLGESASTVPPASTATLLSNDLEADSSYYLNSAQPHSPPRGTIELGRILEPGYLGSSGKWDVMRPQKGSVSGDLSSGSSVYQLNSKPTGADLLEEHLGEIRNLRQRLEESICINDRLREQLEHRLTSTARGRGSTSNFYSQGLESIPQLCNENRVLREDNRRLQAQLSHVSREHSQETESLREALLSSRSHLQELEKELEHQKVERQQLLEDLREKQQEVLHFREERLSLQENDSSGPCLSLVRLQHKLVLLQQQCEEKQQLFESLQSELQIYEALYGNSKKGLKAYSLDACHQIPLSSDLSHLVAEVRALRGQLEQSIQGNNCLRLQLQQQLESGAGKASLSPSSINQNFPASTDPGNKQLLLQDSAVSPPVRDVGMNSPALVFPSSASSTPGSETPIINRANGLGLDTSPVMKTPPKLEGDATDGSFANKHGRHVIGHIDDYSALRQQIAEGKLLVKKIVSLVRSACSFPGLEAQGTEVLGSKGIHELRSSTSALHHALEESASLLTMFWRAALPSTHIPVLPGKVGESTERELLELRTKVSKQERLLQSTTEHLKNANQQKESMEQFIVSQLTRTHDVLKKARTNLEVKSLRALPCTPAL

SEQ ID NO: 860781 - protein, 2396 aa, Homo sapiens
MKEICRICARELCGNQRRWIFHTASKLNLQVLLSHVLGKDVPRDGKAEFACSKCAFMLDRIYRFDTVIARIEALSIERLQKLLLEKDRLKFCIASMYRKNNDDSGAEIKAGNGTVDMSVLPDARYSALLQEDFAYSGFECWVENEDQIQEPHSCHGSEGPGNRPRRCRGCAALRVADSDYEAICKVPRKVARSISCGPSSRWSTSICTEEPALSEVGPPDLASTKVPPDGESMEEETPGSSVESLDASVQASPPQQKDEETERSAKELGKCDCCSDDQAPQHGCNHKLELALSMIKGLDYKPIQSPRGSRLPIPVKSSLPGAKPGPSMTDGVSSGFLNRSLKPLYKTPVSYPLELSDLQELWDDLCEDYLPLRVQPMTEELLKQQKLNSHETTITQQSVSDSHLAELQEKIQQTEATNKILQEKLNEMSYELKCAQESSQKQDGTIQNLKETLKSRERETEELYQVIEGQNDTMAKLREMLHQSQLGQLHSSEGTSPAQQQVALLDLQSALFCSQLEIQKLQRVVRQKERQLADAKQCVQFVEAAAHESEQQKEASWKHNQELRKALQQLQEELQNKSQQLRAWEAEKYNEIRTQEQNIQHLNHSLSHKEQLLQEFRELLQYRDNSDKTLEANEMLLEKLRQRIHDKAVALERAIDEKFSALEEKEKELRQLRLAVRERDHDLERLRDVLSSNEATMQSMESLLRAKGLEVEQLSTTCQNLQWLKEEMETKFSRWQKEQESIIQQLQTSLHDRNKEVEDLSATLLCKLGPGQSEIAEELCQRLQRKERMLQDLLSDRNKQVLEHEMEIQGLLQSVSTREQESQAAAEKLVQALMERNSELQALRQYLGGRDSLMSQAPISNQQAEVTPTGRLGKQTDQGSMQIPSRDDSTSLTAKEDVSIPRSTLGDLDTVAGLEKELSNAKEELELMAKKERESQMELSALQSMMAVQEEELQVQAADMESLTRNIQIKEDLIKDLQMQLVDPEDIPAMERLTQEVLLLREKVASVESQGQEISGNRRQQLLLMLEGLVDERSRLNEALQAERQLYSSLVKFHAHPESSERDRTLQVELEGAQVLRSRLEEVLGRSLERLNRLETLAAIGGAAAGDDTEDTSTEFTDSIEEEAAHHSHQQLVKVALEKSLATVETQNPSFSPPSPMGGDSNRCLQEEMLHLRAEFHQHLEEKRKAEEELKELKAQIEEAGFSSVSHIRNTMLSLCLENAELKEQMGEAMSDGWEIEEDKEKGEVMVETVVTKEGLSESSLQAEFRKLQGKLKNAHNIINLLKEQLVLSSKEGNSKLTPELLVHLTSTIERINTELVGSPGKHQHQEEGNVTVRPFPRPQSLDLGATFTVDAHQLDNQSQPRDPGPQSAFSLPGSTQHLRSQLSQCKQRYQDLQEKLLLSEATVFAQANELEKYRVMLTGESLVKQDSKQIQVDLQDLGYETCGRSENEAEREETTSPECEEHNSLKEMVLMEGLCSEQGRRGSTLASSSERKPLENQLGKQEEFRVYGKSENILVLRKDIKDLKAQLQNANKVIQNLKSRVRSLSVTSDYSSSLERPRKLRAVGTLEGSSPHSVPDEDEGWLSDGTGAFYSPGLQAKKDLESLIQRVSQLEAQLPKNGLEEKLAEELRSASWPGKYDSLIQDQARELSYLRQKIREGRGICYLITRHAKDTVKSFEDLLRSNDIDYYLGQSFREQLAQGSQLTERLTSKLSTKDHKSEKDQAGLEPLALRLSRELQEKEKVIEVLQAKLDARSLTPSSSHALSDSHRSPSSTSFLSDELEACSDMDIVSEYTHYEEKKASPSHSGASTVPPASTATLLSNDLEADSSYYLNSAQPHSPPRGTIELGRILEPGYLGSSGKWDVMRPQKGSVSGDLSSGSSVYQLNSKPTGADLLEEHLGEIRNLRQRLEESICINDRLREQLEHRLTSTARGRGSTSNFYSQGLESIPQLCNENRVLREDNRRLQAQLSHVSREHSQETESLREALLSSRSHLQELEKELEHQKVERQQLLEDLREKQQEVLHFREERLSLQENDSRLQHKLVLLQQQCEEKQQLFESLQSELQIYEALYGNSKKGLKAYSLDACHQIPLSSDLSHLVAEVRALRGQLEQSIQGNNCLRLQLQQQLESGAGKASLSPSSINQNFPASTDPGNKQLLLQDSAVSPPVRDVGMNSPALVFPSSASSTPGSETPIINRANGLGLDTSPVMKTPPKLEGDATDGSFANKHGRHVIGHIDDYSALRQQIAEGKLLVKKIVSLVRSACSFPGLEAQGTEVLGSKGIHELRSSTSALHHALEESASLLTMFWRAALPSTHIPVLPGKVGESTERELLELRTKVSKQERLLQSTTEHLKNANQQKESMEQFIVSQLTRTHDVLKKARTNLEVKSLRALPCTPAL

SEQ ID NO: 860782 - protein, 2348 aa, Homo sapiens
MKEICRICARELCGNQRRWIFHTASKLNLQVLLSHVLGKDVPRDGKAEFACSKCAFMLDRIYRFDTVIARIEALSIERLQKLLLEKDRLKFCIASMYRKNNDDSGAEIKAGNGTVDMSVLPDARYSALLQEDFAYSGFECWVENEDQIQEPHSCHGSEGPGNRPRRCRGCAALRVADSDYEAICKVPRKVARSISCGPSSRWSTSICTEEPALSEVGPPDLASTKVPPDGESMEEETPGSSVESLDASVQASPPQQKDEETERSAKELGKCDCCSDDQAPQHGCNHKLELALSMIKGLDYKPIQSPRGSRLPIPVKSSLPGAKPGPSMTDGVSSGFLNRSLKPLYKTPVSYPLELSDLQELWDDLCEDYLPLRVQPMTEELLKQQKLNSHETTITQQSVSDSHLAELQEKIQQTEATNKILQEKLNEMSYELKCAQESSQKQDGTIQNLKETLKSRERETEELYQVIEGQNDTMAKLREMLHQSQLGQLHSSEGTSPAQQQVALLDLQSALFCSQLEIQKLQRVVRQKERQLADAKQCVQFVEAAAHESEQQKEASWKHNQELRKALQQLQEELQNKSQQLRAWEAEKYNEIRTQEQNIQHLNHSLSHKEQLLQEFRELLQYRDNSDKTLEANEMLLEKLRQRIHDKAVALERAIDEKFSALEEKEKELRQLRLAVRERDHDLERLRDVLSSNEATMQSMESLLRAKGLEVEQLSTTCQNLQWLKEEMETKFSRWQKEQESIIQQLQTSLHDRNKEVEDLSATLLCKLGPGQSEIAEELCQRLQRKERMLQDLLSDRNKQVLEHEMEIQGLLQSVSTREQESQAAAEKLVQALMERNSELQALRQYLGGRDSLMSQAPISNQQAEVTPTGRLGKQTDQGSMQIPSRDDSTSLTAKEDVSIPRSTLGDLDTVAGLEKELSNAKEELELMAKKERESQMELSALQSMMAVQEEELQVQAADMESLTRNIQIKEDLIKDLQMQLVDPEDIPAMERLTQEVLLLREKVASVESQGQEISGNRRQQLLLMLEGLVDERSRLNEALQAERQLYSSLVKFHAHPESSERDRTLQVELEGAQVLRSRLEEVLGRSLERLNRLETLAAIGGAAAGDDTEDTSTEFTDSIEEEAAHHSHQQLVKVALEKSLATVETQNPSFSPPSPMGGDSNRCLQEEMLHLRAEFHQHLEEKRKAEEELKELKAQIEEAGFSSVSHIRNTMLSLCLENAELKEQMGEAMSDGWEIEEDKEKGEVMVETVVTKEGLSESSLQAEFRKLQGKLKNAHNIINLLKEQLVLSSKEGNSKLTPELLVHLTSTIERINTELVGSPGKHQHQEEGNVTVRPFPRPQSLDLGATFTVDAHQLDNQSQPRDPGPQSAFSLPGSTQHLRSQLSQCKQRYQDLQEKLLLSEATVFAQANELEKYRVMLTGESLVKQDSKQIQVDLQDLGYETCGRSENEAEREETTSPECEEHNSLKEMVLMEGLCSEQGRRGSTLASSSERKPLENQLGKQEEFRVYGKSENILVLRKDIKDLKAQLQNANKVIQNLKSRVRSLSVTSDYSSSLERPRKLRAVGTLEGSSPHSVPDEDEGWLSDGTGAFYSPGLQAKKDLESLIQRVSQLEAQLPKNGLEEKLAEELRSASWPGKYDSLIQDQARELSYLRQKIREGRGICYLITRHAKDTVKSFEDLLRSNDIDYYLGQSFREQLAQGSQLTERLTSKLSTKDHKSEKDQAGLEPLALRLSRELQEKEKVIEVLQAKLDARSLTPSSSHALSDSHRSPSSTSFLSDELEACSDMDIVSEYTHYEEKKASPSHSDSIHHSSHSAVLSSKPSSTSASQGAKAESNSNPISLPTPQNTPKEANQAHSGFHFHSIPKLASLPQAPLPSAPSSFLPFSPTGPLLLGCCETPVVSLAEAQQELQMLQKQLGESASTVPPASTATLLSNDLEADSSYYLNSAQPHSPPRGTIELGRILEPGYLGSSGKWDVMRPQKGSVSGDLSSGSSVYQLNSKPTGADLLEEHLGEIRNLRQRLEESICINDRLREQLEHRLTSTARGRGSTSNFYSQGLESIPQLCNENRVLREDNRRLQAQLSHVSREHSQETESLREALLSSRSHLQELEKELEHQKVERQQLLEDLREKQQEVLHFREDVFPSRKTTPGLGLDTSPVMKTPPKLEGDATDGSFANKHGRHVIGHIDDYSALRQQIAEGKLLVKKIVSLVRSACSFPGLEAQGTEVLGSKGIHELRSSTSALHHALEESASLLTMFWRAALPSTHIPVLPGKVGESTERELLELRTKVSKQERLLQSTTEHLKNANQQKESMEQFIVSQLTRTHDVLKKARTNLEVKSLRALPCTPAL

SEQ ID NO: 860783 - protein, 1638 aa, Homo sapiens
RVGSCTSKRTHKGDPLPSLAQLGYTSHQAEVIPTRDLDTVAGLEKELSNAKEELELMAKKERESQMELSALQSMMAVQEEELQVQAADMESLTRNIQIKEDLIKDLQMQLVDPEDIPAMERLTQEVLLLREKVASVESQGQEISGNRRQQLLLMLEGLVDERSRLNEALQAERQLYSSLVKFHAHPESSERDRTLQVELEGAQVLRSRLEEVLGRSLERLNRLETLAAIGGAAAGDDTEDTSTEFTDSIEEEAAHHSHQQLVKVALEKSLATVETQNPSFSPPSPMGGDSNRCLQEEMLHLRAEFHQHLEEKRKAEEELKELKAQIEEAGFSSVSHIRNTMLSLCLENAELKEQMGEAMSDGWEIEEDKEKGEVMVETVVTKEGLSESSLQAEFRKLQGKLKNAHNIINLLKEQLVLSSKEGNSKLTPELLVHLTSTIERINTELVGSPGKHQHQEEGNVTVRPFPRPQSLDLGATFTVDAHQLDNQSQPRDPGPQSAFSLPGSTQHLRSQLSQCKQRYQDLQEKLLLSEATVFAQANELEKYRVMLTGESLVKQDSKQIQVDLQDLGYETCGRSENEAEREETTSPECEEHNSLKEMVLMEGLCSEQGRRGSTLASSSERKPLENQLGKQEEFRVYGKSENILVLRKDIKDLKAQLQNANKVIQNLKSRVRSLSVTSDYSSSLERPRKLRAVGTLEGSSPHSVPDEDEGWLSDGTGAFYSPGLQAKKDLESLIQRVSQLEAQLPKNGLEEKLAEELRSASWPGKYDSLIQDQARELSYLRQKIREGRGICYLITRHAKDTVKSFEDLLRSNDIDYYLGQSFREQLAQGSQLTERLTSKLSTKDHKSEKDQAGLEPLALRLSRELQEKEKVIEVLQAKLDARSLTPSSSHALSDSHRSPSSTSFLSDELEACSDMDIVSEYTHYEEKKASPSHSDSIHHSSHSAVLSSKPSSTSASQGAKAESNSNPISLPTPQNTPKEANQAHSGFHFHSIPKLASLPQAPLPSAPSSFLPFSPTGPLLLGCCETPVVSLAEAQQELQMLQKQLGESASTVPPASTATLLSNDLEADSSYYLNSAQPHSPPRGTIELGRILEPGYLGSSGKWDVMRPQKGSVSGDLSSGSSVYQLNSKPTGADLLEEHLGEIRNLRQRLEESICINDRLREQLEHRLTSTARGRGSTSNFYSQGLESIPQLCNENRVLREDNRRLQAQLSHVSREHSQETESLREALLSSRSHLQELEKELEHQKVERQQLLEDLREKQQEVLHFREERLSLQENDSRLQHKLVLLQQQCEEKQQLFESLQSELQIYEALYGNSKKGLKAYSLDACHQIPLSSDLSHLVAEVRALRGQLEQSIQGNNCLRLQLQQQLESGAGKASLSPSSINQNFPASTDPGNKQLLLQDSAVSPPVRDVGMNSPALVFPSSASSTPGSETPIINRANGLGLDTSPVMKTPPKLEGDATDGSFANKHGRHVIGHIDDYSALRQQIAEGKLLVKKIVSLVRSACSFPGLEAQGTEVLGSKGIHELRSSTSALHHALEESASLLTMFWRAALPSTHIPVLPGKVGESTERELLELRTKVSKQERLLQSTTEHLKNANQQKESMEQFIVSQLTRTHDVLKKARTNLEVKSLRALPCTPAL

SEQ ID NO: 860784 - protein, 1116 aa, Homo sapiens
MKEICRICARELCGNQRRWIFHTASKLNLQVLLSHVLGKDVPRDGKAEFACSKCAFMLDRIYRFDTVIARIEALSIERLQKLLLEKDRLKFCIASMYRKNNDDSGAEIKAGNGTVDMSVLPDARYSALLQEDFAYSGFECWVENEDQIQEPHSCHGSEGPGNRPRRCRGCAALRVADSDYEAICKVPRKVARSISCGPSSRWSTSICTEEPALSEVGPPDLASTKVPPDGESMEEETPGSSVESLDASVQASPPQQKDEETERSAKELGKCDCCSDDQAPQHGCNHKLELALSMIKGLDYKPIQSPRGSRLPIPVKSSLPGAKPGPSMTDGVSSGFLNRSLKPLYKTPVSYPLELSDLQELWDDLCEDYLPLRVQPMTEELLKQQKLNSHETTITQQSVSDSHLAELQEKIQQTEATNKILQEKLNEMSYELKCAQESSQKQDGTIQNLKETLKSRERETEELYQVIEGQNDTMAKLREMLHQSQLGQLHSSEGTSPAQQQVALLDLQSALFCSQLEIQKLQRVVRQKERQLADAKQCVQFVEAAAHESEQQKEASWKHNQELRKALQQLQEELQNKSQQLRAWEAEKYNEIRTQEQNIQHLNHSLSHKEQLLQEFRELLQYRDNSDKTLEANEMLLEKLRQRIHDKAVALERAIDEKFSALEEKEKELRQLRLAVRERDHDLERLRDVLSSNEATMQSMESLLRAKGLEVEQLSTTCQNLQWLKEEMETKFSRWQKEQESIIQQLQTSLHDRNKEVEDLSATLLCKLGPGQSEIAEELCQRLQRKERMLQDLLSDRNKQVLEHEMEIQGLLQSVSTREQESQAAAEKLVQALMERNSELQALRQYLGGRDSLMSQAPISNQQAEVTPTGRLGKQTDQGSMQIPSRDDSTSLTAKEDVSIPRSTLGDLDTVAGLEKELSNAKEELELMAKKERESQMELSALQSMMAVQEEELQVQAADMESLTRNIQIKEDLIKDLQMQLVDPEDIPAMERLTQEVLLLREKVASVESQGQEISGNRRQQLLLMLEGLVDERSRLNEALQAERQLYSSLVKFHAHPESSERDRTLQVELEGAQVLRSRLEEVLGRSLERLNRLETLAAIGGGELESVRIHHKHAY

SEQ ID NO: 860785 - protein, 1132 aa, Homo sapiens
MKEICRICARELCGNQRRWIFHTASKLNLQVLLSHVLGKDVPRDGKAEFACSKCAFMLDRIYRFDTVIARIEALSIERLQKLLLEKDRLKFCIASMYRKNNDDSGAEIKAGNGTVDMSVLPDARYSALLQEDFAYSGFECWVENEDQIQEPHSCHGSEGPGNRPRRCRGCAALRVADSDYEAICKVPRKVARSISCGPSSRWSTSICTEEPALSEVGPPDLASTKVPPDGESMEEETPGSSVESLDASVQASPPQQKDEETERSAKELGKCDCCSDDQAPQHGCNHKLELALSMIKGLDYKPIQSPRGSRLPIPVKSSLPGAKPGPSMTDGVSSGFLNRSLKPLYKTPVSYPLELSDLQELWDDLCEDYLPLRVQPMTEELLKQQKLNSHETTITQQSVSDSHLAELQEKIQQTEATNKILQEKLNEMSYELKCAQESSQKQDGTIQNLKETLKSRERETEELYQVIEGQNDTMAKLREMLHQSQLGQLHSSEGTSPAQQQVALLDLQSALFCSQLEIQKLQRVVRQKERQLADAKQCVQFVEAAAHESEQQKEASWKHNQELRKALQQLQEELQNKSQQLRAWEAEKYNEIRTQEQNIQHLNHSLSHKEQLLQEFRELLQYRDNSDKTLEANEMLLEKLRQRIHDKAVALERAIDEKFSALEEKEKELRQLRLAVRERDHDLERLRDVLSSNEATMQSMESLLRAKGLEVEQLSTTCQNLQWLKEEMETKFSRWQKEQESIIQQLQTSLHDRNKEVEDLSATLLCKLGPGQSEIAEELCQRLQRKERMLQDLLSDRNKQVLEHEMEIQGLLQSVSTREQESQAAAEKLVQALMERNSELQALRQYLGGRDSLMSQAPISNQQAEVTPTGRLGKQTDQGSMQIPSRDDSTSLTAKEDVSIPRSTLGDLDTVAGLEKELSNAKEELELMAKKERESQMELSALQSMMAVQEEELQVQAADMESLTRNIQIKEDLIKDLQMQLVDPEDIPAMERLTQEVLLLREKVASVESQGQEISGNRRQQLLLMLEGLVDERSRLNEALQAERQLYSSLVKFHAHPESSERDRTLQVELEGAQVLRSRLEEVLGRSLERLNRLETLAAIGGAAAGDDTEDTSTEFTDSIEEEAAHHSHQQL

SEQ ID NO: 860786 - protein, 1026 aa, Homo sapiens
MKEICRICARELCGNQRRWIFHTASKLNLQVLLSHVLGKDVPRDGKAEFACSKCAFMLDRIYRFDTVIARIEALSIERLQKLLLEKDRLKFCIASMYRKNNDDSGAEIKAGNGTVDMSVLPDARYSALLQEDFAYSGFECWVENEDQIQEPHSCHGSEGPGNRPRRCRGCAALRVADSDYEAICKVPRKVARSISCGPSSRWSTSICTEEPALSEVGPPDLASTKVPPDGESMEEETPGSSVESLDASVQASPPQQKDEETERSAKELGKCDCCSDDQAPQHGCNHKLELALSMIKGLDYKPIQSPRGSRLPIPVKSSLPGAKPGPSMTDGVSSGFLNRSLKPLYKTPVSYPLELSDLQELWDDLCEDYLPLRVQPMTEELLKQQKLNSHETTITQQSVSDSHLAELQEKIQQTEATNKILQEKLNEMSYELKCAQESSQKQDGTIQNLKETLKSRERETEELYQVIEGQNDTMAKLREMLHQSQLGQLHSSEGTSPAQQQVALLDLQSALFCSQLEIQKLQRVVRQKERQLADAKQCVQFVEAAAHESEQQKEASWKHNQELRKALQQLQEELQNKSQQLRAWEAEKYNEIRTQEQNIQHLNHSLSHKEQLLQEFRELLQYRDNSDKTLEANEMLLEKLRQRIHDKAVALERAIDEKFSALEEKEKELRQLRLAVRERDHDLERLRDVLSSNEATMQSMESLLRAKGLEVEQLSTTCQNLQWLKEEMETKFSRWQKEQESIIQQLQTSLHDRNKEVEDLSATLLCKLGPGQSEIAEELCQRLQRKERMLQDLLSDRNKQVLEHEMEIQGLLQSVSTREQESQAAAEKLVQALMERNSELQALRQYLGGRDSLMSQAPISNQQAEVTPTGRLGKQTDQGSMQIPSRDDSTSLTAKEDVSIPRSTLGDLDTVAGLEKELSNAKEELELMAKKERESQMELSALQSMMAVQEEELQVQAADMESLTRNIQIKEDLIKDLQMQLVDPEDIPAMERLTQEVLLLREKVASVESQGQEISGNRRQQEVTGI

SEQ ID NO: 860787 - protein, 1132 aa, Homo sapiens; identical to SEQ ID NO: 860785

SEQ ID NO: 860788 - protein, 2046 aa, Homo sapiens
SCCRAGEVPSDAVKVVQAGFGAAFLEAVQQVALLDLQSALFCSQLEIQKLQRVVRQKERQLADAKQCVQFVEAAAHESEQQKEASWKHNQELRKALQQLQEELQNKSQQLRAWEAEKYNEIRTQEQNIQHLNHSLSHKEQLLQEFRELLQYRDNSDKTLEANEMLLEKLRQRIHDKAVALERAIDEKFSALEEKEKELRQLRLAVRERDHDLERLRDVLSSNEATMQSMESLLRAKGLEVEQLSTTCQNLQWLKEEMETKFSRWQKEQESIIQQLQTSLHDRNKEVEDLSATLLCKLGPGQSEIAEELCQRLQRKERMLQDLLSDRNKQVLEHEMEIQGLLQSVSTREQESQAAAEKLVQALMERNSELQALRQYLGGRDSLMSQAPISNQQAEVTPTGRLGKQTDQGSMQIPSRDDSTSLTAKEDVSIPRSTLGDLDTVAGLEKELSNAKEELELMAKKERESQMELSALQSMMAVQEEELQVQAADMESLTRNIQIKEDLIKDLQMQLVDPEDIPAMERLTQEVLLLREKVASVESQGQEISGNRRQQLLLMLEGLVDERSRLNEALQAERQLYSSLVKFHAHPESSERDRTLQVELEGAQVLRSRLEEVLGRSLERLNRLETLAAIGGAAAGDDTEDTSTEFTDSIEEEAAHHSHQQLVKVALEKSLATVETQNPSFSPPSPMGGDSNRCLQEEMLHLRAEFHQHLEEKRKAEEELKELKAQIEEAGFSSVSHIRNTMLSLCLENAELKEQMGEAMSDGWEIEEDKEKGEVMVETVVTKEGLSESSLQAEFRKLQGKLKNAHNIINLLKEQLVLSSKEGNSKLTPELLVHLTSTIERINTELVGSPGKHQHQEEGNVTVRPFPRPQSLDLGATFTVDAHQLDNQSQPRDPGPQSAFSLPGSTQHLRSQLSQCKQRYQDLQEKLLLSEATVFAQANELEKYRVMLTGESLVKQDSKQIQVDLQDLGYETCGRSENEAEREETTSPECEEHNSLKEMVLMEGLCSEQGRRGSTLASSSERKPLENQLGKQEEFRVYGKSENILVLRKDIKDLKAQLQNANKVIQNLKSRVRSLSVTSDYSSSLERPRKLRAVGTLEGSSPHSVPDEDEGWLSDGTGAFYSPGLQAKKDLESLIQRVSQLEAQLPKNGLEEKLAEELRSASWPGKYDSLIQDQARELSYLRQKIREGRGICYLITRHAKDTVKSFEDLLRSNDIDYYLGQSFREQLAQGSQLTERLTSKLSTKDHKSEKDQAGLEPLALRLSRELQEKEKVIEVLQAKLDARSLTPSSSHALSDSHRSPSSTSFLSDELEACSDMDIVSEYTHYEEKKASPSHSDSIHHSSHSAVLSSKPSSTSASQGAKAESNSNPISLPTPQNTPKEANQAHSGFHFHSIPKLASLPQAPLPSAPSSFLPFSPTGPLLLGCCETPVVSLAEAQQELQMLQKQLGESASTVPPASTATLLSNDLEADSSYYLNSAQPHSPPRGTIELGRILEPGYLGSSGKWDVMRPQKGSVSGDLSSGSSVYQLNSKPTGADLLEEHLGEIRNLRQRLEESICINDRLREQLEHRLTSTARGRGSTSNFYSQGLESIPQLCNENRVLREDNRRLQAQLSHVSREHSQETESLREALLSSRSHLQELEKELEHQKVERQQLLEDLREKQQEVLHFREERLSLQENDSSGPCLSLVRLQHKLVLLQQQCEEKQQLFESLQSELQIYEALYGNSKKGLKAYSLDACHQIPLSSDLSHLVAEVRALRGQLEQSIQGNNCLRLQLQQQLESGAGKASLSPSSINQNFPASTDPGNKQLLLQDSAVSPPVRDVGMNSPALVFPSSASSTPGSETPIINRANGLGLDTSPVMKTPPKLEGDATDGSFANKHGRHVIGHIDDYSALRQQIAEGKLLVKKIVSLVRSACSFPGLEAQGTEVLGSKGIHELRSSTSALHHALEESASLLTMFWRAALPSTHIPVLPGKVGESTERELLELRTKVSKQERLLQSTTEHLKNANQQKESMEQFIVSQLTRTHDVLKKARTNLEVKSLRALPCTPAL

SEQ ID NO: 860789 - protein, 2509 aa, Homo sapiens
MKEICRICARELCGNQRRWIFHTASKLNLQVLLSHVLGKDVPRDGKAEFACSKCAFMLDRIYRFDTVIARIEALSIERLQKLLLEKDRLKFCIASMYRKNNDDSGAEIKAGNGTVDMSVLPDARYSALLQEDFAYSGFECWVENEDQIQEPHSCHGSEGPGNRPRRCRGCAALRVADSDYEAICKVPRKVARSISCGPSSRWSTSICTEEPALSEVGPPDLASTKVPPDGESMEEETPGSSVESLDASVQASPPQQKDEETERSAKELGKCDCCSDDQAPQHGCNHKLELALSMIKGLDYKPIQSPRGSRLPIPVKSSLPGAKPGPSMTDGVSSGFLNRSLKPLYKTPVSYPLELSDLQELWDDLCEDYLPLRVQPMTEELLKQQKLNSHETTITQQSVSDSHLAELQEKIQQTEATNKILQEKLNEMSYELKCAQESSQKQDGTIQNLKETLKSRERETEELYQVIEGQNDTMAKLREMLHQSQLGQLHSSEGTSPAQQQVALLDLQSALFCSQLEIQKLQRVVRQKERQLADAKQCVQFVEAAAHESEQQKEASWKHNQELRKALQQLQEELQNKSQQLRAWEAEKYNEIRTQEQNIQHLNHSLSHKEQLLQEFRELLQYRDNSDKTLEANEMLLEKLRQRIHDKAVALERAIDEKFSALEEKEKELRQLRLAVRERDHDLERLRDVLSSNEATMQSMESLLRAKGLEVEQLSTTCQNLQWLKEEMETKFSRWQKEQESIIQQLQTSLHDRNKEVEDLSATLLCKLGPGQSEIAEELCQRLQRKERMLQDLLSDRNKQVLEHEMEIQGLLQSVSTREQESQAAAEKLVQALMERNSELQALRQYLGGRDSLMSQAPISNQQAEVTPTGRLGKQTDQGSMQIPSRDDSTSLTAKEDVSIPRSTLGDLDTVAGLEKELSNAKEELELMAKKERESQMELSALQSMMAVQEEELQVQAADMESLTRNIQIKEDLIKDLQMQLVDPEDIPAMERLTQEVLLLREKVASVESQGQEISGNRRQQLLLMLEGLVDERSRLNEALQAERQLYSSLVKFHAHPESSERDRTLQVELEGAQVLRSRLEEVLGRSLERLNRLETLAAIGGAAAGDDTEDTSTEFTDSIEEEAAHHSHQQLVKVALEKSLATVETQNPSFSPPSPMGGDSNRCLQEEMLHLRAEFHQHLEEKRKAEEELKELKAQIEEAGFSSVSHIRNTMLSLCLENAELKEQMGEAMSDGWEIEEDKEKGEVMVETVVTKEGLSESSLQAEFRKLQGKLKNAHNIINLLKEQLVLSSKEGNSKLTPELLVHLTSTIERINTELVGSPGKHQHQEEGNVTVRPFPRPQSLDLGATFTVDAHQLDNQSQPRDPGPQSAFSLPGSTQHLRSQLSQCKQRYQDLQEKLLLSEATVFAQANELEKYRVMLTGESLVKQDSKQIQVDLQDLGYETCGRSENEAEREETTSPECEEHNSLKEMVLMEGLCSEQGRRGSTLASSSERKPLENQLGKQEEFRVYGKSENILVLRKDIKDLKAQLQNANKVIQNLKSRVRSLSVTSDYSSSLERPRKLRAVGTLEGSSPHSVPDEDEGWLSDGTGAFYSPGLQAKKDLESLIQRVSQLEAQLPKNGLEEKLAEELRSASWPGKYDSLIQDQARELSYLRQKIREGRGICYLITRHAKDTVKSFEDLLRSNDIDYYLGQSFREQLAQGSQLTERLTSKLSTKDHKSEKDQAGLEPLALRLSRELQEKEKVIEVLQAKLDARSLTPSSSHALSDSHRSPSSTSFLSDELEACSDMDIVSEYTHYEEKKASPSHSDSIHHSSHSAVLSSKPSSTSASQGAKAESNSNPISLPTPQNTPKEANQAHSGFHFHSIPKLASLPQAPLPSAPSSFLPFSPTGPLLLGCCETPVVSLAEAQQELQMLQKQLGESASTVPPASTATLLSNDLEADSSYYLNSAQPHSPPRGTIELGRILEPGYLGSSGKWDVMRPQKGSVSGDLSSGSSVYQLNSKPTGADLLEEHLGEIRNLRQRLEESICINDRLREQLEHRLTSTARGRGSTSNFYSQGLESIPQLCNENRVLREDNRRLQAQLSHVSREHSQETESLREALLSSRSHLQELEKELEHQKVERQQLLEDLREKQQEVLHFREERLSLQENDSRLQHKLVLLQQQCEEKQQLFESLQSELQIYEALYGNSKKGLKAYSLDACHQIPLSSDLSHLVAEVRALRGQLEQSIQGNNCLRLQLQQQLESGAGKASLSPSSINQNFPASTDPGNKQLLLQDSAVSPPVRDVGMNSPALVFPSSASSTPGSETPIINRANGLGLDTSPVMKTPPKLEGDATDGSFANKHGRHVIGHIDDYSALRQQIAEGKLLVKKIVSLVRSACSFPGLEAQGTEVLGSKGIHELRSSTSALHHALEESASLLTMFWRAALPSTHIPVLPGKVGESTERELLELRTKVSKQERLLQSTTEHLKNANQQKESMEQFIVSQLTRTHDVLKKARTNLEVKSLRALPCTPAL

SEQ ID NO: 860790 - protein, 2447 aa, Homo sapiens
MKEICRICARELCGNQRRWIFHTASKLNLQVLLSHVLGKDVPRDGKAEFACSKCAFMLDRIYRFDTVIARIEALSIERLQKLLLEKDRLKFCIASMYRKNNDDSGAEIKAGNGTVDMSVLPDARYSALLQEDFAYSGFECWVENEDQIQEPHSCHGSEGPGNRPRRCRGCAALRVADSDYEAICKVPRKVARSISCGPSSRWSTSICTEEPALSEVGPPDLASTKVPPDGESMEEETPGSSVESLDASVQASPPQQKDEETERSAKELGKCDCCSDDQAPQHGCNHKLELALSMIKGLDYKPIQSPRGSRLPIPVKSSLPGAKPGPSMTDGVSSGFLNRSLKPLYKTPVSYPLELSDLQELWDDLCEDYLPLRVQPMTEELLKQQKLNSHETTITQQSVSDSHLAELQEKIQQTEATNKILQEKLNEMSYELKCAQESSQKQDGTIQNLKETLKSRERETEELYQVIEGQNDTMAKLREMLHQSQLGQLHSSEGTSPAQQQVALLDLQSALFCSQLEIQKLQRVVRQKERQLADAKQCVQFVEAAAHESEQQKEASWKHNQELRKALQQLQEELQNKSQQLRAWEAEKYNEIRTQEQNIQHLNHSLSHKEQLLQEFRELLQYRDNSDKTLEANEMLLEKLRQRIHDKAVALERAIDEKFSALEEKEKELRQLRLAVRERDHDLERLRDVLSSNEATMQSMESLLRAKGLEVEQLSTTCQNLQWLKEEMETKFSRWQKEQESIIQQLQTSLHDRNKEVEDLSATLLCKLGPGQSEIAEELCQRLQRKERMLQDLLSDRNKQVLEHEMEIQGLLQSVSTREQESQAAAEKLVQALMERNSELQALRQYLGGRDSLMSQAPISNQQAEVTPTGRLGKQTDQGSMQIPSRDDSTSLTAKEDVSIPRSTLGDLDTVAGLEKELSNAKEELELMAKKERESQMELSALQSMMAVQEEELQVQAADMESLTRNIQIKEDLIKDLQMQLVDPEDIPAMERLTQEVLLLREKVASVESQGQEISGNRRQQLLLMLEGLVDERSRLNEALQAERQLYSSLVKFHAHPESSERDRTLQVELEGAQVLRSRLEEVLGRSLERLNRLETLAAIGGAAAGDDTEDTSTEFTDSIEEEAAHHSHQQLVKVALEKSLATVETQNPSFSPPSPMGGDSNRCLQEEMLHLRAEFHQHLEEKRKAEEELKELKAQIEEAGFSSVSHIRNTMLSLCLENAELKEQMGEAMSDGWEIEEDKEKGEVMVETVVTKEGLSESSLQAEFRKLQGKLKNAHNIINLLKEQLVLSSKEGNSKLTPELLVHLTSTIERINTELVGSPGKHQHQEEGNVTVRPFPRPQSLDLGATFTVDAHQLDNQSQPRDPGPQSAFSLPGSTQHLRSQLSQCKQRYQDLQEKLLLSEATVFAQANELEKYRVMLTGESLVKQDSKQIQVDLQDLGYETCGRSENEAEREETTSPECEEHNSLKEMVLMEGLCSEQGRRGSTLASSSERKPLENQLGKQEEFRVYGKSENILVLRKDIKDLKAQLQNANKVIQNLKSRVRSLSVTSDYSSSLERPRKLRAVGTLEGSSPHSVPDEDEGWLSDGTGAFYSPGLQAKKDLESLIQRVSQLEAQLPKNGLEEKLAEELRSASWPGKYDSLIQDQARELSYLRQKIREGRGICYLITRHAKDTVKSFEDLLRSNDIDYYLGQSFREQLAQGSQLTERLTSKLSTKDHKSEKDQAGLEPLALRLSRELQEKEKVIEVLQAKLDARSLTPSSSHALSDSHRSPSSTSFLSDELEACSDMDIVSEYTHYEEKKASPSHSDSIHHSSHSAVLSSKPSSTSASQGAKAESNSNPISLPTPQNTPKEANQAHSGASTVPPASTATLLSNDLEADSSYYLNSAQPHSPPRGTIELGRILEPGYLGSSGKWDVMRPQKGSVSGDLSSGSSVYQLNSKPTGADLLEEHLGEIRNLRQRLEESICINDRLREQLEHRLTSTARGRGSTSNFYSQGLESIPQLCNENRVLREDNRRLQAQLSHVSREHSQETESLREALLSSRSHLQELEKELEHQKVERQQLLEDLREKQQEVLHFREERLSLQENDSRLQHKLVLLQQQCEEKQQLFESLQSELQIYEALYGNSKKGLKAYSLDACHQIPLSSDLSHLVAEVRALRGQLEQSIQGNNCLRLQLQQQLESGAGKASLSPSSINQNFPASTDPGNKQLLLQDSAVSPPVRDVGMNSPALVFPSSASSTPGSETPIINRANGLGLDTSPVMKTPPKLEGDATDGSFANKHGRHVIGHIDDYSALRQQIAEGKLLVKKIVSLVRSACSFPGLEAQGTEVLGSKGIHELRSSTSALHHALEESASLLTMFWRAALPSTHIPVLPGKVGESTERELLELRTKVSKQERLLQSTTEHLKNANQQKESMEQFIVSQLTRTHDVLKKARTNLEVKSLRALPCTPAL

SEQ ID NO: 860791 - protein, 1531 aa, Homo sapiens
MQLVDPEDIPAMERLTQEVLLLREKVASVESQGQEISGNRRQQLLLMLEGLVDERSRLNEALQAERQLYSSLVKFHAHPESSERDRTLQVELEGAQVLRSRLEEVLGRSLERLNRLETLAAIGGAAAGDDTEDTSTEFTDSIEEEAAHHSHQQLVKVALEKSLATVETQNPSFSPPSPMGGDSNRCLQEEMLHLRAEFHQHLEEKRKAEEELKELKAQIEEAGFSSVSHIRNTMLSLCLENAELKEQMGEAMSDGWEIEEDKEKGEVMVETVVTKEGLSESSLQAEFRKLQGKLKNAHNIINLLKEQLVLSSKEGNSKLTPELLVHLTSTIERINTELVGSPGKHQHQEEGNVTVRPFPRPQSLDLGATFTVDAHQLDNQSQPRDPGPQSAFSLPGSTQHLRSQLSQCKQRYQDLQEKLLLSEATVFAQANELEKYRVMLTGESLVKQDSKQIQVDLQDLGYETCGRSENEAEREETTSPECEEHNSLKEMVLMEGLCSEQGRRGSTLASSSERKPLENQLGKQEEFRVYGKSENILVLRKDIKDLKAQLQNANKVIQNLKSRVRSLSVTSDYSSSLERPRKLRAVGTLEGSSPHSVPDEDEGWLSDGTGAFYSPGLQAKKDLESLIQRVSQLEAQLPKNGLEEKLAEELRSASWPGKYDSLIQDQARELSYLRQKIREGRGICYLITRHAKDTVKSFEDLLRSNDIDYYLGQSFREQLAQGSQLTERLTSKLSTKDHKSEKDQAGLEPLALRLSRELQEKEKVIEVLQAKLDARSLTPSSSHALSDSHRSPSSTSFLSDELEACSDMDIVSEYTHYEEKKASPSHSDSIHHSSHSAVLSSKPSSTSASQGAKAESNSNPISLPTPQNTPKEANQAHSGFHFHSIPKLASLPQAPLPSAPSSFLPFSPTGPLLLGCCETPVVSLAEAQQELQMLQKQLGESASTVPPASTATLLSNDLEADSSYYLNSAQPHSPPRGTIELGRILEPGYLGSSGKWDVMRPQKGSVSGDLSSGSSVYQLNSKPTGADLLEEHLGEIRNLRQRLEESICINDRLREQLEHRLTSTARGRGSTSNFYSQGLESIPQLCNENRVLREDNRRLQAQLSHVSREHSQETESLREALLSSRSHLQELEKELEHQKVERQQLLEDLREKQQEVLHFREERLSLQENDSRLQHKLVLLQQQCEEKQQLFESLQSELQIYEALYGNSKKGLKAYSLDACHQIPLSSDLSHLVAEVRALRGQLEQSIQGNNCLRLQLQQQLESGAGKASLSPSSINQNFPASTDPGNKQLLLQDSAVSPPVRDVGMNSPALVFPSSASSTPGSETPIINRANGLGLDTSPVMKTPPKLEGDATDGSFANKHGRHVIGHIDDYSALRQQIAEGKLLVKKIVSLVRSACSFPGLEAQGTEVLGSKGIHELRSSTSALHHALEESASLLTMFWRAALPSTHIPVLPGKVGESTERELLELRTKVSKQERLLQSTTEHLKNANQQKESMEQFIVSQLTRTHDVLKKARTNLEVKSLRALPCTPAL

SEQ ID NO: 860792 - protein, 1181 aa, Homo sapiens
MKEICRICARELCGNQRRWIFHTASKLNLQVLLSHVLGKDVPRDGKAEFACSKCAFMLDRIYRFDTVIARIEALSIERLQKLLLEKDRLKFCIASMYRKNNDDSGAEIKAGNGTVDMSVLPDARYSALLQEDFAYSGFECWVENEDQIQEPHSCHGSEGPGNRPRRCRGCAALRVADSDYEAICKVPRKVARSISCGPSSRWSTSICTEEPALSEVGPPDLASTKVPPDGESMEEETPGSSVESLDASVQASPPQQKDEETERSAKELGKCDCCSDDQAPQHGCNHKLELALSMIKGLDYKPIQSPRGSRLPIPVKSSLPGAKPGPSMTDGVSSGFLNRSLKPLYKTPVSYPLELSDLQELWDDLCEDYLPLRVQPMTEELLKQQKLNSHETTITQQSVSDSHLAELQEKIQQTEATNKILQEKLNEMSYELKCAQESSQKQDGTIQNLKETLKSRERETEELYQVIEGQNDTMAKLREMLHQSQLGQLHSSEGTSPAQQQVALLDLQSALFCSQLEIQKLQRVVRQKERQLADAKQCVQFVEAAAHESEQQKEASWKHNQELRKALQQLQEELQNKSQQLRAWEAEKYNEIRTQEQNIQHLNHSLSHKEQLLQEFRELLQYRDNSDKTLEANEMLLEKLRQRIHDKAVALERAIDEKFSALEEKEKELRQLRLAVRERDHDLERLRDVLSSNEATMQSMESLLRAKGLEVEQLSTTCQNLQWLKEEMETKFSRWQKEQESIIQQLQTSLHDRNKEVEDLSATLLCKLGPGQSEIAEELCQRLQRKERMLQDLLSDRNKQVLEHEMEIQGLLQSVSTREQESQAAAEKLVQALMERNSELQALRQYLGGRDSLMSQAPISNQQAEVTPTGRLGKQTDQGSMQIPSRDDSTSLTAKEDVSIPRSTLGDLDTVAGLEKELSNAKEELELMAKKERESQMELSALQSMMAVQEEELQVQAADMESLTRNIQIKEDLIKDLQMQLVDPEDIPAMERLTQEVLLLREKVASVESQGQEISGNRRQQLLLMLEGLVDERSRLNEALQAERQLYSSLVKFHAHPESSERDRTLQVELEGAQVLRSRLEEVLGRSLERLNRLETLAAIGGAAAGDDTEDTSTEFTDSIEEEAAHHSHQQLVKVALEKSLATVETQNPSFSPPSPMGGDSNRCLQEEMLHLRAEFHQQHY

SEQ ID NO: 860793 - protein, 127 aa, Homo sapiens [sequence omitted]

SEQ ID NO: 860794 - protein, 106 aa, Homo sapiens
WNLGESDVRAVEMKEAKAGAEGREGEACGTVGLLLEHSFEIDDSANFRKRGSLLWNQQDGTLSLSQRQLSEEERGRLRDVAALNGLYRVRIPRRPGALDGPPCKSI

SEQ ID NO: 860795 - protein, 286 aa, Homo sapiens
QHKTQTTESSHKIEAGGFIGEEAEMAAASAGATRLLLLLLMAVAAPSRARGSGCRAGTGARGAGAEGREGEACGTVGLLLEHSFEIDDSANFRKRGSLLWNQQDGTLSLSQRQLSEEERGRLRDVAALNGLYRVRIPRRPGALDGLEAGGYVSSFVPACSLVESHLSDQLTLHVDVAGNVVGVSVVTHPGGCRGHEVEDVDLELFNTSVQLQPPTTAPGPETAAFIERLEMEQAQKAKNPQEQKSFFAKYWMYIIPVVLFLMMSGAPDTGGQGGGGGGGGGGGSGR

SEQ ID NO: 860796 - protein, 310 aa, Homo sapiens
RPQVRTGASAQVPGPSAGARASGCGLFLPACSAALGSQPSLRWWEEAEMAAASAGATRLLLLLLMAVAAPSRARGSGCRAGTGARGAGAEGREGEACGTVGLLLEHSFEIDDSANFRKRGSLLWNQQDGTLSLSQRQLSEEERGRLRDVAALNGLYRVRIPRRPGALDGLEAGGYVSSFVPACSLVESHLSDQLTLHVDVAGNVVGVSVVTHPGGCRGHEVEDVDLELFNTSVQLQPPTTAPGPETAAFIERLEMEQAQKAKNPQEQKSFFAKYWMYIIPVVLFLMMSGAPDTGGQGGGGGGGGGGGSGR

SEQ ID NO: 860797 - protein, 358 aa, Homo sapiens
QAPGADGCQCAGAGAQRRRTGVRMRPVPPGVLRGSWLTAVPSLVGRSRDGGSQRWGNPAAPALADGGSSAQSSPGQRLPGRDWCARGECSLAVHSGRGLRMSQVLGLQAGAEGREGEACGTVGLLLEHSFEIDDSANFRKRGSLLWNQQDGTLSLSQRQLSEEERGRLRDVAALNGLYRVRIPRRPGALDGLEAGGYVSSFVPACSLVESHLSDQLTLHVDVAGNVVGVSVVTHPGGCRGHEVEDVDLELFNTSVQLQPPTTAPGPETAAFIERLEMEQAQKAKNPQEQKSFFAKYWHIILGGGRVAHSPASCCARARATATGGLMDVHHSRRPVPHDVRSARHRGPGWGWGWGWWWG

SEQ ID NO: 860798 - protein, 332 aa, Homo sapiens
QAPGADGCQCAGAGAQRRRTGVRMRPVPPGVLRGSWLTAVPSLVGRSRDGGSQRWGNPAAPALADGGSSAQSSPGQRLPGRDWCARGECSLAVHSGRGLRMSQVLGLQAGAEGREGEACGTVGLLLEHSFEIDDSANFRKRGSLLWNQQDGTLSLSQRQLSEEERGRLRDVAALNGLYRVRIPRRPGALDGLEAGGYVSSFVPACSLVESHLSDQLTLHVDVAGNVVGVSVVTHPGGCRGHEVEDVDLELFNTSVQLQPPTTAPGPETAAFIERLEMEQAQKAKNPQEQKSFFAKYWMYIIPVVLFLMMSGAPDTGGQGGGGGGGGGGGSGR

SEQ ID NO: 860799 - protein, 188 aa, Homo sapiens
AVLISLRAGRFHCYITCGGPTIYIRDVAALNGLYRVRIPRRPGALDGLEAGGYVSSFVPACSLVESHLSDQLTLHVDVAGNVVGVSVVTHPGGCRGHEVEDVDLELFNTSVQLQPPTTAPGPETAAFIERLEMEQAQKAKNPQEQKSFFAKYWMYIIPVVLFLMMSGAPDTGGQGGGGGGGGGGGSGR

SEQ ID NO: 860800 - protein, 310 aa, Homo sapiens; identical to SEQ ID NO: 860796

SEQ ID NO: 860801 - protein, 194 aa, Homo sapiens
QAPGADGCQCAGAGAQRRRTGVRMRPVPPGVLRGSWLTAVPSLVGRSRDGGSQRWGNPAAPALADGDDSANFRKRGSLLWNQQDGTLSSAFCWQRSSWTGAFGTAAGVSCARLPHGPMQPQGLPPCPWSRARDPGHYASSDLASPYPEPMQSGNMPPSLQPLCLCSRWSHPPVPGWARWSCPGSCSAPLTLTLD

SEQ ID NO: 860802 - protein, 66 aa, Homo sapiens
NTKHKQQKVVIKIEAGGFIGEEAEMAAASAGATRLLLLLLMAVAAPSRARGSGCRAGTGARGVSAL

SEQ ID NO: 860803 - protein, 267 aa, Homo sapiens
QHKTQTTESSHKIEAGGFIGEEAEMAAASAGATRLLLLLLMAVAAPSRARGSGCRAGTGARGAGAEGREGEACGTVGLLLEHSFEIDDSANFRKRGSLLWNQQDGTLSLSQRQLSEEERGRLRDVAALNGLYRVRIPRRPGALDGLEAGGYVSSFVPACSLVESHLSDQLTLHVDVAGNVVGVSVVTHPGGCRGHEVEDVDLELFNTSVQLQPPTTAPGPETAAFIERLEMEQAQKAKNPQEQKSFFAKYYEGLRAFAVCHPPCKSI

SEQ ID NO: 860804 - protein, 187 aa, Homo sapiens
QHKTQTTESSHKIEAGGFIGEEAEMAAASAGATRLLLLLLMAVAAPSRARGSGCRAGTGARGAGAEGREGEACGTVGLLLEHSFEIDDSANFRKRGSLLWNQQDGTLSLSQRQLSEEERGRLRDVAALNGLYRVRIPRRPGALDGLEAGGYVSSFVPACSLVESHLSDQLTLHVRGPAGLCCVPPSL

SEQ ID NO: 860805 - protein, 151 aa, Homo sapiens
MAAASAGATRLLLLLLMAVAAPSRARGSGCRAGTGARGAGAEGREGEACGTVGLLLEHSFEIDDSANFRKRGSLLWNQQDGTLSLSQRQLSEEERGRLRDVAALNGLYRVRIPRRPGALDGLEAGGYVSSFVPAYEGLRAFAVCHPPCKSI

SEQ ID NO: 860806 - protein, 310 aa, Homo sapiens; identical to SEQ ID NO: 860796

SEQ ID NO: 860807 - protein, 288 aa, Homo sapiens
MAAASAGATRLLLLLLMAVAAPSRARGSGCRAGTGARGAGAEGREGEACGTVGLLLEHSFEIDDSANFRKRGSLLWNQQDGTLSLSQRQLSEEERGRLRDVAALNGLYRVRIPRRPGALDGLEAGGYVSSFVPACSLVESHLSDQLTLHVDVAGNVVGVSVVTHPGGCRGHEVEDVDLELFNTSVQLQPPTTAPGPETAAFIERLEMEQAQKAKNPQEQKSFFAKYWHIILGGGRVAHSPASCCARARATATGGLMDVHHSRRPVPHDVRSARHRGPGWGWGWGWWWG

SEQ ID NO: 860808 - protein, 310 aa, Homo sapiens; identical to SEQ ID NO: 860796

SEQ ID NO: 860809 - protein, 310 aa, Homo sapiens; identical to SEQ ID NO: 860796

SEQ ID NO: 860810 - protein, 243 aa, Homo sapiens
QHKTQTTESSHKIEAGGFIGEEAEMAAASAGATRLLLLLLMAVAAPSRARGSGCRAGTGARGAGAEGREGEACGTVGLLLEHSFEIDDSANFRKRGSLLWNQQDGTLSLSQRQLSEEERGRLRDVAALNGLYRVRIPRRPGALDGLEAGGYVSSFVPACSLVESHLSDQLTLHVDVAGNVVGVSVVTHPGDGTGPEGQEPPGAEVLLRQILDVHHSRRPVPHDVRSARHRGPGWGWGWGWWWG

SEQ ID NO: 860811 - protein, 310 aa, Homo sapiens; identical to SEQ ID NO: 860796

SEQ ID NO: 860812 - protein, 310 aa, Homo sapiens; identical to SEQ ID NO: 860796

SEQ ID NO: 860813 - protein, 249 aa, Homo sapiens
MAAASAGATRLLLLLLMAVAAPSRARGSGCRAGTGARGAGAEGREGEACGTVGLLLEHSFEIDDSANFRKRGSLLWNQQDGTLSLSQRQLSEEERGRLRDVAALNGLYRVRIPRRPGALDGLEAGGYVSSFVPACSLVESHLSDQLTLHVDVAGNVVGVSVVTHPGGCRGHEVEDVDLELFNTSVQLQPPTTAPGPETAAFIERLEMEQAQKAKNPQEQKSFFAKYWMYIIPVVCSMMSRRRNRARGRG

SEQ ID NO: 860814 - protein, 605 aa, Homo sapiens
MEDVEARFAHLLQPIRDLTKNWEVDVAAQLGEYLEELDQICISFDEGKTTMNFIEAALLIQGSACVYSKKVEYLYSLVYQALDFISGKRRAKQLSSVQEDRANGVASSGVPQEAENEFLSLDDFPDSRTNVDLKNDQTPSEVLIIPLLPMALVAPDEMEKNNNPLYSRQGEVLASRKDFRMNTCVPHPRGAFMLEPEGMSPMEPAGVSPMPGTQKDTGRTEEQPMEVSVCRSPVPALGFSQEPGPSPEGPMPLGGGEDEDAEEAVELPEASAPKAALEPKESRSPQQSAALPRRYMLREREGAPEPASCVKETPDPWQSLDPFDSLESKPFKKGRPYSVPPCVEEALGQKRKRKGAAKLQDFHQWYLAAYADHADSRRLRRKGPSFADMEVLYWTHVKEQLETLRKLQRREVAEQWLRPAEEDHLEDSLEDLGAADDFLEPEEYMEPEGADPREAADLDAVPMSLSYEELVRRNVELFIATSQKFVQETELSQRIRDWEDTVQPLLQEQEQHVPFDIHTYGDQLVSRFPQLNEWCPFAELVAGQPAFEVCRSMLASLQLANDYTVEITQQPGLEMAVDTMSLRLLTHQRAHKRFQTYAAPSMAQP

SEQ ID NO: 860815 - protein, 299 aa, Homo sapiens
MEDVEARFAHLLQPIRDLTKNWEVDVAAQLGEYLEELDQICISFDEGKTTMNFIEAALLIQGSACVYSKKVEYLYSLVYQALDFISGKRRAKQLSSVQEDRANGVASSGVPQEAENEFLSLDDFPDSRTNVDLKNDQTPSEVLIIPLLPMALVAPDEMEKNNNPLYSRQGEVLASRKDFRMNTCVPHPRGAFMLEPEGMSPMEPAGVSPMPGTQKDTGRTEEQPMEVSVCRSPVPALGFSQEPGPSPEGPMPLGGGEDEDAEEAVELPEASAPKAALEPKESRSPQQVGPTWRPAEPEL

SEQ ID NO: 860816 - protein, 250 aa, Homo sapiens
MEDVEARFAHLLQPIRDLTKNWEVDVAAQLGEYLEELDQICISFDEGKTTMNFIEAALLIQGSACVYSKKVEYLYSLVYQALDFISGKRRAKQLSSVQEDRANGVASSGVPQEAENEFLSLDDFPDSRTNVDLKNDQTPSEVLIIPLLPMALVAPDEMEKNNNPLYSRQGEVLASRKDFRMNTCVPHPRGAFMLEPEGMSPMEQGVPMQDQRTRRLGSRNSGRPVKTRFQSKASEAVRGVEQLRESEAQG

SEQ ID NO: 860817 - protein, 605 aa, Homo sapiens; identical to SEQ ID NO: 860814

SEQ ID NO: 860818 - protein, 452 aa, Homo sapiens
MEDVEARFAHLLQPIRDLTKNWEVDVAAQLGEYLEELDQICISFDEGKTTMNFIEAALLIQGSACVYSKKVEYLYSLVYQALDFISGKRRAKQLSSVQEDRANGVASSGVPQEAENEFLSLDDFPDSRTNVDLKNDQTPSEVLIIPLLPMALVAPDEMEKNNNPLYSRQGEVLASRKDFRMNTCVPHPRGAFMLEPEGMSPMEPAGVSPMPGTQKDTGRTEEQPMEVSVCRSPVPALGFSQEPGPSPEGPMPLGGGEDEDAEEAVELPEASAPKAALEPKESRSPQQSAALPRRYMLREREGAPEPASCVKETPDPWQSLDPFDSLESKPFKKGRPYSVPPCVEEALGQKRKRKGAAKLQDFHQWYLAAYADHADSRRLRRKGPSFADMEVLYWTHVKEQLETLRKLQRREVAEQWLRPAEEDHLEDSLEDLGAADDFLEPNKAVLPSQKKK

SEQ ID NO: 860819 - protein, 623 aa, Homo sapiens
MEDVEARFAHLLQPIRDLTKNWEVDVAAQLGEYLEECHLLEGIQEMSQRWGRCWLDQICISFDEGKTTMNFIEAALLIQGSACVYSKKVEYLYSLVYQALDFISGKRRAKQLSSVQEDRANGVASSGVPQEAENEFLSLDDFPDSRTNVDLKNDQTPSEVLIIPLLPMALVAPDEMEKNNNPLYSRQGEVLASRKDFRMNTCVPHPRGAFMLEPEGMSPMEPAGVSPMPGTQKDTGRTEEQPMEVSVCRSPVPALGFSQEPGPSPEGPMPLGGGEDEDAEEAVELPEASAPKAALEPKESRSPQQSAALPRRYMLREREGAPEPASCVKETPDPWQSLDPFDSLESKPFKKGRPYSVPPCVEEALGQKRKRKGAAKLQDFHQWYLAAYADHADSRRLRRKGPSFADMEVLYWTHVKEQLETLRKLQRREVAEQWLRPAEEDHLEDSLEDLGAADDFLEPEEYMEPEGADPREAADLDAVPMSLSYEELVRRNVELFIATSQKFVQETELSQRIRDWEDTVQPLLQEQEQHVPFDIHTYGDQLVSRFPQLNEWCPFAELVAGQPAFEVCRSMLASLQLANDYTVEITQQPGLEMAVDTMSLRLLTHQRAHKRFQTYAAPSMAQP

SEQ ID NO: 860820 - protein, 317 aa, Homo sapiens
MEDVEARFAHLLQPIRDLTKNWEVDVAAQLGEYLEELDQICISFDEGKTTMNFIEAALLIQGSACVYSKKVEYLYSLVYQALDFISGKRRAKQLSSVQEDRANGVASSGVPQEAENEFLSLDDFPDSRTNVDLKNDQTPSEVLIIPLLPMALVAPDEMEKNNNPLYSRQGEVLASRKDFRMNTCVPHELFIATSQKFVQETELSQRIRDWEDTVQPLLQEQEQHVPFDIHTYGDQLVSRFPQLNEWCPFAELVAGQPAFEVCRSMLASLQLANDYTVEITQQPGLEMAVDTMSLRLLTHQRAHKRFQTYAAPSMAQP

SEQ ID NO: 860821 - protein, 317 aa, Homo sapiens; identical to SEQ ID NO: 860820

SEQ ID NO: 860822 - protein, 628 aa, Homo sapiens
MEDVEARFAHLLQPIRDLTKNWEVDVAAQLGEYLEELDQICISFDEGKTTMNFIEAALLIQGSACVYSKKVEYLYSLVYQALDFISGKRRAKQLSSVQEDRANGVASSGVPQEAENEFLSLDDFPDSRTNVDLKNDQTPSEVLIIPLLPMALVAPDEMEKNNNPLYSRQGEVLASRKDFRMNTCVPHPRGAFMLEPEGMSPMEPAGVSPMPGTQKDTGRTEEQPMEVSVCRSPVPALGFSQEPGPSPEGPMPLGGGEDEDAEEAVELPEASAPKAALEPKESRSPQQSAALPRRYMLREREGAPEPASCVKETPDPWQSLDPFDSLESKPFKKGRPYSVPPCVEEALGQKRKRKGAAKLQDFHQWYLAAYADHADSRRLRRKGPSFADMEVLYWTHVKEQLETLRKLQRREVAEQWLRPAEEDHLEDSLEDLGAADDFLEPEEYMEPEGADPREAADLDAVPMSLSYEELVRRNVELFIATSQKFVQETELSQRIRDWEDTVQPLLQEQEQHVPFDIHTYGDQLVSRFPQLNEWCPFAELVAGQPAFEVCRSMLASLQLVSSLGYVGGGDGPQTLLTVPPLQANDYTVEITQQPGLEMAVDTMSLRLLTHQRAHKRFQTYAAPSMAQP

SEQ ID NO: 860823 - protein, 605 aa, Homo sapiens; identical to SEQ ID NO: 860814

SEQ ID NO: 860824 - protein, 635 aa, Homo sapiens
MEDVEARFAHLLQPIRDLTKNWEVDVAAQLGEYLEELDQICISFDEGKTTMNFIEAALLIQGSACVYSKKVEYLYSLVYQALDFISGKRRAKQLSSVQEDRANGVASSGVPQEAENEFLSLDDFPDSRTNVDLKNDQTPSEVLIIPLLPMALVAPDEMEKNNNPLYSRQGEVLASRKDFRMNTCVPHPRGAFMLEPEGMSPMEPAGVSPMPGTQKDTGRTEEQPMEVSVCRSPVPALGFSQEPGPSPEGPMPLGGGEDEDAEEAVELPEASAPKAALEPKESRSPQQVGPTWRPAEPELGTGNPGSGAESPCTRRTVSAALPRRYMLREREGAPEPASCVKETPDPWQSLDPFDSLESKPFKKGRPYSVPPCVEEALGQKRKRKGAAKLQDFHQWYLAAYADHADSRRLRRKGPSFADMEVLYWTHVKEQLETLRKLQRREVAEQWLRPAEEDHLEDSLEDLGAADDFLEPEEYMEPEGADPREAADLDAVPMSLSYEELVRRNVELFIATSQKFVQETELSQRIRDWEDTVQPLLQEQEQHVPFDIHTYGDQLVSRFPQLNEWCPFAELVAGQPAFEVCRSMLASLQLANDYTVEITQQPGLEMAVDTMSLRLLTHQRAHKRFQTYAAPSMAQP

SEQ ID NO: 860825 - protein, 299 aa, Homo sapiens; identical to SEQ ID NO: 860815

SEQ ID NO: 860826 - protein, 310 aa, Homo sapiens
MLREREGAPEPASCVKETPDPWQSLDPFDSLESKPFKKGRPYSVPPCVEEALGQKRKRKGAAKLQDFHQWYLAAYADHADSRRLRRKGPSFADMEVLYWTHVKEQLETLRKLQRREVAEQWLRPAEEDHLEDSLEDLGAADDFLEPEEYMEPEGADPREAADLDAVPMSLSYEELVRRNVELFIATSQKFVQETELSQRIRDWEDTVQPLLQEQEQHVPFDIHTYGDQLVSRFPQLNEWCPFAELVAGQPAFEVCRSMLASLQLANDYTVEITQQPGLEMAVDTMSLRLLTHQRAHKRFQTYAAPSMAQP

SEQ ID NO: 860827 - protein, 153 aa, Homo sapiens
MEDVEARFAHLLQPIRDLTKNWEVDVAAQLGEYLEELDQICISFDEGKTTMNFIEAALLIQGSACVYSKKVEYLYSLVYQALDFISGKRRAKQLSSVQEDRANGVASSGVPQEAENEFLSLDDFPDSRTNVDLKNDQTPSVVLAWPLPSMAQP

SEQ ID NO: 860828 - protein, 443 aa, Homo sapiens
EGAVRTWGRGFQTEKCQASLLNFWNLPTTAQVTIEAEPTKVSKGKDVLLLVHNLPQNLAGYIWYKGQMKDLYHYITSYVVDGQIIIYGPAYSGRETVYSNASLLIQNVTREDAGSYTLHIVKRGDGTRGETGHFTFTLYRHSLDSALSLEVTGSSQPLGDTWENCPTLWLHCLMTELTSGLDSVLPCVISAEVPSPRSGFPVSKGFKDNWKFHHPSLGCPWQGKLQRKHTSGGKVRLKLRRFQHCMLQGGPQVETPKPSISSSNLYPREDMEAVSLTCDPETPDASYLWWMNGQSLPMTHSLQLSKNKRTLFLFGVTKYTAGPYECEIRNPVSASRSDPVTLNLLPKLPKPYITINNLNPRENKDVLAFTCEPKSENYTYIWWLNGQSLPVSPRVKRPIENRILILPSVTRNETGPYQCEIQDRYGGIRSYPVTLNVLYYYKA

SEQ ID NO: 860829 - protein, 450 aa, Homo sapiens
MLRKFLDPRLSSTEENTQAAETMGPLSAPPCTQRITWKGLLLTASLLNFWNLPTTAQVTIEAEPTKVSKGKDVLLLVHNLPQNLAGYIWYKGQMKDLYHYITSYVVDGQIIIYGPAYSGRETVYSNASLLIQNVTREDAGSYTLHIVKRGDGTRGETGHFTFTLYLETPKPSISSSNLYPREDMEAVSLTCDPETPDASYLWWMNGQSLPMTHSLQLSKNKRTLFLFGVTKYTAGPYECEIRNPVSASRSDPVTLNLLPKLPKPYITINNLNPRENKDVLAFTCEPKSENYTYIWWLNGQSLPVSPRVKRPIENRILILPSVTRNETGPYQCEIQDRYGGIRSYPVTLNVLYGPDLPRIYPSFTYYHSGENLYLSCFADSNPPAEYSWTINGKFQLSGQKLFIPQITTKHSGLYACSVRNSATGMESSKSMTVKVSAPSGTGHLPGLNPL

SEQ ID NO: 860830 - protein, 285 aa, Homo sapiens
WLLTRAVERQIIIASTFLAETRKTVTVFPKFRARPGSELRGQSLPMTHSLQLSKNKRTLFLFGVTKYTAGPYECEIRNPVSASRSDPVTLNLLPKLPKPYITINNLNPRENKDVLAFTCEPKSENYTYIWWLNGQSLPVSPRVKRPIENRILILPSVTRNETGPYQCEIQDRYGGIRSYPVTLNVLYGPDLPRIYPSFTYYHSGENLYLSCFADSNPPAEYSWTINGKFQLSGQKLFIPQITTKHSGLYACSVRNSATGMESSKSMTVKVSAPSGTGHLPGLNPL

SEQ ID NO: 860831 - protein, 270 aa, Homo sapiens
DSQLEAVRNQQDPLSIGCHKVYCRTGQSLPMTHSLQLSKNKRTLFLFGVTKYTAGPYECEIRNPVSASRSDPVTLNLLPKLPKPYITINNLNPRENKDVLAFTCEPKSENYTYIWWLNGQSLPVSPRVKRPIENRILILPSVTRNETGPYQCEIQDRYGGIRSYPVTLNVLYGPDLPRIYPSFTYYHSGENLYLSCFADSNPPAEYSWTINGKFQLSGQKLFIPQITTKHSGLYACSVRNSATGMESSKSMTVKVSAPSGTGHLPGLNPL

SEQ ID NO: 860832 - protein, 203 aa, Homo sapiens
LQDLCRHLHFLPKLPKPYITINNLNPRENKDVLAFTCEPKSENYTYIWWLNGQSLPVSPRVKRPIENRILILPSVTRNETGPYQCEIQDRYGGIRSYPVTLNVLYGPDLPRIYPSFTYYHSGENLYLSCFADSNPPAEYSWTINGKFQLSGQKLFIPQITTKHSGLYACSVRNSATGMESSKSMTVKVSAPSGTGHLPGLNPL

SEQ ID NO: 860833 - protein, 284 aa, Homo sapiens
MLRKFLDPRLSSTEENTQAAETMGPLSAPPCTQRITWKGLLLTASLLNFWNPPTTAQVTIEAEPTKVSKGKDVLLLVHNLPQNLAGYIWYKGQMKDLYHYITSYVVDGQIIIYGPAYSGRETVYSNASLLIQNVTREDAGSYTLHIVKRGDGTRGETGHFTFTLYLETPKPSISSSNLYPREDMEAVSLTCDPETPDASYLWWMNMVQTSPEFTLHSPITIQEKTSTCPASRTLTHQQNILGQLMGSFSYQDKSSLSPRLLQSIAGSMLALFVTQPLAWKAPNP

SEQ ID NO: 860834 - protein, 117 aa, Homo sapiens
GQVRDGGDRGYPVTLNVLYGPDLPRIYPSFTYYHSGENLYLSCFADSNPPAEYSWTINGKFQLSGQKLFIPQITTKHSGLYACSVRNSATGMESSKSMTVKVSAPSGTGHLPGLNPL

SEQ ID NO: 860835 - protein, 450 aa, Homo sapiens; identical to SEQ ID NO: 860829

SEQ ID NO: 860836 - protein, 450 aa, Homo sapiens; identical to SEQ ID NO: 860829

SEQ ID NO: 860837 - protein, 478 aa, Homo sapiens
MLRKFLDPRLSSTEENTQAAETMGPLSAPPCTQRITWKGLLLTASLLNFWNPPTTAQVTIEAEPTKVSKGKDVLLLVHNLPQNLAGYIWYKGQMKDLYHYITSYVVDGQIIIYGPAYSGRETVYSNASLLIQNVTREDAGSYTLHIVKRGDGTRGETGHFTFTLYLETPKPSISSSNLYPREDMEAVSLTCDPETPDASYLWWMNGQSLPMTHSLQLSKNKRTLFLFGVTKYTAGPYECEIRNPVSASRSDPVTLNLLPKLPKPYITINNLNPRENKDVLAFTCEPKSENYTYIWWLNGQSLPVSPRVKRPIENRILILPSVTRNETGPYQCEIQDRYGGIRSYPVTLNVLYGPDLPRIYPSFTYYHSGENLYLSCFADSNPPAEYSWTINGKFQLSGQKLFIPQITTKHSGLYACSVRNSATGMESSKSMTVKVSAPSGTGHLPGPHIRTGHEVLSPHMQLAVYPDALPSPQPHHIL

SEQ ID NO: 860838 - protein, 503 aa, Homo sapiens
MLRKFLDPRLSSTEENTQAAETMGPLSAPPCTQRITWKGLLLTASLLNFWNLPTTAQVTIEAEPTKVSKGKDVLLLVHNLPQNLAGYIWYKGQMKDLYHYITSYVVDGQIIIYGPAYSGRETVYSNASLLIQNVTREDAGSYTLHIVKRGDGTRGETGHFTFTLYLETPKPSISSSNLYPREDMEAVSLTCDPETPDASYLWWMNGQSLPMTHSLQLSKNKRTLFLFGVTKYTAGPYECEIRNPVSASRSDPVTLNLLPKLPKPYITINNLNPRENKDVLAFTCEPKSENYTYIWWLNGQSLPVSPRVKRPIENRILILPSVTRNETGPYQCEIQDRYGGIRSYPVTLNVLYGPDLPRIYPSFTYYHSGENLYLSCFADSNPPAEYSWTINGKFQLSGQKLFIPQITTKHSGLYACSVRNSATGMESSKSMTVKVSVYGISSNQGGGPWQNVTSKRETLYPRKARKVKETTAGACSLYEQESRNVQTPHALRKHSQRSRERVS

SEQ ID NO: 860839 - protein, 285 aa, Homo sapiens
MLRKFLDPRLSSTEENTQAAETMGPLSAPPCTQRITWKGLLLTASLLNFWNPPTTAQVTIEAEPTKVSKGKDVLLLVHNLPQNLAGYIWYKGQMKDLYHYITSYVVDGQIIIYGPAYSGRETVYSNASLLIQNVTREDAGSYTLHIVKRGDGTRGETGHFTFTLYLETPKPSISSSNLYPREDMEAVSLTCDPETPDASYLWWMNGQSLPMTHSLQLSKNKRTLFLFGVTKYTAGPYECEIRNPVSASRSDPVTLNLLPKLPKPVPRHSLGTNHIAWVGAQCYLK

SEQ ID NO: 860840 - protein, 293 aa, Homo sapiens
MLRKFLDPRLSSTEENTQAAETMGPLSAPPCTQRITWKGLLLTASLLNFWNPPTTAQVTIEAEPTKVSKGKDVLLLVHNLPQNLAGYIWYKGQMKDLYHYITSYVVDGQIIIYGPAYSGRETVYSNASLLIQNVTREDAGSYTLHIVKRGDGTRGETGHFTFTLYLETPKPSISSSNLYPREDMEAVSLTCDPETPDASYLWWMNGQSLPMTHSLQLSKNKRTLFLFGVTKYTAGPYECEIRNPVSASRSDPVTLNLLPKLYLTRSCTSPVAVPHPELYLTRSCTSPVAVPHP

SEQ ID NO: 860841 - protein, 90 aa, Homo sapiens
LSVFCTVETPKPSISSSNLYPREDMEAVSLTCDPETPDASYLWWMNGQSLPMTHSLQLSKNKRTLFLFGVTKYTAGPYECEIRNPVSASR

SEQ ID NO: 860842 - protein, 450 aa, Homo sapiens; identical to SEQ ID NO: 860829

SEQ ID NO: 860843 - protein, 450 aa, Homo sapiens; identical to SEQ ID NO: 860829

SEQ ID NO: 860844 - protein, 333 aa, Homo sapiens
SLTCDPETPDASYLWWMNGQSAGSYTLHIVKRGDGTRGETGHFTFTLYLETPKPSISSSNLYPREDMEAVSLTCDPETPDASYLWWMNGQSLPMTHSLQLSKNKRTLFLFGVTKYTAGPYECEIRNPVSASRSDPVTLNLLPKLPKPYITINNLNPRENKDVLAFTCEPKSENYTYIWWLNGQSLPVSPRVKRPIENRILILPSVTRNETGPYQCEIQDRYGGIRSYPVTLNVLYGPDLPRIYPSFTYYHSGENLYLSCFADSNPPAEYSWTINGKFQLSGQKLFIPQITTKHSGLYACSVRNSATGMESSKSMTVKVSAPSGTGHLPGLNPL

SEQ ID NO: 860845 - protein, 217 aa, Homo sapiens
MLRKFLDPRLSSTEENTQAAETMGPLSAPPCTQRITWKGLLLTASLLNFWNPPTTAQVTIEAEPTKVSKGKDVLLLVHNLPQNLAGYIWYKGQMKDLYHYITSYVVDGQIIIYGPAYSGRETVYSNASLLIQNVTREDAGSYTLHIVKRGDGTRGETGHFTFTLYLETPKPSISSSNLYPREDMEAVSLTCDPETPDASYLWWMNRSCPSPTSPSTT

SEQ ID NO: 860846 - protein, 357 aa, Homo sapiens
MLRKFLDPRLSSTEENTQAAETMGPLSAPPCTQRITWKGLLLTASLLNFWNLPTTAQVTIEAEPTKVSKGKDVLLLVHNLPQNLAGYIWYKGQMKDLYHYITSYVVDGQIIIYGPAYSGRETVYSNASLLIQNVTREDAGSYTLHIVKRGDGTRGETGHFTFTLYLETPKPSISSSNLYPREDMEAVSLTCDPETPDASYLWWMNGQSLPMTHSLQLSKNKRTLFLFGVTKYTAGPYECEIRNPVSASRSDPVTLNLLHGPDLPRIYPSFTYYHSGENLYLSCFADSNPPAEYSWTINGKFQLSGQKLFIPQITTKHSGLYACSVRNSATGMESSKSMTVKVSAPSGTGHLPGLNPL

SEQ ID NO: 860847 - protein, 111 aa, Homo sapiens
GIRSYPVALNLLYGPDLPRIYPSFTYYHSGENLYLSCFADSNPPAEYSWTINGKFQLSGQKLFIPQITTKHSGLYACSVRNSATGMESSKSMTVKVSAPSGTGHLPGLNPL

SEQ ID NO: 860848 - protein, 365 aa, Homo sapiens
MLRKFLDPRLSSTEENTQAAETMGPLSAPPCTQRITWKGLLLTASLLNFWNPPTTAQVTIEAEPTKVSKGKDVLLLVHNLPQNLAGYIWYKGQMKDLYHYITSYVVDGQIIIYGPAYSGRETVYSNASLLIQNVTREDAGSYTLHIVKRGDGTRGETGHFTFTLYLETPKPSISSSNLYPREDMEAVSLTCDPETPDASYLWWMNGQSLPMTHSLQLSKNKRTLFLFGVTKYTAGPYECEIRNPVSASRSDPVTLNLLPKLPKPYITINNLNPRENKDVLAFTCEPKSENYTYIWWLNGQSLPVSPRVKRPIENRILILPSVTRNETGPYQCEIQDRYGGIRSYPVTLNVLSPSGTGHLPGLNPL

SEQ ID NO: 860849 - protein, 180 aa, Homo sapiens
MLRKFLDPRLSSTEENTQAAETMGPLSAPPCTQRITWKGLLLTASLLNFWNLPTTAQVTIEAEPTKVSKGKDVLLLVHNLPQNLAGYIWYKGQMKDLYHYITSYVVDGQIIIYGPAYSGRETVYSNASLLIQNVTREDAGSYTLHIVKRGDGTRGETGHFTFTLYLKTPEPSISSSYTDG

SEQ ID NO: 860850 - protein, 71 aa, Homo sapiens
ATAVTDGRSCLCWELVARCRALKNERLGRGLVSGDCDLQGPPWSQSRCWRDKRRLQKILTLSTVSQTTLRE

SEQ ID NO: 860851 - protein, 71 aa, Homo sapiens; identical to SEQ ID NO: 860850

SEQ ID NO: 860852 - protein, 71 aa, Homo sapiens; identical to SEQ ID NO: 860850

SEQ ID NO: 860853 - protein, 71 aa, Homo sapiens; identical to SEQ ID NO: 860850

SEQ ID NO: 860854 - protein, 70 aa, Homo sapiens
ATAVTDGRSCLCWELVARCRALKNERLGRGLVSGDCDLQGPPWSQSRCWRDKRRLQKILTLSTVSQTTLR

SEQ ID NO: 860855 - protein, 99 aa, Homo sapiens
MEPEQMLEGQTQVAENPHSEYGLTDNVERIVENEKINAEKSSKQKVDLQSLPTRAYLDQTVVPILLQGLAVLAKERPPNPIEFLASYLLKNKAQFEDRN

SEQ ID NO: 860856 - protein, 97 aa, Homo sapiens
HHNRHITDRMHRLQDDTLHRRVHQFIRIVENEKINAEKSSKQKVDLQSLPTRAYLDQTVVPILLQGLAVLAKERPPNPIEFLASYLLKNKAQFEDRN

SEQ ID NO: 860857 - protein, 96 aa, Homo sapiens
MEPEQMLEGQTQVAENPHSENRVGELPLFEPLPGPTLTQGGKLGDVSGGLETESSNGKDTLEGAGDTSEVMDTQAGSVDEENGRQLGEVELQCGIC

SEQ ID NO: 860858 - protein, 71 aa, Homo sapiens; identical to SEQ ID NO: 860850

SEQ ID NO: 860859 - protein, 71 aa, Homo sapiens; identical to SEQ ID NO: 860850

SEQ ID NO: 860860 - protein, 93 aa, Homo sapiens
ATAVTDGRSCLCWELVARCRALKNERLGRGLVSGDCDLQGPPWSQSRCWRDKRRLQKILTLSTVSQTTLRPPNPIEFLASYLLKNKAQFEDRN

SEQ ID NO: 860861 - protein, 71 aa, Homo sapiens; identical to SEQ ID NO: 860850

SEQ ID NO: 860862 - protein, 71 aa, Homo sapiens; identical to SEQ ID NO: 860850

SEQ ID NO: 860863 - protein, 99 aa, Homo sapiens; identical to SEQ ID NO: 860855

SEQ ID NO: 860864 - protein, 105 aa, Homo sapiens
MAKSGLRQDPQSTAAATVLKRAVELDSESRYPQALVCYQEGIDLLLQVLKGTKDNTKRCNLREKISKYMDRAENIKKYLDQEKEEAKETPGISLRFCCESKHLRS

SEQ ID NO: 860865 - protein, 295 aa, Homo sapiens
RRSERDLQTEAFLFRRNPSHSGKSLERERRRPGYHMTTSRKRSRPAQLHPGLRRRRTSRIMAKSGLRQDPQSTAAATVLKRAVELDSESRYPQALVCYQEGIDLLLQVLKGTKDNTKRCNLREKISKYMDRAENIKKYLDQEKEDGKYHKQIKIEENATGFSYESLFREYLNETVTEVWIEDPYIRHTHQLYNFLRFCEMLIKRPCKVKTIHLLTSLDEGIEQVQQSRGLQEIEESLRSHGVLLEVQYSSSIHDREIRFNNGWMIKIGRGLDYFKKPQVGYNLMSKCVALFLYHF

SEQ ID NO: 860866 - protein, 266 aa, Homo sapiens
MAKSGLRQDPQSTAAATVLKRAVELDSESRYPQALVCYQEGIDLLLQVLKGTKDNTKRCNLREKISKYMDRAENIKKYLDQEKEDGKYHKQIKIEENATGFSYESLFREYLNETVTEVWIEDPYIRHTHQLYNFLRFCEMLIKRPCKVKTIHLLTSLDEGIEQVQQSRGLQEIEESLRSHGVLLEVQYSSSIHDREIRFNNGWMIKIGRGLDYFKKPQTGFHHVAQAGLKLLGSSSPPTLASQSAGITGMSHCTQPHYLYLKAKLC

SEQ ID NO: 860867 - protein, 220 aa, Homo sapiens
MAKSGLRQDPQSTAAATVLKRAVELDSESRYPQALVCYQEGIDLLLQVLKGTKDNTKRCNLREKISKYMDRAENIKKYLDQEKEDGKYHKQIKIEENATGFSYESLFREYLNETVTEVWIEDPYIRHTHQGIEQVQQSRGLQEIEESLRSHGVLLEVQYSSSIHDREIRFNNGWMIKIGRGLDYFKKPQSRFSLGYCDFDLRPCHETTVDIFHKKHTKNI

SEQ ID NO: 860868 - protein, 309 aa, Homo sapiens
RRSERDLQTEAFLFRRNPSHSGKSLERERRRPGYHMTTSRKRSRPAQLHPGLRRRRTSRIMAKSGLRQDPQSTAAATVLKRAVELDSESRYPQALVCYQEGIDLLLQVLKGTKDNTKRCNLREKISKYMDRAENIKKYLDQEKEDGKYHKQIKIEENATGFSYESLFREYLNETVTEVWIEDPYIRHTHQLYNFLRFCEMLIKRPCKVKTIHLLTSLDEGIEQVQQSRGLQEIEESLRSHGVLLEVQYSSSIHDREIRFNNGWMIKIGRGLDYFKKPQSRFSLGYCDFDLRPCHETTVDIFHKKHTKNI

SEQ ID NO: 860869 - protein, 249 aa, Homo sapiens
MAKSGLRQDPQSTAAATVLKRAVELDSESRYPQALVCYQEGIDLLLQVLKGTKDNTKRCNLREKISKYMDRAENIKKYLDQEKEDGKYHKQIKIEENATGFSYESLFREYLNETVTEVWIEDPYIRHTHQLYNFLRFCEMLIKRPCKVKTIHLLTSLDEGIEQVQQSRGLQEIEESLRSHGVLLEVQYSSSIHDREIRFNNGWMIKIGRGLDYFKKPQSRFSLGYCDFDLRPCHETTVDIFHKKHTKNI

SEQ ID NO: 860870 - protein, 127 aa, Homo sapiens [sequence omitted]

SEQ ID NO: 860871 - protein, 296 aa, Homo sapiens
RRSERDLQTEAFLFRRNPSHSGKSLERERRRPGYHMTTSRKRSRPAQLHPGLRRRRTSRIMAKSGLRQDPQSTAAATVLKRAVELDSESRYPQALVCYQEGIDLLLQVLKGTKDNTKRCNLREKISKYMDRAENIKKYLDQEKEDGKYHKQIKIEENATGFSYESLFREYLNETVTEVWIEDPYIRHTHQLYNFLRFCEMLIKRPCKVKTIHLLTSLDEGIEQVQQSRGLQEIEESLRSHGVLLEVQYSSSIHDREIRFNNGWMIKIGRGLDYFKKPQVQVLIILNLKNFRLKLIY

SEQ ID NO: 860872 - protein, 105 aa, Homo sapiens; identical to SEQ ID NO: 860864

SEQ ID NO: 860873 - protein, 127 aa, Homo sapiens [sequence omitted]

SEQ ID NO: 860874 - protein, 97 aa, Homo sapiens
FPGRHLTRGLKMLHSIVSRIGSFRWVLGLTDFKNEATDPCGCSHSLEVSSLTCSTINLYSPFKAQLKCPLPQKPSTSPEGITEPHFQDEPTALHTMS

SEQ ID NO: 860875 - protein, 79 aa, Homo sapiens
FPGRHLTRGLKMLHSIVSRIGSFRWVLGLTDFKNEATDPCVTSTSSAKPTSLSRLIPRPSLSKTFQVNRQPSSAAVSRN

SEQ ID NO: 860876 - protein, 306 aa, Homo sapiens
MDTPPLSDSESESDESLVTDRELQDAFSRGLLKPGLNVVLEGPKKAVNDVNGLKQCLAEFKRDLEWVERLDVTLGPVPEIGGSEAPAPQNKDQKAVDPEDDFQREMSFYRQAQAAVLAVLPRLHQLKVPTKRPTDYFAEMAKSDLQMQKIRQKLQTKQAAMERSEKAKQLRALRKYGKKVQTEVLQKRQQEKAHMMNAIKKYQKGFSDKLDFLEGDQKPLAQRKKAGAKGQQMRKGPSAKRRYKNQKFGFGGKKKGSKWNTRESYDDVSSFRAKTAHGRGLKRPGKKGSNKRPGKRTREKMKNRTH

SEQ ID NO: 860877 - protein, 306 aa, Homo sapiens; identical to SEQ ID NO: 860876

SEQ ID NO: 860878 - protein, 306 aa, Homo sapiens; identical to SEQ ID NO: 860876

SEQ ID NO: 860879 - protein, 292 aa, Homo sapiens
MDTPPLSDSESESDESLVTDRELQDAFSRGLLKPGLNVVLEGPKKAVNDVNGLKQCLAEFKRDLEWVERLDVTLGPVPEIGGSEAPAPQNKDQKAVDPEDDFQREMSFYRQAQAAVLAVLPRLHQLKVPTKRPTDYFAEMAKSDLQMQKIRQKLQTKQAAMERSEKAKQLRALRKYGKKVQTEVLQKRQQEKAHMMNAIKKYQKGFSDKLDFLEGDQKPLAQRKKAGAKGQQMRKGPSAKRRYKNQKFGFGGKKKGSKWNTRESYDDVSSFRAKTAHGRGLKRPGKKGSNCK

SEQ ID NO: 860880 - protein, 292 aa, Homo sapiens; identical to SEQ ID NO: 860879

SEQ ID NO: 860881 - protein, 312 aa, Homo sapiens
MDTPPLSDSESESDESLVTDRELQDAFSRGLLKPGLNVVLEGPKKAVNDVNGLKQCLAEFKRDLEWVERLDVTLGPVPEIGGSEAPAPQNKDQKAVDPEDDFQREMSFYRQAQAAVLAVLPRLHQLKVPTKRPTDYFAEMAKSDLQMQKIRQKLQTKQAAMERSEKAKQLRALRKYGKKVQTEVLQKRQQEKAHMMNAIKKYQKGFSDKLDFLEGDQKPLAQRKKAGAKGQQMRKGPTGPQRIEKGKGPVLNDGIKTRSLVLVERRKAQSGTLGRAMMMYLASGPRQLMAEASRGLARKGQIRDLENEQERR

SEQ ID NO: 860882 - protein, 361 aa, Homo sapiens
MYPEALPVGILSNPDTFKRRSGSYSNDKPEVWFAAGSGSPNQKLSSSCVGRACGEMDTPPLSDSESESDESLVTDRELQDAFSRGLLKPGLNVVLEGPKKAVNDVNGLKQCLAEFKRDLEWVERLDVTLGPVPEIGGSEAPAPQNKDQKAVDPEDDFQREMSFYRQAQAAVLAVLPRLHQLKVPTKRPTDYFAEMAKSDLQMQKIRQKLQTKQAAMERSEKAKQLRALRKYGKKVQTEVLQKRQQEKAHMMNAIKKYQKGFSDKLDFLEGDQKPLAQRKKAGAKGQQMRKGPSAKRRYKNQKFGFGGKKKGSKWNTRESYDDVSSFRAKTAHGRGLKRPGKKGSNKRPGKRTREKMKNRTH

SEQ ID NO: 860883 - protein, 321 aa, Homo sapiens
SSRMYWYHTSPRLSGFASRDLLHVIPLHHSTADVVRMSSPRKVFCNQGSCVMTTEGRKKAVHYDVNGLKQCLAEFKRDLEWVERLDVTLGPVPEIGGSEAPAPQNKDQKAVDPEDDFQREMSFYRQAQAAVLAVLPRLHQLKVPTKRPTDYFAEMAKSDLQMQKIRQKLQTKQAAMERSEKAKQLRALRKYGKKVQTEVLQKRQQEKAHMMNAIKKYQKGFSDKLDFLEGDQKPLAQRKKAGAKGQQMRKGPSAKRRYKNQKFGFGGKKKGSKWNTRESYDDVSSFRAKTAHGRGLKRPGKKGSNKRPGKRTREKMKNRTH

SEQ ID NO: 860884 - protein, 331 aa, Homo sapiens
MDTPPLSDSESESDESLVTDRELQDAFSRGLLKPGLNVVLEGPKKAVNDVNGLKQCLAEFKRDLEWVERLDVTLGPVPEIGGSEAPAPQNKDQKAVDPEDDFQREMSFYRQAQAAVLAVLPRLHQLKVPTKRPTDYFAEMAKSDLQMQKIRQKLQTKQAAMERSEKAKQLRALRKYGKKVQTEVLQKRQQEKAHMMNAIKKYQKGPDNWILEGDRNSGQGQDGGAKATDIGRGQGKDGINQKVGGRVATTQRPQGRTPGSTQYRSTYNRRQTTIAEPQDGNKHNHTRTADNQSRPQTRHTHTTTRQPTSAMAIQQKKSTEHVIDERRTDVL

SEQ ID NO: 860885 - protein, 167 aa, Homo sapiens [sequence omitted]

SEQ ID NO: 860886 - protein, 209 aa, Homo sapiens
MLSNIGRQKQFLSQGWSSFGFRLPRLHQLKVPTKRPTDYFAEMAKSDLQMQKIRQKLQTKQAAMERSEKAKQLRALRKYGKKVQTEVLQKRQQEKAHMMNAIKKYQKGFSDKLDFLEGDQKPLAQRKKAGAKGQQMRKGPSAKRRYKNQKFGFGGKKKGSKWNTRESYDDVSSFRAKTAHGRGLKRPGKKGSNKRPGKRTREKMKNRTH

SEQ ID NO: 860887 - protein, 79 aa, Homo sapiens; identical to SEQ ID NO: 860875

SEQ ID NO: 860888 - protein, 49 aa, Homo sapiens
GKAHLPLSLDSPAILIKDLPGEQAAILSSSQQELIIKGKQHLKRKRVMA

SEQ ID NO: 860889 - protein, 327 aa, Homo sapiens
MDTPPLSDSESESDESLVTDRELQDAFSRGLLKPGLNVVLEGPKKAVNDVNGLKQCLAEFKRDLEWVERLDVTLGPVPEIGGSEAPAPQNKDQKAVDPEDDFQREMSFYRQAQAAVLAVLPRLHQLKVPTKRPTDYFAEMAKSDLQMQKIRQKLQTKQAAMERSEKAKQLRALRKYGKKVQTEVLQKRQQEKAHMMNAIKKYQKGFSDKLDFLEGDQKPLAQRKKAGAKGQQMRKGPSAKRRYKNQKFGFGGKKKGSKWNTRESYDDVSSFRAKTAHGRGLKRPGKKGSNKRPGKRTREKMKPTHPINSLFGMFDSIQKQLILAVQV

SEQ ID NO: 860890 - protein, 311 aa, Homo sapiens
MDTPPLSDSESESDESLVTDRELQDAFSRGLLKPGLNVVLEGPKKAVNDVNGLKQCLAEFKRDLEWVERLDVTLGPVPEIGGSEAPAPQNKDQKAVDPEDDFQREMSFYRQAQAAVLAVLPRLHQLKVPTKRPTDYFAEMAKSDLQMQKIRQKLQTKQAAMERSEKAKQLRALRKYGKKVQTEVLQKRQQEKAHMMNAIKKYQKGFSDKLDFLEGDQKPLAQRKKAGAKGQQMRKGPSAKRRYKNQKFGFGGKKKGSKWNTRESYDDVSSFRAKTAHGRGLKRPGKKGSNLEDWKEQESEKTLMHLVQDRK

SEQ ID NO: 860891 - protein, 304 aa, Homo sapiens
MDTPPLSDSESESDESLVTDRELQDAFSRGLLKPGLNVVLEGPKKAVNDVNGLKQCLAEFKRDLEWVERLDVTLGPVPEIGGSEAPAPQNKDQKAVDPEDDFQREMSFYRQAQAAVLAVLPRLHQLKVPTKRPTDYFAEMAKSDLQMQKIRQKLQTKQAAMERSEKAKQLRALRKYGKKVQTEVLQKRQQEKAHMMNAIKKYQKGFSDKLDFLEGDQKPLAQRKKAGAKGQQMRKGPSAKRRYKNQKFGFGGKKKGSKWNTRESYDDVSSFRAKTAHGRGLKRPGKKGSNFCSSSPWGRRQAAM

SEQ ID NO: 860892 - protein, 201 aa, Homo sapiens [sequence omitted]

SEQ ID NO: 860893 - protein, 329 aa, Homo sapiens
MDTPPLSDSESESDESLVTDRELQDAFSRGLLKPGLNVVLEGPKKAVNDVNGLKQCLAEFKRDLEWVERLDVTLGPVPEIGGSEAPAPQNKDQKAVDPEDDFQREMSLYVCFQMLEKLRILVQESGKRGNYYRQAQAAVLAVLPRLHQLKVPTKRPTDYFAEMAKSDLQMQKIRQKLQTKQAAMERSEKAKQLRALRKYGKKVQTEVLQKRQQEKAHMMNAIKKYQKGFSDKLDFLEGDQKPLAQRKKAGAKGQQMRKGPSAKRRYKNQKFGFGGKKKGSKWNTRESYDDVSSFRAKTAHGRGLKRPGKKGSNKRPGKRTREKMKNRTH

SEQ ID NO: 860894 - protein, 167 aa, Homo sapiens [sequence omitted]

SEQ ID NO: 860895 - protein, 137 aa, Homo sapiens
MDTPPLSDSESESDESLVTDRELQDAFSRGLLKPGLNVVLEGPKKAVNDVNGLKQCLAEFKRDLEWVERLDVTLGPVPEIGGSEAPAPQNKDQKAVDPEDDFQREMSLYVCFQMLEKLRILVQESGKEGKLVSLHSE

SEQ ID NO: 860896 - protein, 79 aa, Homo sapiens; identical to SEQ ID NO: 860875

SEQ ID NO: 860897 - protein, 561 aa, Homo sapiens
RHPGQKSPGQWRARHYPCGQAEVSARRPDGRDGRGGRRAPWRALTSASPRAALPQAQCPELGASPARGTLLAKEVVSPVLSSRPGGPKLPDDEEPPNMASESGKLWGGRFVGAVDPIMEKFNASIAYDRHLWEVDVQGSKAYSRGLEKAGLLTKAEMDQILHGLDKVAEEWAQGTFKLNSNDEDIHTANERRLKELIGATAGKLHTGRSRNDQVVTDLRLWMRQTCSTLSGLLWELIRTMVDRAEAERDVLFPGYTHLQRAQPIRWSHWILSHAVALTRDSERLLEVRKRINVLPLGSGAIAGNPLGVDRELLRAELNFGAITLNSMDATSERDFVAEFLFWASLCMTHLSRMAEDLILYCTKEFSFVQLSDAYSTGSSLMPQKKNPDSLELIRSKAGRVFGRCAGLLMTLKGLPSTYNKDLQEDKEAVFEVSDTMSAVLQVATGVISTLQIHQENMGQALSPDMLATDLAYYLVRKGMPFRQAHEASGKAVFMAETKGVALNQLSLQELQTISPLFSGDVICVWDYGHSVEQYGALGGTARSSVDWQIRQVRALLQAQQA

SEQ ID NO: 860898 - protein, 594 aa, Homo sapiens
RHPGQKSPGQWRARHYPCGQAEVSARRPDGRDGRGGRRAPWRALTSASPRAALPQAQCPELGASPARGTLLAKEVVSPVLSSRPGGPKLPDDEEPPNMASESGKLWGGRFVGAVDPIMEKFNASIAYDRHLWEVDVQGSKAYSRGLEKAGLLTKAEMDQILHGLDKVAEEWAQGTFKLNSNDEDIHTANERRLKELIGATAGKLHTGRSRNDQVVTDLRLWMRQTCSTLSGLLWELIRTMVDRAEAERDVLFPGYTHLQRAQPIRWSHWILSHAVALTRDSERLLEVRKRINVLPLGSGAIAGNPLGVDRELLRAELNFGAITLNSMDATSERDFVAEFLFWASLCMTHLSRMAEDLILYCTKEFSFVQLSDAYSTGSSLMPQKKNPDSLELIRSKAGRVFGRVSKAGGGAGPLGCWWVARGAGSRVQPLCLPLPACAGLLMTLKGLPSTYNKDLQEDKEAVFEVSDTMSAVLQVATGVISTLQIHQENMGQALSPDMLATDLAYYLVRKGMPFRQAHEASGKAVFMAETKGVALNQLSLQELQTISPLFSGDVICVWDYGHSVEQYGALGGTARSSVDWQIRQVRALLQAQQA

SEQ ID NO: 860899 - protein, 444 aa, Homo sapiens [sequence omitted]

SEQ ID NO: 860900 - protein, 535 aa, Homo sapiens
RHPGQKSPGQWRARHYPCGQAEVSARRPDGRDGRGGRRAPWRALTSASPRAALPQAQCPELGASPARGTLLAKEVVSPVLSSRPGGPKLPDDEEPPNMASESGKLWGGRFVGAVDPIMEKFNASIAYDRHLWEVDVQGSKAYSRGLEKAGLLTKAEMDQILHGLDKVAEEWAQGTFKLNSNDEDIHTANERRLKELIGATAGKLHTGRSRNDQVVTDLRLWMRQTCSTLSGLLWELIRTMVDRAEAERDVLFPGYTHLQRAQPIRWSHWILSGAIAGNPLGVDRELLRAELNFGAITLNSMDATSERDFVAEFLFWASLCMTHLSRMAEDLILYCTKEFSFVQLSDAYSTGSSLMPQKKNPDSLELIRSKAGRVFGRCAGLLMTLKGLPSTYNKDLQEDKEAVFEVSDTMSAVLQVATGVISTLQIHQENMGQALSPDMLATDLAYYLVRKGMPFRQAHEASGKAVFMAETKGVALNQLSLQELQTISPLFSGDVICVWDYGHSVEQYGALGGTARSSVDWQIRQVRALLQAQQA

SEQ ID NO: 860901 - protein, 462 aa, Homo sapiens
RHPGQKSPGQWRARHYPCGQAEVSARRPDGRDGRGGRRAPWRALTSASPRAALPQAQCPELGASPARGTLLAKEVVSPVLSSRPGGPKLPDDEEPPNMASESGKLWGGRFVGAVDPIMEKFNASIAYDRHLWEVDVQGSKAYSRGLEKAGLLTKAEMDQILHGLDKVAEEWAQGTFKLNSNDEDIHTANERRLKELIGATAGKLHTGRSRNDQVVTDLRLWMRQTCSTLSGLLWELIRTMVDRAEAERDVLFPGYTHLQRAQPIRWSHWILSHAVALTRDSERLLEVRKRINVLPLGSGAIAGNPLGVDRELLRAELNFGAITLNSMDATSERDFVAEFLFWASLCMTHLSRMAEDLILYCTKEFSFVQLSDAYSTGSSLMPQKKNPDSLELIRSKAGRVFGRCAGLLMTLKGLPSTYNKDLQCGAVWCPGRHCALQRRLADPPGAGATAGTAGLGPPTPAP

SEQ ID NO: 860902 - protein, 708 aa, Homo sapiens
RHPGQKSPGQWRARHYPCGQAEVSARRPDGRDGRGGRRAPWRALTSASPRAALPQAQCPELGASPARGTLLAKEVVSPVLSSRPGGPKLPDDEEPPNMASESGKLWGGRFVGAVDPIMEKFNASIAYDRHLWEVDVQGSKAYSRGLEKAGLLTKAEMDQILHGLDKVAEEWAQGTFKLNSNDEDIHTANERRLKELIGATAGKLHTGRSRNDQVVTDLRLWMRQTCSTLSGLLWELIRTMVDRAEAERDVLFPGYTHLQRAQPIRWSHWILSHAVALTRDSERLLEVRKRINVLPLGSGAIAGNPLGVDRELLRAGETSCPSSPGRITLSTRQDLQTHLKPEGRGLWLLVKPSFIAYGPEVIKFRGHSWQGCLVLRDSGLLPPSWDCAKDPSPQLLPHPDQEEGAGQPSWGRGGHSLSSSLALLPPTPPELNFGAITLNSMDATSERDFVAEFLFWASLCMTHLSRMAEDLILYCTKEFSFVQLSDAYSTGSSLMPQKKNPDSLELIRSKAGRVFGRVSKAGGGAGPLGCWWVARGAGSRVQPLCLPLPACAGLLMTLKGLPSTYNKDLQEDKEAVFEVSDTMSAVLQVATGVISTLQIHQENMGQALSPDMLATDLAYYLVRKGMPFRQAHEASGKAVFMAETKGVALNQLSLQELQTISPLFSGDVICVWDYGHSVEQYGALGGTARSSVDWQIRQVRALLQAQQA

SEQ ID NO: 860903 - protein, 328 aa, Homo sapiens
GTHRDREGESEGETEMEYYQRDTHLQRAQPIRWSHWILSHAVALTRDSERLLEVRKRINVLPLGSGAIAGNPLGVDRELLRAELNFGAITLNSMDATSERDFVAEFLFWASLCMTHLSRMAEDLILYCTKEFSFVQLSDAYSTGSSLMPQKKNPDSLELIRSKAGRVFGRCAGLLMTLKGLPSTYNKDLQEDKEAVFEVSDTMSAVLQVATGVISTLQIHQENMGQALSPDMLATDLAYYLVRKGMPFRQAHEASGKAVFMAETKGVALNQLSLQELQTISPLFSGDVICVWDYGHSVEQYGALGGTARSSVDWQIRQVRALLQAQQA

SEQ ID NO: 860904 - protein, 235 aa, Homo sapiens [sequence omitted]

SEQ ID NO: 860905 - protein, 359 aa, Homo sapiens
RHPGQKSPGQWRARHYPCGQAEVSARRPDGRDGRGGRRAPWRALTSASPRAALPQAQCPELGASPARGTLLAKEVVSPVLSSRPGGPKLPDDEEPPNMASESGKLWGGRFVGAVDPIMEKFNASIAYDRHLWEVDVQGSKAYSRGLEKAGLLTKAEMDQILHGLDKVAEEWAQGTFKLNSNDEDIHTANERRLKELIGATAGKLHTGRSRNDQVVTDLRLWMRQTCSTLSGLLWELIRTMVDRAEAERDVLFPGYTHLQRAQPIRWSHWILSHAVALTRDSERLLEVRKRINVLPLGSGAIAGNPLGVDRELLRAGETSCPSSPGRITLSTRQDLQTHLKPEGRGLWLLVKPSFIAYGH

SEQ ID NO: 860906 - protein, 196 aa, Homo sapiens
MGKVGGAWWFTMPSTGQHGETPSLLRIQNLAGCVVAGACNPSYSGVLRPENHLNPGGGGCSEPRSRQCTPAWATRAKLHLKKKKKKKEGGAGNGGRSGHGETCLSAIFLPGTQMPFRQAHEASGKAVFMAETKGVALNQLSLQELQTISPLFSGDVICVWDYGHSVEQYGALGGTARSSVDWQIRQVRALLQAQQA

SEQ ID NO: 860907 - protein, 501 aa, Homo sapiens
DAIPARKALASGGRDTIRAARRRPGGPKLPDDEEPPNMASESGKLWGGRFVGAVDPIMEKFNASIAYDRHLWEVDVQGSKAYSRGLEKAGLLTKAEMDQILHGLDKVAEEWAQGTFKLNSNDEDIHTANERRLKELIGATAGKLHTGRSRNDQVVTDLRLWMRQTCSTLSGLLWELIRTMVDRAEAERDVLFPGYTHLQRAQPIRWSHWILSHAVALTRDSERLLEVRKRINVLPLGSGAIAGNPLGVDRELLRAELNFGAITLNSMDATSERDFVAEFLFWASLCMTHLSRMAEDLILYCTKEFSFVQLSDAYSTGSSLMPQKKNPDSLELIRSKAGRVFGRCAGLLMTLKGLPSTYNKDLQEDKEAVFEVSDTMSAVLQVATGVISTLQIHQENMGQALSPDMLATDLAYYLVRKGMPFRQAHEASGKAVFMAETKGVALNQLSLQELQTISPLFSGDVICVWDYGHSVEQYGALGGTARSSVDWQIRQVRALLQAQQA

SEQ ID NO: 860908 - protein, 317 aa, Homo sapiens
DAIPARKALASGGRDTIRAARRRPGGPKLPDDEEPPNMASESGKLWGGRFVGAVDPIMEKFNASIAYDRHLWEVDVQGSKAYSRGLEKAGLLTKAEMDQILHGLDKVAEEWAQGTFKLNSNDEDIHTANERRLKELIGATAGKLHTGRSRNDQVVTDLRLWMRQTCSTLSGLLWELIRTMVDRAEAERDVLFPGYTHLQRAQPIRWSHWILSHAVALTRDSERLLEVRKRINVLPLGSGAIAGNPLGVDRELLRAELNFGAITLNSMDATSERDFVAEFLFWASLCMTHLSRMARPIFLAKDSRRRLNLRREQLCQK

SEQ ID NO: 860909 - protein, 561 aa, Homo sapiens; identical to SEQ ID NO: 860897

SEQ ID NO: 860910 - protein, 561 aa, Homo sapiens; identical to SEQ ID NO: 860897

SEQ ID NO: 860911 - protein, 411 aa, Homo sapiens
RHPGQKSPGQWRARHYPCGQAEVSARRPDGRDGRGGRRAPWRALTSASPRAALPQAQCPELGASPARGTLLAKEVVSPVLSSRPGGPKLPDDEEPPNMASESGKLWGGRFVGAVDPIMEKFNASIAYDRHLWEVDVQGSKAYSRGLEKAGLLTKAEMDQILHGLDKVAEEWAQGTFKLNSNDEDIHTANERRLKELIGATAGKLHTGRSRNDQVVTDLRLWMRQTCSTLSGLLWELIRTMVDRAEAERDVLFPGYTHLQRAQPIRWSHWILSHAVALTRDSERLLEVRKRINVLPLGSGAIAGNPLGVDRELLRAELNFGAITLNSMDATSERDFVAEFLFWASLCMTHLSRMAEDLILYCTKEFSFVQLSDAYSTGSSLMPQKMCRAPDDPQGTSQHLQQRLTGGQGSCV

SEQ ID NO: 860912 - protein, 675 aa, Homo sapiens
RHPGQKSPGQWRARHYPCGQAEVSARRPDGRDGRGGRRAPWRALTSASPRAALPQAQCPELGASPARGTLLAKEVVSPVLSSRPGGPKLPDDEEPPNMASESGKLWGGRFVGAVDPIMEKFNASIAYDRHLWEVDVQGSKAYSRGLEKAGLLTKAEMDQILHGLDKVAEEWAQGTFKLNSNDEDIHTANERRLKELIGATAGKLHTGRSRNDQVVTDLRLWMRQTCSTLSGLLWELIRTMVDRAEAERDVLFPGYTHLQRAQPIRWSHWILSHAVALTRDSERLLEVRKRINVLPLGSGAIAGNPLGVDRELLRAGETSCPSSPGRITLSTRQDLQTHLKPEGRGLWLLVKPSFIAYGPEVIKFRGHSWQGCLVLRDSGLLPPSWDCAKDPSPQLLPHPDQEEGAGQPSWGRGGHSLSSSLALLPPTPPELNFGAITLNSMDATSERDFVAEFLFWASLCMTHLSRMAEDLILYCTKEFSFVQLSDAYSTGSSLMPQKKNPDSLELIRSKAGRVFGRCAGLLMTLKGLPSTYNKDLQEDKEAVFEVSDTMSAVLQVATGVISTLQIHQENMGQALSPDMLATDLAYYLVRKGMPFRQAHEASGKAVFMAETKGVALNQLSLQELQTISPLFSGDVICVWDYGHSVEQYGALGGTARSSVDWQIRQVRALLQAQQA

SEQ ID NO: 860913 - protein, 496 aa, Homo sapiens
RHPGQKSPGQWRARHYPCGQAEVSARRPDGRDGRGGRRAPWRALTSASPRAALPQAQCPELGASPARGTLLAKEVVSPVLSSRPGGPKLPDDEEPPNMASEVAEEWAQGTFKLNSNDEDIHTANERRLKELIGATAGKLHTGRSRNDQVVTDLRLWMRQTCSTLSGLLWELIRTMVDRAEAERDVLFPGYTHLQRAQPIRWSHWILSHAVALTRDSERLLEVRKRINVLPLGSGAIAGNPLGVDRELLRAELNFGAITLNSMDATSERDFVAEFLFWASLCMTHLSRMAEDLILYCTKEFSFVQLSDAYSTGSSLMPQKKNPDSLELIRSKAGRVFGRCAGLLMTLKGLPSTYNKDLQEDKEAVFEVSDTMSAVLQVATGVISTLQIHQENMGQALSPDMLATDLAYYLVRKGMPFRQAHEASGKAVFMAETKGVALNQLSLQELQTISPLFSGDVICVWDYGHSVEQYGALGGTARSSVDWQIRQVRALLQAQQA

SEQ ID NO: 860914 - protein, 481 aa, Homo sapiens
RHPGQKSPGQWRARHYPCGQAEVSARRPDGRDGRGGRRAPWRALTSASPRAALPQAQCPELGASPARGTLLAKEVVSPVLSSRPGGPKLPDDEEPPNMASESGKLWGGRFVGAVDPIMEKFNASIAYDRHLWEVDVQGSKAYSRGLEKAGLLTKAEMDQILHGLDKVAEEWAQGTFKLNSNDEDIHTANERRLKELIGATAGKLHTGRSRNDQVVTDLRLWMRQTCSTLSGLLWELIRTMVDRAEAERDVLFPGYTHLQRAQPIRWSHWILSHAVALTRDSERLLEVRKRINVLPLGSGAIAGNPLGVDRELLRAELNFGAITLNSMDATSERDFVAEFLFWASLCMTHLSRMAEDLILYCTKEFSFVQLSDAYSTGSSLMPQKKNPDSLELIRSKAGRVFGRCAGLLMTLKGLPSTYNKDLQQLSLQELQTISPLFSGDVICVWDYGHSVEQYGALGGTARSSVDWQIRQVRALLQAQQA

SEQ ID NO: 860915 - protein, 359 aa, Homo sapiens; identical to SEQ ID NO: 860905

SEQ ID NO: 860916 - protein, 425 aa, Homo sapiens
RHPGQKSPGQWRARHYPCGQAEVSARRPDGRDGRGGRRAPWRALTSASPRAALPQAQCPELGASPARGTLLAKEVVSPVLSSRPGGPKLPDDEEPPNMASESGKLWGGRFVGAVDPIMEKFNASIAYDRHLWEVDVQGSKAYSRGLEKAGLLTKAEMDQILHGLDKVAEEWAQGTFKLNSNDEDIHTANERRLKELIGATAGKLHTGRSRNDQVVTDLRLWMRQTCSTLSGLLWELIRTMVDRAEAERDVLFPGYTHLQRAQPIRWSHWILSHAVALTRDSERLLEVRKRINVLPLGSGAIAGNPLGVDRELLRAELNFGAITLNSMDATSERDFVAEFLFWASLCMTHLSRMAEDLILYCTKEFSFVQLSDAYSTGSSLMPQKKNPDSLELIRSKAGRVFGRCAGLLMTLKGLPSTYNKDLQQA

SEQ ID NO: 860917 - protein, 664 aa, Homo sapiens
RHPGQKSPGQWRARHYPCGQAEVSARRPDGRDGRGGRRAPWRALTSASPRAALPQAQCPELGASPARGTLLAKEVVSPVLSSRPGGPKLPDDEEPPNMASESGKLWGGRFVGAVDPIMEKFNASIAYDRHLWEVDVQGSKAYSRGLEKAGLLTKAEMDQILHGLDKVAEEWAQGTFKLNSNDEDIHTANERRLKELIGATAGKLHTGRSRNDQVVTDLRLWMRQTCSTLSGLLWELIRTMVDRAEAERDVLFPGYTHLQRAQPIRWSHWILSHAVALTRDSERLLEVRKRINVLPLGSGAIAGNPLGVDRELLRAGETSCPSSPGRITLSTRQDLQTHLKPEGRGLWLLVKPSFIAYGPEVIKFRGHSWQGCLVLRDSGLLPPSWDCAKDPSPQLLPHPDQEEGAGQPSWGRGGHSLSSSLALLPPTPPELNFGAITLNSMDATSERDFVAEFLFWASLCMTHLSRMAEDLILYCTKEFSFVQLSDAYSTGSSLMPQKTPVPPSSRCAGLLMTLKGLPSTYNKDLQEDKEAVFEVSDTMSAVLQVATGVISTLQIHQENMGQALSPDMLATDLAYYLVRKGMPFRQAHEASGKAVFMAETKGVALNQLSLQELQTISPLFSGDVICVWDYGHSVEQYGALGGTARSSVDWQIRQVRALLQAQQA

SEQ ID NO: 860918 - protein, 359 aa, Homo sapiens; identical to SEQ ID NO: 860905

SEQ ID NO: 860919 - protein, 137 aa, Homo sapiens
RHPGQKSPGQWRARHYPCGQAEVSARRPDGRDGRGGRRAPWRALTSASPRAALPQAQCPELGASPARGTLLAKEVVSPVLSSRPGGPKLPDDEEPPNMASEVSGTSGTPVLLASKGESGGARPASGHPAGNRPPGSN

SEQ ID NO: 860920 - protein, 1130 aa, Homo sapiens
RPGTPGSPAVSGGMAGAGGGLGVWGNLVLLGLCSWTGARAPAPNPGRNLTVETQTTSSISLSWEVPDGLDSQNSNYWVQCTGDGGTTETRNTTATNVTVDGLGPGSLYTCSVWVEKDGVNSSVGTVTTATAPNPVRNLRVEAQTNSSIALTWEVPDGPDPQNSTYGVEYTGDGGRAGTRSTAHTNITVDGLEPGCLYAFSMWVGKNGINSSRETRNATTAHNPVRKPESGGSDHQLHLPELGGPRWHRPTELDLLRTSALEMVAEQRLETQQTPESPVDGLGPGSLYTCSVWVEKDGVNSSSWRLVTSTTAPNPVRNLTVEAQTNSSIALTWEVPDGPDPQNSTYGVEYTGDGGRAGTRSTAHTNITVDRLEPGCLYVFSVWVGKNGINSSRETRNATTAPNPVRNLHMETQTNSSIALCWEVPDGPYPQDYTYWVEYTGDGGGTETRNTTNTSVTAERLEPGTLYTFSVWAEKNGARGSRQNVSISTVPNAVTSLSKQDWTNSTIALRWTAPQGPGQSSYSYWVSWVREGMTDPRTQSTSGTDITLKELEAGSLYHLTVWAERNEVRGYNSTLTAATAPNEVTDLQNETQTKNSVMLWWKAPGDPHSQLYVYWVQWASKGHPRRGQDPQANWVNQTSRTNETWYKVEALEPGTLYNFTVWAERNDVASSTQSLCASTYPDTVTITSCVSTSAGYGVNLIWSCPQGGYEAFELEVGGQRGSQDRSSCGEAVSVLGLGPARSYPATITTIWDGMKVVSHSVVCHTESAGVIAGAFVGILLFLILVGLLIFFLKRRNKKKQQKPELRDLVFSSPGDIPAEDFADHVRKNERDSNCGFADEYQQLSLVGHSQSQMVASASENNAKNRYRNVLPYDWSRVPLKPIHEEPGSDYINASFMPGLWSPQEFIATQGPLPQTVGDFWRLVWEQQSHTLVMLTNCMEAGRVKCEHYWPLDSQPCTHGHLRVTLVGEEVMENWTVRELLLLQVEEQKTLSVRQFHYQAWPDHGVPSSPDTLLAFWRMLRQWLDQTMEGGPPIVHCSAGVGRTGTLIALDVLLRQLQSEGLLGPFSFVRKMRESRPLMVQTEAQYVFLHQCILRFLQQSAQAPAEKEVPYEDVENLIYENVAAIQAHKLEV

SEQ ID NO: 860921 - protein, 967 aa, Homo sapiens
RPGTPGSPAVSGGMAGAGGGLGVWGNLVLLGLCSWTGARAPAPNPGRNLTVETQTTSSISLSWEVPDGLDSQNSNYWVQCTGDGGTTETRNTTATNVTVDGLGPGSLYTCSVWVEKDGVNSSVGTVTTATAPNPVRNLRVEAQTNSSIALTWEVPDGPDPQNSTYGVEYTGDGGRAGTRSTAHTNITVDGLEPGCLYAFSMWVGKNGINSSRETRNATTAHNPVRKPESGGSDHQLHLPELGGPRWHRPTELDLLRTSALEMVAEQRLETQQTPESPVDGLGPGSLYTCSVWVEKDGVNSSSWRLVTSTTAPNPVRNLTVEAQTNSSIALTWEVPDGPDPQNSTYGVEYTGDGGRAGTRSTAHTNITVDRLEPGCLYVFSVWVGKNGINSSRETRNATTAPNPVRNLHMETQTNSSIALCWEVPDGPYPQDYTYWVEYTGDGGGTETRNTTNTSVTAERLEPGTLYTFSVWAEKNGARGSRQNVSISTAGTLYNFTVWAERNDVASSTQSLCASTYPDTVTITSCVSTSAGYGVNLIWSCPQGGYEAFELEVGGQRGSQDRSSCGEAVSVLGLGPARSYPATITTIWDGMKVVSHSVVCHTESAGVIAGAFVGILLFLILVGLLIFFLKRRNKKKQQKPELRDLVFSSPGDIPAEDFADHVRKNERDSNCGFADEYQQLSLVGHSQSQMVASASENNAKNRYRNVLPYDWSRVPLKPIHEEPGSDYINASFMPGLWSPQEFIATQGPLPQTVGDFWRLVWEQQSHTLVMLTNCMEAGRVKCEHYWPLDSQPCTHGHLRVTLVGEEVMENWTVRELLLLQVEEQKTLSVRQFHYQAWPDHGVPSSPDTLLAFWRMLRQWLDQTMEGGPPIVHCSAGVGRTGTLIALDVLLRQLQSEGLLGPFSFVRKMRESRPLMVQTEAQYVFLHQCILRFLQQSAQAPAEKEVPYEDVENLIYENVAAIQAHKLEV

SEQ ID NO: 860922 - protein, 232 aa, Homo sapiens
RPGTPGSPAVSGGMAGAGGGLGVWGNLVLLGLCSWTGARAPAPNPGRNLTVETQTTSSISLSWEVPDGLDSQNSNYWVQCTGDGGTTETRNTTATNVTVDGLGPGSLYTCSVWVEKDGVNSSVGTVTTATAPNPVRNLRVEAQTNSSIALTWEVPDGPDPQNSTYGVEYTGDGGRAGTRSTAHTNITVDGLEPGCLYAFSMWVGKNGINSSRETRNATTGERQSPFVLLLLV

SEQ ID NO: 860923 - protein, 1085 aa, Homo sapiens
RPGTPGSPAVSGGMAGAGGGLGVWGNLVLLGLCSWTGARAPAPNPGRNLTVETQTTSSISLSWEVPDGLDSQNSNYWVQCTGDGGTTETRNTTATNVTVDGLGPGSLYTCSVWVEKDGVNSSVGTVTTATAPNPVRNLRVEAQTNSSIALTWEVPDGPDPQNSTYGVEYTGDGGRAGTRSTAHTNITVDGLEPGCLYAFSMWVGKNGINSSRETRNATTAHNPVRKPESGGSDHQLHLPELGGPRWHRPTELDLLRTSALEMVAEQRLETQQTPESPVDGLGPGSLYTCSVWVEKDGVNSSSWRLVTSTTAPNPVRNLTVEAQTNSSIALTWEVPDGPDPQNSTYGVEYTGDGGRAGTRSTAHTNITVDRLEPGCLYVFSVWVGKNGINSSRETRNATTAPNPVRNLHMETQTNSSIALCWEVPDGPYPQDYTYWVEYTGDGGGTETRNTTNTSVTAERLEPGTLYTFSVWAEKNGARGSRQNVSISTVPNAVTSLSKQDWTNSTIALRWTAPQGPGQSSYSYWVSWVREGMTDPRTQSTSGTDITLKELEAGSLYHLTVWAERNEVRGYNSTLTAATAPNEVTDLQNETQTKNSVMLWWKAPGDPHSQLYVYWVQWASKGHPRRGQDPQANWVNQTSRTNETWYKVEALEPGTLYNFTVWAERNDVASSTQSLCASTYPDTVTITSCVSTSAGYGVNLIWSCPQGGYEAFELEVGGQRGSQDRSSCGEAVSVLGLGPARSYPATITTIWDGMKVVSHSVVCHTESAGVIAGAFVGILLFLILVGLLIFFLKRRNKKKQQKPELRDLVFSSPGDIPAEDFADHVRKNERDSNCGFADEYQQLSLVGHSQSQMVASASENNAKNRYRNVLPYDWSRVPLKPIHEEPGSDYINASFMPVKCEHYWPLDSQPCTHGHLRVTLVGEEVMENWTVRELLLLQVEEQKTLSVRQFHYQAWPDHGVPSSPDTLLAFWRMLRQWLDQTMEGGPPIVHCSAGVGRTGTLIALDVLLRQLQSEGLLGPFSFVRKMRESRPLMVQTEAQYVFLHQCILRFLQQSAQAPAEKEVPYEDVENLIYENVAAIQAHKLEV

SEQ ID NO: 860924 - protein, 81 aa, Homo sapiens
APPPALSMDKISPSPEAGNDPGPPVTSFSLPLPPPYQSFKVKAQSNQQQVAALIFACLVIIRQRQLDRKALEKVRKQIESI

SEQ ID NO: 860925 - protein, 146 aa, Homo sapiens
MLAGAGRPGLPQGRHLCWLLCAFTLKLCQAEAPVQEEKLSASTSNLPCWLVEEFVVAEECSPCSNFRAKTTPECGPTGYVEKITCSSSKRNEFKSCRSALMEQRLFWKFEGAVVCVALIFACLVIIRQRQLDRKALEKVRKQIESI

SEQ ID NO: 860926 - protein, 146 aa, Homo sapiens; identical to SEQ ID NO: 860925

SEQ ID NO: 860927 - protein, 146 aa, Homo sapiens; identical to SEQ ID NO: 860925

SEQ ID NO: 860928 - protein, 146 aa, Homo sapiens; identical to SEQ ID NO: 860925

SEQ ID NO: 860929 - protein, 146 aa, Homo sapiens; identical to SEQ ID NO: 860925

SEQ ID NO: 860930 - protein, 146 aa, Homo sapiens; identical to SEQ ID NO: 860925

SEQ ID NO: 860931 - protein, 120 aa, Homo sapiens
GGTYSAALPEVPGQDREGRSKCRLCAPTEARGLWSRSLCSDRCDTWRSMLAGAGRPGLPQGRHLCWLLCAFTLKLCQAEAPVQEEKLSASTSNLPCWLVEEFVVAEECSPCSNFRAKNYP

SEQ ID NO: 860932 - protein, 117 aa, Homo sapiens
MAWGWHLSFLSASTSNLPCWLVEEFVVAEECSPCSNFRAKTTPECGPTGYVEKITCSSSKRNEFKSCRSALMEQRLFWKFEGAVVCVALIFACLVIIRQRQLDRKALEKVRKQIESI

SEQ ID NO: 860933 - protein, 118 aa, Homo sapiens
MLAGAGRPGLPQGRHLCWLLCAFTLKLCQAEAPVQEEKLSKTTPECGPTGYVEKITCSSSKRNEFKSCRSALMEQRLFWKFEGAVVCVALIFACLVIIRQRQLDRKALEKVRKQIESI

SEQ ID NO: 860934 - protein, 117 aa, Homo sapiens; identical to SEQ ID NO: 860932

SEQ ID NO: 860935 - protein, 118 aa, Homo sapiens; identical to SEQ ID NO: 860933

SEQ ID NO: 860936 - protein, 84 aa, Homo sapiens
HEAPGPPPLLVALGEARPPGTRKLERHLCWLLCAFTLKLCQAEAPVQEEKLSASTSNLPCWLVEEFVVAEECSPCSNFRAKNYP

SEQ ID NO: 860937 - protein, 197 aa, Homo sapiens
MSRIKRVKWTHTPPPPPPTPTPHPHGGAPQNNPPGGPTIPPPHLCTSAPTNAANKRRPAANTATDHRQQHQRTPSGRTRPQQPEHKSGHLPARTHINSRPPAVTPAHEDATARHLLAPLLTLATVLPDDVTSPDVVDWTLARRWAAARHGSRAAEPYCLRPDLSSAVTSAAHRRKSHVHTDEIADRHHTTPTTPHPH

SEQ ID NO: 860938 - protein, 172 aa, Homo sapiens
MLAGAGRPGLPQGRHLCWLLCAFTLKLCQAEAPVQEEKLSASTSNLPCWLVEEFLPGFKAQGKKGKRGLGPLPFPNGLPEKFFPPGLKTYRPLEKTTPECGPTGYVEKITCSSSKRNEFKSCRSALMEQRLFWKFEGAVVCVALIFACLVIIRQRQLDRKALEKVRKQIESI

SEQ ID NO: 860939 - protein, 117 aa, Homo sapiens; identical to SEQ ID NO: 860932

SEQ ID NO: 860940 - protein, 117 aa, Homo sapiens; identical to SEQ ID NO: 860932

SEQ ID NO: 860941 - protein, 146 aa, Homo sapiens; identical to SEQ ID NO: 860925

SEQ ID NO: 860942 - protein, 146 aa, Homo sapiens; identical to SEQ ID NO: 860925

SEQ ID NO: 860943 - protein, 146 aa, Homo sapiens; identical to SEQ ID NO: 860925

SEQ ID NO: 860944 - protein, 146 aa, Homo sapiens; identical to SEQ ID NO: 860925

SEQ ID NO: 860945 - protein, 638 aa, Homo sapiens
MDAFEKVRTKLETQPQEEYEIINVEVKHGGFVYYQEGCCLVRSKDEEADNDNYEVLFNLEELKLDQPFIDCIRVAPDEKYVAAKIRTEDSEASTCVIIKLSDQPVMEASFPNVSSFEWVKDEEDEDVLFYTFQRNLRCHDVYRATFGDNKRNERFYTEKDPSYFVFLYLTKDSRFLTINIMNKTTSEVWLIDGLSPWDPPVLIQKRIHGVLYYVEHRDDELYILTNVGEPTEFKLMRTAADTPAIMNWDLFFTMKRNTKVIDLDMFKDHCVLFLKHSNLLYVNVIGLADDSVRSLKLPPWACGFIMDTNSDPKNCPFQLCSPIRPPKYYTYKFAEGKLFEETGHEDPITKTSRVLRLEAKSKDGKLVPMTVFHKTDSEDLQKKPLLVHVYGAYGMDLKMNFRPERRVLVDDGWILAYCHVRGGGELGLQWHADGRLTKKLNGLADLEACIKTLHGQGFSQPSLTTLTAFSAGGVLAGALCNSNPELVRAVTLEAPFLDVLNTMMDTTLPLTLEELEEWGNPSSDEKHKNYIKRYCPYQNIKPQHYPSIHITAYENDERVPLKGIVSYTEKLKEAIAEHAKDTGEGYQTPNIILDIQPGGNHVIEDSHKKITAQIKFLYEELGLDSTSVFEDLKKYLKF

SEQ ID NO: 860946 - protein, 572 aa, Homo sapiens
MDAFEKVRTKLETQPQEEYEIINVEVKHGGFVYYQEGCCLVRSKDEEADNDNYEVLFNLEELKLDQPFIDCIRVAPDEKYVAAKIRTEDSEASTCVIIKLSDQPVMEASFPNVSSFEWVKDEEDEDVLFYTFQRNLRCHDVYRATFGDNKRNERFYTEKDPSYFVFLYLTKDSRFLTINIMNKTTSEVWLIDGLSPWDPPVLIQKRIHGVLYYVEHRDDELYILTNVGEPTEFKLMRTAADTPAIMNWDLFFTMKRNTKVIDLDMFKDHCVLFLKHSNLLYVNVIGLADDSVRSLKDGKLVPMTVFHKTDSEDLQKKPLLVHVYGAYGMDLKMNFRPERRVLVDDGWILAYCHVRGGGELGLQWHADGRLTKKLNGLADLEACIKTLHGQGFSQPSLTTLTAFSAGGVLAGALCNSNPELVRAVTLEAPFLDVLNTMMDTTLPLTLEELEEWGNPSSDEKHKNYIKRYCPYQNIKPQHYPSIHITAYENDERVPLKGIVSYTEKLKEAIAEHAKDTGEGYQTPNIILDIQPGGNHVIEDSHKKITAQIKFLYEELGLDSTSVFEDLKKYLKF

SEQ ID NO: 860947 - protein, 638 aa, Homo sapiens; identical to SEQ ID NO: 860945

SEQ ID NO: 860948 - protein, 629 aa, Homo sapiens
MDAFEKVRTKLETQPQEEYEIINVEVKHGGFVYYQEGCCLVRSKDEEADNDNYEVLFNLEELKLDQPFIDCIRVAPDEKYVAAKIRTEDSEASTCVIIKLSDQPVMEASFPNVSSFEWVKDEEDEDVLFYTFQRNLRCHDVYRATFGDNKRNERFYTEKDPSYFVFLYLTKDSRFLTINIMNKTTSEVWLIDGLSPWDPPVLIQKRIHGVLYYVEHRDDELYILTNVGEPTEFKLMRTAADTPAIMNWDLFFTMKRNTKVIDLDMFKDHCVLFLKHSNLLYVNVIGLADDSVRSLKLPPWACGFIMDTNSDPKNCPFQLCSPIRPPKYYTYKFAEGKLFEETGHEDPITKTSRVLRLEAKSKDGKLVPMTVFHKTDSEDLQKKPLLVHVYGAYGMDLKMNFRPERRVLVDDGWILAYCHVRGGGELGLQWHADGRLTKKLNGLADLEACIKTLHGQGFSQPSLTTLTAFSAGGVLAGALCNSNPELVRAVTLEAPFLDVLNTMMDTTLPLTLEELEEWGNPSSDEKHKNYIKRYCPYQNIKPQHYPSIHITAYENDERVPLKGIVSYTEKLKEAIAEHAKDTGEGRRPPRSREHGQTDYYPQHTAQRNIFQAVAKSSAQDLGQTIILLC

SEQ ID NO: 860949 - protein, 727 aa, Homo sapiens
MQQKTKLFLQALKYSIPHLGKCMQKQHLNHYNFADHCYNRIKLKKYHLTKCLQNKPKISELARNIPSRSFSCKDLQPVKQENEKPLPENMDAFEKVRTKLETQPQEEYEIINVEVKHGGFVYYQEGCCLVRSKDEEADNDNYEVLFNLEELKLDQPFIDCIRVAPDEKYVAAKIRTEDSEASTCVIIKLSDQPVMEASFPNVSSFEWVKDEEDEDVLFYTFQRNLRCHDVYRATFGDNKRNERFYTEKDPSYFVFLYLTKDSRFLTINIMNKTTSEVWLIDGLSPWDPPVLIQKRIHGVLYYVEHRDDELYILTNVGEPTEFKLMRTAADTPAIMNWDLFFTMKRNTKVIDLDMFKDHCVLFLKHSNLLYVNVIGLADDSVRSLKLPPWACGFIMDTNSDPKNCPFQLCSPIRPPKYYTYKFAEGKLFEETGHEDPITKTSRVLRLEAKSKDGKLVPMTVFHKTDSEDLQKKPLLVHVYGAYGMDLKMNFRPERRVLVDDGWILAYCHVRGGGELGLQWHADGRLTKKLNGLADLEACIKTLHGQGFSQPSLTTLTAFSAGGVLAGALCNSNPELVRAVTLEAPFLDVLNTMMDTTLPLTLEELEEWGNPSSDEKHKNYIKRYCPYQNIKPQHYPSIHITAYENDERVPLKGIVSYTEKLKEAIAEHAKDTGEGYQTPNIILDIQPGGNHVIEDSHKKITAQIKFLYEELGLDSTSVFEDLKKYLKF

SEQ ID NO: 860950 - protein, 638 aa, Homo sapiens; identical to SEQ ID NO: 860945

SEQ ID NO: 860951 - protein, 638 aa, Homo sapiens; identical to SEQ ID NO: 860945

SEQ ID NO: 860952 - protein, 638 aa, Homo sapiens; identical to SEQ ID NO: 860945

SEQ ID NO: 860953 - protein, 87 aa, Homo sapiens
MGPGGSQLDDDLGCCLRRGKRLSQAKDIKRCAALSAGFLAYMNGSLGRTCKPAQYAGLIVGTVHAGTGRRIQMGIEPGVLLQWALDE

SEQ ID NO: 860954 - protein, 638 aa, Homo sapiens; identical to SEQ ID NO: 860945

SEQ ID NO: 860955 - protein, 638 aa, Homo sapiens; identical to SEQ ID NO: 860945

SEQ ID NO: 860956 - protein, 620 aa, Homo sapiens
MDAFEKVRTKLETQPQEEYEIINVEVKHGGFVYYQEGCCLVRSKDEEADNDNYEVLFNLEELKLDQPFIDCIRVAPDEKYVAAKIRTEDSEASTCVIIKLSDQPVMEASFPNVSSFEWVKDEEDEDVLFYTFQRNLRCHDVYRATFGDNKRNERFYTEKDPSYFVFLYLTVVDRWPEPLGPTVLIQKRIHGVLYYVEHRDDELYILTNVGEPTEFKLMRTAADTPAIMNWDLFFTMKRNTKVIDLDMFKDHCVLFLKHSNLLYVNVIGLADDSVRSLKLPPWACGFIMDTNSDPKNCPFQLCSPIRPPKYYTYKFAEGKLFEETGHEDPITKTSRVLRLEAKSKDGKLVPMTVFHKTDSEDLQKKPLLVHVYGAYGMDLKMNFRPERRVLVDDGWILAYCHVRGGGELGLQWHADGRLTKKLNGLADLEACIKTLHGQGFSQPSLTTLTAFSAGGVLAGALCNSNPELVRAVTLEAPFLDVLNTMMDTTLPLTLEELEEWGNPSSDEKHKNYIKRYCPYQNIKPQHYPSIHITAYENDERVPLKGIVSYTEKLKEAIAEHAKDTGEGYQTPNIILDIQPGGNHVIEDSHKKITAQIKFLYEELGLDSTSVFEDLKKYLKF

SEQ ID NO: 860957 - protein, 727 aa, Homo sapiens; identical to SEQ ID NO: 860949

SEQ ID NO: 860958 - protein, 638 aa, Homo sapiens; identical to SEQ ID NO: 860945

SEQ ID NO: 860959 - protein, 228 aa, Homo sapiens
STKTFLPFNFRGGGELGLQWHADGRLTKKLNGLADLEACIKTLHGQGFSQPSLTTLTAFSAGGVLAGALCNSNPELVRAVTLEAPFLDVLNTMMDTTLPLTLEELEEWGNPSSDEKHKNYIKRYCPYQNIKPQHYPSIHITAYENDERVPLKGIVSYTEKLKEAIAEHAKDTGEGYQTPNIILDIQPGGNHVIEDSHKKITAQIKFLYEELGLDSTSVFEDLKKYLKF

SEQ ID NO: 860960 - protein, 539 aa, Homo sapiens
MDAFEKVRTKLETQPQEEYEIINVEVKHGGFVYYQEGCCLVRSKDEEADNDNYEVLFNLEELKLDQPFIDCIRVAPDEKYVAAKIRTEDSEASTCVIIKLSDQPVMEASFPNVSSFEWVKDEEDEDVLFYTFQRNLRCHDVYRATFGDNKRNERFYTEKDPSYFVFLYLTKDSRFLTINIMNKTTSEVWLIDGLSPWDPPVLIQKRIHGVLYYVEHRDDELYILTNVGEPTEFKLMRTAADTPAIMNWDLFFTMKRNTKVIDLDMFKDHCVLFLKHSNLLYVNVIGLADDSVRSLKLPPWACGFIMDTNSDPKNCPFQLCSPIRPPKYYTYKFAEGKLFEETGHEDPITKTSRVLRLEAKSKDGKLVPMTVFHKTDSEDLQKKPLLVHVYGAYGMDLKMNFRPERRVLVDDGWILAYCHVRGGGELGLQWHADGRLTKKLNGLADLEACIKTLHGQGFSQPSLTTLTAFSAGGVLAGALCNSNPELVRAVTLEAPFLDVFNPMMGPTLPLTLKKLKEWGDPSFDEKPKNYPTPEPTTLY

SEQ ID NO: 860961 - protein, 82 aa, Homo sapiens
RGGGELGLQWHADGRLTKKLNGLADLEACIKTLHGQGFSQPSLTTLTAFSAGGVLAGALCNSNPELVRAVTLEVSTLCLYCL

SEQ ID NO: 860962 - protein, 108 aa, Homo sapiens [sequence omitted]

SEQ ID NO: 860963 - protein, 77 aa, Homo sapiens
AAAPEVMRTPGGAQGAGSGAAAASSPAAGEPLQRERRAGAECGLARQVRAEVTKWIGVNRRPRKRKRREKEEVFEKF

SEQ ID NO: 860964 - protein, 181 aa, Homo sapiens
MRMRRPLAGGGKSWGIAHFYKPLQRERRAGAECGLARQVRAEVTKWIGVNRRPRKRKRREKEEVFEKLLPDQLVLLLEHLLEQKTLSPRTLQSLQRTYHLQDQDAEVRHRWCELIVKHKFTKAYKSVERFLQEDQAMGVYLYGELMVSEDARQQQLARRCFERTKEQMDRSSAQVVAEMLF

SEQ ID NO: 860965 - protein, 720 aa, Homo sapiens
MDIQLDPARDDLPLMANTSHILVKHYVLDLDVDFESQVIEGTIVLFLEDGNRFKKQNSSIEEACQSESNKACKFGMPEPCHIPVTNARTFSSEMEYNDFAICSKGEKDTSDKDGNHDNQEHASGISSSKYCCDTGNHGSEDFLLVLDCCDLSVLKVEEVDVAAVPGLEKFTRSPELTVVSEEFRNQIVRELVTLPANRWREQLDYYARCSQAPGCGELLFDTDTWSLQIRKTGAQTATDFPHAIRIWYKTKPEGRSVTWTSDQSGRPCVYTVGSPINNRALFPCQEPPVAMSTWQATVRAAASFVVLMSGENSAKPTQLWEECSSWYYYVTMPMPASTFTIAVGCWTEMKMETWSSNDLATERPFSPSEANFRHVGVCSHMEYPCRFQNASATTQEIIPHRVFAPVCLTGACQETLLRLIPPCLSAAHSVLGAHPFSRLDVLIVPANFPSLGMARPSKDKTGHTSDSGASVIKHGLNPEKIFMQVHYLKGYFLLRFLAKRLGDETYFSFLRKFVHTFHGQLILSQDFLQMLLENIPEEKRLELSVENIYQDWLESSGIPKPLQRERRAGAECGLARQVRAEVTKWIGVNRRPRKRKRREKEEVFEKLLPDQLVLLLEHLLEQKTLSPRTLQSLQRTYHLQDQDAEVRHRWCELIVKHKFTKAYKSVERFLQEDQAMGVYLYGELMVSEDARQQQLARRCFERTKEQMDRSSAQVVAEMLF

SEQ ID NO: 860966 - protein, 168 aa, Homo sapiens
MQHTHTRGRTTQSTHSTHHTAHAPHRAHAAHTAHTAHAPRRAHTAHAAYTPNSARTTQSTRGTRSTHTTQSTWSTHSTHTTQSTRGTHTTHSACTTQSTHSTCTTRSAHTACSTHTTHSACTTQSTCGTHSTHRTHHTEHMWHTQCTHHTAPAAHTAHVAYGLHDPVS

SEQ ID NO: 860967 - protein, 181 aa, Homo sapiens; identical to SEQ ID NO: 860964

SEQ ID NO: 860968 - protein, 221 aa, Homo sapiens
MRMRRPLAGGGKSWGIAHFYKPLQRERRAGAECGLARQVRAEVTKWIGVNRRPRKRKRREKEEVFEKLLPDQLVLLLEHLLEQKTLSPRTLQSLQRTYHLQDQDAEVRHRWCELIVKHKFTKAYKSVERFLQEDQERPQQDSFIRLLLAWGTRLELTLDIKGGIMWLLKPSAHSPVHVLVLLFPRGWSQPGTHKRQILVNAASLPGGCLLPWIWSGAALRF

SEQ ID NO: 860969 - protein, 181 aa, Homo sapiens; identical to SEQ ID NO: 860964

SEQ ID NO: 860970 - protein, 180 aa, Homo sapiens
RGREAGAAPAVNLTVSSSPEPLQRERRAGAECGLARQVRAEVTKWIGVNRRPRKRKRREKEEVFEKLLPDQLVLLLEHLLEQKTLSPRTLQSLQRTYHLQDQDAEVRHRWCELIVKHKFTKAYKSVERFLQEDQAMGVYLYGELMVSEDARQQQLARRCFERTKEQMDRSSAQVVAEMLF

SEQ ID NO: 860971 - protein, 760 aa, Homo sapiens
MDIQLDPARDDLPLMANTSHILVKHYVLDLDVDFESQVIEGTIVLFLEDGNRFKKQNSSIEEACQSESNKACKFGMPEPCHIPVTNARTFSSEMEYNDFAICSKGEKDTSDKDGNHDNQEHASGISSSKYCCDTGNHGSEDFLLVLDCCDLSVLKVEEVDVAAVPGLEKFTRSPELTVVSEEFRNQIVRELVTLPANRWREQLDYYARCSQAPGCGELLFDTDTWSLQIRKTGAQTATDFPHAIRIWYKTKPEGRSVTWTSDQSGRPCVYTVGSPINNRALFPCQEPPVAMSTWQATVRAAASFVVLMSGENSAKPTQLWEECSSWYYYVTMPMPASTFTIAVGCWTEMKMETWSSNDLATERPFSPSEANFRHVGVCSHMEYPCRFQNASATTQEIIPHRVFAPVCLTGACQETLLRLIPPCLSAAHSVLGAHPFSRLDVLIVPANFPSLGMARPSKDKTGHTSDSGASVIKHGLNPEKIFMQVHYLKGYFLLRFLAKRLGDETYFSFLRKFVHTFHGQLILSQDFLQMLLENIPEEKRLELSVENIYQDWLESSGIPKPLQRERRAGAECGLARQVRAEVTKWIGVNRRPRKRKRREKEEVFEKLLPDQLVLLLEHLLEQKTLSPRTLQSLQRTYHLQDQDAEVRHRWCELIVKHKFTKAYKSVERFLQEDQERPQQDSFIRLLLAWGTRLELTLDIKGGIMWLLKPSAHSPVHVLVLLFPRGWSQPGTHKRQILVNAASLPGGCLLPWIWSGAALRF

SEQ ID NO: 860972 - protein, 181 aa, Homo sapiens; identical to SEQ ID NO: 860964

SEQ ID NO: 860973 - protein, 114 aa, Homo sapiens
IQGHRRRNCDFVRVLFTRPSNQKGQANTRSGAIKKVHTKDKSSREKVTYLAGSGLGFLQPRARSPDGTSPALPPGEACSRLRLQGRGLGSTERSSLFFQTSWSCFWSISWSRRL

SEQ ID NO: 860974 - protein, 182 aa, Homo sapiens
MRMRRPLAGGGKSWGIAHFYKPLQRERRAGAECGLARQVRAEVTKWIGVNRRPRKRKRREKEEVFEKLLPDQLVLLLEHLLEQKTLSPRTLQSLQRTYHLQDQDAEVRHRWCELIVKHKFTKAYKSVERFLQEDQAMGVYLYGELMVSEDTNVQQGPCRPFSFPYLGALNSPRVYPFMPLVC

SEQ ID NO: 860975 - protein, 653 aa, Homo sapiens
MDIQLDPARDDLPLMANTSHILVKHYVLDLDVDFESQVIEGTIVLFLEDGNRFKKQNSSIEEACQSESNKACKFGMPEPCHIPVTNARTFSSEMEYNDFAICSKGEKDTSDKDGNHDNQEHASGISSSKYCCDTGNHGSEDFLLVLDCCDLSVLKVEEVDVAAVPGLEKFTRSPELTVVSEEFRNQIVRELVTLPANRWREQLDYYARCSQAPGCGELLFDTDTWSLQIRKTGAQTATDFPHAIRIWYKTKPEGRSVTWTSDQSGRPCVYTVGSPINNRALFPCQEPPVAMSTWQATVRAAASFVVLMSGENSAKPTQLWEECSSWYYYVTMPMPASTFTIAVGCWTEMKMETWSSNDLATERPFSPSEANFRHVGVCSHMEYPCRFQNASATTQEIIPHRVFAPVCLTGACQETLLRLIPPCLSAAHSVLGAHPFSRLDVLIVPANFPSLGMARPSKDKTGHTSDSGASVIKHGLNPEKIFMQVHYLKGYFLLRFLAKRLGDETYFSFLRKFVHTFHGQLILSQDFLQMLLENIPEEKRLELSVENIYQDWLESSGIPKPLQRERRAGAECGLARQVRAEVTKWIGVNRRPRKRKRREKEEVFEKLLPDQLVLLLEHLLEQKTLSPRTLQSLQRTYHLQDQDAEVTRNTLGV

SEQ ID NO: 860976 - protein, 164 aa, Homo sapiens
ALQIVVGTAVVALNLKGLECEAHVETLRHLDPPDADFAGPVIVWVVGRLNVAIVLFHITPADGFVDCKEALSNPIAAAAEFNPEAAPEEKAKKDYFCLDLLNRIFTFLGTPDGVQGHRREEIRHCYRTLALGSDYSMGGEKRVVASDCCRFCLSFLFFFVSNLF

SEQ ID NO: 860977 - protein, 109 aa, Homo sapiens
GHQRRDYVAAKAIGPQPCSRLGASLSQRLVPARHTQKADSRKRSLPPWRLPPALDLEWSCSEILSSSAEMIKYIQETLENLLNILHWSAQHMAGCGYFYNSRKSHSSSV

SEQ ID NO: 860978 - protein, 349 aa, Homo sapiens
MDIQLDPARDDLPLMANTSHILVKHYVLDLDVDFESQVIEGTIVLFLEDGNRFKKQNSSIEEACQSESNKACKFGMPEPCHIPVTNARTFSSEMEYNDFAICSKGEKDTSDKDGNHDNQEHASGISSSKYCCDTGNHGSEDFLLVLDCCDLSVLKVEEVDVAAVPGLEKFTRSPELTVVSEEFRNQIVRELVTLPANRWREQLDYYARCSQAPGCGELLFDTDTWSLQIRKTGAQTATDFPHAIRIWYKTKPEGRSVTWTSDQSGRPCVYTVGSPINNRALFPCQEPPVAMSTWQATVRAAASFVVLMSGENSAKPTQLWEGTVHVFFAYLCIAHMWTQEPNKQYFSKL

SEQ ID NO: 860979 - protein, 707 aa, Homo sapiens
MDIQLDPARDDLPLMANTSHILVKHYVLDLDVDFESQVIEGTIVLFLEDGNRFKKQNSSIEEACQSESNKACKFGMPEPCHIPVTNARTFSSEMEYNDFAICSKGEKDTSDKDGNHDNQEHASGISSSKYCCDTGNHGSEDFLLVLDCCDLSVLKVEEVDVAAVPGLEKFTRSPELTVVSEEFRNQIVRELVTLPANRWREQLDYYARCSQAPGCGELLFDTDTWSLQIRKTGAQTATDFPHAIRIWYKTKPEGRSVTWTSDQSGRPCVYTVGSPINNRALFPCQEPPVAMSTWQATVRAAASFVVLMSGENSAKPTQLWEECSSWYYYVTMPMPASTFTIAVGCWTEMKMETWSSNDLATERPFSPSEANFRHVGVCSHMEYPCRFQNASATTQEIIPHRVFAPVCLTGACQETLLRLIPPCLSAAHSVLGAHPFSRLDVLIVPANFPSLGMARPSKDKTGHTSDSGASVIKHGLNPEKIFMQVHYLKGYFLLRFLAKRLGDETYFSFLRKFVHTFHGQLILSQDFLQMLLENIPEEKRLELSVENIYQDWLESSGIPKPLQRERRAGAECGLARQVRAEVTKWIGVNRRPRKRKRREKEEVFEKLLPDQLVLLLEHLLEQKTLSPRTLQSLQRTYHLQDQDAEVRHRWCELIVKHKFTKAYKSVERFLQEDQGRCHLSADGDSVKAVPALHTGIHVLGISFITNN

SEQ ID NO: 860980 - protein, 274 aa, Homo sapiens
MCFGPQHSRPSKDKTGHTSDSGASVIKHGLNPEKIFMQVHYLKGYFLLRFLAKRLGDETYFSFLRKFVHTFHGQLILSQDFLQMLLENIPEEKRLELSVENIYQDWLESSGIPKPLQRERRAGAECGLARQVRAEVTKWIGVNRRPRKRKRREKEEVFEKLLPDQLVLLLEHLLEQKTLSPRTLQSLQRTYHLQDQDAEVRHRWCELIVKHKFTKAYKSVERFLQEDQAMGVYLYGELMVSEDARQQQLARRCFERTKEQMDRSSAQVVAEMLF

SEQ ID NO: 860981 - protein, 168 aa, Homo sapiens; identical to SEQ ID NO: 860966

SEQ ID NO: 860982 - protein, 168 aa, Homo sapiens; identical to SEQ ID NO: 860966

SEQ ID NO: 860983 - protein, 181 aa, Homo sapiens; identical to SEQ ID NO: 860964

SEQ ID NO: 860984 - protein, 69 aa, Homo sapiens
DFLRVRLQRTSWATPGGALLCFRRGAGNGAWMLPFAGLLSQALPLQGQSWDMSVAFSDVGGELACSASC

SEQ ID NO: 860985 - protein, 181 aa, Homo sapiens; identical to SEQ ID NO: 860964

SEQ ID NO: 860986 - protein, 152 aa, Homo sapiens
ARGAAVTKVAAPAVTKWIGVNRRPRKRKRREKEEVFEKLLPDQLVLLLEHLLEQKTLSPRTLQSLQRTYHLQDQDAEVRHRWCELIVKHKFTKAYKSVERFLQEDQAMGVYLYGELMVSEDARQQQLARRCFERTKEQMDRSSAQVVAEMLF

SEQ ID NO: 860987 - protein, 224 aa, Homo sapiens
MRTPGWAQGAGSGAAAASSPAAGEPLQRERRAGAECGLARQVRAEVTKWIGVNRRPRKRKRREKEEVFEKLLPDQLVLLLEHLLEQKTLSPRTLQSLQRTYHLQDQDAEVRHRWCELIVKHKFTKAYKSVERFLQEDQERPQQDSFIRLLLAWGTRLELTLDIKGGIMWLLKPSAHSPVHVLVLLFPRGWSQPGTHKRQILVNAASLPGGCLLPWIWSGAALRF

SEQ ID NO: 860988 - protein, 217 aa, Homo sapiens [sequence omitted]

SEQ ID NO: 860989 - protein, 146 aa, Homo sapiens
MRMRRPLAGGGKSWGIAHFYKPLQRERRAGAECGLARQVRAEVTKWIGVNRRPRKRKRREKEEVFEKLLPDQLVLLLEHLLEQKTLSPRTLQSLQRTYHLQDQDAEVRHRWCELIVKHKFTKAYKSVERFLQEDQKKVQNAGPSVT

SEQ ID NO: 860990 - protein, 646 aa, Homo sapiens
MDIQLDPARDDLPLMANTSHILVKHYVLDLDVDFESQVIEGTIVLFLEDGNRFKKQNSSIEEACQSESNKACKFGMPEPCHIPVTNARTFSSEMEYNDFAICSKGEKDTSDKDGNHDNQEHASGISSSKYCCDTGNHGSEDFLLVLDCCDLSVLKVEEVDVAAVPGLEKFTRSPELTVVSEEFRNQIVRELVTLPANRWREQLDYYARCSQAPGCGELLFDTDTWSLQIRKTGAQTATDFPHAIRIWYKTKPEGRSVTWTSDQSGRPCVYTVGSPINNRALFPCQEPPVAMSTWQATVRAAASFVVLMSGENSAKPTQLWEECSSWYYYVTMPMPASTFTIAVGCWTEMKMETWSSNDLATERPFSPSEANFRHVGVCSHMEYPCRFQNASATTQEIIPHRVFAPVCLTGACQETLLRLIPPCLSAAHSVLGAHPFSRLDVLIVPANFPSLGMARPSKDKTGHTSDSGASVIKHGLNPEKIFMQVHYLKGYFLLRFLAKRLGDETYFSFLRKFVHTFHGQLILSQDFLQMLLENIPEEKRLELSVENIYQDWLESSGIPKPLQRERRAGAECGLARQVRAEVTKWIGVNRRPRKRKRREKEEVFEKTLNWSHLRNRERRRKKWITFKTLGGILFTVKQMRNLFAQV

SEQ ID NO: 860991 - protein, 83 aa, Homo sapiens
ALYHHGARGAGERIPPPPPPTPPPPPPPLPLLTHSESLASLPGVGAVRVCARRPLARSNPRACLPGLRRRTPISASGSGRFRS

SEQ ID NO: 860992 - protein, 353 aa, Homo sapiens
MSTLLLNLDFGEPPPKKALEGNAKHRNFVKKRRLLERRGFLSKKNQPPSKAPKLHSEPSKKGETPTVDGTWKTPSFPKKKTAASSNGSGQPLDKKAAVSWLTPAPSKKADSVAAKVDLLGEFQSALPKINSHPTRSQKKSSQKKSSKKNHPQKNAPQNSTQAHSENKCSGASQKLPRKMVAIDCEMVGTGPKGHVSSLARCSIVNYNGDVLYDEYILPPCHIVDYRTRWSGIRKQHMVNATPFKIARGQILKILTGKIVVGHAIHNDFKALQYFHPKSLTRDTSHIPPLNRKADCPENATMSLKHLTKKLLNRDIQVGKSGHSSVEDAQATMELYKLVEVEWEEHLARNPPTD

SEQ ID NO: 860993 - protein, 353 aa, Homo sapiens; identical to SEQ ID NO: 860992

SEQ ID NO: 860994 - protein, 353 aa, Homo sapiens; identical to SEQ ID NO: 860992

SEQ ID NO: 860995 - protein, 312 aa, Homo sapiens
MSTLLLNLDFGEPPPKKALEGNAKHRNFVKKRRLLERRGFLSKKNQPPSKAPKLHSEPSKKGETPTVDGTWKTPSFPKKKTAASSNGSGQPLDKKAAVSWLTPAPSKKADSVAAKVDLLGEFQSALPKINSHPTRSQKKSSQKKSSKKNHPQKNAPQNSTQAHSENKCSGASQKLPRKMVAIDCEMVGTGPKGHVSSLARCSIVNYNGDVLYDEYILPPCHIVDYRTRWSGIRKQHMVNATPFKIARGQILKILTGKIVVGHAIHNDFKALQYFHPKSLTRDAGDMRRQRQHPGETGQWTNGQLHQLHIFGS

SEQ ID NO: 860996 - protein, 138 aa, Homo sapiens
MSPNRVYHGNHLWKRKVDSRRKKTCGSEHFKDGEILKILTGKIVVGHAIHNDFKALQYFHPKSLTRDTSHIPPLNRKADCPENATMSLKHLTKKLLNRDIQVGKSGHSSVEDAQATMELYKLVEVEWEEHLARNPPTD

SEQ ID NO: 860997 - protein, 175 aa, Homo sapiens [sequence omitted]

SEQ ID NO: 860998 - protein, 413 aa, Homo sapiens
MSTLLLNLDFGEPPPKKALEGNAKHRNFVKKRRLLERRGFLSKKNQPPSKAPKLHSEPSKKGETPTVDGTWKTPSFPKKKTAASSNGSGQPLDKKAAVSWLTPAPSKKADSVAAKVDLLGEFQSALPKINSHPTRSQKKSSQKKSSKKNHPQKNAPQNSTQAHSENKCSGASQKLPRKMVAIDCEMVGTGPKGHVSSLARCSIVNYNGDVLYDEYILPPCHIVDYRTRWSGIRKQHMVNATPFKIARGQILKILTGKIVVGHAIHNDFKALQYFHPKSLTRDTSHIPPLNRKADCPENATMSLKHLTKKLLNRDIQWEELRSELMAAEQEDDVEGVCKPLSAAGEHKTLRVRGPCLHPSEHHVSGPRSPRRITAGPQRCIWERWGRWQARVPLARTLVPTLPPPRSTCSVSAL

SEQ ID NO: 860999 - protein, 353 aa, Homo sapiens; identical to SEQ ID NO: 860992

SEQ ID NO: 861000 - protein, 353 aa, Homo sapiens; identical to SEQ ID NO: 860992

SEQ ID NO: 861001 - protein, 353 aa, Homo sapiens; identical to SEQ ID NO: 860992

SEQ ID NO: 861002 - protein, 488 aa, Homo sapiens
MNFTPTHTPVCRKRTVVSKRGVAVSGPTKRRGMADSLESTPLPSPEDRLAKLHPSKELLEYYQKKMAECEAENEDLLKKLELYKEACEGQHKLECDLQQREEEIAELQKALSDMQVCLFQEREHVLRLYSENDRLRIRELEDKKKIQNLLALVGTDAGEVTYFCKEPPHKVTILQKTIQAVGECEQSESSAFKADPKISKRRPSRERKESSEHYQRDIQTLILQVEALQAQLGEQTKLSREQIEGLIEDRRIHLEEIQVQHQRNQNKIKELTKNLHHTQELLYESTKDFLQLRSENQNKEKSWMLEKDNLMSKIKQYRVQCKKKEDKIGKVLPVMHESHHAQSEYIKSLKDKLVQEKKLSNMYQEQCISLEEELARIREEEGMRREIFKDRTNKMGKRLQIMTKRYEALERRRILEVEGFKTDIKVLRQKLKDLEQMLYKATVNARANQDLALLCEVRDSNRRAHKIQGELKNLKSKVFGLENELRLC

SEQ ID NO: 861003 - protein, 276 aa, Homo sapiens
MNFTPTHTPVCRKRTVVSKRGVAVSGPTKRRGMADSLESTPLPSPEDRLAKLHPSKELLEYYQKKMAECEAENEDLLKKLELYKEACEGQHKLECDLQQREEEIAELQKALSDMQVCLFQEREHVLRLYSENDRLRIRELEDKKKIQNLLALVGTDAGEVTYFCKEPPHKVTILQKTIQAVGECEQSESSAFKADPKISKRRPSRERKESSEHYQRDIQTLILQVEALQAQLGEQTKLSREQIEGLIEDRRIHLEEIQVQHQRNQNKIKELTKNGS

SEQ ID NO: 861004 - protein, 456 aa, Homo sapiens
MADSLESTPLPSPEDRLAKLHPSKELLEYYQKKMAECEAENEDLLKKLELYKEACEGQHKLECDLQQREEEIAELQKALSDMQVCLFQEREHVLRLYSENDRLRIRELEDKKKIQNLLALVGTDAGEVTYFCKEPPHKVTILQKTIQAVGECEQSESSAFKADPKISKRRPSRERKESSEHYQRDIQTLILQVEALQAQLGEQTKLSREQIEGLIEDRRIHLEEIQVQHQRNQNKIKELTKNLHHTQELLYESTKDFLQLRSENQNKEKSWMLEKDNLMSKIKQYRVQCKKKEDKIGKVLPVMHESHHAQSEYIKSLKDKLVQEKKLSNMYQEQCISLEEELARIREEEGMRREIFKDRTNKMGKRLQIMTKRYEALERRRILEVEGFKTDIKVLRQKLKDLEQMLYKATVNARANQDLALLCEVRDSNRRAHKIQGELKNLKSKVFGLENELRLC

SEQ ID NO: 861005 - protein, 498 aa, Homo sapiens
CGCLSPCPPKFCPVQRLHAARPWRTVVSKRGVAVSGPTKRRGMADSLESTPLPSPEDRLAKLHPSKELLEYYQKKMAECEAENEDLLKKLELYKEACEGQHKLECDLQQREEEIAELQKALSDMQVCLFQEREHVLRLYSENDRLRIRELEDKKKIQNLLALVGTDAGEVTYFCKEPPHKVTILQKTIQAVGECEQSESSAFKADPKISKRRPSRERKESSEHYQRDIQTLILQVEALQAQLGEQTKLSREQIEGLIEDRRIHLEEIQVQHQRNQNKIKELTKNLHHTQELLYESTKDFLQLRSENQNKEKSWMLEKDNLMSKIKQYRVQCKKKEDKIGKVLPVMHESHHAQSEYIKSLKDKLVQEKKLSNMYQEQCISLEEELARIREEEGMRREIFKDRTNKMGKRLQIMTKRYEALERRRILEVEGFKTDIKVLRQKLKDLEQMLYKATVNARANQDLALLCEVRDSNRRAHKIQGELKNLKSKVFGLENELRLC

SEQ ID NO: 861006 - protein, 395 aa, Homo sapiens
MNFTPTHTPVCRKRTVVSKRGVAVSGPTKRRGMADSLESTPLPSPEDRLAKLHPSKELLEYYQKKMAECEAENEDLLKKLELYKEACEGQHKLECDLQQREEEIAELQKALSDMQVCLFQEREHVLRLYSENDRLRIRELEDKKKIQNLLALVGTDAGEVTYFCKEPPHKVTILQKTIQAVGECEQSESSAFKADPKISKRRPSRERKESSEHYQRDIQTLILQVEALQAQLGEQTKLSREQIEGLIEDRRIHLEEIQVQHQRNQNKIKELTKNLHHTQELLYESTKDFLQLRSENQNKEKSWMLEKDNLMSKIKQYRVQCKKKEDKIGKVLPVMHESHHAQSEYIKATVNARANQDLALLCEVRDSNRRAHKIQGELKNLKSKVFGLENELRLC

SEQ ID NO: 861007 - protein, 136 aa, Homo sapiens
LLRDCTDSGTLSGAAPLLGLTFVFQLRSLTRSLSVSRTVVSKRGVAVSGPTKRRGMADSLESTPLPSPEDRLAKLHPSKELLEYYQKKMAECEAENEDLLKKLELYKEACEGQHKLECDLQQREEEIAELQKAILK

SEQ ID NO: 861008 - protein, 374 aa, Homo sapiens
MNFTPTHTPVCRKRTVVSKRGVAVSGPTKRRGMADSLESTPLPSPEDRLAKLHPSKELLEYYQKKMAECEAENEDLLKKLELYKEACEGQHKLECDLQQREEEIAELQKALSDMQVCLFQEREHVLRLYSENDRLRIRELEDKKKIQNLLALVGTDAGEVTYFCKEPPHKVTILQKTIQAVGECEQSESSAFKADPKISKRRPSRERKESSEHYQRDIQTLILQVEALQAQLGEQTKLSREQIEGLIEDRRIHLEEIQVQHQRNQNKIKELTKNLHHTQELLYESTKDFLQLRSENQNKEKSWMLEKDNLMSKIKQYRVQCKKKEDKIGKVLPVMHESHHAQSEYIKVMSLCRNEVVYFSGRVEGIPKNLQFVM

SEQ ID NO: 861009 - protein, 511 aa, Homo sapiens
LLRDCTDSGTLSGAAPLLGLTFVFQLRSLTRSLSVSRTVVSKRGVAVSGPTKRRGMADSLESTPLPSPEDRLAKLHPSKELLEYYQKKMAECEAENEDLLKKLELYKEACEGQHKLECDLQQREEEIAELQKALSDMQVCLFQEREHVLRLYSENDRLRIRELEDKKKIQNLLALVGTDAGEVTYFCKEPPHKVTILQKTIQAVGECEQSESSAFKADPKISKRRPSRERKESSEHYQRDIQTLILQVEALQAQLGEQTKLSREQIEGLIEDRRIHLEEIQVQHQRNQNKIKELTKNLHHTQELLYESTKDFLQLRSENQNKEKSWMLEKDNLMSKIKQYRVQCKKKEDKIGKVLPVMHESHHAQSEYIKSLKDKLVQEKKLSNMYQEQCISLEEELARIREEEGMRREIFKDRTNKMGKRLQIMTKRYEALERRRILEVEGFKTDIKVLRQKLKDLEQMLYKATVNARANQDLALLCEVRDSNRRAHKIQGELKNLKSKVFGLENELRLC

SEQ ID NO: 861010 - protein, 529 aa, Homo sapiens
LLRDCTDSGTLSGAAPLLGLTFVFQLRSLTRSLSVSCEKDSMNFTPTHTPVCRKRTVVSKRGVAVSGPTKRRGMADSLESTPLPSPEDRLAKLHPSKELLEYYQKKMAECEAENEDLLKKLELYKEACEGQHKLECDLQQREEEIAELQKALSDMQVCLFQEREHVLRLYSENDRLRIRELEDKKKIQNLLALVGTDAGEVTYFCKEPPHKVTILQKTIQAVGECEQSESSAFKADPKISKRRPSRERKESSEHYQRDIQTLILQVEALQAQLGEQTKLSREQIEGLIEDRRIHLEEIQVQHQRNQNKIKELTKNLHHTQELLYESTKDFLQLRSENQNKEKSWMLEKDNLMSKIKQYRVQCKKKEDKIGKVLPVMHESHHAQSEYIKSLKDKLVQEKKLSNMYQEQCISLEEELARIREEEGMRREIFKDRTNKMGKRLQIMTKRYEALERRRILEVEGFKTDIKVLRQKLKDLEQMLYKATVNARANQDLALLCEVRDSNRRAHKIQGELKNLKSKVFGLENELRLC

SEQ ID NO: 861011 - protein, 127 aa, Homo sapiens [sequence omitted]

SEQ ID NO: 861012 - protein, 488 aa, Homo sapiens; identical to SEQ ID NO: 861002

SEQ ID NO: 861013 - protein, 89 aa, Homo sapiens
PPISGSLAQGWSAGGLQVQSGKCESSVLGYSATCLPDMGRWRVSSVESWPFASTGGKLAIATAGTGTQAAPRPFLIRPPDSWALALALM

SEQ ID NO: 861014 - protein, 89 aa, Homo sapiens; identical to SEQ ID NO: 861013

SEQ ID NO: 861015 - protein, 89 aa, Homo sapiens; identical to SEQ ID NO: 861013

SEQ ID NO: 861016 - protein, 89 aa, Homo sapiens; identical to SEQ ID NO: 861013

SEQ ID NO: 861017 - protein, 125 aa, Homo sapiens
MWVPTKIPPLSPQLLTPGSESHSVSQAGVLWHRVGSLQPPSPGFKQFSCLSLQSSWDYRCPPPHPANFFIFLVDTGFHHVGQAGLELVTSGDAPALASQSAGITGPDFEQISLEIEQSCAWIPPQ

SEQ ID NO: 861018 - protein, 99 aa, Homo sapiens
MWVPTKIPPLSPQLLTPGSGKVDATVFTDSSSFLEKGLRKAGAAVTMETDVLWAQALPANTSAQKAELIALTQALRWGKDINVNTDSRYAFATVHVRGA

SEQ ID NO: 861019 - protein, 80 aa, Homo sapiens
ALPFPEAWRKVRHLEAPARNVTGRNVTGREPGPLCAPPEGQPACRGECHLKKKFPGPQRVTVFRRTADRLPCGCPQKFHL

SEQ ID NO: 861020 - protein, 89 aa, Homo sapiens; identical to SEQ ID NO: 861013

SEQ ID NO: 861021 - protein, 95 aa, Homo sapiens
PPISGSLAQGWSAGGLQVQSGKCESVRHLEAPARNVTGRNVTGREPGPLCAPPEGQPACRGECHLKKKFPGPQRVTVFRRTADRLPCGCPQKFHL

SEQ ID NO: 861022 - protein, 141 aa, Homo sapiens
TESCSVAQAGVQWRDLGSLQESASQIHAIFPPQPPGVAEKYRLPPPRPANFFIFLVDTGFHHVGQAGLELVTSGDAPALASQSAGITGGCLAKGLIFLKGFPQEGKSQTYSGKSCLFILLGPDFEQISLEIEQSCAWIPPQ

SEQ ID NO: 861023 - protein, 89 aa, Homo sapiens; identical to SEQ ID NO: 861013

SEQ ID NO: 861024 - protein, 89 aa, Homo sapiens; identical to SEQ ID NO: 861013

SEQ ID NO: 861025 - protein, 89 aa, Homo sapiens; identical to SEQ ID NO: 861013

SEQ ID NO: 861026 - protein, 89 aa, Homo sapiens; identical to SEQ ID NO: 861013

SEQ ID NO: 861027 - protein, 53 aa, Homo sapiens
METDVLWAQALPANTSAQKAELIALTQALRWGKDINVNTDSRYAFATVHVRGA

SEQ ID NO: 861028 - protein, 141 aa, Homo sapiens; identical to SEQ ID NO: 861022

SEQ ID NO: 861029 - protein, 1232 aa, Homo sapiens
MKEEVKGIPVRVALRCRPLVPKEISEGCQMCLSFVPGEPQVVVGTDKSFTYDFVFDPSTEQEEVFNTAVAPLIKGVFKGYNATVLAYGQTGSGKTYSMGGAYTAEQENEPTVGVIPRVIQLLFKEIDKKSDFEFTLKVSYLEIYNEEILDLLCPSREKAQINIREDPKEGIKIVGLTEKTVLVALDTVSCLEQGNNSRTVASTAMNSQSSRSHAIFTISLEQRKKSDKNSSFRSKLHLVDLAGSERQKKTKAEGDRLKEGININRGLLCLGNVISALGDDKKGGFVPYRDSKLTRLLQDSLGGNSHTLMIACVSPADSNLEETLNTLRYADRARKIKNKPIVNIDPQTAELNHLKQQVQQLQVLLLQAHGGTLPGSITVEPSENLQSLMEKNQSLVEENEKLSRGLSEAAGQTAQMLERIILTEQANEKMNAKLEELRQHAACKLDLQKLVETLEDQELKENVEIICNLQQLITQLSDETVACMAAAIDTAVEQEAQVETSPETSRSSDAFTTQHALRQAQMSKELVELNKALALKEALARKMTQNDSQLQPIQYQYQDNIKELELEVINLQKEKEELVLELQTAKKDANQAKLSERRRKRLQELEGQIADLKKKLNEQSKLLKLKESTERTVSKLNQEIRMMKNQRVQLMRQMKEDAEKFRQWKQKKDKEVIQLKERDRKRQYELLKLERNFQKQSNVLRRKTEEAAAANKRLKDALQKQREVADKRKETQSRGMEGTAARVKNWLGNEIEVMVSTEEAKRHLNDLLEDRKILAQDVAQLKEKKESGENPPPKLRRRTFSLTEVRGQVSESEDSITKQIESLETEMEFRSAQIADLQQKLLDAESEDRPKQRWENIATILEAKCALKYLIGELVSSKIQVSKLESSLKQSKTSCADMQKMLFEERNHFAEIETELQAELVRMEQQHQEKVLYLLSQLQQSQMAEKQLEESVSEKEQQLLSTLKCQDEELEKMREVCEQNQQLLRENEIIKQKLTLLQVASRQKHLPKDTLLSPDSSFEYVPPKPKPSRVKEKFLEQSMDIEDLKYCSEHSVNEHEDGDGDDDEGDDEEWKPTKLVKVSRKNIQGCSCKGWCGNKQCGCRKQKSDCGVDCCCDPTKCRNRQQGKDSLGTVERTQDSEGSFKLEDPTEVTPGLSFFNPVCATPNSKILKEMCDVEQVLSKKTPPAPSPFDLPELKHVATEYQENKAPGKKKKRALASNTSFFSGCSPIEEEAH

SEQ ID NO: 861030 - protein, 1232 aa, Homo sapiens; identical to SEQ ID NO: 861029

SEQ ID NO: 861031 - protein, 1232 aa, Homo sapiens; identical to SEQ ID NO: 861029

SEQ ID NO: 861032 - protein, 844 aa, Homo sapiens
MEKNQSLVEENEKLSRGLSEAAGQTAQMLERIILTEQANEKMNAKLEELRQHAACKLDLQKLVETLEDQELKENVEIICNLQQLITQLSDETVACMAAAIDTAVEQEAQVETSPETSRSSDAFTTQHALRQAQMSKELVELNKALALKEALARKMTQNDSQLQPIQYQYQDNIKELELEVINLQKEKEELVLELQTAKKDANQAKLSERRRKRLQELEGQIADLKKKLNEQSKLLKLKESTERTVSKLNQEIRMMKNQRVQLMRQMKEDAEKFRQWKQKKDKEVIQLKERDRKRQYELLKLERNFQKQSNVLRRKTEEAAAANKRLKDALQKQREVADKRKETQSRGMEGTAARVKNWLGNEIEVMVSTEEAKRHLNDLLEDRKILAQDVAQLKEKKESGENPPPKLRRRTFSLTEVRGQVSESEDSITKQIESLETEMEFRSAQIADLQQKLLDAESEDRPKQRWENIATILEAKCALKYLIGELVSSKIQVSKLESSLKQSKTSCADMQKMLFEERNHFAEIETELQAELVRMEQQHQEKVLYLLSQLQQSQMAEKQLEESVSEKEQQLLSTLKCQDEELEKMREVCEQNQQLLRENEIIKQKLTLLQVASRQKHLPKDTLLSPDSSFEYVPPKPKPSRVKEKFLEQSMDIEDLKYCSEHSVNEHEDGDGDDDEGDDEEWKPTKLVKVSRKNIQGCSCKGWCGNKQCGCRKQKSDCGVDCCCDPTKCRNRQQGKDSLGTVERTQDSEGSFKLEDPTEVTPGLSFFNPVCATPNSKILKEMCDVEQVLSKKTPPAPSPFDLPELKHVATEYQENKAPGKKKKRALASNTSFFSGCSPIEEEAH

SEQ ID NO: 861033 - protein, 419 aa, Homo sapiens
MKEEVKGIPVRVALRCRPLVPKEISEGCQMCLSFVPGEPQVVVGTDKSFTYDFVFDPSTEQEEVFNTAVAPLIKGVFKGYNATVLAYGQTGSGKTYSMGGAYTAEQENEPTVGVIPRVIQLLFKEIDKKSDFEFTLKVSYLEIYNEEILDLLCPSREKAQINIREDPKEGIKIVGLTEKTVLVALDTVSCLEQGNNSRTVASTAMNSQSSRSHAIFTISLEQRKKSDKNSSFRSKLHLVDLAGSERQKKTKAEGDRLKEGININRGLLCLGNVISALGDDKKGGFVPYRDSKLTRLLQDSLGGNSHTLMIACVSPADSNLEETLNTLRYADRARKIKNKPIVNIDPQTAELNHLKQQVQQLQVLLLQAHGGTLPGSITYVKHNGSKSQSYTKRYTQSREMQIKTPMRYHLMPIRMATVK

SEQ ID NO: 861034 - protein, 1232 aa, Homo sapiens; identical to SEQ ID NO: 861029

SEQ ID NO: 861035 - protein, 1232 aa, Homo sapiens; identical to SEQ ID NO: 861029

SEQ ID NO: 861036 - protein, 1232 aa, Homo sapiens; identical to SEQ ID NO: 861029

SEQ ID NO: 861037 - protein, 622 aa, Homo sapiens
MKEEVKGIPVRVALRCRPLVPKEISEGCQMCLSFVPGEPQVVVGTDKSFTYDFVFDPSTEQEEVFNTAVAPLIKGVFKGYNATVLAYGQTGSGKTYSMGGAYTAEQENEPTVGVIPRVIQLLFKEIDKKSDFEFTLKVSYLEIYNEEILDLLCPSREKAQINIREDPKEGIKIVGLTEKTVLVALDTVSCLEQGNNSRTVASTAMNSQSSRSHAIFTISLEQRKKSDKNSSFRSKLHLVDLAGSERQKKTKAEGDRLKEGININRGLLCLGNVISALGDDKKGGFVPYRDSKLTRLLQDSLGGNSHTLMIACVSPADSNLEETLNTLRYADRARKIKNKPIVNIDPQTAELNHLKQQVQQLQVLLLQAHGGTLPGSITVEPSENLQSLMEKNQSLVEENEKLSRGLSEAAGQTAQMLERIILTEQANEKMNAKLEELRQHAACKLDLQKLVETLEDQELKENVEIICNLQQLITQLSDETVACMAAAIDTAVEQEAQVETSPETSRSSDAFTTQHALRQAQMSKELVELNKALALKEALARKMTQNDSQLQPIQYQYQDNIKELELEVINLQKEKEELVLELQTAKKDANQAKLSEPANVSELRQCCLKKLMTANFELRSRR

SEQ ID NO: 861038 - protein, 185 aa, Homo sapiens
ANNSISCNRQSGVKVEAQCKVELRGNGIYDNRGHGIITKGDSTIVIENDIIGNRGSGLQLLPRSDTKVIKNRIHSFRAYGIAVRGRAKALVQENIIFQGKTSKTIFQQISNNRECIMQNNKFLVFKKKSDTWRLVNPPARPHLENSLRRPSAAHNGQKVTAMATRITARVEGGYHSNRSVFCTIL

SEQ ID NO: 861039 - protein, 228 aa, Homo sapiens
ANNSISCNRQSGVKVEAQCKVELRGNGIYDNRGHGIITKGDSTIVIENDIIGNRGSGLQLLPRSDTKVIKNRIHSFRAYGIAVRGRAKALVQENIIFQGKTSKTIFQQISNNRECIMQNNKFLVFKKKLSAWGCLNESSRATVSSLKKPGPHPGIVAARAPCNPASCRLQSEKGLCLALCQARAEDSPGGNKLFKSQGYVVSDLSSAGYWLCDLGQLTSHLRALVKSI

SEQ ID NO: 861040 - protein, 185 aa, Homo sapiens; identical to SEQ ID NO: 861038

SEQ ID NO: 861041 - protein, 185 aa, Homo sapiens; identical to SEQ ID NO: 861038

SEQ ID NO: 861042 - protein, 121 aa, Homo sapiens
MRLAGGEAAAGRAADSGGLGHIPGADRSPAGVTGSFAECSTAPSRSWRRWPGRTERRGCSAVLARWPSGAADAAAPLPGAVAALDGAVGPRRRLRVALEPHLGDDAAPPALHAVPAAGAAR

SEQ ID NO: 861043 - protein, 169 aa, Homo sapiens
MCRATLGLPLPPIVIQPARRSLPPIVTPASRRLGPRGGRHLGSVSTAMAATQELLLQLQKDNRDGRQRKQELEKLMRGLEAESESLPQPAPAGPERAGAEAAAEAKPGSAASARGGARGGAGARAAGAQKTGGGGAPQGGLGEEESWNGAGPRVGWGRAGGRGQDPGVG

SEQ ID NO: 861044 - protein, 169 aa, Homo sapiens; identical to SEQ ID NO: 861043

SEQ ID NO: 861045 - protein, 213 aa, Homo sapiens
MRLAGGEAAAGRAADSGGLGHIPGADRSPAGAAPLRRQGASRLSSPRPGAVSLPTHRQDASPRPQSALSPAPGGAGEGDGGCGGAGRLAEWPGTVRELGLRARRGTVGPGRAGLPPACLSPAGVTGSFAECSTAPSRSWRRWPGRTERRGCSAVLARWPSGAADAAAPLPGAVAALDGAVGPRRRLRVALEPHLGDDAAPPALHAVPAAGAAR

SEQ ID NO: 861046 - protein, 213 aa, Homo sapiens; identical to SEQ ID NO: 861045

SEQ ID NO: 861047 - protein, 131 aa, Homo sapiens
MEEMARADRVSACAGPGGVGWSGTPLPIPPAVPPPPPPGNRAGAAGAEVDWMRPSLPAGDAAVRRSSRAGHQALLTLPLLFLGLSLLWTVLLDPGAVSAWLWSLTSETTLRRLRYTLSPLLELRANGLLPT

SEQ ID NO: 861048 - protein, 129 aa, Homo sapiens
MPVPAGVTGSFAECSTAPSRSWRRWPGRTERRGCSAVLARWPSGEQGGGAAAVPHVPARAAAHLPAFALQALLTLPLLFLGLSLLWTVLLDPGAVSAWLWSLTSETTLRRLRYTLSPLLELRANGLLPT

SEQ ID NO: 861049 - protein, 121 aa, Homo sapiens; identical to SEQ ID NO: 861042

SEQ ID NO: 861050 - protein, 169 aa, Homo sapiens; identical to SEQ ID NO: 861043

SEQ ID NO: 861051 - protein, 105 aa, Homo sapiens
MAFECGWGRACRPAPAESNPGVHTQDALQTAEAWAIFQEQTVVLQVRPHSDAKVPPASPPPDLGRCDGQLRRVQYSTESLMEEMARADRETRLFGGPRALAIRRC

SEQ ID NO: 861052 - protein, 131 aa, Homo sapiens; identical to SEQ ID NO: 861047

SEQ ID NO: 861053 - protein, 131 aa, Homo sapiens
MEEMARADRVSACAGPGGVGWSGTPLPIPPAVPPPPPPGNRAGAAGAEVAWMRPSLPAGDAAVRRSSRAGHQALLTLPLLFLGLSLLWTVLLDPGAVSAWLWSLTSETTLRRLRYTLSPLLELRANGLLPT

SEQ ID NO: 861054 - protein, 989 aa, Homo sapiens
APGPALLKMAADSEPESEVFEITDFTTASEWERFISKVEEVLNDWKLIGNSLGKPLEKGIFTSGTWEEKSDEISFADFKFSVTHHYLVQESTDKEGKDELLEDVVPQSMQDLLGMNNDFPPRAHCLVRWYGLREFVVIAPAAHSDAVLSESKCNLLLSSVSIALGNTGCQVPLFVQIHHKWRRMYVGECQGPGVRTDFEMVHLRKVPNQYTHLSGLLDIFKSKIGCPLTPLPPVSIAIRFTYVLQDWQQYFWPQQPPDIDALVGGEVGGLEFGKLPFGACEDPISELHLATTWPHLTEGIIVDNDVYSDLDPIQAPHWSVRVRKAENPQCLLGDFVTEFFKICRRKESTDEILGRSAFEEEGKETADITHALSKLTEPASVPIHKLSVSNMVHTAKKKIRKHRGVEESPLNNDVLNTILLFLFPDAVSEKPLDGTTSTDNNNPPSESEDYNLYNQFKSAPSDSLTYKLALCLCMINFYHGGLKGVAHLWQEFVLEMRFRWENNFLIPGLASGPPDLRCCLLHQKLQMLNCCIERKKARDEGKKTSASDVTNIYPGDAGKAGDQLVPDNLKETDKEKGEVGKSWDSWSDSEEEFFECLSDTEELKGNGQESGKKGGPKEMANLRPEGRLYQHGKLTLLHNGEPLYIPVTQEPAPMTEDLLEEQSEVLAKLGTSAEGAHLRARMQSACLLSDMESFKAANPGCSLEDFVRWYSPRDYIEEEVIDEKGNVVLKGELSARMKIPSNMWVEAWETAKPIPARRQRRLFDDTREAEKVLHYLAIQKPADLARHLLPCVIHAAVLKVKEEESLENISSVKKIIKQIISHSSKVLHFPNPEDKKLEEIIHQITNVEALIARARSLKAKFGTEKCEQEEEKEDLERFVSCLLEQPEVLVTGAGRGHAGRIIHKLFVNAQRAAAMTPPEEELKRMGSPEERRQNSVSDFPPPAGREFILRTTVPRPAPYSKALPQRMYSVLTKEDFRLAGAFSSDTSFF

SEQ ID NO: 861055 - protein, 998 aa, Homo sapiens
APGPALLKMAADSEPESEVFEITDFTTASEWERFISKVEEVLNDWKLIGNSLGKPLEKGIFTSGTWEEKSDEISFADFKFSVTHHYLVQESTDKEGKDELLEDVVPQSMQDLLGMNNDFPPRAHCLVRWYGLREFVVIAPAAHSDAVLSESKCNLLLSSVSIALGNTGCQVPLFVQIHHKWRRMYVGECQGPGVRTDFEMVHLRKVPNQYTHLSGLLDIFKSKIGCPLTPLPPVSIAIRFTYVLQDWQQYFWPQQPPDIDALVGGEVGGLEFGKLPFGACEDPISELHLATTWPHLTEGIIVDNDVYSDLDPIQAPHWSVRVRKAENPQCLLGDFVTEFFKICRRKESTDEILGRSAFEEEGKETADITHALSKLTEPASVPIHKLSVSNMVHTAKKKIRKHRGVEESPLNNDVLNTILLFLFPDAVSEKPLDGTTSTDNNNPPSESEDYNLYNQFKSAPSDSLTYKLALCLCMINFYHGGLKGVAHLWQEFVLEMRFRWENNFLIPGLASGPPDLRCCLLHQKLQMLNFALGFRFFFGQNAQRKARDEGKKTSASDVTNIYPGDAGKAGDQLVPDNLKETDKEKGEVGKSWDSWSDSEEEFFECLSDTEELKGNGQESGKKGGPKEMANLRPEGRLYQHGKLTLLHNGEPLYIPVTQEPAPMTEDLLEEQSEVLAKLGTSAEGAHLRARMQSACLLSDMESFKAANPGCSLEDFVRWYSPRDYIEEEVIDEKGNVVLKGELSARMKIPSNMWVEAWETAKPIPARRQRRLFDDTREAEKVLHYLAIQKPADLARHLLPCVIHAAVLKVKEEESLENISSVKKIIKQIISHSSKVLHFPNPEDKKLEEIIHQITNVEALIARARSLKAKFGTEKCEQEEEKEDLERFVSCLLEQPEVLVTGAGRGHAGRIIHKLFVNAQRAAAMTPPEEELKRMGSPEERRQNSVSDFPPPAGREFILRTTVPRPAPYSKALPQRMYSVLTKEDFRLAGAFSSDTSFF

SEQ ID NO: 861056 - protein, 842 aa, Homo sapiens
APGPALLKMAADSEPESEVFEITDFTTASEWERFISKVEEVLNDWKLIGNSLGKPLEKGIFTSGTWEEKSDEISFADFKFSVTHHYLVQESTDKEGKDELLEDVVPQSMQDLLGMNNDFPPRAHCLVRWYGLREFVVIAPAAHSDAVLSESKCNLLLSSVSIALGNTGCQVPLFVQIHHKWRRMYVGECQGPGVRTDFEMVHLRKVPNQYTHLSGLLDIFKSKIGCPLTPLPPVSIAIRFTYVLQDWQQYFWPQQPPDIDALVGGEVGGLEFGKLPFGACEDPISELHLATTWPHLTEGIIVDNDVYSDLDPIQAPHWSVRVRKAENPQCLLGDFVTEFFKICRRKESTDEILGRSAFEEEGKETADITHALSKLTEPASVPIHKLSVSNMVHTAKKKIRKHRGVEESPLNNDVLNTILLFLFPDAVSEKPLDGTTSTDNNNPPSESEDYNLYNQFKSAPSDSLTYKLALCLCMINFYHGGLKGVAHLWQEFVLEMRFRWENNFLIPGLASGPPDLRCCLLHQKLQMLNCCIERKKARDEGKKTSASDVTNIYPGDAGKAGDQLVPDNLKETDKEKGEVGKSWDSWSDSEEEFFECLSDTEELKGNGQESGKKGGPKEMANLRPEGRLYQHGKLTLLHNGEPLYIPVTQEPAPMTEDLLEEQSEVLAKLGTSAEGAHLRARMQSACLLSDMESFKAANPGCSLEDFVRWYSPRDYIEEEVIDEKGNVVLKGELSARMKIPSNMWVEAWETAKPIPARRQRRLFDDTREAEKVLHYLAIQKPADLARHLLPCVIHAAVLKVKEEESLENISSVKKIIKQIISHSSKVLHFPNPEDKKLEVSLM

SEQ ID NO: 861057 - protein, 980 aa, Homo sapiens
APGPALLKMAADSEPESEVFEITDFTTASEWERFISKVEEVLNDWKLIGNSLGKPLEKGIFTSGTWEEKSDEISFADFKFSVTHHYLVQESTDKEGKDELLEDVVPQSMQDLLGMNNDFPPRAHCLVRWYGLREFVVIAPAAHSDAVLSESKCNLLLSSVSIALGNTGCQVPLFVQIHHKWRRMYVGECQGPGVRTDFEMVHLRKVPNQYTHLSGLLDIFKSKIGCPLTPLPPVSIAIRFTYVLQDWQQYFWPQQPPDIDALVGGEVGGLEFGKLPFGACEDPISELHLATTWPHLTEGIIVDNDVYSDLDPIQAPHWSVRVRKAENPQCLLGDFVTEFFKICRRKESTDEILGRSAFEEEGKETADITHALSKLTEPASVPIHKLSVSNMVHTAKKKIRKHRGVEESPLNNDVLNTILLFLFPDAVSEKPLDGTTSTDNNNPPSESEDYNLYNQFKSAPSDSLTYKLALCLCMINFYHGGLKGVAHLWQEFVLEMRFRWENNFLIPGLASGPPDLRCCLLHQKLQMLNCCIERKKARDEGKKTSASDVTNIYPGDAGKAGDQLVPDNLKETDKEKGEVGKSWDSWSDSEEEFFECLSDTEELKGNGQESGKKGGPKEMANLRPEGRLYQHGKLTLLHNGEPLYIPVTQEPAPMTEDLLEEQSEVLAKLGTSAEGAHLRARMQSACLLSDMESFKAANPGCSLEDFVRWYSPRDYIEEEVIDEKGNVVLKGELSARMKIPSNMWVEAWETAKPIPARRQRRLFDDTREAEKVLHYLAIQKPADLARHLLPCVIHAAVLKVKEEESLENISSVKKIIKQIISHSSKVLHFPNPEDKKLEEIIHQITNVEALIARARSLKAKFGTEKCEQEEEKEDLERFVSCLLEQPEVLVTGAGRGHAGRIIHKLFVNAQRAAAMTPPEEELKRMGSPEERRQNSVSDFPPPAGREFILRTTVPRPAPYSKALPQRMYSVLTKEDFRLAG

SEQ ID NO: 861058 - protein, 917 aa, Homo sapiens
APGPALLKMAADSEPESEVFEITDFTTASEWERFISKVEEVLNDWKLIGNSLGKPLEKGIFTSGTWEEKSDEISFADFKFSVTHHYLVQESTDKEGKDELLEDVVPQSMQDLLGMNNDFPPRAHCLVRWYGLREFVVIAPAAHSDAVLSESKCNLLLSSVSIALGNTGCQVPLFVQIHHKWRRMYVGECQGPGVRTDFEMVHLRKVPNQYTHLSGLLDIFKSKIGCPLTPLPPVSIAIRFTYVLQDWQQYFWPQQPPDIDALVGGEVGGLEFGKLPFGACEDPISELHLATTWPHLTEGIIVDNDVYSDLDPIQAPHWSVRVRKAENPQCLLGDFVTEFFKICRRKESTDEILGRSAFEEEGKETADITHALSKLTEPASVPIHKLSVSNMVHTAKKKIRKHRGVEESPLNNDVLNTILLFLFPDAVSEKPLDGTTSTDNNNPPSESEDYNLYNQFKSAPSDSLTYKLALCLCMINFYHGGLKGVAHLWQEFVLEMRFRWENNFLIPGLASGPPDLRCCLLHQKLQMLNCCIERKKARDEGKKTSASDVTNIYPGDAGKAGDQLVPDNLKETDKEKGEVGKSWDSWSDSEEEFFECLSDTEELKGNGQESGKKGGPKEMANLRPEGRLYQHGKLTLLHNGEPLYIPVTQEPAPMTEDLLEEQSEVLAKLGTSAEGAHLRARMQSACLLSDMESFKAANPGCSLEDFVRWYSPRDYIEEEVIDEKGNVVLKGELSARMKIPSNMWVEAWETAKPIPARRQRRLFDDTREAEKVLHYLAIQKPADLARHLLPCVIHAAVLKVKEEESLENISSVKKIIKQIISHSSKVLHFPNPEDKKLEEIIHQITNVEALIARARSLKAKFGTEKCEQEEEKEDLERFVSCLLEQPEVLVTGAGRGHAGRIIHKLFVNAQRVCESHY

SEQ ID NO: 861059 - protein, 812 aa, Homo sapiens
APGPALLKMAADSEPESEVFEITDFTTASEWERFISKVEEVLNDWKLIGNSLGKPLEKGIFTSGTWEEKSDEISFADFKFSVTHHYLVQESTDKEGKDELLEDVVPQSMQDLLGMNNDFPPRAHCLVRWYGLREFVVIAPAAHSDAVLSESKCNLLLSSVSIALGNTGCQVPLFVQIHHKWRRMYVGECQGPGVRTDFEMVHLRKVPNQYTHLSGLLDIFKSKIGCPLTPLPPVSIAIRFTYVLQDWQQYFWPQQPPDIDALVGGEVGGLEFGKLPFGACEDPISELHLATTWPHLTEGIIVDNDVYSDLDPIQAPHWSVRVRKAENPQCLLGDFVTEFFKICRRKESTDEILGRSAFEEEGKETADITHALSKLTEPASVPIHKLSVSNMVHTAKKKIRKHRGVEESPLNNDVLNTILLFLFPDAVSEKPLDGTTSTDNNNPPSESEDYNLYNQFKSAPSDSLTYKLALCLCMINFYHGGLKGVAHLWQEFVLEMRFRWENNFLIPGLASGPPDLRCCLLHQKLQMLNCCIERKKARDEGKKTSASDVTNIYPGDAGKAGDQLVPDNLKETDKEKGEVGKSWDSWSDSEEEFFECLSDTEELKGNGQESGKKGGPKEMANLRPEGRLYQHGKLTLLHNGEPLYIPVTQEPAPMTEDLLEEQSEVLAKLGTSAEGAHLRARMQSACLLSDMESFKAANPGCSLEDFVRWYSPRDYIEEEVIDEKGNVVLKGELSARMKIPSNMWVEAWETAKPIPARRQRRLFDDTREAEKVLHYLAIQKPADLARHLLPCVIHAAVLKVKEEASDRNMSAI

SEQ ID NO: 861060 - protein, 500 aa, Homo sapiens
APGPALLKMAADSEPESEVFEITDFTTASEWERFISKVEEVLNDWKLIGNSLGKPLEKGIFTSGTWEEKSDEISFADFKFSVTHHYLVQESTDKEGKDELLEDVVPQSMQDLLGMNNDFPPRAHCLVRWYGLREFVVIAPAAHSDAVLSESKCNLLLSSVSIALGNTGCQVPLFVQIHHKWRRMYVGECQGPGVRTDFEMVHLRKVPNQYTHLSGLLDIFKSKIGCPLTPLPPVSIAIRFTYVLQDWQQYFWPQQPPDIDALVGGEVGGLEFGKLPFGACEDPISELHLATTWPHLTEGIIVDNDVYSDLDPIQAPHWSVRVRKAENPQCLLGDFVTEFFKICRRKESTDEILGRSAFEEEGKETADITHALSKLTEPASVPIHKLSVSNMVHTAKKKIRKHRGVEESPLNNDVLNTILLFLFPDAVSEKPLDGTTSTDNNNPPSESEDYNLYNQFKSAPSDSLTYKLALCLCMINFYHGGLKGVAHLWSSGREFSSSRA

SEQ ID NO: 861061 - protein, 989 aa, Homo sapiens; identical to SEQ ID NO: 861054

SEQ ID NO: 861062 - protein, 962 aa, Homo sapiens
APGPALLKMAADSEPESEVFEITDFTTASEWERFISKVEEVLNDWKLIGNSLGKPLEKGIFTSGTWEEKSDEISFADFKFSVTHHYLVQESTDKEGKDELLEDVVPQSMQDLLGMNNDFPPRAHCLVRWYGLREFVVIAPAAHSDAVLSESKCNLLLSSVSIALGNTGCQVPLFVQIHHKWRRMYVGECQGPGVRTDFEMVHLRKVPNQYTHLSGLLDIFKSKIGCPLTPLPPVSIAIRFTYVLQDWQQYFVASATSSELHLATTWPHLTEGIIVDNDVYSDLDPIQAPHWSVRVRKAENPQCLLGDFVTEFFKICRRKESTDEILGRSAFEEEGKETADITHALSKLTEPASVPIHKLSVSNMVHTAKKKIRKHRGVEESPLNNDVLNTILLFLFPDAVSEKPLDGTTSTDNNNPPSESEDYNLYNQFKSAPSDSLTYKLALCLCMINFYHGGLKGVAHLWQEFVLEMRFRWENNFLIPGLASGPPDLRCCLLHQKLQMLNCCIERKKARDEGKKTSASDVTNIYPGDAGKAGDQLVPDNLKETDKEKGEVGKSWDSWSDSEEEFFECLSDTEELKGNGQESGKKGGPKEMANLRPEGRLYQHGKLTLLHNGEPLYIPVTQEPAPMTEDLLEEQSEVLAKLGTSAEGAHLRARMQSACLLSDMESFKAANPGCSLEDFVRWYSPRDYIEEEVIDEKGNVVLKGELSARMKIPSNMWVEAWETAKPIPARRQRRLFDDTREAEKVLHYLAIQKPADLARHLLPCVIHAAVLKVKEEESLENISSVKKIIKQIISHSSKVLHFPNPEDKKLEEIIHQITNVEALIARARSLKAKFGTEKCEQEEEKEDLERFVSCLLEQPEVLVTGAGRGHAGRIIHKLFVNAQRAAAMTPPEEELKRMGSPEERRQNSVSDFPPPAGREFILRTTVPRPAPYSKALPQRMYSVLTKEDFRLAGAFSSDTSFF

SEQ ID NO: 861063 - protein, 124 aa, Homo sapiens
MKGHLQVYSLFGENTVHPLRQSFVVTGAGRGHAGRIIHKLFVNAQRAAAMTPPEEELKRMGSPEERRQNSVSDFPPPAGREFILRTTVPRPAPYSKALPQRMYSVLTKEDFRLAGAFSSDTSFF

SEQ ID NO: 861064 - protein, 980 aa, Homo sapiens; identical to SEQ ID NO: 861057

SEQ ID NO: 861065 - protein, 344 aa, Homo sapiens
APGPALLKMAADSEPESEVFEITDFTTASEWERFISKVEEVLNDWKLIGNSLGKPLEKGIFTSGTWEEKSDEISFADFKFSVTHHYLVQESTDKEGKDELLEDVVPQSMQDLLGMNNDFPPRAHCLVRWYGLREFVVIAPAAHSDAVLSESKCNLLLSSVSIALGNTGCQVPLFVQIHHKWRRMYVGECQGPGVRTDFEMVHLRKVPNQYTHLSGLLDIFKSKIGCPLTPLPPVSIAIRFTYVLQDWQQYFWPQQPPDIDALVGGEVGGLEFGKLPFGACEDPISELHLATTWPHLTEGIIVDNDVYSDLDPIQAPHWSVRVRKAENPQCLLGDFVTEFFKIAV

SEQ ID NO: 861066 - protein, 103 aa, Homo sapiens
RPQRLGRLGFPLPPRTPKDTPNPRPAGPALARPKYYLAQASARGTPKLPMYPAPEGLHSQEVPMYPNTGRHPAPPSQTRKKVNLTTTYSPKTTYFVLAGLPAT

SEQ ID NO: 861067 - protein, 347 aa, Homo sapiens
TGSGVRRKRWQPHSPLGGRGARPWGGESPAPQVRAMGRRRAARGPGAEGGRPRHLPTRSLEAFAEEVGAALQASVEPGAADGEGGPGPAALPCTLAMWELGHCDPRRCTGRKLARLGLVRCLRLGHRFGGLVLSPVGKQYASPADRQLVAQSGVAVIDCSWARLDETPFGKMRGSHLRLLPYLVAANPVNYGRPYRLSCVEAFAATFCIVGFPDLAVILLRKFKWGKGFLDLNRQLLDKYAACGSPEEVLQAEQEFLANAKESPQEEEIDPFDVDSGREFGNPNRPVASTRLPSDTDDSDASEDPGPGAERGGASSSCCEEEQTQGRGAEARAPAEVWKGIKKRQRD

SEQ ID NO: 861068 - protein, 219 aa, Homo sapiens
TGSGVRRKRWQPHSPLGGRGARPWGGESPAPQVRAMGRRRAARGPGAEGGRPRHLPTRSLEAFAEEVGAALQASVEPGAADGEGGPGPAALPCTLAMWELGHCDPRRCTGRKLARLGLVRCLRLGHRFGGLVLSPVGKQYASPADRQLVAQSGVAVIDCSWARLDETPFGKMRGSHLRLLPYLVAANPVNYGRPYRLSCVEAFAATFCIVGESSGPTAV

SEQ ID NO: 861069 - protein, 306 aa, Homo sapiens
TGSGVRRKRWQPHSPLGGRGARPWGGESPAPQVRAMGRRRAARGPGAEGGRPRHLPTRSLEAFAEEVGAALQASVEPGAADGEGGPGPAALPCTLAMWELGHCDPRRCTGRKLARLGLVRCLRLGHRFGGLVLSPLRLLPYLVAANPVNYGRPYRLSCVEAFAATFCIVGFPDLAVILLRKFKWGKGFLDLNRQLLDKYAACGSPEEVLQAEQEFLANAKESPQEEEIDPFDVDSGREFGNPNRPVASTRLPSDTDDSDASEDPGPGAERGGASSSCCEEEQTQGRGAEARAPAEVWKGIKKRQRD

SEQ ID NO: 861070 - protein, 317 aa, Homo sapiens
MARYEAGCRKMAALRALCGFRGVAAQVLRPGAGVRLPIQPSRGVRQWQPDVEWAQQFGGAVMYPSKETAHWKPPPWNDVDPPKDTIVKNITLNFGPQHPAAHGVLRLVMELSGEMVRKCDPHIGLLHRGTEKLIEYKTYLQALPYFDRLDYVSMMCNEQAYSLAVEKLLNIRPPPRAQWIRVLFGEITRLLNHIMAVTTHALDLGAMTPFFWLFEEREKMFEFYERVSGARMHAAYIRPGGVHQTYLGFGALSVLDSLFGESGECDHMDLGNGPAWRVRTKTYLVGGARQDQDANPFFTDESGPGKPGGSPHVKRAD

SEQ ID NO: 861071 - protein, 463 aa, Homo sapiens
MAALRALCGFRGVAAQVLRPGAGVRLPIQPSRGVRQWQPDVEWAQQFGGAVMYPSKETAHWKPPPWNDVDPPKDTIVKNITLNFGPQHPAAHGVLRLVMELSGEMVRKCDPHIGLLHRGTEKLIEYKTYLQALPYFDRLDYVSMMCNEQAYSLAVEKLLNIRPPPRAQWIRVLFGEITRLLNHIMAVTTHALDLGAMTPFFWLFEEREKMFEFYERVSGARMHAAYIRPGGVHQDLPLGLMDDIYQFSKNFSLRLDELEELLTNNRIWRNRTIDIGVVTAEEALNYGFSGVMLRGSGIQWDLRKTQPYDVYDQVEFDVPVGSRGDCYDRYLCRVEEMRQSLRIIAQCLNKMPPGEIKVDDAKVSPPKRAEMKTSMESLIHHFKLYTEGYQVPPGATYTAIEAPKGEFGVYLVSDGSSRPYRCKIKAPGFAHLAGLDKMSKGHMLADVVAIIGTQDIVFGEVDR

SEQ ID NO: 861072 - protein, 463 aa, Homo sapiens; identical to SEQ ID NO: 861071

SEQ ID NO: 861073 - protein, 457 aa, Homo sapiens
MAALRALCGFRGVAAQVLRPGAGVRLPIQPSRGVRQWQPDVEWAQQFGGAVMYPSKETAHWKPPPWNDVDPPKDTIVKNITLNFGPQHPAAHGVLRLVMELSGEMVRKCDPHIGLLHRGTEKLIEYKTYLQALPYFDRLDYVSMMCNEQAYSLAVEKLLNIRPPPRAQWIRVLFGEITRLLNHIMAVTTHALDLGAMTPFFWLFEEREKMFEFYERVSGARMHAAYIRPGGVHQDLPLGLMDDIYQFSKNFSLRLDELEELLTNNRIWRNRTIDIGVVTAEEALNYGFSGVMLRGSGIQWDLRKTQPYDVYDQVEFDVPVGSRGDCYDRYLCRVEEMRQSLRIIAQCLNKMPPGEIKVDDAKVSPPKRAEMKTSMESLIHHFKLYTEGYQVPPGATYTAIEAPKGEFGVYLVSDGSSRPYRCKIKAPGFAHLAGLDKMSKGHMLADVVAIIGTRPIV

SEQ ID NO: 861074 - protein, 484 aa, Homo sapiens
MAALRALCGFRGVAAQVLRPGAGVRLPIQPSRGVRQWQPDVEWAQQFGGAVMYPSKETAHWKPPPWNDVDPPKDTIVKNITLNFGPQHPAAHGVLRLVMELSGEMVRKCDPHIGLLHRGTEKLIEYKTYLQALPYFDRLDYVSMMCNEQAYSLAVEKLLNIRPPPRAQWIRVLFGEITRLLNHIMAVTTHALDLGAMTPFFWLFEEREKMFEFYERVSGARMHAAYIRPGGVHQDLPLGLMDDIYQFSKNFSLRLDELEELLTNNRIWRNRTIDIGVVTAEEALNYGFSGVMLRGSGIQWDLRKTQPYDVYDQVEFDVPVGSRGDCYDRYLCRVEEMRQSLRIIAQCLNKMPPGEIKVDDAKVSPPKRAEMKSFTLIAQTGVQSRLTATSASQTSMESLIHHFKLYTEGYQVPPGATYTAIEAPKGEFGVYLVSDGSSRPYRCKIKAPGFAHLAGLDKMSKGHMLADVVAIIGTQDIVFGEVDR

SEQ ID NO: 861075 - protein, 366 aa, Homo sapiens
MAALRALCGFRGVAAQVLRPGAGVRLPIQPSRGVRQWQPDVEWAQQFGGAVMYPSKETAHWKPPPWNDVDPPKDTIVKNITLNFGPQHPAAHGVLRLVMELSGEMVRKCDPHIGLLHRGTEKLIEYKTYLQALPYFDRLDYVSMMCNEQAYSLAVEKLLNIRPPPRAQWIRVLFGEITRLLNHIMAVTTHALDLGAMTPFFWLFEEREKMFEFYERVSGARMHAAYIRPGGVHQDLPLGLMDDIYQFSKNFSLRLDELEELLTNNRIWRNRTIDIGVVTAEEALNYGFSGVMLRGSGIQWDLRKTQPYDVYDQVEFDVPVGSRGDCYDRYLCRVEEMRQSLRIIAQCLNKMPRPHCWLVLTGILIE

SEQ ID NO: 861076 - protein, 437 aa, Homo sapiens
MAALRALCGFRGVAAQVLRPGAGVRLPIQPSRGVRQWQPDVEWAQQFGGAVMYPSKETAHWKPPPWNDVDPPKDTIVKNITLNFGPQHPAAHGVLRLVMELSGEMVRKCDPHIGLLHRGTEKLIEYKTYLQALPYFDRLDYVSMMCNEQAYSLAVEKLLNIRPPPRAQWIRVLFGEITRLLNHIMAVTTHALDLGAMTPFFWLFEEREKMFEFYERVSGARMHAAYIRPGGVHQLLTNNRIWRNRTIDIGVVTAEEALNYGFSGVMLRGSGIQWDLRKTQPYDVYDQVEFDVPVGSRGDCYDRYLCRVEEMRQSLRIIAQCLNKMPPGEIKVDDAKVSPPKRAEMKTSMESLIHHFKLYTEGYQVPPGATYTAIEAPKGEFGVYLVSDGSSRPYRCKIKAPGFAHLAGLDKMSKGHMLADVVAIIGTQDIVFGEVDR

SEQ ID NO: 861077 - protein, 412 aa, Homo sapiens [sequence omitted]

SEQ ID NO: 861078 - protein, 365 aa, Homo sapiens
MELSGEMVRKCDPHIGLLHRGTEKLIEYKTYLQALPYFDRLDYVSMMCNEQAYSLAVEKLLNIRPPPRAQWIRVLFGEITRLLNHIMAVTTHALDLGAMTPFFWLFEEREKMFEFYERVSGARMHAAYIRPGGVHQDLPLGLMDDIYQFSKNFSLRLDELEELLTNNRIWRNRTIDIGVVTAEEALNYGFSGVMLRGSGIQWDLRKTQPYDVYDQVEFDVPVGSRGDCYDRYLCRVEEMRQSLRIIAQCLNKMPPGEIKVDDAKVSPPKRAEMKTSMESLIHHFKLYTEGYQVPPGATYTAIEAPKGEFGVYLVSDGSSRPYRCKIKAPGFAHLAGLDKMSKGHMLADVVAIIGTQDIVFGEVDR

SEQ ID NO: 861079 - protein, 424 aa, Homo sapiens
AGSLHLGMMWAVSLLGYITAHWKPPPWNDVDPPKDTIVKNITLNFGPQHPAAHGVLRLVMELSGEMVRKCDPHIGLLHRGTEKLIEYKTYLQALPYFDRLDYVSMMCNEQAYSLAVEKLLNIRPPPRAQWIRVLFGEITRLLNHIMAVTTHALDLGAMTPFFWLFEEREKMFEFYERVSGARMHAAYIRPGGVHQDLPLGLMDDIYQFSKNFSLRLDELEELLTNNRIWRNRTIDIGVVTAEEALNYGFSGVMLRGSGIQWDLRKTQPYDVYDQVEFDVPVGSRGDCYDRYLCRVEEMRQSLRIIAQCLNKMPPGEIKVDDAKVSPPKRAEMKTSMESLIHHFKLYTEGYQVPPGATYTAIEAPKGEFGVYLVSDGSSRPYRCKIKAPGFAHLAGLDKMSKGHMLADVVAIIGTQDIVFGEVDR

SEQ ID NO: 861080 - protein, 254 aa, Homo sapiens
MFEFYERVSGARMHAAYIRPGGVHQDLPLGLMDDIYQFSKNFSLRLDELEELLTNNRIWRNRTIDIGVVTAEEALNYGFSGVMLRGSGIQWDLRKTQPYDVYDQVEFDVPVGSRGDCYDRYLCRVEEMRQSLRIIAQCLNKMPPGEIKVDDAKVSPPKRAEMKTSMESLIHHFKLYTEGYQVPPGATYTAIEAPKGEFGVYLVSDGSSRPYRCKIKAPGFAHLAGLDKMSKGHMLADVVAIIGTQDIVFGEVDR

SEQ ID NO: 861081 - protein, 210 aa, Homo sapiens
MAALRALCGFRGVAAQVLRPGAGVRLPIQPSRGVRQWQPDVEWAQQFGGAVMYPSKETAHWKPPPWNDVDPPKDTIVKNITLNFGPQHPAAHGVLRLVMELSGEMVRKCDPHIGLLHRGTEKLIEYKTYLQALPYFDRLDYVSMMCNEQAYSLAVEKLLNIRPPPRAQWIRVLFGEITRLLNHIMAVTTHALDLGAMTPFFWLFEEREKR

SEQ ID NO: 861082 - protein, 192 aa, Homo sapiens
MAALRALCGFRGVAAQVLRPGAGVRLPIQPSRGVRQWQPDVEWAQQFGGAVMYPSKETAHWKPPPWNDVDPPKDTIVKNITLNFGPQHPAAHGVLRLVMELSGEMVRKCDPHIGLLHRGTEKLIEYKTYLQALPYFDRLDYVSMMCNEQAYSLAVEKLLNIRPPPRAQWIRDHGCDHTCPGPWGHDPFLLAV

SEQ ID NO: 861083 - protein, 31 aa, Homo sapiens
VLLLLCLIFLRYLCRVEEMRQSLRIIAQCLN

SEQ ID NO: 861084 - protein, 463 aa, Homo sapiens; identical to SEQ ID NO: 861071

SEQ ID NO: 861085 - protein, 463 aa, Homo sapiens; identical to SEQ ID NO: 861071

SEQ ID NO: 861086 - protein, 463 aa, Homo sapiens; identical to SEQ ID NO: 861071

SEQ ID NO: 861087 - protein, 444 aa, Homo sapiens
MAALRALCGFRGVAAQVLRPGAGVRLPIQPSRGVRQWQPDVEWAQQFGGAVMYPSKETAHWKPPPWNDVDPPKDTIVKNITLNFGPQHPAAHGVLRLVMELSGEMVRKCDPHIGLLHRGTEKLIEYKTYLQALPYFDRLDYVSMMCNEQAYSLAVEKLLNIRPPPRAQWIRVLFGEITRLLNHIMAVTTHALDLGAMTPFFWLFEEREKMFEFYERVSGARMHAAYIRPGGVHQDLPLGLMDDIYQFSKNFSLRLDELEELLTNNRIWRNRTIDIGVVTAEEALNYGFSGVMLRGSGIQWDLRKTQPYDVYDQVEFDVPVGSRGDCYDRYLCRVEEMRQSLRIIAQCLNKMPPGEIKVDDAKVSPPKRAEMKTSMESLIHHFKLYTEGYQVPPGATYTAIEAPKGEFGVYLVSAGLDKMSKGHMLADVVAIIGTQDIVFGEVDR

SEQ ID NO: 861088 - protein, 466 aa, Homo sapiens
MAALRALCGFRGVAAQVLRPGAGVRLPIQPSRGVRQWQPDVEWAQQFGGAVMYPSKETAHWKPPPWNDVDPPKDTIVKNITLNFGPQHPAAHGVLRLVMELSGEMVRKCDPHIGLLHRGTEKLIEYKTYLQALPYFDRLDYVSMMCNEQAYSLAVEKLLNIRPPPRAQWIRVLFGEITRLLNHIMAVTTHALDLGAMTPFFWLFEEREKMFEFYERVSGARMHAAYIRPGGVHQDLPLGLMDDIYQFSKNFSLRLDELEELLTNNRIWRNRTIDIGVVTAEEALNYGFSGVMLRGSGIQWDLRKTQPYDVYDQVEFDVPVGSRGDCYDRYLCRVEEMRQSLRIIAQCLNKMPPGEIKVDDAKVSPPKRAEMKTSMESLIHHFKLYTEGYQVPPGATYTAIEAPKGEFGVYLVSDGSSRPYRCKIKAPGFAHLVRINPSNYNSNELNLTLVEVFMNSSFSSHLASLN

SEQ ID NO: 861089 - protein, 305 aa, Homo sapiens
MAALRALCGFRGVAAQVLRPGAGVRLPIQPSRGVRQWQPDVEWAQQFGGAVMYPSKETAHWKPPPWNDVDPPKDTIVKNITLNFGPQHPAAHGVLRLVMELSGEMVRKCDPHIGLLHRGTEKLIEYKTYLQALPYFDRLDYVSMMCNEQAYSLAVEKLLNIRPPPRAQWIRVLFGEITRLLNHIMAVTTHALDLGAMTPFFWLFEEREKMFEFYERVSGARMHAAYIRPGGVHQDLPLGLMDDIYQFSKNFSLRLDELEELLTNNRIWMAAAALIDARSRLLVLPIWLVWTRCLRDTCWQMSLPS

SEQ ID NO: 861090 - protein, 459 aa, Homo sapiens
LGAQRVTGRIAFRSASRNCQTFVPLFRTGVRQWQPDVEWAQQFGGAVMYPSKETAHWKPPPWNDVDPPKDTIVKNITLNFGPQHPAAHGVLRLVMELSGEMVRKCDPHIGLLHRGTEKLIEYKTYLQALPYFDRLDYVSMMCNEQAYSLAVEKLLNIRPPPRAQWIRVLFGEITRLLNHIMAVTTHALDLGAMTPFFWLFEEREKMFEFYERVSGARMHAAYIRPGGVHQDLPLGLMDDIYQFSKNFSLRLDELEELLTNNRIWRNRTIDIGVVTAEEALNYGFSGVMLRGSGIQWDLRKTQPYDVYDQVEFDVPVGSRGDCYDRYLCRVEEMRQSLRIIAQCLNKMPPGEIKVDDAKVSPPKRAEMKTSMESLIHHFKLYTEGYQVPPGATYTAIEAPKGEFGVYLVSDGSSRPYRCKIKAPGFAHLAGLDKMSKGHMLADVVAIIGTQDIVFGEVDR

SEQ ID NO: 861091 - protein, 451 aa, Homo sapiens
MARYEAGCRKMAALRALCGFRGVAAQVLRPGAGVRLPIQPSRGDRVAAWKPPPWNDVDPPKDTIVKNITLNFGPQHPAAHGVLRLVMELSGEMVRKCDPHIGLLHRGTEKLIEYKTYLQALPYFDRLDYVSMMCNEQAYSLAVEKLLNIRPPPRAQWIRVLFGEITRLLNHIMAVTTHALDLGAMTPFFWLFEEREKMFEFYERVSGARMHAAYIRPGGVHQDLPLGLMDDIYQFSKNFSLRLDELEELLTNNRIWRNRTIDIGVVTAEEALNYGFSGVMLRGSGIQWDLRKTQPYDVYDQVEFDVPVGSRGDCYDRYLCRVEEMRQSLRIIAQCLNKMPPGEIKVDDAKVSPPKRAEMKTSMESLIHHFKLYTEGYQVPPGATYTAIEAPKGEFGVYLVSDGSSRPYRCKIKAPGFAHLAGLDKMSKGHMLADVVAIIGTQDIVFGEVDR

SEQ ID NO: 861092 - protein, 398 aa, Homo sapiens
MNDVDPPKDTIVKNITLNFGPQHPAAHGVLRLVMELSGEMVRKCDPHIGLLHRGTEKLIEYKTYLQALPYFDRLDYVSMMCNEQAYSLAVEKLLNIRPPPRAQWIRVLFGEITRLLNHIMAVTTHALDLGAMTPFFWLFEEREKMFEFYERVSGARMHAAYIRPGGVHQDLPLGLMDDIYQFSKNFSLRLDELEELLTNNRIWRNRTIDIGVVTAEEALNYGFSGVMLRGSGIQWDLRKTQPYDVYDQVEFDVPVGSRGDCYDRYLCRVEEMRQSLRIIAQCLNKMPPGEIKVDDAKVSPPKRAEMKTSMESLIHHFKLYTEGYQVPPGATYTAIEAPKGEFGVYLVSDGSSRPYRCKIKAPGFAHLAGLDKMSKGHMLADVVAIIGTQDIVFGEVDR

SEQ ID NO: 861093 - protein, 307 aa, Homo sapiens
MAALRALCGFRGVAAQVLRPGAGVRLPIQPSRGVRQWQPDVEWAQQFGGAVMYPSKETAHWKPPPWNDVDPPKDTIVKNITLNFGPQHPAAHGVLRLVMELSGEMVRKCDPHIGLLHRGTEKLIEYKTYLQALPYFDRLDYVSMMCNEQAYSLAVEKLLNIRPPPRAQWIRVLFGEITRLLNHIMAVTTHALDLGAMTPFFWLFEEREKMFEFYERVSGARMHAAYIRPGGVHQTYLGFGALSVLDSLFGESGECDHMDLGNGPAWRVRTKTYLVGGARQDQDANPFFTDESGPGKPGGSPHVKRAD

SEQ ID NO: 861094 - protein, 246 aa, Homo sapiens
MAALRALCGFRGVAAQVLRPGAGVRLPIQPSRGVRQWQPDVEWAQQFGGAVMYPSKETAHWKPPPWNDVDPPKDTIVKNITLNFGPQHPPYDVYDQVEFDVPVGSRGDCYDRYLCRVEEMRQSLRIIAQCLNKMPPGEIKVDDAKVSPPKRAEMKTSMESLIHHFKLYTEGYQVPPGATYTAIEAPKGEFGVYLVSDGSSRPYRCKIKAPGFAHLAGLDKMSKGHMLADVVAIIGTQDIVFGEVDR

SEQ ID NO: 861095 - protein, 102 aa, Homo sapiens
KLTARYEAWVATSMESLIHHFKLYTEGYQVPPGATYTAIEAPKGEFGVYLVSDGSSRPYRCKIKAPGFAHLAGLDKMSKGHMLADVVAIIGTQDIVFGEVDR

SEQ ID NO: 861096 - protein, 2505 aa, Homo sapiens
MFSPIMLFLNLATAHQEIEYISPPLEHGSNQALRSTALETLHESALLSGELALKTLCNKMDTGDTALGQKATSRSGETDKASGRWRQEQSAVIKMSTFGSHEGQRQPQIEPEQIGNTASAQLFGSGKLASPSEVVQQVAEKQYPPHRPSPYSCQHSLSFPQHSLPQGVMHSTKPHQSLEGPPWLFPGPLPSVASEDLFPFPIHGHSGGYPRKKISSLNPAYSQYSQKSIEQAEEAHKKEHKPKKPGKYICPYCSRACAKPSVLKKHIRSHTGERPYPCIPCGFSFKTKSNLYKHRKSHAHAIKAGLVPFTESAVSKLDLEAGFIDVEAEIHSDGEQSTDTDEESSLFAEASDKMSPGPPIPLDIASRGGYHGSLEESLGGPMKVPILIIPKSGIPLPNESSQYIGPDMLPNPSLNTKADDSHTVKQKLALRLSEKKGQDSEPSLNLLSPHSKGSTDSGYFSRSESAEQQISPPNTNAKSYEEIIFGKYCRLSPRNALSVTTTSQERAAMGRKGIMEPLPHVNTRLDVKMFEDPVSQLIPSKGDVDPSQTSMLKSTKFNSESRQPQIIPSSIRNEGKLYPANFQGSNPVLLEAPVDSSPLIRSNSVPTSSATNLTIPPSLRGSHSFDERMTGSDDVFYPGTVGIPPQRMLRRQAAFELPSVQEGHVEVEHHGRMLKGISSSSLKEKKLSPGDRVGYDYDVCRKPYKKWEDSETPKQNYRDISCLSSLKHGGEYFMDPVVPLQGVPSMFGTTCENRKRRKEKSVGDEEDTPMICSSIVSTPVGIMASDYDPKLQMQEGVRSGFAMAGHENLSHGHTERFDPCRPQLQPGSPSLVSEESPSAIDSDKMSDLGGRKPPGNVISVIQHTNSLSRPNSFERSESAELVACTQDKAPSPSETCDSEISEAPVSPEWAPPGDGAESGGKPSPSQQVQQQSYHTQPRLVRQHNIQVPEIRVTEEPDKPEKEKEAQSKEPEKPVEEFQWPQRSETLSQLPAEKLPPKKKRLRLADMEHSSGESSFESTGTGLSRSPSQESNLSHSSSFSMSFEREETSKLSALPKQDEFGKHSEFLTVPAGSYSLSVPGHHHQKEMRRCSSEQMPCPHPAEVPEVRSKSFDYGNLSHAPVSGAAASTVSPSRERKKCFLVRQASFSGSPEISQGEVGMDQSVKQEQLEHLHAGLRSGWHHGPPAVLPPLQQEDPGKQVAGPCPPLSSGPLHLAQPQIMHMDSQESLRNPLIQPTSYMTSKHLPEQPHLFPHQETIPFSPIQNALFQFQYPTVCMVHLPAQQPPWWQAHFPHPFAQHPQKSYGKPSFQTEIHSSYPLEHVAEHTGKKPAEYAHTKEQTYPCYSGASGLHPKNLLPKFPSDQSSKSTETPSEQVLQEDFASANAGSLQSLPGTVVPVRIQTHVPSYGSVMYTSISQILGQNSPAIVICKVDENMTQRTLVTNAAMQGIGFNIAQVLGQHAGLEKYPIWKAPQTLPLGLESSIPLCLPSTSDSVATLGGSKRMLSPASSLELFMETKQQKRVKEEKMYGQIVEELSAVELTNSDIKKDLSRPQKPQLVRQGCASEPKDGLQSGSSSFSSLSPSSSQDYPSVSPSSREPFPPSKEMLSGSRAPLPGQKSSGPSESKESSDELDIDETASDMSMSPQSSSLPAGDGQLEEEGKGHKRPVGMLVRMASAPSGNVADSTLLLTDMADFQQILQFPSLRTTTTVSWCFLNYTKPNYVQQATFKSSVYASWCISSCNPNPSGLNTKTTLALLRSKQKITAEIYTLAAMHRPGTGKLTSSSAWKQFTQMKPDASFLFGSKLERKLVGNILKERGKGDIHGDKDIGSKQTEPIRIKIFEGGYKSNEDYVYVRGRGRGKYICEECGIRCKKPSMLKKHIRTHTDVRPYVCKLCNFAFKTKGNLTKHMKSKAHMKKCLELGVSMTSVDDTETEEAENLEDLHKAAEKHSMSSISTDHQFSDAEESDGEDGDDNDDDDEDEDDFDDQGDLTPKTRSRSTSPQPPRFSSLPVNVGAVPHGVPSDSSLGHSSLISYLVTLPSIRVTQLMTPSDSCEDTQMTEYQRLFQSKSTDSEPDKDRLDIPSCMDEECMLPSEPSSSPRDFSPSSHHSSPGYDSSPCRDNSPKRYLIPKGDLSPRRHLSPRRDLSPMRHLSPRKEAALRREMSQRDVSPRRHLSPRRPVSPGKDITARRDLSPRRERRYMTTIRAPSPRRALYHNPPLSMGQYLQAEPIVLGPPNLRRGLPQVPYFSLYGDQEGAYEHPGSSLFPEGPNDYVFSHLPLHSQQQVRAPIPMVPVGGIQMVHSMPPALSSLHPSPTLPLPMEGFEEKKGASGESFSKDPYVLSKQHEKRGPHALQSSGPPSTPSSPRLLMKQSTSEDSLNATEREQEENIQTCTKAIASLRIATEEAALLGPDQPARVQEPHQNPLGSAHVSIRHFSRPEPGQPCTSATHPDLHDGEKDNFGTSQTPLAHSTFYSKSCVDDKQLDFHSSKELSSSTEESKDPSSEKSQLH

SEQ ID NO: 861097 - protein, 2271 aa, Homo sapiens
IYRISLAVPFPGKYICPYCSRACAKPSVLKKHIRSHTGERPYPCIPCGFSFKTKSNLYKHRKSHAHAIKAGLVPFTESAVSKLDLEAGFIDVEAEIHSDGEQSTDTDEESSLFAEASDKMSPGPPIPLDIASRGGYHGSLEESLGGPMKVPILIIPKSGIPLPNESSQYIGPDMLPNPSLNTKADDSHTVKQKLALRLSEKKGQDSEPSLNLLSPHSKGSTDSGYFSRSESAEQQISPPNTNAKSYEEIIFGKYCRLSPRNALSVTTTSQERAAMGRKGIMEPLPHVNTRLDVKMFEDPVSQLIPSKGDVDPSQTSMLKSTKFNSESRQPQIIPSSIRNEGKLYPANFQGSNPVLLEAPVDSSPLIRSNSVPTSSATNLTIPPSLRGSHSFDERMTGSDDVFYPGTVGIPPQRMLRRQAAFELPSVQEGHVEVEHHGRMLKGISSSSLKEKKLSPGDRVGYDYDVCRKPYKKWEDSETPKQNYRDISCLSSLKHGGEYFMDPVVPLQGVPSMFGTTCENRKRRKEKSVGDEEDTPMICSSIVSTPVGIMASDYDPKLQMQEGVRSGFAMAGHENLSHGHTERFDPCRPQLQPGSPSLVSEESPSAIDSDKMSDLGGRKPPGNVISVIQHTNSLSRPNSFERSESAELVACTQDKAPSPSETCDSEISEAPVSPEWAPPGDGAESGGKPSPSQQVQQQSYHTQPRLVRQHNIQVPEIRVTEEPDKPEKEKEAQSKEPEKPVEEFQWPQRSETLSQLPAEKLPPKKKRLRLADMEHSSGESSFESTGTGLSRSPSQESNLSHSSSFSMSFEREETSKLSALPKQDEFGKHSEFLTVPAGSYSLSVPGHHHQKEMRRCSSEQMPCPHPAEVPEVRSKSFDYGNLSHAPVSGAAASTVSPSRERKKCFLVRQASFSGSPEISQGEVGMDQSVKQEQLEHLHAGLRSGWHHGPPAVLPPLQQEDPGKQVAGPCPPLSSGPLHLAQPQIMHMDSQESLRNPLIQPTSYMTSKHLPEQPHLFPHQETIPFSPIQNALFQFQYPTVCMVHLPAQQPPWWQAHFPHPFAQHPQKSYGKPSFQTEIHSSYPLEHVAEHTGKKPAEYAHTKEQTYPCYSGASGLHPKNLLPKFPSDQSSKSTETPSEQVLQEDFASANAGSLQSLPGTVVPVRIQTHVPSYGSVMYTSISQILGQNSPAIVICKVDENMTQRTLVTNAAMQGIGFNIAQVLGQHAGLEKYPIWKAPQTLPLGLESSIPLCLPSTSDSVATLGGSKRMLSPASSLELFMETKQQKRVKEEKMYGQIVEELSAVELTNSDIKKDLSRPQKPQLVRQGCASEPKDGLQSGSSSFSSLSPSSSQDYPSVSPSSREPFPPSKEMLSGSRAPLPGQKSSGPSESKESSDELDIDETASDMSMSPQSSSLPAGDGQLEEEGKGHKRPVGMLVRMASAPSGNVADSTLLLTDMADFQQILQFPSLRTTTTVSWCFLNYTKPNYVQQATFKSSVYASWCISSCNPNPSGLNTKTTLALLRSKQKITAEIYTLAAMHRPGTGKLTSSSAWKQFTQMKPDASFLFGSKLERKLVGNILKERGKGDIHGDKDIGSKQTEPIRIKIFEGGYKSNEDYVYVRGRGRGKYICEECGIRCKKPSMLKKHIRTHTDVRPYVCKLCNFAFKTKGNLTKHMKSKAHMKKCLELGVSMTSVDDTETEEAENLEDLHKAAEKHSMSSISTDHQFSDAEESDGEDGDDNDDDDEDEDDFDDQGDLTPKTRSRSTSPQPPRFSSLPVNVGAVPHGVPSDSSLGHSSLISYLVTLPSIRVTQLMTPSDSCEDTQMTEYQRLFQSKSTDSEPDKDRLDIPSCMDEECMLPSEPSSSPRDFSPSSHHSSPGYDSSPCRDNSPKRYLIPKGDLSPRRHLSPRRDLSPMRHLSPRKEAALRREMSQRDVSPRRHLSPRRPVSPGKDITARRDLSPRRERRYMTTIRAPSPRRALYHNPPLSMGQYLQAEPIVLGPPNLRRGLPQVPYFSLYGDQEGAYEHPGSSLFPEGPNDYVFSHLPLHSQQQVRAPIPMVPVGGIQMVHSMPPALSSLHPSPTLPLPMEGFEEKKGASGESFSKDPYVLSKQHEKRGPHALQSSGPPSTPSSPRLLMKQSTSEDSLNATEREQEENIQTCTKAIASLRIATEEAALLGPDQPARVQEPHQNPLGSAHVSIRHFSRPEPGQPCTSATHPDLHDGEKDNFGTSQTPLAHSTFYSKSCVDDKQLDFHSSKELSSSTEESKDPSSEKSQLH

SEQ ID NO: 861098 - protein, 201 aa, Homo sapiens
SGSRAPLPGQKSSGPSESKESSDELDIDETASDMSMSPQSSSLPAGDGQLEEEGKGHKRPVGMLVRMASAPSGNVADSTLLLTDMADFQQILQFPSLRTTTTVSWCFLNYTKPNYVQQATFKSSVYASWCISSCNPNPSGLNTKTTLALLRSKQKITAEIYTLAAMHRPGTGKLTSSSAWKQFTQVTNTVLGRTLYCGFDC

SEQ ID NO: 861099 - protein, 2509 aa, Homo sapiens
TLLANAHRLWCACGRFQREGAISKFADTLEHGSNQALRSTALETLHESALLSGELALKTLCNKMDTGDTALGQKATSRSGETDKASGRWRQEQSAVIKMSTFGSHEGQRQPQIEPEQIGNTASAQLFGSGKLASPSEVVQQVAEKQYPPHRPSPYSCQHSLSFPQHSLPQGVMHSTKPHQSLEGPPWLFPGPLPSVASEDLFPFPIHGHSGGYPRKKISSLNPAYSQYSQKSIEQAEEAHKKEHKPKKPGKYICPYCSRACAKPSVLKKHIRSHTGERPYPCIPCGFSFKTKSNLYKHRKSHAHAIKAGLVPFTESAVSKLDLEAGFIDVEAEIHSDGEQSTDTDEESSLFAEASDKMSPGPPIPLDIASRGGYHGSLEESLGGPMKVPILIIPKSGIPLPNESSQYIGPDMLPNPSLNTKADDSHTVKQKLALRLSEKKGQDSEPSLNLLSPHSKGSTDSGYFSRSESAEQQISPPNTNAKSYEEIIFGKYCRLSPRNALSVTTTSQERAAMGRKGIMEPLPHVNTRLDVKMFEDPVSQLIPSKGDVDPSQTSMLKSTKFNSESRQPQIIPSSIRNEGKLYPANFQGSNPVLLEAPVDSSPLIRSNSVPTSSATNLTIPPSLRGSHSFDERMTGSDDVFYPGTVGIPPQRMLRRQAAFELPSVQEGHVEVEHHGRMLKGISSSSLKEKKLSPGDRVGYDYDVCRKPYKKWEDSETPKQNYRDISCLSSLKHGGEYFMDPVVPLQGVPSMFGTTCENRKRRKEKSVGDEEDTPMICSSIVSTPVGIMASDYDPKLQMQEGVRSGFAMAGHENLSHGHTERFDPCRPQLQPGSPSLVSEESPSAIDSDKMSDLGGRKPPGNVISVIQHTNSLSRPNSFERSESAELVACTQDKAPSPSETCDSEISEAPVSPEWAPPGDGAESGGKPSPSQQVQQQSYHTQPRLVRQHNIQVPEIRVTEEPDKPEKEKEAQSKEPEKPVEEFQWPQRSETLSQLPAEKLPPKKKRLRLADMEHSSGESSFESTGTGLSRSPSQESNLSHSSSFSMSFEREETSKLSALPKQDEFGKHSEFLTVPAGSYSLSVPGHHHQKEMRRCSSEQMPCPHPAEVPEVRSKSFDYGNLSHAPVSGAAASTVSPSRERKKCFLVRQASFSGSPEISQGEVGMDQSVKQEQLEHLHAGLRSGWHHGPPAVLPPLQQEDPGKQVAGPCPPLSSGPLHLAQPQIMHMDSQESLRNPLIQPTSYMTSKHLPEQPHLFPHQETIPFSPIQNALFQFQYPTVCMVHLPAQQPPWWQAHFPHPFAQHPQKSYGKPSFQTEIHSSYPLEHVAEHTGKKPAEYAHTKEQTYPCYSGASGLHPKNLLPKFPSDQSSKSTETPSEQVLQEDFASANAGSLQSLPGTVVPVRIQTHVPSYGSVMYTSISQILGQNSPAIVICKVDENMTQRTLVTNAAMQGIGFNIAQVLGQHAGLEKYPIWKAPQTLPLGLESSIPLCLPSTSDSVATLGGSKRMLSPASSLELFMETKQQKRVKEEKMYGQIVEELSAVELTNSDIKKDLSRPQKPQLVRQGCASEPKDGLQSGSSSFSSLSPSSSQDYPSVSPSSREPFPPSKEMLSGSRAPLPGQKSSGPSESKESSDELDIDETASDMSMSPQSSSLPAGDGQLEEEGKGHKRPVGMLVRMASAPSGNVADSTLLLTDMADFQQILQFPSLRTTTTVSWCFLNYTKPNYVQQATFKSSVYASWCISSCNPNPSGLNTKTTLALLRSKQKITAEIYTLAAMHRPGTGKLTSSSAWKQFTQMKPDASFLFGSKLERKLVGNILKERGKGDIHGDKDIGSKQTEPIRIKIFEGGYKSNEDYVYVRGRGRGKYICEECGIRCKKPSMLKKHIRTHTDVRPYVCKLCNFAFKTKGNLTKHMKSKAHMKKCLELGVSMTSVDDTETEEAENLEDLHKAAEKHSMSSISTDHQFSDAEESDGEDGDDNDDDDEDEDDFDDQGDLTPKTRSRSTSPQPPRFSSLPVNVGAVPHGVPSDSSLGHSSLISYLVTLPSIRVTQLMTPSDSCEDTQMTEYQRLFQSKSTDSEPDKDRLDIPSCMDEECMLPSEPSSSPRDFSPSSHHSSPGYDSSPCRDNSPKRYLIPKGDLSPRRHLSPRRDLSPMRHLSPRKEAALRREMSQRDVSPRRHLSPRRPVSPGKDITARRDLSPRRERRYMTTIRAPSPRRALYHNPPLSMGQYLQAEPIVLGPPNLRRGLPQVPYFSLYGDQEGAYEHPGSSLFPEGPNDYVFSHLPLHSQQQVRAPIPMVPVGGIQMVHSMPPALSSLHPSPTLPLPMEGFEEKKGASGESFSKDPYVLSKQHEKRGPHALQSSGPPSTPSSPRLLMKQSTSEDSLNATEREQEENIQTCTKAIASLRIATEEAALLGPDQPARVQEPHQNPLGSAHVSIRHFSRPEPGQPCTSATHPDLHDGEKDNFGTSQTPLAHSTFYSKSCVDDKQLDFHSSKELSSSTEESKDPSSEKSQLH

SEQ ID NO: 861100 - protein, 1851 aa, Homo sapiens
TLLANAHRLWCACGRFQREGAISKFADTLEHGSNQALRSTALETLHESALLSGELALKTLCNKMDTGDTALGQKATSRSGETDKASGRWRQEQSAVIKMSTFGSHEGQRQPQIEPEQIGNTASAQLFGSGKLASPSEVVQQVAEKQYPPHRPSPYSCQHSLSFPQHSLPQGVMHSTKPHQSLEGPPWLFPGPLPSVASEDLFPFPIHGHSGGYPRKKISSLNPAYSQYSQKSIEQAEEAHKKEHKPKKPGKYICPYCSRACAKPSVLKKHIRSHTGERPYPCIPCGFSFKTKSNLYKHRKSHAHAIKAGLVPFTESAVSKLDLEAGFIDVEAEIHSDGEQSTDTDEESSLFAEASDKMSPGPPIPLDIASRGGYHGSLEESLGGPMKVPILIIPKSGIPLPNESSQYIGPDMLPNPSLNTKADDSHTVKQKLALRLSEKKGQDSEPSLNLLSPHSKGSTDSGYFSRSESAEQQISPPNTNAKSYEEIIFGKYCRLSPRNALSVTTTSQERAAMGRKGIMEPLPHVNTRLDVKMFEDPVSQLIPSKGDVDPSQTSMLKSTKFNSESRQPQIIPSSIRNEGKLYPANFQGSNPVLLEAPVDSSPLIRSNSVPTSSATNLTIPPSLRGSHSFDERMTGSDDVFYPGTVGIPPQRMLRRQAAFELPSVQEGHVEVEHHGRMLKGISSSSLKEKKLSPGDRVGYDYDVCRKPYKKWEDSETPKQNYRDISCLSSLKHGGEYFMDPVVPLQGVPSMFGTTCENRKRRKEKSVGDEEDTPMICSSIVSTPVGIMASDYDPKLQMQEGVRSGFAMAGHENLSHGHTERFDPCRPQLQPGSPSLVSEESPSAIDSDKMSDLGGRKPPGNVISVIQHTNSLSRPNSFERSESAELVACTQDKAPSPSETCDSEISEAPVSPEWAPPGDGAESGGKPSPSQQVQQQSYHTQPRLVRQHNIQVPEIRVTEEPDKPEKEKEAQSKEPEKPVEEFQWPQRSETLSQLPAEKLPPKKKRLRLADMEHSSGESSFESTGTGLSRSPSQESNLSHSSSFSMSFEREETSKLSALPKQDEFGKHSEFLTVPAGSYSLSVPGHHHQKEMRRCSSEQMPCPHPAEVPEVRSKSFDYGNLSHAPVSGAAASTVSPSRERKKCFLVRQASFSGSPEISQGEVGMDQSVKQEQLEHLHAGLRSGWHHGPPAVLPPLQQEDPGKQVAGPCPPLSSGPLHLAQPQIMHMDSQESLRNPLIQPTSYMTSKHLPEQPHLFPHQETIPFSPIQNALFQFQYPTVCMVHLPAQQPPWWQAHFPHPFAQHPQKSYGKPSFQTEIHSSYPLEHVAEHTGKKPAEYAHTKEQTYPCYSGASGLHPKNLLPKFPSDQSSKSTETPSEQVLQEDFASANAGSLQSLPGTVVPVRIQTHVPSYGSVMYTSISQILGQNSPAIVICKVDENMTQRTLVTNAAMQGIGFNIAQVLGQHAGLEKYPIWKAPQTLPLGLESSIPLCLPSTSDSVATLGGSKRMLSPASSLELFMETKQQKRVKEEKMYGQIVEELSAVELTNSDIKKDLSRPQKPQLVRQGCASEPKDGLQSGSSSFSSLSPSSSQDYPSVSPSSREPFPPSKEMLSGSRAPLPGQKSSGPSESKESSDELDIDETASDMSMSPQSSSLPAGDGQLEEEGKGHKRPVGMLVRMASAPSGNVADSTLLLTDMADFQQILQFPSLRTTTTVSWCFLNYTKPNYVQQATFKSSVYASWCISSCNPNPSGLNTKTTLALLRSKQKITAEIYTLAAMHRPGTGKLTSSSAWKQFTQMKPDASFLFGSKLERKLVGNILKERGKGDIHGDKDIGSKQTEPIRIKIFEGGYKSNLSH

SEQ ID NO: 861101 - protein, 122 aa, Homo sapiens
SSMNTSPSQPQQEEEKPKTSETTPPKKRGTNPRARCCVKEPHKKEVNRTHACFALQDEILQRLLFSEMKMKVLENQMFIIWNKMNHHGRSSRHRNFPMKKHRMRRHESICPTLSDCTSSSPS

SEQ ID NO: 861102 - protein, 146 aa, Homo sapiens
SAGTIGAVAAWLMSYKPALFGFLFLLLLLSNWLVKYEHKLTLPEPQQEEEKPKTSENDSKNSKAVNTKEVNRTHACFALQDEILQRLLFSEMKMKVLENQMFIIWNKMNHHGRSSRHRNFPMKKHRMRRHESICPTLSDCTSSSPS

SEQ ID NO: 861103 - protein, 471 aa, Homo sapiens
GAAGRTAAAPRGRAPVGAGQGRARRAVAAERAAWVLAAGFAETRSRGLPSRARSGRGGMKGALGSPVAAAGAAMQESFGCVVANRFHQLLDDESDPFDILREAERRRQQQLQRKRRDEAAAAAGAGPRGGRSPAGASGHRAGAGGRRESQKERKSLPAPVAQRPDSPGGGLQAPGQKRTPRRGEQQGWNDSRGPEGMLERAERRSYREYRPYETERQADFTAEKFPDEKPGDRFDRDRPLRGRGGPRGGMRGRGRGGPGNRVFDAFDQRGKREFERYGGNDKIAVRTEDNMGGCGVRTWGSGKDTSDVEPTAPMEEPTVVEESQGTPEEESPAKVPELEVEEETQVQEMTLDEWKNLQEQTRPKPEFNIRKPESTVPSKAVVIHKSKYRDDMVKDDYEDDSHVFRKPANDITSQLEINFGNLPRPGRGARGGTRGGRGRIRRAENYGPRAEVVMQDVAPNPDDPEDFPALS

SEQ ID NO: 861104 - protein, 317 aa, Homo sapiens
GAAGRTAAAPRGRAPVGAGQGQKRTPRRGEQQGWNDSRGPEGMLERAERRSYREYRPYETERQADFTAEKFPDEKPGDRFDRDRPLRGRGGPRGGMRGRGRGGPGNRVFDAFDQRGKREFERYGGNDKIAVRTEDNMGGCGVRTWGSGKDTSDVEPTAPMEEPTVVEESQGTPEEESPAKVPELEVEEETQVQEMTLDEWKNLQEQTRPKPEFNIRKPESTVPSKAVVIHKSKYRDDMVKDDYEDDSHVFRKPANDITSQLEINFGNLPRPGRGARGGTRGGRGRIRRAENYGPRAEVVMQDVAPNPDDPEDFPALS

SEQ ID NO: 861105 - protein, 283 aa, Homo sapiens
GAAGRTAAAPRGRAPVGAGQGRARRAVAAERAAWVLAAGFAETRSRGLPSRARSGRGGMKGALGSPVAAAGAAMQESFGCVVANRFHQLLDDESDPFDILREAERRRQQQLQRKRRDEAAAAAGAGPRGGRSPAGASGHRAGAGGRRESQKERKSLPAPVAQRPDSPGGGLQAPGQKRTPRRGEQQGWNDSRGPEGMLERAERRSYREYRPYETERQADFTAEKFPDEKPGDRFDRDRPLRGRGGPRGGMRGRGRGGPGNRVFDAFDQRGKREFERYGGNDKM

SEQ ID NO: 861106 - protein, 471 aa, Homo sapiens; identical to SEQ ID NO: 861103

SEQ ID NO: 861107 - protein, 317 aa, Homo sapiens
MEAPTVVEESQCTPEEESPASQKRTPRRGEQQGWNDSRGPEGMLERAERRSYREYRPYETERQADFTAEKFPDEKPGDRFDRDRPLRGRGGPRGGMRGRGRGGPGNRVFDAFDQRGKREFERYGGNDKIAVRTEDNMGGCGVRTWGSGKDTSDVEPTAPMEEPTVVEESQGTPEEESPAKVPELEVEEETQVQEMTLDEWKNLQEQTRPKPEFNIRKPESTVPSKAVVIHKSKYRDDMVKDDYEDDSHVFRKPANDITSQLEINFGNLPRPGRGARGGTRGGRGRIRRAENYGPRAEVVMQDVAPNPDDPEDFPALS

SEQ ID NO: 861108 - protein, 657 aa, Homo sapiens
MRRAVCFPALCLLLNLHAAGCFSGNNDHFLAINQKKSGKPVFIYKHSQDIEKSLDIAPQKIYRHSYHSSSEAQVSKRHQIVNSAFPRPAYDPSLNLLAMDGQDLEVENLPIPAANVIVVTLQMDVNKLNITLLRIFRQGVAAALGLLPQQVHINRLIGKKNSIELFVSPINRKTGISDALPSEEVLRSLNINVLHQSLSQFGITEVSPEKNVLQGQHEADKIWSKEGFYAVVIFLSIFVIIVTCLMILYRLKERFQLSLRQDKEKNQEIHLSPITLQPALSEAKTVHSMVQPEQAPKVLNVVVDPQGRGAPEIRATTATSVCPSPFKMKPIGLQERRGSNVSLTLDMSSLGNIEPFVSIPTPREKVAMEYLQSASRILTRSQLRDVVASSHLLQSEFMEIPMNFVDPKEIDIPRHGTKNRYKTILPNPLSRVCLRPKNVTDSLSTYINANYIRGYSGKEKAFIATQGPMINTVDDFWQMVWQEDSPVIVMITKLKEKNEKCVLYWPEKRGIYGKVEVLVISVNECDNYTIRNLVLKQGSHTQHVKHYWYTSWPDHKTPDSAQPLLQLMLDVEEDRLASQGRGPVVVHCSAGIGRTGCFIATSIGCQQLKEEGVVDALSIVCQLRMDRGGMVQTSEQYEFVHHALCLYESRLSAETVQ

SEQ ID NO: 861109 - protein, 457 aa, Homo sapiens
NRTLLPMNQKNVLQGQHEADKIWSKEGFYAVVIFLSIFVIIVTCLMILYRLKERFQLSLRQDKEKNQEIHLSPITLQPALSEAKTVHSMVQPEQAPKVLNVVVDPQGRGAPEIRATTATSVCPSPFKMKPIGLQERRGSNVSLTLDMSSLGNIEPFVSIPTPREKVAMEYLQSASRILTRSQLRDVVASSHLLQSEFMEIPMNFVDPKEIDIPRHGTKNRYKTILPNPLSRVCLRPKNVTDSLSTYINANYIRGYSGKEKAFIATQGPMINTVDDFWQMVWQEDSPVIVMITKLKEKNEKCVLYWPEKRGIYGKVEVLVISVNECDNYTIRNLVLKQGSHTQHVKHYWYTSWPDHKTPDSAQPLLQLMLDVEEDRLASQGRGPVVVHCSAGIGRTGCFIATSIGCQQLKEEGVVDALSIVCQLRMDRGGMVQTSEQYEFVHHALCLYESRLSAETVQ

SEQ ID NO: 861110 - protein, 392 aa, Homo sapiens
MILYRLKERFQLSLRQDKEKNQEIHLSPITLQPALSEAKTVHSMVQPEQAPKVLNVVVDPQGRGAPEIRATTATSVCPSPFKMKPIGLQERRGSNVSLTLDMSSLGNIEPFVSIPTPREKVAMEYLQSASRILTRSQLRDVVASSHLLQSEFMEIPMNFVDPKEIDIPRHGTKNRYKTILPNPLSRVCLRPKNVTDSLSTYINANYIRGYSGKEKAFIATQGPMINTVDDFWQMVWQEDSPVIVMITKLKEKNEKCVLYWPEKRGIYGKVEQGSHTQHVKHYWYTSWPDHKTPDSAQPLLQLMLDVEEDRLASQGRGPVVVHCSAGIGRTGCFIATSIGCQQLKEEGVVDALSIVCQLRMDRGGMVQTSEQYEFVHHALCLYESRLSAETVQ

SEQ ID NO: 861111 - protein, 412 aa, Homo sapiens
MILYRLKERFQLSLRQDKEKNQEIHLSPITLQPALSEAKTVHSMVQPEQAPKVLNVVVDPQGRGAPEIRATTATSVCPSPFKMKPIGLQERRGSNVSLTLDMSSLGNIEPFVSIPTPREKVAMEYLQSASRILTRSQLRDVVASSHLLQSEFMEIPMNFVDPKEIDIPRHGTKNRYKTILPNPLSRVCLRPKNVTDSLSTYINANYIRGYSGKEKAFIATQGPMINTVDDFWQMVWQEDSPVIVMITKLKEKNEKCVLYWPEKRGIYGKVEVLVISVNECDNYTIRNLVLKQGSHTQHVKHYWYTSWPDHKTPDSAQPLLQLMLDVEEDRLASQGRGPVVVHCSAGIGRTGCFIATSIGCQQLKEEGVVDALSIVCQLRMDRGGMVQTSEQYEFVHHALCLYESRLSAETVQ

SEQ ID NO: 861112 - protein, 159 aa, Homo sapiens
MRRKGGNCLRLRGWGGAQEATRARDTSSAKRRVSSRAPSPPLFLVSRVFRIPPRFRFGFWDCYLVGCESHPPPRSVALGGVRAGCEPKRAKCELMDHAQELHALLGSLLLFLYIMYSRRVQVSTSFLEQPKTNFLPFLVSTENFRVVLKNKRQDLYTHK

SEQ ID NO: 861113 - protein, 306 aa, Homo sapiens
MSEVTRSLLQRWGASFRRGADFDSWGQLVEAIDEYQILARHLQKEAQAQHNNSEFTEEQKKTIGKIATCLELRSAALQSTQSQEEFKLEDLKKLEPILKNILTYNKEFPFDVQPVPLRRILAPGEEENLEFEEDEEEGGAGAGSPDSFPARVPGTLLPRLPSEPGMTLLTIRIEKIGLKDAGQCIDPYITVSVKDLNGIDLTPVQDTPVASRKEDTYVHFNVDIELQKHVEKLTKGAAIFFEFKHYKPKKRFTSTKCFAFMEMDEIKPGPIVIELYKKPTDFKRKKLQLLTKKPLYLHLHQTLHKE

SEQ ID NO: 861114 - protein, 306 aa, Homo sapiens; identical to SEQ ID NO: 861113

SEQ ID NO: 861115 - protein, 306 aa, Homo sapiens; identical to SEQ ID NO: 861113

SEQ ID NO: 861116 - protein, 306 aa, Homo sapiens; identical to SEQ ID NO: 861113

SEQ ID NO: 861117 - protein, 296 aa, Homo sapiens
MDFLSVVCFKALEGDFWSTVQGLWRLILARHLQKEAQAQHNNSEFTEEQKKTIGKIATCLELRSAALQSTQSQEEFKLEDLKKLEPILKNILTYNKEFPFDVQPVPLRRILAPGEEENLEFEEDEEEGGAGAGSPDSFPARVPGTLLPRLPSEPGMTLLTIRIEKIGLKDAGQCIDPYITVSVKDLNGIDLTPVQDTPVASRKEDTYVHFNVDIELQKHVEKLTKGAAIFFEFKHYKPKKRFTSTKCFAFMEMDEIKPGPIVIELYKKPTDFKRKKLQLLTKKPLYLHLHQTLHKE

SEQ ID NO: 861118 - protein, 110 aa, Homo sapiens
MLVTLSPFSAPGPCAEVRALPAPAAEPEPAWEEAPPERALELEGAPAKDQTNEELPEITEVPESIKRRLGGRVPAATPAPRGNLLLQAWMRVHSWASRLFAPNVLPGTGP

SEQ ID NO: 861119 - protein, 163 aa, Homo sapiens
MRRRLIPHPRRLSPVVIRRIQVPQDSLGQALAGQATPEIPLGLQLHTVLVQEIQELIEAQTRAPGPCAEVRALPAPAAEPEPAWEEAPPERALELEGAPAKDQTNEELPEITEVPESIKRRLGGRVPAATPAPRGNLLLQAWMRVHSWASRLFAPNVLPGTGP

SEQ ID NO: 861120 - protein, 915 aa, Homo sapiens
MDLRVGQRPPVEPPPEPTLLALQRPQRLHHHLFLAGLQQQRSVEPMRLSMDTPMPELQVGPQEQELRQLLHKDKSKRSAVASSVVKQKLAEVILKKQQAALERTVHPNSPGIPYRTLEPLETEGATRSMLSSFLPPVPSLPSDPPEHFPLRKTVSEPNLKLRYKPKKSLERRKNPLLRKESAPPSLRRRPAETLGDSSPSSSSTPASGCSSPNDSEHGPNPILGSEADSDRRTHPTLGPRGPILGSPHTPLFLPHGLEPEAGGTLPSRLQPILLLDPSGSHAPLLTVPGLGPLPFHFAQSLMTTERLSGSGLHWPLSRTRSEPLPPSATAPPPPGPMQPRLEQLKTHVQVIKRSAKPSEKPRLRQIPSAEDLETDGGGPGQVVDDGLEHRELGHGQPEARGPAPLQQHPQVLLWEQQRLAGRLPRGSTGDTVLLPLAQGGHRPLSRAQSSPAAPASLSAPEPASQARVLSSSETPARTLPFTTGLIYDSVMLKHQCSCGDNSRHPEHAGRIQSIWSRLQERGLRSQCECLRGRKASLEELQSVHSERHVLLYGTNPLSRLKLDNGKLAGLLAQRMFVMLPCGGVGVDTDTIWNELHSSNAARWAAGSVTDLAFKVASRELKNGFAVVRPPGHHADHSTAMGFCFFNSVAIACRQLQQQSKASKILIVDWDVHHGNGTQQTFYQDPSVLYISLHRHDDGNFFPGSGAVDEVGAGSGEGFNVNVAWAGGLDPPMGDPEYLAAFRIVVMPIAREFSPDLVLVSAGFDAAEGHPAPLGGYHVSAKCFGYMTQQLMNLAGGAVVLALEGGHDLTAICDASEACVAALLGNRVDPLSEEGWKQKPNLNAIRSLEAVIRVHSKYWGCMQRLASCPDSWVPRVPGADKEEVEAVTALASLSVGILAEDRPSEQLVEEEEPMNL

SEQ ID NO: 861121 - protein, 1016 aa, Homo sapiens
SSVSPSVKWGENSKHTSQSRAEEVDYGEENEDGTQVSPGAHYCSPTGAGCPRPCADTPGPQPQPMDLRVGQRPPVEPPPEPTLLALQRPQRLHHHLFLAGLQQQRSVEPMRLSMDTPMPELQVGPQEQELRQLLHKDKSKRSAVASSVVKQKLAEVILKKQQAALERTVHPNSPGIPYRTLEPLETEGATRSMLSSFLPPVPSLPSDPPEHFPLRKTVSEPNLKLRYKPKKSLERRKNPLLRKESAPPSLRRRPAETLGDSSPSSSSTPASGCSSPNDSEHGPNPILGSEALLGQRLRLQETSVAPFALPTVSLLPAITLGLPAPARADSDRRTHPTLGPRGPILGSPHTPLFLPHGLEPEAGGTLPSRLQPILLLDPSGSHAPLLTVPGLGPLPFHFAQSLMTTERLSGSGLHWPLSRTRSEPLPPSATAPPPPGPMQPRLEQLKTHVQVIKRSAKPSEKPRLRQIPSAEDLETDGGGPGQVVDDGLEHRELGHGQPEARGPAPLQQHPQVLLWEQQRLAGRLPRGSTGDTVLLPLAQGGHRPLSRAQSSPAAPASLSAPEPASQARVLSSSETPARTLPFTTGLIYDSVMLKHQCSCGDNSRHPEHAGRIQSIWSRLQERGLRSQCECLRGRKASLEELQSVHSERHVLLYGTNPLSRLKLDNGKLAGLLAQRMFVMLPCGGVGVDTDTIWNELHSSNAARWAAGSVTDLAFKVASRELKNGFAVVRPPGHHADHSTAMGFCFFNSVAIACRQLQQQSKASKILIVDWDVHHGNGTQQTFYQDPSVLYISLHRHDDGNFFPGSGAVDEVGAGSGEGFNVNVAWAGGLDPPMGDPEYLAAFRIVVMPIAREFSPDLVLVSAGFDAAEGHPAPLGGYHVSAKCFGYMTQQLMNLAGGAVVLALEGGHDLTAICDASEACVAALLGNRVDPLSEEGWKQKPNLNAIRSLEAVIRVHSKYWGCMQRLASCPDSWVPRVPGADKEEVEAVTALASLSVGILAEDRPSEQLVEEEEPMNL

SEQ ID NO: 861122 - protein, 1201 aa, Homo sapiens
SSVSPSVKWGENSKHTSQSRAEEVDYGEENEDGTQVSPGAHYCSPTGAGCPRPCADTPGPQPQPMDLRVGQRPPVEPPPEPTLLALQRPQRLHHHLFLAGLQQQRSVEPMRLSMDTPMPELQVGPQEQELRQLLHKDKSKRSAVASSVVKQKLAEVILKKQQAALERTVHPNSPGIPYRTLEPLETEGATRSMLSSFLPPVPSLPSDPPEHFPLRKTVSEPNLKLRYKPKKSLERRKNPLLRKESAPPSLRRRPAETLGDSSPSSSSTPASGCSSPNDSEHGPNPILGSEADSDRRTHPTLGPRGPILGSPHTPLFLPHGLEPEAGGTLPSRLQPILLLDPSGSHAPLLTVPGLGPLPFHFAQSLMTTERLSGSGLHWPLSRTRSEPLPPSATAPPPPGPMQPRLEQLKTHVQVIKRSAKPSEKPRLRQIPSAEDLETDGGGPGQVVDDGLEHRELGHGQPEARGPAPLQQHPQVLLWEQQRLAGRLPRGSTGDTVLLPLAQGGHRPLSRAQSSPAAPASLSAPEPASQARVLSSSETPARTLPFTTGSLYRSSIPGSHGVSILRVVGVLDAQKLTLPPSNEQDPPLKTSHGSDWNSHFSKAGFVYHMVQCHRGLLSSRFGGFLGILFPPAAPWEPLWVHDTCVRCCTLGLMLCSEHLRAWCWALESWATQQSCPHVGRPWLCGSHVGWSCVDVLAAATWGSVWACVDRCEGLGLGEGQDEMQACVGVRGVYPPGSMWVPAVAVLACSLQPRPWGVRTPWVPALTLAPAGLIYDSVMLKHQCSCGDNSRHPEHAGRIQSIWSRLQERGLRSQCECLRGRKASLEELQSVHSERHVLLYGTNPLSRLKLDNGKLAGLLAQRMFVMLPCGGVGVDTDTIWNELHSSNAARWAAGSVTDLAFKVASRELKNGFAVVRPPGHHADHSTAMGFCFFNSVAIACRQLQQQSKASKILIVDWDVHHGNGTQQTFYQDPSVLYISLHRHDDGNFFPGSGAVDEVGAGSGEGFNVNVAWAGGLDPPMGDPEYLAAFRIVVMPIAREFSPDLVLVSAGFDAAEGHPAPLGGYHVSAKCFGYMTQQLMNLAGGAVVLALEGGHDLTAICDASEACVAALLGNRVDPLSEEGWKQKPNLNAIRSLEAVIRVHSKYWGCMQRLASCPDSWVPRVPGADKEEVEAVTALASLSVGILAEDRPSEQLVEEEEPMNL

SEQ ID NO: 861123 - protein, 915 aa, Homo sapiens; identical to SEQ ID NO: 861120

SEQ ID NO: 861124 - protein, 612 aa, Homo sapiens
SSVSPSVKWGENSKHTSQSRAEEVDYGEENEDGTQVSPGAHYCSPTGAGCPRPCADTPGPQPQPMDLRVGQRPPVEPPPEPTLLALQRPQRLHHHLFLAGLQQQRSVEPMRLSMDTPMPELQVGPQEQELRQLLHKDKSKRSAVASSVVKQKLAEVILKKQQAALERTVHPNSPGIPYRTLEPLETEGATRSMLSSFLPPVPSLPSDPPEHFPLRKTVSEPNLKLRYKPKKSLERRKNPLLRKESAPPSLRRRPAETLGDSSPSSSSTPASGCSSPNDSEHGPNPILGSEADSDRRTHPTLGPRGPILGSPHTPLFLPHGLEPEAGGTLPSRLQPILLLDPSGSHAPLLTVPGLGPLPFHFAQSLMTTERLSGSGLHWPLSRTRSEPLPPSATAPPPPGPMQPRLEQLKTHVQVIKRSAKPSEKPRLRQIPSAEDLETDGGGPGQVVDDGLEHRELGHGQPEARGPAPLQQHPQVLLWEQQRLAGRLPRGSTGDTVLLPLAQGGHRPLSRAQSSPAAPASLSAPEPASQARVLSSSETPARTLPFTTGETGRRVAGGGRGSAARVHVGVLVSLGTFLEATECLALLGPRSTHGAHGTAGYCIWPMRTKAHEI

SEQ ID NO: 861125 - protein, 612 aa, Homo sapiens; identical to SEQ ID NO: 861124

SEQ ID NO: 861126 - protein, 612 aa, Homo sapiens; identical to SEQ ID NO: 861124

SEQ ID NO: 861127 - protein, 612 aa, Homo sapiens; identical to SEQ ID NO: 861124

SEQ ID NO: 861128 - protein, 612 aa, Homo sapiens; identical to SEQ ID NO: 861124

SEQ ID NO: 861129 - protein, 911 aa, Homo sapiens
SSVSPSVKWGENSKHTSQSRAEEVDYGEENEDGTQVSPGAHYCSPTGAGCPRPCADTPGPQPQPMDLRVGQRPPVEPPPEPTLLALQRPQRLHHHLFLAGLQQQRSVEPMRLSMDTPMPELQVGPQEQELRQLLHKDKSKRSAVASSVVKQKLAEVILKKQQAALERTVHPNSPGIPYRTLEPLETEGATRSMLSSFLPPVPSLPSDPPEHFPLRKTVSEPNLKLRYKPKKSLERRKNPLLRKESAPPSLRRRPAETLGDSSPSSSSTPASGCSSPNDSEHGPNPILGSEADSDRRTHPTLGPRGPILGSPHTPLFLPHGLEPEAGGTLPSRLQPILLLDPSGSHAPLLTVPGLGPLPFHFAQSLMTTERLSGSGLHWPLSRTRSEPLPPSATAPPPPGPMQPRLEQLKTHVQVIKRSAKPSEKPRLRQIPSAEDLETDGGGPGQVVDDGLEHRELGHGQPEARGPAPLQQHPQVLLWEQQRLAGRLPRGSTGDTVLLPLAQGGHRPLSRAQSSPAAPASLSAPEPASQARVLSSSETPARTLPFTTGLIYDSVMLKHQCSCGDNSRHPEHAGRIQSIWSRLQERGLRSQCECLRGRKASLEELQSVHSERHVLLYGTNPLSRLKLDNGKLAGLLAQRMFVMLPCGGVGVDTDTIWNELHSSNAARWAAGSVTDLAFKVASRELKNGFAVVRPPGHHADHSTAMGFCFFNSVAIACRQLQQQSKASKILIVDWVVMIRIIADNIEYTTNHIQTLMVLHMMDLILTITHFTDDRRAPWQLDPADFYKTQWALLSLDCLETGIFRGSGAWIESVMPMRGRSPRLNGGCGEWDGLRYPGPRGGRPAFVPALWFLGGRCIVCECGSVASGGGHTPGGVAGGSVLGGTSYEGAPPPVVVPWLWGALARRVYDTPVR

SEQ ID NO: 861130 - protein, 611 aa, Homo sapiens
SSVSPSVKWGENSKHTSQSRAEEVDYGEENEDGTQVSPGAHYCSPTGAGCPRPCADTPGPQPQPMDLRVGQRPPVEPPPEPTLLALQRPQRLHHHLFLAGLQQQRSVEPMRLSMDTPMPELQVGPQEQELRQLLHKDKSKRSAVASSVVKQKLAEVILKKQQAALERTVHPNSPGIPYRTLEPLETEGATRSMLSSFLPPVPSLPSDPPEHFPLRKTVSEPNLKLRYKPKKSLERRKNPLLRKESAPPSLRRRPAETLGDSSPSSSSTPASGCSSPNDSEHGPNPILGSEADSDRRTHPTLGPRGPILGSPHTPLFLPHGLEPEAGGTLPSRLQPILLLDPSGSHAPLLTVPGLGPLPFHFAQSLMTTERLSGSGLHWPLSRTRSEPLPPSATAPPPPGPMQPRLEQLKTHVQVIKRSAKPSEKPRLRQIPSAEDLETDGGGPGQVVDDGLEHRELGHGQPEARGPAPLQQHPQVLLWEQQRLAGRLPRGSTGDTVLLPLAQGGHRPLSRAQSSPAAPASLSAPEPASQARVLSSSETPARTLPFTTGLIYDSVMLKHQCSCGDNSRHPEHAGRIQSIWSRLQELAEVILKKQQAALERTVHPNSPGIPYR

SEQ ID NO: 861131 - protein, 952 aa, Homo sapiens
MDLRVGQRPPVEPPPEPTLLALQRPQRLHHHLFLAGLQQQRSVEPMRLSMDTPMPELQVGPQEQELRQLLHKDKSKRSAVASSVVKQKLAEVILKKQQAALERTVHPNSPGIPYRTLEPLETEGATRSMLSSFLPPVPSLPSDPPEHFPLRKTVSEPNLKLRYKPKKSLERRKNPLLRKESAPPSLRRRPAETLGDSSPSSSSTPASGCSSPNDSEHGPNPILGSEALLGQRLRLQETSVAPFALPTVSLLPAITLGLPAPARADSDRRTHPTLGPRGPILGSPHTPLFLPHGLEPEAGGTLPSRLQPILLLDPSGSHAPLLTVPGLGPLPFHFAQSLMTTERLSGSGLHWPLSRTRSEPLPPSATAPPPPGPMQPRLEQLKTHVQVIKRSAKPSEKPRLRQIPSAEDLETDGGGPGQVVDDGLEHRELGHGQPEARGPAPLQQHPQVLLWEQQRLAGRLPRGSTGDTVLLPLAQGGHRPLSRAQSSPAAPASLSAPEPASQARVLSSSETPARTLPFTTGLIYDSVMLKHQCSCGDNSRHPEHAGRIQSIWSRLQERGLRSQCECLRGRKASLEELQSVHSERHVLLYGTNPLSRLKLDNGKLAGLLAQRMFVMLPCGGVGVDTDTIWNELHSSNAARWAAGSVTDLAFKVASRELKNGFAVVRPPGHHADHSTAMGFCFFNSVAIACRQLQQQSKASKILIVDWDVHHGNGTQQTFYQDPSVLYISLHRHDDGNFFPGSGAVDEVGAGSGEGFNVNVAWAGGLDPPMGDPEYLAAFRIVVMPIAREFSPDLVLVSAGFDAAEGHPAPLGGYHVSAKCFGYMTQQLMNLAGGAVVLALEGGHDLTAICDASEACVAALLGNRVDPLSEEGWKQKPNLNAIRSLEAVIRVHSKYWGCMQRLASCPDSWVPRVPGADKEEVEAVTALASLSVGILAEDRPSEQLVEEEEPMNL

SEQ ID NO: 861132 - protein, 480 aa, Homo sapiens
MQACVGVRGVYPPGSMWVPAVAVLACSLQPRPWGVRTPWVPALTLAPAGLIYDSVMLKHQCSCGDNSRHPEHAGRIQSIWSRLQERGLRSQCECLRGRKASLEELQSVHSERHVLLYGTNPLSRLKLDNGKLAGLLAQRMFVMLPCGGVGVDTDTIWNELHSSNAARWAAGSVTDLAFKVASRELKNGFAVVRPPGHHADHSTAMGFCFFNSVAIACRQLQQQSKASKILIVDWDVHHGNGTQQTFYQDPSVLYISLHRHDDGNFFPGSGAVDEVGAGSGEGFNVNVAWAGGLDPPMGDPEYLAAFRIVVMPIAREFSPDLVLVSAGFDAAEGHPAPLGGYHVSAKCFGYMTQQLMNLAGGAVVLALEGGHDLTAICDASEACVAALLGNRVDPLSEEGWKQKPNLNAIRSLEAVIRVHSKYWGCMQRLASCPDSWVPRVPGADKEEVEAVTALASLSVGILAEDRPSEQLVEEEEPMNL

SEQ ID NO: 861133 - protein, 339 aa, Homo sapiens
MRALTLAPQVDTDTIWNELHSSNAARWAAGSVTDLAFKVASRELKNGFAVVRPPGHHADHSTAMGFCFFNSVAIACRQLQQQSKASKILIVDWDVHHGNGTQQTFYQDPSVLYISLHRHDDGNFFPGSGAVDEVGAGSGEGFNVNVAWAGGLDPPMGDPEYLAAFRIVVMPIAREFSPDLVLVSAGFDAAEGHPAPLGGYHVSAKCFGYMTQQLMNLAGGAVVLALEGGHDLTAICDASEACVAALLGNRVDPLSEEGWKQKPNLNAIRSLEAVIRVHSKYWGCMQRLASCPDSWVPRVPGADKEEVEAVTALASLSVGILAEDRPSEQLVEEEEPMNL

SEQ ID NO: 861134 - protein, 612 aa, Homo sapiens; identical to SEQ ID NO: 861124

SEQ ID NO: 861135 - protein, 170 aa, Homo sapiens
MLGTRLGGVRLVLVSAGFDAAEGHPAPLGGYHVSAKCFGYMTQQLMNLAGGAVVLALEGGHDLTAICDASEACVAALLGNRVDPLSEEGWKQKPNLNAIRSLEAVIRVHSKYWGCMQRLASCPDSWVPRVPGADKEEVEAVTALASLSVGILAEDRPSEQLVEEEEPMNL

SEQ ID NO: 861136 - protein, 915 aa, Homo sapiens; identical to SEQ ID NO: 861120

SEQ ID NO: 861137 - protein, 612 aa, Homo sapiens; identical to SEQ ID NO: 861124

SEQ ID NO: 861138 - protein, 416 aa, Homo sapiens
SSVSPSVKWGENSKHTSQSRAEEVDYGEENEDGTQVSPGAHYCSPTGAGCPRPCADTPGPQPQPMDLRVGQRPPVEPPPEPTLLALQRPQRLHHHLFLAGLQQQRSVEPMRLSMDTPMPELQVGPQEQELRQLLHKDKSKRSAVASSVVKQKLAEVILKKQQAALERTVHPNSPGIPYRTLEPLETEGATRSMLSSFLPPVPSLPSDPPEHFPLRKTVSEPNLKLRYKPKKSLERRKNPLLRKESAPPSLRRRPAETLGDSSPSSSSTPASGCSSPNDSEHGPNPILGSEADSDRRTHPTLGPRGPILGSPHTPLFLPHGLEPEAGGTLPSRLQPILLLDPSGSHAPLLTGESAASSGKGLGPCTLLRAKLGMDPSFLPISVPLSCALPCCTLAPHPIPSLPSIAPCGSHLIHTPS

SEQ ID NO: 861139 - protein, 501 aa, Homo sapiens
MDTQAGSVDEENGRQLGEVELQCGICTKWFTADTFGIDTSSCLPFMTNYSFHCNVCHHSGNTYFLRKQANLKEMCLSALANLTWQSRTQDEHPKTMFSKDKDIIPFIDKYWECMTTRQRPGKMTWPNNIVKTMSKERDVFLVKEHPDPGSKDPEEDYPKFGLLDQDLSNIGPAYDNQKQSSAVSTSGNLNGGIAAGSSGKGRGAKRKQQDGGTTGTTKKARSDPLFSAQRLPPHGYPLEHPFNKDGYRYILAEPDPHAPDPEKLELDCWAGKPIPGDLYRACLYERVLLALHDRAPQLKISDDRLTVVGEKGYSMVRASHGVRKGAWYFEITVDEMPPDTAARLGWSQPLGNLQAPLGYDKFSYSWRSKKGTKFHQSIGKHYSSGYGQGDVLGFYINLPEDTETAKSLPDTYKDKALIKFKSYLYFEEKDFVDKAEKSLKQTPHSEVSINFGPCFKYPPKDLTYRPMSDMGWGAVVEHTLADVLYHVETEVDGRRSPPWEP

SEQ ID NO: 861140 - protein, 259 aa, Homo sapiens
MAAAGAGPGQEAGAGPGPGAVANATGAEEGEMKPVAAGAAAPPGEGISAAPTVEPSSGEAEGGEANLVDVSGGLETESSNGKDTLEGAGDTSEVMDTQAGSVDEENGRQLGEVELQCGICTKWFTADTFGIDTSSCLPFMTNYSFHCNVCHHSGNTYFLRKQANLKEMCLSALANLTWQSRTQDEHPKTMFSKDKMECSDAISAQCTLCLLGPRDSPASASRVAGITGMRHHAQLIFCIFSRDRISPCWPGSSPTDLMI

SEQ ID NO: 861141 - protein, 628 aa, Homo sapiens
MAAAGAGPGQEAGAGPGPGAVANATGAEEGEMKPVAAGAAAPPGEGISAAPTVEPSSGEAEGGEANLVDVSGGLETESSNGKDTLEGAGDTSEVMDTQAGSVDEENGRQLGEVELQCGICTKWFTADTFGIDTSSCLPFMTNYSFHCNVCHHSGNTYFLRKQANLKEMCLSALANLTWQSRTQDEHPKTMFSKDKDIIPFIDKYWECMTTRQRPGKMTWPNNIVKTMSKERDVFLVKEHPDPGSKDPEEDYPKFGLLDQDLSNIGPAYDNQKQSSAVSTSGNLNGGIAAGSSGKGRGAKRKQQDGGTTGTTKKARSDPLFSAQRLPPHGYPLEHPFNKDGYRYILAEPDPHAPDPEKLELDCWAGKPIPGDLYRACLYERVLLALHDRAPQLKISDDRLTVVGEKGYSMVRASHGVRKGAWYFEITVDEMPPDTAARLGWSQPLGNLQAPLGYDKFSYSWRSKKGTKFHQSIGKHYSSGYGQGDVLGFYINLPEDTETAKSLPDTYKDKALIKFKSYLYFEEKDFVDKAEKSLKQTPHSEIIFYKNGVNQGVAYKDIFEGVYFPAISLYKSCTVSINFGPCFKYPPKDLTYRPMSDMGWGAVVEHTLADVLYHVETEVDGRRSPPWEP

SEQ ID NO: 861142 - protein, 628 aa, Homo sapiens; identical to SEQ ID NO: 861141

SEQ ID NO: 861143 - protein, 420 aa, Homo sapiens
MVRVALSLNPILKPSEENIEEFNDIQGQGHQGHHQHEDDEEDYPKLGLLDQDLSNIGPAYDNQKQSSAVSTSGNLNGGIAAGSSGKGRGAKRKQQDGGTTGTTKKARSDPLFSAQRLPPHGYPLEHPFNKDGYRYILAEPDPHAPDPEKLELDCWAGKPIPGDLYRACLYERVLLALHDRAPQLKISDDRLTVVGEKGYSMVRASHGVRKGAWYFEITVDEMPPDTAARLGWSQPLGNLQAPLGYDKFSYSWRSKKGTKFHQSIGKHYSSGYGQGDVLGFYINLPEDTETAKSLPDTYKDKALIKFKSYLYFEEKDFVDKAEKSLKQTPHSEIIFYKNGVNQGVAYKDIFEGVYFPAISLYKSCTVSINFGPCFKYPPKDLTYRPMSDMGWGAVVEHTLADVLYHVETEVDGRRSPPWEP

SEQ ID NO: 861144 - protein, 251 aa, Homo sapiens
MTRSECKRGKVVRKGARKKRWGIEGMKKGYSMVRASHGVRKGAWYFEITVDEMPPDTAARLGWSQPLGNLQAPLGYDKFSYSWRSKKGTKFHQSIGKHYSSGYGQGDVLGFYINLPEDTETAKSLPDTYKDKALIKFKSYLYFEEKDFVDKAEKSLKQTPHSEIIFYKNGVNQGVAYKDIFEGVYFPAISLYKSCTVSINFGPCFKYPPKDLTYRPMSDMGWGAVVEHTLADVLYHVETEVDGRRSPPWEP

SEQ ID NO: 861145 - protein, 628 aa, Homo sapiens; identical to SEQ ID NO: 861141

SEQ ID NO: 861146 - protein, 628 aa, Homo sapiens; identical to SEQ ID NO: 861141

SEQ ID NO: 861147 - protein, 527 aa, Homo sapiens
MAAAGAGPGQEAGAGPGPGAVANATGAEEGEMKPVAAGAAAPPGEGISAAPTVEPSSGEAEGGEANLVDVSGGLETESSNGKDTLEGAGDTSEVMDTQAGSVDEENGRQLGEVELQCGICTKWFTADTFGIDTSSCLPFMTNYSFHCNVCHHSGNTYFLRKQANLKEMCLSALANLTWQSRTQDEHPKTMFSKDKDIIPFIDKYWECMTTRQRPGKMTWPNNIVKTMSKERDVFLVKEHPDPGSKDPEEDYPKFGLLDQDLSNIGPAYDNQKQSSAVSTSGNLNGGIAAGSSGKGRGAKRKQQDGGTTGTTKKARSDPLFSAQRLPPHGYPLEHPFNKDGYRYILAEPDPHAPDPEKLELDCWAGKPIPGDLYRACLYERVLLALHDRAPQLKISDDRLTVVGEKGYSMVRASHGVRKGAWYFEITVDEMPPDTAARLGWSQPLGNLQAPLGYDKFSYSWRSKKGTKFHQSIGPYELDKPKEKGKITIIKKEGKAAEAVAAAVGTGATTAAVMAAAGIAAIGPWPLS

SEQ ID NO: 861148 - protein, 534 aa, Homo sapiens
MDTQAGSVDEENGRQLGEVELQCGICTKWFTADTFGIDTSSCLPFMTNYSFHCNVCHHSGNTYFLRKQANLKEMCLSALANLTWQSRTQDEHPKTMFSKDKDIIPFIDKYWECMTTRQRPGKMTWPNNIVKTMSKERDVFLVKEHPDPGSKDPEEDYPKFGLLDQDLSNIGPAYDNQKQSSAVSTSGNLNGGIAAGSSGKGRGAKRKQQDGGTTGTTKKARSDPLFSAQRLPPHGYPLEHPFNKDGYRYILAEPDPHAPDPEKLELDCWAGKPIPGDLYRACLYERVLLALHDRAPQLKISDDRLTVVGEKGYSMVRASHGVRKGAWYFEITVDEMPPDTAARLGWSQPLGNLQAPLGYDKFSYSWRSKKGTKFHQSIGKHYSSGYGQGDVLGFYINLPEDTETAKSLPDTYKDKALIKFKSYLYFEEKDFVDKAEKSLKQTPHSEIIFYKNGVNQGVAYKDIFEGVYFPAISLYKSCTVSINFGPCFKYPPKDLTYRPMSDMGWGAVVEHTLADVLYHVETEVDGRRSPPWEP

SEQ ID NO: 861149 - protein, 628 aa, Homo sapiens; identical to SEQ ID NO: 861141

SEQ ID NO: 861150 - protein, 628 aa, Homo sapiens; identical to SEQ ID NO: 861141

SEQ ID NO: 861151 - protein, 456 aa, Homo sapiens
KGRGAKRKQQDGGTTGTTREGPEDIIPFIDKYWECMTTRQRPGKMTWPNNIVKTMSKERDVFLVKEHPDPGSKDPEEDYPKFGLLDQDLSNIGPAYDNQKQSSAVSTSGNLNGGIAAGSSGKGRGAKRKQQDGGTTGTTKKARSDPLFSAQRLPPHGYPLEHPFNKDGYRYILAEPDPHAPDPEKLELDCWAGKPIPGDLYRACLYERVLLALHDRAPQLKISDDRLTVVGEKGYSMVRASHGVRKGAWYFEITVDEMPPDTAARLGWSQPLGNLQAPLGYDKFSYSWRSKKGTKFHQSIGKHYSSGYGQGDVLGFYINLPEDTETAKSLPDTYKDKALIKFKSYLYFEEKDFVDKAEKSLKQTPHSEIIFYKNGVNQGVAYKDIFEGVYFPAISLYKSCTVSINFGPCFKYPPKDLTYRPMSDMGWGAVVEHTLADVLYHVETEVDGRRSPPWEP

SEQ ID NO: 861152 - protein, 413 aa, Homo sapiens
MFINSKTLLLFESKERDVFLVKEHPDPGSKDPEEDYPKFGLLDQDLSNIGPAYDNQKQSSAVSTSGNLNGGIAAGSSGKGRGAKRKQQDGGTTGTTKKARSDPLFSAQRLPPHGYPLEHPFNKDGYRYILAEPDPHAPDPEKLELDCWAGKPIPGDLYRACLYERVLLALHDRAPQLKISDDRLTVVGEKGYSMVRASHGVRKGAWYFEITVDEMPPDTAARLGWSQPLGNLQAPLGYDKFSYSWRSKKGTKFHQSIGKHYSSGYGQGDVLGFYINLPEDTETAKSLPDTYKDKALIKFKSYLYFEEKDFVDKAEKSLKQTPHSEIIFYKNGVNQGVAYKDIFEGVYFPAISLYKSCTVSINFGPCFKYPPKDLTYRPMSDMGWGAVVEHTLADVLYHVETEVDGRRSPPWEP

SEQ ID NO: 861153 - protein, 628 aa, Homo sapiens; identical to SEQ ID NO: 861141

SEQ ID NO: 861154 - protein, 591 aa, Homo sapiens
MAAAGAGPGQEAGAGPGPGAVANATGAEEGEMKPVAAGAAAPPGEGISAAPTVEPSSGEAEGGEANLVDVSGGLETESSNGKDTLEGAGDTSEVMDTQAGSVDEENGRQLGEVELQCGICTKWFTADTFGIDTSSCLPFMTNYSFHCNVCHHSGNTYFLRKQANLKEMCLSALANLTWQSRTQDEHPKTMFSKDKDIIPFIDKYWECMTTRQRPGKMTWPNNIVKTMSKERDVFLVKEHPDPGSKDPEEDYPKFGLLDQDLSNIGPAYDNQKQSSAVSTSGNLNGGIAAGSSGKGRGAKRKQQDGGTTGTTKKARSDPLFSAQRLPPHGYPLEHPFNKDGYRYILAEPDPHAPDPEKLELDCWAGKPIPGDLYRACLYERVLLALHDRAPQLKISDDRLTVVGEKGYSMVRASHGVRKGAWYFEITVDEMPPDTAARLGWSQPLGNLQAPLGYDKFSYSWRSKKGTKFHQSIGKHYSSGYGQGDVLGFYINLPEDTETAKSLPDTYKDKALIKFKSYLYFEEKDFVDKAEKSLKQTPHSEIIFYKNGVNQGVAYKDIFEGVYFPAISLYKSCTFPLTLDLELTYHVEKIQL

SEQ ID NO: 861155 - protein, 206 aa, Homo sapiens
MELTQPAEDLIQTQQTPASELGDPEDPGEEAADGSDTVVLSLFPCTPEPVNPEPDASVSSPQAGSSLKHSTTLTNRQRGNEVSALPATLDSLSIHQLAAQGELDQLKEHLRKGDNLVNKPDERGFTPLIWASAFGEIETVRFLLEWGADPHILAKERESALSLASTGGYTDIVGLLLERDVDINIYDWNGGTPLLLRCAREPREMR

SEQ ID NO: 861156 - protein, 111 aa, Homo sapiens
QPRRLEKPPWNWICSWETRMSWGNSSVTHWEGPGLSSNMSPHPGRKDVFFQTAECCDSALNSPCSLSLDKPKSGSCRFHKTSQGLGLGTALVRIPAPPQATGRRDLGYALA

SEQ ID NO: 861157 - protein, 206 aa, Homo sapiens; identical to SEQ ID NO: 861155

SEQ ID NO: 861158 - protein, 206 aa, Homo sapiens; identical to SEQ ID NO: 861155

SEQ ID NO: 861159 - protein, 206 aa, Homo sapiens; identical to SEQ ID NO: 861155

SEQ ID NO: 861160 - protein, 184 aa, Homo sapiens
MELTQPAEDLIQTQQTPASELGDPEDPGEEAADGSDTVVLSLFPCTPEPVNPEPDASVSSPQAGSSLKHSTTLTNRQRGNEVSALPATLDCDNLVNKPDERGFTPLIWASAFGEIETVRFLLEWGADPHILAKERESALSLASTGGYTDIVGLLLERDVDINIYDWNGGTPLLLRCAREPREMR

SEQ ID NO: 861161 - protein, 206 aa, Homo sapiens; identical to SEQ ID NO: 861155

SEQ ID NO: 861162 - protein, 102 aa, Homo sapiens [sequence omitted]

SEQ ID NO: 861163 - protein, 186 aa, Homo sapiens
MELTQPAEDLIQTQQTPASELGDPEDPGEEAADGSDTVVLSLFPCTPEPVNPEPDASVSSPQAGSSLKHSTTLTNRQRGNEVSALPATLDSLSIHQLAAQGELDQLKEHLRKGDNLVNKPDERGFTGADPHILAKERESALSLASTGGYTDIVGLLLERDVDINIYDWNGGTPLLLRCAREPREMR

SEQ ID NO: 861164 - protein, 184 aa, Homo sapiens; identical to SEQ ID NO: 861160

SEQ ID NO: 861165 - protein, 102 aa, Homo sapiens [sequence omitted]

SEQ ID NO: 861166 - protein, 206 aa, Homo sapiens; identical to SEQ ID NO: 861155

SEQ ID NO: 861167 - protein, 122 aa, Homo sapiens
AAPATGEATLKLDLQLGDTDELGKLQRHPLGGPWKQTGKLRRKLTAGTEPCYACLIHIVLGMEGKKEIRHMFLSWSKRCFFPNCRVLRFSTELTLEAPGSRRREGLRPALSSAEGLTPRSVH

SEQ ID NO: 861168 - protein, 206 aa, Homo sapiens; identical to SEQ ID NO: 861155

SEQ ID NO: 861169 - protein, 184 aa, Homo sapiens; identical to SEQ ID NO: 861160

SEQ ID NO: 861170 - protein, 247 aa, Homo sapiens
LKQTVSPRTHTSLVATFGPPSFERTGLSARGDRGGSWGAFPMELTQPAEDLIQTQQTPASELGDPEDPGEEAADGSDTVVLSLFPCTPEPVNPEPDASVSSPQAGSSLKHSTTLTNRQRGNEVSALPATLDSLSIHQLAAQGELDQLKEHLRKGDNLVNKPDERGFTPLIWASAFGEIETVRFLLEWGADPHILAKERESALSLASTGGYTDIVGLLLERDVDINIYDWNGGTPLLLRCAREPREMR

SEQ ID NO: 861171 - protein, 127 aa, Homo sapiens
MSEDSASVLPQPLSIHQLAAQGELDQLKEHLRKGDNLVNKPDERGFTPLIWASAFGEIETVRFLLEWGADPHILAKERESALSLASTGGYTDIVGLLLERDVDINIYDWNGGTPLLLRCAREPREMR

SEQ ID NO: 861172 - protein, 102 aa, Homo sapiens [sequence omitted]

SEQ ID NO: 861173 - protein, 203 aa, Homo sapiens
MELTQPAEDLIQTQQTPASELGDPEDPGEEAADGSDTVVLSLFPCTPEPVNPEPDASVSSPQAGSSLKHSTTLTNRQRGNEVSALPATLDSLSIHQLAAQGELDQLKEHLRKGDNLVNKPDERGFTPLIWASAFGEIETVRFLLEWVRPSPAGQRGGFPGALGWAGVLAVSAGALSLRCGCWLGAVAHACNPSTLGGRGGWIT

SEQ ID NO: 861174 - protein, 261 aa, Homo sapiens
MELTQPAEDLIQTQQTPASELGDPEDPGEEAADGSDTVVLSLFPCTPEPVNPEPDASVSSPQAGSSLKHSTTLTNRQRGNEVSALPATLDCDNLVNKPDERGFTPLIWASAFGEIETVRFLLEWGADPHILAKERESALSLASTGGYTDIVGLLLERDVDINIYDWMEGTHCCTLCAEPREWVGWWPADSHERSGNQMTAGPDTKDRIRHIQSQDWRDWRAADHTASPGPRSGGGGAQKLEKPSGRESFPQTAYNKTKRGP

SEQ ID NO: 861175 - protein, 267 aa, Homo sapiens
MYELRDWDFNISREAGVCIMTWKAAADRMDGTFNLPSDGSAVDVHINMEQAPIQSEPRVRLVMAQHMIRDIQTLLSRMECRGGPQPQHSQPPPQPPAVTPEPVALSSQTSEPVESEAPPREPMEAEEVEERAPAQNPELTPGPAPAGPTPAPETNAPNHPSPAEYVEVLQELQRLESRLQPFLQRYYEVLGAAATTDYNNNHEGREEDQRLINLVGESLRLLGNTFVALSDLRCNLACTPPRHLHVVRPMLITPMVSADIPKILGPV

SEQ ID NO: 861176 - protein, 109 aa, Homo sapiens
RWTSGHGLFCSREPPSGAGGGSRDEQDGASAETEPWAAAVPPEWVPIIQQDIQSQRKVKPQPPLSDAYLSGMPAKRRKLRSDIQKRLQEDPNYSPQRFPNAQRAFADDP

SEQ ID NO: 861177 - protein, 137 aa, Homo sapiens
EGGNPPIPGDMELGAEEFPDFKRENASPAPGTTAEEAMSRGPPPAPEGGSRDEQDGASAETEPWAAAVPPEWVPIIQQDIQSQRKVKPQPPLSDAYLSGMPAKRRKLRSDIQKRLQEDPNYSPQRFPNAQRAFADDP

SEQ ID NO: 861178 - protein, 1063 aa, Homo sapiens
KSLPDLQRRVQGPRRVSSEPRVRLVMAQHMIRDIQTLLSRMETLPYLQCRGGPQPQHSQPPPQPPAVTPEPVALSSQTSEPVESEAPPREPMEAEEVEERAPAQNPELTPGPAPAGPTPAPETNAPNHPSPAEYVEVLQELQRLESRLQPFLQRYYEVLGAAATTDYNNNHEGREEDQRLINLVGESLRLLGNTFVALSDLRCNLACTPPRHLHVVRPMSHYTTPMVLQQAAIPIQINVGTTVTMTGNGTRPPPTPNAEAPPPGPGQASSVAPSSTNVESSAEGAPPPGPAPPPATSHPRVIRISHQSVEPVVMMHMNIQDSGTQPGGVPSAPTGPLGPPGHGQTLGSTLIQLPSLPPEFMHAVAHQITHQAMVAAVASAAAGNDLEGEAWEVGHSPWWQLAGKGLASALFGLSLLPPTGQQVPGFPTAPTRVVIARPTPPQARPSHPGGPPVSGTLQGAGLGTNASLAQMVSGLVGQLLMQPVLVAQGTPGMAPPPAPATASASAGTTNTATTAGPAPGGPAQPPPTPQPSMADLQFSQLLGNLLGPAGPGAGGSGVASPTITVAMPGVPAFLQGMTDFLQATQTAPPPPPPPPPPPPAPEQQTMPPPGSPSGGAGSPGGLGLESLSPEFFTSVVQGVLSSLLGSLGARAGSSESIAAFIQRLSGSSNIFEPGADGALGFFGALLSLLCQNFSMVDVVMLLHGHFQPLQRLQPQLRSFFHQHYLGGQEPTPSNIRMATHTLITGLEEYVRESFSLVQVQPGVDIIRTNLEFLQEQFNSIAAHVLHCTDSGFGARLLELCNQGLFECLALNLHCLGGQQMELAAVINGRIRRMSRGVNPSLVSWLTTMMGLRLQVVLEHMPVGPDAILRYVRRVGDPPQPLPEEPMEVQGAERASPEPQRENASPAPGTTAEEAMSRGPPPAPEGGSRDEQDGASAETEPWAAAVPPEWVPIIQQDIQSQRKVKPQPPLSDAYLSGMPAKRRKTMQGEGPQLLLSEAVSRAAKAAGARPLTSPESLSRDLEAPEVQESYRQQLRSDIQKRLQEDPNYSPQRFPNAQRAFADDP

SEQ ID NO: 861179 - protein, 593 aa, Homo sapiens
MVSGLVGQLLMQPVLVAQGTPGMAPPPAPATASASAGTTNTATTAGPAPGGPAQPPPTPQPSMADLQFSQLLGNLLGPAGPGAGGSGVASPTITVAMPGVPAFLQGMTDFLQATQTAPPPPPPPPPPPPAPEQQTMPPPGSPSGGAGSPGGLGLESLSPEFFTSVVQGVLSSLLGSLGARAGSSESIAAFIQRLSGSSNIFEPGADGALGFFGALLSLLCQNFSMVDVVMLLHGHFQPLQRLQPQLRSFFHQHYLGGQEPTPSNIRMATHTLITGLEEYVRESFSLVQVQPGVDIIRTNLEFLQEQFNSIAAHVLHCTDSGFGARLLELCNQGLFECLALNLHCLGGQQMELAAVINGRIRRMSRGVNPSLVSWLTTMMGLRLQVVLEHMPVGPDAILRYVRRVGDPPQPLPEEPMEVQGAERASPEPQRENASPAPGTTAEEAMSRGPPPAPEGGSRDEQDGASAETEPWAAAVPPEWVPIIQQDIQSQRKVKPQPPLSDAYLSGMPAKRRKTMQGEGPQLLLSEAVSRAAKAAGARPLTSPESLSRDLEAPEVQESYRQQLRSDIQKRLQEDPNYSPQRFPNAQRAFADDP

SEQ ID NO: 861180 - protein, 1038 aa, Homo sapiens
KSLPDLQRRVQGPRRVSSEPRVRLVMAQHMIRDIQTLLSRMETLPYLQCRGGPQPQHSQPPPQPPAVTPEPVALSSQTSEPVESEAPPREPMEAEEVEERAPAQNPELTPGPAPAGPTPAPETNAPNHPSPAEYVEVLQELQRLESRLQPFLQRYYEVLGAAATTDYNNNHEGREEDQRLINLVGESLRLLGNTFVALSDLRCNLACTPPRHLHVVRPMSHYTTPMVLQQAAIPIQINVGTTVTMTGNGTRPPPTPNAEAPPPGPGQASSVAPSSTNVESSAEGAPPPGPAPPPATSHPRVIRISHQSVEPVVMMHMNIQDSGTQPGGVPSAPTGPLGPPGHGQTLGSTLIQLPSLPPEFMHAVAHQITHQAMVALAGKGLASALFGLSLLPPTGQQVPGFPTAPTRVVIARPTPPQARPSHPGGPPVSGTLQGAGLGTNASLAQMVSGLVGQLLMQPVLVAQGTPGMAPPPAPATASASAGTTNTATTAGPAPGGPAQPPPTPQPSMADLQFSQLLGNLLGPAGPGAGGSGVASPTITVAMPGVPAFLQGMTDFLQATQTAPPPPPPPPPPPPAPEQQTMPPPGSPSGGAGSPGGLGLESLSPEFFTSVVQGVLSSLLGSLGARAGSSESIAAFIQRLSGSSNIFEPGADGALGFFGALLSLLCQNFSMVDVVMLLHGHFQPLQRLQPQLRSFFHQHYLGGQEPTPSNIRMATHTLITGLEEYVRESFSLVQVQPGVDIIRTNLEFLQEQFNSIAAHVLHCTDSGFGARLLELCNQGLFECLALNLHCLGGQQMELAAVINGRIRRMSRGVNPSLVSWLTTMMGLRLQVVLEHMPVGPDAILRYVRRVGDPPQPLPEEPMEVQGAERASPEPQRENASPAPGTTAEEAMSRGPPPAPEGGSRDEQDGASAETEPWAAAVPPEWVPIIQQDIQSQRKVKPQPPLSDAYLSGMPAKRRKTMQGEGPQLLLSEAVSRAAKAAGARPLTSPESLSRDLEAPEVQESYRQQLRSDIQKRLQEDPNYSPQRFPNAQRAFADDP

SEQ ID NO: 861181 - protein, 1085 aa, Homo sapiens
KSLPDLQRRVQGPRRVSSEPRVRLVMAQHMIRDIQTLLSRMETLPYLQCRGGPQPQHSQPPPQPPAVTPEPVALSSQTSEPVESEAPPREPMEAEEVEERAPAQNPELTPGPAPAGPTPAPETNAPNHPSPAEYVEVLQELQRLESRLQPFLQRYYEVLGAAATTDYNNNHEGREEDQRLINLVGESLRLLGNTFVALSDLRCNLACTPPRHLHVVRPMSHYTTPMVLQQAAIPIQINVGTTVTMTGNGTRPPPTPNAEAPPPGPGQASSVAPSSTNVESSAEGAPPPGPAPPPATSHPRVIRISHQSVEPVVMMHMNIQGPLSLSPCPDSGTQPGGVPSAPTGPLGPPGHGQTLGVRVRASGQAELWVEKGKELSGWVEGVQVQGYIRPAPQAPPSSSCPPCPLSSCTPSPTRSLIRPWWHWLARAWPSALFGLSLLPPTGQQVPGFPTAPTRVVIARPTPPQARPSHPGGPPVSGTLQGAGLGTNASLAQMVSGLVGQLLMQPVLVAQGTPGMAPPPAPATASASAGTTNTATTAGPAPGGPAQPPPTPQPSMADLQFSQLLGNLLGPAGPGAGGSGVASPTITVAMPGVPAFLQGMTDFLQATQTAPPPPPPPPPPPPAPEQQTMPPPGSPSGGAGSPGGLGLESLSPEFFTSVVQGVLSSLLGSLGARAGSSESIAAFIQRLSGSSNIFEPGADGALGFFGALLSLLCQNFSMVDVVMLLHGHFQPLQRLQPQLRSFFHQHYLGGQEPTPSNIRMATHTLITGLEEYVRESFSLVQVQPGVDIIRTNLEFLQEQFNSIAAHVLHCTDSGFGARLLELCNQGLFECLALNLHCLGGQQMELAAVINGRIRRMSRGVNPSLVSWLTTMMGLRLQVVLEHMPVGPDAILRYVRRVGDPPQPLPEEPMEVQGAERASPEPQRENASPAPGTTAEEAMSRGPPPAPEGGSRDEQDGASAETEPWAAAVPPEWVPIIQQDIQSQRKVKPQPPLSDAYLSGMPAKRRKTMQGEGPQLLLSEAVSRAAKAAGARPLTSPESLSRDLEAPEVQESYRQQLRSDIQKRLQEDPNYSPQRFPNAQRAFADDP

SEQ ID NO: 861182 - protein, 1026 aa, Homo sapiens
KSLPDLQRRVQGPRRVSSEPRVRLVMAQHMIRDIQTLLSRMETLPYLQCRGGPQPQHSQPPPQPPAVTPEPVALSSQTSEPVESEAPPREPMEAEEVEERAPAQNPELTPGPAPAGPTPAPETNAPNHPSPAEYVEVLQELQRLESRLQPFLQRYYEVLGAAATTDYNNNHEGREEDQRLINLVGESLRLLGNTFVALSDLRCNLACTPPRHLHVVRPMSHYTTPMVLQQAAIPIQINVGTTVTMTGNGTRPPPTPNAEAPPPGPGQASSVAPSSTNVESSAEGAPPPGPAPPPATSHPRVIRISHQSVEPVVMMHMNIQDSGTQPGGVPSAPTGPLGPPGHGQTLGSTLIQLPSLPPEFMHAVAHQITHQAMVAAVASAAAGQQVPGFPTAPTRVVIARPTPPQARPSHPGGPPVSGTLQGAGLGTNASLAQMVSGLVGQLLMQPVLVAQGTPGMAPPPAPATASASAGTTNTATTAGPAPGGPAQPPPTPQPSMADLQFSQLLGNLLGPAGPGAGGSGVASPTITVAMPGVPAFLQGMTDFLQATQTAPPPPPPPPPPPPAPEQQTMPPPGSPSGGAGSPGGLGLESLSPEFFTSVVQGVLSSLLGSLGARAGSSESIAAFIQRLSGSSNIFEPGADGALGFFGALLSLLCQNFSMVDVVMLLHGHFQPLQRLQPQLRSFFHQHYLGGQEPTPSNIRMATHTLITGLEEYVRESFSLVQVQPGVDIIRTNLEFLQEQFNSIAAHVLHCTDSGFGARLLELCNQGLFECLALNLHCLGGQQMELAAVINGRIRRMSRGVNPSLVSWLTTMMGLRLQVVLEHMPVGPDAILRYVRRVGDPPQPLPEEPMEVQGAERASPEPQRENASPAPGTTAEEAMSRGPPPAPEGGSRDEQDGASAETEPWAAAVPPEWVPIIQQDIQSQRKVKPQPPLSDAYLSGMPAKRRKTMQGEGPQLLLSEAVSRAAKAAGARPLTSPESLSRDLEAPEVQESYRQQLRSDIQKRLQEDPNYSPQRFPNAQRAFADDP

SEQ ID NO: 861183 - protein, 1026 aa, Homo sapiens; identical to SEQ ID NO: 861182

SEQ ID NO: 861184 - protein, 977 aa, Homo sapiens
KSLPDLQRRVQGPRRVSSEPRVRLVMAQHMIRDIQTLLSRMETLPYLQCRGGPQPQHSQPPPQPPAVTPEPVALSSQTSEPVESEAPPREPMEAEEVEERAPAQNPELTPGPAPAGPTPAPETNAPNHPSPAEYVEVLQELQRLESRLQPFLQRYYEVLGAAATTDYNNNHEGREEDQRLINLVGESLRLLGNTFVALSDLRCNLACTPPRHLHVVRPMSHYTTPMVLQQAAIPIQINVGTTVTMTGNGTRPPPTPNAEAPPPGPGQASSVAPSSTNVESSAEGAPPPGPAPPPATSHPRVIRISHQSVEPVVMMHMNIQDSGTQPGGVPSAPTGPLGPPGHGQTLGSTLIQLPSLPPEFMHAVAHQITHQAMVAAVASAAAGQQVPGFPTAPTRVVIARPTPPQARPSHPGGPPVSGTLQGAGLGTNASLAQMVSGLVGQLLMQPVLVAQGTPGMAPPPAPATASASAGTTNTATTAGPAPGGPAQPPPTPQPSMADLQFSQLLGNLLGPAGPGAGGSGVASPTITVAMPGVPAFLQGMTDFLQATQTAPPPPPPPPPPPPAPEQQTMPPPGSPSGGAGSPGGLGLESLSPEFFTSVVQGVLSSLLGSLGARAGSSESIAAFIQRLSGSSNIFEPGADGALGFFGALLSLLCQNFSMVDVVMLLHGHFQPLQRLQPQLRSFFHQHYLGGQEPTPSNIRMATHTLITGLEEYVRESFSLVQVQPGVDIIRTNLEFLQEQFNSIAAHVLHCTDSGFGARLLELCNQGLFECLALNLHCLGGQQMELAAVINGRIRRMSRGVNPSLVSWLTTMMGLRLQVVLEHMPVGPDAILRYVRRVGDPPQPLPEEPMEVQGAERASPEPQRENASPAPGTTAEEAMSRGPPPAPEGGSRDEQDGASAETEPWAAAVPPEWVPIIQQDIQSQRKVKPQPPLSDAYLSGMPAKRRKLRSDIQKRLQEDPNYSPQRFPNAQRAFADDP

SEQ ID NO: 861185 - protein, 977 aa, Homo sapiens; identical to SEQ ID NO: 861184

SEQ ID NO: 861186 - protein, 1020 aa, Homo sapiens
KSLPDLQRRVQGPRRVSSEPRVRLVMAQHMIRDIQTLLSRMETLPYLQCRGGPQPQHSQPPPQPPAVTPEPVALSSQTSEPVESEAPPREPMEAEEVEERAPAQNPELTPGPAPAGPTPAPETNAPNHPSPAEYVEVLQELQRLESRLQPFLQRYYEVLGAAATTDYNNNHEGREEDQRLINLVGESLRLLGNTFVALSDLRCNLACTPPRHLHVVRPMSHYTTPMVLQQAAIPIQINVGTTVTMTGNGTRPPPTPNAEAPPPGPGQASSVAPSSTNVESSAEGAPPPGPAPPPATSHPRVIRISHQSVEPVVMMHMNIQDSGTQPGGVPSAPTGPLGPPGHGQTLGSTLIQLPSLPPEFMHAVAHQITHQAMVAAVASAAAGQQVPGFPTAPTRVVIARPTPPQARPSHPGGPPVSGTLQGAGLGTNASLAQMVSGLVGQLLMQPVLVAQGTPGMAPPPAPATASASAGTTNTATTAGPAPGGPAQPPPTPQPSMADLQFSQLLGNLLGPAGPGAGGSGVASPTITVAMPGVPAFLQGMTDFLQATQTAPPPPPPPPPPPPAPEQQTMPPPGSPSGGAGSPGGLGLESLSPEFFTSVVQGVLSSLLGSLGARAGSSESIAAFIQRLSGSSNIFEPGADGALGFFGALLSLLCQNFSMVDVVMLLHGHFQPLQRLQPQLRSFFHQHYLGGQEPTPSNIRMATHTLITGLEEYVRESFSLVQVQPGVDIIRTNLEFLQEQFNSIAAHVLHCTDSGFGARLLELCNQGLFECLALNLHCLGGQQMELAAVINGRIRRMSRGVNPSLVSWLTTMMGLRLQVVLEHMPVGPDAILRYVRRPLPEEPMEVQGAERASPEPQRENASPAPGTTAEEAMSRGPPPAPEGGSRDEQDGASAETEPWAAAVPPEWVPIIQQDIQSQRKVKPQPPLSDAYLSGMPAKRRKTMQGEGPQLLLSEAVSRAAKAAGARPLTSPESLSRDLEAPEVQESYRQQLRSDIQKRLQEDPNYSPQRFPNAQRAFADDP

SEQ ID NO: 861187 - protein, 970 aa, Homo sapiens
KSLPDLQRRVQGPRRVSSEPRVRLVMAQHMIRDIQTLLSRMETLPYLQCRGGPQPQHSQPPPQPPAVTPEPVALSSQTSEPVESEAPPREPMEAEEVEERAPAQNPELTPGPAPAGPTPAPETNAPNHPSPAEYVEVLQELQRLESRLQPFLQRYYEVLGAAATTDYNNNHEGREEDQRLINLVGESLRLLGNTFVALSDLRCNLACTPPRHLHVVRPMSHYTTPMVLQQAAIPIQINVGTTVTMTGNGTRPPPTPNAEAPPPGPGQASSVAPSSTNVESSAEGAPPPGPAPPPATSHPRVIRISHQSVEPVVMMHMNIQDSGTQPGGVPSAPTGPLGPPGHGQTLGSTLIQLPSLPPEFMHAVAHQITHQAMVAAVASAAAGQQVPGFPTAPTRVVIARPTPPQARPSHPGGPPVSGTLQGAGLGTNASLAQMVSGLVGQLLMQPVLVAQGTPGMAPPPAPATASASAGTTNTATTAGPAPGGPAQPPPTPQPSMADLQFSQLLGNLLGPAGPGAGGSGVASPTITVAMPGVPAFLQGMTDFLQATQTAPPPPPPPPPPPPAPEQQTMPPPGSPSGGAGSPGGLGLESLSPEFFTSVVQGVLSSLLGSLGARAGSSESIAAFIQRLSGSSNIFEPGADGALGFFGALLSLLCQNFSMVDVVMLLHGHFQPLQRLQPQLRSFFHQHYLGGQEPTPSNIRMATHTLITGLEEYVRESFSLVQVQPGVDIIRTNLEFLQEQFNSIAAHVLHCTDSGFGARLLELCNQGLFECLALNLHCLGGQQMELAAVINGRIRRMSRGVNPSLVSWLTTMMGLRLQVVLEHMPVGPDAILRYVRRVGDPPQPLPEEPMEVQGAERASPEPQRENASPAPGTTAEEAMSRGPPPAPEGGSRDEQDGASAETEPWAAAVPPEWVPIIQQDIQSQRKVKPQPPLSDAYLSGMPAKRRKLHPVHPGSPLKEQEVDLGTWPLLL

SEQ ID NO: 861188 - protein, 978 aa, Homo sapiens
KSLPDLQRRVQGPRRVSSEPRVRLVMAQHMIRDIQTLLSRMETLPYLQCRGGPQPQHSQPPPQPPAVTPEPVALSSQTSEPVESEAPPREPMEAEEVEERAPAQNPELTPGPAPAGPTPAPETNAPNHPSPAEYVEVLQELQRLESRLQPFLQRYYEVLGAAATTDYNNNHEGREEDQRLINLVGESLRLLGNTFVALSDLRCNLACTPPRHLHVVRPMSHYTTPMVLQQAAIPIQINVGTTVTMTGNGTRPPPTPNAEAPPPGPGQASSVAPSSTNVESSAEGAPPPGPAPPPATSHPRVIRISHQSVEPVVMMHMNIQDSGTQPGGVPSAPTGPLGPPGHGQTLGSTLIQLPSLPPEFMHAVAHQITHQAMVAAVASAAAGQQVPGFPTAPTRVVIARPTPPQARPSHPGGPPVSGTLQGAGLGTNASLAQMVSGLVGQLLMQPVLVAQGTPGMAPPPAPATASASAGTTNTATTAGPAPGGPAQPPPTPQPSMADLQFSQLLGNLLGPAGPGAGGSGVASPTITVAMPGVPAFLQGMTDFLQATQTAPPPPPPPPPPPPAPEQQTMPPPGSPSGGAGSPGGLGLESLSPEFFTSVVQGVLSSLLGSLGARAGSSESIAAFIQRLSGSSNIFEPGADGALGFFGALLSLLCQNFSMVDVVMLLHGHFQPLQRLQPQLRSFFHQHYLGGQEPTPSNIRMATHTLITGLEEYVRESFSLVQVQPGVDIIRTNLEFLQEQFNSIAAHVLHCTDSGFGARLLELCNQGLFECLALNLHCLGGQQMELAAVINGRIRRMSRGVNPSLVSWLTTMMGLRLQVVLEHMPVGPDAILRYVRRVGDPPQPLPEEPMEVQGAERASPEPQEWVPIIQQDIQSQRKVKPQPPLSDAYLSGMPAKRRKTMQGEGPQLLLSEAVSRAAKAAGARPLTSPESLSRDLEAPEVQESYRQQLRSDIQKRLQEDPNYSPQRFPNAQRAFADDP

SEQ ID NO: 861189 - protein, 387 aa, Homo sapiens
KSLPDLQRRVQGPRRVSSEPRVRLVMAQHMIRDIQTLLSRMETLPYLQCRGGPQPQHSQPPPQPPAVTPEPVALSSQTSEPVESEAPPREPMEAEEVEERAPAQNPELTPGPAPAGPTPAPETNAPNHPSPAEYVEVLQELQRLESRLQPFLQRYYEVLGAAATTDYNNNHEGREEDQRLINLVGESLRLLGNTFVALSDLRCNLACTPPRHLHVVRPMSHYTTPMVLQQAAIPIQINVGTTVTMTGNGTRPPPTPNAEAPPPGPGQASSVAPSSTNVESSAEGAPPPGPAPPPATSHPRVIRISHQSVEPVVMMHMNIQDSGTQPGGVPSAPTGPLGPPGHGQTLDGNPHIDHGARRVCAGEFFLGAGSARCGHHPDKPGISPRAV

SEQ ID NO: 861190 - protein, 587 aa, Homo sapiens
KSLPDLQRRVQGPRRVSSEPRVRLVMAQHMIRDIQTLLSRMETLPYLQCRGGPQPQHSQPPPQPPAVTPEPVALSSQTSEPVESEAPPREPMEAEEVEERAPAQNPELTPGPAPAGPTPAPETNAPNHPSPAEYVEVLQELQRLESRLQPFLQRYYEVLGAAATTDYNNNHEGREEDQRLINLVGESLRLLGNTFVALSDLRCNLACTPPRHLHVVRPMSHYTTPMVLQQAAIPIQINVGTTVTMTGNGTRPPPTPNAEAPPPGPGQASSVAPSSTNVESSAEGAPPPGPAPPPATSHPRVIRISHQSVEPVVMMHMNIQDSGTQPGGVPSAPTGPLGPPGHGQTLGSTLIQLPSLPPEFMHAVAHQITHQAMVAAVASAAAGQQVPGFPTAPTRVVIARPTPPQARPSHPGGPPVSGTLQGAGLGTNASLAQMVSGLVGQLLMQPVLVAQGTPGMAPPPAPATASASAGTTNTATTAGPAPGGPAQPPPTPQPSMADLQFSQLLGNLLGPAGPGAGGSGVASPTITVAMPGVPAFLQGMTDFLQATQTAPPPPPPASTPTTCPRAADHAPTRLPFWWRRESWRPGS

SEQ ID NO: 861191 - protein, 852 aa, Homo sapiens
KSLPDLQRRVQGPRRVSSEPRVRLVMAQHMIRDIQTLLSRMETLPYLQCRGGPQPQHSQPPPQPPAVTPEPVALSSQTSEPVESEAPPREPMEAEEVEERAPAQNPELTPGPAPAGPTPAPETNAPNHPSPAEYVEVLQELQRLESRLQPFLQRYYEVLGAAATTDYNNNHEGREEDQRLINLVGESLRLLGNTFVALSDLRCNLACTPPRHLHVVRPMSHYTTPMVLQQAAIPIQINVGTTVTMTGNGTRPPPTPNAEAPPPGPGQASSVAPSSTNVESSAEGAPPPGPAPPPATSHPRVIRISHQSVEPVVMMHMNIQDSGTQPGGVPSAPTGPLGPPGHGQTLGSTLIQLPSLPPEFMHAVAHQITHQAMVAAVASAAAGQQVPGFPTAPTRVVIARPTPPQARPSHPGGPPVSGTLQGAGLGTNASLAQMVSGLVGQLLMQPVLVAQGTPGMAPPPAPATASASAGTTNTATTAGPAPGGPAQPPPTPQPSMADLQFSQLLGNLLGPAGPGAGGSGVASPTITVAMPGVPAFLQGMTDFLQATQTAPPPPPPPPPPPPAPEQQTMPPPGSPSGGAGSPGGLGLESLSPEFFTSVVQGVLSSLLGSLGARAGSSESIAAFIQRLSGSSNIFEPGADGALGFFGALLSLLCQNFSMVDVVMLLHGHFQPLQRLQPQLRSFFHQHYLGGQEPTPSNIRMATHTLITGLEEYVRESFSLVQVQPGVDIIRTNLEFLQEQFNSIAAHVLHCTDSGFGARLLELCNQGLFECLALNLHCLGGQQMELAAVINGRIRRMSRGVNPSLVSWLTTMMGLRLQVVLEHMPVGPDAILRYVRRVGDPPQPLPDVSMASE

SEQ ID NO: 861192 - protein, 534 aa, Homo sapiens
KSLPDLQRRVQGPRRVSSEPRVRLVMAQHMIRDIQTLLSRMETLPYLQCRGGPQPQHSQPPPQPPAVTPEPVALSSQTSEPVESEAPPREPMEAEEVEERAPAQNPELTPGPAPAGPTPAPETNAPNHPSPAEYVEVLQELQRLESRLQPFLQRYYEVLGAAATTDYNNNHEGREEDQRLINLVGESLRLLGNTFVALSDLRCNLACTPPRHLHVVRPMSHYTTPMVLQQAAIPIQINVGTTVTMTGNGTRPPPTPNAEAPPPGPGQASSVAPSSTNVESSAEGAPPPGPAPPPATSHPRVIRISHQSVEPVVMMHMNIQDSGTQPGGVPSAPTGPLGPPGHGQTLGSTLIQLPSLPPEFMHAVAHQITHQAMVAAVASAAAGNDLEGEAWEVGHSPWWQLAGKGLALSPLRSVSSATHRTAGARLPNSSNPGGDCPAHSSTGSAFPSWRAPSLWDTAGRRSGYQCLVGPDGERPCGAASYAASPCGSGDPRYGSTASPCHCFCQCWHHQHSYHSWPRSWGACPASTHPSTLHG

SEQ ID NO: 861193 - protein, 519 aa, Homo sapiens
KSLPDLQRRVQGPRRVSSEPRVRLVMAQHMIRDIQTLLSRMETLPYLQCRGGPQPQHSQPPPQPPAVTPEPVALSSQTSEPVESEAPPREPMEAEEVEERAPAQNPELTPGPAPAGPTPAPETNAPNHPSPAEYVEVLQELQRLESRLQPFLQRYYEVLGAAATTDYNNNHEGREEDQRLINLVGESLRLLGNTFVALSDLRCNLACTPPRHLHVVRPMSHYTTPMVLQQAAIPIQINVGTTVTMTGNGTRPPPTPNAEAPPPGPGQASSVAPSSTNVESSAEGAPPPGPAPPPATSHPRVIRISHQSVEPVVMMHMNIQDSGTQPGGVPSAPTGPLGPPGHGQTLGQQVPGFPTAPTRVVIARPTPPQARPSHPGGPPVSGTLQGAGLGTNASLAQMVSGLVGQLLMQPVLVAQGTPGMAPPPAPATASASAGTTNTATTAGPAPGGPAQPPPTPQPSMADLQFSQLLGNLLGPAGPGAGGSGVASPTITVAMPGVPAFLQGMTDFLQATQTAPAAAK

SEQ ID NO: 861194 - protein, 744 aa, Homo sapiens
KSLPDLQRRVQGPRRVSSEPRVRLVMAQHMIRDIQTLLSRMETLPYLQCRGGPQPQHSQPPPQPPAVTPEPVALSSQTSEPVESEAPPREPMEAEEVEERAPAQNPELTPGPAPAGPTPAPETNAPNHPSPAEYVEVLQELQRLESRLQPFLQRYYEVLGAAATTDYNNNHEGREEDQRLINLVGESLRLLGNTFVALSDLRCNLACTPPRHLHVVRPMSHYTTPMVLQQAAIPIQINVGTTVTMTGNGTRPPPTPNAEAPPPGPGQASSVAPSSTNVESSAEGAPPPGPAPPPATSHPRVIRISHQSVEPVVMMHMNIQDSGTQPGGVPSAPTGPLGPPGHGQTLGSTLIQLPSLPPEFMHAVAHQITHQAMVAAVASAAAGQQVPGFPTAPTRVVIARPTPPQARPSHPGGPPVSGTLQGAGLGTNASLAQMVSGLVGQLLMQPVLVAQGTPGMAPPPAPATASASAGTTNTATTAGPAPGGPAQPPPTPQPSMADLQFSQLLGNLLGPAGPGAGGSGVASPTITVAMPGVPAFLQGMTDFLQATQTAPPPPPPPPPPPPAPEQQTMPPPGSPSGGAGSPGGLGLESLSPEFFTSVVQGVLSSLLGSLGARAGSSESIAAFIQRLSGSSNIFEPGADGALGFFGALLSLLCQNFSMVDVVMLLHGHFQPLQRLQPQLRSFFHQHYLGGQEPTPSNIRMATHTLITGLEEYVRESFVSNPSLFLSSPGSGQGSCLLHSQSYDS

SEQ ID NO: 861195 - protein, 49 aa, Homo sapiens
GEKEVGLQGMNWRCGGLSVGFSQNNFPYPFPRVTALLWMFTSTWNRPRF

SEQ ID NO: 861196 - protein, 217 aa, Homo sapiens
DSDDGVLGFVLHLMGHALTLISLAGSRLTISSAPTGPLGPPGHGQTLGQQVPGFPTAPTRVVIARPTPPQARPSHPGGPPVSGTLQGAGLGTNASLAQMVSGLVGQLLMQPVLVAQGTPGMAPPPAPATASASAGTTNTATTAGPAPGGPAQPPPTPQPSMADLQFSQLLGNLLGPAGPGAGGSGVASPTITVAMPGVPAFLQGMTDFLQVSGWLAI

SEQ ID NO: 861197 - protein, 105 aa, Homo sapiens
MERVSRMVALDLTLILFSLPTPCPQTMQGEGPQLLLSEAVSRAAKAAGARPLTSPESLSRDLEAPEVQESYRQQLRSDIQKRLQEDPNYSPQRFPNAQRAFADDP

SEQ ID NO: 861198 - protein, 1026 aa, Homo sapiens; identical to SEQ ID NO: 861182

SEQ ID NO: 861199 - protein, 990 aa, Homo sapiens
KSLPDLQRRVQGPRRVSSEPRVRLVMAQHMIRDIQTLLSRMETLPYLQCRGGPQPQHSQPPPQPPAVTPEPVALSSQTSEPVESEAPPREPMEAEEVEERAPAQNPELTPGPAPAGPTPAPETNAPNHPSPAEYVEVLQELQRLESRLQPFLQRYYEVLGAAATTDYNNNHEGREEDQRLINLVGESLRLLGNTFVALSDLRCNLACTPPRHLHVVRPMSHYTTPMVLQQAAIPIQINVGTTVTMTGNGTRPPPTPNAEAPPPGPGQASSVAPSSTNVESSAEGAPPPGPAPPPATSHPRVIRISHQSVEPVVMMHMNIQDSGTQPGGVPSAPTGPLGPPGHGQTLGQQVPGFPTAPTRVVIARPTPPQARPSHPGGPPVSGTLQGAGLGTNASLAQMVSGLVGQLLMQPVLVAQGTPGMAPPPAPATASASAGTTNTATTAGPAPGGPAQPPPTPQPSMADLQFSQLLGNLLGPAGPGAGGSGVASPTITVAMPGVPAFLQGMTDFLQATQTAPPPPPPPPPPPPAPEQQTMPPPGSPSGGAGSPGGLGLESLSPEFFTSVVQGVLSSLLGSLGARAGSSESIAAFIQRLSGSSNIFEPGADGALGFFGALLSLLCQNFSMVDVVMLLHGHFQPLQRLQPQLRSFFHQHYLGGQEPTPSNIRMATHTLITGLEEYVRESFSLVQVQPGVDIIRTNLEFLQEQFNSIAAHVLHCTDSGFGARLLELCNQGLFECLALNLHCLGGQQMELAAVINGRIRRMSRGVNPSLVSWLTTMMGLRLQVVLEHMPVGPDAILRYVRRVGDPPQPLPEEPMEVQGAERASPEPQRENASPAPGTTAEEAMSRGPPPAPEGGSRDEQDGASAETEPWAAAVPPEWVPIIQQDIQSQRKVKPQPPLSDAYLSGMPAKRRKTMQGEGPQLLLSEAVSRAAKAAGARPLTSPESLSRDLEAPEVQESYRQQLRSDIQKRLQEDPNYSPQRFPNAQRAFADDP

SEQ ID NO: 861200 - protein, 593 aa, Homo sapiens; identical to SEQ ID NO: 861179

SEQ ID NO: 861201 - protein, 977 aa, Homo sapiens; identical to SEQ ID NO: 861184

SEQ ID NO: 861202 - protein, 998 aa, Homo sapiens
KSLPDLQRRVQGPRRVSSEPRVRLVMAQHMIRDIQTLLSRMETLPYLQCRGGPQPQHSQPPPQPPAVTPEPVALSSQTSEPVESEAPPREPMEAEEVEERAPAQNPELTPGPAPAGPTPAPETNAPNHPSPAEYVEVLQELQRLESRLQPFLQRYYEVLGAAATTDYNNNHEGREEDQRLINLVGESLRLLGNTFVALSDLRCNLACTPPRHLHVVRPMSHYTTPMVLQQAAIPIQINVGTTVTMTGNGTRPPPTPNAEAPPPGPGQASSVAPSSTNVESSAEGAPPPGPAPPPATSHPRVIRISHQSVEPVVMMHMNIQDSGTQPGGVPSAPTGPLGPPGHGQTLGSTLIQLPSLPPEFMHAVAHQITHQAMVAAVASAAAGQQVPGFPTAPTRVVIARPTPPQARPSHPGGPPVSGTLQGAGLGTNASLAQMVSGLVGQLLMQPVLVAQGTPGMAPPPAPATASASAGTTNTATTAGPAPGGPAQPPPTPQPSMADLQFSQLLGNLLGPAGPGAGGSGVASPTITVAMPGVPAFLQGMTDFLQATQTAPPPPPPPPPPPPAPEQQTMPPPGSPSGGAGSPGGLGLESLSPEFFTSVVQGVLSSLLGSLGARAGSSESIAAFIQRLSGSSNIFEPGADGALGFFGALLSLLCQNFSMVDVVMLLHGHFQPLQRLQPQLRSFFHQHYLGGQEPTPSNIRMATHTLITGLEEYVRESFSLVQVQPGVDIIRTNLEFLQEQFNSIAAHVLHCTDSGFGARLLELCNQGLFECLALNLHCLGGQQMELAAVINGRIRRMSRGVNPSLVSWLTTMMGLRLQVVLEHMPVGPDAILRYVRRVGDPPQPLPEEPMEVQGAERASPEPQRENASPAPGTTAEEAMSRGPPPAPEGGSRDEQDGASAETEPWAAAVPPEWVPIIQQDIQSQRKVKPQPPLSDAYLSGMPAKRRKTMQGEGPQLLLSEAVSRAAKAAGARPLTSPESLSRDLEAPEVQESYRQQVPP

SEQ ID NO: 861203 - protein, 977 aa, Homo sapiens; identical to SEQ ID NO: 861184

SEQ ID NO: 861204 - protein, 1095 aa, Homo sapiens
KSLPDLQRRVQGPRRVSSEPRVRLVMAQHMIRDIQTLLSRMETLPYLQCRGGPQPQHSQPPPQPPAVTPEPVALSSQTSEPVESEAPPREPMEAEEVEERAPAQNPELTPGPAPAGPTPAPETNAPNHPSPAEYVEVLQELQRLESRLQPFLQRYYEVLGAAATTDYNNNHEGREEDQRLINLVGESLRLLGNTFVALSDLRCNLACTPPRHLHVVRPMSHYTTPMVLQQAAIPIQINVGTTVTMTGNGTRPPPTPNAEAPPPGPGQASSVAPSSTNVESSAEGAPPPGPAPPPATSHPRVIRISHQSVEPVVMMHMNIQDSGTQPGGVPSAPTGPLGPPGHGQTLGSTLIQLPSLPPEFMHAVAHQITHQAMVAAVASAAAGQQVPGFPTAPTRVVIARPTPPQARPSHPGGPPVSGTLQGAGLGTNASLAQMVSGLVGQLLMQPVLVAQGTPGMAPPPAPATASASAGTTNTATTAGPAPGGPAQPPPTPQPSMADLQFSQLLGNLLGPAGPGAGGSGVASPTITVAMPGVPAFLQGMTDFLQATQTAPPPPPPPPPPPPAPEQQTMPPPGSPSGGAGSPGGLGLESLSPEFFTSVVQGVLSSLLGSLGARAGSSESIAAFIQRLSGSSNIFEPGADGALGFFGALLSLLCQNFSMVDVVMLLHGHFQPLQRLQPQLRSFFHQHYLGGQEPTPSNIRMATHTLITGLEEYVRESFVSNPSLFLSSPGSGQGSCLLHSQSYDSGFWDLCVILSLSPWCRFSQVWTSSGQTWNFSKSSLIALLRMCCIAQVRGWPGGGKWGLLHVQGCHVPAFPPCILPTDSGFGARLLELCNQGLFECLALNLHCLGGQQMELAAVINGRIRRMSRGVNPSLVSWLTTMMGLRLQVVLEHMPVGPDAILRYVRRVGDPPQPLPEEPMEVQGAERASPEPQRENASPAPGTTAEEAMSRGPPPAPEGGSRDEQDGASAETEPWAAAVPPEWVPIIQQDIQSQRKVKPQPPLSDAYLSGMPAKRRKTMQGEGPQLLLSEAVSRAAKAAGARPLTSPESLSRDLEAPEVQESYRQQLRSDIQKRLQEDPNYSPQRFPNAQRAFADDP

SEQ ID NO: 861205 - protein, 1003 aa, Homo sapiens
KSLPDLQRRVQGPRRVSSEPRVRLVMAQHMIRDIQTLLSRMETLPYLQCRGGPQPQHSQPPPQPPAVTPEPVALSSQTSEPVESEAPPREPMEAEEVEERAPAQNPELTPGPAPAGPTPAPETNAPNHPSPAEYVEVLQELQRLESRLQPFLQRYYEVLGAAATTDYNNNHEGREEDQRLINLVGESLRLLGNTFVALSDLRCNLACTPPRHLHVVRPMSHYTTPMVLQQAAIPIQINVGTTVTMTGNGTRPPPTPNAEAPPPGPGQASSVAPSSTNVESSAEGAPPPGPAPPPATSHPRVIRISHQSVEPVVMMHMNIQDSGTQPGGVPSAPTGPLGPPGHGQTLGSTLIQLPSLPPEFMHAVAHQITHQAMVAAVASAAAGQQVPGFPTAPTRVVIARPTPPQARPSHPGGPPVSGTLQGAGLGTNASLAQMVSGLVGQLLMQPVLVAQGTPGMAPPPAPATASASAGTTNTATTAGPAPGGPAQPPPTPQPSMADLQFSQLLGNLLGPAGPGAGGSGVASPTITVAMPGVPAFLQGMTDFLQATQTAPPPPPPPPPPPPAPEQQTMPPPGSPSGGAGSPGGLGLESLSPEFFTSVVQGVLSSLLGSLGARAGSSESIAAFIQRLSGSSNIFEPGADGALGFFGALLSLLCQNFSMVDVVMLLHGHFQPLQRLQPQLRSFFHQHYLGGQEPTPSNIRMATHTLITGLEEYVRESFSLVQVQPGVDIIRTNLEFLQEQFNSIAAHVLHCTDSGFGARLLELCNQGLFECLALNLHCLGGQQMELAAVINGRIRRMSRGVNPSLVSWLTTMMGLRLQVVLEHMPVGPDAILRYVRRVGDPPQPLPEEPMEVQGAERASPEPQRENASPAPGTTAEEAMSRGPPPAPEGGSRDEQDGASAETEPWAAAVPPVSVRKKSSGSWQLKVKDITIFSFPPQEWVPIIQQDIQSQRKVKPQPPLSDAYLSGMPAKRRKLRSDIQKRLQEDPNYSPQRFPNAQRAFADDP

SEQ ID NO: 861206 - protein, 929 aa, Homo sapiens
KSLPDLQRRVQGPRRVSSEPRVRLVMAQHMIRDIQTLLSRMETLPYLQCRGGPQPQHSQPPPQPPAVTPEPVALSSQTSEPVESEAPPREPMEAEEVEERAPAQNPELTPGPAPAGPTPAPETNAPNHPSPAEYVEVLQELQRLESRLQPFLQRYYEVLGAAATTDYNNNHEGREEDQRLINLVGESLRLLGNTFVALSDLRCNLACTPPRHLHVVRPMSHYTTPMVLQQAAIPIQINVGTTVTMTGNGTRPPPTPNAEAPPPGPGQASSVAPSSTNVESSAEGAPPPGPAPPPATSHPRVIRISHQSVEPVVMMHMNIQDSGTQPGGVPSAPTGPLGPPGHGQTLGSTLIQLPSLPPEFMHAVAHQITHQAMVAAVASAAAGQQVPGFPTAPTRVVIARPTPPQARPSHPGGPPVSGTLQGAGLGTNASLAQMVSGLVGQLLMQPVLVAQGTPGMAPPPAPATASASAGTTNTATTAGPAPGGPAQPPPTPQPSMADLQFSQLLGNLLGPAGPGAGGSGVASPTITVAMPGVPAFLQGMTDFLQATQTAPPPPPPPPPPPPAPEQQTMPPPGSPSGGAGSPGGLGLESLSPEFFTSVVQGVLSSLLGSLGARAGSSESIAAFIQRLSGSSNIFEPGADGALGFFGALLSLLCQNFSMVDVVMLLHGHFQPLQRLQPQLRSFFHQHYLGGQEPTPSNIRMATHTLITGLEEYVRESFSLVQVQPGVDIIRTNLEFLQEQFNSIAAHVLHCTDSGFGARLLELCNQGLFECLALNLHCLGGQQMELAAVINGRIRRMSRGVNPSLVSWLTTMMGLRLQVVLEHMPVGPDAILRYVRRVGDPPQPLPEEPMEVQGAERASPEPQEWVPIIQQDIQSQRKVKPQPPLSDAYLSGMPAKRRKLRSDIQKRLQEDPNYSPQRFPNAQRAFADDP

SEQ ID NO: 861207 - protein, 893 aa, Homo sapiens
KSLPDLQRRVQGPRRVSSEPRVRLVMAQHMIRDIQTLLSRMETLPYLQCRGGPQPQHSQPPPQPPAVTPEPVALSSQTSEPVESEAPPREPMEAEEVEERAPAQNPELTPGPAPAGPTPAPETNAPNHPSPAEYVEVLQELQRLESRLQPFLQRYYEVLGAAATTDYNNNHEGREEDQRLINLVGESLRLLGNTFVALSDLRCNLACTPPRHLHVVRPMSHYTTPMVLQQAAIPIQINVGTTVTMTGNGTRPPPTPNAEAPPPGPGQASSVAPSSTNVESSAEGAPPPGPAPPPATSHPRVIRISHQSVEPVVMMHMNIQDSGTQPGGVPSAPTGPLGPPGHGQTLGSTLIQLPSLPPEFMHAVAHQITHQAMVAAVASAAAGQQVPGFPTAPTRVVIARPTPPQARPSHPGGPPVSGTLQGAGLGTNASLAQMVSGLVGQLLMQPVLVAQGTPGMAPPPAPATASASAGTTNTATTAGPAPGGPAQPPPTPQPSMADLQFSQLLGNLLGPAGPGAGGSGVASPTITVAMPGVPAFLQGMTDFLQATQTAPPPPPPPPPPPPAPEQQTMPPPGSPSGGAGSPGGLGLESLSPEFFTSVVQGVLSSLLGSLGARAGSSESIAAFIQRLSGSSNIFEPGADGALGFFGALLSLLCQNFSMVDVVMLLHGHFQPLQRLQPQLRSFFHQHYLGGQEPTPSNIRMATHTLITGLEEYVRESFSLVQVQPGVDIIRTNLEFLQEQFNSIAAHVLHCTDSGFGARLLELCNQGLFECLALNLHCLGGQQMELAAVINGRIRRMSRGVNPSLVSWLTTMMGLRLQVVLEHMPVGPDAILRYVRRVGDPPQPLPEEPMEVQGAERASPEPQLRSDIQKRLQEDPNYSPQRFPNAQRAFADDP

SEQ ID NO: 861208 - protein, 555 aa, Homo sapiens
KSLPDLQRRVQGPRRVSSEPRVRLVMAQHMIRDIQTLLSRMETLPYLQCRGGPQPQHSQPPPQPPAVTPEPVALSSQTSEPVESEAPPREPMEAEEVEERAPAQNPELTPGPAPAGPTPAPETNAPNHPSPAEYVEVLQELQRLESRLQPFLQRYYEVLGAAATTDYNNNHEGREEDQRLINLVGESLRLLGNTFVALSDLRCNLACTPPRHLHVVRPMSHYTTPMVLQQAAIPIQINVGTTVTMTGNGTRPPPTPNAEAPPPGPGQASSVAPSSTNVESSAEGAPPPGPAPPPATSHPRVIRISHQSVEPVVMMHMNIQDSGTQPGGVPSAPTGPLGPPGHGQTLGSTLIQLPSLPPEFMHAVAHQITHQAMVAAVASAAAGQQVPGFPTAPTRVVIARPTPPQARPSHPGGPPVSGTLQGAGLGTNASLAQMVSGLVGQLLMQPVLVAQGTPGMAPPPAPATASASAGTTNTATTAGPAPGGPAQPPPTPQPSMADLQFSQLLGNLLGPAGPGAGGSGVASPTITVAMPGVPAFLQGMTDFLQATQTAPAAAK

SEQ ID NO: 861209 - protein, 831 aa, Homo sapiens
KSLPDLQRRVQGPRRVSSEPRVRLVMAQHMIRDIQTLLSRMETLPYLQCRGGPQPQHSQPPPQPPAVTPEPVALSSQTSEPVESEAPPREPMEAEEVEERAPAQNPELTPGPAPAGPTPAPETNAPNHPSPAEYVEVLQELQRLESRLQPFLQRYYEVLGAAATTDYNNNHEGREEDQRLINLVGESLRLLGNTFVALSDLRCNLACTPPRHLHVVRPMSHYTTPMVLQQAAIPIQINVGTTVTMTGNGTRPPPTPNAEAPPPGPGQASSVAPSSTNVESSAEGAPPPGPAPPPATSHPRVIRISHQSVEPVVMMHMNIQDSGTQPGGVPSAPTGPLGPPGHGQTLGSTLIQLPSLPPEFMHAVAHQITHQAMVAAVASAAAGQQVPGFPTAPTRVVIARPTPPQARPSHPGGPPVSGTLQGAGLGTNASLAQMVSGLVGQLLMQPVLVAQGTPGMAPPPAPATASASAGTTNTATTAGPAPGGPAQPPPTPQPSMADLQFSQLLGNLLGPAGPGAGGSGVASPTITVAMPGVPAFLQGMTDFLQATQTAPQHRAADKLGTQPEGTPHQRDAPMEDSHKTHDSQGTPRMHPGKQNTAAIAEPTQHQHTQATADSATTNKLHTNRKNKRRLLNLTTQRNPRPTAEQAVYINRHVTRGTTAADAGDTSTTSQLPAMRGAVHIDRGESASNVVLASHETHLTTEPRSASRPDHSRAGQAQLGGAPERTAGRHSKRPTELARQREKLQNDDDSTPTVRGHWQHKAPLRSTQPRRGANHTRRQNADNKRAPTRIQENRDEYTNQRDEHDNQPDIAAVRRTSKQITYRSKRHTQSYS

SEQ ID NO: 861210 - protein, 178 aa, Homo sapiens [sequence omitted]

SEQ ID NO: 861211 - protein, 131 aa, Homo sapiens
MADVVVGKDKGGEQRLISLPLSRIRVIMKSSPEVSSINQEALVLTAKATELFVQCLATYSYRHGSGKEKKVLTYSDLANTAQQSETFQFLADILPKKILASKYLKMLKEEKREEDEENDNDNESDHDEADS

SEQ ID NO: 861212 - protein, 131 aa, Homo sapiens; identical to SEQ ID NO: 861211

SEQ ID NO: 861213 - protein, 131 aa, Homo sapiens; identical to SEQ ID NO: 861211

SEQ ID NO: 861214 - protein, 131 aa, Homo sapiens; identical to SEQ ID NO: 861211

SEQ ID NO: 861215 - protein, 112 aa, Homo sapiens
MADVVVGKDKGGEQRLISLPLSRIRVIMKSSPEVSSINQEALVLTAKATELFVQCLATYSYRHGSGKEKKVLTYSDLANTAQQSETFQFLADILPKKRNPPGFGWFRKFSYM

SEQ ID NO: 861216 - protein, 119 aa, Homo sapiens
MADVVVGKDKGGEQRLISLPLSRIRVIMKSSPEVSSINQEALVLTAKATELFVQCLATYSYRHGSGKEKKVLTYSDLANTAQQSETFQFLADILPKKILASKYLKMLKEEKREEDEERR

SEQ ID NO: 861217 - protein, 72 aa, Homo sapiens
RSGARGLTELVVSRTGRSRPRGLASPHYNSHGAAGAAPRTHQLAGQGSHFAVGPAGCGHPRDGREDGGRGRG

SEQ ID NO: 861218 - protein, 76 aa, Homo sapiens
QGWYADVMEGRSRPRGLASPHYNSHGAAGAAPRTHQLAGQGNSSPSSTGPPCSSGTKKTADTGSHCSSKLQRQGQF

SEQ ID NO: 861219 - protein, 39 aa, Homo sapiens
MANKRGRTTQTRGENNNREQEQGGAHTEQTTTRDTNYHP

SEQ ID NO: 861220 - protein, 1309 aa, Homo sapiens
MLLNGDCPESLKKEAAAAEPPRENGLDEAGPGDETTGQEVIVIQDTGFSVKILAPGIEPFSLQVSPQEMVQEIHQVLMDREDTCHRTCFSLHLDGNVLDHFSELRSVEGLQEGSVLRVVEEPYTVREARIHVRHVRDLLKSLDPSDAFNGVDCNSLSFLSVFTDGDLGDSGKRKKGLEMDPIDCTPPEYILPGSRERPLCPLQPQNRDWKPLQCLKVLTMSGWNPPPGNRKMHGDLMYLFVITAEDRQVSITASTRGFYLNQSTAYHFNPKPASPRFLSHSLVELLNQISPTFKKNFAVLQKKRVQRHPFERIATPFQVYSWTAPQAEHAMDCVRAEDAYTSRLGYEEHIPGQTRDWNEELQTTRELPRKNLPERLLRERAIFKVHSDFTAAATRGAMAVIDGNVMAINPSEETKMQMFIWNNIFFSLGFDVRDHYKDFGGDVAAYVAPTNDLNGVRTYNAVDVEGLYTLGTVVVDYRGYRVTAQSIIPGILERDQEQSVIYGSIDFGKTVVSHPRYLELLERTSRPLKILRHQVLNDRDEEVELCSSVECKGIIGNDGRHYILDLLRTFPPDLNFLPVPGEELPEECARAGFPRAHRHKLCCLRQELVDAFVEHRYLLFMKLAALQLMQQNASQLETPSSLENGGPSSLESKSEDPPGQEAGSEEEGSSASGLAKVKELAETIAADDGTDPRSREVIRNACKAVGSISSTAFDIRFNPDIFSPGVRFPESCQDEVRDQKQLLKDAAAFLLSCQIPGLVKDCMEHAVLPVDGATLAEVMRQRGINMRYLGKVLELVLRSPARHQLDHVFKIGIGELITRSAKHIFKTYLQGVELSGLSAAISHFLNCFLSSYPNPVAHLPADELVSKKRNKRRKNRPPGAADNTAWAVMTPQELWKNICQEAKNYFDFDLECETVDQAVETYGLQKITLLREISLKTGIQVLLKEYSFDSRHKPAFTEEDVLNIFPVVKHVNPKASDAFHFFQSGQAKVQQGFLKEGCELINEALNLFNNVYGAMHVETCACLRLLARLHYIMGDYAEALSNQQKAVLMSERVMGTEHPNTIQEYMHLALYCFASSQLSTALSLLYRARYLMLLVFGEDHPEMALLDNNIGLVLHGVMEYDLSLRFLENALAVSTKYHGPKALKVALSHHLVARVYESKAEFRSALQHEKEGYTIYKTQLGEDHEKTKESSEYLKCLTQQAVALQRTMNEIYRNGSSANIPPLKFTAPSMASVLEQLNVINGILFIPLSQKDLENLKAEVARRHQLQEASRNRDRAEEPMATEPAPAGAPGDLGSQPPAAKDPSPSVQG

SEQ ID NO: 861221 - protein, 1241 aa, Homo sapiens
AAAPADSAREHGSQAGGKGRPGAAELPSVMLLNGDCPESLKKEAAAAEPPRENGLDEAGPGDETTGQEVIVIQDTGFSVKILAPGIEPFSLQVSPQEMVQEIHQVLMDREDTCHRTCFSLHLDGNVLDHFSELRSPQNRDWKPLQCLKVLTMSGWNPPPGNRKMHGDLMYLFVITAEDRQVSITASTRGFYLNQSTAYHFNPKPASPRFLSHSLVELLNQISPTFKKNFAVLQKKRVQRHPFERIATPFQVYSWTAPQAEHAMDCVRAEDAYTSRLGYEEHIPGQTRDWNEELQTTRELPRKNLPERLLRERAIFKVHSDFTAAATRGAMAVIDGNVMAINPSEETKMQMFIWNNIFFSLGFDVRDHYKDFGGDVAAYVAPTNDLNGVRTYNAVDVEGLYTLGTVVVDYRGYRVTAQSIIPGILERDQEQSVIYGSIDFGKTVVSHPRYLELLERTSRPLKILRHQVLNDRDEEVELCSSVECKGIIGNDGRHYILDLLRTFPPDLNFLPVPGEELPEECARAGFPRAHRHKLCCLRQELVDAFVEHRYLLFMKLAALQLMQQNASQLETPSSLENGGPSSLESKSEDPPGQEAGSEEEGSSASGLAKVKELAETIAADDGTDPRSREVIRNACKAVGSISSTAFDIRFNPDIFSPGVRFPESCQDEVRDQKQLLKDAAAFLLSCQIPGLVKDCMEHAVLPVDGATLAEVMRQRGINMRYLGKVLELVLRSPARHQLDHVFKIGIGELITRSAKHIFKTYLQGVELSGLSAAISHFLNCFLSSYPNPVAHLPADELVSKKRNKRRKNRPPGAADNTAWAVMTPQELWKNICQEAKNYFDFDLECETVDQAVETYGLQKITLLREISLKTGIQVLLKEYSFDSRHKPAFTEEDVLNIFPVVKHVNPKASDAFHFFQSGQAKVQQGFLKEGCELINEALNLFNNVYGAMHVETCACLRLLARLHYIMGDYAEALSNQQKAVLMSERVMGTEHPNTIQEYMHLALYCFASSQLSTALSLLYRARYLMLLVFGEDHPEMALLDNNIGLVLHGVMEYDLSLRFLENALAVSTKYHGPKALKVALSHHLVARVYESKAEFRSALQHEKEGYTIYKTQLGEDHEKTKESSEYLKCLTQQAVALQRTMNEIYRNGSSANIPPLKFTAPSMASVLEQLNVINGILFIPLSQKDLENLKAEVARRHQLQEASRNRDRAEEPMATEPAPAGAPGDLGSQPPAAKDPSPSVQG

SEQ ID NO: 861222 - protein, 547 aa, Homo sapiens [sequence omitted]

SEQ ID NO: 861223 - protein, 1338 aa, Homo sapiens
AAAPADSAREHGSQAGGKGRPGAAELPSVMLLNGDCPESLKKEAAAAEPPRENGLDEAGPGDETTGQEVIVIQDTGFSVKILAPGIEPFSLQVSPQEMVQEIHQVLMDREDTCHRTCFSLHLDGNVLDHFSELRSVEGLQEGSVLRVVEEPYTVREARIHVRHVRDLLKSLDPSDAFNGVDCNSLSFLSVFTDGDLGDSGKRKKGLEMDPIDCTPPEYILPGSRERPLCPLQPQNRDWKPLQCLKVLTMSGWNPPPGNRKMHGDLMYLFVITAEDRQVSITASTRGFYLNQSTAYHFNPKPASPRFLSHSLVELLNQISPTFKKNFAVLQKKRVQRHPFERIATPFQVYSWTAPQAEHAMDCVRAEDAYTSRLGYEEHIPGQTRDWNEELQTTRELPRKNLPERLLRERAIFKVHSDFTAAATRGAMAVIDGNVMAINPSEETKMQMFIWNNIFFSLGFDVRDHYKDFGGDVAAYVAPTNDLNGVRTYNAVDVEGLYTLGTVVVDYRGYRVTAQSIIPGILERDQEQSVIYGSIDFGKTVVSHPRYLELLERTSRPLKILRHQVLNDRDEEVELCSSVECKGIIGNDGRHYILDLLRTFPPDLNFLPVPGEELPEECARAGFPRAHRHKLCCLRQELVDAFVEHRYLLFMKLAALQLMQQNASQLETPSSLENGGPSSLESKSEDPPGQEAGSEEEGSSASGLAKVKELAETIAADDGTDPRSREVIRNACKAVGSISSTAFDIRFNPDIFSPGVRFPESCQDEVRDQKQLLKDAAAFLLSCQIPGLVKDCMEHAVLPVDGATLAEVMRQRGINMRYLGKVLELVLRSPARHQLDHVFKIGIGELITRSAKHIFKTYLQGVELSGLSAAISHFLNCFLSSYPNPVAHLPADELVSKKRNKRRKNRPPGAADNTAWAVMTPQELWKNICQEAKNYFDFDLECETVDQAVETYGLQKITLLREISLKTGIQVLLKEYSFDSRHKPAFTEEDVLNIFPVVKHVNPKASDAFHFFQSGQAKVQQGFLKEGCELINEALNLFNNVYGAMHVETCACLRLLARLHYIMGDYAEALSNQQKAVLMSERVMGTEHPNTIQEYMHLALYCFASSQLSTALSLLYRARYLMLLVFGEDHPEMALLDNNIGLVLHGVMEYDLSLRFLENALAVSTKYHGPKALKVALSHHLVARVYESKAEFRSALQHEKEGYTIYKTQLGEDHEKTKESSEYLKCLTQQAVALQRTMNEIYRNGSSANIPPLKFTAPSMASVLEQLNVINGILFIPLSQKDLENLKAEVARRHQLQEASRNRDRAEEPMATEPAPAGAPGDLGSQPPAAKDPSPSVQG

SEQ ID NO: 861224 - protein, 1338 aa, Homo sapiens; identical to SEQ ID NO: 861223

SEQ ID NO: 861225 - protein, 1338 aa, Homo sapiens; identical to SEQ ID NO: 861223

SEQ ID NO: 861226 - protein, 817 aa, Homo sapiens
AAAPADSAREHGSQAGGKGRPGAAELPSVMLLNGDCPESLKKEAAAAEPPRENGLDEAGPGDETTGQEVIVIQDTGFSVKILAPGIEPFSLQVSPQEMVQEIHQVLMDREDTCHRTCFSLHLDGNVLDHFSELRSVEGLQEGSVLRVVEEPYTVREARIHVRHVRDLLKSLDPSDAFNGVDCNSLSFLSVFTDGDLGDSGKRKKGLEMDPIDCTPPEYILPGSRERPLCPLQPQNRDWKPLQCLKVLTMSGWNPPPGNRKMHGDLMYLFVITAEDRQVSITASTRGFYLNQSTAYHFNPKPASPRFLSHSLVELLNQISPTFKKNFAVLQKKRVQRHPFERIATPFQVYSWTAPQAEHAMDCVRAEDAYTSRLGYEEHIPGQTRDWNEELQTTRELPRKNLPERLLRERAIFKVHSDFTAAATRGAMAVIDGNVMAINPSEETKMQMFIWNNIFFSLGFDVRDHYKDFGGDVAAYVAPTNDLNGVRTYNAVDVEGLYTLGTVVVDYRGYRVTAQSIIPGILERDQEQSVIYGSIDFGKTVVSHPRYLELLERTSRPLKILRHQVLNDRDEEVELCSSVECKGIIGNDGRHYILDLLRTFPPDLNFLPVPGEELPEECARAGFPRAHRHKLCCLRQELVDAFVEHRYLLFMKLAALQLMQQNASQLETPSSLENGGPSSLESKSEDPPGQEAGSEEEGSSASGLAKVKELAETIAADDGTDPRSREVIRNACKAVGSISSTAFDIRFNPDIFSPGVRFPESCQDEVRDQKQLLKDAAAFLLSCQIPGLVKDCMEHAVPARAAALCLLSEPWWGRMWPP

SEQ ID NO: 861227 - protein, 919 aa, Homo sapiens
AAAPADSAREHGSQAGGKGRPGAAELPSVMLLNGDCPESLKKEAAAAEPPRENGLDEAGPGDETTGQEVIVIQDTGFSVKILAPGIEPFSLQVSPQEMVQEIHQVLMDREDTCHRTCFSLHLDGNVLDHFSELRSVEGLQEGSVLRVVEEPYTVREARIHVRHVRDLLKSLDPSDAFNGVDCNSLSFLSVFTDGDLGDSGKRKKGLEMDPIDCTPPEYILPGSRERPLCPLQPQNRDWKPLQCLKVLTMSGWNPPPGNRKMHGDLMYLFVITAEDRQVSITASTRGFYLNQSTAYHFNPKPASPRFLSHSLVELLNQISPTFKKNFAVLQKKRVQRHPFERIATPFQVYSWTAPQAEHAMDCVRAEDAYTSRLGYEEHIPGQTRDWNEELQTTRELPRKNLPERLLRERAIFKVHSDFTAAATRGAMAVIDGNVMAINPSEETKMQMFIWNNIFFSLGFDVRDHYKDFGGDVAAYVAPTNDLNGVRTYNAVDVEGLYTLGTVVVDYRGYRVTAQSIIPGILERDQEQSVIYGSIDFGKTVVSHPRYLELLERTSRPLKILRHQVLNDRDEEVELCSSVECKGIIGNDGRHYILDLLRTFPPDLNFLPVPGEELPEECARAGFPRAHRHKLCCLRQELVDAFVEHRYLLFMKLAALQLMQQNASQLETPSSLENGGPSSLESKSEDPPGQEAGSEEEGSSASGLAKVKELAETIAADDGTDPRSREVIRNACKAVGSISSTAFDIRFNPDIFSPGVRFPESCQDEVRDQKQLLKDAAAFLLSCQIPGLVKDCMEHAVLPVDGATLAEVMRQRGINMRYLGKVLELVLRSPARHQLDHVFKIGIGELITRSAKHIFKTYLQESSSPGSQPHQHSEMVPGSYQTVANGAKSVSRADEGGNGRGGIKAGVDPGWNLGADIGPV

SEQ ID NO: 861228 - protein, 1338 aa, Homo sapiens; identical to SEQ ID NO: 861223

SEQ ID NO: 861229 - protein, 1123 aa, Homo sapiens
ALLPLTPGSGHLVFPCSPNTVLDMPLQCLKVLTMSGWNPPPGNRKMHGDLMYLFVITAEDRQVSITASTRGFYLNQSTAYHFNPKPASPRFLSHSLVELLNQISPTFKKNFAVLQKKRVQRHPFERIATPFQVYSWTAPQAEHAMDCVRAEDAYTSRLGYEEHIPGQTRDWNEELQTTRELPRKNLPERLLRERAIFKVHSDFTAAATRGAMAVIDGNVMAINPSEETKMQMFIWNNIFFSLGFDVRDHYKDFGGDVAAYVAPTNDLNGVRTYNAVDVEGLYTLGTVVVDYRGYRVTAQSIIPGILERDQEQSVIYGSIDFGKTVVSHPRYLELLERTSRPLKILRHQVLNDRDEEVELCSSVECKGIIGNDGRHYILDLLRTFPPDLNFLPVPGEELPEECARAGFPRAHRHKLCCLRQELVDAFVEHRYLLFMKLAALQLMQQNASQLETPSSLENGGPSSLESKSEDPPGQEAGSEEEGSSASGLAKVKELAETIAADDGTDPRSREVIRNACKAVGSISSTAFDIRFNPDIFSPGVRFPESCQDEVRDQKQLLKDAAAFLLSCQIPGLVKDCMEHAVLPVDGATLAEVMRQRGINMRYLGKVLELVLRSPARHQLDHVFKIGIGELITRSAKHIFKTYLQGVELSGLSAAISHFLNCFLSSYPNPVAHLPADELVSKKRNKRRKNRPPGAADNTAWAVMTPQELWKNICQEAKNYFDFDLECETVDQAVETYGLQKITLLREISLKTGIQVLLKEYSFDSRHKPAFTEEDVLNIFPVVKHVNPKASDAFHFFQSGQAKVQQGFLKEGCELINEALNLFNNVYGAMHVETCACLRLLARLHYIMGDYAEALSNQQKAVLMSERVMGTEHPNTIQEYMHLALYCFASSQLSTALSLLYRARYLMLLVFGEDHPEMALLDNNIGLVLHGVMEYDLSLRFLENALAVSTKYHGPKALKVALSHHLVARVYESKAEFRSALQHEKEGYTIYKTQLGEDHEKTKESSEYLKCLTQQAVALQRTMNEIYRNGSSANIPPLKFTAPSMASVLEQLNVINGILFIPLSQKDLENLKAEVARRHQLQEASRNRDRAEEPMATEPAPAGAPGDLGSQPPAAKDPSPSVQG

SEQ ID NO: 861230 - protein, 665 aa, Homo sapiens
SPPAGSKKVVLRLRSVSEYSEEEGSSASGLAKVKELAETIAADDGTDPRSREVIRNACKAVGSISSTAFDIRFNPDIFSPGVRFPESCQDEVRDQKQLLKDAAAFLLSCQIPGLVKDCMEHAVLPVDGATLAEVMRQRGINMRYLGKVLELVLRSPARHQLDHVFKIGIGELITRSAKHIFKTYLQGVELSGLSAAISHFLNCFLSSYPNPVAHLPADELVSKKRNKRRKNRPPGAADNTAWAVMTPQELWKNICQEAKNYFDFDLECETVDQAVETYGLQKITLLREISLKTGIQVLLKEYSFDSRHKPAFTEEDVLNIFPVVKHVNPKASDAFHFFQSGQAKVQQGFLKEGCELINEALNLFNNVYGAMHVETCACLRLLARLHYIMGDYAEALSNQQKAVLMSERVMGTEHPNTIQEYMHLALYCFASSQLSTALSLLYRARYLMLLVFGEDHPEMALLDNNIGLVLHGVMEYDLSLRFLENALAVSTKYHGPKALKVALSHHLVARVYESKAEFRSALQHEKEGYTIYKTQLGEDHEKTKESSEYLKCLTQQAVALQRTMNEIYRNGSSANIPPLKFTAPSMASVLEQLNVINGILFIPLSQKDLENLKAEVARRHQLQEASRNRDRAEEPMATEPAPAGAPGDLGSQPPAAKDPSPSVQG

SEQ ID NO: 861231 - protein, 1268 aa, Homo sapiens
AAAPADSAREHGSQAGGKGRPGAAELPSVMLLNGDCPESLKKEAAAAEPPRENGLDEAGPGDETTGQEVIVIQDTGFSVKILAPGIEPFSLQVSPQEMVQEIHQVLMDREDTCHRTCFSLHLDGNVLDHFSELRSVEGLQEGSVLRVVEEPYTVREARIHVRHVRDLLKSLDPSDAFNGVDCNSLSFLSVFTDGDLGDSGKRKKGLEMDPIDCTPPEYILPGSRERPLCPLQPQNRDWKPLQCLKVLTMSGWNPPPGNRKMHGDLMYLFVITAEDRQVSITASTRGFYLNQSTAYHFNPKPASPRFLSHSLVELLNQISPTFKKNFAVLQKKRVQRHPFERIATPFQVYSWTAPQAEHAMDCVRAEDAYTSRLGYEEHIPGQTRDWNEELQTTRELPRKNLPERLLRERAIFKVHSDFTAAATRGAMAVIDGNVMAINPSEETKMQMFIWNNIFFSLGFDVRDHYKDFGGDVAAYVAPTNDLNGVRTYNAVDVEGLYTLGTVVVDYRGYRVTAQSIIPGILERDQEQSVIYGSIDFGKTVVSHPRYLELLERTSRPLKILRHQVLNDRDEEVELCSSVECKGIIGNDGRHYILDLLRTFPPDLNFLPVPGEELPEECARAGFPRAHRHKLCCLRQELVDAFVEHRYLLFMKLAALQLMQQNASQLETPSSLENGGPSSLESKSEDPPGQEAGSEEEGSSASGLAKVKELAETIAADDGTDPRSREVIRNACKAVGSISSTAFDIRFNPDIFSPGVRFPESCQDEVRDQKQLLKDAAAFLLSCQIPGLVKDCMEHAVLPVDGATLAEVMRQRGINMRYLGKVLELVLRSPARHQLDHVFKIGIGELITRSAKHIFKTYLQGVELSGLSAAISHFLNCFLSSYPNPVAHLPADELVSKKRNKRRKNRPPGAADNTAWAVMTPQELWKNICQEAKNYFDFDLECETVDQAVETYGLQKITLLREISLKTGIQVLLKEYSFDSRHKPAFTEEDVLNIFPVVKHVNPKASDAFHFFQSGQAKVQQGFLKEGCELINEALNLFNNVYGAMHVETCACLRLLARLHYIMGDYAEALSNQQKAVLMSERVMGTEHPNTIQEYMHLALYCFASSQLSTALSLLYRARYLMLLVFGEDHPEMALLDNNIGLVLHGVMEYDLSLRFLENALAVSTKYHGPKALKVALSHHLVARVYESKAEFRSALQHEKEGYTIYKTQLGEDHEKTKESSEYLKCLTQQAVALQRTMNEIYRNGSSANIPPLKSQPPAAKDPSPSVQG

SEQ ID NO: 861232 - protein, 1079 aa, Homo sapiens
AAAPADSAREHGSQAGGKGRPGAAELPSVMLLNGDCPESLKKEAAAAEPPRENGLDEAGPGDETTGQEVIVIQDTGFSVKILAPGIEPFSLQVSPQEMVQEIHQVLMDREDTCHRTCFSLHLDGNVLDHFSELRSVEGLQEGSVLRVVEEPYTVREARIHVRHVRDLLKSLDPSDAFNGVDCNSLSFLSVFTDGDLGDSGKRKKGLEMDPIDCTPPEYILPGSRERPLCPLQPQNRDWKPLQCLKVLTMSGWNPPPGNRKMHGDLMYLFVITAEDRQVSITASTRGFYLNQSTAYHFNPKPASPRFLSHSLVELLNQISPTFKKNFAVLQKKRVQRHPFERIATPFQVYSWTAPQAEHAMDCVRAEDAYTSRLGYEEHIPGQTRDWNEELQTTRELPRKNLPERLLRERAIFKVHSDFTAAATRGAMAVIDGNVMAINPSEETKMQMFIWNNIFFSLGFDVRDHYKDFGGDVAAYVAPTNDLNGVRTYNAVDVEGLYTLGTVVVDYRGYRVTAQSIIPGILERDQEQSVIYGSIDFGKTVVSHPRYLELLERTSRPLKILRHQVLNDRDEEVELCSSVECKGIIGNDGRHYILDLLRTFPPDLNFLPVPGEELPEECARAGFPRAHRHKLCCLRQELVDAFVEHRYLLFMKLAALQLMQQNASQLETPSSLENGGPSSLESKSEDPPGQEAGSEEEGSSASGLAKVKELAETIAADDGTDPRSREVIRNACKAVGSISSTAFDIRFNPDIFSPGVRFPESCQDEVRDQKQLLKDAAAFLLSCQIPGLVKDCMEHAVLPVDGATLAEVMRQRGINMRYLGKVLELVLRSPARHQLDHVFKIGIGELITRSAKHIFKTYLQGVELSGLSAAISHFLNCFLSSYPNPVAHLPADELVSKKRNKRRKNRPPGAADNTAWAVMTPQELWKNICQEAKNYFDFDLECETVDQAVETYGLQKITLLREISLKTGIQVLLKEYSFDSRHKPAFTEEDVLNIFPVVERWDHGNKISFLVISSLGQREFQTRLLARLGPTLSGFTQEPGSMDQGLPSRRKLLGSSECWMMSGYSPHMLSSSIICAGSSR

SEQ ID NO: 861233 - protein, 140 aa, Homo sapiens
MASVDFKTYVDQACRAAEEFVNVYYTTMDKRRRLLSRLYMGTATLVWNGNAVSGQESLSEFFEMLPSSEFQISVVDCQPVHDEATPSQTTVLVVICGSVKFEGNKQRDFNQNFILTAQASPSNTVWKIASDCFRFQDWAS

SEQ ID NO: 861234 - protein, 140 aa, Homo sapiens; identical to SEQ ID NO: 861233

SEQ ID NO: 861235 - protein, 121 aa, Homo sapiens
AVRMKFWLKSRCPSNCTDPQMTTRTLVWNGNAVSGQESLSEFFEMLPSSEFQISVVDCQPVHDEATPSQTTVLVVICGSVKFEGNKQRDFNQNFILTAQASPSNTVWKIASDCFRFQDWAS

SEQ ID NO: 861236 - protein, 99 aa, Homo sapiens
PKKFGHERVPNSGCQSTHADFGTRWKATFQISVVDCQPVHDEATPSQTTVLVVICGSVKFEGNKQRDFNQNFILTAQASPSNTVWKIASDCFRFQDWAS

SEQ ID NO: 861237 - protein, 140 aa, Homo sapiens; identical to SEQ ID NO: 861233

SEQ ID NO: 861238 - protein, 99 aa, Homo sapiens; identical to SEQ ID NO: 861236

SEQ ID NO: 861239 - protein, 726 aa, Homo sapiens
MEDRLHMDNGLVPQKIVSVHLQDSTLKEVKDQVSNKQAQILEPKPEPSLEIKPEQDGMEHVGRDDPKALGEEPKQRRGSASGSEPAGDSDRGGGPVEHYHLHLSSCHECLELENSTIESVKFASAENIPDLPYDYSSSLESVADETSPEREGRRVNLTGKAPNILLYVGSDSQEALGRFHEVRSVLADCVDIDSYILYHLLEDSALRDPWTDNCLLLVIATRESIPEDLYQKFMAYLSQGGKVLGLSSSFTFGGFQVTSKGALHKTVQNLVFSKADQSEVKLSVLSSGCRYQEGPVRLSPGRLQGHLENEDKDRMIVHVPFGTRGGEAVLCQVHLELPPSSNIVQTPEDFNLLKSSNFRRYEVLREILTTLGLSCDMKQVPALTPLYLLSAAEEIRDPLMQWLGKHVDSEGEIKSGQLSLRFVSSYVSEVEITPSCIPVVTNMEAFSSEHFNLEIYRQNLQTKQLGKVILFAEVTPTTMRLLDGLMFQTPQEMGLIVIAARQTEGKGRGGNVWLSPVGCALSTLLISIPLRSQLGQRIPFVQHLMSVAVVEAVRSIPEYQDINLRVKWPNDIYYSDLMKIGGVLVNSTLMGETFYILIGCGFNVTNSNPTICINDLITEYNKQHKAELKPLRADYLIARVVTVLEKLIKEFQDKGPNSVLPLYYRYWVHSGQQVHLGSAEGPKVSIVGLDDSGFLQVHQEGGEVVTVHPDGNSFDMLRNLILPKRR

SEQ ID NO: 861240 - protein, 957 aa, Homo sapiens
IRHEDDEEEKQESEEISSIRDLTLGTSGLLRFLFPTHCRAAACQCPLLGRATCASLTWGLSLPDCFLDVSFKLRKRARPAGGAAMLITLCYLYLWARWGRRPAELVRATVRRLRASRCSFTFCGAAAEPPGARVCLSRGGRVFCVSDSQSIEDLNKWALFLVSPFILEAEHIAFVTESIWVQSENLQRSSSSETIVKWSDCCLPLACRPGDPYRLIAEASVDNFSKLGVAFMEDRLHMDNGLVPQKIVSVHLQDSTLKEVKDQVSNKQAQILEPKPEPSLEIKPEQDGMEHVGRDDPKALGEEPKQRRGSASGSEPAGDSDRGGGPVEHYHLHLSSCHECLELENSTIESVKFASAENIPDLPYDYSSSLESVADETSPEREGRRVNLTGKAPNILLYVGSDSQEALGRFHEVRSVLADCVDIDSYILYHLLEDSALRDPWTDNCLLLVIATRESIPEDLYQKFMAYLSQGGKVLGLSSSFTFGGFQVTSKGALHKTVQNLVFSKADQSEVKLSVLSSGCRYQEGPVRLSPGRLQGHLENEDKDRMIVHVPFGTRGGEAVLCQVHLELPPSSNIVQTPEDFNLLKSSNFRRYEVLREILTTLGLSCDMKQVPALTPLYLLSAAEEIRDPLMQWLGKHVDSEGEIKSGQLSLRFVSSYVSEVEITPSCIPVVTNMEAFSSEHFNLEIYRQNLQTKQLGKVILFAEVTPTTMRLLDGLMFQTPQEMGLIVIAARQTEGKGRGGNVWLSPVGCALSTLLISIPLRSQLGQRIPFVQHLMSVAVVEAVRSIPEYQDINLRVKWPNDIYYSDLMKIGGVLVNSTLMGETFYILIGCGFNVTNSNPTICINDLITEYNKQHKAELKPLRADYLIARVVTVLEKLIKEFQDKGPNSVLPLYYRYWVHSGQQVHLGSAEGPKVSIVGLDDSGFLQVHQEGGEVVTVHPDGNSFDMLRNLILPKRR

SEQ ID NO: 861241 - protein, 123 aa, Homo sapiens
CRWYGLLLVTLNPQPISNKQHKAELKPLRADYLIARVVTVLEKLIKEFQDKGPNSVLPLYYRYWVHSGQQVHLGSAEGPKVSIVGLDDSGFLQVHQEGGEVVTVHPDGNSFDMLRNLILPKRR

SEQ ID NO: 861242 - protein, 726 aa, Homo sapiens; identical to SEQ ID NO: 861239

SEQ ID NO: 861243 - protein, 726 aa, Homo sapiens; identical to SEQ ID NO: 861239

SEQ ID NO: 861244 - protein, 228 aa, Homo sapiens
IRHEDDEEEKQESEEISSIRDLTLGTSGLLRFLFPTHCRAAACQCPLLGRATCASLTWGLSLPDCFLDVSFKLRKRARPAGGAAMLITLCYLYLWARWGRRPAELVRATVRRLRASRCSFTFCGAAAEPPGARVCLSRGGRVFCVSDSQVGGSGGRATRAPRAGSAPVPAPRPRREPGSSGAPEWRPQCGLCGPGGAVAPGPRERPEVRDSDHGPGRLFPASRAVLDA

SEQ ID NO: 861245 - protein, 91 aa, Homo sapiens
DPLTTTSPQGDLEVPPTPPLLRKEIGRMRQNSPEEQARSSPRPRREKGGPPLPQTLAKPDTRDPGMGRSPRCQLRESMKSFNESNEPLPQP

SEQ ID NO: 861246 - protein, 249 aa, Homo sapiens
MSLEDPFFVVRGEVQKAVNTARGLYQRWCELLQESAAVGREELDWTTNELRNGLRSIEWDLEDLEETIGIVEANPGKFKLPAGDLQERKVFVERMREAVQEMKDHMVSPTAVAFLERNNREILAGKPAAQKSPSDLLDASAVSATSRYIEEQQATQQLIMDEQDQQLEMVSGSIQVLKHMSGRVGEELDEQGIMLDAFAQEMDHTQSRMDGVLRKLAKVSHMTSDRRQWCAIAVLVGVLLLVLILLFSL

SEQ ID NO: 861247 - protein, 249 aa, Homo sapiens; identical to SEQ ID NO: 861246

SEQ ID NO: 861248 - protein, 155 aa, Homo sapiens
MREAVQEMKDHMVSPTAVAFLERNNREILAGKPAAQKSPSDLLDASAVSATSRYIEEQQATQQLIMDEQDQQLEMVSGSIQVLKHMSGRVGEELDEQGIMLDAFAQEMDHTQSRMDGVLRKLAKVSHMTSDRRQWCAIAVLVGVLLLVLILLFSL

SEQ ID NO: 861249 - protein, 339 aa, Homo sapiens
MCTGSCLCPQPRWLRRGRKCPHVGPPRLLFLPWRSGSRWWRDGGGGGGAFSSVGREPAREPRPGGVYRGLRSPPCVWVCSRGQRQAGGPPAPSRARRAPARSEVQKAVNTARGLYQRWCELLQESAAVGREELDWTTNELRNGLRSIEWDLEDLEETIGIVEANPGKFKLPAGDLQERKVFVERMREAVQEMKDHMVSPTAVAFLERNNREILAGKPAAQKSPSDLLDASAVSATSRYIEEQQATQQLIMDEQDQQLEMVSGSIQVLKHMSGRVGEELDEQGIMLDAFAQEMDHTQSRMDGVLRKLAKVSHMTSDRRQWCAIAVLVGVLLLVLILLFSL

SEQ ID NO: 861250 - protein, 155 aa, Homo sapiens; identical to SEQ ID NO: 861248

SEQ ID NO: 861251 - protein, 289 aa, Homo sapiens
RNLEYRLGTRLGLNRPRVLLGWEGTSPRTQAGRGVRPGGEGTDMSLEDPFFVVRGEVQKAVNTARGLYQRWCELLQESAAVGREELDWTTNELRNGLRSIEWDLEDLEETIGIVEANPGKFKLPAGDLQERKVFVERMREAVQEMKDHMVSPTAVAFLERNNREILAGKPAAQKSPSDLLDASAVSATSRYIEEQQATQQLIMDEQDQQLEMVSGSIQVLKHMSGRVGEELDEQGIMLDAFAQEMDHTQSRMDGVLRKLAKVSHMTSGESPQGRGQSWWGQVVGGTLSP

SEQ ID NO: 861252 - protein, 149 aa, Homo sapiens
MSCGMACAASSGTSRTWKRPSILAGKPAAQKSPSDLLDASAVSATSRYIEEQQATQQLIMDEQDQQLEMVSGSIQVLKHMSGRVGEELDEQGIMLDAFAQEMDHTQSRMDGVLRKLAKVSHMTSDRRQWCAIAVLVGVLLLVLILLFSL

SEQ ID NO: 861253 - protein, 87 aa, Homo sapiens
ARYPVQLFSHAAGHVLQNLDAVGEELDEQGIMLDAFAQEMDHTQSRMDGVLRKLAKVSHMTSDRRQWCAIAVLVGVLLLVLILLFSL

SEQ ID NO: 861254 - protein, 249 aa, Homo sapiens; identical to SEQ ID NO: 861246

SEQ ID NO: 861255 - protein, 292 aa, Homo sapiens
RNLEYRLGTRLGLNRPRVLLGWEGTSPRTQAGRGVRPGGEGTDMSLEDPFFVVRGEVQKAVNTARGLYQRWCELLQESAAVGREELDWTTNELRNGLRSIEWDLEDLEETIGIVEANPGKFKLPAGDLQERKVFVERMREAVQEMKDHMVSPTAVAFLERNNREILAGKPAAQKSPSDLLDASAVSATSRYIEEQQATQQLIMDEQDQQLEMVSGSIQVLKHMSGRVGEELDEQGIMLDAFAQEMDHTQSRMDGVLRKLAKVSHMTSDRRQWCAIAVLVGVLLLVLILLFSL

SEQ ID NO: 861256 - protein, 246 aa, Homo sapiens
MSLEDPFFVVRGEVQKAVNTARGLYQRWCELLQESAAVGREELDWTTNELRNGLRSIEWDLEDLEETIGIVEANPGKFKLPAGDLQERKVFVERMREAVQEMKDHMVSPTAVAFLERNNREILAGKPAAQKSPSDLLDASAVSATSRYIEEQQATQQLIMDEQDQQLEMVSGSIQVLKHMSGRVGEELDEQGIMLDAFAQEMDHTQSRMDGVLRKLAKVSHMTSGESPQGRGQSWWGQVVGGTLSP

SEQ ID NO: 861257 - protein, 232 aa, Homo sapiens
MSLEDPFFVVRGEVQKAVNTARGLYQRWCELLQESAAVGREELDWTTNELRNGLRSIEWDLEDLEETIGIVEANPGKFKLPAGDLQERKVFVERMREAVQEMKDHMVSPTAVAFLERNNREILAGKPAAQKSPSDLLDASAVSATSRYIEEQQATQQLIMDEQDQQLEMVSGSIQVLKHMSGRVGEELDEQGIMLDAFAQEMDHTQSRMDGVLRKLAKVSHMTSALPGRLVP

SEQ ID NO: 861258 - protein, 91 aa, Homo sapiens; identical to SEQ ID NO: 861245

SEQ ID NO: 861259 - protein, 91 aa, Homo sapiens; identical to SEQ ID NO: 861245

SEQ ID NO: 861260 - protein, 91 aa, Homo sapiens; identical to SEQ ID NO: 861245

SEQ ID NO: 861261 - protein, 95 aa, Homo sapiens
ALQGHGPAQLVVVSAHPVRHCPLLLQDVLLAVPVLRIRPPQLRHRPELPHVAVEAHELLPVVDVSLQEALCPIKRVAFLPSLEKVLEWPCPGPQM

SEQ ID NO: 861262 - protein, 225 aa, Homo sapiens
MCQLMPRLYRRIDQQGSLCLNLMKMSMFYVDLDKKETVWHLEEFGQAFSFEAQGGLANIAILNNNLNTLIQRSNHTQATNDPPEVTVFPKEPVELGQPNTLICHIDKFFPPVLNVTWLCNGELVTEGVAESLFLPRTDYSFHKFHYLTFVPSAEDFYDCRVEHWGLDQPLLKHWEAQEPIQMPETTETVLCALGLVLGLVGIIVGTVLIIKSLRSGHDPRAQGTL

SEQ ID NO: 861263 - protein, 225 aa, Homo sapiens; identical to SEQ ID NO: 861262

SEQ ID NO: 861264 - protein, 225 aa, Homo sapiens; identical to SEQ ID NO: 861262

SEQ ID NO: 861265 - protein, 225 aa, Homo sapiens; identical to SEQ ID NO: 861262

SEQ ID NO: 861266 - protein, 225 aa, Homo sapiens; identical to SEQ ID NO: 861262

SEQ ID NO: 861267 - protein, 144 aa, Homo sapiens
ALQGHGPAQLVVVSAHPVRHCPLLLQDVLLAVPVLRIRPPQLRHRPELPHVAVEAHELLPVVDVSLQEALCPIKRVAFLPSLEKVVNPSHADSSPPISSARGPQFQSHLPPLGLSSSSLFLCSQSSIIDPTTCALKTECSISEL

SEQ ID NO: 861268 - protein, 225 aa, Homo sapiens; identical to SEQ ID NO: 861262

SEQ ID NO: 861269 - protein, 105 aa, Homo sapiens
ALQGHGPAQLVVVSAHPVRHCPLLLQDVLLAVPVLRIRPPQLRHRPELPHVAVEAHELLPVVDVSLQEALCPIKRVAFLPSLEKVSSIIDPTTCALKTECSISEL

SEQ ID NO: 861270 - protein, 167 aa, Homo sapiens
MCQLMPRLYRRIDQQGSLCLNLMKMSMFYVDLDKKETVWHLEEFGQAFSFEAQGGLANIAILNNNLNTLIQRSNHTQATNDPPEVTVFPKEPVELGQPNTLICHIDKFFPPVLNVTWLCNGELVTEGVAESLFLPRTDYSFHKFHYLTFVPSAEDFYDCRVEHWCWA

SEQ ID NO: 861271 - protein, 153 aa, Homo sapiens
MCQLMPRLYRRIDQQGSLCLNLMKMSMFYVDLDKKETVWHLEEFGQAFSFEAQGGLANIAILNNNLNTLIQRSNHTQATNDPPEVTVFPKEPVELGQPNTLICHIDKFFPPVLNVTWLCNGELVTEGVAESLFLPRTDYSFHKFHYCENYSSG

SEQ ID NO: 861272 - protein, 144 aa, Homo sapiens; identical to SEQ ID NO: 861267

SEQ ID NO: 861273 - protein, 85 aa, Homo sapiens
PVRHCPLLLQDVLLAVPVLRIRPPQLRHRPELPHVAVEAHELLPVVDVSLQEALCPIKRVAFLPSLEKVILCGEGADMSGGATLI

SEQ ID NO: 861274 - protein, 225 aa, Homo sapiens; identical to SEQ ID NO: 861262

SEQ ID NO: 861275 - protein, 225 aa, Homo sapiens; identical to SEQ ID NO: 861262

SEQ ID NO: 861276 - protein, 225 aa, Homo sapiens; identical to SEQ ID NO: 861262

SEQ ID NO: 861277 - protein, 225 aa, Homo sapiens; identical to SEQ ID NO: 861262

SEQ ID NO: 861278 - protein, 225 aa, Homo sapiens; identical to SEQ ID NO: 861262

SEQ ID NO: 861279 - protein, 127 aa, Homo sapiens
MCQLMPRLYRRIDQQGSLCLNLMKMSMFYVDLDKKETVWHLEEFGQAFSFEAQGGLANIAILNNNLNTLIQRSNHTQATNASSATLTSSSHQCSTSRGCATGSWSLRVSLRASSCPEQITASTSSIT

SEQ ID NO: 861280 - protein, 227 aa, Homo sapiens
MCQLMPRLYRRIDQQGSLCLNLMKMSMFYVDLDKKETVWHLEEFGQAFSFEAQGGLANIAILNNNLNTLIQRSNHTQATNDPPEVTVFPKEPVELGQPNTLICHIDKFFPPVLNVTWLCNGELVTEGVAESLFLPRTDYSFHKFHYLTFVPSAEDFYDCRVEHWGLDQPLLKHWEAQEPIQMPETTETVLCALGLVLGLVGIIVARLLSSGLAARAGPCDPVGAFAK

SEQ ID NO: 861281 - protein, 76 aa, Homo sapiens
MPDVTGLPDAYTNGKSIILEDHSFSYSRKINNFRLGSLVLKKPIVENPYRGVFVSPPQIEAVLLKEGARVAGPFKK

SEQ ID NO: 861282 - protein, 178 aa, Homo sapiens
MAALKALVSGCGRLLRGLLAGPAATSWSRLPARGFREVVETQEGKTTIIEGRITATPKESPNPPNPSGQCPICRWNLKHKYNYDDVLLLSQFIRPHGGMLPRKITGLCQEEHRKIEECVKMAHRAGLLPNHRPRLPEGVVPKSKPQLNRYLTRWAPGSVKPIYKDNVCYSRTPWKLYH

SEQ ID NO: 861283 - protein, 205 aa, Homo sapiens
MAALKALVSGCGRLLRGLLAGPAATSWSRLPKRGSFPGPRGGGSKGSGGDPRREDNYIEGRITATPKESPNPPNPSGQCPICRWNLKHKYNYDDVLLLSQFIRPHGGMLPRKITGLCQEEHRKIEECVKMAHRAGLLPNHRPRLPEGVVPKSKPQLNRYLTRWAPGSVKPIYKKGPRWNRVRMPVGSPLLRDNVCYSRTPWKLYH

SEQ ID NO: 861284 - protein, 270 aa, Homo sapiens
MAALKALVSGCGRLLRGLLAGPAATSWSRLPARGFREVVETQEGKTTIIEGRITATPKESPNPPNPSGQCPICRWNLKHKYNYDDVLLLSQFIRPHGGMLPRKITGLCQEEHRKIEECVKMAHRAGRRPWGPRGAEGCRHSLPTQLPHVSAPPGRKVDIRSVNYTHHPMPTFPLPWAFPLAPSELQRELQRLSPLPRHSGLLPNHRPRLPEGVVPKSKPQLNRYLTRWAPGSVKPIYKKGPRWNRVRMPVGSPLLRDNVCYSRTPWKLYH

SEQ ID NO: 861285 - protein, 270 aa, Homo sapiens; identical to SEQ ID NO: 861284

SEQ ID NO: 861286 - protein, 127 aa, Homo sapiens
MAALKALVSGCGRLLRGLLAGPAATSWSRLPARGFREVVETQEGKTTIIEGRITATPKESPNPPNPSGQCPICRWNLKHKYNYDDVLLLSQFIRPHGGMLPRKITGLCQEEHRKIEECVKMAHRAGT

SEQ ID NO: 861287 - protein, 168 aa, Homo sapiens
MCLAPRARESHTGPYRAPGSGETHRKQRNSAGHGVGCLEGNRGPTPGRTGGLIIHPRILQRGPHAGLPRAQASKLVIPAGRRRPKKPPRKVFKPGGSPRRTRSLGAPLGRHRGTKTPSSLIPPISRWAPTRGANLWGSGSMLPAGGGLTPPFLVEGAPRGLATSAGEK

SEQ ID NO: 861288 - protein, 196 aa, Homo sapiens
MAALKALVSGCGRLLRGLLAGPAATSWSRLPARGFREVVETQEGKTTIIEGRITATPKESPNPPNPSGQCPICRWNLKHKYNYDDVLLLSQFIRPHGGMLPRKITGLCQEEHRKIEECVKMAHRAGLLPNHRPRLPEGVVPKSKPQLNRYLTRWAPGSVKPIYKKGPRWNRVRMPVGSPLLRDNVCYSRTPWKLYH

SEQ ID NO: 861289 - protein, 196 aa, Homo sapiens; identical to SEQ ID NO: 861288

SEQ ID NO: 861290 - protein, 127 aa, Homo sapiens; identical to SEQ ID NO: 861286

SEQ ID NO: 861291 - protein, 144 aa, Homo sapiens
MAALKALVSGCGRLLRGLLAGPAATSWSRLPARGFREVVETQEGKTTIIEGRITATPKESPNPPNPSGQCPICRWNLKHKYNYDDVLLLSQFIRPHGGMLPRKITGLCQEEHRKIEECVKMAHRAGLGFLKELFRRANPNSTGT

SEQ ID NO: 861292 - protein, 214 aa, Homo sapiens
MAALKALVSGCGRLLRGLLAGPAATSWSRLPARGFREVVETQEGKTTIIEGRITATPKESPNPPNPSGQCPICRWNLKHKYNYDDVLLLSQFIRPHGGMLPRKITGLCQEEHRKIEECVKMAHRAGRRPWGPRGAEGCRHSLPTQLPHVSAPPGRKVDIRSVSYHTMQLSVLVSLALELQELKDIPISASVYTNQGGPEECERTNQGQRRAGEA

SEQ ID NO: 861293 - protein, 537 aa, Homo sapiens
MTFIPYHKQCRKEILVAALVFRKPWEQVPKKPKRKKRRRRNVNCLKNVVIWYEDHKHRCPYEPHLAELDPTFGLYTTAVWQCEAGHRYFQDLHSPLKPLSDSDPDSDKVGNGLVAGSSDSSSSGSASDSEESPEGQPVKAAAAAAAATPTSPVGSSGLITQEGVHIPFDVHHVESLAEQGTPLCSNPAGNGPEALETVVCVPVPVQVGAGPSALFENVPQEALGEVVASCPMPGMVPGSQVIIIAGPGYDALTAEGIHLNMAAGSGVPGSGLGEEVPCAMMEGVAAYTQTEPEGSQPSTMDATAVAGIETKKEKEDLCLLKKEEKEEPVAPELATTVPESAEPEAEADGEELDGSDMSAIIYEIPKEPEKRRRSKRSRVMDADGLLEMFHCPYEGCSQVYVALSSFQNHVNLVHRKGKTKVCPHPGCGKKFYLSNHLRRHMIIHSGVREFTCETCGKSFKRKNHLEVHRRTHTGETPLQCEICGYQCRQRASLNWHMKKHTAEVQYNFTCDRCGKRFEKLDSVKFHTLKSHPDHKPT

SEQ ID NO: 861294 - protein, 680 aa, Homo sapiens
MAERALEPEAEAEAEAGAGGEAAAEEGAAGRKARGRPRLTESDRARRRLESRKKYDVRRVYLGEAHGPWVDLRRRSGWSDAKLAAYLISLERGQRSGRHGKPWEQVPKKPKRKKRRRRNVNCLKNVVIWYEDHKHRCPYEPHLAELDPTFGLYTTAVWQCEAGHRYFQDLHSPLKPLSDSDPDSDKVGNGLVAGSSDSSSSGSASDSEESPEGQPVKAAAAAAAATPTSPVGSSGLITQEGVHIPFDVHHVESLAEQGTPLCSNPAGNGPEALETVVCVPVPVQVGAGPSALFENVPQEALGEVVASCPMPGMVPGSQVIIIAGPGYDALTAEGIHLNMAAGSGVPGSGLGEEVPCAMMEGVAAYTQTEPEGSQPSTMDATAVAGIETKKEKEDLCLLKKEEKEEPVAPELATTVPESAEPEAEADGEELDGSDMSAIIYEIPKEPEKRRRSKRSRVMDADGLLEMFHCPYEGCSQVYVALSSFQNHVNLVHRKGKTKVCPHPGCGKKFYLSNHLRRHMIIHSGVREFTCETCGKSFKRKNHLEVRDLWLPVPAARVAQLAHEEAHCGGAVQLHVRSLREALREAGQRQVPHAQKPPGSQAHLTHLTTDRPYLFVRSDTTPGLAGAWTAARAARTAGRKEAPPPRPRAGPPGQVPHPAPPHPSRSWCLGLHCWNCVKRAE

SEQ ID NO: 861295 - protein, 615 aa, Homo sapiens
MAERALEPEAEAEAEAGAGGEAAAEEGAAGRKARGRPRLTESDRARRRLESRKKYDVRRVYLGEAHGPWVDLRRRSGWSDAKLAAYLISLERGQRSGRHGKPWEQVPKKPKRKKRRRRNVNCLKNVVIWYEDHKHRCPYEPHLAELDPTFGLYTTAVWQCEAGHRYFQDLHSPLKPLSDSDPDSDKVGNGLVAGSSDSSSSGSASDSEESPEGQPVKAAAAAAAATPTSPVGSSGLITQEGVHIPFDVHHVESLAEQGTPLCSNPAGNGPEALETVVCVPVPVQVGAGPSALFENVPQEALGEVVASCPMPGMVPGSQVIIIAGPGYDALTAEGIHLNMAAGSGVPGSGLGEEVPCAMMEGVAAYTQTEPEGSQPSTMDATAVAGIETKKEKEDLCLLKKEEKEEPVAPELATTVPESAEPEAEADGEELDGSDMSAIIYEIPKEPEKRRRSKRSRVMDADGLLEMFHCPYEGCSQVYVALSSFQNHVNLVHRKGKTKVCPHPGCGKKFYLSNHLRRHMIIHSGVREFTCETCGKSFKRKNHLEVHRRTHTGETPLQCEICGYQCRQRASLNWHMKKHTAEVQYNFTCDRCGKRFEKLDSVKFHTLKSHPDHKPT

SEQ ID NO: 861296 - protein, 676 aa, Homo sapiens
MAERALEPEAEAEAEAGAGGEAAAEEGAAGRKARGRPRLTESDRARRRLESRKKYDVRRVYLGEAHGPWVDLRRRSGWSDAKLAAYLISLERGQRSGRHGKPWEQVPKKPKRKKRRRRNVNCLKNVVIWYEDHKHRCPYEPHLAELDPTFGLYTTAVWQCEAGHRYFQDLHSPLKPLSDSDPDSDKVGNGLVAGSSDSSSSGSASDSEESPEGQPVKAAAAAAAATPTSPVGSSGLITQEGVHIPFDVHHVESLAEQGTPLCSNPAGNGPEALETVVCVPVPVQVGAGPSALFENVPQEALGEVVASCPMPGMVPGSQVIIIAGPGYDALTAEGIHLNMAAGSGVPGSGLGEEVPCAMMEGVAAYTQTEPEGSQPSTMDATAVAGIETKKEKEDLCLLKKEEKEEPVAPELATTVPESAEPEAEADGEELDGSDMSAIIYEIPKEPEKRRRSKRSRVMDADGLLEMFHCPYEGCSQVYVALSSFQNHVNLVHRKGKTKVCPHPGCGKKFYLSNHLRRHMIIHSGVREFTCETCGKSFKRKNHLEVHRRTHTGETPLQWVTGRPVPLEDWVGGDPSRSQGRLRPNAVSGPGSTCARPCRAPPRPAHSDPAPSRHGLPARCEICGYQCRQRASLNWHMKKHTAEVQYNFTCDRCGKRFEKLDSVKFHTLKSHPDHKPT

SEQ ID NO: 861297 - protein, 424 aa, Homo sapiens
MQRLQVVLGHLRGPADSGWMPQAAPCLSGAPQASAADVVVVHGRRTAICRAGRGGFKDTTPDELLSAVMTAVLKDVNLRPEQLGDICVGNVLQPGAGAIMARIAQFLSDIPETVPLSTVNRQCSSGLQAVASIAGGIRNGSYDIGMACGVESMSLADRGNPGNITSRLMEKEKARDCLIPMGITSENVAERFGISREKQDTFALASQQKAARAQSKGCFQAEIVPVTTTVHDDKGTKRSITVTQDEGIRPSTTMEGLAKLKPAFKKDGSTTAGNSSQVSDGAAAILLARRSKAEELGLPILGVLRSYAVVGVPPDIMGIGPAYAIPVALQKAGLTVSDVDIFEINEAFASQAAYCVEKLRLPPEKVNPLGGAVALGHPLGCTGARQVITLLNELKRRGKRAYGVVSMCIGTGMGAAAVFEYPGN

SEQ ID NO: 861298 - protein, 132 aa, Homo sapiens
EGEPPGVTVALGPTGLHWGTTGHHAAILLARRSKAEELGLPILGVLRSYAVVGVPPDIMGIGPAYAIPVALQKAGLTVSDVDIFEINEAFASQLEIVPVTTTVHDDKGTKRSITVTQDEGIRPSTTMEGLAN

SEQ ID NO: 861299 - protein, 449 aa, Homo sapiens
PPPRGLRLGRGPSRTGGWSAGLTCAMQRLQVVLGHLRGPADSGWMPQAAPCLSGAPQASAADVVVVHGRRTAICRAGRGGFKDTTPDELLSAVMTAVLKDVNLRPEQLGDICVGNVLQPGAGAIMARIAQFLSDIPETVPLSTVNRQCSSGLQAVASIAGGIRNGSYDIGMACGVESMSLADRGNPGNITSRLMEKEKARDCLIPMGITSENVAERFGISREKQDTFALASQQKAARAQSKGCFQAEIVPVTTTVHDDKGTKRSITVTQDEGIRPSTTMEGLAKLKPAFKKDGSTTAGNSSQVSDGAAAILLARRSKAEELGLPILGVLRSYAVVGVPPDIMGIGPAYAIPVALQKAGLTVSDVDIFEINEAFASQAAYCVEKLRLPPEKVNPLGGAVALGHPLGCTGARQVITLLNELKRRGKRAYGVVSMCIGTGMGAAAVFEYPGN

SEQ ID NO: 861300 - protein, 480 aa, Homo sapiens
MQRLQVVLGHLRGPADSGWMPQAAPCLSGAPQASAADVVVVHGRRTAICRAGRGGFKDTTPDELLSAVMTAVLKDVNLRPEQLGDICVGNVLQPGAGAIMARIAQFLSDIPETVPLSTVNRQCSSGLQAVASIAGGIRNGSYDIGMACGVESMSLADRGNPGNITSRLMEKEKARDCLIPMGITSENVAERFGISREKQDTFALASQQKAARAQSKGCFQAEIVPVTTTVHDDKGTKRSITVTQDEGIRPSTTMEGLAKLKPAFKKDGSTTAGETGRGRGMRKQAMAMLGAVLWEPGIDQAPLQSKKWEGWDLLIPTPMPSYPNSLPLGNSSQVSDGAAAILLARRSKAEELGLPILGVLRSYAVVGVPPDIMGIGPAYAIPVALQKAGLTVSDVDIFEINEAFASQAAYCVEKLRLPPEKVNPLGGAVALGHPLGCTGARQVITLLNELKRRGKRAYGVVSMCIGTGMGAAAVFEYPGN

SEQ ID NO: 861301 - protein, 424 aa, Homo sapiens; identical to SEQ ID NO: 861297

SEQ ID NO: 861302 - protein, 364 aa, Homo sapiens
MQRLQVVLGHLRGPADSGWMPQAAPCLSGAPQASAADVVVVHGRRTAICRAGRGGFKDTTPDELLSAVMTAVLKDVNLRPEQLGDICVGNVLQPGAGAIMARIAQFLSDIPETVPLSTVNRQCSSGLQAVASIAGGIRNGSYDIGMACGVESMSLADRGNPGNITSRLMEKEKARDCLIPMGITSENVAERFGISREKQDTFALASQQKAARAQSKGCFQAEIVPVTTTVHDDKGTKRSITVTQDEGIRPSTTMEGLAKLKPAFKKDGSTTAGLTVSDVDIFEINEAFASQAAYCVEKLRLPPEKVNPLGGAVALGHPLGCTGARQVITLLNELKRRGKRAYGVVSMCIGTGMGAAAVFEYPGN

SEQ ID NO: 861303 - protein, 426 aa, Homo sapiens
MQRLQVVLGHLRGPADSGWMPQAAPCLSGAPQASAADVVVVHGRRTAICRAGRGGFKDTTPDELLSAVMTAVLKDVNLRPEQLGDICVGNVLQPGAGAIMARIAQFLSDIPETVPLSTVNRQCSSGLQAVASIAGGIRNGSYDIGMACGVESMSLADRGNPGNITSRLMEKEKARDCLIPMGITSENVAERFGISREKQDTFALASQQKAARAQSKGCFQAEIVPVTTTVHDDKGTKRSITVTQDEGIRPSTTMEGLAKLKPAFKKDGSTTAGNSSQVSDGAAAILLARRSKAEELGLPILGVLRSYAVVGVPPDIMGIGPAYAIPVALQKAGLTVSDVDIFEINEAFASQAAYCVEKLRLPPEKVNPLGGAVALGHPLGCTGARFFFFYLLKYVFSFFFTISSFFPYLSFLYSYSYSPAALAARQ

SEQ ID NO: 861304 - protein, 336 aa, Homo sapiens
MQRLQVVLGHLRGPADSGWMPQAAPCLSGAPQASAADVVVVHGRRTAICRAGRGGFKDTTPDELLSAVMTAVLKDVNLRPEQLGDICVGNVLQPGAGAIMARIAQFLSDIPETVPLSTVNRQCSSGLQAVASIAGGIRNGSYDIGMACGVESMSLADRGNPGNITSRLMEKEKARDCLIPMGITSENVAERFGISREKQDTFALASQQKAARAQSKGCFQAEIVPVTTTVHDDKGTKRSITVTQDEGIRPSTTMEGLAKLKPAFKKDGSTTAGNSSQVSDGAAAILLARRSKAEELGLPILGVLRSYAVVGVPPDIMGIGPAYAIPVALQKAECEH

SEQ ID NO: 861305 - protein, 279 aa, Homo sapiens
MACGVESMSLADRGNPGNITSRLMEKEKARDCLIPMGITSENVAERFGISREKQDTFALASQQKAARAQSKGCFQAEIVPVTTTVHDDKGTKRSITVTQDEGIRPSTTMEGLAKLKPAFKKDGSTTAGNSSQVSDGAAAILLARRSKAEELGLPILGVLRSYAVVGVPPDIMGIGPAYAIPVALQKAGLTVSDVDIFEINEAFASQAAYCVEKLRLPPEKVNPLGGAVALGHPLGCTGARQVITLLNELKRRGKRAYGVVSMCIGTGMGAAAVFEYPGN

SEQ ID NO: 861306 - protein, 220 aa, Homo sapiens
MWLSGLAFHGRSRIPLPWLPSRTTTVHDDKGTKRSITVTQDEGIRPSTTMEGLAKLKPAFKKDGSTTAGNSSQVSDGAAAILLARRSKAEELGLPILGVLRSYAVVGVPPDIMGIGPAYAIPVALQKAGLTVSDVDIFEINEAFASQAAYCVEKLRLPPEKVNPLGGAVALGHPLGCTGARQVITLLNELKRRGKRAYGVVSMCIGTGMGAAAVFEYPGN

SEQ ID NO: 861307 - protein, 343 aa, Homo sapiens
MQRLQVVLGHLRGPADSGWMPQAAPCLSGAPQASAADVVVVHGRRTAICRAGRGGFKDTTPDELLSAVMTAVLKDVNLRPEQLGDICVGNVLQPGAGAIMARIAQFLSDIPETVPLSTVNRQCSSGLQAVASIAGGIRNGSYDIGMACGVESMSLADRGNPGNITSRLMEKEKARDCLIPMGITSENVAERFGISREKQDTFALASQQKAARAQSKGCFQAEIVPVSAGADTLILGHSDAPLGALVIMDLVVTGQYGCAGDGNVVGEAEDAGALEEKQTQAGAAGAGGGHNHCSGSPKTSVLLRFMFSKVKAGQPWVGDVLMSCRWLTVCVPRRPDSNLVHNI

SEQ ID NO: 861308 - protein, 113 aa, Homo sapiens
MQRLQVVLGHLRGPADSGWMPQAAPCLSGAPQASAADVVVVHGRRTAICRAGRGGFKDTTPDELLSAVMTAVLKDVNLRPEQLGDICVVTSRRLCLCPLSIDSVRRGYRQWPA

SEQ ID NO: 861309 - protein, 58 aa, Homo sapiens
VEKLRLPPEKVNPLGGAVALGHPLGCTGARQVITLLNELKRRGKREGFAPGGGVIGGY

SEQ ID NO: 861310 - protein, 123 aa, Homo sapiens
MQRLQVVLGHLRGPADSGWMPQAAPCLSGAPQASAADVVVVHGRRTAICRAGRGGFKDTTPDELLSAVMTAVLKDVNLRPEQLGDICVEMSCLRAACSGRPCPRPSRPPGVDPSLIKIHQVSR

SEQ ID NO: 861311 - protein, 469 aa, Homo sapiens
DTRELRDYKCPKSTALLYTELCILNGLRDELGSRTGGWSAGLTCAMQRLQVVLGHLRGPADSGWMPQAAPCLSGAPQASAADVVVVHGRRTAICRAGRGGFKDTTPDELLSAVMTAVLKDVNLRPEQLGDICVGNVLQPGAGAIMARIAQFLSDIPETVPLSTVNRQCSSGLQAVASIAGGIRNGSYDIGMACGVESMSLADRGNPGNITSRLMEKEKARDCLIPMGITSENVAERFGISREKQDTFALASQQKAARAQSKGCFQAEIVPVTTTVHDDKGTKRSITVTQDEGIRPSTTMEGLAKLKPAFKKDGSTTAGNSSQVSDGAAAILLARRSKAEELGLPILGVLRSYAVVGVPPDIMGIGPAYAIPVALQKAGLTVSDVDIFEINEAFASQAAYCVEKLRLPPEKVNPLGGAVALGHPLGCTGARQVITLLNELKRRGKRAYGVVSMCIGTGMGAAAVFEYPGN

SEQ ID NO: 861312 - protein, 424 aa, Homo sapiens; identical to SEQ ID NO: 861297

SEQ ID NO: 861313 - protein, 373 aa, Homo sapiens
MQRLQVVLGHLRGPADSGWMPQAAPCLSGAPQASAADVVVVHGRRTAICRAGRGGFKDTTPDELLSAVMTAVLKDVNLRPEQLGDICVGNVLQPGAGAIMARIAQFLSDIPETVPLSTVNRQCSSGLQAVASIAGGIRNGSYDIGMACGVESMSLADRGNPGNITSRLMEKEKARDCLIPMGITSENVAERFGISREKQDTFALASQQKAARAQSKGCFQAEIVPVTTTVHDDKGTKRSITVTQDEGIRPSTTMEGLAKLKPAFKKDGSTTAGNSSQVSDGAAAILLARRSKAEELGLPILGVLRSYAVVGVPPDIMGIGPAYAIPVALQKAEVRWLLHIVSGSHLDPAAALHAVARGMRVVLWVLQSGGGAG

SEQ ID NO: 861314 - protein, 424 aa, Homo sapiens; identical to SEQ ID NO: 861297

SEQ ID NO: 861315 - protein, 320 aa, Homo sapiens
MQRLQVVLGHLRGPADSGWMPQAAPCLSGAPQASAADVVVVHGRRTAICRAGRGGFKDTTPDELLSAVMTAVLKDVNLRPEQLGDICVGNVLQPGAGAIMARIAQFLSDIPETVPLSTVNRQCSSGLQAVASIAGGIRNGSYDIGMACGVESMSLADRGNPGNITSRLMEKEKARDCLIPMGITSENVAERFGISREKQDTFALASQQKAARAQSKGCFQAEIVPVTTTVHDDKGTKRSITVTQDEGIRPSTTMEGLAKLKPAFKKDGSTTAGNSSQVSDGAAAILLARRSKAEELGLPILGVLRSYAVVGVPPGHHAAQ

SEQ ID NO: 861316 - protein, 272 aa, Homo sapiens
MSLADRGNPGNITSRLMEKEKARDCLIPMGITSENVAERFGISREKQDTFALASQQKAARAQSKGCFQAEIVPVTTTVHDDKGTKRSITVTQDEGIRPSTTMEGLAKLKPAFKKDGSTTAGNSSQVSDGAAAILLARRSKAEELGLPILGVLRSYAVVGVPPDIMGIGPAYAIPVALQKAGLTVSDVDIFEINEAFASQAAYCVEKLRLPPEKVNPLGGAVALGHPLGCTGARQVITLLNELKRRGKRAYGVVSMCIGTGMGAAAVFEYPGN

SEQ ID NO: 861317 - protein, 391 aa, Homo sapiens
MQRLQVVLGHLRGPADSGWMPQAAPCLSGAPQASAADVVVVHGRRTAICRAGRGGFKDTTPDELLSAVMTAVLKDVNLRPEQLGDICVGNVLQPGAGAIMARIAQFLSDIPETVPLSTVNRQCSSGLQAVASIAGGIRNGSYDIGMACGITSENVAERFGISREKQDTFALASQQKAARAQSKGCFQAEIVPVTTTVHDDKGTKRSITVTQDEGIRPSTTMEGLAKLKPAFKKDGSTTAGNSSQVSDGAAAILLARRSKAEELGLPILGVLRSYAVVGVPPDIMGIGPAYAIPVALQKAGLTVSDVDIFEINEAFASQAAYCVEKLRLPPEKVNPLGGAVALGHPLGCTGARQVITLLNELKRRGKRAYGVVSMCIGTGMGAAAVFEYPGN

SEQ ID NO: 861318 - protein, 162 aa, Homo sapiens
MPSYPNSLPLGNSSQVSDGAAAILLARRSKAEELGLPILGVLRSYAVVGVPPDIMGIGPAYAIPVALQKAGLTVSDVDIFEINEAFASQAAYCVEKLRLPPEKVNPLGGAVALGHPLGCTGARQVITLLNELKRRGKRAYGVVSMCIGTGMGAAAVFEYPGN

SEQ ID NO: 861319 - protein, 331 aa, Homo sapiens
MQRLQVVLGHLRGPADSGWMPQAAPCLSGAPQASAADVVVVHGRRTAICRAGRGGFKDTTPDELLSAVMTAVLKDVNLRPEQLGDICVGNVLQPGAGAIMARIAQFLSDIPETVPLSTVNRQCSSGLQAVASIAGGIRNGSYDIGMACGITSENVAERFGISREKQDTFALASQQKAARAQSKGCFQAEIVPVTTTVHDDKGTKRSITVTQDEGIRPSTTMEGLAKLKPAFKKDGSTTAGLTVSDVDIFEINEAFASQAAYCVEKLRLPPEKVNPLGGAVALGHPLGCTGARQVITLLNELKRRGKRAYGVVSMCIGTGMGAAAVFEYPGN

SEQ ID NO: 861320 - protein, 149 aa, Homo sapiens
MQRLQVVLGHLRGPADSGWMPQAAPCLSGAPQASAADVVVVHGRRTAICRAGRGGFKDTTPDELLSAVMTAVLKDVNLRPEQLGDICVGNVLQPGAGAIMARIAQFLSDIPETVPLSTVNRQCSSGLQAVASIAGGIRNGSYDIGMACG

SEQ ID NO: 861321 - protein, 69 aa, Homo sapiens
SDAWVDPRVRTDAVWLWIAPYGQLCPQGRMRIATEVLKSKPNSSHWHTGQALDRKLEVEMVESNLPGPA

SEQ ID NO: 861322 - protein, 344 aa, Homo sapiens
MDSYSAPESTPSASSRPEDYFIGATPLQKRLESVRKQSSFILTPPRRKIPQCSQLQEDVDPQKVAFLLHKQWTLYSLTPLYKFSYSNLKEYSRLLNAFIVAEKQKGLAVEVGEDFNIKVIFSTLLGMKGTQRDPEAFLVQIVSKSQLPSENREGKVLWTGWFCCVFGDSLLETVSEDFTCLPLFLANGAESNTAIIGTWFQKTFDCYFSPLAINAFNLSWMAAMWTACKMDHYVATTEFLWSVPCSPQSLDISFAIHPEDAKALWDSVHKTPGEVTQEEVDLFMDCLYSHFHRHFKIHLSATRLVRVSTSVASAHTDGKIKILCHKYLIGVLAYLTELAIFQIE

SEQ ID NO: 861323 - protein, 218 aa, Homo sapiens [sequence omitted]

SEQ ID NO: 861324 - protein, 344 aa, Homo sapiens; identical to SEQ ID NO: 861322

SEQ ID NO: 861325 - protein, 151 aa, Homo sapiens
MDSYSAPESTPSASSRPEDYFIGATPLQKRLESVRKQSSFILTPPRRKIPQCSQLQEDVDPQKVAFLLHKQWTLYSLTPLYKFSYSNLKEYSRLLNAFIVAEKQKGLAVEVGEDFNIKVIFSTLLGMKGTQRDPEAFLVPGSHFVTQAGVQ

SEQ ID NO: 861326 - protein, 194 aa, Homo sapiens
AQGAAAGAVGAKAMSDSWVPNSASGQDPGGRRRAWAELLAGRVKREKYNPERAQKLKESAVRLLRSHQDLNALLLEVEGPLCKKLSLSKVIDCDSSEAYANHSSSFIGSALQDQASRLGVPVGILSAGMVASSVGQICTAPAETSHPVLLTVEQRKKLSSLLEFAQYLLAHSMFSRLSFCQELWKIQVNLRLQI

SEQ ID NO: 861327 - protein, 1468 aa, Homo sapiens
AQGAAAGAVGAKAMSDSWVPNSASGQDPGGRRRAWAELLAGRVKREKYNPERAQKLKESAVRLLRSHQDLNALLLEVEGPLCKKLSLSKVIDCDSSEAYANHSSSFIGSALQDQASRLGVPVGILSAGMVASSVGQICTAPAETSHPVLLTVEQRKKLSSLLEFAQYLLAHSMFSRLSFCQELWKIQSSLLLEAVWHLHVQGIVSLQELLESHPDMHAVGSWLFRNLCCLCEQMEASCQHADVARAMLSDFVQMFVLRGFQKNSDLRRTVEPEKMPQVAVDVLQRMLIFALDALAAGVQEESSTHKIVRCWFGVFSGHTLGSVISTDPLKRFFSHTLTQILTHSPVLKASDAVQMQREWSFARTHPLLTSLYRRLFVMLSAEELVGHLQEVLETQEVHWQRVLSFVSALVVCFPEAQQLLEDWVARLMAQAFESCQLDSMVTAFLVVRQAALEGPSAFLSYADWFKASFGSTRGYHGCSKKALVFLFTFLSELVPFESPRYLQVHILHPPLVPSKYRSLLTDYISLAKTRLADLKVSIENMGLYEDLSSAGDITEPHSQALQDVEKAIMVFEHTGNIPVTVMEASIFRRPYYVSHFLPALLTPRVLPKVPDSRVAFIESLKRADKIPPSLYSTYCQACSAAEEKPEDAALGVRAEPNSAEEPLGQLTAALGELRASMTDPSQRDVISAQVAVISERLRAVLGHNEDDSSVEISKIQLSINTPRLEPREHMAVDLLLTSFCQNLMAASSVAPPERQGPWAALFVRTMCGRVLPAVLTRLCQLLRHQGPSLSAPHVLGLAALAVHLGESRSALPEVDVGPPAPGAGLPVPALFDSLLTCRTRDSLFFCLKFCTAAISYSLCKFSSQSRDTLCSCLSPGLIKKFQFLMFRLFSEARQPLSEEDVASLSWRPLHLPSADWQRAALSLWTHRTFREVLKEEDVHLTYQDWLHLELEIQPEADALSDTERQDFHQWAIHEHFLPESSASGGCDGDLQAACTILVNALMDFHQSSRSYDHSENSDLVFGGRTGNEDIISRLQEMVADLELQQDLIVPLGHTPSQEHFLFEIFRRRLQALTSGWSVAASLQRQRELLMYKRILLRLPSSVLCGSSFQAEQPITARCEQFFHLVNSEMRNFCSHGGALTQDITAHFFRGLLNACLRSRDPSLMVDFILAKCQTKCPLILTSALVWWPSLEPVLLCRWRRHCQSPLPRELQKLQEGRQFASDFLSPEAASPAPNPDWLSAAALHFAIQQVREENIRKQLKKLDCEREELLVFLFFFSLMGLLSSHLTSNSTTDLPKAFHVCAAILECLEKRKISWLALFQLTESDLRLGRLLLRVAPDQHTRLLPFAFYSLLSYFHEDAAIREEAFLHVAVDMYLKLVQLFVAGDTSTVSPPAGRSLELKGQGNPVELITKARLFLLQLIPRCPKKSFSHVAELLADRGDCDPEVSAALQSRQQAAPDADLSQEPHLF

SEQ ID NO: 861328 - protein, 1440 aa, Homo sapiens
AQGAAAGAVGAKAMSDSWVPNSASGQDPGGRRRAWAELLAGRVKREKYNPERAQKLKESAVRLLRSHQDLNALLLEVEGPLCKKLSLSKVIDCDSSEAYANHSSSFIGSALQDQASRLGVPVGILSAGMVASSVGQICTAPAETSHPVLLTVEQRKKLSSLLEFAQYLLAHSMFSRLSFCQELWKIQSSLLLEAVWHLHVQGIVSLQELLESHPDMHAVGSWLFRNLCCLCEQMEASCQHADVARAMLSDFVQMFVLRGFQKNSDLRRTVEPEKMPQVAVDVLQRMLIFALDALAAGVQEESSTHKIVRCWFGVFSGHTLGSVISTDPLKRFFSHTLTQILTHSPVLKASDAVQMQREWSFARTHPLLTSLYRRLFVMLSAEELVGHLQEVLETQEVHWQRVLSFVSALVVCFPEAQQLLEDWVARLMAQAFESCQLDSMVTAFLVVRQAALEGPSAFLSYADWFKASFGSTRGYHGCSKKALVFLFTFLSELVPFESPRYLQVHILHPPLVPSKYRSLLTDYISLAKTRLADLKVSIENMGLYEDLSSAGDITEPHSQALQDVEKAIMVFEHTGNIPVTVMEASIFRRPYYVSHFLPALLTPRVLPKVPDSRVAFIESLKRADKIPPSLYSTYCQACSAAEEKPEDAALGVRAEPNSAEEPLGQLTAALGELRASMTDPSQRDVISAQVAVISERLRAVLGHNEDDSSVEISKIQLSINTPRLEPREHMAVDLLLTSFCQNLMAASSVAPPERQGPWAALFVRTMCGRVLPAVLTRLCQLLRHQGPSLSAPHVLGLAALAVHLGESRSALPEVDVGPPAPGAGLPVPALFDSLLTCRTRDSLFFCLKFCTAAISYSLCKFSSQSRDTLCSCLSPGLIKKFQFLMFRLFSEARQPLSEEDVASLSWRPLHLPSADWQRAALSLWTHRTFREVLKEEDVHLTYQDWLHLELEIQPEADALSDTERQDFHQWAIHEHFLPESSASGGCDGDLQAACTILVNALMDFHQEEMVADLELQQDLIVPLGHTPSQEHFLFEIFRRRLQALTSGWSVAASLQRQRELLMYKRILLRLPSSVLCGSSFQAEQPITARCEQFFHLVNSEMRNFCSHGGALTQDITAHFFRGLLNACLRSRDPSLMVDFILAKCQTKCPLILTSALVWWPSLEPVLLCRWRRHCQSPLPRELQKLQEGRQFASDFLSPEAASPAPNPDWLSAAALHFAIQQVREENIRKQLKKLDCEREELLVFLFFFSLMGLLSSHLTSNSTTDLPKAFHVCAAILECLEKRKISWLALFQLTESDLRLGRLLLRVAPDQHTRLLPFAFYSLLSYFHEDAAIREEAFLHVAVDMYLKLVQLFVAGDTSTVSPPAGRSLELKGQGNPVELITKARLFLLQLIPRCPKKSFSHVAELLADRGDCDPEVSAALQSRQQAAPDADLSQEPHLF

SEQ ID NO: 861329 - protein, 1410 aa, Homo sapiens
AQGAAAGAVGAKAMSDSWVPNSASGQDPGGRRRAWAELLAGRVKREKYNPERAQKLKESAVRLLRSHQDLNALLLEVEGPLCKKLSLSKVIDCDSSEAYANHSSSFIGSALQDQASRLGVPVGILSAGMVASSVGQICTAPAETSHPVLLTVEQRKKLSSLLEFAQYLLAHSMFSRLSFCQELWKIQSSLLLEAVWHLHVQGIVSLQELLESHPDMHAVGSWLFRNLCCLCEQMEASCQHADVARAMLSDFVQMFVLRGFQKNSDLRRTVEPEKMPQVAVDVLQRMLIFALDALAAGVQEESSTHKIVRCWFGVFSGHTLGSVISTDPLKRFFSHTLTQILTHSPVLKASDAVQMQREWSFARTHPLLTSLYRRLFVMLSAEELVGHLQEVLETQEVHWQRVLSFVSALVVCFPEAQQLLEDWVARLMAQAFESCQLDSMVTAFLVVRQAALEGPSAFLSYADWFKASFGSTRGYHGCSKKALVFLFTFLSELVPFESPRYLQVHILHPPLVPSKYRSLLTDYISLAKTRLADLKVSIENMGLYEDLSSAGDITEPHSQALQDVEKAIMVFEHTGNIPVTVMEASIFRRPYYVSHFLPALLTPRVLPKVPDSRVAFIESLKRADKIPPSLYSTYCQACSAAEEKPEDAALGVRAEPNSAEEPLGQLTAALGELRASMTDPSQRDVISAQVAVISERLRAVLGHNEDDSSVEISKIQLSINTPRLEPREHMAVDLLLTSFCQNLMAASSVAPPERQGPWAALFVRTMCGRVLPAVLTRLCQLLRHQGPSLSAPHVLGLAALAVHLGESRSALPEVDVGPPAPGAGLPVPALFDSLLTCRTRDSLFFCLKFCTAAISYSLCKFSSQSRDTLCSCLSPGLIKKFQFLMFRLFSEARQPLSEEDVASLSWRPLHLPSADWQRAALSLWTHRTFREVLKEEDVHLTYQDWLHLELEIQPEADALSDTERQDFHQWAIHEHFLPESSASGGCDGDLQAACTILVNALMDFHQSSRSYDHSENSDLVLVAAQEMRILFPDCRILLRLPSSVLCGSSFQAEQPITARCEQFFHLVNSEMRNFCSHGGALTQDITAHFFRGLLNACLRSRDPSLMVDFILAKCQTKCPLILTSALVWWPSLEPVLLCRWRRHCQSPLPRELQKLQEGRQFASDFLSPEAASPAPNPDWLSAAALHFAIQQVREENIRKQLKKLDCEREELLVFLFFFSLMGLLSSHLTSNSTTDLPKAFHVCAAILECLEKRKISWLALFQLTESDLRLGRLLLRVAPDQHTRLLPFAFYSLLSYFHEDAAIREEAFLHVAVDMYLKLVQLFVAGDTSTVSPPAGRSLELKGQGNPVELITKARLFLLQLIPRCPKKSFSHVAELLADRGDCDPEVSAALQSRQQAAPDADLSQEPHLF

SEQ ID NO: 861330 - protein, 1504 aa, Homo sapiens
AQGAAAGAVGAKAMSDSWVPNSASGQDPGGRRRAWAELLAGRVKREKYNPERAQKLKESAVRLLRSHQDLNALLLEVEGPLCKKLSLSKVIDCDSSEAYANHSSSFIGSALQDQASRLGVPVGILSAGMVASSVGQICTAPAETSHPVLLTVEQRKKLSSLLEFAQYLLAHSMFSRLSFCQELWKIQSSLLLEAVWHLHVQGIVSLQELLESHPDMHAVGSWLFRNLCCLCEQMEASCQHADVARAMLSDFVQMFVLRGFQKNSDLRRTVEPEKMPQVAVDVLQRMLIFALDALAAGVQEESSTHKIVRCWFGVFSGHTLGSVISTDPLKRFFSHTLTQILTHSPVLKASDAVQMQREWSFARTHPLLTSLYRRLFVMLSAEELVGHLQEVLETQEVHWQRVLSFVSALVVCFPEAQQLLEDWVARLMAQAFESCQLDSMVTAFLVVRQAALEGPSAFLSYADWFKASFGSTRGYHGCSKKALVFLFTFLSELVPFESPRYLQVHILHPPLVPSKYRSLLTDYISLAKTRLADLKVSIENMGLYEDLSSAGDITEPHSQALQDVEKAIMVFEHTGNIPVTVMEASIFRRPYYVSHFLPALLTPRVLPKVPDSRVAFIESLKRADKIPPSLYSTYCQACSAAEEKPEDAALGVRAEPNSAEEPLGQLTAALGELRASMTDPSQRDVISAQVAVISERLRAVLGHNEDDSSVEISKIQLSINTPRLEPREHMAVDLLLTSFCQNLMAASSVAPPERQGPWAALFVRTMCGRVLPAVLTRLCQLLRHQGPSLSAPHVLGLAALAVHLGESRSALPEVDVGPPAPGAGLPVPALFDSLLTCRTRDSLFFCLKFCTAAISYSLCKFSSQSRDTLCSCLSPGLIKKFQFLMFRLFSEARQPLSEEDVASLSWRPLHLPSADWQRAALSLWTHRTFREVLKEEDVHVGDRSFSCIMPRPESRVCVCSSGKNSSTGHGDVHLQSQPSERLRGRILEFRRQSLQRATIAPLHTLQPGQQNLFPKIMKLTYQDWLHLELEIQPEADALSDTERSRSYDHSENSDLVFGGRTGNEDIISRLQEMVADLELQQDLIVPLGHTPSQEHFLFEIFRRRLQALTSGWSVAASLQRQRELLMYKRILLRLPSSVLCGSSFQAEQPITARCEQFFHLVNSEMRNFCSHGGALTQDITAHFFRGLLNACLRSRDPSLMVDFILAKCQTKCPLILTSALVWWPSLEPVLLCRWRRHCQSPLPRELQKLQEGRQFASDFLSPEAASPAPNPDWLSAAALHFAIQQVREENIRKQLKKLDCEREELLVFLFFFSLMGLLSSHLTSNSTTDLPKAFHVCAAILECLEKRKISWLALFQLTESDLRLGRLLLRVAPDQHTRLLPFAFYSLLSYFHEDAAIREEAFLHVAVDMYLKLVQLFVAGDTSTVSPPAGRSLELKGQGNPVELITKARLFLLQLIPRCPKKSFSHVAELLADRGDCDPEVSAALQSRQQAAPDADLSQEPHLF

SEQ ID NO: 861331 - protein, 1159 aa, Homo sapiens
AQGAAAGAVGAKAMSDSWVPNSASGQDPGGRRRAWAELLAGRVKREKYNPERAQKLKESAVRLLRSHQDLNALLLEVEGPLCKKLSLSKVIDCDSSEAYANHSSSFIGSALQDQASRLGVPVGILSAGMVASSVGQICTAPAETSHPVLLTVEQRKKLSSLLEFAQYLLAHSMFSRLSFCQELWKIQSSLLLEAVWHLHVQGIVSLQELLESHPDMHAVGSWLFRNLCCLCEQMEASCQHADVARAMLSDFVQMFVLRGFQKNSDLRRTVEPEKMPQVAVDVLQRMLIFALDALAAGVQEESSTHKIVRCWFGVFSGHTLGSVISTDPLKRFFSHTLTQILTHSPVLKASDAVQMQREWSFARTHPLLTSLYRRLFVMLSAEELVGHLQEVLETQEVHWQRVLSFVSALVVCFPEAQQLLEAVDLLLTSFCQNLMAASSVAPPERQGPWAALFVRTMCGRVLPAVLTRLCQLLRHQGPSLSAPHVLGLAALAVHLGESRSALPEVDVGPPAPGAGLPVPALFDSLLTCRTRDSLFFCLKFCTAAISYSLCKFSSQSRDTLCSCLSPGLIKKFQFLMFRLFSEARQPLSEEDVASLSWRPLHLPSADWQRAALSLWTHRTFREVLKEEDVHLTYQDWLHLELEIQPEADALSDTERQDFHQWAIHEHFLPESSASGGCDGDLQAACTILVNALMDFHQSSRSYDHSENSDLVFGGRTGNEDIISRLQEMVADLELQQDLIVPLGHTPSQEHFLFEIFRRRLQALTSGWSVAASLQRQRELLMYKRILLRLPSSVLCGSSFQAEQPITARCEQFFHLVNSEMRNFCSHGGALTQDITAHFFRGLLNACLRSRDPSLMVDFILAKCQTKCPLILTSALVWWPSLEPVLLCRWRRHCQSPLPRELQKLQEGRQFASDFLSPEAASPAPNPDWLSAAALHFAIQQVREENIRKQLKKLDCEREELLVFLFFFSLMGLLSSHLTSNSTTDLPKAFHVCAAILECLEKRKISWLALFQLTESDLRLGRLLLRVAPDQHTRLLPFAFYSLLSYFHEDAAIREEAFLHVAVDMYLKLVQLFVAGDTSTVSPPAGRSLELKGQGNPVELITKARLFLLQLIPRCPKKSFSHVAELLADRGDCDPEVSAALQSRQQAAPDADLSQEPHLF

SEQ ID NO: 861332 - protein, 1161 aa, Homo sapiens
FYTLSSPHTGRDPPTLWGWSLTKTHNFLISDLKFLSVSPPAASDAVQMQREWSFARTHPLLTSLYRRLFVMLSAEELVGHLQEVLETQEVHWQRVLSFVSALVVCFPEAQQLLEDWVARLMAQAFESCQLDSMVTAFLVVRQAALEGPSAFLSYADWFKASFGSTRGYHGCSKKALVFLFTFLSELVPFESPRYLQVHILHPPLVPSKYRSLLTDYISLAKTRLADLKVSIENMGLYEDLSSAGDITEPHSQALQDVEKAIMVFEHTGNIPVTVMEASIFRRPYYVSHFLPALLTPRVLPKVPDSRVAFIESLKRADKIPPSLYSTYCQACSAAEEKPEDAALGVRAEPNSAEEPLGQLTAALGELRASMTDPSQRDVISAQVAVISERLRAVLGHNEDDSSVEISKIQLSINTPRLEPREHMAVDLLLTSFCQNLMAASSVAPPERQGPWAALFVRTMCGRVLPAVLTRLCQLLRHQGPSLSAPHVLGLAALAVHLGESRSALPEVDVGPPAPGAGLPVPALFDSLLTCRTRDSLFFCLKFCTAAISYSLCKFSSQSRDTLCSCLSPGLIKKFQFLMFRLFSEARQPLSEEDVASLSWRPLHLPSADWQRAALSLWTHRTFREVLKEEDVHLTYQDWLHLELEIQPEADALSDTERQDFHQWAIHEHFLPESSASGGCDGDLQAACTILVNALMDFHQSSRSYDHSENSDLVFGGRTGNEDIISRLQEMVADLELQQDLIVPLGHTPSQEHFLFEIFRRRLQALTSGWSVAASLQRQRELLMYKRILLRLPSSVLCGSSFQAEQPITARCEQFFHLVNSEMRNFCSHGGALTQDITAHFFRGLLNACLRSRDPSLMVDFILAKCQTKCPLILTSALVWWPSLEPVLLCRWRRHCQSPLPRELQKLQEGRQFASDFLSPEAASPAPNPDWLSAAALHFAIQQVREENIRKQLKKLDCEREELLVFLFFFSLMGLLSSHLTSNSTTDLPKAFHVCAAILECLEKRKISWLALFQLTESDLRLGRLLLRVAPDQHTRLLPFAFYSLLSYFHEDAAIREEAFLHVAVDMYLKLVQLFVAGDTSTVSPPAGRSLELKGQGNPVELITKARLFLLQLIPRCPKKSFSHVAELLADRGDCDPEVSAALQSRQQAAPDADLSQEPHLF

SEQ ID NO: 861333 - protein, 1345 aa, Homo sapiens
MSDSWVPNSASGQDPGGRRRAWAELLAGRVKREKYNPERAQKLKESAVRLLRSHQDLNALLLEVEGPLCKKLSLSKVIDCDSSEAYANHSSSFIGSALQDQASRLGVPVGILSAGMVASSVGQICTAPAETSHPVLLTVEQRKKLSSLLEFAQYLLAHSMFSRLSFCQELWKIQSSLLLEAVWHLHVQGIVSLQELLESHPDMHAVGSWLFRNLCCLCEQMEASCQHADVARAMLSDFVQMFVLRGFQKNSDLRRTVEPEKMPQVAVDVLQRMLIFALDALAAGVQEESSTHKIVRCWFGVFSGHTLGSVISTDPLKRFFSHTLTQILTHSPVLKASDAVQMQREWSFARTHPLLTSLYRRLFVMLSAEELVGHLQEVLETQEVHWQRVLSFVSALVVCFPEAQQLLEDWVARLMAQAFESCQLDSMVTAFLVVRQAALEGPSAFLSYADWFKASFGSTRGYHGCSKKALVFLFTFLSELVPFESPRYLQVHILHPPLVPSKYRSLLTDYISLAKTRLADLKVSIENMGLYEDLSSAGDITEPHSQALQDVEKAIMVFEHTGNIPVTVMEASIFRRPYYVSHFLPALLTPRVLPKVPDSRVAFIESLKRADKIPPSLYSTYCQACSAAEEKPEDAALGVRAEPNSAEEPLGQLTAALGELRASMTDPSQRDVISAQVAVISERLRAVLGHNEDDSSVEISKIQLSINTPRLEPREHMAVDLLLTSFCQNLMAASSVAPPERQGPWAALFVRTMCGRVLPAVLTRLCQLLRHQGPSLSAPHVLGLAALAVHLGESRSALPEVDVGPPAPGAGLPVPALFDSLLTCRTRDSLFFCLKFCTAAISYSLCKFSSQSRDTLCSCLSPGLIKKFQFLMFRLFSEARQPLSEEDVASLSWRPLHLPSADWQRAALSLWTHRTFREVLKEEDVHLTYQDWLHLELEIQPEADALSDTERQDFHQWAIHEHFLPESSASGGCDGDLQAACTILVNALMDFHQSSRSYDHSENSDLVFGGRTGNEDIISRLQEMVADLELQQDLIVPLGHTPSQEHFLFEIFRRRLQALTSGWSVAASLQRQRELLMYKRILLRLPSSVLCGSSFQAEQPITARCEQFFHLVNSEMRNFCSHGGALTQDITAHFFRGLLNACLRSRDPSLMVDFILAKCQTKCPLILTSALVWWPSLEPVLLCRWRRHCQSPLPRELQKLQEGRQFASDFLSPEAASPAPNPDWLSAAALHFAIQQVREENIRKQLKKLDCEREELLVFLFFFSLMGLLSSHLTSNSTTDLPKAFHVCAAILECLEKRKISWLALFQLTESGKKHAAEAQMRRAALFRGILQMVKNEPSLRFLAK

SEQ ID NO: 861334 - protein, 1345 aa, Homo sapiens; identical to SEQ ID NO: 861333

SEQ ID NO: 861335 - protein, 1428 aa, Homo sapiens
AQGAAAGAVGAKAMSDSWVPNSASGQDPGGRRRAWAELLAGRVKREKYNPERAQKLKESAVRLLRSHQDLNALLLEVEGPLCKKLSLSKVIDCDSSEAYANHSSSFIGSALQDQASRLGVPVGILSAGMVASSVGQICTAPAETSHPVLLTVEQRKKLSSLLEFAQYLLAHSMFSRLSFCQELWKIQSSLLLEAVWHLHVQGIVSLQELLESHPDMHAVGSWLFRNLCCLCEQMEASCQHADVARAMLSDFVQMFVLRGFQKNSDLRRTVEPEKMPQVAVDVLQRMLIFALDALAAGVQEESSTHKIVRCWFGVFSGHTLGSVISTDPLKRFFSHTLTQILTHSPVLKASDAVQMQREWSFARTHPLLTSLYRRLFVMLSAEELVGHLQEVLETQEVHWQRVLSFVSALVVCFPEAQQLLEDWVARLMAQAFESCQLDSMVTAFLVVRQAALEGPSAFLSYADWFKASFGSTRGYHGCSKKALVFLFTFLSELVPFESPRYLQVHILHPPLVPSKYRSLLTDYISLAKTRLADLKVSIENMGLYEDLSSAGDITEPHSQALQDVEKAIMVFEHTGNIPVTVMEASIFRRPYYVSHFLPALLTPRVLPKVPDSRVAFIESLKRADKIPPSLYSTYCQACSAAEEKPEDAALGVRAEPNSAEEPLGQLTAALGELRASMTDPSQRDVISAQVAVISERLRAVLGHNEDDSSVEISKIQLSINTPRLEPREHMAVDLLLTSFCQNLMAASSVAPPERQGPWAALFVRTMCGRVLPAVLTRLCQLLRHQGPSLSAPHVLGLAALAVHLGESRSALPEVDVGPPAPGAGLPVPALFDSLLTCRTRDSLFFCLKFCTAAISYSLCKFSSQSRDTLCSCLSPGLIKKFQFLMFRLFSEARQPLSEEDVASLSWRPLHLPSADWQRAALSLWTHRTFREVLKEEDVHLTYQDWLHLELEIQPEADALSDTERQDFHQWAIHEHFLPESSASGGCDGDLQAACTILVNALMDFHQSSRSYDHSENSDLVFGGRTGNEDIISRLQEMVADLELQQDLIVPLGHTPSQEHFLFEIFRRRLQALTSGWSVAASLQRQRELLMYKRILLRLPSSVLCGSSFQAEQPITARCEQFFHLVNSEMRNFCSHGGALTQDITAHFFRGLLNACLRSRDPSLMVDFILAKCQTKCPLILTSALVWWPSLEPVLLCRWRRHCQSPLPRELQKLQEGRQFASDFLSPEAASPAPNPDWLSAAALHFAIQQVREENIRKQLKKLDCEREELLVFLFFFSLMGLLSSHLTSNSTTDLPKAFHVCAAILECLEKRKISWLALFQLTESDLRLGRLLLRVAPDQHTRLLPFAFYRRGHQGRGLPACCCGHVLEAGPALRGWGYKHSFTSSWQEPGAQGSGQPRGTDNKSSSFSAAVNTSVPEKELLTRGRAAG

SEQ ID NO: 861336 - protein, 316 aa, Homo sapiens
WPVGALGACHGWGSGGVSISATLICVLVLSPEVWWPSLEPVLLCRWRRHCQSPLPRELQKLQEGRQFASDFLSPEAASPAPNPDWLSAAALHFAIQQVREENIRKQLKKLDCEREELLVFLFFFSLMGLLSSHLTSNSTTDLPKAFHVCAAILECLEKRKISWLALFQLTESDLRLGRLLLRVAPDQHTRLLPFAFYSLLSYFHEDAAIREEAFLHVAVDMYLKLVQLFVAGDTSTVSPPAGRSLELKGQGNPVELITKARLFLLQLIPRCPKKSFSHVAELLADRGDCDPEVSAALQSRQQAAPDADLSQEPHLF

SEQ ID NO: 861337 - protein, 1345 aa, Homo sapiens; identical to SEQ ID NO: 861333

SEQ ID NO: 861338 - protein, 1345 aa, Homo sapiens; identical to SEQ ID NO: 861333

SEQ ID NO: 861339 - protein, 1204 aa, Homo sapiens
AQGAAAGAVGAKAMSDSWVPNSASGQDPGGRRRAWAELLAGRVKREKYNPERAQKLKESAVRLLRSHQDLNALLLEVEGPLCKKLSLSKVIDCDSSEAYANHSSSFIGSALQDQASRLGVPVGILSAGMVASSVGQICTAPAETSHPVLLTVEQRKKLSSLLEFAQYLLAHSMFSRLSFCQELWKIQSSLLLEAVWHLHVQGIVSLQELLESHPDMHAVGSWLFRNLCCLCEQMEASCQHADVARAMLSDFVQMFVLRGFQKNSDLRRTVEPEKMPQVAVDVLQRMLIFALDALAAGVQEESSTHKIVRCWFGVFSGHTLGSVISTDPLKRFFSHTLTQILTHSPVLKASDAVQMQREWSFARTHPLLTSLYRRLFVMLSAEELVGHLQEVLETQEVHWQRVLSFVSALVVCFPEAQQLLEDWVARLMAQAFESCQLDSMVTAFLVVRQAALEGPSAFLSYADWFKASFGSTRGYHGCSKKALVFLFTFLSELVPFESPRYLQVHILHPPLVPSKYRSLLTDYISLAKTRLADLKVSIENMGLYEDLSSAGDITEPHSQALQDVEKAIMVFEHTGNIPVTVMEASIFRRPYYVSHFLPALLTPRVLPKVPDSRVAFIESLKRADKIPPSLYSTYCQACSAAEEKPEDAALGVRAEPNSAEEPLGQLTAALGELRASMTDPSQRDVISAQVAVISERLRAVLGHNEDDSSVEISKIQLSINTPRLEPREHMAVDLLLTSFCQNLMAASSVAPPERQGPWAALFVRTMCGRVLPAVLTRLCQLLRHQGPSLSAPHVLGLAALAVHLGESRSALPEVDVGPPAPGAGLPVPALFDSLLTCRTRDSLFFCLKFCTAAISYSLCKFSSQSRDTLCSCLSPGLIKKFQFLMFRLFSEARQPLSEEDVASLSWRPLHLPSADWQRAALSLWTHRTFREVLKEEDVHLTYQDWLHLELEIQPEADALSDTERQDFHQWAIHEHFLPESSASGGCDGDLQAACTILVNALMDFHQSSRSYDHSENSDLVFGGRTGNEDIISRLQEMVADLELQQDLIVPLGHTPSQEHFLFEIFRRRLQALTSGWSVAASLQRQRELLMYKRILLRLPSSVLCGSSFQAEQPITARCEQFFHLVNSEMRNFCSHGGALTQDITAHFFRGLLNACLRSRDPSLMVDFILAKCQTKCPLILTSALVFGWAPNPGNPVALLPGWKE

SEQ ID NO: 861340 - protein, 310 aa, Homo sapiens
AQGAAAGAVGAKAMSDSWVPNSASGQDPGGRRRAWAELLAGRVKREKYNPERAQKLKESAVRLLRSHQDLNALLLEVEGPLCKKLSLSKVIDCDSSEAYANHSSSFIGSALQDQASRLGVPVGILSAGMVASSVGQICTAPAETSHPVLLTVEQRKKLSSLLEFAQYLLAHSMFSRLSFCQELWKIQSSLLLEAVWHLHVQGIVSLQELLESHPDMHAVGSWLFRNLCCLCEQMEASCQHADVARAMLSDFVQMFVLRGFQKNSDLRRTVEPEKMPQVAVDVLQRMLIFALDALAAGVQEESSTHKIVRC

SEQ ID NO: 861341 - protein, 310 aa, Homo sapiens; identical to SEQ ID NO: 861340

SEQ ID NO: 861342 - protein, 66 aa, Homo sapiens
KRLGIVSGGLPPCADICFLFLALSSVALDALAAGVQEESSTHKIVRCWYVPEGGLPECAAGRCLPN

SEQ ID NO: 861343 - protein, 247 aa, Homo sapiens
MSDSWVPNSASGQDPGGRRRAWAELLGRWARQAAGVGGVRPGTVSPVPRSLPARASAGRIPGRRARGAVRGGRPAGAARLPRTRPLLRLGGRPPDRRPRGAPFFPERRPRRPPCQAGLGCAAWGSPQRRGRPSPAVPGLPCLGPSWAVFPGVRGGAVSVSFPRPAPWGGAPAPLREGVAGGFLRGVHLRVGPGTPCVNCAVMVSNRLLSVAGRVKREKYNPERAQKLKESAVRLLRSHQDLNALLLE

SEQ ID NO: 861344 - protein, 310 aa, Homo sapiens; identical to SEQ ID NO: 861340

SEQ ID NO: 861345 - protein, 1520 aa, Homo sapiens
AQGAAAGAVGAKAMSDSWVPNSASGQDPGGRRRAWAELLAGRVKREKYNPERAQKLKESAVRLLRSHQDLNALLLEVEGPLCKKLSLSKVIDCDSSEAYANHSSSFIGSALQDQASRLGVPVGILSAGMVASSVGQICTAPAETSHPVLLTVEQRKKLSSLLEFAQYLLAHSMFSRLSFCQELWKIQSSLLLEAVWHLHVQGIVSLQELLESHPDMHAVGSWLFRNLCCLCEQMEASCQHADVARAMLSDFVQMFVLRGFQKNSDLRRTVEPEKMPQVAVDVLQRMLIFALDALAAGVQEESSTHKIVRCWFGVFSGHTLGSVISTDPLKRFFSHTLTQILTHSPVLKASDAVQMQREWSFARTHPLLTSLYRRLFVMLSAEELVGHLQEVLETQEVHWQRVLSFVSALVVCFPEAQQLLEDWVARLMAQAFESCQLDSMVTAFLVVRQAALEGPSAFLSYADWFKASFGSTRGYHGCSKKALVFLFTFLSELVPFESPRYLQVHILHPPLVPSKYRSLLTDYISLAKTRLADLKVSIENMGLYEDLSSAGDITEPHSQALQDVEKAIMVFEHTGNIPVTVMEASIFRRPYYVSHFLPALLTPRVLPKVPDSRVAFIESLKRADKIPPSLYSTYCQACSAAEEKPEDAALGVRAEPNSAEEPLGQLTAALGELRASMTDPSQRDVISAQVAVISERLRAVLGHNEDDSSVEISKIQLSINTPRLEPREHMAVDLLLTSFCQNLMAASSVAPPERQGPWAALFVRTMCGRVLPAVLTRLCQLLRHQGPSLSAPHVLGLAALAVHLGESRSALPEVDVGPPAPGAGLPVPALFDSLLTCRTRDSLFFCLKFCTAAISYSLCKFSSQSRDTLCSCLSPGLIKKFQFLMFRLFSEARQPLSEEDVASLSWRPLHLPSADWQRAALSLWTHRTFREVLKEEDVHVVMVMLHLQSQPSERLRGRILEFRRQSLQRATIAPLHTLQPGQQNLFPKIMKLTYQDWLHLELEIQPEADALSDTERQDFHQWAIHEHFLPESSASGGCDGDLQAACTILVNALMDFHQSSRSYDHSENSDLVFGGRTGNEDIISRLQEMVADLELQQDLIVPLGHTPSQEHFLFEIFRRRLQALTSGWSVAASLQRQRELLMYKRILLRLPSSVLCGSSFQAEQPITARCEQFFHLVNSEMRNFCSHGGALTQDITAHFFRGLLNACLRSRDPSLMVDFILAKCQTKCPLILTSALVWWPSLEPVLLCRWRRHCQSPLPRELQKLQEGRQFASDFLSPEAASPAPNPDWLSAAALHFAIQQVREENIRKQLKKLDCEREELLVFLFFFSLMGLLSSHLTSNSTTDLPKAFHVCAAILECLEKRKISWLALFQLTESDLRLGRLLLRVAPDQHTRLLPFAFYSLLSYFHEDAAIREEAFLHVAVDMYLKLVQLFVAGDTSTVSPPAGRSLELKGQGNPVELITKARLFLLQLIPRCPKKSFSHVAELLADRGDCDPEVSAALQSRQQAAPDADLSQEPHLF

SEQ ID NO: 861346 - protein, 1425 aa, Homo sapiens
AQGAAAGAVGAKAMSDSWVPNSASGQDPGGRRRAWAELLAGRVKREKYNPERAQKLKESAVRLLRSHQDLNALLLEVEGPLCKKLSLSKVIDCDSSEAYANHSSSFIGSALQDQASRLGVPVGILSAGMVASSVGQICTAPAETSHPVLLTVEQRKKLSSLLEFAQYLLAHSMFSRLSFCQELWKIQSSLLLEAVWHLHVQGIVSLQELLESHPDMHAVGSWLFRNLCCLCEQMEASCQHADVARAMLSDFVQMFVLRGFQKNSDLRRTVEPEKMPQVAVDVLQRMLIFALDALAAGVQEESSTHKIVRCWFGVFSGHTLGSVISTDPLKRFFSHTLTQILTHSPVLKASDAVQMQREWSFARTHPLLTSLYRRLFVMLSAEELVGHLQEVLETQEVHWQRVLSFVSALVVCFPEAQQLLEDWVARLMAQAFESCQLDSMVTAFLVVRQAALEGPSAFLSYADWFKASFGSTRGYHGCSKKALVFLFTFLSELVPFESPRYLQVHILHPPLVPSKYRSLLTDYISLAKTRLADLKVSIENMGLYEDLSSAGDITEPHSQALQDVEKAIMVFEHTGNIPVTVMEASIFRRPYYVSHFLPALLTPRVLPKVPDSRVAFIESLKRADKIPPSLYSTYCQACSAAEEKPEDAALGVRAEPNSAEEPLGQLTAALGELRASMTDPSQRDVISAQVAVISERLRAVLGHNEDDSSVEISKIQLSINTPRLEPREHMAVDLLLTSFCQNLMAASSVAPPERQGPWAALFVRTMCGRVLPAVLTRLCQLLRHQGPSLSAPHVLGLAALAVHLGESRSALPEVDVGPPAPGAGLPVPALFDSLLTCRTRDSLFFCLKFCTAAISYSLCKFSSQSRDTLCSCLSPGLIKKFQFLMFRLFSEARQPLSEEDVASLSWRPLHLPSADWQRAALSLWTHRTFREVLKEEDVHLTYQDWLHLELEIQPEADALSDTERSRSYDHSENSDLVFGGRTGNEDIISRLQEMVADLELQQDLIVPLGHTPSQEHFLFEIFRRRLQALTSGWSVAASLQRQRELLMYKRILLRLPSSVLCGSSFQAEQPITARCEQFFHLVNSEMRNFCSHGGALTQDITAHFFRGLLNACLRSRDPSLMVDFILAKCQTKCPLILTSALVWWPSLEPVLLCRWRRHCQSPLPRELQKLQEGRQFASDFLSPEAASPAPNPDWLSAAALHFAIQQVREENIRKQLKKLDCEREELLVFLFFFSLMGLLSSHLTSNSTTDLPKAFHVCAAILECLEKRKISWLALFQLTESDLRLGRLLLRVAPDQHTRLLPFAFYSLLSYFHEDAAIREEAFLHVAVDMYLKLVQLFVAGDTSTVSPPAGRSLELKGQGNPVELITKARLFLLQLIPRCPKKSFSHVAELLADRGDCDPEVSAALQSRQQAAPDADLSQEPHLF

SEQ ID NO: 861347 - protein, 1446 aa, Homo sapiens
NLRLGTRLGVEGWAELLAGRVKREKYNPERAQKLKESAVRLLRSHQDLNALLLEVEGPLCKKLSLSKVIDCDSSEAYANHSSSFIGSALQDQASRLGVPVGILSAGMVASSVGQICTAPAETSHPVLLTVEQRKKLSSLLEFAQYLLAHSMFSRLSFCQELWKIQSSLLLEAVWHLHVQGIVSLQELLESHPDMHAVGSWLFRNLCCLCEQMEASCQHADVARAMLSDFVQMFVLRGFQKNSDLRRTVEPEKMPQVAVDVLQRMLIFALDALAAGVQEESSTHKIVRCWFGVFSGHTLGSVISTDPLKRFFSHTLTQILTHSPVLKASDAVQMQREWSFARTHPLLTSLYRRLFVMLSAEELVGHLQEVLETQEVHWQRVLSFVSALVVCFPEAQQLLEDWVARLMAQAFESCQLDSMVTAFLVVRQAALEGPSAFLSYADWFKASFGSTRGYHGCSKKALVFLFTFLSELVPFESPRYLQVHILHPPLVPSKYRSLLTDYISLAKTRLADLKVSIENMGLYEDLSSAGDITEPHSQALQDVEKAIMVFEHTGNIPVTVMEASIFRRPYYVSHFLPALLTPRVLPKVPDSRVAFIESLKRADKIPPSLYSTYCQACSAAEEKPEDAALGVRAEPNSAEEPLGQLTAALGELRASMTDPSQRDVISAQVAVISERLRAVLGHNEDDSSVEISKIQLSINTPRLEPREHMAVDLLLTSFCQNLMAASSVAPPERQGPWAALFVRTMCGRVLPAVLTRLCQLLRHQGPSLSAPHVLGLAALAVHLGESRSALPEVDVGPPAPGAGLPVPALFDSLLTCRTRDSLFFCLKFCTAAISYSLCKFSSQSRDTLCSCLSPGLIKKFQFLMFRLFSEARQPLSEEDVASLSWRPLHLPSADWQRAALSLWTHRTFREVLKEEDVHLTYQDWLHLELEIQPEADALSDTERQDFHQWAIHEHFLPESSASGGCDGDLQAACTILVNALMDFHQSSRSYDHSENSDLVFGGRTGNEDIISRLQEMVADLELQQDLIVPLGHTPSQEHFLFEIFRRRLQALTSGWSVAASLQRQRELLMYKRILLRLPSSVLCGSSFQAEQPITARCEQFFHLVNSEMRNFCSHGGALTQDITAHFFRGLLNACLRSRDPSLMVDFILAKCQTKCPLILTSALVWWPSLEPVLLCRWRRHCQSPLPRELQKLQEGRQFASDFLSPEAASPAPNPDWLSAAALHFAIQQVREENIRKQLKKLDCEREELLVFLFFFSLMGLLSSHLTSNSTTDLPKAFHVCAAILECLEKRKISWLALFQLTESDLRLGRLLLRVAPDQHTRLLPFAFYSLLSYFHEDAAIREEAFLHVAVDMYLKLVQLFVAGDTSTVSPPAGRSLELKGQGNPVELITKARLFLLQLIPRCPKKSFSHVAELLADRGDCDPEVSAALQSRQQAAPDADLSQEPHLF

SEQ ID NO: 861348 - protein, 1447 aa, Homo sapiens
AQGAAAGAVGAKAMSDSWVPNSASGQDPGGRRRAWAELLAGRVKREKYNPERAQKLKESAVRLLRSHQDLNALLLEVEGPLCKKLSLSKVIDCDSSEAYANHSSSFIGSALQDQASRLGVPVGILSAGMVASSVGQICTAPAETSHPVLLTVEQRKKLSSLLEFAQYLLAHSMFSRLSFCQELWKIQSSLLLEAVWHLHVQGIVSLQELLESHPDMHAVGSWLFRNLCCLCEQMEASCQHADVARAMLSDFVQMFVLRGFQKNSDLRRTVEPEKMPQVAVDVLQRMLIFALDALAAGVQEESSTHKIVRCWFGVFSGHTLGSVISTDPLKRFFSHTLTQILTHSPVLKASDAVQMQREWSFARTHPLLTSLYRRLFVMLSAEELVGHLQEVLETQEVHWQRVLSFVSALVVCFPEAQQLLEDWVARLMAQAFESCQLDSMVTAFLVVRQAALEGPSAFLSYADWFKASFGSTRGYHGCSKKALVFLFTFLSELVPFESPRYLQVHILHPPLVPSKYRSLLTDYISLAKTRLADLKVSIENMGLYEDLSSAGDITEPHSQALQDVEKAIMVFEHTGNIPVTVMEASIFRRPYYVSHFLPALLTPRVLPKVPDSRVAFIESLKRADKIPPSLYSTYCQACSAAEEKPEDAALGVRAEPNSAEEPLGQLTAALGELRASMTDPSQRDVISAQVAVISERLRAVLGHNEDDSSVEISKIQLSINTPRLEPREHMAVDLLLTSFCQNLMAASSVAPPERQGPWAALFVRTMCGRVLPAVLTRLCQLLRHQGPSLSAPHVLGLAALAVHLGESRSALPEVDVGPPAPGAGLPVPALFDSLLTCRTRDSLFFCLKFCTAAISYSLCKFSSQSRDTLCSCLSPGLIKKFQFLMFRLFSEARQPLSEEDVASLSWRPLHLPSADWQRAALSLWTHRTFREVLKEEDVHLTYQDWLHLELEIQPEADALSDTERQDFHQWAIHEHFLPESSASGGCDGDLQAACTILVNALMDFHQSSRSYDHSENSDLVFGGRTGNEDIISRLQEMVADLELQQDLIVPLGHTPSQEHFLFEIFRRRLQALTSGWSVAASLQRQRELLMYKRILLRLPSSVLCGSSFQAEQPITARCEQFFHLVNSEMRNFCSHGGALTQDITAHFFRGLLNACLRSRDPSLMVDFILAKCQTKCPLILTSALVWWPSLEPVLLCRWRRHCQSPLPRELQKLQEGRQFASDFLSPEAASPAPNPDWLSAAALHFAIQQVREENIRKQLKKLDCEREESTTDLPKAFHVCAAILECLEKRKISWLALFQLTESDLRLGRLLLRVAPDQHTRLLPFAFYSLLSYFHEDAAIREEAFLHVAVDMYLKLVQLFVAGDTSTVSPPAGRSLELKGQGNPVELITKARLFLLQLIPRCPKKSFSHVAELLADRGDCDPEVSAALQSRQQAAPDADLSQEPHLF

SEQ ID NO: 861349 - protein, 1345 aa, Homo sapiens; identical to SEQ ID NO: 861333

SEQ ID NO: 861350 - protein, 1345 aa, Homo sapiens; identical to SEQ ID NO: 861333

SEQ ID NO: 861351 - protein, 1446 aa, Homo sapiens
AQGAAAGAVGAKAMSDSWVPNSASGQDPGGRRRAWAELLAGRVKREKYNPERAQKLKESAVRLLRSHQDLNALLLEVEGPLCKKLSLSKVIDCDSSEAYANHSSSFIGSALQDQASRLGVPVGILSAGMVASSVGQICTAPAETSHPVLLTVEQRKKLSSLLEFAQYLLAHSMFSRLSFCQELWKIQSSLLLEAVWHLHVQGIVSLQELLESHPDMHAVGSWLFRNLCCLCEQMEASCQHADVARAMLSDFVQMFVLRGFQKNSDLRRTVEPEKMPQVAVDVLQRMLIFALDALAAGVQEESSTHKIVRCWFGVFSGHTLGSVISTDPLKRFFSHTLTQILTHSPVLKASDAVQMQREWSFARTHPLLTSLYRRLFVMLSAEELVGHLQEVLETQEVHWQRVLSFVSALVVCFPEAQQLLEDWVARLMAQAFESCQLDSMVTAFLVVRQAALEGPSAFLSYADWFKASFGSTRGYHGCSKKALVFLFTFLSELVPFESPRYLQVHILHPPLVPSKYRSLLTDYISLAKTRLADLKVSIENMGLYEDLSSAGDITEPHSQALQDVEKAIMVFEHTGNIPVTVMEASIFRRPYYVSHFLPALLTPRVLPKVPDSRVAFIESLKRADKIPPSLYSTYCQACSAAEEKPEDAALGVRAEPNSAEEPLGQLTAALGELRASMTDPSQRDVISAQVAVISERLRAVLGHNEDDSSVEISKIQLSINTPRLEPREHMAVDLLLTSFCQNLMAASSVAPPERQGPWAALFVRTMCGRVLPAVLTRLCQLLRHQGPSLSAPHVLGLAALAVHLGESRSALPEVDVGPPAPGAGLPVPALFDSLLTCRTRDSLFFCLKFCTAAISYSLCKFSSQSRDTLCSCLSPGLIKKFQFLMFRLFSEARQPLSEEDVASLSWRPLHLPSADWQRAALSLWTHRTFREVLKEEDVHLTYQDWLHLELEIQPEADALSDTERQDFHQWAIHEHFLPESSASGGCDGDLQAACTILVNALMDFHQSSRSYDHSENSDLVFGGRTGNEDIISRLQEMVADLELQQDLIVPLGHTPSQEHFLFEIFRRRLQALTSGWSVAASLQRQRELLMYKRILLRLPSSVLCGSSFQAEQPITARCEQFFHLVNSEMRNFCSHGGALTQDITAHFFRGLLNACLRSRDPSLMVDFILAKCQTKCPLILTSALVWWPSLEPVLLCRWRRHCQSPLPRELQKLQEGRQFASDFLSPEAASPAPNPDWLSAAALHFAIQQVREENIRKQLKKLDCEREELLVFLFFFSLMGLLSSHLTSNSTTDLPKAFHVCAAILECLEKRKISWLALFQLTESDLRLGRLLLRVAPDQHTRLLPFAFYSLLSYFHEDAAIREEAFLHVAVDMYLKLVQLFVAGDTSTVSPPAGRSLELKGQGNPVELITKARLFLLQLIPRCPKKSFSHVAEVTSRCPPWATWGT

SEQ ID NO: 861352 - protein, 1440 aa, Homo sapiens
AQGAAAGAVGAKAMSDSWVPNSASGQDPGGRRRAWAELLAGRVKREKYNPERAQKLKESAVRLLRSHQDLNALLLEVEGPLCKKLSLSKVIDCDSSEAYANHSSSFIGSALQDQASRLGVPVGILSAGMVASSVGQICTAPAETSHPVLLTVEQRKKLSSLLEFAQYLLAHSMFSRLSFCQELWKIQSSLLLEAVWHLHVQGIVSLQELLESHPDMHAVGSWLFRNLCCLCEQMEASCQHADVARAMLSDFVQMFVLRGFQKNSDLRRTVEPEKMPQVAVDVLQRMLIFALDALAAGVQEESSTHKIVRCWFGVFSGHTLGSVISTDPLKRFFSHTLTQILTHSPVLKASDAVQMQREWSFARTHPLLTSLYRRLFVMLSAEELVGHLQEVLETQEVHWQRVLSFVSALVVCFPEAQQLLEDWVARLMAQAFESCQLDSMVTAFLVVRQAALEGPSAFLSYADWFKASFGSTRGYHGCSKKALVFLFTFLSELVPFESPRYLQVHILHPPLVPSKYRSLLTDYISLAKTRLADLKVSIENMGLYEDLSSAGDITEPHSQALQDVEKAIMVFEHTGNIPVTVMEASIFRRPYYVSHFLPALLTPRVLPKVPDSRVAFIESLKRADKIPPSLYSTYCQACSAAEEKPEDAALGVRAEPNSAEEPLGQLTAALGELRASMTDPSQRDVISAQVAVISERLRAVLGHNEDDSSVEISKIQLSINTPRLEPREHMAVDLLLTSFCQNLMAASSVAPPERQGPWAALFVRTMCGRVLPAVLTRLCQLLRHQGPSLSAPHVLGLAALAVHLGESRSALPEVDVGPPAPGAGLPVPALFDSLLTCRTRDSLFFCLKFCTAAISYSLCKFSSQSRDTLCSCLSPGLIKKFQFLMFRLFSEARQPLSEEDVASLSWRPLHLPSADWQRAALSLWTHRTFREVLKEEDVHLTYQDWLHLELEIQPEADALSDTERQDFHQWAIHEHFLPESSASGGCDGDLQAACTILVNALMDFHQSSRSYDHSENSDLVFGGRTGNEDIISRLQEMVADLELQQDLIVPLGHTPSQEHFLFEIFRRRLQALTSGWSVAASLQRQRELLMYKRILLRLPSSVLCGSSFQAEQPITARCEQFFHLVNSEMRNFCSHGGALTQDITAHFFRGLLNACLRSRDPSLMVDFILAKCQTKCPLILTSALVWWPSLEPVLLCRWRRHCQSPLPRELQKLQEGRQFASDFLSPEAASPAPNPDWLSAAALHFAIQQVREENIRKQLKKLDCEREELLVFLFFFSLMGLLSSHLTSNSTTDLPKAFHVCAAILECLEKRKISWLALFQLTESDLRLGRLLLRVAPDQHTRLLPFAFYSLLSYFHEDAAIREEAFLHVAVDMYLKLVQLFVAGDTSTVSPPAGRSLELKGQVQGPVPPPGELPPAGGSFCQRMFRHSMQTMGDTPALFL

SEQ ID NO: 861353 - protein, 266 aa, Homo sapiens
MALGTRLGVGSYKKAAVCSDFLSPEAASPAPNPDWLSAAALHFAIQQVREENIRKQLKKLDCEREELLVFLFFFSLMGLLSSHLTSNSTTDLPKAFHVCAAILECLEKRKISWLALFQLTESDLRLGRLLLRVAPDQHTRLLPFAFYSLLSYFHEDAAIREEAFLHVAVDMYLKLVQLFVAGDTSTVSPPAGRSLELKGQGNPVELITKARLFLLQLIPRCPKKSFSHVAELLADRGDCDPEVSAALQSRQQAAPDADLSQEPHLF

SEQ ID NO: 861354 - protein, 252 aa, Homo sapiens
RGSIRPVEISIVHKVITTTDYTWRSRRARGTQGDCLSLHHTHPPARGRPPHPLPAADRYLGILSSGCSPHTIPTGRPPRVHVPTPRGVPSTDNRQRCPELPEPLLGVADLRLGRLLLRVAPDQHTRLLPFAFYSLLSYFHEDAAIREEAFLHVAVDMYLKLVQLFVAGDTSTVSPPAGRSLELKGQGNPVELITKARLFLLQLIPRCPKKSFSHVAELLADRGDCDPEVSAALQSRQQAAPDADLSQEPHLF

SEQ ID NO: 861355 - protein, 1289 aa, Homo sapiens
AQGAAAGAVGAKAMSDSWVPNSASGQDPGGRRRAWAELLAGRVKREKYNPERAQKLKESAVRLLRSHQDLNALLLEVEGPLCKKLSLSKVIDCDSSEAYANHSSSFIGSALQDQASRLGVPVGILSAGMVASSVGQICTAPAETSHPVLLTVEQRKKLSSLLEFAQYLLAHSMFSRLSFCQELWKIQSSLLLEAVWHLHVQGIVSLQELLESHPDMHAVGSWLFRNLCCLCEQMEASCQHADVARAMLSDFVQMFVLRGFQKNSDLRRTVEPEKMPQVAVDVLQRMLIFALDALAAGVQEESSTHKIVRCWFGVFSGHTLGSVISTDPLKRFFSHTLTQILTHSPVLKASDAVQMQREWSFARTHPLLTSLYRRLFVMLSAEELVGHLQEVLETQEVHWQRVLSFVSALVVCFPEAQQLLEDWVARLMAQAFESCQLDSMVTAFLVVRQAALEGPSAFLSYADWFKASFGSTRGYHGCSKKALVFLFTFLSELVPFESPRYLQVHILHPPLVPSKYRSLLTDYISLAKTRLADLKVSIENMGLYEDLSSAGDITEPHSQALQDVEKAIMVFEHTGNIPVTVMEASIFRRPYYVSHFLPALLTPRVLPKVPDSRVAFIESLKRADKIPPSLYSTYCQACSAAEEKPEDAALGVRAEPNSAEEPLGQLTAALGELRASMTDPSQRDVISAQVAVISERLRAVLGHNEDDSSVEISKIQLSINTPRLEPREHMAVDLLLTSFCQNLMAASSVAPPERQGPWAALFVRTMCGRVLPAVLTRLCQLLRHQGPSLSAPHVLGLAALAVHLGESRSALPEVDVGPPAPGAGLPVPALFDSLLTCRTRDSLFFCLKFCTAAISYSLCKFSSQSRDTLCSCLSPGLIKKFQFLMFRLFSEARQPLSEEDVASLSWRPLHLPSADWQRAALSLWTHRTFREVLKEEDVHLTYQDWLHLELEIQPEADALSDTERQDFHQWAIHEHFLPESSASGGCDGDLQAACTILVNALMDFHQSSRSYDHSENSDLVFGGRTGNEDIISRLQEMVADLELQQDLIVPLGHTPSQEHFLFEIFRRRLQALTSGWSVAASLQRQRELLMYKRILLRLPSSVLCGSSFQAEQPITARCEQFFHLVNSEMRNFCSHGGALTQDITAHFFRGLLNACLRSRDPSLMVDFILAKCQTKCPLILTSALVWWPSLEPVLLCRWRRHCQSPLPRELQKLQEGRQFASEYVWVVRWGVPAQMHFGTCSRSSPKHPGLLERSGVGSLSCEQGEKNRVLVVVGACNPNYWGGRGRRIS

SEQ ID NO: 861356 - protein, 492 aa, Homo sapiens
AQGAAAGAVGAKAMSDSWVPNSASGQDPGGRRRAWAELLAGRVKREKYNPERAQKLKESAVRLLRSHQDLNALLLEVEGPLCKKLSLSKVIDCDSSEAYANHSSSFIGSALQDQASRLGVPVGILSAGMVASSVGQICTAPAETSHPVLLTVEQRKKLSSLLEFAQYLLAHSMFSRLSFCQELWKIQSSLLLEAVWHLHVQGIVSLQELLESHPDMHAVGSWLFRNLCCLCEQMEASCQHADVARAMLSDFVQMFVLRGFQKNSDLRRTVEPEKMPQVAVDVLQRMLIFALDALAAGVQEESSTHKIVRCWFGVFSGHTLGSVISTDPLKRFFSHTLTQILTHSPVLKASDAVQMQREWSFARTHPLLTSLYRRLFVMLSAEELVGHLQEVLETQEVHWQRVLSFVSALVVCFPEAQQLLEDWVARLMAQAFESCQLDSMVTAFLVVRQAALEGPSAFLSYADWFKVSDLPIGYLIPDLPRRPGSGDHAVPT

SEQ ID NO: 861357 - protein, 310 aa, Homo sapiens; identical to SEQ ID NO: 861340

SEQ ID NO: 861358 - protein, 84 aa, Homo sapiens
LPRELQKLQEGRQFASEYVWVVRWGVPAQMHFGTCSRSSPKHPGLLERSGVGSLSCEQGEKNRVLVVVGACNPNYWGGRGRRIS

SEQ ID NO: 861359 - protein, 249 aa, Homo sapiens
MAMLRVQPEAQAKVDVFREDLCTKTENLLGSYFPKKISELDAFLKEPALNEANLSNLKAPLDIPVPDPVKEKEKEERKKQQEKEDKDEKKKGEDEDKGPPCGPVNCNEKIVVLLQRLKPEIKDVIEQLNLVTTWLQLQIPRIEDGNNFGVAVQEKVFELMTSLHTKLEGFHTQISKYFSERGDAVTKAAKQPHVGDYRQLVHELDEAEYRDIRLMVMEIRNAYAVLYDIILKNFEKLKKPRGETKGMIY

SEQ ID NO: 861360 - protein, 251 aa, Homo sapiens
GAGCERPTAFAFPSRCPLHSLCGARPPVPVMAMLRVQPEAQAKVDVFREDLCTKTENLLGSYFPKKISELDAFLKEPALNEANLSNLKAPLDIPVPDPVKEKEKEERKKQQEKEDKDEKKKGEDEDKGPPCGPVNCNEKIVVLLQRLKPEIKDVIEQLNLVTTWLQLQIPRIEDGNNFGVAVQQKLFRVVTRLHTKLDGLHIFSNPLSMRCDGTDSWNHACPLIDAIWQASSQALLRITTSLPPFLPLWSF

SEQ ID NO: 861361 - protein, 138 aa, Homo sapiens
QKINSLSFAGPPYKDMAMLRVQARGPSQGEMCFEKTYVTKTENLLGSYFPKKISELDAFLKEPALNEANLSNLKAPLDIPVPDPVKEKEKEERKKQQEKEDKDEKKKGEDEDKGPPCGPVNCNEKIGHHLVAAADTSD

SEQ ID NO: 861362 - protein, 278 aa, Homo sapiens
MAMLRVQPEAQAKVRPYITLRELSSNELALKPSFWRDACAPQVDVFREDLCTKTENLLGSYFPKKISELDAFLKEPALNEANLSNLKAPLDIPVPDPVKEKEKEERKKQQEKEDKDEKKKGEDEDKGPPCGPVNCNEKIVVLLQRLKPEIKDVIEQLNLVTTWLQLQIPRIEDGNNFGVAVQEKVFELMTSLHTKLEGFHTQISKYFSERGDAVTKAAKQPHVGDYRQLVHELDEAEYRDIRLMVMEIRNAYAVLYDIILKNFEKLKKPRGETKGMIY

SEQ ID NO: 861363 - protein, 250 aa, Homo sapiens
MAMLRVQPEAQAKVDVFREDLCTKTENLLGSYFPKKISELDAFLKEPALNEANLSNLKAPLDIPVPDPVKEKEKEERKKQQEKEDKDEKKKGEDEDKGPPCGPVNCNEKIVVLLQRLKPEIKDVIEQLNLVTTWLQLQIPRIEDGNNFGVAVQEKVFELMTSLHTKLEGFHTQISKYFSERGDAVTKAAKQPHVGDYRQLVHELDEAEYRDIRLMVMEIRNAYVRRQGQGRGGQRQLSQATHSLTLQARG

SEQ ID NO: 861364 - protein, 207 aa, Homo sapiens
MVVLFSKMPDVYGFLRSQCLLSSLSALLLSAAAAADKQQEKEDKDEKKKGEDEDKGPPCGPVNCNEKIVVLLQRLKPEIKDVIEQLNLVTTWLQLQIPRIEDGNNFGVAVQEKVFELMTSLHTKLEGFHTQISKYFSERGDAVTKAAKQPHVGDYRQLVHELDEAEYRDIRLMVMEIRNAYAVLYDIILKNFEKLKKPRGETKGMIY

SEQ ID NO: 861365 - protein, 194 aa, Homo sapiens
GAGCERPTAFAFPSRCPLHSLCGARPPVPVMAMLRVQPEAQAKVDVFREDLCTKTENLLGSYFPKKISELDAFLKEPALNEANLSNLKAPLDIPVPDPVKEKEKEERKKQQEKEDKDEKKKGEDEDKGPPCGPVNCNEKIVVLLQRLKPEIKDVIEQLNLVTTWLQLQIPRIEDGNNFGVAVQVRALPHFPALF

SEQ ID NO: 861366 - protein, 224 aa, Homo sapiens
MAMLRVQPEAQAKVDVFREDLCTKTENLLGSYFPKKISELDAFLKEPALNEANLSNLKAPLDIPVPDPVKEKEKEERKKQQEKEDKDEKKKGEDEDKGPPCGPVNCNEKIVVLLQRLKPEIKDVIEQLNLVTTWLQLQIPRIEDGNNFGVAVQEKVFELMTSLHTKLEGFHTQISKYFSERGDAVTKAAKQPHVAEQRQLVHELDDAAYRDIRLNSYKESTQAD

SEQ ID NO: 861367 - protein, 190 aa, Homo sapiens
MAMLRVQPEAQAKVDVFREDLCTKTENLLGSYFPKKISELDAFLKEPALNEANLSNLKAPLDIPVPDPVKEKEKEERKKQQEKEDKDEKKKGEDEDKGPPCGPVNCNEKIVVLLQRLKPEIKDVIEQLNLVTTWLQLQIPRIEDGNNFGVAVQEKVFELMTSLHTKLEGFHTQISKRISLADHLSGSAGP

SEQ ID NO: 861368 - protein, 214 aa, Homo sapiens
GAGCERPTAFAFPSRCPLHSLCGARPPVPVMAMLRVQPEAQAKVDVFREDLCTKTENLLGSYFPKKISELDAFLKEPALNEANLSNLKAPLDIPVPDPVKEKEKEERKKQQEKEDKDEKKKGEDEDKGPPCGPVNCNEKIVVLLQRLKPEIKDVIEQLNLVTTWLQLQIPRIEDGNNFGVAVQEKVFELMTSLHTKLEGFHTQISNISLSVVMQ

SEQ ID NO: 861369 - protein, 249 aa, Homo sapiens; identical to SEQ ID NO: 861359

SEQ ID NO: 861370 - protein, 116 aa, Homo sapiens
LKAYRRPTRSDGNNFGVAVQEKVFELMTSLHTKLEGFHTQISKYFSERGDAVTKAAKQPHVGDYRQLVHELDEAEYRDIRLMVMEIRNAYAVLYDIILKNFEKLKKPRGETKGMIY

SEQ ID NO: 861371 - protein, 115 aa, Homo sapiens
MEQLNLVTTWLQLQIPRIEDGNNFGVAVQEKVFELMTSLHTKLEGFHTQISKYFSERGDAVTKAAKQPHVGDYRQLVHELDEAEYRDIRLMVMEIRNAYAVLYDILIWAQPAGPA

SEQ ID NO: 861372 - protein, 116 aa, Homo sapiens; identical to SEQ ID NO: 861370

SEQ ID NO: 861373 - protein, 249 aa, Homo sapiens; identical to SEQ ID NO: 861359

SEQ ID NO: 861374 - protein, 239 aa, Homo sapiens
MLTPILLHPHLTTQTENLLGSYFPKKISELDAFLKEPALNEANLSNLKAPLDIPVPDPVKEKEKEERKKQQEKEDKDEKKKGEDEDKGPPCGPVNCNEKIVVLLQRLKPEIKDVIEQLNLVTTWLQLQIPRIEDGNNFGVAVQEKVFELMTSLHTKLEGFHTQISKYFSERGDAVTKAAKQPHVGDYRQLVHELDEAEYRDIRLMVMEIRNAYAVLYDIILKNFEKLKKPRGETKGMIY

SEQ ID NO: 861375 - protein, 123 aa, Homo sapiens
MKRSVTTWLQLQIPRIEDGNNFGVAVQEKVFELMTSLHTKLEGFHTQISKYFSERGDAVTKAAKQPHVGDYRQLVHELDEAEYRDIRLMVMEIRNAYAVLYDIILKNFEKLKKPRGETKGMIY

SEQ ID NO: 861376 - protein, 178 aa, Homo sapiens
TKTHILLPGIPRPLPFLLNTSRDLTSPQHENKVNCNEKIVVLLQRLKPEIKDVIEQLNLVTTWLQLQIPRIEDGNNFGVAVQEKVFELMTSLHTKLEGFHTQISKYFSERGDAVTKAAKQPHVGDYRQLVHELDEAEYRDIRLMVMEIRNAYAVLYDIILKNFEKLKKPRGETKGMIY

SEQ ID NO: 861377 - protein, 192 aa, Homo sapiens
MLTPILLHPHLTTQTENLLGSYFPKKISELDAFLKVPRLGRELGSKGQEKSLEAVRGGERNSLTSSPPPTLHQEPALNEANLSNLKAPLDIPVPDPVKEKEKEERKKQQEKEDKDEKKKGEDEDKGPPCGPVNCNEKIVVLLQRLKPEIKDVIEQLNLVTTWLQLQIPRIEDGNNFGVAVQVRALPHFPALF

SEQ ID NO: 861378 - protein, 105 aa, Homo sapiens
MAAAEHRHSSGLPCWPYLTAETLKNRMGHQPPPPTQQHSITDNSLSLKTPAECLLYPLPPSADDNLKTPPSVCSLPFHPQLHPQRMIISRHLPSVSAHSPSTLSG

SEQ ID NO: 861379 - protein, 389 aa, Homo sapiens
GSSCHPAIIVFYVLSPKVTLRNPGSSGRKERPEAGTGSWLGWTRNQVINTLADHRHRGTDFGGSPWLLIITVFLRSYKFAISLCTTYLWVINTLADHRHRGTDFGGSPWLLIITVFLRSYKFAISLCTSYLCVSFLKTIFPSQNGHDGSTDVQQRARRSNRRRQEGIKIVLEDIFTLWRQVETKVRAKIRKMKVTTKVNRHDKINGKKKTAKEHLRKLSMKEREHGEKERQVSEAEENGKLDMKEIHTYMEMFQRAQALRRRAEDYYRCKITPSARKPLCNRVRMAAAEHRHSSGLPCWPYLTAETLKNRMGHQPPPPTQQHSITDNSLSLKTPAECLLYPLPPSADDNLKTPPSVCSLPFHPQLHPQRMIISRHLPSVSAHSPSTLSG

SEQ ID NO: 861380 - protein, 402 aa, Homo sapiens
LIPVLSRSELPPLTTALVLQVAGSPSPTPAGQQVLDIDSCLDSSVLDSSFLTFSGLHAEVINTLADHRHRGTDFGGSPWLLIITVFLRSYKFAISLCTTYLWVINTLADHRHRGTDFGGSPWLLIITVFLRSYKFAISLCTSYLCVSFLKTIFPSQNGHDGSTDVQQRARRSNRRRQEGIKIVLEDIFTLWRQVETKVRAKIRKMKVTTKVNRHDKINGKKKTAKEHLRKLSMKEREHGEKERQVSEAEENGKLDMKEIHTYMEMFQRAQALRRRAEDYYRCKITPSARKPLCNRVRMAAAEHRHSSGLPCWPYLTAETLKNRMGHQPPPPTQQHSITDNSLSLKTPAECLLYPLPPSADDNLKTPPSVCSLPFHPQLHPQRMIISRHLPSVSAHSPSTLSG

SEQ ID NO: 861381 - protein, 333 aa, Homo sapiens
MILRVTLRNPGSSGRKERPEAGTGSWLGRTRNQVINTLADHRHRGTDFGGSPWLLIITVFLRSYKFAISLCTSYLCVSFLKTIFPSQNGHDGSTDVQQRARRSNRRRQEGIKIVLEDIFTLWRQVETKVRAKIRKMKVTTKVNRHDKINGKKKTAKEHLRKLSMKEREHGEKERQVSEAEENGKLDMKEIHTYMEMFQRAQALRRRAEDYYRCKITPSARKPLCNRVRMAAAEHRHSSGLPCWPYLTAETLKNRMGHQPPPPTQQHSITDNSLSLKTPAECLLYPLPPSADDNLKTPPSVCSLPFHPQLHPQRMIISRHLPSVSAHSPSTLSG

SEQ ID NO: 861382 - protein, 356 aa, Homo sapiens
AWPKYITLSVINTLADHRHRGTDFGGSPWLLIITVFLRSYKFAISLCTTYLWVINTLADHRHRGTDFGGSPWLLIITVFLRSYKFAISLCTSYLCVSFLKTIFPSQNGHDGSTDVQQRARRSNRRRQEGIKIVLEDIFTLWRQVETKVRAKIRKMKVTTKVNRHDKINGKKKTAKEHLRKLSMKEREHGEKERQVSEAEENGKLDMKEIHTYMEMFQRAQALRRRAEDYYRCKITPSARKPLCNRVRMAAAEHRHSSGLPCWPYLTAETLKNRMGHQPPPPTQQHSITDNSLSLKTPAECLLYPLPPSADDNLKTPPSVCSLPFHPQLHPQRMIISRHLPSVSAHSPSTLSSTLSG

SEQ ID NO: 861383 - protein, 99 aa, Homo sapiens
VDTVAVGLVSSVVVYPVYLAILFLFRMSRSKVAGSPSPTPAGQQVLDIDSCLDSSVLDSSFLTFSGLHAEVRALLGVLPPWRSLDSRPCAPLSRPLLDR

SEQ ID NO: 861384 - protein, 99 aa, Homo sapiens; identical to SEQ ID NO: 861383

SEQ ID NO: 861385 - protein, 337 aa, Homo sapiens
GSSCHPAIIVFYVLSPKVTLRNPGSSGRKERPEAGTGSWLGWTRNQVINTLADHRHRGTDFGGSPWLLIITVFLRSYKFAISLCTTYLWVINTLADHRHRGTDFGGSPWLLIITVFLRSYKFAISLCTSYLCVSFLKTIFPSQNGHDGSTDVQQRARRSNRRRQEGIKIVLEDIFTLWRQVETKVRAKIRKMKVTTKVNRHDKINGKKKTAKEHLRKLSMKEREHGEKERQVSEAEENGKLDMKEIHTYMEMFQRAQALRRRAEDYYRCKITPSARKPLCNRVRMAAAEHRHSSGLPCWPYLTAETLKNRMGHQPPPPTQQHSPTPDFHLARVPELE

SEQ ID NO: 861386 - protein, 99 aa, Homo sapiens; identical to SEQ ID NO: 861383

SEQ ID NO: 861387 - protein, 198 aa, Homo sapiens
MKVTTKVNRHDKINGKRKTAKEHLRKLSMKEREHGEKERQVSEAEENGKLDMKEIHTYMEMFQRAQALRRRAEDYYRCKITPSARKPLCNRVRMAAAEHRHSSGLPCWPYLTAETLKNRMGHQPPPPTQQHSITDNSLSLKTPAECLLYPLPPSADDNLKTPPSVCSLPFHPQLHPQRMIISRHLPSVSAHSPSTLSG

SEQ ID NO: 861388 - protein, 366 aa, Homo sapiens
GSSCHPAIIVFYVLSPKVTLRNPGSSGRKERPEAGTGSWLGWTRNQVINTLADHRHRGTDFGGSPWLLIITVFLRSYKFAISLCTTYLWVINTLADHRHRGTDFGGSPWLLIITVFLRSYKFAISLCTSYLCVSFLKTIFPSQNGHDGSTDVQQRARRSNRRRQEGIKIVLEDIFTLWRQVETKVRAKIRKMKVTTKVNRHDKINGKKKTAKEHLRKLSMKEREHGEKERQVSEAEENGKLDMKEIHTYMEMFQRAQALRRRAEDYYRCKITPSARKPLCNRVSLLVFLAFGHSLPGQDMDTFFSLRLCAQALQREMAERKAAYKHHSPIPVGNRVAQKHLHPHPVGPPSNILSVRGSVFVIANGP

SEQ ID NO: 861389 - protein, 148 aa, Homo sapiens
VTSYIPTSYLPRFITCILNQASGHQPPPPTQQHSIIDNSLSLKTPSERLLYPLPPSADDNLKTPSECLLTPLPPSALPSADDNLKTPAECLLYPLPPSADDNLKTPPECLLTPLPPSAPPSVDDNLKTPPECVCSLPFHPQRMIISRN

SEQ ID NO: 861390 - protein, 66 aa, Homo sapiens
LHDIEYRKKWDSNVIETFDIARLTVNADVGYYSCEQAVSTLIPVPLASIQASHQASPSTLSSTLSG

SEQ ID NO: 861391 - protein, 350 aa, Homo sapiens
MFCCLGYEWLSGGCKTWHSAWVINTLADHRHRGTDFGGSPWLLIITVFLRSYKFAISLCTSYLCVSFLKTIFPSQNGHDGSTDVQQRARRSNRRRQEGIKIVLEDIFTLWRQVETKVRAKIRKMKVTTKVNRHDKINGKRKTAKEHLRKLSMKEREHGEKERQVSEAEENGKLDMKEIHTYMEMFQRAQALRRRAEDYYRCKITPSARKPLCNRVRMAAVEHRHSSGLPYWPYLTAETLKNRMGHQPPPPTQQHSIIDNSLSLKTPSECLLTPLPPSALPSADDNLKTPAECLLYPLPPSADDNLKTPPECLLTPLPPSAPPSVDDNLKTPPECVCSLPFHPQRMIISRN

SEQ ID NO: 861392 - protein, 352 aa, Homo sapiens
AWPKYITLSVINTLADHRHRGTDFGGSPWLLIITVFLRSYKFAISLCTTYLWVINTLADHRHRGTDFGGSPWLLIITVFLRSYKFAISLCTSYLCVSFLKTIFPSQNGHDGSTDVQQRARRSNRRRQEGIKIVLEDIFTLWRQVETKVRAKIRKMKVTTKVNRHDKINGKKKTAKEHLRKLSMKEREHGEKERQVSEAEENGKLDMKEIHTYMEMFQRAQALRRRAEDYYRCKITPSARKPLCNRVRMAAAEHRHSSGLPCWPYLTAETLKNRMGHQPPPPTQQHSITDNSLSLKTPAECLLYPLPPSADDNLKTPPSVCSLPFHPQLHPQRMIISRHLPSVSAHSPSTLSG

SEQ ID NO: 861393 - protein, 198 aa, Homo sapiens
MKVTTKVNRHDKINGKKKTAKEHLRKLSMKEREHGEKERQVSEAEENGKLDMKEIHTYMEMFQRAQALRRRAEDYYRCKITPSARKPLCNRVRMAAAEHRHSSGLPCWPYLTAETLKNRMGHQPPPPTQQHSITDNSLSLKTPAECLLYPLPPSADDNLKTPPSVCSLPFHPQLHPQRMIISRHLPSVSAHSPSTLSG

SEQ ID NO: 861394 - protein, 339 aa, Homo sapiens
AWPKYITLSVINTLADHRHRGTDFGGSPWLLIITVFLRSYKFAISLCTTYLWVINTLADHRHRGTDFGGSPWLLIITVFLRSYKFAISLCTSYLCVSFLKTIFPSQNGHDGSTDVQQRARRSNRRRQEGIKIVLEDIFTLWRQVETKVRAKIRKMKVTTKVNRHDKINGKKKTAKEHLRKLSMKEREHGEKERQVSEAEENGKLDMKEIHTYMEMFQRAQALRRRAEDYYRCKITPSARKPLCNRVRMAAAEHRHSSGLPCWPYLTAETLKNRMGHQPPPPTQQHSITDNSLSLKTPAECLLYPLPPSADDNLKTSVLLLLCHYSVDDNLKQCLLVTSC

SEQ ID NO: 861395 - protein, 244 aa, Homo sapiens
MILRVTLRNPGSSGRKERPEAGTGSWLGRTRNQVINTLADHRHRGTDFGGSPWLLIITVFLRSYKFAISLCTSYLCVSFLKTIFPSQNGHDGSTDVQQRARRSNRRRQEGIKIVLEDIFTLWRQVETKVRAKIRKMKVTTKVNRHDKINGKRKTAKEHLRKLSMKEREHGEKERQVSEAEENGKLDMKEIHTYMEMFQRAQALRRRAEDYYRCKITPSARKPLCNRCTYNLVLPGSEKKYYSHA

SEQ ID NO: 861396 - protein, 212 aa, Homo sapiens
MVINTLADHRHRGTDFGGSPWLLIITVFLRSYKFAISLCTSYLCVSFLKTIFPSQNGHDGSTDVQQRARRSNRRRQEGIKIVLEDIFTLWRQVETKVRAKIRKMKVTTKVNRHDKINGKRKTAKEHLRKLSMKEREHGEKERQVSEAEENGKLDMKEIHTYMEMFQRAQALRRRAEDYYRCKITPSARKPLCNRCTYNLVLPGSEKKYYSHA

SEQ ID NO: 861397 - protein, 138 aa, Homo sapiens
MFQRAQALRRRAEDYYRCKITPSARKPLCNRVRMAAAEHRHSSGLPCWPYLTAETLKNRMGHQPPPPTQQHSITDNSLSLKTPAECLLYPLPPSADDNLKTPPSVCSLPFHPQLHPQRMIISRHLPSVSAHSPSTLSG

SEQ ID NO: 861398 - protein, 99 aa, Homo sapiens; identical to SEQ ID NO: 861383

SEQ ID NO: 861399 - protein, 99 aa, Homo sapiens; identical to SEQ ID NO: 861383

SEQ ID NO: 861400 - protein, 379 aa, Homo sapiens
ASPQLGSRALSTASGGQMQAERGARGGRGRRPGRGRPGGDRHSERPGAAAAVARGGGGGGGGDGGGRRGRGRGRGFRGARGGRGGGGAPRGSRREPGGWGAGASAPVEDDSDAETYGEENDEQGNYSKRKIVSNWDRYQDIEKEVNNESGESQRGTDFSVLLSSAGDSFSQFRFAEEKEWDSEASCPKQNSAFYVDSELLVRALQELPLCLRLNVAAELVQGTVPLEVPQVKPKRTDDGKGLGMQLKGPLGPGGRGPIFELKSVAAGCPVLLGKDNPSPGPSRDSQKPTSPLQSAGDHLEEELDLLLNLDAPIKEGDNILPDQTSQDLKSKEDGEVVQEEEVCAKPSVTEEKNMEPEQPSTSKNVTEEELEDWLDSMIS

SEQ ID NO: 861401 - protein, 224 aa, Homo sapiens
ASPQLGSRALSTASGGQMQAERGARGGRGRRPGRGRPGGDRHSERPGAAAAVARGGGGGGGGDGGGRRGRGRGRGFRGARGGRGGGGAPRGSRREPGGWGAGASAPVEDDSDAETYGEENDEQGNYSKRKIVSNWDRYQDIEKEVNNESGESQRGTDFSVLLSSAGDSFSQFRFAEEKEWDSEASCPKQNSAFYVDSELLVRALQELPLCLRLNVAAELVQMHL

SEQ ID NO: 861402 - protein, 363 aa, Homo sapiens
ASPQLGSRALSTASGGQMQAERGARGGRGRRPGRGRPGGDRHSERPGAAAAVARGGGGGGGGDGGGRRGRGRGRGFRGARGGRGGGGAPRGSRREPGGWGAGASAPVEDDSDAETYGEENDEQGNYSKRKIVSNWDRYQDIEKEVNNESGESQRGTDFSVLLSSAGDSFSQFRFAEEKEWDSEASCPKQNSAFYVDSELLVRALQELPLCLRLNVAAELVQGTVPLEVPQVKPKRTDDGKGLGMQLKGPLGPGGRGPIFELKSVAAGCPVLLGKDNPSPGPSRDSQKPTSPLQSAGDHLEEELDLLLNLDAPIKEGDNILPDQTSQDLKSKEDGEVVQEEEGMCKEIKHQRQPCFITIPSQCN

SEQ ID NO: 861403 - protein, 379 aa, Homo sapiens; identical to SEQ ID NO: 861400

SEQ ID NO: 861404 - protein, 181 aa, Homo sapiens
GLPLGCGLSLGGLPLGCCRTGSSGTVPLEVPQVKPKRTDDGKGLGMQLKGPLGPGGRGPIFELKSVAAGCPVLLGKDNPSPGPSRDSQKPTSPLQSAGDHLEEELDLLLNLDAPIKEGDNILPDQTSQDLKSKEDGEVVQEEEVCAKPSVTEEKNMEPEQPSTSKNVTEEELEDWLDSMIS

SEQ ID NO: 861405 - protein, 445 aa, Homo sapiens
MSVTYDDSVGVEVSSDSFWEVGNYKRTVKRIDDGHRLCSDLMNCLHERARIEKAYAQQLTEWARRWRQLVEKGPQYGTVEKAWMAFMSEAERVSELHLEVKASLMNDDFEKIKNWQKEAFHKQMMGGFKETKEAEDGFRKAQKPWAKKLKEVEAAKKAHHAACKEEKLAISREANSKADPSLNPEQLKKLQDKIEKCKQDVLKTKEKYEKSLKELDQGTPQYMENMEQVFEQCQQFEEKRLRFFREVLLEVQKHLDLSNVAGYKAIYHDLEQSIRAADAVEDLRWFRANHGPGMAMNWPQFEEWSADLNRTLSRREKKKATDGVTLTGINQTGDQSLPSKPSSVSSYEKTQSYPTDWSDDESNNPFSSTDANGDSNPFDDDATSGTEVRVRALYDYEGQEHDELSFKAGDELTKMEDEDEQGWCKGRLDNGQVGLYPANYVEAIQ

SEQ ID NO: 861406 - protein, 486 aa, Homo sapiens
MSVTYDDSVGVEVSSDSFWEVGNYKRTVKRIDDGHRLCSDLMNCLHERARIEKAYAQQLTEWARRWRQLVEKGPQYGTVEKAWMAFMSEAERVSELHLEVKASLMNDDFEKIKNWQKEAFHKQMMGGFKETKEAEDGFRKAQKPWAKKLKEVEAAKKAHHAACKEEKLAISREANSKADPSLNPEQLKKLQDKIEKCKQDVLKTKEKYEKSLKELDQGTPQYMENMEQVFEQCQQFEEKRLRFFREVLLEVQKHLDLSNVAGYKAIYHDLEQSIRAADAVEDLRWFRANHGPGMAMNWPQFEEWSADLNRTLSRREKKKATDGVTLTGINQTGDQSLPSKPSSTLNVPSNPAQSAQSQSSYNPFEDEDDTGSTVSEKDDTKAKNVSSYEKTQSYPTDWSDDESNNPFSSTDANGDSNPFDDDATSGTEVRVRALYDYEGQEHDELSFKAGDELTKMEDEDEQGWCKGRLDNGQVGLYPANYVEAIQ

SEQ ID NO: 861407 - protein, 445 aa, Homo sapiens; identical to SEQ ID NO: 861405

SEQ ID NO: 861408 - protein, 486 aa, Homo sapiens; identical to SEQ ID NO: 861406

SEQ ID NO: 861409 - protein, 445 aa, Homo sapiens [sequence omitted]

SEQ ID NO: 861410 - protein, 582 aa, Homo sapiens
SPSPSVCVRCPFRHPQPHPFLSQSASLPDPQPSFYLVPNLKNIEKPPFTDVYDLINNKNREAHYLTTRSAFQTLGEGCGKHDPRGASGPGWHGGHLCHSQGQAAPSPLPPSWFSLLVGNYKRTVKRIDDGHRLCSDLMNCLHERARIEKAYAQQLTEWARRWRQLVEKGPQYGTVEKAWMAFMSEAERVSELHLEVKASLMNDDFEKIKNWQKEAFHKQMMGGFKETKEAEDGFRKAQKPWAKKLKEVEAAKKAHHAACKEEKLAISREANSKADPSLNPEQLKKLQDKIEKCKQDVLKTKEKYEKSLKELDQGTPQYMENMEQVFEQCQQFEEKRLRFFREVLLEVQKHLDLSNVAGYKAIYHDLEQSIRAADAVEDLRWFRANHGPGMAMNWPQFEEWSADLNRTLSRREKKKATDGVTLTGINQTGDQSLPSKPSSTLNVPSNPAQSAQSQSSYNPFEDEDDTGSTVSEKDDTKAKNVSSYEKTQSYPTDWSDDESNNPFSSTDANGDSNPFDDDATSGTEVRVRALYDYEGQEHDELSFKAGDELTKMEDEDEQGWCKGRLDNGQVGLYPANYVEAIQ

SEQ ID NO: 861411 - protein, 486 aa, Homo sapiens; identical to SEQ ID NO: 861406

SEQ ID NO: 861412 - protein, 486 aa, Homo sapiens; identical to SEQ ID NO: 861406

SEQ ID NO: 861413 - protein, 487 aa, Homo sapiens
MSVTYDDSVGVEVSSDSFWEVGNYKRTVKRIDDGHRLCSDLMNCLHERARIEKAYAQQLTEWARRWRQLVEKGPQYGTVEKAWMAFMSEAERVSELHLEVKASLMNDDFEKIKNWQKEAFHKQMMGGFKETKEAEDGFRKAQKPWAKKLKEVEAAKKAHHAACKEEKLAISREANSKADPSLNPEQLKKLQDKIEKCKQDVLKTKEKYEKSLKELDQGTPQYMENMEQVFEQCQQFEEKRLRFFREVLLEVQKHLDLSNVAGYKAIYHDLEQSIRAADAVEDLRWFRANHGPGMAMNWPQFEEWSADLNRTLSRREKKKATDGVTLTGINQTGDQSLPSKPSSTLNVPSNPAQSAQSQSSYNPFEDEDDTGSTVSEKDDTKAKNVSSYEKTQSYPTDWSDDESNNPFSSTDANGDSNPFDDDATSGTEVRVRALYDYEGQEHDELSFKAGDELTKMEDEDEQGWCKGRLDNGALAQRWANAPCWASG

SEQ ID NO: 861414 - protein, 406 aa, Homo sapiens
MSVTYDDSVGVEVSSDSFWEVGNYKRTVKRIDDGHRLCSDLMNCLHERARIEKAYAQQLTEWARRWRQLVEKGPQYGTVEKAWMAFMSEAERVSELHLEVKASLMNDDFEKIKNWQKEAFHKQMMGGFKETKEAEDGFRKAQKPWAKKLKEVEAAKKAHHAACKEEKLAISREANSKADPSLNPEQLKKLQDKIEKCKQDVLKTKEKYEKSLKELDQGTPQYMENMEQVFEQCQQFEEKRLRFFREVLLEVQKHLDLSNVAGYKAIYHDLEQSIRAADAVEDLRWFRANHGPGMAMNWPQFEEWSADLNRTLSRREKKKATDGVTLTGINQTGDQSLPSKPSSTLNVPSNPAQSAQSQSSYNPFEDEDDTGSTVSEKDDTKAKNVSSYEKTQSYPTRTSMQPGPQF

SEQ ID NO: 861415 - protein, 63 aa, Homo sapiens
TDWSDDESNNPFSSTDANGDSNPFDDDATSGTEVRVRALYDYEGQEHDELSFKAGRWAPPASR

SEQ ID NO: 861416 - protein, 486 aa, Homo sapiens; identical to SEQ ID NO: 861406

SEQ ID NO: 861417 - protein, 75 aa, Homo sapiens
MVGALGNLHGPGQPRPGHLGGSWAPELCGPWPSLDTWEVPGLLSSVGRGPGASPGKVVFLPGARAADRSREGGLA

SEQ ID NO: 861418 - protein, 486 aa, Homo sapiens; identical to SEQ ID NO: 861406

SEQ ID NO: 861419 - protein, 486 aa, Homo sapiens; identical to SEQ ID NO: 861406

SEQ ID NO: 861420 - protein, 486 aa, Homo sapiens; identical to SEQ ID NO: 861406

SEQ ID NO: 861421 - protein, 462 aa, Homo sapiens
MVTAEYLTDGHRLCSDLMNCLHERARIEKAYAQQLTEWARRWRQLVEKGPQYGTVEKAWMAFMSEAERVSELHLEVKASLMNDDFEKIKNWQKEAFHKQMMGGFKETKEAEDGFRKAQKPWAKKLKEVEAAKKAHHAACKEEKLAISREANSKADPSLNPEQLKKLQDKIEKCKQDVLKTKEKYEKSLKELDQGTPQYMENMEQVFEQCQQFEEKRLRFFREVLLEVQKHLDLSNVAGYKAIYHDLEQSIRAADAVEDLRWFRANHGPGMAMNWPQFEEWSADLNRTLSRREKKKATDGVTLTGINQTGDQSLPSKPSSTLNVPSNPAQSAQSQSSYNPFEDEDDTGSTVSEKDDTKAKNVSSYEKTQSYPTDWSDDESNNPFSSTDANGDSNPFDDDATSGTEVRVRALYDYEGQEHDELSFKAGDELTKMEDEDEQGWCKGRLDNGQVGLYPANYVEAIQ

SEQ ID NO: 861422 - protein, 121 aa, Homo sapiens [sequence omitted]

SEQ ID NO: 861423 - protein, 490 aa, Homo sapiens
MSVTYDDSVGVEVSSDSFWEVGNYKRTVKRIDDGHRLCSDLMNCLHERARIEKAYAQQLTEWARRWRQLVEKGPQYGTVEKAWMAFMSEAERVSELHLEVKASLMNDDFEKIKNWQKEAFHKQMMGGFKETKEAEDGFRKAQKPWAKKLKEVEAAKKAHHAACKEEKLAISREANSKADPSLNPEQLKKLQDKIEKCKQDVLKTKEKYEKSLKELDQGTPQYMENMEQVFEQCQQFEEKRLRFFREVLLEVQKHLDLSNVAGYKAIYHDLEQSIRAADAVEDLRWFRANHGPGMAMNWPQFEEWSADLNRTLSRREKKKATDGVTLTGINQTGDQSLPSKPSSTLNVPSNPAQSAQSQSSYNPFEDEDDTGSTVSEKDDTKAKNVSSYEKTQSYPTDWSDDESNNPFSSTDANGDSNPFDDDATSGTEVRVRALYDYEGQEHDELSFKAGDELTKMEEEADTGLPAQDAGTPRPGPSVERTQAGLEQEAH

SEQ ID NO: 861424 - protein, 105 aa, Homo sapiens
INKITNSVLITKNSEELEVDDPRKPNCFELYIPNNKGQLIKACKTEADGRVVEGNHMVYRISAPTQEEKDEWIKSIQAAVSVDPFYEMLAARKKRISVKKKQEQP

SEQ ID NO: 861425 - protein, 97 aa, Homo sapiens
DHSTFSSCVEGRDPVHHVVSLHHSDVRLSYAGFDELPLVVWGCKVQSSSVSGGRPNREPGPLGLGAVDPGSLFGKFTTSSSSLFFVINTLLVILLII

SEQ ID NO: 861426 - protein, 133 aa, Homo sapiens
LPLRTPPCAHPVSVACGSWGCSILPPSLLLHLVLPAFSLSAPGGGRVKTWKRRWFILTDNCLYYFEYTTDKEPRGIIPLENLSIREVDDPRKPNSIIYYGAAPPGWPDPWALGLWILVPCLENSPPLAPHCSL

SEQ ID NO: 861427 - protein, 400 aa, Homo sapiens
MEDGVYEPPDLTPEERMELENIRRRKQELLVEIQRLREELSEAMSEVEGLEANEGSKTLQRNRKMAMGRKKFNMDPKKGIQFLVENELLQNTPEEIARFLYKGEGLNKTAIGDYLGEREELNLAVLHAFVDLHEFTDLNLVQALRQFLWSFRLPGEAQKIDRMMEAFAQRYCLCNPGVFQSTDTCYVLSFAVIMLNTSLHNPNVRDKPGLERFVAMNRGINEGGDLPEELLRNLYDSIRNEPFKIPEDDGNDLTHTFFNPDREGWLLKLGGGRVKTWKRRWFILTDNCLYYFEYTTDKEPRGIIPLENLSIREVDDPRKPNCFELYIPNNKGQLIKACKTEADGRVVEGNHMVYRISAPTQEEKDEWIKSIQAAVSVDPFYEMLAARKKRISVKKKQEQP

SEQ ID NO: 861428 - protein, 368 aa, Homo sapiens
MEDGVYEPPDLTPEERMELENIRRRKQELLVEIQRLREELSEAMSEVEGLEANEGSKTLQRNRKMAMGRKKFNMDPKKGIQFLVENELLQNTPEEIARFLYKGEGLNKTAIGDYLGEREELNLAVLHAFVDLHEFTDLNLVQALRQFLWSFRLPGEAQKIDRMMEAFAQRYCLCNPGVFQSTDTCYVLSFAVIMLNTSLHNPNVRDKPGLERFVAMNRGINEGGDLPEELLRNLYDSIRNEPFKIPEDDGNDLTHTFFNPDREGWLLKLGGGRVKTWKRRWFILTDNCLYYFEYTTDKEPRGIIPLENLSIREVDDPRKPNCFELYIPNNKGQLIKACKTEADGRVVEGNHMVYRISAPGGCECGPLL

SEQ ID NO: 861429 - protein, 374 aa, Homo sapiens
MEDGVYEPPDLTPEERMELENIRRRKQELLVEIQRLREELSEAMSEVEGLEANEGSKTLQRNRKMAMGRKKFNMDPKKGIQFLVENELLQNTPEEIARFLYKGEGLNKTAIGDYLGEREELNLAVLHAFVDLHEFTDLNLVQALRQFLWSFRLPGEAQKIDRMMEAFAQRYCLCNPGVFQSTDTCYVLSFAVIMLNTSLHNPNVRDKPGLERFVAMNRGINEGGDLPEELLRNLYDSIRNEPFKIPEDDGNDLTHTFFNPDREGWLLKLGGGRVKTWKRRWFILTDNCLYYFEYTTDKEPRGIIPLENLSIREVDDPRKPNCFELYIPNNKGQTQEEKDEWIKSIQAAVSVDPFYEMLAARKKRISVKKKQEQP

SEQ ID NO: 861430 - protein, 364 aa, Homo sapiens
SPNCTKVWPKQGSQARYSSQECVLSIPHPGGRPVWESSRKLHPRQWAAVVQQRGHDFPRALPFAHSCPILSKLYVSLSHPSREELNLAVLHAFVDLHEFTDLNLVQALRQFLWSFRLPGEAQKIDRMMEAFAQRYCLCNPGVFQSTDTCYVLSFAVIMLNTSLHNPNVRDKPGLERFVAMNRGINEGGDLPEELLRNLYDSIRNEPFKIPEDDGNDLTHTFFNPDREGWLLKLGGGRVKTWKRRWFILTDNCLYYFEYTTDKEPRGIIPLENLSIREVDDPRKPNCFELYIPNNKGQLIKACKTEADGRVVEGNHMVYRISAPTQEEKDEWIKSIQAAVSVDPFYEMLAARKKRISVKKKQEQP

SEQ ID NO: 861431 - protein, 171 aa, Homo sapiens
FWASCCGDNGDLLAHALVRVEVVAQARVVLFYDDPPRMHAGGGRVKTWKRRWFILTDNCLYYFEYTTDKEPRGIIPLENLSIREVDDPRKPNCFELYIPNNKGQLIKACKTEADGRVVEGNHMVYRISAPTQEEKDEWIKSIQAAVSVDPFYEMLAARKKRISVKKKQEQP

SEQ ID NO: 861432 - protein, 182 aa, Homo sapiens
RGISPEVTIEHGIVTNWDDMEKIWHHTFYNELRVAPGQHPVLLTEAPSSSVLWGRVKTWKRRWFILTDNCLYYFEYTTDKEPRGIIPLENLSIREVDDPRKPNCFELYIPNNKGQLIKACKTEADGRVVEGNHMVYRISAPTQEEKDEWIKSIQAAVSVDPFYEMLAARKKRISVKKKQEQP

SEQ ID NO: 861433 - protein, 109 aa, Homo sapiens
RGGCTAWLRLRATLFRGFSLESKPVKCFLLFRRRGLLPCLHSDWPRGPSTSGRTYLHRLFVRLLALENDPLVARAGRTKAPTVDWTVSKRGAVPTEGAVGRRREESFQR

SEQ ID NO: 861434 - protein, 119 aa, Homo sapiens
AFLINFGSNNQGQREPREGNSPLGGIWSIEEVEEPPGNRNCFELYIPNNKGQLIKACKTEADGRVVEGNHMVYRISAPTQEEKDEWIKSIQAAVSVDPFYEMLAARKKRISVKKKQEQP

SEQ ID NO: 861435 - protein, 105 aa, Homo sapiens; identical to SEQ ID NO: 861424

SEQ ID NO: 861436 - protein, 400 aa, Homo sapiens; identical to SEQ ID NO: 861427

SEQ ID NO: 861437 - protein, 422 aa, Homo sapiens
MDPVVRITRSPATSPVMESENQGLSPLPKPPDLTPEERMELENIRRRKQELLVEIQRLREELSEAMSEVEGLEANEGSKTLQRNRKMAMGRKKFNMDPKKGIQFLVENELLQNTPEEIARFLYKGEGLNKTAIGDYLGEREELNLAVLHAFVDLHEFTDLNLVQALRQFLWSFRLPGEAQKIDRMMEAFAQRYCLCNPGVFQSTDTCYVLSFAVIMLNTSLHNPNVRDKPGLERFVAMNRGINEGGDLPEELLRNLYDSIRNEPFKIPEDDGNDLTHTFFNPDREGWLLKLGGGRVKTWKRRWFILTDNCLYYFEYTTDKEPRGIIPLENLSIREVDDPRKPNCFELYIPNNKGQLIKACKTEADGRVVEGNHMVYRISAPTQEEKDEWIKSIQAAVSVDPFYEMLAARKKRISVKKKQEQP

SEQ ID NO: 861438 - protein, 384 aa, Homo sapiens
MELENIRRRKQELLVEIQRLREELSEAMSEVEGLEANEGSKTLQRNRKMAMGRKKFNMDPKKGIQFLVENELLQNTPEEIARFLYKGEGLNKTAIGDYLGEREELNLAVLHAFVDLHEFTDLNLVQALRQFLWSFRLPGEAQKIDRMMEAFAQRYCLCNPGVFQSTDTCYVLSFAVIMLNTSLHNPNVRDKPGLERFVAMNRGINEGGDLPEELLRNLYDSIRNEPFKIPEDDGNDLTHTFFNPDREGWLLKLGGGRVKTWKRRWFILTDNCLYYFEYTTDKEPRGIIPLENLSIREVDDPRKPNCFELYIPNNKGQLIKACKTEADGRVVEGNHMVYRISAPTQEEKDEWIKSIQAAVSVDPFYEMLAARKKRISVKKKQEQP

SEQ ID NO: 861439 - protein, 262 aa, Homo sapiens
MEDGVYEPPDLTPEERMELENIRRRKQELLVEIQRLREELSEAMSEVEGLEANEGSKTLQRNRKMAMGRKKFNMDPKKGIQFLVENELLQNTPEEIARFLYKGEGLNKTAIGDYLGEREELNLAVLHAFVDLHEFTDLNLVQALRQFLWSFRLPGEAQKIDRMMEAFAQRYCLCNPGVFQSTDTCYVLSFAVIMLNTSLHNPNVRDKPGLERFVAMNRGINEGGDLPEELLRNLYDSIRNEPFKIPEDDGNDLTHTFLQEQP

SEQ ID NO: 861440 - protein, 187 aa, Homo sapiens
CPCAPLPVPTLFLSPAALGGAPFSRLPFSCTWSCLLSRCLPQEEVHDLSLSPTPSLSGGRVKTWKRRWFILTDNCLYYFEYTTDKEPRGIIPLENLSIREVDDPRKPNCFELYIPNNKGQLIKACKTEADGRVVEGNHMVYRISAPTQEEKDEWIKSIQAAVSVDPFYEMLAARKKRISVKKKQEQP

SEQ ID NO: 861441 - protein, 189 aa, Homo sapiens
MEDGVYEPPDLTPEERMELENIRRRKQELLVEIQRLREELSEAMSEVEGLEANEGSKTLQRNRKMAMGRKKFNMDPKKGIQFLVENELLQNTPEEIARFLYKGEGLNKTAIGDYLGEREELNLAVLHAFVDLHEFTDLNLVQALRDSQHSRGQCPLVRLDHVTIPETTAEAGRSGFLVDQFLTQGLRVG

SEQ ID NO: 861442 - protein, 138 aa, Homo sapiens
MSWSGLLHGLNTSLTCGPALVPRLWATCSMATLNQMHRLGPPKRPPRKLGPTEGRPQLKGVVLCTFTRKPKKPNSANRKCCRVRLSTGREAVCFIPGEGHTLQEHQIVLVEGGRTQDLPGVKLTVVRGKYDCGHVQKK

SEQ ID NO: 861443 - protein, 138 aa, Homo sapiens; identical to SEQ ID NO: 861442

SEQ ID NO: 861444 - protein, 138 aa, Homo sapiens; identical to SEQ ID NO: 861442

SEQ ID NO: 861445 - protein, 138 aa, Homo sapiens; identical to SEQ ID NO: 861442

SEQ ID NO: 861446 - protein, 138 aa, Homo sapiens; identical to SEQ ID NO: 861442

SEQ ID NO: 861447 - protein, 138 aa, Homo sapiens; identical to SEQ ID NO: 861442

SEQ ID NO: 861448 - protein, 138 aa, Homo sapiens; identical to SEQ ID NO: 861442

SEQ ID NO: 861449 - protein, 138 aa, Homo sapiens; identical to SEQ ID NO: 861442

SEQ ID NO: 861450 - protein, 138 aa, Homo sapiens; identical to SEQ ID NO: 861442

SEQ ID NO: 861451 - protein, 138 aa, Homo sapiens; identical to SEQ ID NO: 861442

SEQ ID NO: 861452 - protein, 138 aa, Homo sapiens; identical to SEQ ID NO: 861442

SEQ ID NO: 861453 - protein, 32 aa, Homo sapiens
MGWWLVIDQGLKQCLYFSFSSGRPDIIYTLEG

SEQ ID NO: 861454 - protein, 138 aa, Homo sapiens; identical to SEQ ID NO: 861442

SEQ ID NO: 861455 - protein, 138 aa, Homo sapiens; identical to SEQ ID NO: 861442

SEQ ID NO: 861456 - protein, 138 aa, Homo sapiens; identical to SEQ ID NO: 861442

SEQ ID NO: 861457 - protein, 123 aa, Homo sapiens
MSWSGLLHGLNTSLTCGPALVPRLWATCSMATLNQMHRLGPQLKGVVLCTFTRKPKKPNSANRKCCRVRLSTGREAVCFIPGEGHTLQEHQIVLVEGGRTQDLPGVKLTVVRGKYDCGHVQKK

SEQ ID NO: 861458 - protein, 140 aa, Homo sapiens
MSWSGLLHGLNTSLTCGKWGTWASGTRLEGEGYSLLDLCASVGAPRETGVEKHGGVLAELGLLEQEVGSSCMEGYCVSSGVWVSFIIYLFKISLLSPRLKCSGVITAHCSLDLLGSSDPPASASQVAGTTGLQNHNQLTF

SEQ ID NO: 861459 - protein, 394 aa, Homo sapiens
MGLGCEGPLNGEPSGPGLLTMPILSPAHSPTAPGATDQTAVPMPAAPGCRPGQHPLTCLQPFPVPHIRSSHDRHSRPTHHVCPAGLGFAEGGQPWAAVPGVVTMPPPQAPVVCTRKRRLEDDERQSIPSVLQGEVARLDPKFLVNLDPSHCSNNGTVHLICKLGECPEGRDWCGKAGPDRSPRTLPSKPDGTAPRTHPVFTPRQAVCSILTHTGLQTACHASVPTARARTLSPPQHRCGFACLGPREVVGRTSGHPSMQSTPGFTFGNLRVRETSSRLCHKLHQNLPGCGVLFQSRAVRQGRPGLVQVTDRAFCVADDKDLPSVPPLELSVPADYPAQSPLWIDRQWQYDANPFLQSVHRCMTSRLLQLPDKHSVTALLNTWAQSVHQACLSAA

SEQ ID NO: 861460 - protein, 777 aa, Homo sapiens
PARFGPGSVTEAAAVAAKRDTGGGSWGTGMDVSGQETDWRSTAFRQKLVSQIEDAMRKAGVAHSKSSKDMESHVFLKAKTRDEYLSLVARLIIHFRDIHNKKSQASVSDPMNALQSLTGGPAAGAAGIGMPPRGPGQSLGGMGSLGAMGQPMSLSGQPPPGTSGMAPHSMAVVSTATPQTQLQLQQVALQQQQQQQQFQQQQQAALQQQQQQQQQQQFQAQQSAMQQQFQAVVQQQQQLQQQQQQQQHLIKLHHQNQQQIQQQQQQLQRIAQLQLQQQQQQQQQQQQQQQQALQAQPPIQQPPMQQPQPPPSQALPQQLQQMHHTQHHQPPPQPQQPPVAQNQPSQLPPQSQTQPLVSQAQALPGQMLYTQPPLKFVRAPMVVQQPPVQPQVQQQQTAVQTAQAAQMVAPGVQVSQSSLPMLSSPSPGQQVQTPQSMPPPPQPSPQPGQPSSQPNSNVSSGPAPSPSSFLPSPSPQPSQSPVTARTPQNFSVPSPGPLNTPVNPSSVMSPAGSSQAEEQQYLDKLKQLSKYIEPLRRMINKIDKNEDRKKDLSKMKSLLDILTDPSKRCPLKTLQKCEIALEKLKNDMAVPTPPPPPVPPTKQQYLCQPLLDAVLANIRSPVFNHSLYRTFVPAMTAIHGPPITAPVVCTRKRRLEDDERQSIPSVLQGEVARLDPKFLVNLDPSHCSNNGTVHLICKLDDKDLPSVPPLELSVPADYPAQSPLWIDRQWQYDANPFLQSVHRCMTSRLLQLPDKHSVTALLNTWAQSVHQACLSAA

SEQ ID NO: 861461 - protein, 693 aa, Homo sapiens
AAPARRAAPARRWDHSEDAMRKAGVAHSKSSKDMESHVFLKAKTRDEYLSLVARLIIHFRDIHNKKSQASVSDPMNALQSLTGGPAAGAAGIGMPPRGPGQSLGGMGSLGAMGQPMSLSGQPPPGTSGMAPHSMAVVSTATPQTQLQLQQVALQQQQQQQQFQQQQQALQAQPPIQQPPMQQPQPPPSQALPQQLQQMHHTQHHQPPPQPQQPPVAQNQPSQLPPQSQTQPLVSQAQALPGQMLYTQPPLKFVRAPMVVQQPPVQPQVQQQQTAVQTAQAAQMVAPGVQMITEALAQGGMHIRARFPPTTAVSAIPSSSIPLGRQPMAQVSQSSLPMLSSPSPGQQVQTPQSMPPPPQPSPQPGQPSSQPNSNVSSGPAPSPSSFLPSPSPQPSQSPVTARTPQNFSVPSPGPLNTPVNPSSVMSPAGSSQAEEQQYLDKLKQLSKYIEPLRRMINKIDKNEDRKKDLSKMKSLLDILTDPSKRCPLKTLQKCEIALEKLKNDMAVPTPPPPPVPPTKQQYLCQPLLDAVLANIRSPVFNHSLYRTFVPAMTAIHGPPITAPVVCTRKRRLEDDERQSIPSVLQGEVARLDPKFLVNLDPSHCSNNGTVHLICKLDDKDLPSVPPLELSVPADYPAQSPLWIDRQWQYDANPFLQSVHRCMTSRLLQLPDKHSVTALLNTWAQSVHQACLSAA

SEQ ID NO: 861462 - protein, 769 aa, Homo sapiens
AAPARRAAPARRWDHSEDAMRKAGVAHSKSSKDMESHVFLKAKTRDEYLSLVARLIIHFRDIHNKKSQASVSDPMNALQSLTGGPAAGAAGIGMPPRGPGQSLGGMGSLGAMGQPMSLSGQPPPGTSGMAPHSMAVVSTATPQTQLQLQQVALQQQQQQQQFQQQQQAALQQQQQQQQQQQFQAQQSAMQQQFQAVVQQQQQLQQQQQQQQHLIKLHHQNQQQIQQQQQQLQRIAQLQLQQQQQQQQQQQQQQQQALQAQPPIQQPPMQQPQPPPSQALPQQLQQMHHTQHHQPPPQPQQPPVAQNQPSQLPPQSQTQPLVSQAQALPGQMLYTQPPLKFVRAPMVVQQPPVQPQVQQQQTAVQTAQAAQMVAPGVQVSQSSLPMLSSPSPGQQVQTPQSMPPPPQPSPQPGQPSSQPNSNVSSGPAPSPSSFLPSPSPQPSQSPVTARTPQNFSVPSPGPLNTPVNPSSVMSPAGSSQAEEQQYLDKLKQLSKYIEPLRRMINKIDKNEDRKKDLSKMKSLLDILTDPSKRCPLKTLQKCEIALEKLKNDMAVPTPPPPPVPPTKQQYLCQPLLDAVLANIRSPVFNHSLYRTFVPAMTAIHGPPITYVQLGWALRRAASPGPRVPGVVTMPPPQAPVVCTRKRRLEDDERQSIPSVLQGEVARLDPKFLVNLDPSHCSNNGTVHLICKLDDKDLPSVPPLELSVPADYPAQSPLWIDRQWQYDANPFLQSVHRCMTSRLLQLPDKHSVTALLNTWAQSVHQACLSAA

SEQ ID NO: 861463 - protein, 741 aa, Homo sapiens
AAPARRAAPARRWDHSEDAMRKAGVAHSKSSKDMESHVFLKAKTRDEYLSLVARLIIHFRDIHNKKSQASVSDPMNALQSLTGGPAAGAAGIGMPPRGPGQSLGGMGSLGAMGQPMSLSGQPPPGTSGMAPHSMAVVSTATPQTQLQLQQVALQQQQQQQQFQQQQQAALQQQQQQQQQQQFQAQQSAMQQQFQAVVQQQQQLQQQQQQQQHLIKLHHQNQQQIQQQQQQLQRIAQLQLQQQQQQQQQQQQQQQQALQAQPPIQQPPMQQPQPPPSQALPQQLQQMHHTQHHQPPPQPQQPPVAQNQPSQLPPQSQTQPLVSQAQALPGQMLYTQPPLKFVRAPMVVQQPPVQPQVQQQQTAVQTAQAAQMVAPGVQVSQSSLPMLSSPSPGQQVQTPQSMPPPPQPSPQPGQPSSQPNSNVSSGPAPSPSSFLPSPSPQPSQSPVTARTPQNFSVPSPGPLNTPVNPSSVMSPAGSSQAEEQQYLDKLKQLSKYIEPLRRMINKIDKNEDRKKDLSKMKSLLDILTDPSKRCPLKTLQKCEIALEKLKNDMAVPTPPPPPVPPTKQQYLCQPLLDAVLANIRSPVFNHSLYRTFVPAMTAIHGPPITAPVVCTRKRRLEDDERQSIPSVLQGEVARLDPKFLVNLDPSHCSNNGTVHLICKLDDKDLPSVPPLELSVPADYPAQSPLWIDRQWQYDANPFLQSVHRCMTSRLLQLPDKHSVTALLNTWAQSVHQACLSAA

SEQ ID NO: 861464 - protein, 741 aa, Homo sapiens; identical to SEQ ID NO: 861463

SEQ ID NO: 861465 - protein, 741 aa, Homo sapiens; identical to SEQ ID NO: 861463

SEQ ID NO: 861466 - protein, 393 aa, Homo sapiens
AAPARRAAPARRWDHSEDAMRKAGVAHSKSSKDMESHVFLKAKTRDEYLSLVARLIIHFRDIHNKKSQASVSDPMNALQSLTGGPAAGAAGIGMPPRGPGQSLGGMGSLGAMGQPMSLSGQPPPGTSGMAPHSMAVVSTATPQTQLQLQQVALQQQQQQQQFQQQQQAALQQQQQQQQQQQFQAQQSAMQQQFQAVVQQQQQLQQQQQQQQHLIKLHHQNQQQIQQQQQQLQRIAQLQLQQQQQQQQQQQQQQQQALQAQPPIQQPPMQQPQPPPSQALPQQLQQMHHTQHHQPPPQPQQPPVAQNQPSQLPPQSQTQPLVSQAQALPGQMLYTQPPLKFVRAPMVVQQPPVQPQVQQQQTAVTYASRSWMPSWPTSAHLSSTIPCTAHSFQP

SEQ ID NO: 861467 - protein, 840 aa, Homo sapiens
AAPARRAAPARRWDHSEDAMRKAGVAHSKSSKDMESHVFLKAKTRDEYLSLVARLIIHFRDIHNKKSQASVSDPMNALQSLTGGPAAGAAGIGMPPRGPGQSLGGMGSLGAMGQPMSLSGQPPPGTSGMAPHSMAVVSTATPQTQLQLQQVALQQQQQQQQFQQQQQAALQQQQQQQQQQQFQAQQSAMQQQFQAVVQQQQQLQQQQQQQQHLIKLHHQNQQQIQQQQQQLQRIAQLQLQQQQQQQQQQQQQQQQALQAQPPIQQPPMQQPQPPPSQALPQQLQQMHHTQHHQPPPQPQQPPVAQNQPSQLPPQSQTQPLVSQAQALPGQMLYTQPPLKFVRAPMVVQQPPVQPQVQQQQTAVQTAQAAQMVAPGVQVSQSSLPMLSSPSPGQQVQTPQSMPPPPQPSPQPGQPSSQPNSNVSSGPAPSPSSFLPSPSPQPSQSPVTARTPQNFSVPSPGPLNTPVNPSSVMSPAGSSQAEEQQYLDKLKQLSKYIEPLRRMINKIDKNEDRKKDLSKMKSLLDILTDPSKRCPLKTLQKCEIALEKLKNDMAVAPVVCTRKRRLEDDERQSIPSVLQGEVARLDPKFLVNLDPSHCSNNGTVHLICKLGECPEGRDWCGKAGPDRSPRTLPSKPDGTAPRTHPVFTPRQAVCSILTHTGLQTACHASVPTARARTLSPPQHRCGFACLGPREVVGRTSGHPSMQSTPGFTFGNLRVRETSSRLCHKLHQNLPGCGVLFQSRAVRQGRPGLVQVTDRAFCVADDKDLPSVPPLELSVPADYPAQSPLWIDRQWQYDANPFLQSVHRCMTSRLLQLPDKHSVTALLNTWAQSVHQACLSAA

SEQ ID NO: 861468 - protein, 416 aa, Homo sapiens
AAPARRAAPARRWDHSEDAMRKAGVAHSKSSKDMESHVFLKAKTRDEYLSLVARLIIHFRDIHNKKSQASVSDPMNALQSLTGGPAAGAAGIGMPPRGPGQSLGGMGSLGAMGQPMSLSGQPPPGTSGMAPHSMAVVSTATPQTQLQLQQVALQQQQQQQQFQQQQQAALQQQQQQQQQQQFQAQQSAMQQQFQAVVQQQQQLQQQQQQQQHLIKLHHQNQQQIQQQQQQLQRIAQLQLQQQQQQQQQQQQQQQQALQAQPPIQQPPMQQPQPPPSQALPQQLQQMHHTQHHQPPPQPQQPPVAQNQPSQLPPQSQTQPLVSQAQALPGQMLYTQPPLKFVRAPMVVQQPPVQPQVQQQQTAVQTAQAAQMVAPGVQVSQSSLPMLSSPSPGQQVQTPQSMPPPPLLAVFLPASQR

SEQ ID NO: 861469 - protein, 404 aa, Homo sapiens
AAPARRAAPARRWDHSEDAMRKAGVAHSKSSKDMESHVFLKAKTRDEYLSLVARLIIHFRDIHNKKSQASVSDPMNALQSLTGGPAAGAAGIGMPPRGPGQSLGGMGSLGAMGQPMSLSGQPPPGTSGMAPHSMAVVSTATPQTQLQLQQVALQQQQQQQQFQQQQQAALQQQQQQQQQQQFQAQQSAMQQQFQAVVQQQQQLQQQQQQQQHLIKLHHQNQQQIQQQQQQLQRIAQLQLQQQQQQQQQQQQQQQQALQAQPPIQQPPMQQPQPPPSQALPQQLQQMHHTQHHQPPPQPQQPPVAQNQPSQLPPQSQTQPLVSQAQALPGQMLYTQPPLKFVRAPMVVQQPPVQPQVQQQQTAVQTAQAAQMVAPGVQMITEALAQGGMHIRARFPPTTAVSAIS

SEQ ID NO: 861470 - protein, 602 aa, Homo sapiens
PQRTQVHTCMAEPGSGPRCLTLSSSPLPGALVWADASATMGVCVAPWATSLQLSRSRWDSLGPALQQHVLTTTDGCSHQACPWCSQPGGCGGLWKHVGRRSHWSAEQGPHRPTEEHVTGQAGVSGKARLVPAKGIASQTALFLTLPRHSPQSLCPCGSLAKEQGLPCLGPPRQPLGHLMLCARLGECACVYVQVAFGGRHRCVVRLCGRMGLCVRWAGGVEAGGRACGSAPAEPLHFQVSQSSLPMLSSPSPGQQVQTPQSMPPPPQPSPQPGQPSSQPNSNVSSGPAPSPSSFLPSPSPQPSQSPVTARTPQNFSVPSPGPLNTPVNPSSVMSPAGSSQAEEQQYLDKLKQLSKYIEPLRRMINKIDKNEDRKKDLSKMKSLLDILTDPSKRCPLKTLQKCEIALEKLKNDMAVPTPPPPPVPPTKQQYLCQPLLDAVLANIRSPVFNHSLYRTFVPAMTAIHGPPITAPVVCTRKRRLEDDERQSIPSVLQGEVARLDPKFLVNLDPSHCSNNGTVHLICKLDDKDLPSVPPLELSVPADYPAQSPLWIDRQWQYDANPFLQSVHRCMTSRLLQLPDKHSVTALLNTWAQSVHQACLSAA

SEQ ID NO: 861471 - protein, 781 aa, Homo sapiens
AAPARRAAPARRWDHSEDAMRKAGVAHSKSSKDMESHVFLKAKTRDEYLSLVARLIIHFRDIHNKKSQASVSDPMNALQSLTGGPAAGAAGIGMPPRGPGQSLGGMGSLGAMGQPMSLSGQPPPGTSGMAPHSMAVVSTATPQTQLQLQQVALQQQQQQQQFQQQQQAALQQQQQQQQQQQFQAQQSAMQQQFQAVVQQQQQLQQQQQQQQHLIKLHHQNQQQIQQQQQQLQRIAQLQLQQQQQQQQQQQQQQQQALQAQPPIQQPPMQQPQPPPSQALPQQLQQMHHTQHHQPPPQPQQPPVAQNQPSQLPPQSQTQPLVSQAQALPGQMLYTQPPLKFVRAPMVVQQPPVQPQVQQQQTAVQTAQAAQMVAPGVQMITEALAQGGMHIRARFPPTTAVSAIPSSSIPLGRQPMAQVSQSSLPMLSSPSPGQQVQTPQSMPPPPQPSPQPGQPSSQPNSNVSSGPAPSPSSFLPSPSPQPSQSPVTARTPQNFSVPSPGPLNTPVNPSSVMSPAGSSQAEEQQYLDKLKQLSKYIEPLRRMINKIDKNEDRKKDLSKMKSLLDILTDPSKRCPLKTLQKCEIALEKLKNDMAVPTPPPPPVPPTKQQYLCQPLLDAVLANIRSPVFNHSLYRTFVPAMTAIHGPPITAPVVCTRKRRLEDDERQSIPSVLQGEVARLDPKFLVNLDPSHCSNNGTVHLICKLDDKDLPSVPPLELSVPADYPAQSPLWIDRQWQYDANPFLQSVHRCMTSRLLQLPDKHSVTALLNTWAQSVHQACLSAA

SEQ ID NO: 861472 - protein, 741 aa, Homo sapiens; identical to SEQ ID NO: 861463

SEQ ID NO: 861473 - protein, 741 aa, Homo sapiens; identical to SEQ ID NO: 861463

SEQ ID NO: 861474 - protein, 741 aa, Homo sapiens; identical to SEQ ID NO: 861463

SEQ ID NO: 861475 - protein, 894 aa, Homo sapiens
AAPARRAAPARRWDHSEDAMRKAGVAHSKSSKDMESHVFLKAKTRDEYLSLVARLIIHFRDIHNKKSQASVSDPMNALQSLTGGPAAGAAGIGMPPRGPGQSLGGMGSLGAMGQPMSLSGQPPPGTSGMAPHSMAVVSTATPQTQLQLQQVALQQQQQQQQFQQQQQAALQQQQQQQQQQQFQAQQSAMQQQFQAVVQQQQQLQQQQQQQQHLIKLHHQNQQQIQQQQQQLQRIAQLQLQQQQQQQQQQQQQQQQALQAQPPIQQPPMQQPQPPPSQALPQQLQQMHHTQHHQPPPQPQQPPVAQNQPSQLPPQSQTQPLVSQAQALPGQMLYTQPPLKFVRAPMVVQQPPVQPQVQQQQTAVQTAQAAQMVAPGVQVSQSSLPMLSSPSPGQQVQTPQSMPPPPQPSPQPGQPSSQPNSNVSSGPAPSPSSFLPSPSPQPSQSPVTARTPQNFSVPSPGPLNTPVNPSSVMSPAGSSQAEEQQYLDKLKQLSKYIEPLRRMINKIDKNEDRKKDLSKMKSLLDILTDPSKRCPLKTLQKCEIALEKLKNDMAVPTPPPPPVPPTKQQYLCQPLLDAVLANIRSPVFNHSLYRTFVPAMTAIHGPPITAPVVCTRKRRLEDDERQSIPSVLQGEVARLDPKFLVNLDPSHCSNNGTVHLICKLGECPEGRDWCGKAGPDRSPRTLPSKPDGTAPRTHPVFTPRQAVCSILTHTGLQTACHASVPTARARTLSPPQHRCGFACLGPREVVGRTSGHPSMQSTPGFTFGNLRVRETSSRLCHKLHQNLPGCGVLFQSRAVRQGRPGLVQVTDRAFCVADDKDLPSVPPLELSVPADYPAQSPLWIDRQWQYDANPFLQSVHRCMTSRLLQLPDKHSVTALLNTWAQSVHQACLSAA

SEQ ID NO: 861476 - protein, 741 aa, Homo sapiens; identical to SEQ ID NO: 861463

SEQ ID NO: 861477 - protein, 386 aa, Homo sapiens
AAPARRAAPARRWDHSEDAMRKAGVAHSKSSKDMESHVFLKAKTRDEYLSLVARLIIHFRDIHNKKSQASVSDPMNALQSLTGGPAAGAAGIGMPPRGPGQSLGGMGSLGAMGQPMSLSGQPPPGTSGMAPHSMAVVSTATPQTQLQLQQVALQQQQQQQQFQQQQQAALQQQQQQQQQQQFQAQQSAMQQQFQAVVQQQQQLQQQQQQQQHLIKLHHQNQQQIQQQQQQLQRIAQLQLQQQQQQQQQQQQQQQQALQAQPPIQQPPMQQPQPPPSQALPQQLQQMHHTQHHQPPPQPQQPPVAQNQPSQLPPQSQTQPLVSQAQALPGQMLYTQPPLKFVRAPMVVQQPPVQPQVQQQQTAVQTAQAAQMVAPGVQVRAWGWRAP

SEQ ID NO: 861478 - protein, 104 aa, Homo sapiens
MIGNPKINTNATSYSIFLSVVNGTFRFQRQPWQWGFCWLFCPLLCSPAAFLGICPVELTGDSGLFSAQLQLQQVALQQQQQQQQFQQQQQAALQQQQQQQQQQQ

SEQ ID NO: 861479 - protein, 199 aa, Homo sapiens
MDALNSMQNFLRGRPKTFKSLENAIEWSVKSGQIRNLESARVSMVGQVKQCEGITSPEGSKSIVEGIIEEEEEDEEGSESISKRKKEDDMETKKDHPYTWRIELAKTEKYWDGWFRGLSNLFLSCPIPKLLLLAGVDRLDKDLTIGQMQGKFQMQVLPQCGHAVHEDAPDKVAEAVATFLIRHRFAEPIGGFQCVFPGC

SEQ ID NO: 861480 - protein, 138 aa, Homo sapiens
MSALEKSMHLGRLPSRPPLPGSGGSQSGAKMRMGPGRKRDFSPVPWSQYFESMEDVEVENETGKDTFRVYKSGSEGPVLLLLHGGGHSALSWAVFTDKLCDLSISTRLCHVSGPVLSNRNRVQTTYVILNFLVDTLNR

SEQ ID NO: 861481 - protein, 386 aa, Homo sapiens; identical to SEQ ID NO: 792910

SEQ ID NO: 861482 - protein, 390 aa, Homo sapiens
MSALEKSMHLGRLPSRPPLPGSGGSQSGAKMRMGPGRKRDFSPVPWSQYFESMEDVEVENETGKDTFRVYKSGSEGPVLLLLHGGGHSALSWAVFTQRLISTSSVEDSYASDLRQLMVKQRSNTSCHDLPAQTMATRRLRTAADAMYGDLPPPIMLIGHSMGGAIAVHTASSNLVPSLLGLCMIDVVEGTAMDALNSMQNFLRGRPKTFKSLENAIEWSVKSGQIRNLESARVSMVGQVKQCEGITSPEGSKSIVEGIIEEEEEDEEGSESISKRKKEDDMETKKDHPYTWRIELAKTEKYWDGWFRGLSNLFLSCPIPKLLLLAGVDRLDKDLTIGQMQGKFQMQVLPQCGHAVHEDAPDKVAEAVATFLIRHRFAEPIGGFQCVFPGC

SEQ ID NO: 861483 - protein, 386 aa, Homo sapiens; identical to SEQ ID NO: 792910

SEQ ID NO: 861484 - protein, 260 aa, Homo sapiens
MSALEKSMHLGRLPSRPPLPGSGGSQSGAKMRMGPGRKRDFSPVPWSQYFESMEDVEVENETGKDTFRVYKSGSEGPVLLLLHGGGHSALSWAVFTAAIISRVQCRIVALDLRSHGETKVKNPEDLSAETMAKDVGNVVEAMYGDLPPPIMLIGHSMGGAIAVHTASSNLVPSLLGLCMIDVVEGTAMDALNSMQNFLRGRPKTFKSLENAIEWSVKSGQIRNLESARVSMVGQVKQGSPAPFPSLYWGSSCLLSLRCLG

SEQ ID NO: 861485 - protein, 450 aa, Homo sapiens
MSALEKSMHLGRLPSRPPLPGSGGSQSGAKMRMGPGRKRDFSPVPWSQYFESMEDVEVENETGKDTFRVYKSGSEGPVLLLLHGGGHSALSWAVFTAAIISRVQCRIVALDLRSHGETKVKNPEDLSAETMAKDVGNVVEAMYGDLPPPIMLIGHSMGGAIAVHTASSNLVPSLLGLCMIDVVEGTAMDALNSMQNFLRGRPKTFKSLENAIEWSVKSGQIRNLESARVSMVGQVKQCEGITSPEGSKSIVEGIIEEEEEDEEGSESISKRKKEDDMETKKDHPYTWRIELAKTEKYWDGWFRGLSNLFLSCPIPKLLLLAGVDRLDKDLTIGQMQGKFQMQVLPQCGHAVHEDAPDKVAEAVATFLIRHRFAEPIGGFQCVLSMSCLSDTACSNPLRTSIGDSCMYTYSQTKKAHVVIAHLFITLPSRAEPMLNTWTHLVMTGAPPRGM

SEQ ID NO: 861486 - protein, 106 aa, Homo sapiens
MSALEKSMHLGRLPSRPPLPGSGGSQSGAKMRMGPGRKRDFSPVPWSQYFESMEDVEVENCLDPGGKGCSEWRSCMPLHSSLGDKSKILSQTKQNKTNKKLLTRIF

SEQ ID NO: 861487 - protein, 125 aa, Homo sapiens
MRTSGGSAEASGWSLRSRWAVGGATGSWVLSKGDRASLGERVVTGWATLNVGRSFAYCLTTCVQPPLDVGPRKEHAPRPPSLSPTSTRQRGQSERSQDANGVRDPYPFSLWARPQPLENGISGRS

SEQ ID NO: 861488 - protein, 334 aa, Homo sapiens
DGSESVSWSSLLPGLKSRRSYPIQALLLLLHGGGHSALSWAVFTAAIISRVQCRIVALDLRSHGETKVKNPEDLSAETMAKDVGNVVEAMYGDLPPPIMLIGHSMGGAIAVHTASSNLVPSLLGLCMIDVVEGTAMDALNSMQNFLRGRPKTFKSLENAIEWSVKSGQIRNLESARVSMVGQVKQCEGITSPEGSKSIVEGIIEEEEEDEEGSESISKRKKEDDMETKKDHPYTWRIELAKTEKYWDGWFRGLSNLFLSCPIPKLLLLAGVDRLDKDLTIGQMQGKFQMQVLPQCGHAVHEDAPDKVAEAVATFLIRHRFAEPIGGFQCVFPGC

SEQ ID NO: 861489 - protein, 386 aa, Homo sapiens; identical to SEQ ID NO: 792910

SEQ ID NO: 861490 - protein, 386 aa, Homo sapiens; identical to SEQ ID NO: 792910

SEQ ID NO: 861491 - protein, 341 aa, Homo sapiens
MSALEKSMHLGRLPSRPPLPGSGGSQSGAKMRMGPGRKRDFSPVPWSQYFESMEDVEVENETGKDTFRVYKSGSEGPVLLLLHGGGHSALSWAVFTAAIISRVQCRIVALDLRSHGETKVKNPEDLSAETMAKDVGNVVEAMYGDLPPPIMLIGHSMGGAIAVHTASSNLVPSLLGLCMIDVVEGTAMDALNSMQNFLRGRPKTFKSLENAIEWSVKSGQIRNLESARVSMVGQVKQCEGITSPEGSKSIVEGIIEEEEEDEEGSESISKRKKEDDMERAMCLMLLSVARAFLSMVVRTEEVAGFRWPDLRLLTTTTPLPSDDDLNAHSLAVNQSGVAKGI

SEQ ID NO: 861492 - protein, 914 aa, Homo sapiens
MSQSQNAIFTSPTGEENLMNSNHRDSESITDVCSNEDLPEVELVSLLEEQLPQYRLKVDTLFLYENQDWTQSPHQRQHASDALSPVLAEETFRYMILGTDRVEQMTKTYNDIDMVTHLLAERDRDLELAARIGQALLKRNHVLSEQNESLEEQLGQAFDQVNQLQHELCKKDELLRIVSIASEESETDSSCSTPLRFNESFSLSQGLLQLEMLQEKLKELEEENMALRSKACHIKTETVTYEEKEQQLVSDCVKELRETNAQMSRMTEELSGKSDELIRYQEELSSLLSQIVDLQHKLKEHVIEKEELKLHLQASKDAQRQLTMELHELQDRNMECLGMLHESQEEIKELRSRSGPTAHLYFSQSYGAFTGESLAAEIEGTMRKKLSLDEESSLFKQKAQQKRVFDTVRIANDTRGRSISFPALLPIPGSNRSSVIMTAKPFESGLQQTEDKSLLNQGSSSEEVAGSSQKMGQPGPSGDSDLATALHRLSLRRQNYLSEKQFFAEEWQRKIQVLADQKEGVSGCVTPTESLASLCTTQSEITDLSSASCLRGFMPEKLQIVKPLEGSQTLYHWQQLAQPNLGTILDPRPGVITKGFTQLPGDAIYHISDLEEDEEEGITFQVQQPLEVEEKLSTSKPVTGIFLPPITSAGGPVTVATANPGKCLSCTNSTFTFTTCRILHPSDITQVTPSSGFPSLSCGSSGSSSSNTAVNSPALSYRLSIGESITNRRDSTTTFSSTMSLAKLLQERGISAKVYHSPISENPLQPLPKSLAIPSTPPNSPSHSPCPSPLPFEPRVHLSENFLASRPAETFLQEMYGLRPSRNPPDVGQLKMNLVDRLKRLGIARVVKNPGAQENGRCQEAEIGPQKPDSAVYLNSGSSLLGGLRRNQSLPVIMGSFAAPVCTSSPKMGVLKED

SEQ ID NO: 861493 - protein, 361 aa, Homo sapiens [sequence omitted]

SEQ ID NO: 861494 - protein, 914 aa, Homo sapiens; identical to SEQ ID NO: 861492

SEQ ID NO: 861495 - protein, 664 aa, Homo sapiens
MSQSQNAIFTSPTGEENLMNSNHRDSESITDVCSNEDLPEVELVSLLEEQLPQYRLKVDTLFLYENQDWTQSPHQRQHASDALSPVLAEETFRYMILGTDRVEQMTKTYNDIDMVTHLLAERDRDLELAARIGQALLKRNHVLSEQNESLEEQLGQAFDQVNQLQHELCKKDELLRIVSIASEESETDSSCSTPLRFNESFSLSQGLLQLEMLQEKLKELEEENMALRSKACHIKTETVTYEEKEQQLVSDCVKELRETNAQMSRMTEELSGKSDELIRYQEELSSLLSQIVDLQHKLKEHVIEKEELKLHLQASKDAQRQLTMELHELQDRNMECLGMLHESQEEIKELRSRSGPTAHLYFSQSYGAFTGESLAAEIEGTMRKKLSLDEESSLFKQKAQQKRVFDTVRIANDTRGRSISFPALLPIPGSNRSSVIMTAKPFESGLQQTEDKSLLNQGSSSEEVAGSSQKMGQPGPSGDSDLATALHRLSLRRQNYLSEKQFFAEEWQRKIQVLADQKEGVSGCVTPTESLASLCTTQSEITDLSSASCLRGFMPEKLQIVKPLEGSQTLYHWQQLAQPNLGTILDPRPGVITKGFTQLPGDAIYHISDLEEDEEEGITFQVQQPLEVEEKLSTSKPVTGIFLPPITSAGGPVTGEKSVWLNMV

SEQ ID NO: 861496 - protein, 176 aa, Homo sapiens [sequence omitted]

SEQ ID NO: 861497 - protein, 914 aa, Homo sapiens; identical to SEQ ID NO: 861492

SEQ ID NO: 861498 - protein, 1158 aa, Homo sapiens
GTHIGWRGASGGSFSRVGEGTGLQEGSNNSSPVDFVNNKRTDLSSEHFSHSSKWLETCQHESDEQPLDPIPQISSTPKTSEEAVDPLGNYMVKTIVLVPSPLGQQQDMIFEARLDTMAETNSISLNGPLRTDDLVREEVAPCMGDRFSEVAAVSEKPIFQESPSHLLEESPPNPCSEQLHCSKESLSSRTEAVREDLVPSESNAFLPSSVLWLSPSTALAADFRVNHVDPEEEIVEHGAMEEREMRFPTHPKESETEDQALVSSVEDILSTCLTPNLVEMESQEAPGPAVEDVGRILGSDTESWMSPLAWLEKGVNTSVMLENLRQSLSLPSMLRDAAIGTTPFSTCSVGTWFTPSAPQEKSTNTSQTGLVGTKHSTSETEQLLCGRPPDLTALSRHDLEDNLLSSLVILEVLSRQLRDWKSQLAVPHPETQDSSTQTDTSHSGITNKLQHLKESHEMGQALQQARNVMQSWVLISKELISLLHLSLLHLEEDKTTVSQESRRAETLVCCCFDLLKKLRAKLQSLKAEREEARHREEMALRGKDAAEIVLEAFCAHASQRISQLEQDLASMREFRGLLKDAQTQLVGLHAKQEELVQQTVSLTSTLQQDWRSMQLDYTTWTALLSRSRQLTEKLTVKSQQALQERDVAIEEKQEVSRVLEQVSAQLEECKGQTEQLELENSRLATDLRAQLQILANMDSQLKELQSQHTHCAQDLAMKDELLCQLTQSNEEQAAQWQKEEMALKHMQAELQQQQAVLAKEVRDLKETLEFADQENQVAHLELGQVECQLKTTLEVLRERSLQCENLKDTVENLTAKLASTIADNQEQDLEKTRQYSQKLGLLTEQLQSLTLFLQTKLKEKTEQETLLLSTACPPTQEHPLPNDRTFLGSILTAVADEEPESTPVPLLGSDKSAFTRVASMVSLQPAETPGMEESLAEMSIMTTELQSLCSLLQESKEEAIRTLQRKICELQARLQAQEEQHQEVQKAKEADIEKLNQALCLRYKNEKELQEVIQQQNEKILEQIDKSGELISLREEVTHLTRSLRRAETETKVLQEALAGQLDSNCQPMATNWIQEKVWLSQEVDKLRVMFLEMKNEKEKLMIKFQSHRNILEENLRRSDKELEKLDDIVQHIYKTLLSIPEVVRGCKELQGLLEFLS

SEQ ID NO: 861499 - protein, 1208 aa, Homo sapiens
MWRVKKLSLSLSPSPQTGKPSMRTPLRELTLQPGALTNSGKRSPACSSLTPSLCKLGLQEGSNNSSPVDFVNNKRTDLSSEHFSHSSKWLETCQHESDEQPLDPIPQISSTPKTSEEAVDPLGNYMVKTIVLVPSPLGQQQDMIFEARLDTMAETNSISLNGPLRTDDLVREEVAPCMGDRFSEVAAVSEKPIFQESPSHLLEESPPNPCSEQLHCSKESLSSRTEAVREDLVPSESNAFLPSSVLWLSPSTALAADFRVNHVDPEEEIVEHGAMEEREMRFPTHPKESETEDQALVSSVEDILSTCLTPNLVEMESQEAPGPAVEDVGRILGSDTESWMSPLAWLEKGVNTSVMLENLRQSLSLPSMLRDAAIGTTPFSTCSVGTWFTPSAPQEKSTNTSQTGLVGTKHSTSETEQLLCGRPPDLTALSRHDLEDNLLSSLVILEVLSRQLRDWKSQLAVPHPETQDSSTQTDTSHSGITNKLQHLKESHEMGQALQQARNVMQSWVLISKELISLLHLSLLHLEEDKTTVSQESRRAETLVCCCFDLLKKLRAKLQSLKAEREEARHREEMALRGKDAAEIVLEAFCAHASQRISQLEQDLASMREFRGLLKDAQTQLVGLHAKQEELVQQTVSLTSTLQQDWRSMQLDYTTWTALLSRSRQLTEKLTVKSQQALQERDVAIEEKQEVSRVLEQVSAQLEECKGQTEQLELENSRLATDLRAQLQILARRSATDLRAQLQILANMDSQLKELQSQHTHCAQDLAMKDELLCQLTQSNEEQAAQWQKEEMALKHMQAELQQQQAVLAKEVRDLKETLEFADQENQVAHLELGQVECQLKTTLEVLRERSLQCENLKDTVENLTAKLASTIADNQEQDLEKTRQYSQKLGLLTEQLQSLTLFLQTKLKEKTEQETLLLSTACPPTQEHPLPNDRTFLGSILTAVADEEPESTPVPLLGSDKSAFTRVASMVSLQPAETPGMEESLAEMSIMTTELQSLCSLLQESKEEAIRTLQRKICELQARLQAQEEQHQEVQKAKEADIEKLNQALCLRYKNEKELQEVIQQQNEKILEQIDKSGELISLREEVTHLTRSLRRAETETKVLQEALAGQLDSNCQPMATNWIQEKVWLSQEVDKLRVMFLEMKNEKEKLMIKFQSHRNILEENLRRSDKELEKLDDIVQHIYKTLLSIPEVVRGCKELQGLLEFLS

SEQ ID NO: 861500 - protein, 1193 aa, Homo sapiens
MWRVKKLSLSLSPSPQTGKPSMRTPLRELTLQPGALTNSGKRSPACSSLTPSLCKLGLQEGSNNSSPVDFVNNKRTDLSSEHFSHSSKWLETCQHESDEQPLDPIPQISSTPKTSEEAVDPLGNYMVKTIVLVPSPLGQQQDMIFEARLDTMAETNSISLNGPLRTDDLVREEVAPCMGDRFSEVAAVSEKPIFQESPSHLLEESPPNPCSEQLHCSKESLSSRTEAVREDLVPSESNAFLPSSVLWLSPSTALAADFRVNHVDPEEEIVEHGAMEEREMRFPTHPKESETEDQALVSSVEDILSTCLTPNLVEMESQEAPGPAVEDVGRILGSDTESWMSPLAWLEKGVNTSVMLENLRQSLSLPSMLRDAAIGTTPFSTCSVGTWFTPSAPQEKSTNTSQTGLVGTKHSTSETEQLLCGRPPDLTALSRHDLEDNLLSSLVILEVLSRQLRDWKSQLAVPHPETQDSSTQTDTSHSGITNKLQHLKESHEMGQALQQARNVMQSWVLISKELISLLHLSLLHLEEDKTTVSQESRRAETLVCCCFDLLKKLRAKLQSLKAEREEARHREEMALRGKDAAEIVLEAFCAHASQRISQLEQDLASMREFRGLLKDAQTQLVGLHAKQEELVQQTVSLTSTLQQDWRSMQLDYTTWTALLSRSRQLTEKLTVKSQQALQERDVAIEEKQEVSRVLEQVSAQLEECKGQTEQLELENSRLATDLRAQLQILANMDSQLKELQSQHTHCAQDLAMKDELLCQLTQSNEEQAAQWQKEEMALKHMQAELQQQQAVLAKEVRDLKETLEFADQENQVAHLELGQVECQLKTTLEVLRERSLQCENLKDTVENLTAKLASTIADNQEQDLEKTRQYSQKLGLLTEQLQSLTLFLQTKLKEKTEQETLLLSTACPPTQEHPLPNDRTFLGSILTAVADEEPESTPVPLLGSDKSAFTRVASMVSLQPAETPGMEESLAEMSIMTTELQSLCSLLQESKEEAIRTLQRKICELQARLQAQEEQHQEVQKAKEADIEKLNQALCLRYKNEKELQEVIQQQNEKILEQIDKSGELISLREEVTHLTRSLRRAETETKVLQEALAGQLDSNCQPMATNWIQEKVWLSQEVDKLRVMFLEMKNEKEKLMIKFQSHRNILEENLRRSDKELEKLDDIVQHIYKTLLSIPEVVRGCKELQGLLEFLS

SEQ ID NO: 861501 - protein, 1171 aa, Homo sapiens
MWRVKKLSLSLSPSPQTGKPSMRTPLRELTLQPGALTNSGKRSPACSSLTPSLCKLGLQEGSNNSSPVDFVNNKRTDLSSEHFSHSSKWLETCQHESDEQPLDPIPQISSTPKTSEEAVDPLGNYMVKTIVLVPSPLGQQQDMIFEARLDTMAETNSISLNGPLRTDDLVREEVAPCMGDRFSEVAAVSEKPIFQESPSHLLEESPPNPCSEQLHCSKESLSSRTEAVREDLVPSESNAFLPSSVLWLSPSTALAADFRVNHVDPEEEIVEHGAMEEREMRFPTHPKESETEDQALVSSVEDILSTCLTPNLVEMESQEAPGPAVEDVGRILGSDTESWMSPLAWLEKGVNTSVMLENLRQSLSLPSMLRDAAIGTTPFSTCSVGTWFTPSAPQEKSTNTSQTGLVGTKHSTSETEQLLCGRPPDLTALSRHDLEDNLLSSLVILEVLSRQLRDWKSQLAVPHPETQDSSTQTDTSHSGITNKLQHLKESHEMGQALQQARNVMQSWVLISKELISLLHLSLLHLEEDKTTVSQESRRAETLVCCCFDLLKKLRAKLQSLKAEREEARHREEMALRGKDAAEIVLEAFCAHASQRISQLEQDLASMREFRGLLKDAQTQLVGLHAKQEELVQQTVSLTSTLQQDWRSMQLDYTTWTALLSRSRQLTEKLTVKSQQALQERDVAIEEKQEVSRVLEQVSAQLEECKGQTEQLELENSRLATDLRAQLQILANMDSQLKELQSQHTHCAQDLAMKDELLCQLTQSNEEQAAQWQKEEMALKHMQAELQQQQAVLAKEVRDLKETLEFADQENQVAHLELGQVECQLKTTLEVLRERSLQCENLKDTVENLTAKLASTIADNQEQDLEKTRQYSQKLGLLTEQLQSLTLFLQTKLKEKTEQETLLLSTACPPTQEHPLPNDRTFLGSILTAVADEEPESTPVPLLGSDKSAFTRVASMVSLQPAETPGMEESLAEMSIMTTELQSLCSLLQESKEEAIRTLQRKICELQARLQAQEEQHQEVQKAKEADIEKLNQALCLRYKNEKELQEVIQQQNEKILEQIDKSGELISLREEVTHLTRSLRRAETETKVLQEALAGQLDSNCQPMATNWIQEKVWLSQEVDKLRVMFLEMKNEKEKLMIKFQSHRNILEENLRRSDKELEKLDDIVQHIYKV

SEQ ID NO: 861502 - protein, 1122 aa, Homo sapiens
MWRVKKLSLSLSPSPQTGKPSMRTPLRELTLQPGALTNSGKRSPACSSLTPSLCKLGLQEGSNNSSPVDFVNNKRTDLSSEHFSHSSKWLETCQHESDEQPLDPIPQISSTPKTSEEAVDPLGNYMVKTIVLVPSPLGQQQDMIFEARLDTMAETNSISLNGPLRTDDLVREEVAPCMGDRFSEVAAVSEKPIFQESPSHLLEESPPNPCSEQLHCSKESLSSRTEAVREDLVPSESNAFLPSSVLWLSPSTALAADFRVNHVDPEEEIVEHGAMEEREMRFPTHPKESETEDQALVSSVEDILSTCLTPNLVEMESQEAPGPAVEDVGRILGSDTESWMSPLAWLEKGVNTSVMLENLRQSLSLPSMLRDAAIGTTPFSTCSVGTWFTPSAPQEKSTNTSQTGLVGTKHSTSETEQLLCGRPPDLTALSRHDLEDNLLSSLVILEVLSRQLRDWKSQLAVPHPETQDSSTQTDTSHSGITNKLQHLKESHEMGQALQQARNVMQSWVLISKELISLLHLSLLHLEEDKTTVSQESRRAETLVCCCFDLLKKLRAKLQSLKAEREEARHREEMALRGKDAAEIVLEAFCAHASQRISQLEQDLASMREFRGLLKDAQTQLVGLHAKQEELVQQTVSLTSTLQQDWRSMQLDYTTWTALLSRSRQLTEKLTVKSQQALQERDVAIEEKQEVSRVLEQVSAQLEECKGQTEQLELENSRLATDLRAQLQILANMDSQLKELQSQHTHCAQDLAMKDELLCQLTQSNEEQAAQWQKEEMALKHMQAELQQQQAVLAKEVRDLKETLEFADQENQVAHLELGQVECQLKTTLEVLRERSLQCENLKDTVENLTAKLASTIADNQEQDLEKTRQYSQKLGLLTEQLQSLTLFLQTKLKEKTEQETLLLSTACPPTQEHPLPNDRTFLGSILTAVADEEPESTPVPLLGSDKSAFTRVASMVSLQPAETPGMEESLAEMSIMTTELQSLCSLLQESKEEAIRTLQRKICELQARLQAQEEQHQEVQKAKEADIEKLNQALCLRYKNEKELQEVIQQQNEKILEQIDKSGELISLREEVTHLTRSLRRAETETKVLQEALAGQLDSNCQPMATNWIQEKVWLSQEVTQS

SEQ ID NO: 861503 - protein, 1122 aa, Homo sapiens; identical to SEQ ID NO: 861502

SEQ ID NO: 861504 - protein, 919 aa, Homo sapiens
MEEREMRFPTHPKESETEDQALVSSVEDILSTCLTPNLVEMESQEAPGPAVEDVGRILGSDTESWMSPLAWLEKGVNTSVMLENLRQSLSLPSMLRDAAIGTTPFSTCSVGTWFTPSAPQEKSTNTSQTGLVGTKHSTSETEQLLCGRPPDLTALSRHDLEDNLLSSLVILEVLSRQLRDWKSQLAVPHPETQDSSTQTDTSHSGITNKLQHLKESHEMGQALQQARNVMQSWVLISKELISLLHLSLLHLEEDKTTVSQESRRAETLVCCCFDLLKKLRAKLQSLKAEREEARHREEMALRGKDAAEIVLEAFCAHASQRISQLEQDLASMREFRGLLKDAQTQLVGLHAKQEELVQQTVSLTSTLQQDWRSMQLDYTTWTALLSRSRQLTEKLTVKSQQALQERDVAIEEKQEVSRVLEQVSAQLEECKGQTEQLELENSRLATDLRAQLQILANMDSQLKELQSQHTHCAQDLAMKDELLCQLTQSNEEQAAQWQKEEMALKHMQAELQQQQAVLAKEVRDLKETLEFADQENQVAHLELGQVECQLKTTLEVLRERSLQCENLKDTVENLTAKLASTIADNQEQDLEKTRQYSQKLGLLTEQLQSLTLFLQTKLKEKTEQETLLLSTACPPTQEHPLPNDRTFLGSILTAVADEEPESTPVPLLGSDKSAFTRVASMVSLQPAETPGMEESLAEMSIMTTELQSLCSLLQESKEEAIRTLQRKICELQARLQAQEEQHQEVQKAKEADIEKLNQALCLRYKNEKELQEVIQQQNEKILEQIDKSGELISLREEVTHLTRSLRRAETETKVLQEALAGQLDSNCQPMATNWIQEKVWLSQEVDKLRVMFLEMKNEKEKLMIKFQSHRNILEENLRRSDKELEKLDDIVQHIYKTLLSIPEVVRGCKELQGLLEFLS

SEQ ID NO: 861505 - protein, 894 aa, Homo sapiens
MEEREMRFPTHPKESETEDQALVSSVEDILSTCLTPNLVEMESQEAPGPAVEDVGRILGSDTESWMSPLAWLEKGVNTSVMLENLRQSLSLPSMLRDAAIGTTPFSTCSVGTWFTPSAPQEKSTNTSQTGLVGTKHSTSETEQLLCGRPPDLTALSRHDLEDNLLSSLVILEVLSRQLRDWKSQLAVPHPETQDSSTQTDTSHSGQSWVLISKELISLLHLSLLHLEEDKTTVSQESRRAETLVCCCFDLLKKLRAKLQSLKAEREEARHREEMALRGKDAAEIVLEAFCAHASQRISQLEQDLASMREFRGLLKDAQTQLVGLHAKQEELVQQTVSLTSTLQQDWRSMQLDYTTWTALLSRSRQLTEKLTVKSQQALQERDVAIEEKQEVSRVLEQVSAQLEECKGQTEQLELENSRLATDLRAQLQILANMDSQLKELQSQHTHCAQDLAMKDELLCQLTQSNEEQAAQWQKEEMALKHMQAELQQQQAVLAKEVRDLKETLEFADQENQVAHLELGQVECQLKTTLEVLRERSLQCENLKDTVENLTAKLASTIADNQEQDLEKTRQYSQKLGLLTEQLQSLTLFLQTKLKEKTEQETLLLSTACPPTQEHPLPNDRTFLGSILTAVADEEPESTPVPLLGSDKSAFTRVASMVSLQPAETPGMEESLAEMSIMTTELQSLCSLLQESKEEAIRTLQRKICELQARLQAQEEQHQEVQKAKEADIEKLNQALCLRYKNEKELQEVIQQQNEKILEQIDKSGELISLREEVTHLTRSLRRAETETKVLQEALAGQLDSNCQPMATNWIQEKVWLSQEVDKLRVMFLEMKNEKEKLMIKFQSHRNILEENLRRSDKELEKLDDIVQHIYKTLLSIPEVVRGCKELQGLLEFLS

SEQ ID NO: 861506 - protein, 520 aa, Homo sapiens
MWRVKKLSLSLSPSPQTGKPSMRTPLRELTLQPGALTNSGKRSPACSSLTPSLCKLGLQEGSNNSSPVDFVNNKRTDLSSEHFSHSSKWLETCQHESDEQPLDPIPQISSTPKTSEEAVDPLGNYMVKTIVLVPSPLGQQQDMIFEARLDTMAETNSISLNGPLRTDDLVREEVAPCMGDRFSEVAAVSEKPIFQESPSHLLEESPPNPCSEQLHCSKESLSSRTEAVREDLVPSESNAFLPSSVLWLSPSTALAADFRVNHVDPEEEIVEHGAMEEREMRFPTHPKESETEDQALVSSVEDILSTCLTPNLVEMESQEAPGPAVEDVGRILGSDTESWMSPLAWLEKGVNTSVMLENLRQSLSLPSMLRDAAIGTTPFSTCSVGTWFTPSAPQEKSTNTSQTGLVGTKHSTSETEQLLCGRPPDLTALSRHDLEDNLLSSLVILEVLSRQLRDWKSQLAVPHPETQDSSTQTDTSHSGLINFSLPKAPGLQRPAGSLSWLPLFSLTVDQRAACVILKPL

SEQ ID NO: 861507 - protein, 284 aa, Homo sapiens
MWRVKKLSLSLSPSPQTGKPSMRTPLRELTLQPGALTNSGKRSPACSSLTPSLCKLGLQEGSNNSSPVDFVNNKRTDLSSEHFSHSSKWLETCQHESDEQPLDPIPQISSTPKTSEEAVDPLGNYMVKTIVLVPSPLGQQQDMIFEARLDTMAETNSISLNGPLRTDDLVREEVAPCMGDRFSEVAAVSEKPIFQESPSHLLEESPPNPCSEQLHCSKESLSSRTEAVREDLVPSESNAFLPSSVLWLSPSTALAADFRVNHVDPEARTHDEDLSRHRPAEFKL

SEQ ID NO: 861508 - protein, 265 aa, Homo sapiens
MWRVKKLSLSLSPSPQTGKPSMRTPLRELTLQPGALTNSGKRSPACSSLTPSLCKLGLQEGSNNSSPVDFVNNKRTDLSSEHFSHSSKWLETCQHESDEQPLDPIPQISSTPKTSEEAVDPLGNYMVKTIVLVPSPLGQQQDMIFEARVNTSVMLENLRQSLSLPSMLRDAAIGTTPFSTCSVGTWFTPSAPQEKSTNTSQTGLVGTKHSTSETEQLLCGRPPDLTALSRHDLEDNLLSSLVILEVLSRQLRDWKSQLAVPHPPP

SEQ ID NO: 861509 - protein, 45 aa, Homo sapiens
MWRVKKLSLSLSPSPQTVSGRSLAERTGPGCCRGGTGRVYCPGKL

SEQ ID NO: 861510 - protein, 1193 aa, Homo sapiens; identical to SEQ ID NO: 861500

SEQ ID NO: 861511 - protein, 1214 aa, Homo sapiens
RRAQGGQKPPVGRDRPAFWLKMWRVKKLSLSLSPSPQTGKPSMRTPLRELTLQPGALTNSGKRSPACSSLTPSLCKLGLQEGSNNSSPVDFVNNKRTDLSSEHFSHSSKWLETCQHESDEQPLDPIPQISSTPKTSEEAVDPLGNYMVKTIVLVPSPLGQQQDMIFEARLDTMAETNSISLNGPLRTDDLVREEVAPCMGDRFSEVAAVSEKPIFQESPSHLLEESPPNPCSEQLHCSKESLSSRTEAVREDLVPSESNAFLPSSVLWLSPSTALAADFRVNHVDPEEEIVEHGAMEEREMRFPTHPKESETEDQALVSSVEDILSTCLTPNLVEMESQEAPGPAVEDVGRILGSDTESWMSPLAWLEKGVNTSVMLENLRQSLSLPSMLRDAAIGTTPFSTCSVGTWFTPSAPQEKSTNTSQTGLVGTKHSTSETEQLLCGRPPDLTALSRHDLEDNLLSSLVILEVLSRQLRDWKSQLAVPHPETQDSSTQTDTSHSGITNKLQHLKESHEMGQALQQARNVMQSWVLISKELISLLHLSLLHLEEDKTTVSQESRRAETLVCCCFDLLKKLRAKLQSLKAEREEARHREEMALRGKDAAEIVLEAFCAHASQRISQLEQDLASMREFRGLLKDAQTQLVGLHAKQEELVQQTVSLTSTLQQDWRSMQLDYTTWTALLSRSRQLTEKLTVKSQQALQERDVAIEEKQEVSRVLEQVSAQLEECKGQTEQLELENSRLATDLRAQLQILANMDSQLKELQSQHTHCAQDLAMKDELLCQLTQSNEEQAAQWQKEEMALKHMQAELQQQQAVLAKEVRDLKETLEFADQENQVAHLELGQVECQLKTTLEVLRERSLQCENLKDTVENLTAKLASTIADNQEQDLEKTRQYSQKLGLLTEQLQSLTLFLQTKLKEKTEQETLLLSTACPPTQEHPLPNDRTFLGSILTAVADEEPESTPVPLLGSDKSAFTRVASMVSLQPAETPGMEESLAEMSIMTTELQSLCSLLQESKEEAIRTLQRKICELQARLQAQEEQHQEVQKAKEADIEKLNQALCLRYKNEKELQEVIQQQNEKILEQIDKSGELISLREEVTHLTRSLRRAETETKVLQEALAGQLDSNCQPMATNWIQEKVWLSQEVDKLRVMFLEMKNEKEKLMIKFQSHRNILEENLRRSDKELEKLDDIVQHIYKTLLSIPEVVRGCKELQGLLEFLS

SEQ ID NO: 861512 - protein, 1224 aa, Homo sapiens
MWRVKKLSLSLSPSPQTGKPSMRTPLRELTLQPGALTNSGKRSPACSSLTPSLCKLGLQEGSNNSSPVDFVNNKRTDLSSEHFSHSSKWLETCQHESDEQPLDPIPQISSTPKTSEEAVDPLGNYMVKTIVLVPSPLGQQQDMIFEARLDTMAETNSISLNGPLRTDDLVREEVAPCMGDRFSEVAAVSEKPIFQESPSHLLEESPPNPCSEQLHCSKESLSSRTEAVREDLVPSESNAFLPSSVLWLSPSTALAADFRVNHVDPEEEIVEHGAMEEREMRFPTHPKESETEDQALVSSVEDILSTCLTPNLVEMESQEAPGPAVEDVGRILGSDTESWMSPLAWLEKGVNTSVMLENLRQSLSLPSMLRDAAIGTTPFSTCSVGTWFTPSAPQEKSTNTSQTGLVGTKHSTSETEQLLCGRPPDLTALSRHDLEDNLLSSLVILEVLSRQLRDWKSQLAVPHPETQDSSTQTDTSHSGITNKLQHLKESHEMGQALQQARNVMQSWVLISKELISLLHLSLLHLEEDKTTVSQESRRAETLVCCCFDLLKKLRAKLQSLKAEREEARHREEMALRGKDAAEIVLEAFCAHASQRISQLEQDLASMREFRGLLKDAQTQLVGLHAKQEELVQQTVSLTSTLQQDWRSMQLDYTTWTALLSRSRQLTEKLTVKSQQALQERDVAIEEKQEVSRVLEQVSAQLEECKGQTEQLELENSRLATDLRAQLQILANMDSQLKELQSQHTHCAQDLAMKDELLCQLTQSNEEQAAQWQKEEMALKHMQAELQQQQAVLAKEVRDLKETLEFADQENQVAHLELGQVECQLKTTLEVLRERSLQCENLKDTVENLTAKLASTIADNQEQDLEKTRQYSQKLGLLTEQLQSLTLFLQTKLKEKTMFQESRNIAFFGLPAVCTKQEMVDIIQNTKTEQETLLLSTACPPTQEHPLPNDRTFLGSILTAVADEEPESTPVPLLGSDKSAFTRVASMVSLQPAETPGMEESLAEMSIMTTELQSLCSLLQESKEEAIRTLQRKICELQARLQAQEEQHQEVQKAKEADIEKLNQALCLRYKNEKELQEVIQQQNEKILEQIDKSGELISLREEVTHLTRSLRRAETETKVLQEALAGQLDSNCQPMATNWIQEKVWLSQEVDKLRVMFLEMKNEKEKLMIKFQSHRNILEENLRRSDKELEKLDDIVQHIYKTLLSIPEVVRGCKELQGLLEFLS

SEQ ID NO: 861513 - protein, 1172 aa, Homo sapiens
MWRVKKLSLSLSPSPQTGKPSMRTPLRELTLQPGALTNSGKRSPACSSLTPSLCKLGLQEGSNNSSPVDFVNNKRTDLSSEHFSHSSKWLETCQHESDEQPLDPIPQISSTPKTSEEAVDPLGNYMVKTIVLVPSPLGQQQDMIFEARLDTMAETNSISLNGPLRTDDLVREEVAPCMGDRFSEVAAVSEKPIFQESPSHLLEESPPNPCSEQLHCSKESLSSRTEAVREDLVPSESNAFLPSSVLWLSPSTALAADFRVNHVDPEEEIVEHGAMEEREMRFPTHPKESETEDQALVSSVEDILSTCLTPNLVEMESQEAPGPAVEDVGRILGSDTESWMSPLAWLEKGVNTSVMLENLRQSLSLPSMLRDAAIGTTPFSTCSVGTWFTPSAPQEKSTNTSQTGLVGTKHSTSETEQLLCGRPPDLTALSRHDLEDNLLSSLVILEVLSRQLRDWKSQLAVPHPETQDSSTQTDTSHSGITNKLQHLKESHEMGQALQQARNVMQSWVLISKELISLLHLSLLHLEEDKTTVSQESRRAETLVCCCFDLLKKLRAKLQSLKAEREEARHREEMALRGKDAAEIVLEAFCAHASQRISQLEQDLASMREFRGLLKDAQTQLVGLHAKQEELVQQTVSLTSTLQQDWRSMQLDYTTWTALLSRSRQLTEKLTVKSQQALQERDVAIEEKQEVSRVLEQVSAQLEECKGQTEQLELENSRLATDLRAQLQILANMDSQLKELQSQHTHCAQDLAMKDELLCQLTQSNEEQAAQWQKEEMALKHMQAELQQQQAVLAKEVRDLKETLEFADQENQVAHLELGQVECQLKTTLEVLRERSLQCENLKDTVENLTAKLASTIADNQEQDLEKTRQYSQKLGLLTEQLQSLTLFLQTKLKEKTEQETLLLSTACPPTQEHPLPNDRTFLGSILTAVADEEPESTPVPLLGSDKSAFTRVASMVSLQPAETPGMEESLAEMSIMTTELQSLCSLLQESKEEAIRTLQRKICELQARLQAQEEQHQEVQKAKEADIEKLNQALCLRYKNEKELQEVIQQQNEKILEQIDKSGELISLREEVTHLTRSLRRAETETKVLQEALAGQLDSNCQPMATNWIQEKVWLSQEVDKLRVMFLEMKNEKEKLMIKFQSHRNILEENLRRSDKELEKLDDIVQHIYKRW

SEQ ID NO: 861514 - protein, 1122 aa, Homo sapiens; identical to SEQ ID NO: 861502

SEQ ID NO: 861515 - protein, 1216 aa, Homo sapiens
MWRVKKLSLSLSPSPQTGKPSMRTPLRELTLQPGALTNSGKRSPACSSLTPSLCKLGLQEGSNNSSPVDFVNNKRTDLSSEHFSHSSKWLETCQHESDEQPLDPIPQISSTPKTSEEAVDPLGNYMVKTIVLVPSPLGQQQDMIFEARLDTMAETNSISLNGPLRTDDLVREEVAPCMGDRFSEVAAVSEKPIFQESPSHLLEESPPNPCSEQLHCSKESLSSRTEAVREDLVPSESNAFLPSSVLWLSPSTALAADFRVNHVDPEEEIVEHGAMEEREMRFPTHPKESETEDQALVSSVEDILSTCLTPNLVEMESQEAPGPAVEDVGRILGSDTESWMSPLAWLEKGVNTSVMLENLRQSLSLPSMLRDAAIGTTPFSTCSVGTWFTPSAPQEKSTNTSQTGLVGTKHSTSETEQLLCGRPPDLTALSRHDLEDNLLSSLVILEVLSRQLRDWKSQLAVPHPETQDSSTQTDTSHSGITNKLQHLKESHEMGQALQQARNVMQSWVLISKELISLLHLSLLHLEEDKTTVSQESRRAETLVCCCFDLLKKLRAKLQSLKAEREEARHREEMALRGKDAAEIVLEAFCAHASQRISQLEQDLASMREFRGLLKDAQTQLVGLHAKQEELVQQTVSLTSTLQQDWRSMQLDYTTWTALLSRSRQLTEKLTVKSQQALQERDVAIEEKQEVSRVLEQVSAQLEECKGQTEQLELENSRLATDLRAQLQILARRSATDLRAQLQILANMDSQLKELQSQHTHCAQDLAMKDELLCQLTQSNEEQAAQWQKEEMALKHMQAELQQQQAVLAKEVRDLKETLEFADQENQVAHLELGQVECQLKTTLEVLRERSLQCENLKDTVENLTAKLASTIADNQEQDLEKTRQYSQKLGLLTEQLQSLTLFLQTKLKEKLFFLLCPETEQETLLLSTACPPTQEHPLPNDRTFLGSILTAVADEEPESTPVPLLGSDKSAFTRVASMVSLQPAETPGMEESLAEMSIMTTELQSLCSLLQESKEEAIRTLQRKICELQARLQAQEEQHQEVQKAKEADIEKLNQALCLRYKNEKELQEVIQQQNEKILEQIDKSGELISLREEVTHLTRSLRRAETETKVLQEALAGQLDSNCQPMATNWIQEKVWLSQEVDKLRVMFLEMKNEKEKLMIKFQSHRNILEENLRRSDKELEKLDDIVQHIYKTLLSIPEVVRGCKELQGLLEFLS

SEQ ID NO: 861516 - protein, 730 aa, Homo sapiens
MWRVKKLSLSLSPSPQTGKPSMRTPLRELTLQPGALTNSGKRSPACSSLTPSLCKLGLQEGSNNSSPVDFVNNKRTDLSSEHFSHSSKWLETCQHESDEQPLDPIPQISSTPKTSEEAVDPLGNYMVKTIVLVPSPLGQQQDMIFEARLDTMAETNSISLNGPLRTDDLVREEVAPCMGDRFSEVAAVSEKPIFQESPSHLLEESPPNPCSEQLHCSKESLSSRTEAVREDLVPSESNAFLPSSVLWLSPSTALAADFRVNHVDPEEEIVEHGAMEEREMRFPTHPKESETEDQALVSSVEDILSTCLTPNLVEMESQEAPGPAVEDVGRILGSDTESWMSPLAWLEKGVNTSVMLENLRQSLSLPSMLRDAAIGTTPFSTCSVGTWFTPSAPQEKSTNTSQTGLVGTKHSTSETEQLLCGRPPDLTALSRHDLEDNLLSSLVILEVLSRQLRDWKSQLAVPHPETQDSSTQTDTSHSGITNKLQHLKESHEMGQALQQARNVMQSWVLISKELISLLHLSLLHLEEDKTTVSQESRRAETLVCCCFDLLKKLRAKLQSLKAEREEARHREEMALRGKDAAEIVLEAFCAHASQRISQLEQDLASMREFRGLLKDAQTQLVGLHAKQEELVQQTVSLTSTLQQDWRSMQLDYTTWTALLSRSRQLTEKLTVKSQQALQERDVAIEEKQEVSRVLEQVSAQLEECKGQTEQLELENSRLATDLRAQLQILS

SEQ ID NO: 861517 - protein, 274 aa, Homo sapiens
HQRGPLPLLVFLLEPESTPVPLLGSDKSAFTRVASMVSLQPAETPGMEESLAEMSIMTTELQSLCSLLQESKEEAIRTLQRKICELQARLQAQEEQHQEVQKAKEADIEKLNQALCLRYKNEKELQEVIQQQNEKILEQIDKSGELISLREEVTHLTRSLRRAETETKVLQEALAGQLDSNCQPMATNWIQEKVWLSQEVDKLRVMFLEMKNEKEKLMIKFQSHRNILEENLRRSDKELEKLDDIVQHIYKTLLSIPEVVRGCKELQGLLEFLS

SEQ ID NO: 861518 - protein, 95 aa, Homo sapiens
RRAQGGQKPPVGRDRPAFWLKMWRVKKLSLSLSPSPQTGKPSMRTPLRELTLQPGALTNSGKRSPACSSLTPSLCKLGLQQQISVSIMWTQRRKL

SEQ ID NO: 861519 - protein, 443 aa, Homo sapiens
MQKATYYDSSAIYGGYPYQAANGFAYNANQQPYPASAALGADGEYHRPACSLQSPSSAGGHPKAHELSEACLRTLSAPPSQPPSLGEPPLHPPPPQAAPPAPQPPQPAPQPPAPTPAAPPPPSSASPPQNASNNPTPANAAKSPLLNSPTVAKQIFPWMKESRQNTKQKTSSSSSGESCAGDKSPPGQASSKRARTAYTSAQLVELEKEFHFNRYLCRPRRVEMANLLNLTERQIKIWFQNRRMKYKKDQKGKGMLTSSGGQSPSRSPVPPGAGGYLNSMHSLVNSVPYEPQSPPPFSKPPQGTYGLPPASYPASLPSCAPPPPPQKRYTAAGAGAGGTPDYDPHAHGLQGNGSYGTPHIQGSPVFVGGSYVEPMSNSGPALFGLTHLPHAASGAMDYGGAGPLGSGHHHGPGPGEPHPTYTDLTGHHPSQGRIQEAPKLTHL

SEQ ID NO: 861520 - protein, 162 aa, Homo sapiens
MAAGLFGLSARRLLAAAATRGLPAARVRWESSFSRTVVAPSAVAGKRPPEPTTPWQEDPEPEDENLYEKNPDSHGYDKDPVLDVWNMRLVFFFGVSIILVLGSTFVAYLPDYRCTGCPRAWDGMKEWSRREAERLVKYRRGQWPSHHGIQLLRPQQDPAARG

SEQ ID NO: 861521 - protein, 152 aa, Homo sapiens
MAAGLFGLSARRLLAAAATRGLPAARVRWESSFSRTVVAPSAVAGKRPPEPTTPWQEDPEPEDENLYEKNPDSHGYDKDPVLDVWNMRLVFFFGVSIILVLGSTFVAYLPDYRMKEWSRREAERLVKYRRGQWPSHHGIQLLRPQQDPAARG

SEQ ID NO: 861522 - protein, 152 aa, Homo sapiens; identical to SEQ ID NO: 861521

SEQ ID NO: 861523 - protein, 123 aa, Homo sapiens
MAAGLFGLSARRLLAAAATRGLPAARVRWESSFSRTVVAPSAVAGKRPPEPTTPWQEDPEPEDENLYEKNPDSHGYDKDPVLDVWNMRLVFFFGVSIILVLGSTFVAYLPDYRCTGCPRAWDG

SEQ ID NO: 861524 - protein, 152 aa, Homo sapiens; identical to SEQ ID NO: 861521

SEQ ID NO: 861525 - protein, 152 aa, Homo sapiens; identical to SEQ ID NO: 861521

SEQ ID NO: 861526 - protein, 124 aa, Homo sapiens
GSQTSPLPAATSSNSPSSAGAGARNNQVRDWRQIGGRGEAPSALPSQGNSLPPTPSRPQSPAQNGDDEKGVGAPTTIHLLRKRALAGPGDWSPPARGQPWPPLIGKRWPPPHTPCERSPSGEKE

SEQ ID NO: 861527 - protein, 634 aa, Homo sapiens
SGQNAPDAERQEALGIVRRIGTDTEAATEPAGATVPAAAAAARIGTVGPQPPAMPRRKRNAGSSSDGTEDSDFSTDLEHTDSSESDGTSRRSARVTRSSARLSQSSQDSSPVRNLQSFGTEEPAYSTRRVTRSQQQPTPVTPKKYPLRQTRSSGSETEQVVDFSDRETKNTADHDESPPRTPTGNAPSSESDIDISSPNVSHDESIAKDMSLKDSGSDLSHRPKRRRFHESYNFNMKCPTPGCNSLGHLTGKHERHFSISGCPLYHNLSADECKAPTERQLRYKEKVAELRKKRNSGLSKEQKEKYMEHRQTYGNTREPLLENLTSEYDLDLFRRAQARASEDLEKLRLQGQITEGSNMIKTIAFGRYELDTWYHSPYPEEYARLGRLYMCEFCLKYMKSQTILRRHMAKCVWKHPPGDEIYRKGSISVFEVDGKKNKIYCQNLCLLAKLFLDHKTLYYDVEPFLFYVMTEADNTGCHLIGYFSKEKNSFLNYNVSCILTMPQYMRQGYGKMLIDFSYLLSKVEEKVGSPERPLSDLGLISYRSYWKEVLLRYLHNFQGKEISIKEISQETAVNPVDIVSTLQALQMLKYWKGKHLVLKRQDLIDEWIAKEAKRSNSNKTMDPSCLKWTPPKGT

SEQ ID NO: 861528 - protein, 664 aa, Homo sapiens
SGQNAPDAERQEALGIVRRIGTDTEAATEPAGATVPAAAAAARIGTVGPQPPAMPRRKRNAGSSSDGTEDSDFSTDLEHTDSSESDGTSRRSARVTRSSARLSQSSQDSSPVRNLQSFGTEEPAYSTRRVTRSQQQPTPVTPKKYPLRQTRSSGSETEQVVDFSDRETKNTADHDESPPRTPTGNAPSSESDIDISSPNVSHDESIAKDMSLKDSGSDLSHRPKRRRFHESYNFNMKCPTPGCNSLGHLTGKHERHFSISGCPLYHNLSADECKVRAQSRDKQIEERMLSHRQDDNNRHATRHQAPTERQLRYKEKVAELRKKRNSGLSKEQKEKYMEHRQTYGNTREPLLENLTSEYDLDLFRRAQARASEDLEKLRLQGQITEGSNMIKTIAFGRYELDTWYHSPYPEEYARLGRLYMCEFCLKYMKSQTILRRHMAKCVWKHPPGDEIYRKGSISVFEVDGKKNKIYCQNLCLLAKLFLDHKTLYYDVEPFLFYVMTEADNTGCHLIGYFSKEKNSFLNYNVSCILTMPQYMRQGYGKMLIDFSYLLSKVEEKVGSPERPLSDLGLISYRSYWKEVLLRYLHNFQGKEISIKEISQETAVNPVDIVSTLQALQMLKYWKGKHLVLKRQDLIDEWIAKEAKRSNSNKTMDPSCLKWTPPKGT

SEQ ID NO: 861529 - protein, 399 aa, Homo sapiens
MDTRLLAQGNPIYRVCTRYPLVRVERGDAFPGTQGREILEKVVFRKKEKGHRPSKQIVKSEEKREHLRTKLEEHRQTYGNTREPLLENLTSEYDLDLFRRAQARASEDLEKLRLQGQITEGSNMIKTIAFGRYELDTWYHSPYPEEYARLGRLYMCEFCLKYMKSQTILRRHMAKCVWKHPPGDEIYRKGSISVFEVDGKKNKIYCQNLCLLAKLFLDHKTLYYDVEPFLFYVMTEADNTGCHLIGYFSKEKNSFLNYNVSCILTMPQYMRQGYGKMLIDFSYLLSKVEEKVGSPERPLSDLGLISYRSYWKEVLLRYLHNFQGKEISIKEISQETAVNPVDIVSTLQALQMLKYWKGKHLVLKRQDLIDEWIAKEAKRSNSNKTMDPSCLKWTPPKGT

SEQ ID NO: 861530 - protein, 276 aa, Homo sapiens
MIKTIAFGRYELDTWYHSPYPEEYARLGRLYMCEFCLKYMKSQTILRRHMAKCVWKHPPGDEIYRKGSISVFEVDGKKNKIYCQNLCLLAKLFLDHKTLYYDVEPFLFYVMTEADNTGCHLIGYFSKEKNSFLNYNVSCILTMPQYMRQGYGKMLIDFSYLLSKVEEKVGSPERPLSDLGLISYRSYWKEVLLRYLHNFQGKEISIKEISQETAVNPVDIVSTLQALQMLKYWKGKHLVLKRQDLIDEWIAKEAKRSNSNKTMDPSCLKWTPPKGT

SEQ ID NO: 861531 - protein, 134 aa, Homo sapiens
MPQYMRQGYGKMLIDFSYLLSKVEEKVGSPERPLSDLGLISYRSYWKEVLLRYLHNFQGKEISIKEISQETAVNPVDIVSTLQALQMLKYWKGKHLVLKRQDLIDEWIAKEAKRSNSNKTMDPSCLKWTPPKGT

SEQ ID NO: 861532 - protein, 550 aa, Homo sapiens
SGQNAPDAERQEALGIVRRIGTDTEAATEPAGATVPAAAAAARIGTVGPQPPAMPRRKRNAGSSSDGTEDSDFSTDLEHTDSSESDGTSRRSARVTRSSARLSQSSQDSSPVRNLQSFGTEEPAYSTRRVTRSQQQPTPVTPKKYPLRQTRSSGSETEQVVDFSDRETKNTADHDESPPRTPTGNAPSSESDIDISSPNVSHDESIAKDMSLKDSGSDLSHRPKRRRFHESYNFNMKCPTPGCNSLGHLTGKHERHFSISGCPLYHNLSADECKVRAQSRDKQIEERMLSHRQDDNNRHATRHQAPTERQLRYKEKVAELRKKRNSGLSKEQKEKYMEHRQTYGNTREPLLENLTSEYDLDLFRRAQARASEDLEKLRLQGQITEGSNMIKTIAFGRYELDTWYHSPYPEEYARLGRLYMCEFCLKYMKSQTILRRHMAKCVWKHPPGDEIYRKGSISVFEVDGKKNKIYCQNLCLLAKLFLDHKTLYYDVEPFLFYVMTEADNTGCHLIGYFSKVSRIWRLRSQWPEQGDPCSQLGAQITDRKKLYSGQ

SEQ ID NO: 861533 - protein, 281 aa, Homo sapiens
SGQNAPDAERQEALGIVRRIGTDTEAATEPAGATVPAAAAAARIGTVGPQPPAMPRRKRNAGSSSDGTEDSDFSTDLEHTDSSESDGTSRRSARVTRSSARLSQSSQDSSPVRNLQSFGTEEPAYSTRRVTRSQQQPTPVTPKKYPLRQTRSSGSETEQVVDFSDRETKNTADHDESPPRTPTGNAPSSESDIDISSPNVSHDESIAKDMSLKDSGSDLSHRPKRRRFHESYNFNMKCPTPGCNSLGHLTGKHERHFSISGCPLYHNLSADECKVRAAEPG

SEQ ID NO: 861534 - protein, 664 aa, Homo sapiens; identical to SEQ ID NO: 861528

SEQ ID NO: 861535 - protein, 634 aa, Homo sapiens; identical to SEQ ID NO: 861527

SEQ ID NO: 861536 - protein, 337 aa, Homo sapiens
LERILVVTAMEHRQTYGNTREPLLENLTSEYDLDLFRRAQARASEDLEKLRLQGQITEGSNMIKTIAFGRYELDTWYHSPYPEEYARLGRLYMCEFCLKYMKSQTILRRHMAKCVWKHPPGDEIYRKGSISVFEVDGKKNKIYCQNLCLLAKLFLDHKTLYYDVEPFLFYVMTEADNTGCHLIGYFSKEKNSFLNYNVSCILTMPQYMRQGYGKMLIDFSYLLSKVEEKVGSPERPLSDLGLISYRSYWKEVLLRYLHNFQGKEISIKEISQETAVNPVDIVSTLQALQMLKYWKGKHLVLKRQDLIDEWIAKEAKRSNSNKTMDPSCLKWTPPKGT

SEQ ID NO: 861537 - protein, 174 aa, Homo sapiens
LSSDLTSMSQEADNTGCHLIGYFSKEKNSFLNYNVSCILTMPQYMRQGYGKMLIDFSYLLSKVEEKVGSPERPLSDLGLISYRSYWKEVLLRYLHNFQGKEISIKEISQETAVNPVDIVSTLQALQMLKYWKGKHLVLKRQDLIDEWIAKEAKRSNSNKTMDPSCLKWTPPKGT

SEQ ID NO: 861538 - protein, 497 aa, Homo sapiens
SGQNAPDAERQEALGIVRRIGTDTEAATEPAGATVPAAAAAARIGTVGPQPPAMPRRKRNAGSSSDGTEDSDFSTDLEHTDSSESDGTSRRSARVTRSSARLSQSSQDSSPVRNLQSFGTEEPAYSTRRVTRSQQQPTPVTPKKYPLRQTRSSGSETEQVVDFSDRETKNTADHDESPPRTPTGNAPSSESDIDISSPNVSHDESIAKDMSLKDSGSDLSHRPKRRRFHESYNFNMKCPTPGCNSLGHLTGKHERHFSISGCPLYHNLSADECKVRAQSRDKQIEERMLSHRQDDNNRHATRHQAPTERQLRYKEKVAELRKKRNSGLSKEQKEKYMEHRQTYGNTREPLLENLTSEYDLDLFRRAQARASEDLEKLRLQGQITEGSNMIKTIAFGRYELDTWYHSPYPEEYARLGRLYMCEFCLKYMKSQTILRRHMAKCVWKHPPGDEIYRKGSISVFEVDGKKNKVKSGDFRKELKCCIFTGFRRHMFFLHHTL

SEQ ID NO: 861539 - protein, 73 aa, Homo sapiens
ALTVRHVPSSLHLPLPGSNDSPTSASRIAGITGVATTPSKYCTFSRDGVSPCCPGWSQTPELKPSSRLQLPKC

SEQ ID NO: 861540 - protein, 207 aa, Homo sapiens
MASLQRKGLQARILTSEEEEKLKRDQTLVSDFKQQKLEQEAQKNWDLFYKRNSTNFFKDRHWTTREFEELRSCREFEDQKLTMLEAGCGVGNCLFPLLEEDPNIFAYACDFSPRAIEYVKQNPLYDTERCKVFQCDLTKDDLLDHVPPESVDVVMLIFVLSAVHPDKMHLVLQNIYKCHGCSSELRQPWDKDDFAVTWDPWSPAIRY

SEQ ID NO: 861541 - protein, 284 aa, Homo sapiens
MASLQRKGLQARILTSEEEEKLKRDQTLVSDFKQQKLEQEAQKNWDLFYKRNSTNFFKDRHWTTREFEELRSCREFEDQKLTMLEAGCGVGNCLFPLLEEDPNIFAYACDFSPRAIEYVKQNPLYDTERCKVFQCDLTKDDLLDHVPPESVDVVMLIFVLSAVHPDKMHLVLQNIYKVLKPGKSVLFRDYGLYDHAMLRFKASSKLGENFYVRQDGTRSYFFTDDFLAQLFMDTGYEEVVNEYVFRETVNKKEGLCVPRVFLQSKFLKPPKNPSPVVLGLDPKS

SEQ ID NO: 861542 - protein, 207 aa, Homo sapiens; identical to SEQ ID NO: 861540

SEQ ID NO: 861543 - protein, 158 aa, Homo sapiens
AAASRSSPRASGNVPRGPAAGLRSHSWPRTCLAPRSALSRCSRDPSFWRWRLGGLCFRATALEDKESRAGTHPGPEASSLLCVGVREESEEARPWDFRRRVGTSGFLAEVAGAVPWQKNSRRIRIRGPQNWFRVVSRFFPYSASEAQWGWLWGECAWP

SEQ ID NO: 861544 - protein, 158 aa, Homo sapiens; identical to SEQ ID NO: 861543

SEQ ID NO: 861545 - protein, 256 aa, Homo sapiens
MASLQRKGLQARILTSEEEEKLKRDQTLVSDFKQQKLEQEAQKNWDLFYKRNSTNFFKDRHWTTREFEELRSCREFEDQKLTMLEAGCGVGNCLFPLLEEDPNIFAYACDFSPRAIEYVKQNPLYDTERCKVFQCDLTKDDLLDHVPPESVDVVMLIFVLSAVHPDKMHLVLQNIYKCHGCSSELRQPWDKDDFAVTWDPWSPAISTDCMIMPCLGLKPAANLEKTFMLDKMGPDHIFLLMTSWLSSLWTQVMKKW

SEQ ID NO: 861546 - protein, 284 aa, Homo sapiens; identical to SEQ ID NO: 861541

SEQ ID NO: 861547 - protein, 207 aa, Homo sapiens; identical to SEQ ID NO: 861540

SEQ ID NO: 861548 - protein, 251 aa, Homo sapiens
MASLQRKGLQARILTSEEEEKLKRDQTLVSDFKQQKLEQEAQKNWDLFYKRNSTNFFKDRHWTTREFEELRSCREFEDQKLTMLEAGCGVGNCLFPLLEEDPNIFAYACDFSPRAIEYVKQNPLYDTERCKVFQCDLTKDDLLDHVPPESVDVVMLIFVLSAVHPDKMHLVLQNIYKCHGCSSELRQPWDKDDFAVTWDPWSPAIRLLGEGLRHVHETLKQALYCTIFTQHLEGTDLAPALEELTSLLWCQ

SEQ ID NO: 861549 - protein, 124 aa, Homo sapiens
MGATVTRYRWERVWQRPTRAGIDLEGPGLRLTRASGSPGLQEFGTSGNMPEQKGVMAEHGPTCMVLHPLAGSPSKTKLTWLLSIDLKGWLPKSIINQVLSQTQVDFANHLRKRLESHPASEARC

SEQ ID NO: 861550 - protein, 66 aa, Homo sapiens
AEGATVTRYRWERVWQRPTRAGIDLEGPGLRLTRASGSPGLQEFGTSTIFKMLVADMGVGDANHRA

SEQ ID NO: 861551 - protein, 286 aa, Homo sapiens
MLLATFKLCAGSSYRHMRNMKGLRQQAVMAISQELNRRALGGPTPSTWINQVRRRSSLLGSRLEETLYSDQELAYLQQGEEAMQKALGILSNQEGWKKESQQDNGDKVMSKVVPDVGKVFRLEVVVDQPMERLYEELVERMEAMGEWNPNVKEIKVLQKIGKDTFITHELAAEAVQENLVGPRDFVSVRCAKRRGSTCVLAGMATDFGNMPEQKGVIRAEHGPTCMVLHPLAGSPSKTKLTWLLSIDLKGWLPKSIINQVLSQTQVDFANHLRKRLESHPASEARC

SEQ ID NO: 861552 - protein, 286 aa, Homo sapiens; identical to SEQ ID NO: 861551

SEQ ID NO: 861553 - protein, 286 aa, Homo sapiens; identical to SEQ ID NO: 861551

SEQ ID NO: 861554 - protein, 286 aa, Homo sapiens; identical to SEQ ID NO: 861551

SEQ ID NO: 861555 - protein, 286 aa, Homo sapiens; identical to SEQ ID NO: 861551

SEQ ID NO: 861556 - protein, 286 aa, Homo sapiens; identical to SEQ ID NO: 861551

SEQ ID NO: 861557 - protein, 286 aa, Homo sapiens; identical to SEQ ID NO: 861551

SEQ ID NO: 861558 - protein, 286 aa, Homo sapiens; identical to SEQ ID NO: 861551

SEQ ID NO: 861559 - protein, 267 aa, Homo sapiens
MLLATFKLCAGSSYRHMRNMKGLRQQAVMAISQELNRRALGGPTPSTWINQVRRRSSLLGSRLEETLYSDQELAYLQQGEEAMQKALGILSNQEGWKKESQQDNGDKVMSKVVPDVGKVFRLEVVVDQPMERLYEELVERMEAMGEWNPNVKEIKVQENLVGPRDFVSVRCAKRRGSTCVLAGMATDFGNMPEQKGVIRAEHGPTCMVLHPLAGSPSKTKLTWLLSIDLKGWLPKSIINQVLSQTQVDFANHLRKRLESHPASEARC

SEQ ID NO: 861560 - protein, 178 aa, Homo sapiens
MSKVVPDVGKVFRLEVVVDQPMERLYEELVERMEAMGEWNPNVKEIKVLQKIGKDTFITHELAAEAVQENLVGPRDFVSVRCAKRRGSTCVLAGMATDFGNMPEQKGVIRAEHGPTCMVLHPLAGSPSKTKLTWLLSIDLKGWLPKSIINQVLSQTQVDFANHLRKRLESHPASEARC

SEQ ID NO: 861561 - protein, 191 aa, Homo sapiens
MLLATFKLCAGSSYRHMRNMKGLRQQAVMAISQELNRRALGGPTPSTWINQVRRRSSLLGSRLEETLYSDQELAYLQQGEEAMQKALGILSNQEGWKKESQQDNGDKVMSKVVPDVGKVFRLEVVVDQPMERLYEELVERMEAMGEWNPNVKEIKVLQKIGKDTFITHELAAEARLHLCAGWHGHRLREHA

SEQ ID NO: 861562 - protein, 188 aa, Homo sapiens
MATTHESRHRPGGARTSGSLELADPPGCRNSARALYEELVERMEAMGEWNPNVKEIKVLQKIGKDTFITHELAAEAVQENLVGPRDFVSVRCAKRRGSTCVLAGMATDFGNMPEQKGVIRAEHGPTCMVLHPLAGSPSKTKLTWLLSIDLKGWLPKSIINQVLSQTQVDFANHLRKRLESHPASEARC

SEQ ID NO: 861563 - protein, 177 aa, Homo sapiens
MLLATFKLCAGSSYRHMRNMKGLRQQAVMAISQELNRRALGGPTPSTWINQVRRRSSLLGSRLEETLYSDQELAYLQQGEEAMQKALGILSNQEGWKKESQQDNGDKVMSKVVPDVGKVFRLEGSPSKTKLTWLLSIDLKGWLPKSIINQVLSQTQVDFANHLRKRLESHPASEARC

SEQ ID NO: 861564 - protein, 87 aa, Homo sapiens
AEGATVTRYRWERVWQRPTRAGIDLEGPGLRLTRASGSPGLQEFGTSSEAKLEGLRKDEEPPLREEAAAAAAAAAAATPPLPHEARC

SEQ ID NO: 861565 - protein, 236 aa, Homo sapiens
MLLATFKLCAGSSYRHMRNMKGLRQQAVMAISQELNRRALGGPTPSTWINQVRRRSSLLGSRLEETLYSDQELAYLQQGEEAMQKALGILSNQEGWKKESQQDNGDKVMSKVVPDVGKVFRLEVVVDQPMERLYEELVERMEAMGEWNPNVKEIKVLQKIGKDTFITHELAAEAVQENLVGPRDFVSVRCAKRRGSTCVLAGMAAAQQHHRTSSTPQWVPSRNIVQAFSVEKDKTH

SEQ ID NO: 861566 - protein, 191 aa, Homo sapiens; identical to SEQ ID NO: 861561

SEQ ID NO: 861567 - protein, 176 aa, Homo sapiens
MLLATFKLCAGSSYRHMRNMKGLRQQAVMAISQELNRRALGGPTPSTWINQVRRRSSLLGSRLEETLYSDQELAYLQQGEEAMQKALGILSNQEGWKKESQQDNGDKVMSKVVPDVGKVFRLEVVVDQPMERLYEELVERMEAMGEWNPNVKEIKGPAENAGLVSVLQAPRFTVAG

SEQ ID NO: 861568 - protein, 109 aa, Homo sapiens
AEGATVTRYRWERVWQRPTRAGIDLEGPGLRLTRASGSPGLQEFGTSSEAKLEGLRKDEEPPLREEAAAAAAAAAAATPPLPHCAQLHWYTRSSGESLLEACKSKISIW

SEQ ID NO: 861569 - protein, 286 aa, Homo sapiens; identical to SEQ ID NO: 861551

SEQ ID NO: 861570 - protein, 286 aa, Homo sapiens; identical to SEQ ID NO: 861551

SEQ ID NO: 861571 - protein, 286 aa, Homo sapiens; identical to SEQ ID NO: 861551

SEQ ID NO: 861572 - protein, 286 aa, Homo sapiens; identical to SEQ ID NO: 861551

SEQ ID NO: 861573 - protein, 286 aa, Homo sapiens; identical to SEQ ID NO: 861551

SEQ ID NO: 861574 - protein, 286 aa, Homo sapiens; identical to SEQ ID NO: 861551

SEQ ID NO: 861575 - protein, 286 aa, Homo sapiens; identical to SEQ ID NO: 861551

SEQ ID NO: 861576 - protein, 306 aa, Homo sapiens
MLLATFKLCAGSSYRHMRNMKGLRQQAVMAISQELNRRALGGPTPSTWINQVRRRSSLLGSRLEETLYSDQELAYLQQGEEAMQKALGILSNQEGWKKESQQDNGDKVMSKVVPDVGKVFRLEVVVDQPMERLYEELVERMEAMGEWNPNVKEIKVLQKIGKDTFITHELAAEAVQENLVGPRDFVSVRCAKRRGSTCVLAGMATDFGNMPEQKGVIREVPLRPNLRGYSASTSRGGCPRASSTRSCPRPRWILPTTCASAWSPTLPLKPGVEDQPAVPNCAQLHWYTRSSGESLLEACKSKISIW

SEQ ID NO: 861577 - protein, 289 aa, Homo sapiens
MLLATFKLCAGSSYRHMRNMKGLRQQAVMAISQELNRRALGGPTPSTWINQVRRRSSLLGSRLEETLYSDQELAYLQQGEEAMQKALGILSNQEGWKKESQQDNGDKVMSKVVPDVGKVFRLEVVVDQPMERLYEELVERMEAMGEWNPNVKEIKVLQKIGKDTFITHELAAEAVQENLVGPRDFVSVRCAKRRGSTCVLAGMATDFGNMPEQKGVIRGGCPRASSTRSCPRPRWILPTTCASAWSPTLPLKPGVEDQPAVPNCAQLHWYTRSSGESLLEACKSKISIW

SEQ ID NO: 861578 - protein, 312 aa, Homo sapiens
MWCMWLWLPSCHSFILRGRPQPRVPQGQIPLWSPGAAVINSTSRLAPMALVRALQSNEQTQSSRDESWWRLGEEGSSVSPQAVYPGSRLEETLYSDQELAYLQQGEEAMQKALGILSNQEGWKKESQQDNGDKVMSKVVPDVGKVFRLEVVVDQPMERLYEELVERMEAMGEWNPNVKEIKVLQKIGKDTFITHELAAEAVQENLVGPRDFVSVRCAKRRGSTCVLAGMATDFGNMPEQKGVIRAEHGPTCMVLHPLAGSPSKTKLTWLLSIDLKGWLPKSIINQVLSQTQVDFANHLRKRLESHPASEARC

SEQ ID NO: 861579 - protein, 268 aa, Homo sapiens
MLLATFKLCAGSSYRHMRNMKGLRQQAVMAISQELNRRALGGPTPSTWINQVRRRSSLLGSRLEETLYSDQELAYLQQGEEAMQKALGILSNQVVPDVGKVFRLEVVVDQPMERLYEELVERMEAMGEWNPNVKEIKVLQKIGKDTFITHELAAEAVQENLVGPRDFVSVRCAKRRGSTCVLAGMATDFGNMPEQKGVIRAEHGPTCMVLHPLAGSPSKTKLTWLLSIDLKGWLPKSIINQVLSQTQVDFANHLRKRLESHPASEARC

SEQ ID NO: 861580 - protein, 270 aa, Homo sapiens
MLLATFKLCAGSSYRHMRNMKGLRQQAVMAISQELNRRALGGPTPSTWINQVRRRSSLLGSRLEETLYSDQELAYLQQGEEAMQKALGILSNQEGWKKESQQDNGDKVMSKVVPDVGKVFRLEVVVDQPMERLYEELVERMEAMGEWNPNVKEIKVQENLVGPRDFVSVRCAKRRGSTCVLAGMATDFGNMPEQKGVIRGGCPRASSTRSCPRPRWILPTTCASAWSPTLPLKPGVEDQPAVPNCAQLHWYTRSSGESLLEACKSKISIW

SEQ ID NO: 861581 - protein, 84 aa, Homo sapiens
AEGATVTRYRWERVWQRPTRAGIDLEGPGLRLTRASGSPGLQEFGTSGWLPKSIINQVLSQTQVDFANHLRKRLESHPASEARC

SEQ ID NO: 861582 - protein, 236 aa, Homo sapiens; identical to SEQ ID NO: 861565

SEQ ID NO: 861583 - protein, 202 aa, Homo sapiens
MLLATFKLCAGSSYRHMRNMKGLRQQAVMAISQELNRRALGGPTPSTWINQVRRRSSLLGSRLEETLYSDQELAYLQQGEEAMQKALGILSNQEGWKKESQQDNGDKVMSKVVPDVGKVFRLEVVVDQPMERLYEELVERMEAMGEWNPNVKEIKLALQKNGKDRYITDDLAVNALELTLVLVGLARLWDMLTVGSLRPSRD

SEQ ID NO: 861584 - protein, 182 aa, Homo sapiens
MLLATFKLCAGSSYRHMRNMKGLRQQAVMAISQELNRRALGGPTPSTWINQVRRRSSLLGSRLEETLYSDQELAYLQQGEEAMQKALGILSNQEGWKKESQQDNGDKVMSKVVPDVGKVFRLEVVVDQPMERLYEELVERMEAMGEWNPNVKEIKQHRQTSYNPITFKTYASPNPETHLFPT

SEQ ID NO: 861585 - protein, 66 aa, Homo sapiens; identical to SEQ ID NO: 861550

SEQ ID NO: 861586 - protein, 135 aa, Homo sapiens
MEFAELIKTPRVDNVVLHRPFYPAVEGTLCLTGHHLILSSRQDNTEELWLLHSNIDAIDKRFVGSLGTIIIKCKDFRIIQLDIPGMEECLNIASSIEALSTLDSITLMYPFFYRPMFEVIEDGWHSFKHRTVKKK

SEQ ID NO: 861587 - protein, 610 aa, Homo sapiens
MRRAAFDKCAVKHLNEENGGRMSEQADCPRGAGNNHVRDNQIPAYSASSLFMWSESWFLYRRYVKKAPQIIFLKYKGSPQSSIEHIRILRFEISTFFFFNQKNIVVGLYVFKNLKLFWWQDLSINIYLVKIFYFDFIKWEESKQKYVKFSRFKTIYKCILFPRKLRVSKQDFKVILRRLGGDNNRHSCQIPYGGFLNISLNFEAWFRGGILLLFVLKDEICGVLVFDSVSIWFMLNKKSVSWKRYDHNLVSSSEKQEYMFRCTLKDLLQGITRVVVWFQDSCLNCHSKVGHQVHYYPTLIWDKGFGICPLLDRMNENNTSVYEHSLSERYFLDQKWAIVTIVDPLFWNFEIYQRMKSFSTSDKVLLCCCCCCFNWATLRTEEVQRTFQVYTIPQDHIDELLLILSHGLGLFSSSRPSILSYYHIVFLCYPSSLKTYRLGMVAYACNPSTLGGQGGRIMRSGDRDHPGYHGENPCLLKIQKISQVWWRAPVVPATQEAEEENGVNPGGRACSEPRSHHCTPAWAKGQDSISKKKKKKDSFIHLHLFSDDKIYTDTITFLWYQFSLFSWIKLLLPSFGLYNPLSTASSFKPKSQKRPSEILGLDIKMPEPVI

SEQ ID NO: 861588 - protein, 141 aa, Homo sapiens
MEFAELIKTPRVDNVVLHRPFYPAVEGTLCLTGHHLILSSRQDNTEELWLLHSNIDAIDKRFVGSLGTIIIKCKDFRIIQLDIPGMEECLNIASSIEALSTLDSITLMYPFFYRPMFEVIEDGWHSFLPEQEFELYSSAVS

SEQ ID NO: 861589 - protein, 324 aa, Homo sapiens
MEFAELIKTPRVDNVVLHRPFYPAVEGTLCLTGHHLILSSRQDNTEELWLLHSNIDAIDKRFVGSLGTIIIKCKDFRIIQLDIPGMEECLNIASSIEALSTLDSITLMYPFFYRPMFEVIEDGWHSFLPEQEFELYSSATSEWRLSYVNKEFAVCPSYPPIVTVPKSIDDEALRKVATFRHGGRFPVLSYYHKKNGMVIMRSGQPLTGTNGRRCKEDEKLINATLRAGKRGYIIDTRSLNVAQQTRAKGGGFEQEAHYPQWRRIHKSIERYHILQESLIKLVEACNDQTHNMDRWLSKLEASNWLTHIKEILTTACLAAQCIDR

SEQ ID NO: 861590 - protein, 549 aa, Homo sapiens
MEFAELIKTPRVDNVVLHRPFYPAVEGTLCLTGHHLILSSRQDNTEELWLLHSNIDAIDKRFVGSLGTIIIKCKDFRIIQLDIPGMEECLNIASSIEALSTLDSITLMYPFFYRPMFEVIEDGWHSFLPEQEFELYSSATSEWRLSYVNKEFAVCPSYPPIVTVPKSIDDEALRKVATFRHGGRFPVLSYYHKKNGMVIMRSGQPLTGTNGRRCKEDEKLINATLRAGKRGYIIDTRSLNVAQQTRAKGGGFEQEAHYPQWRRIHKSIERYHILQESLIKLVEACNDQTHNMDRWLSKLEASNWLTHIKEILTTACLAAQCIDREGASILIHGTEGTDSTLQVTSLAQIILEPRSRTIRGFEALIEREWLQAGHPFQQRCAQSAYCNTKQKWEAPVFLLFLDCVWQILRQFPCSFEFNENFLIMLFEHAYASQFGTFLGNNESERCKLKLQQKTMSLWSWVNQPSELSKFTNPLFEANNLVIWPSVAPQSLPLWEGIFLRWNRSSKYLDEAYEEMVNIIEYNKELQAKVNILRRQLAELETEDGMQESP

SEQ ID NO: 861591 - protein, 95 aa, Homo sapiens
MLNTAGESEVEVKAWGGDGRGAGVCKAKHLPGPVRRHWMEHSKGKCAPWLFSNVNQPCSVTIVSYYPNNILMEKYSSLKNDHPRRFPSNISPQKG

SEQ ID NO: 861592 - protein, 125 aa, Homo sapiens
MLRPKALTQVLSQANTGGVQSTLLLNNEGSLLAYSGYGDTDARVTAAIASNIWAAYDRNGNQAFNEDNLKFILMDCMEGRVAITRVANLLLCMYAKETVGFGMLKAKAQALVQYLEEPLTQVAAS

SEQ ID NO: 861593 - protein, 134 aa, Homo sapiens
MLRPKALTQVLSQANTGGVQSTLLLNNEGSLLAYSGYGDTDARVTAAIASNIWAAYDRNGNQAFNEDNLKFILMDCMVWRGEPDFPCPPKGIPRGRPGPHPGWLEGQGQDLRKITKSWSAAAFVIGRTLFIKWW

SEQ ID NO: 861594 - protein, 125 aa, Homo sapiens; identical to SEQ ID NO: 861592

SEQ ID NO: 861595 - protein, 134 aa, Homo sapiens; identical to SEQ ID NO: 861593

SEQ ID NO: 861596 - protein, 207 aa, Homo sapiens
MLRPKALTQVLSQANTGGVQSTLLLNNEGSLLAYSGYGDTDARVTAAIASNIWAAYDRNGNQAFNEDNLKFILMDCMEGRVAITRVANLLLCMYAKETVGFGMLKAKVCMCPSLHSPGPSLRALHCVHSHQDPVSRVLMSTQSISGVGQLPRAGGGWGLVASYGTGSRPGFGVPNARLCAGLISVLPLQAQALVQYLEEPLTQVAAS

SEQ ID NO: 861597 - protein, 125 aa, Homo sapiens; identical to SEQ ID NO: 861592

SEQ ID NO: 861598 - protein, 150 aa, Homo sapiens
MLRPKALTQVLSQANTGGVQSTLLLNNEGSLLAYSGYGDTDARVTAAIASNIWAAYDRNGNQAFNEDNLKFILMDCMEGRVAITRVANLLLCMYAKETVGFGMLKAKAVCGTDLCSPSAGPGFGAVPGGAPHPSGGILTALVEAGVRKEK

SEQ ID NO: 861599 - protein, 154 aa, Homo sapiens
MGGGWDFVFSKNKLQLLSTKTPYTTNRPPPNHPHTHLWRPPPLPTTGEKTLVYTTPPAVMGQAPGGPPETHTATTTGCSISRLIPHNDKNRVRPKTTPKAAAGTRPHPEKNNTAAGRHKPTSVLQPKIPKRGQTPPTGGDPKTQAATTGARISQ

SEQ ID NO: 861600 - protein, 103 aa, Homo sapiens
YVVPAQTKESNYHWASHARYACLWGSAGDSAMQGWLRAGFGVETRGKYLDFGLSLWCSIPAACWDHREMTKPSPALTLGPSNEHLRGLGGLHKDLLIGTHLFL

SEQ ID NO: 861601 - protein, 533 aa, Homo sapiens
MATSLHEGPTNQLDLLIRAVEASVHSSNAHCTDKTIEAAEALLHMESPTCLRDSRSPVEVFVPPCVSTPEFIHAAMRPDVITETVVEVSTEESEPMDTSPIPTSPDSHEPMKKKKVGRKPKTQQSPISNGSPELGIKKKPREGKGNTTYLWEFLLDLLQDKNTCPRYIKWTQREKGIFKLVDSKAVSKLWGKHKNKPDMNYETMGRALRYYYQRGILAKVEGQRLVYQFKDMPKNIVVIDDDKSETCNEDLAGTTDEKSLERVSLSAESLLKAASSVRSGKNSSPINCSRAEKGVARVVNITSPGHDASSRSPTTTASVSATAAPRTVRVAMQVPVVMTSLGQKISTVAVQSVNAGAPLITSTSPTTATSPKVVIQTIPTVMPASTENGDKITMQPAKIITIPATQLAQCQLQTKSNLTGSGSINIVGTPLAVRALTPVSIAHGTPVMRLSMPTQQASGQTPPRVISAVIKGPEVKSEAVAKKQEHDVKTLQLVEEKPADGNKTVTHVVVVSAPSAIALPVTMKTEGLVTCEK

SEQ ID NO: 861602 - protein, 521 aa, Homo sapiens
MATSLHEGPTNQLDLLIRAVEASVHSSNAHCTDKTIEAAEALLHMESPTCLRDSRSPEFIHAAMRPDVITETVVEVSTEESEPMDTSPIPTSPDSHEPMKKKKVGRKPKTQQSPISNGSPELGIKKKPREGKGNTTYLWEFLLDLLQDKNTCPRYIKWTQREKGIFKLVDSKAVSKLWGKHKNKPDMNYETMGRALRYYYQRGILAKVEGQRLVYQFKDMPKNIVVIDDDKSETCNEDLAGTTDEKSLERVSLSAESLLKAASSVRSGKNSSPINCSRAEKGVARVVNITSPGHDASSRSPTTTASVSATAAPRTVRVAMQVPVVMTSLGQKISTVAVQSVNAGAPLITSTSPTTATSPKVVIQTIPTVMPASTENGDKITMQPAKIITIPATQLAQCQLQTKSNLTGSGSINIVGTPLAVRALTPVSIAHGTPVMRLSMPTQQASGQTPPRVISAVIKGPEVKSEAVAKKQEHDVKTLQLVEEKPADGNKTVTHVVVVSAPSAIALPVTMKTEGLVTCEK

SEQ ID NO: 861603 - protein, 89 aa, Homo sapiens
PPSPRRLGVGGAARAGVAARGGEPLFCLLLSLWSGSGCWGGPGSLRTLGQRRRLVRGPAEREKDAAVFPGVAESSSKELLVQILALPKL

SEQ ID NO: 861604 - protein, 89 aa, Homo sapiens; identical to SEQ ID NO: 861603

SEQ ID NO: 861605 - protein, 492 aa, Homo sapiens
MATSLHEGPTNQLDLLIRAVEASVHSSNAHCTDKTIEAAEALLHMESPTCLRDSRSPEFIHAAMRPDVITETVVEVSTEESEPMDTSPIPTSPDSHEPMKKKKGNTTYLWEFLLDLLQDKNTCPRYIKWTQREKGIFKLVDSKAVSKLWGKHKNKPDMNYETMGRALRYYYQRGILAKVEGQRLVYQFKDMPKNIVVIDDDKSETCNEDLAGTTDEKSLERVSLSAESLLKAASSVRSGKNSSPINCSRAEKGVARVVNITSPGHDASSRSPTTTASVSATAAPRTVRVAMQVPVVMTSLGQKISTVAVQSVNAGAPLITSTSPTTATSPKVVIQTIPTVMPASTENGDKITMQPAKIITIPATQLAQCQLQTKSNLTGSGSINIVGTPLAVRALTPVSIAHGTPVMRLSMPTQQASGQTPPRVISAVIKGPEVKSEAVAKKQEHDVKTLQLVEEKPADGNKTVTHVVVVSAPSAIALPVTMKTEGLVTCEK

SEQ ID NO: 861606 - protein, 593 aa, Homo sapiens
MTSAVVDSGGTILELSSNGVENQEESEKVSEYPAVIVEPVPSARLEQGYAAQVLVYDDETYMMQDVAEEQEVETENVETVEASVHSSNAHCTDKTIEAAEALLHMESPTCLRDSRSPVEVFVPPCVSTPEFIHAAMRPDVITETVVEVSTEESEPMDTSPIPTSPDSHEPMKKKKVGRKPKTQQSPISNGSPELGIKKKPREGKGNTTYLWEFLLDLLQDKNTCPRYIKWTQREKGIFKLVDSKAVSKLWGKHKNKPDMNYETMGRALRYYYQRGILAKVEGQRLVYQFKDMPKNIVVIDDDKSETCNEDLAGTTDEKSLERVSLSAESLLKAASSVRSGKNSSPINCSRAEKGVARVVNITSPGHDASSRSPTTTASVSATAAPRTVRVAMQVPVVMTSLGQKISTVAVQSVNAGAPLITSTSPTTATSPKVVIQTIPTVMPASTENGDKITMQPAKIITIPATQLAQCQLQTKSNLTGSGSINIVGTPLAVRALTPVSIAHGTPVMRLSMPTQQASGQTPPRVISAVIKGPEVKSEAVAKKQEHDVKTLQLVEEKPADGNKTVTHVVVVSAPSAIALPVTMKTEGLVTCEK

SEQ ID NO: 861607 - protein, 581 aa, Homo sapiens
MTSAVVDSGGTILELSSNGVENQEESEKVSEYPAVIVEPVPSARLEQGYAAQVLVYDDETYMMQDVAEEQEVETENVETVEASVHSSNAHCTDKTIEAAEALLHMESPTCLRDSRSPEFIHAAMRPDVITETVVEVSTEESEPMDTSPIPTSPDSHEPMKKKKVGRKPKTQQSPISNGSPELGIKKKPREGKGNTTYLWEFLLDLLQDKNTCPRYIKWTQREKGIFKLVDSKAVSKLWGKHKNKPDMNYETMGRALRYYYQRGILAKVEGQRLVYQFKDMPKNIVVIDDDKSETCNEDLAGTTDEKSLERVSLSAESLLKAASSVRSGKNSSPINCSRAEKGVARVVNITSPGHDASSRSPTTTASVSATAAPRTVRVAMQVPVVMTSLGQKISTVAVQSVNAGAPLITSTSPTTATSPKVVIQTIPTVMPASTENGDKITMQPAKIITIPATQLAQCQLQTKSNLTGSGSINIVGTPLAVRALTPVSIAHGTPVMRLSMPTQQASGQTPPRVISAVIKGPEVKSEAVAKKQEHDVKTLQLVEEKPADGNKTVTHVVVVSAPSAIALPVTMKTEGLVTCEK

SEQ ID NO: 861608 - protein, 521 aa, Homo sapiens; identical to SEQ ID NO: 861602

SEQ ID NO: 861609 - protein, 521 aa, Homo sapiens; identical to SEQ ID NO: 861602

SEQ ID NO: 861610 - protein, 521 aa, Homo sapiens; identical to SEQ ID NO: 861602

SEQ ID NO: 861611 - protein, 331 aa, Homo sapiens
MATSLHEGPTNQLDLLIRAVEASVHSSNAHCTDKTIEAAEALLHMESPTCLRDSRSPEFIHAAMRPDVITETVVEVSTEESEPMDTSPIPTSPDSHEPMKKKKVGRKPKTQQSPISNGSPELGIKKKPREGKGNTTYLWEFLLDLLQDKNTCPRYIKWTQREKGIFKLVDSKAVSKLWGKHKNKPDMNYETMGRALRYYYQRGILAKVEGQRLVYQFKDMPKNIVVIDDDKSETCNEDLAGTTDEKSLERVSLSAESLLKAASSVRSGKNSSPINCSRAEKGVARVVNITSPGHDASSRSPTTTASVSATAAPRFFGENKQKTAKHPSVVS

SEQ ID NO: 861612 - protein, 94 aa, Homo sapiens
RGAEGSRCQLRRPPQPQPPPPPPPPLPLPPLPLPLGGGVSQPGGGRRAGLGFLSEDAQGSGRRSVCECVSVCRSHGVCLRPRVPPPPLPPLLTV

SEQ ID NO: 861613 - protein, 94 aa, Homo sapiens; identical to SEQ ID NO: 861612

SEQ ID NO: 861614 - protein, 521 aa, Homo sapiens; identical to SEQ ID NO: 861602

SEQ ID NO: 861615 - protein, 581 aa, Homo sapiens; identical to SEQ ID NO: 861607

SEQ ID NO: 861616 - protein, 581 aa, Homo sapiens; identical to SEQ ID NO: 861607

SEQ ID NO: 861617 - protein, 521 aa, Homo sapiens; identical to SEQ ID NO: 861602

SEQ ID NO: 861618 - protein, 323 aa, Homo sapiens
MATSLHEGPTNQLDLLIRAVEASVHSSNAHCTDKTIEAAEALLHMESPTCLRDSRSPEFIHAAMRPDVITETVVEVSTEESEPMDTSPIPTSPDSHEPMKKKKVGRKPKTQQSPISNGSPELGIKKKPREGKGNTTYLWEFLLDLLQDKNTCPRYIKWTQREKGIFKLVDSKAVSKLWGKHKNKPDMNYETMGRALRYYYQRGILAKVEGQRLVYQFKDMPKNIVVIDDDKSETCNEDLAGTTDEKSLERVSLSAESLLKAASSVRSGKNSSPINCSRAEKGVARVVNITSPGHDASSRSPTTTASVSATAAPRWQSQTRQES

SEQ ID NO: 861619 - protein, 1099 aa, Homo sapiens
MIGSKGWVGRAGARKGQQLLALTRLLATYAPSIINPKQSKDAPKSFTFDYSYWSHTSTEDPQFASQQQVYRDIGEEMLLHAFEGYNVCIFAYGQTGAGKSYTMMGRQEPGQQGIVPQLCEDLFSRVSENQSAQLSYSVEVSYMEIYCERVRDLLNPKSRGSLRVREHPILGPYVQDLSKLAVTSYADIADLMDCGNKARTVAATNMNETSSRSHAVFTIVFTQRCHDQLTGLDSEKVSKISLVDLAGSERADSSGARGMRLKEGANINKSLTTLGKVISALADMQSKKRKSDFIPYRDSVLTWLLKENLGGNSRTAMIAALSPADINYEETLSTLRYADRTKQIRCNAIINEDPNARLIRELQEEVARLRELLMAQGLSASALEGLKTEEGSVRGALPAVSSPPAPVSPSSPTTHNGELEPSFSPNTESQIGPEEAMERLQETEKIIAELNETWEEKLRKTEALRMEREALLAEMGVAVREDGGTVGVFSPKKTPHLVNLNEDPLMSECLLYHIKDGVTRVGQVDMDIKLTGQFIREQHCLFRSIPQPDGEVVVTLEPCEGAETYVNGKLVTEPLVLKSGNRIVMGKNHVFRFNHPEQARLERERGVPPPPGPPSEPVDWNFAQKELLEQQGIDIKLEMEKRLQDLENQYRKEKEEADLLLEQQRLYADSDSGDDSDKRSCEESWRLISSLREQLPPTTVQTIVKRCGLPSSGKRRAPRRVYQIPQRRRLQGKDPRWATMADLKMQAVKEICYEVALADFRHGRAEIEALAALKMRELCRTYGKPDGPGDAWRAVARDVWDTVGEEEGGGAGSGGGSEEGARGAEVEDLRAHIDKLTGILQEVKLQNSSKDRELQALRDRMLRMERVIPLAQDHEDENEEGGEVPWAPPEGSEAAEEAAPSDRMPSARPPSPPLSSWERVSRLMEEDPAFRRGRLRWLKQEQLRLQGLQGSGGRGGGLRRPPARFVPPHDCKLRFPFKSNPQHRESWPGMGSGEAPTPLQPPEEVTPHPATPARRPPSPRRSHHPRRNSLDGGGRSRGAGSAQPEPQHFQPKKHNSYPQPPQPYPAQRPPGPRYPPYTTPPRMRRQRSAPDLKESGAAV

SEQ ID NO: 861620 - protein, 1103 aa, Homo sapiens
MAGASVKVAVRVRPFNARETSQDAKCVVSMQGNTTSIINPKQSKDAPKSFTFDYSYWSHTSTEDPQFASQQQVYRDIGEEMLLHAFEGYNVCIFAYGQTGAGKSYTMMGRQEPGQQGIVPQLCEDLFSRVSENQSAQLSYSVEVSYMEIYCERVRDLLNPKSRGSLRVREHPILGPYVQDLSKLAVTSYADIADLMDCGNKARTVAATNMNETSSRSHAVFTIVFTQRCHDQLTGLDSEKVSKISLVDLAGSERADSSGARGMRLKEGANINKSLTTLGKVISALADMQSKKRKSDFIPYRDSVLTWLLKENLGGNSRTAMIAALSPADINYEETLSTLRYADRTKQIRCNAIINEDPNARLIRELQEEVARLRELLMAQGLSASALEGLKTEEGSVRGALPAVSSPPAPVSPSSPTTHNGELEPSFSPNTESQIGPEEAMERLQETEKIIAELNETWEEKLRKTEALRMEREALLAEMGVAVREDGGTVGVFSPKKTPHLVNLNEDPLMSECLLYHIKDGVTRVGQVDMDIKLTGQFIREQHCLFRSIPQPDGEVVVTLEPCEGAETYVNGKLVTEPLVLKSGNRIVMGKNHVFRFNHPEQARLERERGVPPPPGPPSEPVDWNFAQKELLEQQGIDIKLEMEKRLQDLENQYRKEKEEADLLLEQQRLYADSDSGDDSDKRSCEESWRLISSLREQLPPTTVQTIVKRCGLPSSGKRRAPRRVYQIPQRRRLQGKDPRWATMADLKMQAVKEICYEVALADFRHGRAEIEALAALKMRELCRTYGKPDGPGDAWRAVARDVWDTVGEEEGGGAGSGGGSEEGARGAEVEDLRAHIDKLTGILQEVKLQNSSKDRELQALRDRMLRMERVIPLAQDHEDENEEGGEVPWAPPEGSEAAEEAAPSDRMPSARPPSPPLSSWERVSRLMEEDPAFRRGRLRWLKQEQLRLQGLQGSGGRGGGLRRPPARFVPPHDCKLRFPFKSNPQHRESWPGMGSGEAPTPLQPPEEVTPHPATPARRPPSPRRSHHPRRNSLDGGGRSRGAGSAQPEPQHFQPKKHNSYPQPPQPYPAQRPPGPRYPPYTTPPRMRRQRSAPDLKESGAAV

SEQ ID NO: 861621 - protein, 1103 aa, Homo sapiens; identical to SEQ ID NO: 861620

SEQ ID NO: 861622 - protein, 1103 aa, Homo sapiens; identical to SEQ ID NO: 861620

SEQ ID NO: 861623 - protein, 928 aa, Homo sapiens
MAGASVKVAVRVRPFNARETSQDAKCVVSMQGNTTSIINPKQSKDAPKSFTFDYSYWSHTSTEDPQFASQQQVYRDIGEEMLLHAFEGYNVCIFAYGQTGAGKSYTMMGRQEPGQQGIVPQLCEDLFSRVSENQSAQLSYSVEVSYMEIYCERVRDLLNPKSRGSLRVREHPILGPYVQDLSKLAVTSYADIADLMDCGNKARTVAATNMNETSSRSHAVFTIVFTQRCHDQLTGLDSEKVSKISLVDLAGSERADSSGARGMRLKEGANINKSLTTLGKVISALADMQSKKRKSDFIPYRDSVLTWLLKENLGGNSRTAMIAALSPADINYEETLSTLRYADRTKQIRCNAIINEDPNARLIRELQEEVARLRELLMAQGLSASALEGLKTEEGSVRGALPAVSSPPAPVSPSSPTTHNGELEPSFSPNTESQIGPEEAMERLQPVDWNFAQKELLEQQGIDIKLEMEKRLQDLENQYRKEKEEADLLLEQQRLYADSDSGDDSDKRSCEESWRLISSLREQLPPTTVQTIVKRCGLPSSGKRRAPRRVYQIPQRRRLQGKDPRWATMADLKMQAVKEICYEVALADFRHGRAEIEALAALKMRELCRTYGKPDGPGDAWRAVARDVWDTVGEEEGGGAGSGGGSEEGARGAEVEDLRAHIDKLTGILQEVKLQNSSKDRELQALRDRMLRMERVIPLAQDHEDENEEGGEVPWAPPEGSEAAEEAAPSDRMPSARPPSPPLSSWERVSRLMEEDPAFRRGRLRWLKQEQLRLQGLQGSGGRGGGLRRPPARFVPPHDCKLRFPFKSNPQHRESWPGMGSGEAPTPLQPPEEVTPHPATPARRPPSPRRSHHPRRNSLDGGGRSRGAGSAQPEPQHFQPKKHNSYPQPPQPYPAQRPPGPRYPPYTTPPRMRRQRSAPDLKESGAAV

SEQ ID NO: 861624 - protein, 677 aa, Homo sapiens
SLHTGYEEAAAYIQCQFEDLNRRKDTKEIYTHFTCATDTKNVQFVFDAVTDVIIKNNLKECGLYGEAWMLVKVTTVRSVETRHLLLSHGAATSMNGTRVGQVDMDIKLTGQFIREQHCLFRSIPQPDGEVVVTLEPCEGAETYVNGKLVTEPLVLKSGNRIVMGKNHVFRFNHPEQARLERERGVPPPPGPPSEPVDWNFAQKELLEQQGIDIKLEMEKRLQDLENQYRKEKEEADLLLEQQRLYADSDSGDDSDKRSCEESWRLISSLREQLPPTTVQTIVKRCGLPSSGKRRAPRRVYQIPQRRRLQGKDPRWATMADLKMQAVKEICYEVALADFRHGRAEIEALAALKMRELCRTYGKPDGPGDAWRAVARDVWDTVGEEEGGGAGSGGGSEEGARGAEVEDLRAHIDKLTGILQEVKLQNSSKDRELQALRDRMLRMERVIPLAQDHEDENEEGGEVPWAPPEGSEAAEEAAPSDRMPSARPPSPPLSSWERVSRLMEEDPAFRRGRLRWLKQEQLRLQGLQGSGGRGGGLRRPPARFVPPHDCKLRFPFKSNPQHRESWPGMGSGEAPTPLQPPEEVTPHPATPARRPPSPRRSHHPRRNSLDGGGRSRGAGSAQPEPQHFQPKKHNSYPQPPQPYPAQRPPGPRYPPYTTPPRMRRQRSAPDLKESGAAV

SEQ ID NO: 861625 - protein, 586 aa, Homo sapiens
VGHCFPRVGQVDMDIKLTGQFIREQHCLFRSIPQPDGEVVVTLEPCEGAETYVNGKLVTEPLVLKSGNRIVMGKNHVFRFNHPEQARLERERGVPPPPGPPSEPVDWNFAQKELLEQQGIDIKLEMEKRLQDLENQYRKEKEEADLLLEQQRLYADSDSGDDSDKRSCEESWRLISSLREQLPPTTVQTIVKRCGLPSSGKRRAPRRVYQIPQRRRLQGKDPRWATMADLKMQAVKEICYEVALADFRHGRAEIEALAALKMRELCRTYGKPDGPGDAWRAVARDVWDTVGEEEGGGAGSGGGSEEGARGAEVEDLRAHIDKLTGILQEVKLQNSSKDRELQALRDRMLRMERVIPLAQDHEDENEEGGEVPWAPPEGSEAAEEAAPSDRMPSARPPSPPLSSWERVSRLMEEDPAFRRGRLRWLKQEQLRLQGLQGSGGRGGGLRRPPARFVPPHDCKLRFPFKSNPQHRESWPGMGSGEAPTPLQPPEEVTPHPATPARRPPSPRRSHHPRRNSLDGGGRSRGAGSAQPEPQHFQPKKHNSYPQPPQPYPAQRPPGPRYPPYTTPPRMRRQRSAPDLKESGAAV

SEQ ID NO: 861626 - protein, 656 aa, Homo sapiens
MAGASVKVAVRVRPFNARETSQDAKCVVSMQGNTTSIINPKQSKDAPKSFTFDYSYWSHTSTEDPQFASQQQVYRDIGEEMLLHAFEGYNVCIFAYGQTGAGKSYTMMGRQEPGQQGIVPQLCEDLFSRVSENQSAQLSYSVEVSYMEIYCERVRDLLNPKSRGSLRVREHPILGPYVQDLSKLAVTSYADIADLMDCGNKARTVAATNMNETSSRSHAVFTIVFTQRCHDQLTGLDSEKVSKISLVDLAGSERADSSGARGMRLKEGANINKSLTTLGKVISALADMQSKKRKSDFIPYRDSVLTWLLKENLGGNSRTAMIAALSPADINYEETLSTLRYADRTKQIRCNAIINEDPNARLIRELQEEVARLRELLMAQGLSASALEGLKTEEGSVRGALPAVSSPPAPVSPSSPTTHNGELEPSFSPNTESQIGPEEAMERLQETEKIIAELNETWEEKLRKTEALRMEREALLAEMGVAVREDGGTVGVFSPKKTPHLVNLNEDPLMSECLLYHIKDGVTRVGQVDMDIKLTGQFIREQHCLFRSIPQPDGEVVVTLEPCEGAETYVNGKLVTEPLVLKSGNRIVMGKNHVFRFNHPEQARLERERGVPPPPGPPSEPVDWNFAQKELLEQQGIDIKLEMEKRLQDLENQYRK

SEQ ID NO: 861627 - protein, 320 aa, Homo sapiens
MAGASVKVAVRVRPFNARETSQDAKCVVSMQGNTTSIINPKQSKDAPKSFTFDYSYWSHTSTEDPQFASQQQVYRDIGEEMLLHAFEGYNVCIFAYGQTGAGKSYTMMGRQEPGQQGIVPQLCEDLFSRVSENQSAQLSYSVEVSYMEIYCERVRDLLNPKSRGSLRVREHPILGPYVQDLSKLAVTSYADIADLMDCGNKARTVAATNMNETSSRSHAVFTIVFTQRCHDQLTGLDSEKVSKISLVDLAGSERADSSGARGMRLKEGANINKSLTTLGKVISALADMQSKKRKSDFIPYRDSVLTWLLKENLGDREDYS

SEQ ID NO: 861628 - protein, 91 aa, Homo sapiens
NYRFEPNGRFRPHASRLSVSVCGGFCFLGGMVDHKSFPSPSRPPAIFGGPDWFGWSPMRMRTESEASSPQPLSVCLSVCGGFCFLGGMVGS

SEQ ID NO: 861629 - protein, 144 aa, Homo sapiens
MAGASVKVAVRVRPFNARETSQDAKCVVSMQGNTTSIINPKQSKDAPKSFTFDYSYWSHTSTEDPQFASQQQVYRDIGEEMLLHAFEGYNVCIFAYGQTGAGKSYTMMGRQEPGQQGIVPQLCEDLFSRVSENQSAQLSYSVEC

SEQ ID NO: 861630 - protein, 1103 aa, Homo sapiens; identical to SEQ ID NO: 861620

SEQ ID NO: 861631 - protein, 1103 aa, Homo sapiens; identical to SEQ ID NO: 861620

SEQ ID NO: 861632 - protein, 1120 aa, Homo sapiens
QDQKDSCNGDSGGPLICNGYLQGLVSFGKAPCGQVGVPGVYTNLCKFTEWIEKTVQAINSGDWEPMKLTPKYILRKEFTEDPQFASQQQVYRDIGEEMLLHAFEGYNVCIFAYGQTGAGKSYTMMGRQEPGQQGIVPQLCEDLFSRVSENQSAQLSYSVEVSYMEIYCERVRDLLNPKSRGSLRVREHPILGPYVQDLSKLAVTSYADIADLMDCGNKARTVAATNMNETSSRSHAVFTIVFTQRCHDQLTGLDSEKVSKISLVDLAGSERADSSGARGMRLKEGANINKSLTTLGKVISALADMQSKKRKSDFIPYRDSVLTWLLKENLGGNSRTAMIAALSPADINYEETLSTLRYADRTKQIRCNAIINEDPNARLIRELQEEVARLRELLMAQGLSASALEGLKTEEGSVRGALPAVSSPPAPVSPSSPTTHNGELEPSFSPNTESQIGPEEAMERLQETEKIIAELNETWEEKLRKTEALRMEREALLAEMGVAVREDGGTVGVFSPKKTPHLVNLNEDPLMSECLLYHIKDGVTRVGQVDMDIKLTGQFIREQHCLFRSIPQPDGEVVVTLEPCEGAETYVNGKLVTEPLVLKSGNRIVMGKNHVFRFNHPEQARLERERGVPPPPGPPSEPVDWNFAQKELLEQQGIDIKLEMEKRLQDLENQYRKEKEEADLLLEQQRLYADSDSGDDSDKRSCEESWRLISSLREQLPPTTVQTIVKRCGLPSSGKRRAPRRVYQIPQRRRLQGKDPRWATMADLKMQAVKEICYEVALADFRHGRAEIEALAALKMRELCRTYGKPDGPGDAWRAVARDVWDTVGEEEGGGAGSGGGSEEGARGAEVEDLRAHIDKLTGILQEVKLQNSSKDRELQALRDRMLRMERVIPLAQDHEDENEEGGEVPWAPPEGSEAAEEAAPSDRMPSARPPSPPLSSWERVSRLMEEDPAFRRGRLRWLKQEQLRLQGLQGSGGRGGGLRRPPARFVPPHDCKLRFPFKSNPQHRESWPGMGSGEAPTPLQPPEEVTPHPATPARRPPSPRRSHHPRRNSLDGGGRSRGAGSAQPEPQHFQPKKHNSYPQPPQPYPAQRPPGPRYPPYTTPPRMRRQRSAPDLKESGAAV

SEQ ID NO: 861633 - protein, 1103 aa, Homo sapiens; identical to SEQ ID NO: 861620

SEQ ID NO: 861634 - protein, 657 aa, Homo sapiens
MGSWSRHSPPTRSPRLGLRKPWRGCREALLAEMGVAVREDGGTVGVFSPKKTPHLVNLNEDPLMSECLLYHIKDGVTRVGQVDMDIKLTGQFIREQHCLFRSIPQPDGEVVVTLEPCEGAETYVNGKLVTEPLVLKSGNRIVMGKNHVFRFNHPEQARLERERGVPPPPGPPSEPVDWNFAQKELLEQQGIDIKLEMEKRLQDLENQYRKEKEEADLLLEQQRLYADSDSGDDSDKRSCEESWRLISSLREQLPPTTVQTIVKRCGLPSSGKRRAPRRVYQIPQRRRLQGKDPRWATMADLKMQAVKEICYEVALADFRHGRAEIEALAALKMRELCRTYGKPDGPGDAWRAVARDVWDTVGEEEGGGAGSGGGSEEGARGAEVEDLRAHIDKLTGILQEVKLQNSSKDRELQALRDRMLRMERVIPLAQDHEDENEEGGEVPWAPPEGSEAAEEAAPSDRMPSARPPSPPLSSWERVSRLMEEDPAFRRGRLRWLKQEQLRLQGLQGSGGRGGGLRRPPARFVPPHDCKLRFPFKSNPQHRESWPGMGSGEAPTPLQPPEEVTPHPATPARRPPSPRRSHHPRRNSLDGGGRSRGAGSAQPEPQHFQPKKHNSYPQPPQPYPAQRPPGPRYPPYTTPPRMRRQRSAPDLKESGAAV

SEQ ID NO: 861635 - protein, 820 aa, Homo sapiens
MAGASVKVAVRVRPFNARETSQDAKCVVSMQGNTTSIINPKQSKDAPKSFTFDYSYWSHTSTEDPQFASQQQVYRDIGEEMLLHAFEGYNVCIFAYGQTGAGKSYTMMGRQEPGQQGIVPQLCEDLFSRVSENQSAQLSYSVEVSYMEIYCERVRDLLNPKSRGSLRVREHPILGPYVQDLSKLAVTSYADIADLMDCGNKARTVAATNMNETSSRSHAVFTIVFTQRCHDQLTGLDSEKVSKISLVDLAGSERADSSGARGMRLKEGANINKSLTTLGKVISALADMQSKKRKSDFIPYRDSVLTWLLKENLGGNSRTAMIAALSPADINYEETLSTLRYADRTKQIRCNAIINEDPNARLIRELQEEVARLRELLMAQGLSASALEGLKTEEGSVRGALPAVSSPPAPVSPSSPTTHNGELEPSFSPNTESQIGPEEAMERLQETEKIIAELNETWEEKLRKTEALRMEREALLAEMGVAVREDGGTVGVFSPKKTPHLVNLNEDPLMSECLLYHIKDGVTRVGQVDMDIKLTGQFIREQHCLFRSIPQPDGEVVVTLEPCEGAETYVNGKLVTEPLVLKSGNRIVMGKNHVFRFNHPEQARLERERGVPPPPGPPSEPVDWNFAQKELLEQQGIDIKLEMEKRLQDLENQYRKEKEEQEQLRLQGLQGSGGRGGGLRRPPARFVPPHDCKLRFPFKSNPQHRESWPGMGSGEAPTPLQPPEEVTPHPATPARRPPSPRRSHHPRRNSLDGGGRSRGAGSAQPEPQHFQPKKHNSYPQPPQPYPAQRPPGPRYPPYTTPPRMRRQRSAPDLKESGAAV

SEQ ID NO: 861636 - protein, 593 aa, Homo sapiens
MGGGLWLRVPVSPRVGQVDMDIKLTGQFIREQHCLFRSIPQPDGEVVVTLEPCEGAETYVNGKLVTEPLVLKSGNRIVMGKNHVFRFNHPEQARLERERGVPPPPGPPSEPVDWNFAQKELLEQQGIDIKLEMEKRLQDLENQYRKEKEEADLLLEQQRLYADSDSGDDSDKRSCEESWRLISSLREQLPPTTVQTIVKRCGLPSSGKRRAPRRVYQIPQRRRLQGKDPRWATMADLKMQAVKEICYEVALADFRHGRAEIEALAALKMRELCRTYGKPDGPGDAWRAVARDVWDTVGEEEGGGAGSGGGSEEGARGAEVEDLRAHIDKLTGILQEVKLQNSSKDRELQALRDRMLRMERVIPLAQDHEDENEEGGEVPWAPPEGSEAAEEAAPSDRMPSARPPSPPLSSWERVSRLMEEDPAFRRGRLRWLKQEQLRLQGLQGSGGRGGGLRRPPARFVPPHDCKLRFPFKSNPQHRESWPGMGSGEAPTPLQPPEEVTPHPATPARRPPSPRRSHHPRRNSLDGGGRSRGAGSAQPEPQHFQPKKHNSYPQPPQPYPAQRPPGPRYPPYTTPPRMRRQRSAPDLKESGAAV

SEQ ID NO: 861637 - protein, 456 aa, Homo sapiens
APVTVRNFVAWNEADLLLEQQRLYADSDSGDDSDKRSCEESWRLISSLREQLPPTTVQTIVKRCGLPSSGKRRAPRRVYQIPQRRRLQGKDPRWATMADLKMQAVKEICYEVALADFRHGRAEIEALAALKMRELCRTYGKPDGPGDAWRAVARDVWDTVGEEEGGGAGSGGGSEEGARGAEVEDLRAHIDKLTGILQEVKLQNSSKDRELQALRDRMLRMERVIPLAQDHEDENEEGGEVPWAPPEGSEAAEEAAPSDRMPSARPPSPPLSSWERVSRLMEEDPAFRRGRLRWLKQEQLRLQGLQGSGGRGGGLRRPPARFVPPHDCKLRFPFKSNPQHRESWPGMGSGEAPTPLQPPEEVTPHPATPARRPPSPRRSHHPRRNSLDGGGRSRGAGSAQPEPQHFQPKKHNSYPQPPQPYPAQRPPGPRYPPYTTPPRMRRQRSAPDLKESGAAV

SEQ ID NO: 861638 - protein, 506 aa, Homo sapiens
MAGASVKVAVRVRPFNARETSQDAKCVVSMQGNTTSIINPKQSKDAPKSFTFDYSYWSHTSTEDPQFASQQQVYRDIGEEMLLHAFEGYNVCIFAYGQTGAGKSYTMMGRQEPGQQGIVPQLCEDLFSRVSENQSAQLSYSVEVSYMEIYCERVRDLLNPKSRGSLRVREHPILGPYVQDLSKLAVTSYADIADLMDCGNKARTVAATNMNETSSRSHAVFTIVFTQRCHDQLTGLDSEKVSKISLVDLAGSERADSSGARGMRLKEGANINKSLTTLGKVISALADMQSKKRKSDFIPYRDSVLTWLLKENLGGNSRTAMIAALSPADINYEETLSTLRYADRTKQIRCNAIINEDPNARLIRELQEEVARLRELLMAQGLSASALEGLKTEEGSVRGALPAVSSPPAPVSPSSPTTHNGELEPSFSPNTESQIGPEEAMERLQETEKIIAELNETWEEKLRKTEALRMEREALLAEMGVAVREDGGTVGVFSPKKVSEESSEEA

SEQ ID NO: 861639 - protein, 361 aa, Homo sapiens
MAGASVKVAVRVRPFNARETSQDAKCVVSMQGNTTSIINPKQSKDAPKSFTFDYSYWSHTSTEDPQFASQQQVYRDIGEEMLLHAFEGYNVCIFAYGQTGAGKSYTMMGRQEPGQQGIVPQLCEDLFSRVSENQSAQLSYSVEVSYMEIYCERVRDLLNPKSRGSLRVREHPILGPYVQDLSKLAVTSYADIADLMDCGNKARTVAATNMNETSSLALNLGMLYLAPSALSFLTPLCCWFPESVPLEPFTLPDHLTSLPAPCAFMDLEFLAPSSLKPDFLPTATSSLTTGLLLSLLVLLVLVMLGASYWYRARLHQRLCQLKGPTCQYRYEHHLPATTSIQLGTVLKLPHLSALPPKIRAG

SEQ ID NO: 861640 - protein, 78 aa, Homo sapiens
DKLTGILQEVKLQNSSKDRELQALRDRMLRMERVIPLAQVGLAFCLLFSPPSALHFRSLNLPSQSLTFPKSGKNCIEV

SEQ ID NO: 861641 - protein, 246 aa, Homo sapiens
MQPFLLLLAFLLTPGAGTEEIIGGHEAKPHSRPYMAFVQFLQEKSRKRCGGILVRKDFVLTAAHCQGSSINVTLGAHNIKEQERTQQFIPVKRPIPHPAYNPKNFSNDIMLLQLERKAKWTTAVRPLRLPSSKAQVKPGQLCSVAGWGYVSMSTLATTLQEVLLTVQKDCQCERLFHGNYSRATEICVGDPKKTQTGFKGDSGGPLVCKDVAQGILSYGNKKGTPPGVYIKVSHFLPWIKRTMKRL

SEQ ID NO: 861642 - protein, 147 aa, Homo sapiens
YNPKNFSNDIMLLQLERKAKWTTAVRPLRLPSSKAQVKPGQLCSVAGWGYVSMSTLATTLQEVLLTVQKDCQCERLFHGNYSRATEICVGDPKKTQTGFKGDSGGPLVCKDVAQGILSYGNKKGTPPGVYIKVSHFLPWIKRTMKRL

SEQ ID NO: 861643 - protein, 182 aa, Homo sapiens
MQPFLLLLAFLLTPGAGTEEIIGGHEAKPHSRPYMAFVQFLQEKSRKRCGGILVRKDFVLTAAHCQGSSINVTLGAHNIKEQERTQQFIPVKRPIPHPAYNPKNFSNDIMLLQLERKAKWTTAVRPLRLPSSKAQGDSGGPLVCKDVAQGILSYGNKKGTPPGVYIKVSHFLPWIKRTMKRL

SEQ ID NO: 861644 - protein, 307 aa, Homo sapiens
MQKGKGRTSRIRRRKLCGSSESRGVNESHKSEFIELRKWLKARKFQDSNLAPACFPGTGRGLMSQTSLQEGQMIISLPESCLLTTDTVIRSYLGAYITKWKPPPSPLLALCTFLVSEKHAGHRSLWKPYLEILPKAYTCPVCLEPEVVNLLPKSLKAKAEEQRAHVQEFFASSRDFFSSLQPLFAEAVDSIFSYSALLWAWCTVNTRAVYLRPRQRECLSAEPDTCALAPYLDLLNHSPHVQVKAAFNEETHSYEIRTTSRWRKHEEVFICYGPHDNQRLFLEYGFVSVHNPHACVYVSRGWNQLCS

SEQ ID NO: 861645 - protein, 283 aa, Homo sapiens
MNESHKSEFIELRKWLKARKFQDSNLAPACFPGTGRGLMSQTSLQEGQMIISLPESCLLTTDTVIRSYLGAYITKWKPPPSPLLALCTFLVSEKHAGHRSLWKPYLEILPKAYTCPVCLEPEVVNLLPKSLKAKAEEQRAHVQEFFASSRDFFSSLQPLFAEAVDSIFSYSALLWAWCTVNTRAVYLRPRQRECLSAEPDTCALAPYLDLLNHSPHVQVKAAFNEETHSYEIRTTSRWRKHEEVFICYGPHDNQRLFLEYGFVSVHNPHACVYVSRGWNQLCS

SEQ ID NO: 861646 - protein, 440 aa, Homo sapiens
MQKGKGRTSRIRRRKLCGSSESRGVNESHKSEFIELRKWLKARKFQDSNLAPACFPGTGRGLMSQTSLQEGQMIISLPESCLLTTDTVIRSYLGAYITKWKPPPSPLLALCTFLVSEKHAGHRSLWKPYLEILPKAYTCPVCLEPEVVNLLPKSLKAKAEEQRAHVQEFFASSRDFFSSLQPLFAEAVDSIFSYSALLWAWCTVNTRAVYLRPRQRECLSAEPDTCALAPYLDLLNHSPHVQVKAAFNEETHSYEIRTTSRWRKHEEVFICYGPHDNQRLFLEYGFVSVHNPHACVYVSREILVKYLPSTDKQMDKKISILKDHGYIENLTFGWDGPSWRLLTALKLLCLEAEKFTCWKKVLLGEVISDTNEKTSLDIAQKICYYFIEETNAVLQKVSHMKDEKEALINQLTLVESLWTEELKILRASAETLHSLQTAFT

SEQ ID NO: 861647 - protein, 416 aa, Homo sapiens
MNESHKSEFIELRKWLKARKFQDSNLAPACFPGTGRGLMSQTSLQEGQMIISLPESCLLTTDTVIRSYLGAYITKWKPPPSPLLALCTFLVSEKHAGHRSLWKPYLEILPKAYTCPVCLEPEVVNLLPKSLKAKAEEQRAHVQEFFASSRDFFSSLQPLFAEAVDSIFSYSALLWAWCTVNTRAVYLRPRQRECLSAEPDTCALAPYLDLLNHSPHVQVKAAFNEETHSYEIRTTSRWRKHEEVFICYGPHDNQRLFLEYGFVSVHNPHACVYVSREILVKYLPSTDKQMDKKISILKDHGYIENLTFGWDGPSWRLLTALKLLCLEAEKFTCWKKVLLGEVISDTNEKTSLDIAQKICYYFIEETNAVLQKVSHMKDEKEALINQLTLVESLWTEELKILRASAETLHSLQTAFT

SEQ ID NO: 861648 - protein, 416 aa, Homo sapiens; identical to SEQ ID NO: 861647

SEQ ID NO: 861649 - protein, 283 aa, Homo sapiens; identical to SEQ ID NO: 861645

SEQ ID NO: 861650 - protein, 440 aa, Homo sapiens; identical to SEQ ID NO: 861646

SEQ ID NO: 861651 - protein, 245 aa, Homo sapiens [sequence omitted]

SEQ ID NO: 861652 - protein, 440 aa, Homo sapiens; identical to SEQ ID NO: 861646

SEQ ID NO: 861653 - protein, 218 aa, Homo sapiens
SFKLAFNFQRWKPPPSPLLALCTFLVSEKHAGHRSLWKPYLEILPKAYTCPVCLEPEVVNLLPKSLKAKAEEQRAHVQEFFASSRDFFSSLQPLFAEAVDSIFSYSALLWAWCTVNTRAVYLRPRQRECLSAEPDTCALAPYLDLLNHSPHVQVKAAFNEETHSYEIRTTSRWRKHEEVFICYGPHDNQRLFLEYGFVSVHNPHACVYVSRGWNQLCS

SEQ ID NO: 861654 - protein, 416 aa, Homo sapiens; identical to SEQ ID NO: 861647

SEQ ID NO: 861655 - protein, 129 aa, Homo sapiens
MQKGKGRTSRIRRRKLCGSSESRGVNESHKSEFIELRKWLKARKFQDSNLAPACFPGTGRGLMSQTSLQVEASSISSAGAVHLFSFRKACWAPISLEALPGDFTQGVYLPCLFGAGSGEPSSQIFKSKG

SEQ ID NO: 861656 - protein, 307 aa, Homo sapiens; identical to SEQ ID NO: 861644

SEQ ID NO: 861657 - protein, 106 aa, Homo sapiens
MGRGGVGFILWKNQNKTANGDCRRDPRERSRSPIERAVAPTMSLHGSHLYTSLPSLGLEQPLALTKNSLDASRPAGLSPTLTPGERQQVITEANSSWLWLKQNASS

SEQ ID NO: 861658 - protein, 295 aa, Homo sapiens [sequence omitted]

SEQ ID NO: 861659 - protein, 290 aa, Homo sapiens
METPLDVLSRAASLVHADDEKREAALRGEPRMQTLPVASALSSHRTGPPPISPSKRKFSMEPGDEDLDCDNDHVSKMSRIFNPHLNKTANGDCRRDPRERSRSPIERAVAPTMSLHGSHLYTSLPSLGLEQPLALTKNSLDASRPAGLSPTLTPGERQQNRPSVITCASAGARNCNLSHCPIAHSGCAAPGPASYRRPPSAATTCDPVVEEHFRRSLGKNYKEPEPAPNSVSITGSVDDHFAKALGDTWLQIKAAKDGASSSPESASRRGQPASPSAHMVSHSHSPSVVS

SEQ ID NO: 861660 - protein, 363 aa, Homo sapiens
PALPSAGPVRACVCVCVFGGGPCGGSGASPPVRLRALGVRPACPGPVPAPGSPAGPGRPQAGAPRAAGRLQPGMETPLDVLSRAASLVHADDEKREAALRGEPRMQTLPVASALSSHRTGPPPISPSKRKFSMEPGDEDLDCDNDHVSKMSRIFNPHLNKTANGDCRRDPRERSRSPIERAVAPTMSLHGSHLYTSLPSLGLEQPLALTKNSLDASRPAGLSPTLTPGERQQNRPSVITCASAGARNCNLSHCPIAHSGCAAPGPASYRRPPSAATTCDPVVEEHFRRSLGKNYKEPEPAPNSVSITGSVDDHFAKALGDTWLQIKAAKDGASSSPESASRRGQPASPSAHMVSHSHSPSVVS

SEQ ID NO: 861661 - protein, 295 aa, Homo sapiens [sequence omitted]

SEQ ID NO: 861662 - protein, 225 aa, Homo sapiens
AFLWEDAGLSSCSLAMIKVRNKTANGDCRRDPRERSRSPIERAVAPTMSLHGSHLYTSLPSLGLEQPLALTKNSLDASRPAGLSPTLTPGERQQNRPSVITCASAGARNCNLSHCPIAHSGCAAPGPASYRRPPSAATTCDPVVEEHFRRSLGKNYKEPEPAPNSVSITGSVDDHFAKALGDTWLQIKAAKDGASSSPESASRRGQPASPSAHMVSHSHSPSVVS

SEQ ID NO: 861663 - protein, 204 aa, Homo sapiens
METPLDVLSRAASLVHADDEKREAALRGEPRMQTLPVASALSSHRTGPPPISPSKRKFSMEPGDEDLDCDNDHVSKMSRIFNPHLNKTANGDCRRDPRERSRSPIERAVAPTMSLHGSHLYTSLPSLGLEQPLALTKNSLDASRPAGLSPTLTPGERQQNRPSVITCASAGARNCNLSHCPIAHSGCAAPGPASYRRPPSATCV

SEQ ID NO: 861664 - protein, 200 aa, Homo sapiens
METPLDVLSRAASLVHADDEKREAALRGEPRMQTLPVASALSSHRTGPPPISPSKRKFSMEPGDEDLDCDNDHVSKMSRIFNPHLNKTANGDCRRDPRERSRSPIERAVAPTMSLHGSHLYTSLPSLGLEQPLALTKNSLDASRPAGLSPTLTPGERQQNRPSVITCASAGARNCNLSQGQPASPSAHMVSHSHSPSVVS

SEQ ID NO: 861665 - protein, 291 aa, Homo sapiens [sequence omitted]

SEQ ID NO: 861666 - protein, 295 aa, Homo sapiens [sequence omitted]

SEQ ID NO: 861667 - protein, 290 aa, Homo sapiens; identical to SEQ ID NO: 861659

SEQ ID NO: 861668 - protein, 385 aa, Homo sapiens
PALPSAGPVRACVCVCVFGGGPCGGSGASPPVRLRALGVRPACPGPVPAPGSPAGPGRPQAGAPRAAGRNTWQFECDSSDAHPPGLHIQTRLQPGMETPLDVLSRAASLVHADDEKREAALRGEPRMQTLPVASALSSHRTGPPPISPSKRKFSMEPGDEDLDCDNDHVSKMSRIFNPHLNKTANGDCRRDPRERSRSPIERAVAPTMSLHGSHLYTSLPSLGLEQPLALTKNSLDASRPAGLSPTLTPGERQQNRPSVITCASAGARNCNLSHCPIAHSGCAAPGPASYRRPPSAATTCDPVVEEHFRRSLGKNYKEPEPAPNSVSITGSVDDHFAKALGDTWLQIKAAKDGASSSPESASRRGQPASPSAHMVSHSHSPSVVS

SEQ ID NO: 861669 - protein, 259 aa, Homo sapiens
MQTLPVASALSSHRTGPPPISPSKRKFSMEPGDEDLDCDNDHVSKMSRIFNPHLNKTANGDCRRDPRERSRSPIERAVAPTMSLHGSHLYTSLPSLGLEQPLALTKNSLDASRPAGLSPTLTPGERQQNRPSVITCASAGARNCNLSHCPIAHSGCAAPGPASYRRPPSAATTCDPVVEEHFRRSLGKNYKEPEPAPNSVSITGSVDDHFAKALGDTWLQIKAAKDGASSSPESASRRGQPASPSAHMVSHSHSPSVVS

SEQ ID NO: 861670 - protein, 206 aa, Homo sapiens
MNKTANGDCRRDPRERSRSPIERAVAPTMSLHGSHLYTSLPSLGLEQPLALTKNSLDASRPAGLSPTLTPGERQQNRPSVITCASAGARNCNLSHCPIAHSGCAAPGPASYRRPPSAATTCDPVVEEHFRRSLGKNYKEPEPAPNSVSITGSVDDHFAKALGDTWLQIKAAKDGASSSPESASRRGQPASPSAHMVSHSHSPSVVS

SEQ ID NO: 861671 - protein, 148 aa, Homo sapiens
KSDLPKCLTYRGRWVLSAEPTLTVAASPALGCLREGAATVPVCLQPPVSDCLPSCLPAAATTCDPVVEEHFRRSLGKNYKEPEPAPNSVSITGSVDDHFAKALGDTWLQIKAAKDGASSSPESASRRGQPASPSAHMVSHSHSPSVVS

SEQ ID NO: 861672 - protein, 1074 aa, Homo sapiens
PALGAPAPPGRGGGEGSPPRRPSEPAPSPAWRLGTPAHEVDAPGEDLGAQPGEKVLSQTEHQPWGPWTTIMETESEQNSNSTNGSSSSGGSSRPQIAQMSLYERQAVQALQALQRQPNAAQYFHQFMLQQQLSNAQLHSLAAVQQATIAASRQASSPNTSTTQQQTTTTQASINLATTSAAQLISRSQSVSSPSATTLTQSVLLGNTTSPPLNQSQAQMYLRPQLGNLLQVNRTLGRNVPLASQLILMPNGAVAAVQQEVPSAQSPGVHADADQVQNLAVRNQQASAQGPQMQGSTQKAIPPGASPVSSLSQASSQALAVAQASSGATNQSLNLSQAGGGSGNSIPGSMGPGGGGQAHGGLGQLPSSGMGGGSCPRKGTGVVQPLPAAQTVTVSQGSQTEAESAAAKKAEADGSGQQNVGMNLTRTATPAPSQTLISSATYTQIQPHSLIQQQQQIHLQQKQVVIQQQIAIHHQQQFQHRQSQLLHTATHLQLAQQQQQQQQQQQQQQQPQATTLTAPQPPQVPPTQQVPPSQSQQQAQTLVVQPMLQSSPLSLPPDAAPKPPIPIQSKPPVAPIKPPQLGAAKMSAAQQPPPHIPVQVVGTRQPGTAQAQALGLAQLAAAVPTSRGMPGTVQSGQAHLASSPPSSQAPGALQECPPTLAPGMTLAPVQGTAHVVKGGATTSSPVVAQVPAAFYMQSVHLPGKPQTLAVKRKADSEEERDDVSTLGSMLPAKASPVAESPKVMDEKSSLGEKAESVANVNANTPSSELVALTPAPSVPPPTLAMVSRQMGDSKPPQAIVKPQILTHIIEGFVIQEGAEPFPVGCSQLLKESEKPLQTGLPTGLTENQSGGPLGVDSPSAELDKKANLLKCEYCGKYAPAEQFRGSKRFCSMTCAKRYNVSCSHQFRLKRKKMKEFQEANYARVRRRGPRRSSSDIARAKIQGKCHRGQEDSSRGSDNSSYDEALSPTSPGPLSVRAGHGERDLGNPNTAPPTPELHGINPVFLSSNPSRWSVEEVYEFIASLQGCQEIAEEFRSQEIDGQALLLLKEEHLMSAMNIKLGPALKICAKINVLKET

SEQ ID NO: 861673 - protein, 906 aa, Homo sapiens
PALGAPAPPGRGGGEGSPPRRPSEPAPSPAWRLGTPAHEVDAPGEDLGAQPGEKVLSQTEHQPWGPWTTIMETESEQNSNSTNGSSSSGGSSRPQIAQMSLYERQAVQALQALQRQPNAAQYFHQFMLQQQLSNAQLHSLAAVQQATIAASRQASSPNTSTTQQQTTTTQASINLATTSAAQLISRSQSVSSPSATTLTQSVLLGNTTSPPLNQSQAQMYLRPQLGNLLQVNRTLGRNVPLASQLILMPNGAVAAVQQEVPSAQSPGVHADADQVQNLAVRNQQASAQGPQMQGSTQKAIPPGASPVSSLSQASSQALAVAQASSGATNQSLNLSQAGGGSGNSIPGSMGPGGGGQAHGGLGQLPSSGMGGGSCPRKGTGVVQPLPAAQTVTVSQGSQTEAESAAAKKAEADGSGQQNVGMNLTRTATPAPSQTLISSATYTQIQPHSLIQQQQQIHLQQKQVVIQQQIAIHHQQQFQHRQSQLLHTATHLQLAQQQQQQQQQQQQQQQPQATTLTAPQPPPGPTYSAGPTFPGKPQTLAVKRKADSEEERDDVSTLGSMLPAKASPVAESPKVMDEKSSLGEKAESVANVNANTPSSELVALTPAPSVPPPTLAMVSRQMGDSKPPQAIVKPQILTHIIEGFVIQEGAEPFPVGCSQLLKESEKPLQTGLPTGLTENQSGGPLGVDSPSAELDKKANLLKCEYCGKYAPAEQFRGSKRFCSMTCAKRYNVSCSHQFRLKRKKMKEFQEANYARVRRRGPRRSSSDIARAKIQGKCHRGQEDSSRGSDNSSYDEALSPTSPGPLSVRAGHGERDLGNPNTAPPTPELHGINPVFLSSNPSRWSVEEVYEFIASLQGCQEIAEEFRSQEIDGQALLLLKEEHLMSAMNIKLGPALKICAKINVLKET

SEQ ID NO: 861674 - protein, 347 aa, Homo sapiens [sequence omitted]

SEQ ID NO: 861675 - protein, 520 aa, Homo sapiens
PALGAPAPPGRGGGEGSPPRRPSEPAPSPAWRLGTPAHEVDAPGEDLGAQPGEKVLSQTEHQPWGPWTTIMETESEQNSNSTNGSSSSGGSSRPQIAQMSLYERQAVQALQALQRQPNAAQYFHQFMLQQQLSNAQLHSLAAVQQATIAASRQASSPNTSTTQQQTTTTQASINLATTSAAQLISRSQSVSSPSATTLTQSVLLGNTTSPPLNQSQAQMYLRPQLGNLLQVNRTLGRNVPLASQLILMPNGAVAAVQQEVPSAQSPGVHADADQVQNLAVRNQQASAQGPQMQGSTQKAIPPGASPVSSLSQASSQALAVAQASSGATNQSLNLSQAGGGSGNSIPGSMGPGGGGQAHGGLGQLPSSGMGGGSCPRKGTGVVQPLPAAQTVTVSQGSQTEAESAAAKKAEADGSGQQNVGMNLTRTATPAPSQTLISSATYTQIQPHSLIQQQQQIHLQQKQVVIQQQIAIHHQQQFQHRQSQLLHTATHLQLAQQQQQQQQQQQQQQQPQATTLSGQKI

SEQ ID NO: 861676 - protein, 358 aa, Homo sapiens
PALGAPAPPGRGGGEGSPPRRPSEPAPSPAWRLGTPAHEVDAPGEDLGAQPGEKVLSQTEHQPWGPWTTIMETESEQNSNSTNGSSSSGGSSRPQIAQMSLYERQAVQALQALQRQPNAAQYFHQFMLQQQLSNAQLHSLAAVQQATIAASRQASSPNTSTTQQQTTTTQASINLATTSAAQLISRSQSVSSPSATTLTQSVLLGNTTSPPLNQSQAQMYLRPQLGNLLQVNRTLGRNVPLASQLILMPNGAVAAVQQEVPSAQSPGVHADADQVQNLAVRNQQASAQGPQMQGSTQKAIPPGASPVSSLSQASSQALAVAQASSGATNQSLNLSQAGGGSGNSIPGSMGPMGEVGFF

SEQ ID NO: 861677 - protein, 783 aa, Homo sapiens
MQGSTQKAIPPGASPVSSLSQASSQALAVAQASSGATNQSLNLSQAGGGSGNSIPGSMGPGGGGQAHGGLGQLPSSGMGGGSCPRKGTGVVQPLPAAQTVTVSQGSQTEAESAAAKKAEADGSGQQNVGMNLTRTATPAPSQTLISSATYTQIQPHSLIQQQQQIHLQQKQVVIQQQIAIHHQQQFQHRQSQLLHTATHLQLAQQQQQQQQQQQQQQQPQATTLTAPQPPQVPPTQQVPPSQSQQQAQTLVVQPMLQSSPLSLPPDAAPKPPIPIQSKPPVAPIKPPQLGAAKMSAAQQPPPHIPVQVVGTRQPGTAQAQALGLAQLAAAVPTSRGMPGTVQSGQAHLASSPPSSQAPGALQECPPTLAPGMTLAPVQGTAHVVKGGATTSSPVVAQVPAAFYMQSVHLPGKPQTLAVKRKADSEEERDDVSTLGSMLPAKASPVAESPKVMDEKSSLGEKAESVANVNANTPSSELVALTPAPSVPPPTLAMVSRQMGDSKPPQAIVKPQILTHIIEGFVIQEGAEPFPVGCSQLLKESEKPLQTGLPTGLTENQSGGPLGVDSPSAELDKKANLLKCEYCGKYAPAEQFRGSKRFCSMTCAKRYNVSCSHQFRLKRKKMKEFQEANYARVRRRGPRRSSSDIARAKIQGKCHRGQEDSSRGSDNSSYDEALSPTSPGPLSVRAGHGERDLGNPNTAPPTPELHGINPVFLSSNPSRWSVEEVYEFIASLQGCQEIAEEFRSQEIDGQALLLLKEEHLMSAMNIKLGPALKICAKINVLKET

SEQ ID NO: 861678 - protein, 705 aa, Homo sapiens
PALGAPAPPGRGGGEGSPPRRPSEPAPSPAWRLGTPAHEVDAPGEDLGAQPGEKVLSQTEHQPWGPWTTIMETESEQNSNSTNGSSSSGGSSRPQIAQMSLYERQAVQALQALQRQPNAAQYFHQFMLQQQLSNAQLHSLAAVQQATIAASRQASSPNTSTTQQQTTTTQASINLATTSAAQLISRSQSVSSPSATTLTQSVLLGNTTSPPLNQSQAQMYLRPQLGNLLQVNRTLGRNVPLASQLILMPNGAVAAVQQEVPSAQSPGVHADADQVQNLAVRNQQASAQGPQMQGSTQKAIPPGASPVSSLSQASSQALAVAQASSGATNQSLNLSQAGGGSGNSIPGSMGPGGGGQAHGGLGQLPSSGMGGGSCPRKGTGVVQPLPAAQTVTVSQGSQTEAESAAAKKAEADGSGQQNVGMNLTRTATPAPSQTLISSATYTQIQPHSLIQQQQQIHLQQKQVVIQQQIAIHHQQQFQHRQSQLLHTATHLQLAQQQQQQQQQQQQQQQPQATTLTAPQPPQVPPTQQVPPSQSQQQAQTLVVQPMLQSSPLSLPPDAAPKPPIPIQSKPPVAPIKPPQLGAAKMSAAQQPPPHIPVQVVGTRQPGTAQAQALGLAQLAAAVPTSRGMPGTVQSGQAHLASSPPSSQAPGALQECPPTLAPGMTLAPVQGTAHVVKGGATTSSPVVAQVPAAFYMQSVHLPVSDV

SEQ ID NO: 861679 - protein, 494 aa, Homo sapiens
PALGAPAPPGRGGGEGSPPRRPSEPAPSPAWRLGTPAHEVDAPGEDLGAQPGEKVLSQTEHQPWGPWTTIMETESEQNSNSTNGSSSSGGSSRPQIAQMSLYERQAVQALQALQRQPNAAQYFHQFMLQQQLSNAQLHSLAAVQQATIAASRQASSPNTSTTQQQTTTTQASINLATTSAAQLISRSQSVSSPSATTLTQSVLLGNTTSPPLNQSQAQMYLRPQLGNLLQVNRTLGRNVPLASQLILMPNGAVAAVQQEVPSAQSPGVHADADQVQNLAVRNQQASAQGPQMQGSTQKAIPPGASPVSSLSQASSQALAVAQASSGATNQSLNLSQAGGGSGNSIPGSMGPGGGGQAHGGLGQLPSSGMGGGSCPRKGTGVVQPLPAAQTVTVSQGSQTEAESAAAKKAEADGSGQQNVGMNLTRTATPAPSQTLISSATYTQIQPHSMWLLSFFLHPTVPLQFMLFSTLFFSSISALSYSFIKPECVGLRSGV

SEQ ID NO: 861680 - protein, 1143 aa, Homo sapiens [sequence omitted]

SEQ ID NO: 861681 - protein, 1016 aa, Homo sapiens
MGDNPFQPKSNSKMAELFMECEEEELEPWQKKVKEVEDDDDDEPIFVGEISSSKPAISNILNRVNPSSYSRGLKNGALSRGITAAFKPTSQHYTNPTSNPVPASPINFHPESRSSDSSVIVQPFSKPGYITNSSRVVSNKSSELLFDLTQDTGLSHYQGGPTLSMAGMSESSFLSKRPSTSEVNNVNPKKPKPSESVSGANSSAVLPSVKSPSVTSSQAMLAKGTNTSSNQSKNGTPFPRACPKCNIHFNLLDPLKNHMKYCCPDMINNFLGLAKTEFSSTVNKNTTIDSEKGKLIMLVNDFYYGKHEGDVQEEQKTHTTFKCFSCLKILKNNIRFMNHMKHHLELEKQSSESWENHTTCQHCYRQFPTPFQLQCHIESTHTPHEFSTICKICELSFETEHVLLQHMKDNHKPGEMPYVCQVCNYRSSSFSDVETHFRTSHENTKNLLCPFCLKVIKIATPYMHHYMKHQKKGIHRCTKCRLQFLTCKEKMDHKTQHHRTFIKPKQLEGLPPGTKVTIRASVGPLQSGASPTPSISASASTLQLSPPRTKNITAKNPAKSNTSKPNTIKSNASKPNTSKPNGSKSKYKPKISNMQKKQSTLASSNKKSKVNTALRNLRYRRGIHKCIECCSEIKDFANHFPTYVHCSFCRYNTSCSKAYVNHMMSFHSNRPSKRFCIFKKHSENLRCVGGQIECDLPKLHKLVVEPRLTLGLLTPTFNNWYDRGITLVCLNCDFLSDVSGLDNMATHLSQHKTHTCQVVMQKVSVCIPTSEHLSELKKEAPAKEQEPVSKEIARPNMAERETETSNSESKQDKAASSKEKNGCNANSFEGSSTTKSEESITVSDKENETCLADQETGSKNIVSCDSNIGADKVEKKKQIQHVCQEMELKMCQSSENIILSDQIKDHNSSEARFSSKNIKDLRLASDNVSIDQFLRKRHEPESVSSDVSEQGSIHLEPLTPSEVLEYEATEILQKGSGDPSAKTDEVVSDQTDDIPGGNNPSTTEATVDLEDEKERS

SEQ ID NO: 861682 - protein, 1180 aa, Homo sapiens
MTFSLSKPTDWGSLHTRRARNARLLACKFRAVRILGLPPGHTSQQLAPTWRQGPGPRPGPARGGARGSSRARDAAHMPVPASRVGEKTGSSDTGRLTRSLPMRQRAGCTRAPPFPRLGCQLRNGSRRRRRSVVFRAPPFPPPLSPPPQGSSQADPLRSRKENRNNLLACLESHGNSKMAELFMECEEEELEPWQKKVKEVEDDDDDEPIFVGEISSSKPAISNILNRVNPSSYSRGLKNGALSRGITAAFKPTSQHYTNPTSNPVPASPINFHPESRSSDSSVIVQPFSKPGYITNSSRVVSNKSSELLFDLTQDTGLSHYQGGPTLSMAGMSESSFLSKRPSTSEVNNVNPKKPKPSESVSGANSSAVLPSVKSPSVTSSQAMLAKGTNTSSNQSKNGTPFPRACPKCNIHFNLLDPLKNHMKYCCPDMINNFLGLAKTEFSSTVNKNTTIDSEKGKLIMLVNDFYYGKHEGDVQEEQKTHTTFKCFSCLKILKNNIRFMNHMKHHLELEKQSSESWENHTTCQHCYRQFPTPFQLQCHIESTHTPHEFSTICKICELSFETEHVLLQHMKDNHKPGEMPYVCQVCNYRSSSFSDVETHFRTSHENTKNLLCPFCLKVIKIATPYMHHYMKHQKKGIHRCTKCRLQFLTCKEKMDHKTQHHRTFIKPKQLEGLPPGTKVTIRASVGPLQSGASPTPSISASASTLQLSPPRTKNITAKNPAKSNTSKPNTIKSNASKPNTSKPNGSKSKYKPKISNMQKKQSTLASSNKKSKVNTALRNLRYRRGIHKCIECCSEIKDFANHFPTYVHCSFCRYNTSCSKAYVNHMMSFHSNRPSKRFCIFKKHSENLRCVGGQIECDLPKLHKLVVEPRLTLGLLTPNFNNWYDRGITLVCLNCDFLSDVSGLDNMATHLSQHKTHTCQVVMQKVSVCIPTSEHLSELKKEAPAKEQEPVSKEIARPNMAERETETSNSESKQDKAASSKEKNGCNANSFEGSSTTKSEESITVSDKENETCLADQETGSKNIVSCDSNIGADKVEKKKQIQHVCQEMELKMCQSSENIILSDQIKDHNSSEARFSSKNIKDLRLASDNVSIDQFLRKRHEPESVSSDVSEQGSIHLEPLTPSEVLEYEATEILQKGSGDPSAKTDEVVSDQTDDIPGGNNPSTTEATVDLEDEKERS

SEQ ID NO: 861683 - protein, 176 aa, Homo sapiens
MTFSLSKPTDWGSLHTRRARNARLLACKFRAVRILGLPPGHTSQQLAPTWRQGPGPRPGPARGGARGSSRARDAAHMPVPASRVGEKTGSSDTGRLTRSLPMRQRAGCTRAPPFPRLGCQLRNGSRRRRRSVVFRAPPFPPPLSPPPQGSSQADPLRSRKENRNNLLACLESHVLR

SEQ ID NO: 861684 - protein, 164 aa, Homo sapiens
MRPEVNLHPSEERDSCTGICDVDQELWNLGAEGQQSVDTFEDDDDDDSFSVGRDIKFNNQQSYQDILNRVNPSSYSRGLKNGALSRGITAAFKPTSQHYTNPTSNPVPASPINFHPESRSSDSSVIVQPFSKPVSVSKTIRPAQGSIGCCLSISTVPSYNSGLS

SEQ ID NO: 861685 - protein, 236 aa, Homo sapiens
MTFSLSKPTDWGSLHTRRARNARLLACKFRAVRILGLPPGHTSQQLAPTWRQGPGPRPGPARGGARGSSRARDAAHMPVPASRVGEKTGSSDTGRLTRSLPMRQRAGCTRAPPFPRLGCQLRNGSRRRRRSVVFRAPPFPPPLSPPPQGSSQADPLRSRRRKGDQRGFGICRHRAPHFAQMTGRSTFAPSFLSKRPPLLCHRIPVIVYRRRALRRNVELETKFSELCKVHLLRRKE

SEQ ID NO: 861686 - protein, 961 aa, Homo sapiens
MGDNPFQPKSNSKMAELFMECEEEELEPWQKKVKEVEDDDDDEPIFVGEISSSKPAISNILNRVNPSSYSRGLKNGALSRGITAAFKPTSQHYTNPTSNPVPASPINFHPESRSSDSSVIVQPFSKPGYITNSSRVVSNKSSELLFDLTQDTGLSHYQGGPTLSMAGMSESSFLSKRPSTSEVNNVNPKKPKPSESVSGANSSAVLPSVKSPSVTSSQAMLAKGTNTSSNQSKNGTPFPRACPKCNIHFNLLDPLKNHMKYCCPDMINNFLGLAKTEFSSTVNKNTTIDSEKGKLIMLVNDFYYGKHEGDVQEEQKTHTTFKCFSCLKILKNNIRFMNHMKHHLELEKQSSESWENHTTCQHCYRQFPTPFQLQCHIESTHTPHEFSTICKICELSFETEHVLLQHMKDNHKPGEMPYVCQVCNYRSSSFSDVETHFRTSHENTKNLLCPFCLKVIKIATPYMHHYMKHQKKGIHRCTKCRLQFLTCKEKMDHKTQHHRTFIKPKQLEGLPPGTKVTIRASVGPLQSGASPTPSISASASTLQLSPPRTKNITAKNPAKSNTSKPNTIKSNASKPNTSKPNGSKSKYKPKISNMQKKQSTLASSNKKSKVNTALRNLRYRRGIHKCIECCSEIKDFANHFPTYVHCSFCRYNTSCSKAYVNHMMSFHSNRPSKRFCIFKKHSENLRGITLVCLNCDFLSDVSGLDNMATHLSQHKTHTCQVVMQKVSVCIPTSEHLSELKKEAPAKEQEPVSKEIARPNMAERETETSNSESKQDKAASSKEKNGCNANSFEGSSTTKSEESITVSDKENETCLADQETGSKNIVSCDSNIGADKVEKKKQIQHVCQEMELKMCQSSFSSKNIKDLRLASDNVSIDQFLRKRHEPESVSSDVSEQGSIHLEPLTPSEVLEYEATEILQKGSGDPSAKTDEVVSDQTDDIPGGNNPSTTEATVDLEDEKERS

SEQ ID NO: 861687 - protein, 176 aa, Homo sapiens; identical to SEQ ID NO: 861683

SEQ ID NO: 861688 - protein, 220 aa, Homo sapiens
MAERETETSNSESKQDKAASSKEKNGCNANSFEGSSTTKSEESITVSDKENETCLADQETGSKNIVSCDSNIGADKVEKKKQIQHVCQEMELKMCQSSENIILSDQIKDHNSSEARFSSKNIKDLRLASDNVSIDQFLRKRHEPESVSSDVSEQGSIHLEPLTPSEVLEYEATEILQKGSGDPSAKTDEVVSDQTDDIPGGNNPSTTEATVDLEDEKERS

SEQ ID NO: 861689 - protein, 941 aa, Homo sapiens
MVFLPLKWSLATMSFLLSSLLALLTVSTPSWCQSTEASPKRSDGTPFPWNKIRLPEYVIPVHYDLLIHANLTTLTFWGTTKVEITASQPTSTIILHSHHLQISRATLRKGAGERLSEEPLQVLEHPRQEQIALLAPEPLLVGLPYTVVIHYAGNLSETFHGFYKSTYRTKEGELRILASTQFEPTAARMAFPCFDEPAFKASFSIKIRREPRHLAISNMPLVKSVTVAEGLIEDHFDVTVKMSTYLVAFIISDFESVSKITKSGVKVSVYAVPDKINQADYALDAAVTLLEFYEDYFSIPYPLPKQDLAAIPDFQSGAMENWGLTTYRESALLFDAEKSSASSKLGITMTVAHELAHQWFGNLVTMEWWNDLWLNEGFAKFMEFVSVSVTHPELKVGDYFFGKCFDAMEVDALNSSHPVSTPVENPAQIREMFDDVSYDKGACILNMLREYLSADAFKSGIVQYLQKHSYKNTKNEDLWDSMASICPTDGVKGMDGFCSRSQHSSSSSHWHQEGVDVKTMMNTWTLQKGFPLITITVRGRNVHMKQEHYMKGSDGAPDTGYLWHVPLTFITSKSDMVHRFLLKTKTDVLILPEEVEWIKFNVGMNGYYIVHYEDDGWDSLTGLLKGTHTAVSSNDRASLINNAFQLVSIGKLSIEKALDLSLYLKHETEIMPVFQGLNELIPMYKLMEKRDMNEVETQFKAFLIRLLRDLIDKQTWTDEGSVSERMLRSQLLLLACVHNYQPCVQRAEGYFRKWKESNGNLSLPVDVTLAVFAVGAQSTEGWDFLYSKYQFSLSSTEKSQIEFALCRTQNKEKLQWLLDESFKGDKIKTQEFPQILTLIGRNPVGYPLAWQFLRKNWNKLVQKFELGSSSIAHMVMGTTNQFSTRTRLEEVKGFFSSLKENGSQLRCVQQTIETIEENIGWMDKNFDKIRVWLQSEKLERM

SEQ ID NO: 861690 - protein, 948 aa, Homo sapiens
MVFLPLKWSLATMSFLLSSLLALLTVSTPSWCQSTEASPKRSDGTPFPWNKIRLPEYVIPVHYDLLIHANLTTLTFWGTTKVEITASQPTSTIILHSHHLQISRATLRKGAGERLSEEPLQVLEHPRQEQIALLAPEPLLVGLPYTVVIHYAGNLSETFHGFYKSTYRTKEGELRILASTQFEPTAARMAFPCFDEPAFKASFSIKIRREPRHLAISNMPLVKSVTVAEGLIEDHFDVTVKMSTYLVAFIISDFESVSKITKSGVKVSVYAVPDKINQADYALDAAVTLLEFYEDYFSIPYPLPKQDLAAIPDFQSGAMENWGLTTYRESALLFDAEKSSASSKLGITMTVAHELAHQWFGNLVTMEWWNDLWLNEGFAKFMEFVSVSVTHPELKVGDYFFGKCFDAMEVDALNSSHPVSTPVENPAQIREMFDDVSYDKGACILNMLREYLSADAFKSGIVQYLQKHSYKNTKNEDLWDSMASICPTDGVKGMDGFCSRSQHSSSSSHWHQEGVDVKTMMNTWTLQKGFPLITITVRGRNVHMKQEHYMKGSDGAPDTGYLWHVPLTFITSKSDMVHRFLLKTKTDVLILPEEVEWIKFNVGMNGYYIVHYEDDGWDSLTGLLKGTHTAVSSNDRASLINNAFQLVSIGKLSIEKALDLSLYLKHETEIMPVFQGLNELIPMYKLMEKRDMNEVETQFKAFLIRLLRDLIDKQTWTDEGSVSERMLRSQLLLLACVHNYQPCVQRAEGYFRKWKESNGNLSLPVDVTLAVFAVGAQSTEGWDFLYSKYQFSLSSTEKSQIEFALCRTQNKEKLQWLLDESFKGDKIKTQEFPQILTLIGRNPVGYPLAWQFLRKNWNKLVQKFELGSSSIAHMVMGTTNQFSTRTRLEEVKGFFSSLKENGSQLRCVQQTIETIEENIGWMDKNFDKIRVWLQSEKLEHDPEADATG

SEQ ID NO: 861691 - protein, 948 aa, Homo sapiens; identical to SEQ ID NO: 861690

SEQ ID NO: 861692 - protein, 941 aa, Homo sapiens; identical to SEQ ID NO: 861689

SEQ ID NO: 861693 - protein, 941 aa, Homo sapiens; identical to SEQ ID NO: 861689

SEQ ID NO: 861694 - protein, 115 aa, Homo sapiens
MVFLPLKWSLATMSFLLSSLLALLTVSTPSWCQSTEASPKRSDGTPFPWNKIRLPEYVIPVHYDLLIHANLTTHAAVAYRTCLGDGARWPPQRITQAEQQPSSPLGCAAQSSKHA

SEQ ID NO: 861695 - protein, 941 aa, Homo sapiens; identical to SEQ ID NO: 861689

SEQ ID NO: 861696 - protein, 948 aa, Homo sapiens; identical to SEQ ID NO: 861690

SEQ ID NO: 861697 - protein, 111 aa, Homo sapiens
QVFPQLFCTFLSIDLECLWNTQSVPCVNHLPQDYQLQAMDHAPGFHLFLAPISVAHIIGPQQTGSHAGGSHMVKNCRWPLGDEGGLQSTASKKLKCSVLQPCVTEFCQQPE

SEQ ID NO: 861698 - protein, 249 aa, Homo sapiens
NSRIRVPWEENFFLAWAPCRSVCQPSSPAYQCRALPTPPPAPPVSAMAKAYDHLFKLLLIGDSGVGKTCLIIRFAEDNFNNTYISTIGIDFKIRTVDIEGKKIKLQVWDTAGQERFKTITTAYYRGAMGIILVYDITDEKSFENIQNWMKSIKENASAGVERLLLGNKCDMEAKRKVQKEQADKLAREHGIRFFETSAKSSMNVDEAFSSLARDILLKSGGRRSGNGNKPPSTDLKTCDKKNTNKCSLG

SEQ ID NO: 861699 - protein, 249 aa, Homo sapiens; identical to SEQ ID NO: 861698

SEQ ID NO: 861700 - protein, 249 aa, Homo sapiens; identical to SEQ ID NO: 861698

SEQ ID NO: 861701 - protein, 249 aa, Homo sapiens; identical to SEQ ID NO: 861698

SEQ ID NO: 861702 - protein, 249 aa, Homo sapiens; identical to SEQ ID NO: 861698

SEQ ID NO: 861703 - protein, 250 aa, Homo sapiens
LFPGAWAEREENFFLAWAPCRSVCQPSSPAYQCRALPTPPPAPPVSAMAKAYDHLFKLLLIGDSGVGKTCLIIRFAEDNFNNTYISTIGIDFKIRTVDIEGKKIKLQVWDTAGQERFKTITTAYYRGAMGIILVYDITDEKSFENIQNWMKSIKENASAGVERLLLGNKCDMEAKRKVQKEQADKLAREHGIRFFETSAKSSMNVDEAFSSLARDILLKSGGRRSGNGNKPPSTDLKTCDKKNTNKCSLG

SEQ ID NO: 861704 - protein, 249 aa, Homo sapiens; identical to SEQ ID NO: 861698

SEQ ID NO: 861705 - protein, 281 aa, Homo sapiens
NSRIRVPWEENFFLAWAPCRSVCQPSSPAYQCRALPTPPPAPPVSAMAKAYDHLFKLLLIGDSGVGKTCLIIRFAEDNFNNTYISTIGEPAGHVPDPDSPVTSFSGSRITSDPTFQSPERIDFKIRTVDIEGKKIKLQVWDTAGQERFKTITTAYYRGAMGIILVYDITDEKSFENIQNWMKSIKENASAGVERLLLGNKCDMEAKRKVQKEQADKLAREHGIRFFETSAKSSMNVDEAFSSLARDILLKSGGRRSGNGNKPPSTDLKTCDKKNTNKCSLG

SEQ ID NO: 861706 - protein, 119 aa, Homo sapiens
EFEDPGTMGGKLLPGLGSVPLCLPTVQSRLPRLLLGNKCDMEAKRKVQKEQADKLAREHGIRFFETSAKSSMNVDEAFSSLARDILLKSGGRRSGNGNKPPSTDLKTCDKKNTNKCSLG

SEQ ID NO: 861707 - protein, 230 aa, Homo sapiens
MASLGLQLVGYILGLLGLLGTLVAMLLPSWKTSSYVGASIVTAVGFSKGLWMECATHSTGITQCDIYSTLLGLPADIQAAQAMMVTSSAISSLACIISVVGMRCTVFCQESRAKDRVAVAGGVFFILGGLLGFIPVAWNLHGILRDFYSPLVPDSMKFEIGEALYLGIISSLFSLIAGIILCFSCSSQRNRSNYYDAYQAQPLATRSSPRPGQPPKVKSEFNSYSLTGYV

SEQ ID NO: 861708 - protein, 230 aa, Homo sapiens; identical to SEQ ID NO: 861707

SEQ ID NO: 861709 - protein, 129 aa, Homo sapiens
MFPLPWSGSEGSYTKGIFPHQSRHDWLLKNSSTPPRTSLSAERDFVQEEIRVSNEYLPITDPFPITQGPRLEQNGCITVLCTCQGMWVWVPCGWFTHMPTRYGVTVCVCMGCTSKCLPMCLSGQCVPSV

SEQ ID NO: 861710 - protein, 68 aa, Homo sapiens
GALRSWTQHGISMPTVLSLRSWTQHRGHGYAMLHCCLGLQLRWEWRMVPRKTVPPLRSENVPFTLEWE

SEQ ID NO: 861711 - protein, 104 aa, Homo sapiens
KQQHHQLLNCLIILFALSRLPQRLHNGLVRLDLQVLFAHHIAIGGVVPKCLGFLSQLPGVGVENGSQEDSSTSKVRKCSLYPGVGVRGHTPKVFSLTSLGMTGF

SEQ ID NO: 861712 - protein, 150 aa, Homo sapiens
MASLGLQLVGYILGLLGLLGTLVAMLLPSWKTSSYVGASIVTAVGFSKGLWMECATHSTGITQCDIYSTLLGLPADIQAAQAMMVTSSAISSLACIISVVGMRCTVFCQESRAKDRVAVAGGVFFILGGLLGFIPVAWNLHGILRDFYYA

SEQ ID NO: 861713 - protein, 209 aa, Homo sapiens
NQARYEAWWLIGRGVGASIVTAVGFSKGLWMECATHSTGITQCDIYSTLLGLPADIQAAQAMMVTSSAISSLACIISVVGMRCTVFCQESRAKDRVAVAGGVFFILGGLLGFIPVAWNLHGILRDFYSPLVPDSMKFEIGEALYLGIISSLFSLIAGIILCFSCSSQRNRSNYYDAYQAQPLATRSSPRPGQPPKVKSEFNSYSLTGYV

SEQ ID NO: 861714 - protein, 230 aa, Homo sapiens; identical to SEQ ID NO: 861707

SEQ ID NO: 861715 - protein, 202 aa, Homo sapiens
MASLGLQLVGYILGLLGLLGTLVAMLLPSWKTSSYVGASIVTAVGFSKGLWMECATHSTGITQCDIYSTLLGLPADIQAAQAMMVTSSAISSLACIISVVGMRCTVFCQESRAKDRVAVAGGVFFILGGLLGFIPVAWNLHGILRDFYSPLVPDSMKFEIGEALYLGIISSLFSLIVHPSPTPPSPNPQCINCFLMLSIHNF

SEQ ID NO: 861716 - protein, 35 aa, Homo sapiens
MASLGLQLVGYILGLLGLLGTLVAMLLPSWKTSSY

SEQ ID NO: 861717 - protein, 369 aa, Homo sapiens
MPRAPKRQRCMPEEDLQSQSETQGLEGAQAPLAVEEDASSSTSTSSSFPSSFPSSSSSSSSSCYPLIPSTPEEVSADDETPNPPQSAQIACSSPSVVASLPLDQSDEGSSSQKEESPSTLQVLPDSESLPRSEIDEKVTDLVQFLLFKYQMKEPITKAEILESVIKNYEDHFPLLFSEASECMLLVFGIDVKEVDPTGHSFVLVTSLGLTYDGMLSDVQSMPKTGILILILSIIFIEGYCTPEEVIWEALNMMGLYDGMEHLIYGEPRKLLTQDWVQENYLEYRQVPGSDPARYEFLWGPRAHAEIRKMSLLKFLAKVNGSDPRSFPLWYEEALKDEEERAQDRIATTDDTTAMASASSSATGSFSYPE

SEQ ID NO: 861718 - protein, 369 aa, Homo sapiens; identical to SEQ ID NO: 861717

SEQ ID NO: 861719 - protein, 215 aa, Homo sapiens
WEGGKWNNRACSTRSTSHVVSPSELALVPQNQVDSCYKITVTLNYSQGNAVHLYELLKKMTGKPEPKVVYFGDSMHSDIFPARHYSNWETVLILEELRGDEGTRSQRPEESEPLEKKGKYEGPKAKPLNTSSKKWGSFFIDSVLGLENTEDSLVYTWSCKRISTYSTIAIPSIEAIAELPLDYKFTRFSSSNSKTAGYYPNPPLVLSSDETLISK

SEQ ID NO: 861720 - protein, 455 aa, Homo sapiens
MAQHFSLAACDVVGFDLDHTLCRYNLPESAPLIYNSFAQFLVKEKGYDKELLNVTPEDWDFCCKGLALDLEDGNFLKLANNGTVLRASHGTKMMTPEVLAEAYGKKEWKHFLSDTGMACRSGKYYFYDNYFDLPGALLCARVVDYLTKLNNGQKTFDFWKDIVAAIQHNYKMSAFKENCGIYFPEIKRDPGRYLHSCPESVKKWLRQLKNAGKILLLITSSHSDYCRLLCEYILGNDFTDLFDIVITNALKPGFFSHLPSQRPFRTLENDEEQEALPSLDKPGWYSQGNAVHLYELLKKMTGKPEPKVVYFGDSMHSDIFPARHYSNWETVLILEELRGDEGTRSQRPEESEPLEKKGKYEGPKAKPLNTSSKKWGSFFIDSVLGLENTEDSLVYTWSCKRISTYSTIAIPSIEAIAELPLDYKFTRFSSSNSKTAGYYPNPPLVLSSDETLISK

SEQ ID NO: 861721 - protein, 476 aa, Homo sapiens
RPGPVPQRPASQLLAPFAAEALPGAPRAAMAQHFSLAACDVVGFDLDHTLCRYNLPESAPLIYNSFAQFLVKEKGYDKELLNVTPEDWDFCCKGLALDLEDGNFLKLANNGTVLRASHGTKMMTPEVLAEAYGKKEWKHFLSDTGMACRSGKYYFYDNYFDLPGALLCARVVDYLTKLNNGQKTFDFWKDIVAAIQHNYKMSAFKEIKRDPGRYLHSCPESVKKWLRQLKNAGKILLLITSSHSDYCRLLCEYILGNDFTDLFDIVITNALKPGFFSHLPSQRPFRTLENDEEQEALPSLDKPGWYSQGNAVHLYELLKKMTGKPEPKVVYFGDSMHSDIFPARHYSNWETVLILEELRGDEGTRSQRPEESEPLEKKGKYEGPKAKPLNTSSKKWGSFFIDSVLGLENTEDSLVYTWSCKRISTYSTIAIPSIEAIAELPLDYKFTRFSSSNSKTAGYYPNPPLVLSSDETLISK

SEQ ID NO: 861722 - protein, 455 aa, Homo sapiens; identical to SEQ ID NO: 861720

SEQ ID NO: 861723 - protein, 430 aa, Homo sapiens
MAQHFSLAACDVVGFDLDHTLCRYNLPESAPLIYNSFAQFLVKEKGYDKELLNVTPEDWDFCCKGLALDLEDGNFLKLANNGTVLRASHGTKMMTPEVLAEAYGKKEWKHFLSDTGMACRSGKYYFYDNYFDLPGALLCARVVDYLTKLNNGQKTFDFWKDIVAAIQHNYKMSAFKENCGIYFPEIKRDPGRYLHSCPESVKKWLRQLKNAGKILLLITSSHSDYCRLLCEYILGNDFTDLFDIVITNALKPGFFSHLPSQRPFRTLENDEEQEALPSLDKPGWYSQGNAVHLYELLKKMTGKPEPKVVYFGDSMHSDIFPARHYSNWETVLILEELRGDEGTRSQRPEDPDPPESPNEGPNPPPPPWAPPPTHPPPPPNQPPPQTRPPHSIAPSEWRLDGFTRLASGGAAGYYPNPPLVLSSDETLISK

SEQ ID NO: 861724 - protein, 201 aa, Homo sapiens
RPGPVPQRPASQLLAPFAAEALPGAPRAAMAQHFSLAACDVVGFDLDHTLCRYNLPESAPLIYNSFAQFLVKEKGYDKELLNVTPEDWDFCCKGLALDLEDGNFLKLANNGTVLRASHGTKMMTPEVLAEAYGKKEWKHFLSDTGMACRSGKYYFYDNYFDLPGALLCARVVDYLTKLNNGQKTFLWAAVALTRFNPSSSR

SEQ ID NO: 861725 - protein, 345 aa, Homo sapiens
RPGPVPQRPASQLLAPFAAEALPGAPRAAMAQHFSLAACDVVGFDLDHTLCRYNLPESAPLIYNSFAQFLVKEKGYDKELLNVTPEDWDFCCKGLALDLEDGNFLKLANNGTVLRASHGTKMMTPEVLAEAYGKKEWKHFLSDTGMACRSGKYYFYDNYFDLPGALLCARVVDYLTKLNNGQKTFDFWKDIVAAIQHNYKMSAFKENCGIYFPEIKRDPGRYLHSCPESVKKWLRQLKNAGKILLLITSSHSDYCRLLCEYILGNDFTDLFDIVITNALKPGFFSHLPSQRPFRTLENDEEQEALPSLDKPGWYSQGNAVHLYELLKKMTGKPEPKKIFTRISVS

SEQ ID NO: 861726 - protein, 337 aa, Homo sapiens
RPGPVPQRPASQLLAPFAAEALPGAPRAAMAQHFSLAACDVVGFDLDHTLCRYNLPESAPLIYNSFAQFLVKEKGYDKELLNVTPEDWDFCCKGLALDLEDGNFLKLANNGTVLRASHGTKMMTPEVLAEAYGKKEWKHFLSDTGMACRSGKYYFYDNYFDLPGALLCARVVDYLTKLNNGQKTFDFWKDIVAAIQHNYKMSAFKEIKRDPGRYLHSCPESVKKWLRQLKNAGKILLLITSSHSDYCRLLCEYILGNDFTDLFDIVITNALKPGFFSHLPSQRPFRTLENDEEQEALPSLDKPGWYSQGNAVHLYELLKKMTGKPEPKKIFTRISVS

SEQ ID NO: 861727 - protein, 226 aa, Homo sapiens
RPGPVPQRPASQLLAPFAAEALPGAPRAAMAQHFSLAACDVVGFDLDHTLCRYNLPESAPLIYNSFAQFLVKEKGYDKELLNVTPEDWDFCCKGLALDLEDGNFLKLANNGTVLRASHGTKMMTPEVLAEAYGKKEWKHFLSDTGMACRSGKYYFYDNYFDLPGALLCARVVDYLTKLNNGQKTFDFWKDIVAAIQHNYKMSAFKGKYCEEGPSNTCLLSYVCLVN

SEQ ID NO: 861728 - protein, 122 aa, Homo sapiens
MTNKFLRMILSSFYGKMFPHSPQASKRSKFPLPDTTKRMFQTCSMKGKVQICDLNANIRKKFLRMLLSTFYIGIPISNEILKAIQISTCRFYKKIFSKLFYQKKGSTLLVGYTHNKQVSENA

SEQ ID NO: 861729 - protein, 645 aa, Homo sapiens
FHPGSRGCSAEARGWWVSPAIMTQAEKGDTENGKEKGGEKEKEQRGVKRPIVPALVPESLQEQIQSNFIIVIHPGSTTLRIGRATDTLPASIPHVIARRHKQQGQPLYKDSWLLREGLNKPESNEQRQNGLKMVDQAIWSKKMSNGTRRIPVSPEQARSYNKQMRPAILDHCSGNKWTNTSHHPEYLVGEEALYVNPLDCYNIHWPIRRGQLNIHPGPGGSLTAVLADIEVIWSHAIQKYLEIPLKDLKYYRCILLIPDIYNKQHVKELVNMILMKMGFSGIVVHQESVCATYGSGLSSTCIVDVGDQKTSVCCVEDGVSHRNTRLCLAYGGSDVSRCFYWLMQRAGFPYRECQLTNKMDCLLLQHLKETFCHLDQDISGLQDHEFQIRHPDSPALLYQFRLGDEKLQAPMALFYPATFGIVGQKMTTLQHRSQGDPEDPHDEHYLLATQSKQEQSAKATADRKSASKPIGFEGDLRGQSSDLPERLHSQEVDLGSAQGDGLMAGNDSEEALTALMSRKTAISLFEGKALGLDKAILHSIDCCSSDDTKKKMYSSILVVGGGLMFHKAQEFLQHRILNKMPPSFRRIIENVDVITRPKDMDPRLIAWKGGAVLACLDTTQELWIYQREWQRFGVRMLRERAAFVW

SEQ ID NO: 861730 - protein, 645 aa, Homo sapiens; identical to SEQ ID NO: 861729

SEQ ID NO: 861731 - protein, 560 aa, Homo sapiens
FHPGSRGCSAEARGWWVSPAIMTQAEKGDTENGKEKGGEKEKEQRGVKRPIVPALVPESLQEQIQSNFIIVIHPGSTTLRIGRATDTLPASIPHVIARRHKQQGQPLYKDSWLLREGLNKPESNEQRQNGLKMVDQAIWSKKMSNGTRRIPVSPEQARSYNKQMRPAILDHCSGNKWTNTSHHPEYLVGEEALYVNPLDCYNIHWPIRRGQLNIHPGPGGSLTAVLADIEVIWSHAIQKYLEIPLKDLKYYRCILLIPDIYNKQHVKELVNMILMKMGFSGIVVHQESVCATYGSGLSSTCIVDVGDQKTSVCCVEDGVSHRNTRLCLAYGGSDVSRCFYWLMQRAGFPYRECQLTNKMDCLLLQHLKETFCHLDQDISGLQDHEFQIRHPDSPALLYQFRLGDEKLQAPMALFYPATFGIVGQKMTTLQHRSQGDPEDPHDEHYLLATQSKQEQSAKATADRKSASKPIGFEGDLRGQSSDLPERLHSQEVDLGSAQGDGLMAGNDSEEALTALMSRKTAISLFEGKALGLDKAILHSIDCCCKHIWGDREIAVKQDSS

SEQ ID NO: 861732 - protein, 613 aa, Homo sapiens
RSDLPHAPPSGCVRSCPGSGLSFPDHKTTTQIQSNFIIVIHPGSTTLRIGRATDTLPASIPHVIARRHKQQGQPLYKDSWLLREGLNKPESNEQRQNGLKMVDQAIWSKKMSNGTRRIPVSPEQARSYNKQMRPAILDHCSGNKWTNTSHHPEYLVGEEALYVNPLDCYNIHWPIRRGQLNIHPGPGGSLTAVLADIEVIWSHAIQKYLEIPLKDLKYYRCILLIPDIYNKQHVKELVNMILMKMGFSGIVVHQESVCATYGSGLSSTCIVDVGDQKTSVCCVEDGVSHRNTRLCLAYGGSDVSRCFYWLMQRAGFPYRECQLTNKMDCLLLQHLKETFCHLDQDISGLQDHEFQIRHPDSPALLYQFRLGDEKLQAPMALFYPATFGIVGQKMTTLQHRSQGDPEDPHDEHYLLATQSKQEQSAKATADRKSASKPIGFEGDLRGQSSDLPERLHSQEVDLGSAQGDGLMAGNDSEEALTALMSRKTAISLFEGKALGLDKAILHSIDCCSSDDTKKKMYSSILVVGGGLMFHKAQEFLQHRILNKMPPSFRRIIENVDVITRPKDMDPRLIAWKGGAVLACLDTTQELWIYQREWQRFGVRMLRERAAFVW

SEQ ID NO: 861733 - protein, 606 aa, Homo sapiens
FHPGSRGCSAEARGWWVSPAIMTQAEKGDTENGKEKGGEKEKEQRGVKRPIVPALVPESLQEQIQSNFIIVIHPGSTTLRIGRATDTLPASIPHVIARRHKQQGQPLYKDSWLLREGLNKPESNEQRQNGLKMVDQAIWSKKMSNGTRRIPVSPEQARSYNKQMRPAILDHCSGNKWTNTSHHPEYLVGEEALYVNPLDCYNIHWPIRRGQLNIHPGPGGSLTAVLADIEVIWSHAIQKYLEIPLKDLKYYRCILLIPDIYNKQHVKELVNMILMKMGFSGIVVHQESVCATYGSGLSSTCIVDVGDQKTSVCCVEDGVSHRNTRLCLAYGGSDVSRCFYWLMQRAGFPYRECQLTNKMDCLLLQHLKETFCHLDQDISGLQDHEFQIRHPDSPALLYQFRLGDEKLQAPMALFYPATFGIVGQKMTTLQHRSQGDPEDPHDEHYLLATQSKQEQSAKATADRKSASKPIGFEGDLRGQSSDLPERLHSQEVDLGSAQGDGLMAGNDSEEALTALMSRKTAISLFEGKALGLDKAILHSIDCCSSDDTKKKMYSSILVVGGGLMFHKAQEFLQHRILNKMPPSFRRIIENVDVITRPKAEMPSSLL

SEQ ID NO: 861734 - protein, 179 aa, Homo sapiens
DAPESNGKGRSQHRAERATMGKIALQLKATLENITNLRPVGEDFRWYLKMKCGNCGEISDKWQYIRLMDSVALKGGRGSASMVQKCKLCARENSIEILSSTIKPYNAEDNENFKTIVEFECRGLEPVDFQPQAGFAAEGVESGTAFSDINLQEKDWTDYDEKAQESVGIYEVTHQFVKC

SEQ ID NO: 861735 - protein, 119 aa, Homo sapiens
MKCGNCGEISDKWQYIRLMDSVALKGGRGSASMVQKCKLCARENSIEILSSTIKPYNAEDNENFKTIVEFECRGLEPVDFQPQAGFAAEGVESGTAFSDINLQEKHARGPWGTLETFNL

SEQ ID NO: 861736 - protein, 179 aa, Homo sapiens; identical to SEQ ID NO: 861734

SEQ ID NO: 861737 - protein, 179 aa, Homo sapiens; identical to SEQ ID NO: 861734

SEQ ID NO: 861738 - protein, 130 aa, Homo sapiens
MKCGNCGEISDKWQYIRLMDSVALKGGRGSASMVQKCKLCARENSIEILSSTIKPYNAEDNENFKTIVEFECRGLEPVDFQPQAGFAAEGVESGTAFSDINLQEKDWTDYDEKAQESVGIYEVTHQFVKC

SEQ ID NO: 861739 - protein, 179 aa, Homo sapiens; identical to SEQ ID NO: 861734

SEQ ID NO: 861740 - protein, 132 aa, Homo sapiens
DAPESNGKGRSQHRAERATMGDSVALKGGRGSASMVQKCKLCARENSIEILSSTIKPYNAEDNENFKTIVEFECRGLEPVDFQPQAGFAAEGVESGTAFSDINLQEKDWTDYDEKAQESVGIYEVTHQFVKC

SEQ ID NO: 861741 - protein, 179 aa, Homo sapiens; identical to SEQ ID NO: 861734

SEQ ID NO: 861742 - protein, 179 aa, Homo sapiens; identical to SEQ ID NO: 861734

SEQ ID NO: 861743 - protein, 179 aa, Homo sapiens; identical to SEQ ID NO: 861734

SEQ ID NO: 861744 - protein, 90 aa, Homo sapiens
RRAGKQRQGPQPAPGGEGYHGENRAATQSHAGEHHQPPARGRGLPVVPEGAAGAGPGERRPVLISVLNRSLLSGSMRKYLTRHIKCSGFS

SEQ ID NO: 861745 - protein, 160 aa, Homo sapiens
DAPESNGKGRSQHRAERATMGKIALQLKATLENITNLRPVGEDFRWYLKDSVALKGGRGSASMVQKCKLCARENSIEILSSTIKPYNAEDNENFKTIVEFECRGLEPVDFQPQAGFAAEGVESGTAFSDINLQEKDWTDYDEKAQESVGIYEVTHQFVKC

SEQ ID NO: 861746 - protein, 91 aa, Homo sapiens
SRGSSINRLMRAPSSLTSAEDNENFKTIVEFECRGLEPVDFQPQAGFAAEGVESGTAFSDINLQEKDWTDYDEKAQESVGIYEVTHQFVKC

SEQ ID NO: 861747 - protein, 173 aa, Homo sapiens
MEPGAGHLDGHRAGSPSLRQALCDGSAVMFSSKERGRCTVINFVPLEAPLRSTPRSRQVTEACGGEGRAVPLGSEPEWSVGGMEATLEQHLEDTMKNPSIVGVLCTDSQGLNLGCRGTLSDEHAGVISVLAQQAAKLTSDPTDIPVVCLESDNGNIMIQKHDGITVAVHKMAS

SEQ ID NO: 861748 - protein, 173 aa, Homo sapiens; identical to SEQ ID NO: 861747

SEQ ID NO: 861749 - protein, 173 aa, Homo sapiens; identical to SEQ ID NO: 861747

SEQ ID NO: 861750 - protein, 104 aa, Homo sapiens
MEPGAGHLDGHRAGSPSLRQALCDGSAVMFSSKERGRCTVINFVPLEAPLRSTPRSRQVTEACGGEGRAVPLGSEPEWSVGGMEATLEQHLEDTIYVKFKTGKV

SEQ ID NO: 861751 - protein, 173 aa, Homo sapiens; identical to SEQ ID NO: 861747

SEQ ID NO: 861752 - protein, 173 aa, Homo sapiens; identical to SEQ ID NO: 861747

SEQ ID NO: 861753 - protein, 173 aa, Homo sapiens; identical to SEQ ID NO: 861747

SEQ ID NO: 861754 - protein, 173 aa, Homo sapiens; identical to SEQ ID NO: 861747

SEQ ID NO: 861755 - protein, 294 aa, Homo sapiens
MFLRRLGGWLPRPWGRRKPMRPDPPYPEPRRVDSSSENSGSDWDSAPETMEDVGHPKTKDSGALRVSRAASEPSKEEPQVEQLGSKRMDSLKWDQPISSTQESGRLEAGGASPKLRWDHVDSGGTRRPGVSPEGGLSVPGPGAPLEKPGRREKLLGWLRGEPGAPSRYLGGPEECLQISTNLTLHLLELLASALLALCSRPLRAALDTLGLRGPLGLWLHGLLSFLAALHGLHAVLSLLTAHPLHFACLFGLLQALVLAVSLREPNGDEAATDWESEGLEREGEEQRGDPGKGL

SEQ ID NO: 861756 - protein, 294 aa, Homo sapiens; identical to SEQ ID NO: 861755

SEQ ID NO: 861757 - protein, 294 aa, Homo sapiens; identical to SEQ ID NO: 861755

SEQ ID NO: 861758 - protein, 294 aa, Homo sapiens; identical to SEQ ID NO: 861755

SEQ ID NO: 861759 - protein, 294 aa, Homo sapiens; identical to SEQ ID NO: 861755

SEQ ID NO: 861760 - protein, 280 aa, Homo sapiens
FIYSLFEQLRIILLYNVGFPSLPDHVEAALKMLRREARLRREYLYRKAREEAQRSAQERKERLRRALEENRLIPTELRREALALQGSLEFDDAGGEGVTSHVDDEYRWAGVEDPKVMITTSRDPSSRLKMFAKELKLVFPGAQRMNRGRHEVGALVRACKANGVTDLLVVHEHRGTPVGLIVSHLPFGPTAYFTLCNVVMRHDIPDLGTMSEAKPHLITHGFSSRLGKRVSDILRYLFPVPKDDSHRVITFANQDDYISFRTMCIRRQTIATRSLQHGLS

SEQ ID NO: 861761 - protein, 291 aa, Homo sapiens
MLRREARLRREYLYRKAREEAQRSAQERKERLRRALEENRLIPTELRREALALQGSLEFDDAGGEGVTSHVDDEYRWAGVEDPKVMITTSRDPSSRLKMFAKELKLVFPGAQRMNRGRHEVGALVRACKANGVTDLLVVHEHRGTPVGLIVSHLPFGPTAYFTLCNVVMRHDIPDLGTMSEAKPHLITHGFSSRLGKRVSDILRYLFPVPKDDSHRVITFANQDDYISFRHHVYKKTDHRNVELTEVGPRFELKLYMIRLGTLEQEATADVEWRWHPYTNTARKRVFLSTE

SEQ ID NO: 861762 - protein, 291 aa, Homo sapiens; identical to SEQ ID NO: 861761

SEQ ID NO: 861763 - protein, 291 aa, Homo sapiens; identical to SEQ ID NO: 861761

SEQ ID NO: 861764 - protein, 206 aa, Homo sapiens
MITTSRDPSSRLKMFAKELKLVFPGAQRMNRGRHEVGALVRACKANGVTDLLVVHEHRGTPVGLIVSHLPFGPTAYFTLCNVVMRHDIPDLGTMSEAKPHLITHGFSSRLGKRVSDILRYLFPVPKDDSHRVITFANQDDYISFRHHVYKKTDHRNVELTEVGPRFELKLYMIRLGTLEQEATADVEWRWHPYTNTARKRVFLSTE

SEQ ID NO: 861765 - protein, 285 aa, Homo sapiens
MLRREARLRREYLYRKAREEAQRSAQERKERLRRALEENRLIPTELRREALALQGSLEFDDAGGEGVTSHVDDEYRWAGVEDPKVMITTSRDPSSRLKMFAKELKLVFPGAQRMNRGRHEVGALVRACKANGVTDLLVVHEHRGTPVGLIVSHLPFGPTAYFTLCNVVMRHDIPDLGTMSEAKPHLITHGFSSRLGKRVSDILRYLFPVPKDDSHRVITFANQDDYISFRHHVYKKTDHRNVELTEVGPRFELKLYMIRLGTLEQEATADVEWRWHPYTNTARNS

SEQ ID NO: 861766 - protein, 322 aa, Homo sapiens
FIYSLFEQLRIILLYNVGFPSLPDHVEAALKMLRREARLRREYLYRKAREEAQRSAQERKERLRRALEENRLIPTELRREALALQGSLEFDDAGGEGVTSHVDDEYRWAGVEDPKVMITTSRDPSSRLKMFAKELKLVFPGAQRMNRGRHEVGALVRACKANGVTDLLVVHEHRGTPVGLIVSHLPFGPTAYFTLCNVVMRHDIPDLGTMSEAKPHLITHGFSSRLGKRVSDILRYLFPVPKDDSHRVITFANQDDYISFRHHVYKKTDHRNVELTEVGPRFELKLYMIRLGTLEQEATADVEWRWHPYTNTARKRVFLSTE

SEQ ID NO: 861767 - protein, 281 aa, Homo sapiens
NRSRYELGLEAQRSAQERKERLRRALEENRLIPTELRREALALQGSLEFDDAGGEGVTSHVDDEYRWAGVEDPKVMITTSRDPSSRLKMFAKELKLVFPGAQRMNRGRHEVGALVRACKANGVTDLLVVHEHRGTPVGLIVSHLPFGPTAYFTLCNVVMRHDIPDLGTMSEAKPHLITHGFSSRLGKRVSDILRYLFPVPKDDSHRVITFANQDDYISFRHHVYKKTDHRNVELTEVGPRFELKLYMIRLGTLEQEATADVEWRWHPYTNTARKRVFLSTE

SEQ ID NO: 861768 - protein, 263 aa, Homo sapiens
MRAVRRALEENRLIPTELRREALALQGSLEFDDAGGEGVTSHVDDEYRWAGVEDPKVMITTSRDPSSRLKMFAKELKLVFPGAQRMNRGRHEVGALVRACKANGVTDLLVVHEHRGTPVGLIVSHLPFGPTAYFTLCNVVMRHDIPDLGTMSEAKPHLITHGFSSRLGKRVSDILRYLFPVPKDDSHRVITFANQDDYISFRHHVYKKTDHRNVELTEVGPRFELKLYMIRLGTLEQEATADVEWRWHPYTNTARKRVFLSTE

SEQ ID NO: 861769 - protein, 178 aa, Homo sapiens
MNRGRHEVGALVRACKANGVTDLLVVHEHRGTPVGLIVSHLPFGPTAYFTLCNVVMRHDIPDLGTMSEAKPHLITHGFSSRLGKRVSDILRYLFPVPKDDSHRVITFANQDDYISFRHHVYKKTDHRNVELTEVGPRFELKLYMIRLGTLEQEATADVEWRWHPYTNTARKRVFLSTE

SEQ ID NO: 861770 - protein, 117 aa, Homo sapiens
AFRLGLRARPGICHSVSLSFLVPQVSDILRYLFPVPKDDSHRVITFANQDDYISFRHHVYKKTDHRNVELTEVGPRFELKLYMIRLGTLEQEATADVEWRWHPYTNTARKRVFLSTE

SEQ ID NO: 861771 - protein, 249 aa, Homo sapiens
MLRREARLRREYLYRKAREEAQRSAQERKERLRRALEENRLIPTELRREALALQGSLEFDDAGGEGVTSHVDDEYRWAGVEDPKVMITTSRDPSSRLKMFAKELKLVFPGAQRMNRGRHEVGALVRACKANGVTDLLVVHEHRGTPVGLIVSHLPFGPTAYFTLCNVVMRHDIPDLGTMSEAKPHLITHGFSSRLGKRVSDILRYLFPVPKDDSHRVITFANQDDYISFRTMCIRRQTIATRSLQHGLS

SEQ ID NO: 861772 - protein, 92 aa, Homo sapiens
MNRGRHEVGALVRACKANGVTDLLVVHEHRGTPVGLIVSHLPFGPTAYFTLCNVVMRHDIPDLGTMSEAKPPHNLGFLRLGSGSDIPDTFRA

SEQ ID NO: 861773 - protein, 291 aa, Homo sapiens; identical to SEQ ID NO: 861761

SEQ ID NO: 861774 - protein, 291 aa, Homo sapiens; identical to SEQ ID NO: 861761

SEQ ID NO: 861775 - protein, 291 aa, Homo sapiens; identical to SEQ ID NO: 861761

SEQ ID NO: 861776 - protein, 291 aa, Homo sapiens; identical to SEQ ID NO: 861761

SEQ ID NO: 861777 - protein, 297 aa, Homo sapiens
MGLLFPQLRREARLRREYLYRKAREEAQRSAQERKERLRRALEENRLIPTELRREALALQGSLEFDDAGGEGVTSHVDDEYRWAGVEDPKVMITTSRDPSSRLKMFAKELKLVFPGAQRMNRGRHEVGALVRACKANGVTDLLVVHEHRGTPVGLIVSHLPFGPTAYFTLCNVVMRHDIPDLGTMSEAKPHLITHGFSSRLGKRVSDILRYLFPVPKDDSHRVITFANQDDYISFRHHVYKKTDHRNVELTEVGPRFELKLYMIRLGTLEQEATADVEWRWHPYTNTARKRVFLSTE

SEQ ID NO: 861778 - protein, 321 aa, Homo sapiens
MLRREARLRREYLYRKAREEAQRSAQERKERLRRALEENRLIPTELRREALALQGSLEFDDAGGEGVTSHVDDEYRWAGVEDPKVMITTSRDPSSRLKMFAKELKLVFPGAQRMNRGRHEVGALVRACKANGVTDLLVVHEHRGTPVGLIVSHLPFGPTAYFTLCNVVMRHDIPDLGTMSEAKPHLITHGFSSRLGKRVSDILRYLFPVPKDDSHRVITFANQDDYISFRWVHGPCPRKGIPTLCTSCCLPLTHSCSLQAHHVYKKTDHRNVELTEVGPRFELKLYMIRLGTLEQEATADVEWRWHPYTNTARKRVFLSTE

SEQ ID NO: 861779 - protein, 279 aa, Homo sapiens
SKCLPAVFLAHWVLLLVLRVFLPCDENRLIPTELRREALALQGSLEFDDAGGEGVTSHVDDEYRWAGVEDPKVMITTSRDPSSRLKMFAKELKLVFPGAQRMNRGRHEVGALVRACKANGVTDLLVVHEHRGTPVGLIVSHLPFGPTAYFTLCNVVMRHDIPDLGTMSEAKPHLITHGFSSRLGKRVSDILRYLFPVPKDDSHRVITFANQDDYISFRHHVYKKTDHRNVELTEVGPRFELKLYMIRLGTLEQEATADVEWRWHPYTNTARKRVFLSTE

SEQ ID NO: 861780 - protein, 327 aa, Homo sapiens
MGLLFPQLRREARLRREYLYRKAREEAQRSAQERKERLRRALEENRLIPTELRREALALQGSLEFDDAGGEGVTSHVDDEYRWAGVEDPKVMITTSRDPSSRLKMFAKELKLVFPGAQRMNRGRHEVGALVRACKANGVTDLLVVHEHRGTPVGLIVSHLPFGPTAYFTLCNVVMRHDIPDLGTMSEAKPHLITHGFSSRLGKRVSDILRYLFPVPKDDSHRVITFANQDDYISFRWVHGPCPRKGIPTLCTSCCLPLTHSCSLQAHHVYKKTDHRNVELTEVGPRFELKLYMIRLGTLEQEATADVEWRWHPYTNTARKRVFLSTE

SEQ ID NO: 861781 - protein, 345 aa, Homo sapiens
MLRREARLRREYLYRKAREEAQRSAQERKERLRRALEENRLIPTELRREALALQGSLEFDDAGGEGVTSHVDDEYRWAGVEDPKVMITTSRDPSSRLKMFAKELKLVFPGAQRMNRGRHEVGALVRACKANGVTDLLVVHEHRGTPVGLIVSHLPFGPTAYFTLCNVVMRHDIPDLGTMSEAKPHLITHGFSSRLGKRVSDILRYLFPVPKDDSHRVITFANQDDYISFRWVHGPAPGKHPPPVYLVLLAVDPQLFPPRRTMCIRRQTTATWSSLSVHDPSGHAGAGGHSRRGVALAPLHQYRTQESLPEHRVSTLTTQSGHGLGTQDGAVIDRPTSRNCHRMAC

SEQ ID NO: 861782 - protein, 226 aa, Homo sapiens
MLRREARLRREYLYRKAREEAQRSAQERKERLRRALEENRLIPTELRREALALQGSLEFDDAGGEGVTSHVDDEYRWAGVEDPKVMITTSRDPSSRLKMFAKELKLVFPGAQRMNRGRHEVGALVRACKANGVTDLLVVHEHRGTPVGLIVSHLPFGPTAYFTLCNVVMRHDIPDLGTMSEAKPHLITHGFSSRLGKRVSDILRYLFPVPKDDSHRVITRVFLSTE

SEQ ID NO: 861783 - protein, 381 aa, Homo sapiens
MGDRERNKKRLLELLRAPDTGNAHCADCGAADPDWASYKLGIFICLNCCGVHRNFPDISRVKSVRLDFWDDSIVEFMIHNGNLRVKAKFEARVPAFYYIPQANDCLVLKEQWIRAKYERREFMADGETISLPGNREGFLWKRGRDNSQFLRRKFVLLAREGLLKYFTKEQGKSPKAVISIKDLNATFQTEKIGHPHGLQITYRRDGHTRNLFVYHESGKEIVDWFNALRAARLQYLKMAFPELPESELVPFLTRNYLKQGFMEKTGPKQKEPFKKRWFALDCHERRLLYYKNPLDAFEQGQVFLGNKEQGYEAYEDLPKGIRGNRWKAGLTIVTPERRFVLTCPSEKEQQEWLESLRGVLSSPLTPLNRLTASTESGRSSR

SEQ ID NO: 861784 - protein, 102 aa, Homo sapiens
STGQHWHGHLPQPSSFPLQLHQQRVAAAAGDPLTEELAATEHLELLVGRSLHLGPGCPPSVPRSQQPFLAVNSARTEAVALSISSLGLPRNPPRGSEDLVHR

SEQ ID NO: 861785 - protein, 33 aa, Homo sapiens
MLHVESNVVFAKHRLCLFLWADLPACSTGRRFL

SEQ ID NO: 861786 - protein, 47 aa, Homo sapiens
MDRCKHVGRLRLAQDHSILNPQKWCCLECATTESVWACLKCSHVACG

SEQ ID NO: 861787 - protein, 212 aa, Homo sapiens
MGVTCVSQMPVAEGKSVQQTVELLTRKLEMLGAEKQGTFCVDCETYHTAASTLGSQGQTGKLMYVMHNSEYPLSCFALFENGPCLIADTNFDVLMVKLKGFFQSAKASKIETRGTRYQYCDFLVKVGTVTMGPSARGISVEVEYGPCVVASDCWSLLLEFLQSFLGSHTPGAPAVFGNRHDAVYGPADTMVQYMELFNKIRKQQQVPVAGIR

SEQ ID NO: 861788 - protein, 116 aa, Homo sapiens
MMRSTAQQIPWSSTWNSSTRSASSSRCRWLGFVSDEQLPAELCHQGYSTGGAGADFQVPGPQKPRVDMDSTLLLWFSAVAFVLGLSPLPNPLTLTHSPPSAVLLRALLDLACPQEW

SEQ ID NO: 861789 - protein, 212 aa, Homo sapiens; identical to SEQ ID NO: 861787

SEQ ID NO: 861790 - protein, 212 aa, Homo sapiens; identical to SEQ ID NO: 861787

SEQ ID NO: 861791 - protein, 212 aa, Homo sapiens; identical to SEQ ID NO: 861787

SEQ ID NO: 861792 - protein, 190 aa, Homo sapiens
SNHPTPPHNYVLVEPVIQSEGETYHVAAVYPWQQGQTGKLMYVMHNSEYPLSCFALFENGPCLIADTNFDVLMVKLKGFFQSAKASKIETRGTRYQYCDFLVKVGTVTMGPSARGISVEVEYGPCVVASDCWSLLLEFLQSFLGSHTPGAPAVFGNRHDAVYGPADTMVQYMELFNKIRKQQQVPVAGIR

SEQ ID NO: 861793 - protein, 212 aa, Homo sapiens; identical to SEQ ID NO: 861787

SEQ ID NO: 861794 - protein, 47 aa, Homo sapiens; identical to SEQ ID NO: 861786

SEQ ID NO: 861795 - protein, 52 aa, Homo sapiens
MSLPGTGGGNSPYPQLLRICPRPMVNMLHFMFGLCCNKSLFLPSEDVAGLLS

SEQ ID NO: 861796 - protein, 68 aa, Homo sapiens
FVDKVLTISQYRSPTTDQTPVQAATSWPGLAASFSGFQGPGTGGLGHQEALLGCPCSHSHPTGPLPPI

SEQ ID NO: 861797 - protein, 68 aa, Homo sapiens; identical to SEQ ID NO: 861796

SEQ ID NO: 861798 - protein, 115 aa, Homo sapiens
AVPSSCLLTLAELTTRFQTSAGAAASYWLSGSKTQKEAGWQADLSQLPAPSPLRLAWDRWGSSLQEGFPGLLFSPTSLWRTVHPSRYAPVMSEGMPQSGETQRQQNLLRDKRTCC

SEQ ID NO: 861799 - protein, 115 aa, Homo sapiens; identical to SEQ ID NO: 861798

SEQ ID NO: 861800 - protein, 68 aa, Homo sapiens; identical to SEQ ID NO: 861796

SEQ ID NO: 861801 - protein, 68 aa, Homo sapiens; identical to SEQ ID NO: 861796

SEQ ID NO: 861802 - protein, 105 aa, Homo sapiens
MSHPIQNINKEIEIVEKNQIEILELKSIITKTENSLEVFSSRLEKSEERINRLQDRSIKIIQSEEQKGKRMKKNEQSIKDLWDSIKHTSICMRGVPEGEEREKGT

SEQ ID NO: 861803 - protein, 105 aa, Homo sapiens; identical to SEQ ID NO: 861802

SEQ ID NO: 861804 - protein, 313 aa, Homo sapiens
MPKVKSGAIGRRRGRQEQRRELKSAGGLMFNTGIGQHILKNPLIINSIIDKAALRPTDVVLEVGPGTGNMTVKLLEKAKKVVACELDPRLVAELHKRVQGTPVASKLQVLVGDVLKTDLPFFDTCVANLPYQISSPFVFKLLLHRPFFRCAILMFQREFALRLVAKPGDKLYCRLSINTQLLARVDHLMKVGKNNFRPPPKVESSVVRIEPKNPPPPINFQEWDGLVRITFVRKNKTLSAAFKSSAVQQLLEKNYRIHCSVHNIIIPEDFSIADKIQQILTSTGFSDKRARSMDIDDFIRLLHGFNAEGIHFS

SEQ ID NO: 861805 - protein, 275 aa, Homo sapiens
MPKVKSGAIGRRRGRQEQRRELKSAGGLMFNTGIGQHILKNPLIINSIIDKAALRPTDVVLEVGPGTGNMTVKLLEKAKKVVACELDPRLVAELHKRVQGTPVASKLQVLVGDVLKTDLPFFDTCVANLPYQISSPFVFKLLLHRPFFRCAILMFQREFALRLVAKPGDKLYCRLSINTQLLARVDHLMKVGKNNFRPPPKVESSVVRIEPKNPPPPINFQEWDGLVRITFVRKNKTLSAAFKSSAVQQLLEKNYRIHCSVHNIVSAAVYPVKQI

SEQ ID NO: 861806 - protein, 284 aa, Homo sapiens
MPKVKSGAIGRRRGRQEQRRELKSAGGLMFNTGIGQHILKNPLIINSIIDKVVACELDPRLVAELHKRVQGTPVASKLQVLVGDVLKTDLPFFDTCVANLPYQISSPFVFKLLLHRPFFRCAILMFQREFALRLVAKPGDKLYCRLSINTQLLARVDHLMKVGKNNFRPPPKVESSVVRIEPKNPPPPINFQEWDGLVRITFVRKNKTLSAAFKSSAVQQLLEKNYRIHCSVHNIIIPEDFSIADKIQQILTSTGFSDKRARSMDIDDFIRLLHGFNAEGIHFS

SEQ ID NO: 861807 - protein, 154 aa, Homo sapiens
MPKVKSGAIGRRRGRQEQRRELKSAGGLMFNTGIGQHILKNPLIINSIIDKAALRPTDVVLEVGPGTGNMTVKLLEKAKKVVACELDPRLVAELHKRVQGTPVASKLQVLVGDVLKTDLPFFDTCVANLPYQISSPFVFKLLLHRPFFRFVTKD

SEQ ID NO: 861808 - protein, 313 aa, Homo sapiens; identical to SEQ ID NO: 861804

SEQ ID NO: 861809 - protein, 313 aa, Homo sapiens; identical to SEQ ID NO: 861804

SEQ ID NO: 861810 - protein, 102 aa, Homo sapiens
MPKVKSGAIGRRRGRQEQRRELKSAGGLMFNTGIGQHILKNPLIINSIIDKAALRPTDVVLEVGPGTGNMTVKLLEKAKKEKGDLMFGITNDYVSKLSWFTI

SEQ ID NO: 861811 - protein, 313 aa, Homo sapiens; identical to SEQ ID NO: 861804

SEQ ID NO: 861812 - protein, 313 aa, Homo sapiens; identical to SEQ ID NO: 861804

SEQ ID NO: 861813 - protein, 181 aa, Homo sapiens
MPKVKSGAIGRRRGRQEQRRELKSAGGLMFNTGIGQHILKNPLIINSIIDKAALRPTDVVLEVGPGTGNMTVKLLEKAKKVVACELDPRLVAELHKRVQGTPVASKLQVLVGDVLKTDLPFFDTCVANLPYQISSPFVFKLLLHRPFFRCAILMFQREFALRLVAKPGDKLYCRLSISGKE

SEQ ID NO: 861814 - protein, 102 aa, Homo sapiens; identical to SEQ ID NO: 861810

SEQ ID NO: 861815 - protein, 269 aa, Homo sapiens [sequence omitted]

SEQ ID NO: 861816 - protein, 273 aa, Homo sapiens
MEANMPKRKEPGRSLRIKVISMGNAEVGKSCIIKRYCEKRFVSKYLATIGIDYGVTKVHVRDREIKVNIFDMAGHPFFYEVRNEFYKDTQGVILVYDVGQKDSFDALDAWLAEMKQELGPHGNMENIIFVVCANKIDCTKHRCVDESEGRLWAESKGFLYFETSAQTGEGINEMFQTFYISIVDLCENGGKRPTTNSSASFTKEQADAIRRIRNSKDSWDMLGVKPGASRDEVNKAYRKLAVLLHPDKCVAPGSEDAFKAVVNARTALLKNIK

SEQ ID NO: 861817 - protein, 93 aa, Homo sapiens
KLMHAAAGMEANMPKRKEPGRSLRIKVISMGNAEVGKSCIIKRYCEKRFVSKYLATIGIDYGVTKVHVRDREIKVNIFDMAGHPFFYEVRKPF

SEQ ID NO: 861818 - protein, 72 aa, Homo sapiens
LSFYLKVRNEFYKDTQGVILVYDVGQKDSFDALDAWLAEMKQELGPHGNMENIIFVVCANKVTPLEMVCSDF

SEQ ID NO: 861819 - protein, 132 aa, Homo sapiens
MASSGGEAVTRAAAPPWTRRPEGRASGAQEETEAGGPERARAMEANMPKRKEPGRSLRIKVISMGNAEVGKSCIIKRYCEKRFVSKYLATIGIDYGVTKVHVRDREIKVNIFDMAGHPFFYEMRKLRRREVK

SEQ ID NO: 861820 - protein, 922 aa, Homo sapiens
MFRKARRVNVRKRNDSEEEERERDEEQEPPPLLPPPGTGEEAGPGGGDRAPGGESLLGPGPSPPSALTPGLGAEAGGGFPGGAEPGNGLKPRKRPRENKEVPRASLLSFQDEEEENEEVFKVKKSSYSKKIVKLLKKEYKEDLEKSKIKTELNSSAESEQPLDKTGHVKDTNQEDGVIISEHGEDEMDMESEKEEEKPKTGGAFSNALSSLNVLRPGEIPDAAFIHAARKKRQMARELGDFTPHDNEPGKGRLVREDENDASDDEDDDEKRRIVFSVKEKSQRQKIAEEIGIEGSDDDALVTGEQDEELSRWEQEQIRKGINIPQVQASQPAEVNMYYQNTYQTMPYGSSYGIPYSYTAYGSSDAKSQKTDNTVPFKTPSNEMTPVTIDLVKKQLKDRLDSMKELHKTNRQQHEKHLQSRVDSTRAIERLEGSSGGIGERYKFLQEMRGYVQDLLECFSEKVPLINELESAIHQLYKQRASRLVQRRQDDIKDESSEFSSHSSQSSEDKALMAPNLDSFGRDRALYQEHAKRRIAEREARRTRRRQAREQTGKMADHLEGLSSDDEETSTDITNFNLEKDRISKESGKVFEDVLESFYSIDCIKSQFEAWRSKYYTSYKDAYIGLCLPKLFNPLIRLQLLTWTPLEAKCRDFENMLWFESLLFYGCEEREQEKDDVDVALLPTIVEKVILPKLTVIAENMWDPFSTTQTSRMVGITLKLINGYPSVVNAENKNTQVYLKALLLRMRRTLDDDVFMPLYPKNVLENKNSGPYLFFQRQFWSSVKLLGNFLQWYGIFSNKTLQELSIDGLLNRYILMAFQNSEYGDDSIKKAQNVINCFPKQWFMNLKGERTISQLENFCRYLVHLADTIYRNSIGCSDVEKRNARENIKQIVKLLASVRALDHAMSVASDHNVKEFKSLIEGK

SEQ ID NO: 861821 - protein, 529 aa, Homo sapiens
GVMAGSYPEGAPAVLADKRQQFGSRFLRDPARVFHHNAWDNVEWSEEQAAAAERKVQENSIQRVCQENKVPLINELESAIHQLYKQRASRLVQRRQDDIKDESSEFSSLKQSSEDKALMAPNLDSFGRDRALYQEHAKRRIAEREARRTRRRQAREQTGKMADHLEGLSSDDEETSTDITNFNLEKDRISKESGKVFEDVLESFYSIDCIKSQFEAWRSKYYTSYKDAYIGLCLPKLFNPLIRLQLLTWTPLEAKCRDFENMLWFESLLFYGCEEREQEKDDVDVALLPTIVEKVILPKLTVIAENMWDPFSTTQTSRMVGITLKLINGYPSVVNAENKNTQVYLKALLLRMRRTLDDDVFMPLYPKNVLENKNSGPYLFFQRQFWSSVKLLGNFLQWYGIFSNKTLQELSIDGLLNRYILMAFQNSEYGDDSIKKAQNVINCFPKQWFMNLKGERTISQLENFCRYLVHLADTIYRNSIGCSDVEKRNARENIKQIVKLLASVRALDHAMSVASDHNVKEFKSLIEGK

SEQ ID NO: 861822 - protein, 426 aa, Homo sapiens
MAFNFNCCCFADKALMAPNLDSFGRDRALYQEHAKRRIAEREARRTRRRQAREQTGKMADHLEGLSSDDEETSTDITNFNLEKDRISKESGKVFEDVLESFYSIDCIKSQFEAWRSKYYTSYKDAYIGLCLPKLFNPLIRLQLLTWTPLEAKCRDFENMLWFESLLFYGCEEREQEKDDVDVALLPTIVEKVILPKLTVIAENMWDPFSTTQTSRMVGITLKLINGYPSVVNAENKNTQVYLKALLLRMRRTLDDDVFMPLYPKNVLENKNSGPYLFFQRQFWSSVKLLGNFLQWYGIFSNKTLQELSIDGLLNRYILMAFQNSEYGDDSIKKAQNVINCFPKQWFMNLKGERTISQLENFCRYLVHLADTIYRNSIGCSDVEKRNARENIKQIVKLLASVRALDHAMSVASDHNVKEFKSLIEGK

SEQ ID NO: 861823 - protein, 820 aa, Homo sapiens
MFRKARRVNVRKRNDSEEEERERDEEQEPPPLLPPPGTGEEAGPGGGDRAPGGESLLGPGPSPPSALTPGLGAEAGGGFPGGAEPGNGLKPRKRPRENKEVPRASLLSFQDEEEENEEVFKVKKSSYSKKIVKLLKKEYKEDLEKSKIKTELNSSAESEQPLDKTGHVKDTNQEDGVIISEHGEDEMDMESEKEEEKPKTGGAFSNALSSLNVLRPGEIPDAAFIHAARKKRQMARELGDFTPHDNEPGKGRLVREDENDASDDEDDDEKRRIVFSVKEKSQRQKIAEEIGIEGSDDDALVTGEQDEELSRWEQEQIRKGINIPQVQASQPAEVNMYYQNTYQTMPYGSSYGIPYSYTAYGSSDAKSQKTDNTVPFKTPSNEMTPVTIDLVKKQLKDRLDSMKELHKTNRQQHEKHLQSRVDSTRAIERLEGSSGGIGERYKFLQEMRGYVQDLLECFSEKVPLINELESAIHQLYKQRASRLVQRRQDDIKDESSEFSSHSSQSSEDKALMAPNLDSFGRDRALYQEHAKRRIAEREARRTRRRQAREQTGKMADHLEGLSSDDEETSTDITNFNLEKDRISKESGKVFEDVLESFYSIDCIKSQFEAWRSKYYTSYKDAYIGLCLPKLFNPLIRLQLLTWTPLEAKCRDFENMLWFESLLFYGCEEREQEKDDVDVALLPTIVEKVILPKLTVIAENMWDPFSTTQTSRMVGITLKLINGYPSVVNAENKNTQVYLKALLLRMRRTLDDDVFMPLYPKNVLENKNSGPYLFFQRQFWSSVKVIKPPFQRGSCPIPRRKECCSERPRRIWTDRPCVVFS

SEQ ID NO: 861824 - protein, 922 aa, Homo sapiens; identical to SEQ ID NO: 861820

SEQ ID NO: 861825 - protein, 883 aa, Homo sapiens
MFRKARRVNVRKRNDSEEEERERDEEQEPPPLLPPPGTGEEAGPGGGDRAPGGESLLGPGPSPPSALTPGLGAEAGGGFPGGAEPGNGLKPRKRPRENKEVPRASLLSFQDEEEENEEVFKVKKSSYSKKIVKLLKKEYKEDLEKSKIKTELNSSAESEQPLDKTGHVKDTNQEDGVIISEHGEDEMDMESEKEEEKPKTGGAFSNALSSLNVLRPGEIPDAAFIHAARKKRQMARELGDFTPHDNEPGKGRLVREDENDASDDEDDDEKRRIVFSVKEKSQRQKIAEEIGIEGSDDDALVTGEQDEELSRWEQEQIRKGINIPQVQASQPAEVNMYYQNTYQTMPYGSSYGIPYSYTAYGSSDAKSQKTDNTVPFKTPSNEMTPVTIDLVKKQLKDRLDSMKELHKTNRQQHEKHLQSRVDSTRAIERLEGSSGGIGERYKFLQEMRGYVQDLLECFSEKVPLINELESAIHQLYKQRASRLVQRRQDDIKDESSEFSSHSSQSSEDKALMAPNLDSFGRDRALYQEHAKRRIAEREARRSNFKRIRQSFEDVLESFYSIDCIKSQFEAWRSKYYTSYKDAYIGLCLPKLFNPLIRLQLLTWTPLEAKCRDFENMLWFESLLFYGCEEREQEKDDVDVALLPTIVEKVILPKLTVIAENMWDPFSTTQTSRMVGITLKLINGYPSVVNAENKNTQVYLKALLLRMRRTLDDDVFMPLYPKNVLENKNSGPYLFFQRQFWSSVKLLGNFLQWYGIFSNKTLQELSIDGLLNRYILMAFQNSEYGDDSIKKAQNVINCFPKQWFMNLKGERTISQLENFCRYLVHLADTIYRNSIGCSDVEKRNARENIKQIVKLLASVRALDHAMSVASDHNVKEFKSLIEGK

SEQ ID NO: 861826 - protein, 922 aa, Homo sapiens; identical to SEQ ID NO: 861820

SEQ ID NO: 861827 - protein, 834 aa, Homo sapiens
MFRKARRVNVRKRNDSEEEERERDEEQEPPPLLPPPGTGEEAGPGGGDRAPGGESLLGPGPSPPSALTPGLGAEAGGGFPGGAEPGNGLKPRKRPRENKEVPRASLLSFQDEEEENEEVFKVKKSSYSKKIVKLLKKEYKEDLEKSKIKTELNSSAESEQPLDKTGHVKDTNQEDGVIISEHGEDEMDMESEKEEEKPKTGGAFSNALSSLNVLRPGEIPDAAFIHAARKKRQMARELGDFTPHDNEPGKGRLVREDENDASDDEDDDEKRRIVFSVKEKSQRQKIAEEIGIEGSDDDALVTGEQDEELSRWEQEQIRKGINIPQVQASQPAEVNMYYQNTYQTMPYGSSYGIPYSYTAYGSSDAKSQKTDNTVPFKTPSNEMTPVTIDLVKKQLKDRLDSMKELHKTNRQQHEKHLQSRVDSTRAIERLEGSSGGIGERYKFLQEMRGYVQDLLECFSEKVPLINELESAIHQLYKQRASRLVQRRQDDIKDESSEFSSHSSQSSEDKALMAPNLDSFGRDRALYQEHAKRRIAEREARRTRRRQAREQTGKMADHLEGLSSDDEETSTDITNFNLEKDRISKESGKVFEDVLESFYSIDCIKSQFEAWRSKYYTSYKDAYIGLCLPKLFNPLIRLQLLTWTPLEAKCRDFENMLWFESLLFYGCEEREQEKDDVDVALLPTIVEKVILPKLTVIAENMWDPFSTTQTSRMVGITLKLINGYPSVVNAENKNTQVYLKALLLRMRRTLDDDVFMPLYPKNVLENKNSGPYLFFQRQFWSSVKLLGNFLQWYGIFSNKTLQELSIDGLLNRYILMAFQNSEYGDDSIKKAQNVS

SEQ ID NO: 861828 - protein, 232 aa, Homo sapiens
AAARADMGEKLELRLKSPVGAEPAVYPWPLPVYDKHHDAAHEIIETIRWVCEEIPDLKLAMENYVLIDYDTKSFESMQRLCDKYNRAIDSIHQLWKGTTQPMKLNTRPSTGLLRHILQQVYNHSVTDPEKLNNYEPFSPEVYGETSFDLVAQMIDEIKMTDDDLFVDLGSGVGQVVLQVAAATNCKHHYGVEKADIPAKYAETMDREFRKWMKWYGKKHAEYTVSAIAPPRL

SEQ ID NO: 861829 - protein, 1708 aa, Homo sapiens
AAARADMGEKLELRLKSPVGAEPAVYPWPLPVYDKHHDAAHEIIETIRWVCEEIPDLKLAMENYVLIDYDTKSFESMQRLCDKYNRAIDSIHQLWKGTTQPMKLNTRPSTGLLRHILQQVYNHSVTDPEKLNNYEPFSPEVYGETSFDLVAQMIDEIKMTDDDLFVDLGSGVGQVVLQVAAATNCKHHYGVEKADIPAKYAETMDREFRKWMKWYGKKHAEYTLERGDFLSEEWRERIANTSVIFVNNFAFGPEVDHQLKERFANMKEGGRIVSSKPFAPLNFRINSRNLSDIGTIMRVVELSPLKGSVSWTGKPVSYYLHTIDRTILENYFSSLKNPKLREEQEAARRRQQRESKSNAAAPTKGPEGKVAGPADAPMDSGAEEEKAGAATVKKPSPSKARKKKLNKKGRKMAGRKRGRPKKMNTANPERKPKKNQMQRHSPNPLLVAPTPPALQKLLESFKIQYLQFLAYTKTPQYKASLQELLGQEKEKNAQLLGAAQQLLSHCQAQKEEIRRLFQQKLDELGVKALTYNDLIQAQKEISAHNQQLREQSEQLEQDNRALRGQSLQLLKARCEELQLDWATLSLEKLLKEKQALKSQISEKQRHCLELQISIVELEKSQRQQELLQLKSCVPPDDALSLHLRGKGALGRELEPDASRLHLELDCTKFSLPHLSSMSPELSMNGQAAGYELCGVLSRPSSKQNTPQYLASPLDQEVVPCTPSHVGRPRLEKLSGLAAPDYTRLSPAKIVLRRHLSQDHTVPGRPAASELHSRAEHTKENGLPYQSPSVPGSMKLSPQDPRPLSPGALQLAGEKSSEKGLRERAYGSSGELITSLPISIPLSTVQPNKLPVSIPLASVVLPSRAERARSTPSPVLQPRDPSSTLEKQIGANAHGAGSRSLALAPAGFSYAGSVAISGALAGSPASLTPGAEPATLDESSSSGSLFATVGSRSSTPQHPLLLAQPRNSLPASPAHQLSSSPRLGGAAQGPLPEASKGDLPSDSGFSDPESEAKRRIVFTITTGAGSAKQSPSSKHSPLTASARGDCVPSHGQDSRRRGRRKRASAGTPSLSAGVSPKRRALPSVAGLFTQPSGSPLNLNSMVSNINQPLEITAISSPETSLKSSPVPYQDHDQPPVLKKERPLSQTNGAHYSPLTSDEEPGSEDEPSSARIERKIATISLESKSPPKTLENGGGLAGRKPAPAGEPVNSSKWKSTFSPISDIGLAKSADSPLQASSALSQNSLFTFRPALEEPSADAKLAAHPRKGFPGSLSGADGLSPGTNPANGCTFGGGLAADLSLHSFSDGASLPHKGPEAAGLSSPLSFPSQRGKEGSDANPFLSKRQLDGLAGLKGEGSRGKEAGEGGLPLCGPTDKTPLLSGKAAKARDREVDLKNGHNLFISAAAVPPGSLLSGPGLAPAASSAGGAASSAQTHRSFLGPFPPGPQFALGPMSLQANLGSVAGSSVLQSLFSSVPAAAGLVHVSSAATRLTNSHAMGSFSGVAGGTVGGVFNHAVPSASAHPFGARVGRGAACGSATLGPSPLQAAASASASSFQAPASVETRPPPPPPPPPPPLPPPAHLGRSPAGPPVLHAPPPPNAALPPPPTLLASNPEPALLQSLASLPPNQAFLPPTSAASLPPANASLSIKLTSLPHKGARPSFTVHHQPLPRLALAQAAPGIPQASATGPSAVWVSLGMPPPYAAHLSGVKPR

SEQ ID NO: 861830 - protein, 1543 aa, Homo sapiens
AAARADMGEKLELRLKSPVGAEPAVYPWPLPVYDKHHDAAHEIIETIRWVCEEIPDLKLAMENYVLIDYDTKSFESMQRLCDKYNRAIDSIHQLWKGTTQPMKLNTRPSTGLLRHILQQVYNHSVTDPEKLNNYEPFSPEVYGETSFDLVAQMIDEIKMTDDDLFVDLGSGVGQVVLQVAAATNCKHHYGVEKADIPAKYAETMDREFRKWMKWYGKKHAEYTLERGDFLSEEWRERIANTSVIFVNNFAFGPEVDHQLKERFANMKEGGRIVSSKPFAPLNFRINSRNLSDIGTIMRVVELSPLKGSVSWTGKPVSYYLHTIDRTILENYFSSLKNPKLREEQEAARRRQQRESKSNAAAPTKGPEGKVAGPADAPMDSGAEEEKAGAATVKKPSPSKARKKKLNKKGRKMAGRKRGRPKKMNTANPERKPKKNQTALDALHAQTVSQTAASSPQDAYRSPHSPFYQLPPSVQRHSPNPLLVAPTPPALQKLLESFKIQYLQFLAYTKTPQYKASLQELLGQEKEKNAQLLGAAQQLLSHCQAQKEEIRRLFQQKLDELGVKALTYNDLIQAQKEISAHNQQLREQSEQLEQDNRALRGQSLQLLKARCEELQLDWATLSLEKLLKEKQALKSQISEKQRHCLELQISIVELEKSQRQQELLQLKSCVPPDDALSLHLRGKGALGRELEPDASRLHLELDCTKFSLPHLSSMSPELSMNGQAAGYELCGVLSRPSSKQNTPQYLASPLDQEVVPCTPSHVGRPRLEKLSGLAAPDYTRLSPAKIVLRRHLSQDHTVPGRPAASELHSRAEHTKENGLPYQSPSVPGSMKLSPQDPRPLSPGALQLAGEKSSEKGLRERAYGSSGELITSLPISIPLSTVQPNKLPVSIPLASVVLPSRAERARSTPSPVLQPRDPSSTLEKQIGANAHGAGSRSLALAPAGFSYAGSVAISGALAGSPASLTPGAEPATLDESSSSGSLFATVGSRSSTPQHPLLLAQPRNSLPASPAHQLSSSPRLGGAAQGPLPEASKGDLPSDSGFSDPESEAKRRIVFTITTGAGSAKQSPSSKHSPLTASARGDCVPSHGQDSRRRGRRKRASAGTPSLSAGVSPKRRALPSVAGLFTQPSGSPLNLNSMVSNINQPLEITAISSPETSLKSSPVPYQDHDQPPVLKKERPLSQTNGAHYSPLTSDEEPGSEDEPSSARIERKIATISLESKSPPKTLENGGGLAGRKPAPAGEPVNSSKWKSTFSPISDIGLAKSADSPLQASSALSQNSLFTFRPALEEPSADAKLAAHPRKGFPGSLSGADGLSPGTNPANGCTFGGGLAADLSLHSFSDGASLPHKGPEAAGLSSPLSFPSQRGKEGSDANPFLSKRQLDGLAGLKGEGSRGKEAGEGGLPLCGPTDKTPLLSGKAAKARDREVDLKNGHNLFISAAAVPPGSLLSGPGLAPAASSAGGAASSAQTHRSFLGPFPPGPQFALGPMSLQANLGSVAGSSVLQSLFSSVPAAAGLVHVSSAATRLTNSHAMGSFSGVAGGTVGGN

SEQ ID NO: 861831 - protein, 1708 aa, Homo sapiens; identical to SEQ ID NO: 861829

SEQ ID NO: 861832 - protein, 1684 aa, Homo sapiens
AAARADMGEKLELRLKSPVGAEPAVYPWPLPVYDKHHDAAHEIIETIRWVCEEIPDLKLAMENYVLIDYDTKSFESMQRLCDKYNRAIDSIHQLQVYNHSVTDPEKLNNYEPFSPEVYGETSFDLVAQMIDEIKMTDDDLFVDLGSGVGQVVLQVAAATNCKHHYGVEKADIPAKYAETMDREFRKWMKWYGKKHAEYTLERGDFLSEEWRERIANTSVIFVNNFAFGPEVDHQLKERFANMKEGGRIVSSKPFAPLNFRINSRNLSDIGTIMRVVELSPLKGSVSWTGKPVSYYLHTIDRTILENYFSSLKNPKLREEQEAARRRQQRESKSNAAAPTKGPEGKVAGPADAPMDSGAEEEKAGAATVKKPSPSKARKKKLNKKGRKMAGRKRGRPKKMNTANPERKPKKNQMQRHSPNPLLVAPTPPALQKLLESFKIQYLQFLAYTKTPQYKASLQELLGQEKEKNAQLLGAAQQLLSHCQAQKEEIRRLFQQKLDELGVKALTYNDLIQAQKEISAHNQQLREQSEQLEQDNRALRGQSLQLLKARCEELQLDWATLSLEKLLKEKQALKSQISEKQRHCLELQISIVELEKSQRQQELLQLKSCVPPDDALSLHLRGKGALGRELEPDASRLHLELDCTKFSLPHLSSMSPELSMNGQAAGYELCGVLSRPSSKQNTPQYLASPLDQEVVPCTPSHVGRPRLEKLSGLAAPDYTRLSPAKIVLRRHLSQDHTVPGRPAASELHSRAEHTKENGLPYQSPSVPGSMKLSPQDPRPLSPGALQLAGEKSSEKGLRERAYGSSGELITSLPISIPLSTVQPNKLPVSIPLASVVLPSRAERARSTPSPVLQPRDPSSTLEKQIGANAHGAGSRSLALAPAGFSYAGSVAISGALAGSPASLTPGAEPATLDESSSSGSLFATVGSRSSTPQHPLLLAQPRNSLPASPAHQLSSSPRLGGAAQGPLPEASKGDLPSDSGFSDPESEAKRRIVFTITTGAGSAKQSPSSKHSPLTASARGDCVPSHGQDSRRRGRRKRASAGTPSLSAGVSPKRRALPSVAGLFTQPSGSPLNLNSMVSNINQPLEITAISSPETSLKSSPVPYQDHDQPPVLKKERPLSQTNGAHYSPLTSDEEPGSEDEPSSARIERKIATISLESKSPPKTLENGGGLAGRKPAPAGEPVNSSKWKSTFSPISDIGLAKSADSPLQASSALSQNSLFTFRPALEEPSADAKLAAHPRKGFPGSLSGADGLSPGTNPANGCTFGGGLAADLSLHSFSDGASLPHKGPEAAGLSSPLSFPSQRGKEGSDANPFLSKRQLDGLAGLKGEGSRGKEAGEGGLPLCGPTDKTPLLSGKAAKARDREVDLKNGHNLFISAAAVPPGSLLSGPGLAPAASSAGGAASSAQTHRSFLGPFPPGPQFALGPMSLQANLGSVAGSSVLQSLFSSVPAAAGLVHVSSAATRLTNSHAMGSFSGVAGGTVGGVFNHAVPSASAHPFGARVGRGAACGSATLGPSPLQAAASASASSFQAPASVETRPPPPPPPPPPPLPPPAHLGRSPAGPPVLHAPPPPNAALPPPPTLLASNPEPALLQSLASLPPNQAFLPPTSAASLPPANASLSIKLTSLPHKGARPSFTVHHQPLPRLALAQAAPGIPQASATGPSAVWVSLGMPPPYAAHLSGVKPR

SEQ ID NO: 861833 - protein, 1146 aa, Homo sapiens
AAARADMGEKLELRLKSPVGAEPAVYPWPLPVYDKHHDAAHEIIETIRWVCEEIPDLKLAMENYVLIDYDTKSFESMQRLCDKYNRAIDSIHQLWKGTTQPMKLNTRPSTGLLRHILQQVYNHSVTDPEKLNNYEPFSPEVYGETSFDLVAQMIDEIKMTDDDLFVDLGSGVGQVVLQVAAATNCKHHYGVEKADIPAKYAETMDREFRKWMKWYGKKHAEYTLERGDFLSEEWRERIANTSVIFVNNFAFGPEVDHQLKERFANMKEGGRIVSSKPFAPLNFRINSRNLSDIGTIMRVVELSPLKGSVSWTGKPVSYYLHTIDRTILENYFSSLKNPKLREEQEAARRRQQRESKSNAAAPTKGPEGKVAGPADAPMDSGAEEEKAGAATVKKPSPSKARKKKLNKKGRKMAGRKRGRPKKMNTANPERKPKKNQMQRHSPNPLLVAPTPPALQKLLESFKIQYLQFLAYTKTPQYKASLQELLGQEKEKNAQLLGAAQQLLSHCQAQKEEIRRLFQQKLDELGVKALTYNDLIQAQKEISAHNQQLREQSEQLEQDNRALRGQSLQLLKARCEELQLDWATLSLEKLLKEKQALKSQISEKQRHCLELQISIVELEKSQRQQELLQLKSCVPPDDALSLHLRGKGALGRELEPDASRLHLELDCTKFSLPHLSSMSPELSMNGQAAGYELCGVLSRPSSKQNTPQYLASPLDQEVVPCTPSHVGRPRLEKLSGLAAPDYTRLSPAKIVLRRHLSQDHTVPGRPAASELHSRAEHTKENGLPYQSPSVPGSMKLSPQDPRPLSPGALQLAGEKSSEKGLRERAYGSSGELITSLPISIPLSTVQPNKLPVSIPLASVVLPSRAERARSTPSPVLQPRDPSSTLEKQIGANAHGAGSRSLALAPAGFSYAGSVAISGALAGSPASLTPGAEPATLDESSSSGSLFATVGSRSSTPQHPLLLAQPRNSLPASPAHQLSSSPRLGGAAQGPLPEASKGDLPSDSGFSDPESEAKRRIVFTITTGAGSAKQSPSSKHSPLTASARGDCVPSHGQDSRRRGRRKRASAGTPSLSAGVSPVLKKERPLSQTNGAHYSPLNSMVSNINQPLEITAISSPETSLKSSPVPYQDHCESAARAAGGWDWSSLYCR

SEQ ID NO: 861834 - protein, 751 aa, Homo sapiens
LVPLRRRRPAASELHSRAEHTKENGLPYQSPSVPGSMKLSPQDPRPLSPGALQLAGEKSSEKGLRERAYGSSGELITSLPISIPLSTVQPNKLPVSIPLASVVLPSRAERARSTPSPVLQPRDPSSTLEKQIGANAHGAGSRSLALAPAGFSYAGSVAISGALAGSPASLTPGAEPATLDESSSSGSLFATVGSRSSTPQHPLLLAQPRNSLPASPAHQLSSSPRLGGAAQGPLPEASKGDLPSDSGFSDPESEAKRRIVFTITTGAGSAKQSPSSKHSPLTASARGDCVPSHGQDSRRRGRRKRASAGTPSLSAGVSPKRRALPSVAGLFTQPSGSPLNLNSMVSNINQPLEITAISSPETSLKSSPVPYQDHDQPPVLKKERPLSQTNGAHYSPLTSDEEPGSEDEPSSARIERKIATISLESKSPPKTLENGGGLAGRKPAPAGEPVNSSKWKSTFSPISDIGLAKSADSPLQASSALSQNSLFTFRPALEEPSADAKLAAHPRKGFPGSLSGADGLSPGTNPANGCTFGGGLAADLSLHSFSDGASLPHKGPEAAGLSSPLSFPSQRGKEGSDANPFLSKRQLDGLAGLKGEGSRGKEAGEGGLPLCGPTDKTPLLSGKAAKARDREVDLKNGHNLFISAAAVPPGSLLSGPGLAPAASSAGGAASSAQTHRSFLGPFPPGPQFALGPMSLQANLGSVAGSSVLQSLFSSVPAAAGLVHVSSAATRLTNSHAMGSFSGVAGGTVGGN

SEQ ID NO: 861835 - protein, 486 aa, Homo sapiens
FPQTQHTPPHTPTPHTPNTTPTQRLGARLGVGRRRGRRKRASAGTPSLSAGVSPKRRALPSVAGLFTQPSGSPLNLNSMVSNINQPLEITAISSPETSLKSSPVPYQDHDQPPVLKKERPLSQTNGAHYSPLTSDEEPGSEDEPSSARIERKIATISLESKSPPKTLENGGGLAGRKPAPAGEPVNSSKWKSTFSPISDIGLAKSADSPLQASSALSQNSLFTFRPALEEPSADAKLAAHPRKGFPGSLSGADGLSPGTNPANGCTFGGGLAADLSLHSFSDGASLPHKGPEAAGLSSPLSFPSQRGKEGSDANPFLSKRQLDGLAGLKGEGSRGKEAGEGGLPLCGPTDKTPLLSGKAAKARDREVDLKNGHNLFISAAAVPPGSLLSGPGLAPAASSAGGAASSAQTHRSFLGPFPPGPQFALGPMSLQANLGSVAGSSVLQSLFSSVPAAAGLVHVSSAATRLTNSHAMGSFSGVAGGTVGGN

SEQ ID NO: 861836 - protein, 1708 aa, Homo sapiens; identical to SEQ ID NO: 861829

SEQ ID NO: 861837 - protein, 1708 aa, Homo sapiens; identical to SEQ ID NO: 861829

SEQ ID NO: 861838 - protein, 1146 aa, Homo sapiens; identical to SEQ ID NO: 861833

SEQ ID NO: 861839 - protein, 880 aa, Homo sapiens
AAARADMGEKLELRLKSPVGAEPAVYPWPLPVYDKHHDAAHEIIETIRWVCEEIPDLKLAMENYVLIDYDTKSFESMQRLCDKYNRAIDSIHQLWKGTTQPMKLNTRPSTGLLRHILQQVYNHSVTDPEKLNNYEPFSPEVYGETSFDLVAQMIDEIKMTDDDLFVDLGSGVGQVVLQVAAATNCKHHYGVEKADIPAKYAETMDREFRKWMKWYGKKHAEYTLERGDFLSEEWRERIANTSVIFVNNFAFGPEVDHQLKERFANMKEGGRIVSSKPFAPLNFRINSRNLSDIGTIMRVVELSPLKGSVSWTGKPVSYYLHTIDRTILENYFSSLKNPKLREEQEAARRRQQRESKSNAAAPTKGPEGKVAGPADAPMDSGAEEEKAGAATVKKPSPSKARKKKLNKKGRKMAGRKRGRPKKMNTANPERKPKKNQMQRHSPNPLLVAPTPPALQKLLESFKIQYLQFLAYTKTPQYKASLQELLGQEKEKNAQLLGAAQQLLSHCQAQKEEIRRLFQQKLDELGVKALTYNDLIQAQKEISAHNQQLREQSEQLEQDNRALRGQSLQLLKARCEELQLDWATLSLEKLLKEKQALKSQISEKQRHCLELQISIVELEKSQRQQELLQLKSCVPPDDALSLHLRGKGALGRELEPDASRLHLELDCTKFSLPHLSSMSPELSMNGQAAGYELCGVLSRPSSKQNTPQYLASPLDQEVVPCTPSHVGRPRLEKLSGLAAPDYTRLSPAKIVLRRHLSQDHTVPGRPAASELHSRAEHTKENGLPYQSPSVPGSMKLSPQDPRPLSPGALQLAGEKSSEKGLRERAYILGAFCVENTFCDAYWRLCFDTPSWADQVEEEGEDDKCVTSELLTGIPLATGDTS

SEQ ID NO: 861840 - protein, 63 aa, Homo sapiens
PLKFPRCPLPTRYWTVTPAASPSQLQASTLTVSSWVLGLLGHLLPLTHRVFSLQRSTPSPVLQ

SEQ ID NO: 861841 - protein, 79 aa, Homo sapiens
AAARADMGEKLELRLKSPVGAEPAVYPWPLPVYDKHHDAAHEIIETIRWVCEEIPDLKLAMENYVLIDYDTKSCWLRKT

SEQ ID NO: 861842 - protein, 1507 aa, Homo sapiens
AAARADMGEKLELRLKSPVGAEPAVYPWPLPVYDKHHDAAHEIIETIRWVCEEIPDLKLAMENYVLIDYDTKSFESMQRLCDKYNRAIDSIHQLWKGTTQPMKLNTRPSTGLLRHILQQVYNHSVTDPEKLNNYEPFSPEVYGETSFDLVAQMIDEIKMTDDDLFVDLGSGVGQVVLQVAAATNCKHHYGVEKADIPAKYAETMDREFRKWMKWYGKKHAEYTLERGDFLSEEWRERIANTSVIFVNNFAFGPEVDHQLKERFANMKEGGRIVSSKPFAPLNFRINSRNLSDIGTIMRVVELSPLKGSVSWTGKPVSYYLHTIDRTILENYFSSLKNPKLREEQEAARRRQQRESKSNAAAPTKGPEGKVAGPADAPMDSGAEEEKAGAATVKKPSPSKARKKKLNKKGRKMAGRKRGRPKKMNTANPERKPKKNQMQRHSPNPLLVAPTPPALQKLLESFKIQYLQFLAYTKTPQYKASLQELLGQEKEKNAQLLGAAQQLLSHCQAQKEEIRRLFQQKLDELGVKALTYNDLIQAQKEISAHNQQLREQSEQLEQDNRALRGQSLQLLKARCEELQLDWATLSLEKLLKEKQALKSQISEKQRHCLELQISIVELEKSQRQQELLQLKSCVPPDDALSLHLRGKGALGRELEPDASRLHLELDCTKFSLPHLSSMSPELSMNGQAAGYELCGVLSRPSSKQNTPQYLASPLDQEVVPCTPSHVGRPRLEKLSGLAAPDYTRLSPAKIVLRRHLSQDHTVPGRPAASELHSRAEHTKENGLPYQSPSVPGSMKLSPQDPRPLSPGALQLAGEKSSEKGLRERAYGSSGELITSLPISIPLSTVQPNKLPVSIPLASVVLPSRAERARSTPSPVLQPRDPSSTLEKQIGANAHGAGSRSLALAPAGFSYAGSVAISGALAGSPASLTPGAEPATLDESSSSGSLFATVGSRSSTPQHPLLLAQPRNSLPASPAHQLSSSPRLGGAAQGPLPEASKGDLPSDSGFSDPESEAKRRIVFTITTGAGSAKQSPSSKHSPLTASARGDCVPSHGQDSRRRGRRKRASAGTPSLSAGVSPKRRALPSVAGLFTQPSGSPLNLNSMVSNINQPLEITAISSPETSLKSSPVPYQDHDQPPVLKKERPLSQTNGAHYSPLTSDEEPGSEDEPSSARIERKIATISLESKSPPKTLENGGGLAGRKPAPAGEPVNSSKWKSTFSPISDIGLAKSADSPLQASSALSQNSLFTFRPALEEPSADAKLAAHPRKGFPGSLSGADGLSPGTNPANGCTFGGGLAADLSLHSFSDGASLPHKGPEAAGLSSPLSFPSQRGKEGSDANPFLSKRQLDGLAGLKGEGSRGKEAGEGGLPLCGPTDKTPLLSGKAAKARDREVDLKNGHNLFISAAAVPPGSLLSGPGLAPAASSAGGAASSAQTHRSFLGPFPPGPQFALGPMSLQANLGSVAGSSVLQSLFSSVPAAAGLVHVSSAATRLTNSHAMGSFSGVAGGTVGGN

SEQ ID NO: 861843 - protein, 1708 aa, Homo sapiens; identical to SEQ ID NO: 861829

SEQ ID NO: 861844 - protein, 972 aa, Homo sapiens
KACRARHSRQAWAPRLDGFSAALGVMEPHSGRLELKARCEELQLDWATLSLEKLLKEKQALKSQISEKQRHCLELQISIVELEKSQRQQELLQLKSCVPPDDALSLHLRGKGALGRELEPDASRLHLELDCTKFSLPHLSSMSPELSMNGQAAGYELCGVLSRPSSKQNTPQYLASPLDQEVVPCTPSHVGRPRLEKLSGLAAPDYTRLSPAKIVLRRHLSQDHTVPGRPAASELHSRAEHTKENGLPYQSPSVPGSMKLSPQDPRPLSPGALQLAGEKSSEKGLRERAYGSSGELITSLPISIPLSTVQPNKLPVSIPLASVVLPSRAERARSTPSPVLQPRDPSSTLEKQIGANAHGAGSRSLALAPAGFSYAGSVAISGALAGSPASLTPGAEPATLDESSSSGSLFATVGSRSSTPQHPLLLAQPRNSLPASPAHQLSSSPRLGGAAQGPLPEASKGDLPSDSGFSDPESEAKRRIVFTITTGAGSAKQSPSSKHSPLTASARGDCVPSHGQDSRRRGRRKRASAGTPSLSAGVSPKRRALPSVAGLFTQPSGSPLNLNSMVSNINQPLEITAISSPETSLKSSPVPYQDHDQPPVLKKERPLSQTNGAHYSPLTSDEEPGSEDEPSSARIERKIATISLESKSPPKTLENGGGLAGRKPAPAGEPVNSSKWKSTFSPISDIGLAKSADSPLQASSALSQNSLFTFRPALEEPSADAKLAAHPRKGFPGSLSGADGLSPGTNPANGCTFGGGLAADLSLHSFSDGASLPHKGPEAAGLSSPLSFPSQRGKEGSDANPFLSKRQLDGLAGLKGEGSRGKEAGEGGLPLCGPTDKTPLLSGKAAKARDREVDLKNGHNLFISAAAVPPGSLLSGPGLAPAASSAGGAASSAQTHRSFLGPFPPGPQFALGPMSLQANLGSVAGSSVLQSLFSSVPAAAGLVHVSSAATRLTNSHAMGSFSGVAGGTVGGN

SEQ ID NO: 861845 - protein, 1507 aa, Homo sapiens; identical to SEQ ID NO: 861842

SEQ ID NO: 861846 - protein, 1507 aa, Homo sapiens; identical to SEQ ID NO: 861842

SEQ ID NO: 861847 - protein, 1146 aa, Homo sapiens; identical to SEQ ID NO: 861833

SEQ ID NO: 861848 - protein, 644 aa, Homo sapiens
AAARADMGEKLELRLKSPVGAEPAVYPWPLPVYDKHHDAAHEIIETIRWVCEEIPDLKLAMENYVLIDYDTKSFESMQRLCDKYNRAIDSIHQLWKGTTQPMKLNTRPSTGLLRHILQQVYNHSVTDPEKLNNYEPFSPEVYGETSFDLVAQMIDEIKMTDDDLFVDLGSGVGQVVLQVAAATNCKHHYGVEKADIPAKYAETMDREFRKWMKWYGKKHAEYTLERGDFLSEEWRERIANTSVIFVNNFAFGPEVDHQLKERFANMKEGGRIVSSKPFAPLNFRINSRNLSDIGTIMRVVELSPLKGSVSWTGKPVSYYLHTIDRTILENYFSSLKNPKLREEQEAARRRQQRESKSNAGTPTKGPEGKVAGPADAPMDSGAEEEKAGAATVKKPSPSKARKKKLNKKGRKMAGRKRGRPKKMNTANPERKPKKNQMQRHSPNPLLVAPTPPALQKLLESFKIQYLQFLAYTKTPQYKASLQELLGQEKEKNAQLLGAAQQLLSHCQAQKEEIRRLFQQKLDELGVKALTYNDLIQAQKEISAHNQQLREQSEQLEQDNRALRGQSLQLLKARCEELQLDWATLSLEKLLKEKQALKSQISEKQRHCLELQVGCARGCTPWCPSLSHQPPCDVVEPRVVAVAAA

SEQ ID NO: 861849 - protein, 313 aa, Homo sapiens
MRVVTIVILLCFCKAAELRKASPGSVRSRVNHGRAGGGRRGSNPVKRYAPGLPCDVYTYLHEKYLDCQERKLVYVLPGWPQDLLHMLLARNKIRTLKNNMFSKFKKLKSLDLQQNEISKIESEAFFGLNKLTTLLLQHNQIKVLTEEVFIYTPLLSYLRLYDNPWHCTCEIETLISMLQIPRNRNLGNYAKCESPQEQKNKKLRQIKSEQLCNEEEKEQLDPKPQVSGRPPVIKPEVDSTFCHNYVFPIQTLDCKRKELKKVPNNIPPDIVKLDLSYNKINQLRPKEFEDVHELKKLNLSSNGIEFIDPGSLR

SEQ ID NO: 861850 - protein, 441 aa, Homo sapiens
MRVVTIVILLCFCKAAELRKASPGSVRSRVNHGRAGGGRRGSNPVKRYAPGLPCDVYTYLHEKYLDCQERKLVYVLPGWPQDLLHMLLARNKIRTLKNNMFSKFKKLKSLDLQQNEISKIESEAFFGLNKLTTLLLQHNQIKVLTEEVFIYTPLLSYLRLYDNPWHCTCEIETLISMLQIPRNRNLGNYAKCESPQEQKNKKLRQIKSEQLCNEEEKEQLDPKPQVSGRPPVIKPEVDSTFCHNYVFPIQTLDCKRKELKKVPNNIPPDIVKLDLSYNKINQLRPKEFEDVHELKKLNLSSNGIEFIDPAAFLGLTHLEELDLSNNSLQNFDYGVLEDLYFLKLLWLRDNPWRCDYNIHYLYYWLKHHYNVHFNGLECKTPEEYKGWSVGKYIRSYYEECPKDKLPAYPESFDQDTEDDEWEKKHRDHTAKKQSVIITIVG

SEQ ID NO: 861851 - protein, 393 aa, Homo sapiens
MSGLPCDVYTYLHEKYLDCQERKLVYVLPGWPQDLLHMLLARNKIRTLKNNMFSKFKKLKSLDLQQNEISKIESEAFFGLNKLTTLLLQHNQIKVLTEEVFIYTPLLSYLRLYDNPWHCTCEIETLISMLQIPRNRNLGNYAKCESPQEQKNKKLRQIKSEQLCNEEEKEQLDPKPQVSGRPPVIKPEVDSTFCHNYVFPIQTLDCKRKELKKVPNNIPPDIVKLDLSYNKINQLRPKEFEDVHELKKLNLSSNGIEFIDPAAFLGLTHLEELDLSNNSLQNFDYGVLEDLYFLKLLWLRDNPWRCDYNIHYLYYWLKHHYNVHFNGLECKTPEEYKGWSVGKYIRSYYEECPKDKLPAYPESFDQDTEDDEWEKKHRDHTAKKQSVIITIVG

SEQ ID NO: 861852 - protein, 313 aa, Homo sapiens; identical to SEQ ID NO: 861849

SEQ ID NO: 861853 - protein, 313 aa, Homo sapiens; identical to SEQ ID NO: 861849

SEQ ID NO: 861854 - protein, 300 aa, Homo sapiens [sequence omitted]

SEQ ID NO: 861855 - protein, 132 aa, Homo sapiens
QEVSTAWNSPPTGKLDNKQYMIMIPRKRETNTIHPLPFQLHLYFHPLFLNLLNIQNQSKCPSINEWIKKMWYIYTMEYYSATKRNKIMAFAATWMELETIIVHSSLKTFSIAACWAVFSSNFIDDAIIPSST

SEQ ID NO: 861856 - protein, 154 aa, Homo sapiens
RKQKSVKEISSYTPKDCTSRNGPERGCDRGIIVSTRLLTDSSTDALEKVSTSNEDFSLKDDALAKTSKRKTKVQKDEICAKLSHVIKKQHRKSTLVDNTINLDENLTVSNIESFYSRKDTGVQKGDGFIHNLSLDPSGVLDDKNGEQKSQNNVL

SEQ ID NO: 861857 - protein, 132 aa, Homo sapiens
MTVTGLGWRDVLEAIKATRPIANPNPGFRQQLEEFGWASSQKLRRQLEERFGESPFRDEEELRALLPLCKRCRQGSATSASSAGPHSAASEGTVQRLVPRTPREAHRPLPLLARVKQTFSCLPRCLSRKGGK

SEQ ID NO: 861858 - protein, 291 aa, Homo sapiens
LGSLRGCFSILSRLCLSLPFCLPSPRISIPAPCKSTSLLSSPPKTCLPPLPSHTQAGLPWFPLVLPGLYLGNFIDAKDLDQLGRNKITHIISIHESPQPLLQDITYLRIPVADTPEVPIKKHFKECINFIHCCRLNGGNCLVHCFAGISRSTTIVTAYVMTVTGLGWRDVLEAIKATRPIANPNPGFRQQLEEFGWASSQKLRRQLEERFGESPFRDEEELRALLPLCKRCRQGSATSASSAGPHSAASEGTVQRLVPRTPREAHRPLPLLARVKQTFSCLPRCLSRKGGK

SEQ ID NO: 861859 - protein, 235 aa, Homo sapiens
MGNGMTKVLPGLYLGNFIDAKDLDQLGRNKITHIISIHESPQPLLQDITYLRIPVADTPEVPIKKHFKECINFIHCCRLNGGNCLVHCFAGISRSTTIVTAYVMTVTGLGWRDVLEAIKATRPIANPNPGFRQQLEEFGWASSQKLRRQLEERFGESPFRDEEELRALLPLCKRCRQGSATSASSAGPHSAASEGTVQRLVPRTPREAHRPLPLLARVKQTFSCLPRCLSRKGGK

SEQ ID NO: 861860 - protein, 129 aa, Homo sapiens
MGNGMTKVLPGLYLGNFIDAKDLDQLGRNKITHIISIHESPQPLLQDITYLRIPVADTPEVPMCSDCRPQRSGTPVFPPPISLKGHNKPNMKTGSTGGVLLPRCKKHFKECINFIHCCRLNGGNCLVHW

SEQ ID NO: 861861 - protein, 517 aa, Homo sapiens
MPSSTSPDQGDDLENCILRFSDLDLKDMSLINPSSSLKAELDGSTKKKYSFAKKKAFALFVKTKEVPTKRSFECKEKLWKCCQQLFTDQTSIHRHVATQHADEIYHQTASILKQLAVTLSTSKSLSSADEKNPLKECLPHSHDVSAWLPDISCFNPDELISGQGSEEGEVLLYYCYHDLEDPQWICAWQTALCQHLHLTGKIRIAAEGINGTVGGSKLATRLYVEVMLSFPLFKDDLCKDDFKTSKGGAHCFPELRVGVFEEIVPMGISPKKISYKKPGIHLSPGEFHKEVEKFLSQANQEQSDTILLDCRNFYESKIVDDSKAASAPDIRKFSYFPSYVDKNLELFREKRVLMYCTGGIRCERGSAYLKAKGVCKEVFQLKGGIHKYLEEFPDGFYKGKLFVFDERYALSYNSDVVSECSYCGARWDQYKLCSTPQCRQLVLTCPACQGQGFTACCVTCQDKGSRKVSGPMQDSFKEECECTARRPRIPRELLQHVRQPVSPEPGPDADEDGPVLM

SEQ ID NO: 861862 - protein, 385 aa, Homo sapiens
MPSSTSPDQGDDLENCILRFSDLDLKDMSLINPSSSLKAELDGSTKKKYSFAKKKAFALFVKTKEVPTKRSFECKEKLWKCCQQLFTDQTSIHRHVATQHADEIYHQTASILKQLAVTLSTSKSLSSADEKNPLKECLPHSHDVSAWLPDISCFNPDELISGQGSEEGEVLLYYCYHDLEDPQWICAWQTALCQHLHLTGKIRIAAEGINGTVGGSKLATRLYVEVMLSFPLFKDDLCKDDFKTSKGGAHCFPELRVGVFEEIVPMGISPKKISYKKPGIHLSPGEFHKEVEKFLSQANQEQSDTILLDCRNFYESKIVMARLQKQRNRELQFWPLPPWQPSTLHSGRGGVTLSTTYLRHSDLDDARAQKIGELHGIPKLLRDRA

SEQ ID NO: 861863 - protein, 508 aa, Homo sapiens
MPSSTSPDQGDDLENCILRFSDLDLKDMSLINPSSSLKAELDGSTKKKYSFAKKKKFQQKGVLNVKKNCGNAVSSYSQTKPASIDMWQHNMLMKFITRQLLILKQLAVTLSTSKSLSSADEKNPLKECLPHSHDVSAWLPDISCFNPDELISGQGSEEGEVLLYYCYHDLEDPQWICAWQTALCQHLHLTGKIRIAAEGINGTVGGSKLATRLYVEVMLSFPLFKDDLCKDDFKTSKGGAHCFPELRVGVFEEIVPMGISPKKISYKKPGIHLSPGEFHKEVEKFLSQANQEQSDTILLDCRNFYESKIVDDSKAASAPDIRKFSYFPSYVDKNLELFREKRVLMYCTGGIRCERGSAYLKAKGVCKEVFQLKGGIHKYLEEFPDGFYKGKLFVFDERYALSYNSDVVSECSYCGARWDQYKLCSTPQCRQLVLTCPACQGQGFTACCVTCQDKGSRKVSGPMQDSFKEECECTARRPRIPRELLQHVRQPVSPEPGPDADEDGPVLM

SEQ ID NO: 861864 - protein, 298 aa, Homo sapiens [sequence omitted]

SEQ ID NO: 861865 - protein, 517 aa, Homo sapiens; identical to SEQ ID NO: 861861

SEQ ID NO: 861866 - protein, 291 aa, Homo sapiens
MLSFPLFKDDLCKDDFKTSKGGAHCFPELRVGVFEEIVPMGISPKKISYKKPGIHLSPGEFHKEVEKFLSQANQEQSDTILLDCRNFYESKIVDDSKAASAPDIRKFSYFPSYVDKNLELFREKRVLMYCTGGIRCERGSAYLKAKGVCKEVFQLKGGIHKYLEEFPDGFYKGKLFVFDERYALSYNSDVVSECSYCGARWDQYKLCSTPQCRQLVLTCPACQGQGFTACCVTCQDKGSRKVSGPMQDSFKEECECTARRPRIPRELLQHVRQPVSPEPGPDADEDGPVLM

SEQ ID NO: 861867 - protein, 106 aa, Homo sapiens
MAFPSSPECSYCGARWDQYKLCSTPQCRQLVLTCPACQGQGFTACCVTCQDKGSRKVSGPMQDSFKEECECTARRPRIPRELLQHVRQPVSPEPGPDADEDGPVLM

SEQ ID NO: 861868 - protein, 271 aa, Homo sapiens
MPSSTSPDQGDDLENCILRFSDLDLKDMSLINPSSSLKAELDGSTKKKYSFAKKKAFALFVKTKEVPTKRSFECKEKLWKCCQQLFTDQTSIHRHVATQHADEIYHQTASILKQLAVTLSTSKSLSSADEKNPLKECLPHSHDVSAWLPDISCFNPDELISGQGSEEGEVLLYYCYHDLEDPQWICAWQTALCQHLHLTGKIRIAAEGINGTVGGSKLATRLYVEVMLSFPLFKDDLCKDDFKVTRQYNRRSMLVPILSLSHHMILDQLVL

SEQ ID NO: 861869 - protein, 492 aa, Homo sapiens
MSSLGCWCGVEDEAAPSKQSIYIQRETQVRTPVTGVSPKKAHPCEMCGPILGDILHVADHQGTHHKQKLHRCEAWGNKLYDSGNFHQHQNEHIGEKPYRGSVEEALFVKRCKLHVSGESSVFSESGKDFLPRSGLLQQEASHTGEKSNSKTECVSPFQCGGAHYSHGDSMKHFSTKHILSQHQRLLPREECYVCCECGKSFSKYVSFSNHQRVHSGKRPYECGECEKSFSQKSSLIQHQQFHTGGKPYGCEECGKYFSLEGYLRRHQKVHAGKGPYECGECGKSFSSNVNLKSHQRIHTGERPYKCGECEKSFSRKPSLSYHQRIHTEVRPYKCGECGKSYISKGHLRIHQRMHTGERPYKCGDCGKSFNEKGHLRSHQRVHTTERPYKCGECGKCFSHKGNLILHQHGHTRKRPYMCWECGKLFKKKSHLLVHQRIHSGEKPYACEACQKFFRHKCHLTAHQRVHTGERPYECSDCGKSFTHSCAFIVHKR

SEQ ID NO: 861870 - protein, 206 aa, Homo sapiens
HLRVHTGERPYECVECGKSFRRSSSLLQHQRVHTRERPYECSECGKSFSLRSHLTEHQRLHTGERPYNCRECGKLFNRKYHLLVHERVHTGERPYACEVCGKLFGNKHSVTIHQRIHTGERPYECSECGKSFLSSSALHVHKRVHSGQKPYKCSECGKSFSECSSLIKHRRIHTGERPYECTKCGKTFQRSSTLLHHQSSHRRKAL

SEQ ID NO: 861871 - protein, 575 aa, Homo sapiens
MAAAVPRRPTQQGTVTFEDVAVNFSQEEWCLLSEAQRCLYRDVMLENLALISSLGCWCGSKDEEAPCKQRISVQRESQSRTPRAGVSPKKAHPCEMCGLILEDVFHFADHQETHHKQKLNRSGACGKNLDDTAYLHQHQKQHIGEKFYRKSVREASFVKKRKLRVSQEPFVFREFGKDVLPSSGLCQEEAAVEKTDSETMHGPPFQEGKTNYSCGKRTKAFSTKHSVIPHQKLFTRDGCYVCSDCGKSFSRYVSFSNHQRDHTAKGPYDCGECGKSYSRKSSLIQHQRVHTGQTAYPCEECGKSFSQKGSLISHQLVHTGEGPYECRECGKSFGQKGNLIQHQQGHTGERAYHCGECGKSFRQKFCFINHQRVHTGERPYKCGECGKSFGQKGNLVHHQRGHTGERPYECKECGKSFRYRSHLTEHQRLHTGERPYNCRECGKLFNRKYHLLVHERVHTGERPYACEVCGKLFGNKHSVTIHQRIHTGERPYECSECGKSFLSSSALHVHKRVHSGQKPYKCSECGKSFSECSSLIKHRRIHTGERPYECTKCGKTFQRSSTLLHHQSSHRRKAL

SEQ ID NO: 861872 - protein, 532 aa, Homo sapiens
MLENLALISSLGCWCGSKDEEAPCKQRISVQRESQSRTPRAGVSPKKAHPCEMCGLILEDVFHFADHQETHHKQKLNRSGACGKNLDDTAYLHQHQKQHIGEKFYRKSVREASFVKKRKLRVSQEPFVFREFGKDVLPSSGLCQEEAAVEKTDSETMHGPPFQEGKTNYSCGKRTKAFSTKHSVIPHQKLFTRDGCYVCSDCGKSFSRYVSFSNHQRDHTAKGPYDCGECGKSYSRKSSLIQHQRVHTGQTAYPCEECGKSFSQKGSLISHQLVHTGEGPYECRECGKSFGQKGNLIQHQQGHTGERAYHCGECGKSFRQKFCFINHQRVHTGERPYKCGECGKSFGQKGNLVHHQRGHTGERPYECKECGKSFRYRSHLTEHQRLHTGERPYNCRECGKLFNRKYHLLVHERVHTGERPYACEVCGKLFGNKHSVTIHQRIHTGERPYECSECGKSFLSSSALHVHKRVHSGQKPYKCSECGKSFSECSSLIKHRRIHTGERPYECTKCGKTFQRSSTLLHHQSSHRRKAL

SEQ ID NO: 861873 - protein, 532 aa, Homo sapiens; identical to SEQ ID NO: 861872

SEQ ID NO: 861874 - protein, 532 aa, Homo sapiens; identical to SEQ ID NO: 861872

SEQ ID NO: 861875 - protein, 532 aa, Homo sapiens; identical to SEQ ID NO: 861872

SEQ ID NO: 861876 - protein, 121 aa, Homo sapiens
MTTHLYDAPTVKFLTPCYHPNVDTQGNICLDILKEKWSAPYDIRTILLSIQCLLGQLNIDSPLNTHATKLWENPIALRSTCKGQAQWLTPVIPALWEAEASRSQGQEFETSLANMVKPHLY

SEQ ID NO: 861877 - protein, 575 aa, Homo sapiens; identical to SEQ ID NO: 861871

SEQ ID NO: 861878 - protein, 532 aa, Homo sapiens; identical to SEQ ID NO: 861872

SEQ ID NO: 861879 - protein, 532 aa, Homo sapiens; identical to SEQ ID NO: 861872

SEQ ID NO: 861880 - protein, 532 aa, Homo sapiens; identical to SEQ ID NO: 861872

SEQ ID NO: 861881 - protein, 284 aa, Homo sapiens
MLENLALISSLGCWCGSKDEEAPCKQRISVQRESQSRTPRAGVSPKKAHPCEMCGLILEDVFHFADHQETHHKQKLNRSGACGKNLDDTAYLHQHQKQHIGEKFYRKSVREASFVKKRKLRVSQEPFVFREFGKDVLPSSGLCQEEAAVEKTDSETMHGPPFQEGKTNYSCGKRTKAFSTKHSVIPHQKLFTRDGCYVCSDCGKSFSRYVSFSNHQRDHTAKGPYDCGECGKSYSRKSSLIQHQRVHTGQTAYPCEECGKSFSQKGSLISHPVWPCWCRMRLPL

SEQ ID NO: 861882 - protein, 240 aa, Homo sapiens
ELNGNYNSREAVRPKTHENYGGERLAQPTAALVRLGLPLALPIRDVAAFRHSPTTDQRGAGLGGGGLIRIRRQRQARGFSRGEGVRAAAAAEAAMDDEEETYRLWKIRKTIMQLCHDRGYLVTQDELDQTLEEFKAQFGDKPSEGRPRRTDLTVLVAHNDDPTDQMFVFFPEEPKVGIKTIKVYCQRMQEENITRALIVVQQGMTPSAKQSLVDMAPKYILEQFLQQELRHQHHGARASP

SEQ ID NO: 861883 - protein, 146 aa, Homo sapiens
MDDEEETYRLWKIRKTIMQLCHDRGYLVTQDELDQTLEEFKAQFGDKPSEGRPRRTDLTVLVAHNDDPTDQMFVFFPEEPKVGIKTIKVYCQRMQEENITRALIVVQQGMTPSAKQSLVDMAPKYILEQFLQQELRHQHHGARASP

SEQ ID NO: 861884 - protein, 146 aa, Homo sapiens; identical to SEQ ID NO: 861883

SEQ ID NO: 861885 - protein, 240 aa, Homo sapiens; identical to SEQ ID NO: 861882

SEQ ID NO: 861886 - protein, 146 aa, Homo sapiens; identical to SEQ ID NO: 861883

SEQ ID NO: 861887 - protein, 146 aa, Homo sapiens; identical to SEQ ID NO: 861883

SEQ ID NO: 861888 - protein, 240 aa, Homo sapiens; identical to SEQ ID NO: 861882

SEQ ID NO: 861889 - protein, 240 aa, Homo sapiens; identical to SEQ ID NO: 861882

SEQ ID NO: 861890 - protein, 240 aa, Homo sapiens; identical to SEQ ID NO: 861882

SEQ ID NO: 861891 - protein, 155 aa, Homo sapiens
VRIASVREAESCEEETYRLWKIRKTIMQLCHDRGYLVTQDELDQTLEEFKAQFGDKPSEGRPRRTDLTVLVAHNDDPTDQMFVFFPEEPKVGIKTIKVYCQRMQEENITRALIVVQQGMTPSAKQSLVDMAPKYILEQFLQQELRHQHHGARASP

SEQ ID NO: 861892 - protein, 106 aa, Homo sapiens [sequence omitted]

SEQ ID NO: 861893 - protein, 240 aa, Homo sapiens; identical to SEQ ID NO: 861882

SEQ ID NO: 861894 - protein, 118 aa, Homo sapiens
MDDEEETYRLWKIRKTIMQVSRAWYLVTQVASTHVLPSWGEASCGPARPIHLWICARCSLRRNKAPRGRSPGGSWCRVFTQTTLGPLCWGFGVRVSHQPLLPPGPSAFHPSSSLPRGP

SEQ ID NO: 861895 - protein, 226 aa, Homo sapiens
ELNGNYNSREAVRPKTHENYGGERLAQPTAALVRLGLPLALPIRDVAAFRHSPTTDQRGAGLGGGGLIRIRRQRQARGFSRGEGVRAAAAAEAAMDDEEETYRLWKIRKTIMQLCHDRGYLVTQDELDQTLEEFKAQFGDKPSEGRPRRTDLTVLVAHNDDPTDQMFVFFPEEPKVGIKTIKVYCQRMQEENITRALIVVQQEFSREQQEFSREQQEFSREQEFSR

SEQ ID NO: 861896 - protein, 181 aa, Homo sapiens
ELNGNYNSREAVRPKTHENYGGERLAQPTAALVRLGLPLALPIRDVAAFRHSPTTDQRGAGLGGGGLIRIRRQRQARGFSRGEGVRAAAAAEAAMDDEEETYRLWKIRKTIMQLCHDRGYLVTQDELDQTLEEFKAQFGDKPSEGRPRRTDLTVLVAHNDDPTDQMFVFFPGEQRVPGEFR

SEQ ID NO: 861897 - protein, 240 aa, Homo sapiens; identical to SEQ ID NO: 861882

SEQ ID NO: 861898 - protein, 240 aa, Homo sapiens; identical to SEQ ID NO: 861882

SEQ ID NO: 861899 - protein, 240 aa, Homo sapiens; identical to SEQ ID NO: 861882

SEQ ID NO: 861900 - protein, 240 aa, Homo sapiens; identical to SEQ ID NO: 861882

SEQ ID NO: 861901 - protein, 106 aa, Homo sapiens [sequence omitted]

SEQ ID NO: 861902 - protein, 277 aa, Homo sapiens
ELNGNYNSREAVRPKTHENYGGERLAQPTAALVRLGLPLALPIRDVAAFRHSPTTDQRGAGLGGGGLIRIRRQRQARGFSRGEGVRAAAAAEAAMDDEEETYRLWKIRKTIMQLCHDRGYLVTQDELDQTLEEFKAQFGDKPSEGRPRRTDLTVLVAHNDDPTDQMFVFFPEEPKVGIKTIKVYCQRMQEENITRALIVVQQGMTPSAKQLVPEHVVMTKEEVTELLARYKLRENQLPRIQAGDPVARYFGIKRGQVVKIIRPSETAGRYITYRLVQ

SEQ ID NO: 861903 - protein, 277 aa, Homo sapiens; identical to SEQ ID NO: 861902

SEQ ID NO: 861904 - protein, 240 aa, Homo sapiens; identical to SEQ ID NO: 861882

SEQ ID NO: 861905 - protein, 665 aa, Homo sapiens
GCGRQSGSGGARGAPKMAAGGAEGGSGPGAAMGDCAEIKSQFRTREGFYKLLPGDGAARRSGPASAQTPVPPQPPQPPPGPASASGPGAAGPASSPPPAGPGPGPALPAVRLSLVRLGEPDSAGAGEPPATPAGLGSGGDRVCFNLGRELYFYPGCCRRGSQRSIDLNKPIDKRIYKGTQPTCHDFNQFTAATETISLLVGFSAGQVQYLDLIKKDTSKLFNEERLIDKTKVTYLKWLPESESLFLASHASGHLYLYNVSHPCASAPPQYSLLKQGEGFSVYAAKSKAPRNPLAKWAVGEGPLNEFAFSPDGRHLACVSQDGCLRVFHFDSMLLRGLMKSYFGGLLCVCWSPDGRYVVTGGEDDLVTVWSFTEGRVVARGHGHKSWVNAVAFDPYTTRAEEAATAAGADGERSGEEEEEEPEAAGTGSAGGAPLSPLPKAGSITYRFGSAGQDTQFCLWDLTEDVLYPHPPLARTRTLPGTPGTTPPAASSSRGGEPGPGPLPRSLSRSNSLPHPAGGGKAGGPGVAAEPGTPFSIGRFATLTLQERRDRGAEKEHKRYHSLGNISRGGSGGSGSGGEKPSGPVPRSRLDPAKVLGTALCPRIHEVPLLEPLVCKKIAQERLTVLLFLEDCIITACQEGLICTWARPGKAGISSQPGNSPSGTVV

SEQ ID NO: 861906 - protein, 628 aa, Homo sapiens
GCGRQSGSGGARGAPKMAAGGAEGGSGPGAAMGDCAEIKSQFRTREGFYKLLPGDGAARRSGPASAQTPVPPQPPQPPPGPASASGPGAAGPASSPPPAGPGPGPALPAVRLSLVRLGEPDSAGAGEPPATPAGLGSGGDRVCFNLGRELYFYPGCCRRGSQRSIDLNKPIDKRIYKGTQPTCHDFNQFTAATETISLLVGFSAGQVQYLDLIKKDTSKLFNEERLIDKTKVTYLKWLPESESLFLASHASGHLYLYNVSHPCASAPPQYSLLKQGEGFSVYAAKSKAPRNPLAKWAVGEGPLNEFAFSPDGRHLACVSQDGCLRVFHFDSMLLRGLMKSYFGGLLCVCWSPDGRYVVTGGEDDLVTVWSFTEGRVVARGHGHKSWVNAVAFDPYTTRAEEAATAAGADGERSGEEEEEEPEAAGTGSAGGAPLSPLPKAGSITYRFGSAGQDTQFCLWDLTEDVLYPHPPLARTRTLPGTPGTTPPAASSSRGGEPGPGPLPRSLSRSNSLPHPAGGGKAGGPGVAAEPGTPFSIGRFATLTLQERRDRGAEKEHKRYHSLGNISRGGSGGSGSGGEKPSGPVPRSRLDPAKSPRSAVCPSVEWAGPGVVQPSPGPHPSCPCYCLCF

SEQ ID NO: 861907 - protein, 625 aa, Homo sapiens [sequence omitted]

SEQ ID NO: 861908 - protein, 625 aa, Homo sapiens [sequence omitted]

SEQ ID NO: 861909 - protein, 625 aa, Homo sapiens [sequence omitted]

SEQ ID NO: 861910 - protein, 625 aa, Homo sapiens [sequence omitted]

SEQ ID NO: 861911 - protein, 690 aa, Homo sapiens
GCGRQSGSGGARGAPKMAAGGAEGGSGPGAAMGDCAEIKSQFRTREGFYKLLPGDGAARRSGPASAQTPVPPQPPQPPPGPASASGPGAAGPASSPPPAGPGPGPALPAVRLSLVRLGEPDSAGAGEPPATPAGLGSGGDRVCFNLGRELYFYPGCCRRGSQRSIDLNKPIDKRIYKGTQPTCHDFNQFTAATETISLLVGFSAGQVQYLDLIKKDTSKLFNEERLIDKTKVTYLKWLPESESLFLASHASGHLYLYNVSHPCASAPPQYSLLKQGEGFSVYAAKSKAPRNPLAKWAVGEGPLNEFAFSPDGRHLACVSQDGCLRVFHFDSMLLRGLMKSYFGGLLCVCWSPDGRYVVTGGEDDLVTVWSFTEGRVVARGHGHKSWVNAVAFDPYTTRAEEAATAAGADGERSGEEEEEEPEAAGTGSAGGAPLSPLPKAGSITYRFGSAGQDTQFCLWDLTEDVLYPHPPLARTRTLPGTPGTTPPAASSSRGGEPGPGPLPRSLSRSNSLPHPAGGGKAGGPGVAAEPGTPFSIGRFATLTLQERRDRGAEKEHKRYHSLGNISRGGSGGSGSGGEKPSGPVPRSRLDPAKVLGTALCPRIHEVPLLEPLVCKKIAQERLTVLLFLEDCIITACQEGLICTWARPGKAFTDEETEAQTGEGSWPRSPSKSVVEGISSQPGNSPSGTVV

SEQ ID NO: 861912 - protein, 690 aa, Homo sapiens; identical to SEQ ID NO: 861911

SEQ ID NO: 861913 - protein, 634 aa, Homo sapiens
MRSGRIRVGGGKATGRGFGVRPIGGRAGHPEAPPPPSCGPAVPPSVEKRGLGWQRARPSSFHCACARHAHPLLGRKLEKSCCKLSSPFPAPPPGQTRPPCGAGNSEGRSAGRDGECGGLQRTLETEACRSSVSGRRLRALSPPGRPVTFCVVPDGETEALSQKHTLGGGRKRGQRRRENKGRITDRREGDGHTQGDRDPSGELDLAFPAWGAGSARKKIEKSGEWGRKGGTGGGGGWGKPEGGREGGRNFPKLQNMATLPLKPETAISVPEGGLPVAPSPALPEAHALGTLSAQQPPPAAATTSSTSLPFSPDSPGLLPNFPAPPPEGLMLSPAAVPVWSAGLELSAGTEGLLEAEKGLGTQAPHTMLRLPDPDPEGLLLGATAGGEVDEGLEAEAKVLTQLQSVPVEEPLELLTQCGPVASPDIGAEDAGTGMGGGSPRNAVAEDPSHHILLPGWPLQALVVLGVVSPATSCPGLHPPLDGRPLCYSPPHAVPCHIRGGLRVLTQGPCPLHLVLAVSGTPCPRAGLPAPRALSLSLPETLLIALPIAGVVTTAWNPKVEDRQPRAPETGDPPQCGISCQGRGVGQLWGDGGLPSPAPLDSSPCPHYPAQTKDSLIPGGSPAAVSPLYPKSLFF

SEQ ID NO: 861914 - protein, 634 aa, Homo sapiens
MGGHFWPPEPYTVFMWGSPWEADSPRVKLRGREKGRQTEGGAFPLVSSALSGDPRFFSPTTPPAEPIVVRLKEVRLQRDDFEILKVIGRGAFSEVAVVKMKQTGQVYAMKIMNKWDMLKRGEVSCFREERDVLVNGDRRWITQLHFAFQDENYLYLVMEYYVGGDLLTLLSKFGERIPAEMARFYLAEIVMAIDSVHRLGYVHRDIKPDNILLDRCGHIRLADFGSCLKLRADGTVRSLVAVGTPDYLSPEILQAVGGGPGTGSYGPECDWWALGVFAYEMFYGQTPFYADSTAETYGKIVHYKEHLSLPLVDEGVPEEARDFIQRLLCPPETRLGRGGAGDFRTHPFFFGLDWDGLRDSVPPFTPDFEGATDTCNFDLVEDGLTAMETLSDIREGAPLGVHLPFVGYSYSCMALRDSEVPGPTPMELEAEQLLEPHVQAPSLEPSVSPQDETAEVAVPAAVPAAEAEAEVTLRELQEALEEEVLTRQSLSREMEAIRTDNQNFASQLREAEARNRDLEAHVRQLQERMELLQAEGATAVTGVPSPRATDPPSHLDGPPAVAVGQCPLVGPGPMHRRHLLLPARVPRPGLSEALSLLLFAVVLSRAAALGCIGLVAHAGQLTAVWRRPGAARAP

SEQ ID NO: 861915 - protein, 690 aa, Homo sapiens; identical to SEQ ID NO: 861911

SEQ ID NO: 861916 - protein, 690 aa, Homo sapiens; identical to SEQ ID NO: 861911

SEQ ID NO: 861917 - protein, 690 aa, Homo sapiens; identical to SEQ ID NO: 861911

SEQ ID NO: 861918 - protein, 669 aa, Homo sapiens
MDSTVSAVCVVGRRLRSGPIRRRVEAAEGLGGASGMRSGRIRVGGGKATGRGFGVRPIGGRAGHPEAPPPPSCGPAVPPSVEKRGLGWQRARPSSFHCACARHAHPLLGRKLEKSCCKLSSPFPAPPPGQTRPPCGAGNSEGRSAGRDGECGGLQRTLETEACRSSVSGRRLRALSPPGRPVTFCVVPDGETEALSQKHTLGGGRKRGQRRRENKGRITDRREGDGHTQGDRDPSGELDLAFPAWGAGSARKKIEKSGEWGRKGGTGGGGGWGKPEGGREGGRNFPKLQNMATLPLKPETAISVPEGGLPVAPSPALPEAHALGTLSAQQPPPAAATTSSTSLPFSPDSPGLLPNFPAPPPEGLMLSPAAVPVWSAGLELSAGTEGLLEAEKGLGTQAPHTMLRLPDPDPEGLLLGATAGGEVDEGLEAEAKVLTQLQSVPVEEPLELLTQCGPVASPDIGAEDAGTGMGGGSPRNAVAEDPSHHILLPGWPLQALVVLGVVSPATSCPGLHPPLDGRPLCYSPPHAVPCHIRGGLRVLTQGPCPLHLVLAVSGTPCPRAGLPAPRALSLSLPETLLIALPIAGVVTTAWNPKVEDRQPRAPETGDPPQCGISCQGRGVGQLWGDGGLPSPAPLDSSPCPHYPAQTKDSLIPGGSPAAVSPLYPKSLFF

SEQ ID NO: 861919 - protein, 634 aa, Homo sapiens; identical to SEQ ID NO: 861913

SEQ ID NO: 861920 - protein, 62 aa, Homo sapiens
AYEMFYGQTPFYADSTAETYGKIVHYKVSTAAGRPGLSRRRSQAIASSPSEQEHLSLPLVDE

SEQ ID NO: 861921 - protein, 625 aa, Homo sapiens [sequence omitted]

SEQ ID NO: 861922 - protein, 625 aa, Homo sapiens [sequence omitted]

SEQ ID NO: 861923 - protein, 1220 aa, Homo sapiens
EKARALLEQAAEWTHSNMGNLKSVAQEPGPPCGLGLGLGLGLCGKQGPATPAPEPSRAPASLLPPAPEHSPPSSPLTQPPEGPKFPRVKNWEVGSITYDTLSAQAQQDGPCTPRRCLGSLVFPRKLQGRPSPGPPAPEQLLSQARDFINQYYSSIKRSGSQAHEQRLQEVEAEVAATGTYQLRESELVFGAKQAWRNAPRCVGRIQWGKLQVFDARDCRSAQEMFTYICNHIKYATNRGNLRSAITVFPQRCPGRGDFRIWNSQLVRYAGYRQQDGSVRGDPANVEITELCIQHGWTPGNGRFDVLPLLLQAPDEPPELFLLPPELVLEVPLEHPTLEWFAALGLRWYALPAVSNMLLEIGGLEFPAAPFSGWYMSTEIGTRNLCDPHRYNILEDVAVCMDLDTRTTSSLWKDKAAVEINVAVLHSYQLAKVTIVDHHAATASFMKHLENEQKARGGCPADWAWIVPPISGSLTPVFHQEMVNYFLSPAFRYQPDPWKGSAAKGTGITRKKTFKEVANAVKISASLMGTVMAKRVKATILYGSETGRAQSYAQQLGRLFRKAFDPRVLCMDEYDVVSLEHETLVLVVTSTFGNGDPPENGESFAAALMEMSGPYNSSPRPEQHKSYKIRFNSISCSDPLVSSWRRKRKESSNTDSAGALGTLRFCVFGLGSRAYPHFCAFARAVDTRLEELGGERLLQLGQGDELCGQEEAFRGWAQAAFQAACETFCVGEDAKAAARDIFSPKRSWKRQRYRLSAQAEGLQLLPGLIHVHRRKMFQATIRSVENLQSSKSTRATILVRLDTGGQEGLQYQPGDHIGVCPPNRPGLVEALLSRVEDPPAPTEPVAVEQLEKGSPGGPPPGWVRDPRLPPCTLRQALTFFLDITSPPSPQLLRLLSTLAEEPREQQELEALSQDPRRYEEWKWFRCPTLLEVLEQFPSVALPAPLLLTQLPLLQPRYYSVSSAPSTHPGEIHLTVAVLAYRTQDGLGPLHYGVCSTWLSQLKPGDPVPCFIRGAPSFRLPPDPSLPCILVGPGTGIAPFRGFWQERLHDIESKGLQPTPMTLVFGCRCSQLDHLYRDEVQNAQQRGVFGRVLTAFSREPDNPKTYVQDILRTELAAEVHRVLCLERGHMFVCGDVTMATNVLQTVQRILATEGDMELDEAGDVIGVLRDQQRYHEDIFGLTLRTQEVTSRIRTQSFSLQERQLRGAVPWAFDPPGSDTNSP

SEQ ID NO: 861924 - protein, 121 aa, Homo sapiens
MVNTYVQDILRTELAAEVHRVLCLERGHMFVCGDVTMATNVLQTVQRILATEGDMELDEAGDVIGVLRDQQRYHEDIFGLTLRTQEVTSRIRTQSFSLQERQLRGAVPWAFDPPGSDTNSP

SEQ ID NO: 861925 - protein, 115 aa, Homo sapiens
MATNVLQTVQRILATEGDMELDEAGDVIGVLRVRRGGPGLSVRGFLLRSPSRVLIHCALFRQDQQRYHEDIFGLTLRTQEVTSRIRTQSFSLQERQLRGAVPWAFDPPGSDTNSP

SEQ ID NO: 861926 - protein, 121 aa, Homo sapiens
MVTTYVQDILRTELAAEVHRVLCLERGHMFVCGDVTMATNVLQTVQRILATEGDMELDEAGDVIGVLRDQQRYHEDIFGLTLRTQEVTSRIRTQSFSLQERQLRGAVPWAFDPPGSDTNSP

SEQ ID NO: 861927 - protein, 121 aa, Homo sapiens; identical to SEQ ID NO: 861924

SEQ ID NO: 861928 - protein, 1027 aa, Homo sapiens
EKARALLEQAAEWTHSNMGNLKSVAQEPGPPCGLGLGLGLGLCGKQGPATPAPEPSRAPASLLPPAPEHSPPSSPLTQPPEGPKFPRVKNWEVGSITYDTLSAQAQQDGPCTPRRCLGSLVFPRKLQGRPSPGPPAPEQLLSQARDFINQYYSSIKRSGSQAHEQRLQEVEAEVAATGTYQLRESELVFGAKQAWRNAPRCVGRIQWGKLQVFDARDCRSAQEMFTYICNHIKYATNRGNLRSAITVFPQRCPGRGDFRIWNSQLVRYAGYRQQDGSVRGDPANVEITELCIQHGWTPGNGRFDVLPLLLQAPDEPPELFLLPPELVLEVPLEHPTLEWFAALGLRWYALPAVSNMLLEIGGLEFPAAPFSGWYMSTEIGTRNLCDPHRYNILEDVAVCMDLDTRTTSSLWKDKAAVEINVAVLHSYQLAKVTIVDHHAATASFMKHLENEQKARGGCPADWAWIVPPISGSLTPVFHQEMVNYFLSPAFRYQPDPWKGSAAKGTGITRKKTFKEVANAVKISASLMGTVMAKRVKATILYGSETGRAQSYAQQLGRLFRKAFDPRVLCMDEYDVVSLEHETLVLVVTSTFGNGDPPENGESFAAALMEMSGPYNSSPRPEQHKSYKIRFNSISCSDPLVSSWRRKRKESSNTDSAGALGTLRFCVFGLGSRAYPHFCAFARAVDTRLEELGGERLLQLGQGDELCGQEEAFRGWAQAAFQAACETFCVGEDAKAAARDIFSPKRSWKRQRYRLSAQAEGLQLLPGLIHVHRRKMFQATIRSVENLQSSKSTRATILVRLDTGGQEGLQYQPGDHIGVCPPNRPGLVEALLSRVEDPPAPTEPVAVEQLEKGSPGGPPPGWVRDPRLPPCTLRQALTFFLDITSPPSPQLLRLLSTLAEEPREQQELEALSQDPRRYEEWKWFRCPTLLEVLEQFPSVALPAPLLLTQLPLLQPRYYSVSSAPSTHPGEIHLTVAVLAYRTQDGLGPLHYGVCSTWLSQLKPGDPVPCFIRGAPSFRHFTSNFLCLT

SEQ ID NO: 861929 - protein, 613 aa, Homo sapiens
EKARALLEQAAEWTHSNMGNLKSVAQEPGPPCGLGLGLGLGLCGKQGPATPAPEPSRAPASLLPPAPEHSPPSSPLTQPPEGPKFPRVKNWEVGSITYDTLSAQAQQDGPCTPRRCLGSLVFPRKLQGRPSPGPPAPEQLLSQARDFINQYYSSIKRSGSQAHEQRLQEVEAEVAATGTYQLRESELVFGAKQAWRNAPRCVGRIQWGKLQVFDARDCRSAQEMFTYICNHIKYATNRGNLRSAITVFPQRCPGRGDFRIWNSQLVRYAGYRQQDGSVRGDPANVEITELCIQHGWTPGNGRFDVLPLLLQAPDEPPELFLLPPELVLEVPLEHPTLEWFAALGLRWYALPAVSNMLLEIGGLEFPAAPFSGWYMSTEIGTRNLCDPHRYNILEDVAVCMDLDTRTTSSLWKDKAAVEINVAVLHSYQLAKVTIVDHHAATASFMKHLENEQKARGGCPADWAWIVPPISGSLTPVFHQEMVNYFLSPAFRYQPDPWKGSAAKGTGITRKKTFKEVANAVKISASLMGTVMAKRVKATILYGSETGRAQSYAQQLGRLFRKAFDPRVLCMDEYDVVSLEHETLVLVVTSTFGNGDPPENGESVSLPEVSVTTE

SEQ ID NO: 861930 - protein, 124 aa, Homo sapiens
PHTHPELFLAGASVAGRSALGVRPSRLRHQQPLRAAWLSLPVPGERLPDSGPPDQDQPRSSPLEVVPSHICPEAARIQHYSSRKEQNASFPSLGLLPRAWVRLNLEGPSQQRYPRAYCHPLPVS

SEQ ID NO: 861931 - protein, 43 aa, Homo sapiens
PTHCILPRQDPRRYEEWKWFRCPTLLEVLEQFPSVALPAPLLL

SEQ ID NO: 861932 - protein, 1220 aa, Homo sapiens; identical to SEQ ID NO: 861923

SEQ ID NO: 861933 - protein, 121 aa, Homo sapiens; identical to SEQ ID NO: 861924

SEQ ID NO: 861934 - protein, 613 aa, Homo sapiens
EKARALLEQAAEWTHSNMGNLKSVAQEPGPPCGLGLGLGLGLCGKQGPATPAPEPSRAPASLLPPAPEHSPPSSPLTQPPEGPKFPRVKNWEVGSITYDTLSAQAQQDGPCTPRRCLGSLVFPRKLQGRPSPGPPAPEQLLSQARDFINQYYSSIKRSGSQAHEQRLQEVEAEVAATGTYQLRESELVFGAKQAWRNAPRCVGRIQWGKLQVFDARDCRSAQEMFTYICNHIKYATNRGNLRSAITVFPQRCPGRGDFRIWNSQLVRYAGYRQQDGSVRGDPANVEITELCIQHGWTPGNGRFDVLPLLLQAPDEPPELFLLPPELVLEVPLEHPTLEWFAALGLRWYALPAVSNMLLEIGGLEFPAAPFSGWYMSTEIGTRNLCDPHRYNILEDVAVCMDLDTRTTSSLWKDKAAVEINVAVLHSYQLAKVTIVDHHAATASFMKHLENEQKARGGCPADWAWIVPPISGSLTPVFHQEMVNYFLSPAFRYQPDPWKGSAAKGTGITRKKTFKEVANAVKISASLMGTVMAKRVKATILYGSETGRAQSYAQQLGRLFRKAFDPRVLCMDEYDVVSLEHETLVLVVTSTFGNGDPPENGENLFTLPRLALNS

SEQ ID NO: 861935 - protein, 2350 aa, Homo sapiens
MAAVLQQVLERTELNKLPKSVQNKLEKFLADQQSEIDGLKGRHEKFKVESEQQYFEIEKRLSHSQERLVNETRECQSLRLELEKLNNQLKALTEKNKELEIAQDRNIAIQSQFTRTKEELEAEKRDLIRTNERLSQELEYLTEDVKRLNEKLKESNTTKGELQLKLDELQASDVSVKYREKRLEQEKELLHSQNTWLNTELKTKTDELLALGREKGNEILELKCNLENKKEEVSRLEEQMNGLKTSNEHLQKHVEDLLTKLKEAKEQQASMEEKFHNELNAHIKLSNLYKSAADDSEAKSNELTRAVEELHKLLKEAGEANKAIQDHLLEVEQSKDQMEKEMLEKIGRLEKELENANDLLSATKRKGAILSEEELAAMSPTAAAVAKIVKPGMKLTELYNAYVETQDQLLLEKLENKRINKYLDEIVKEVEAKAPILKRQREEYERAQKAVASLSVKLEQAMKEIQRLQEDTDKANKQSSVLERDNRRMEIQVKDLSQQIRVLLMELEEARGNHVIRDEEVSSADISSSSEVISQHLVSYRNIEELQQQNQRLLVALRELGETREREEQETTSSKITELQLKLESALTELEQLRKSRQHQMQLVDSIVRQRDMYRILLSQTTGVAIPLHASSLDDVSLASTPKRPSTSQTVSTPAPVPVIESTEAIEAKAALKQLQEIFENYKKEKAENEKIQNEQLEKLQEQVTDLRSQNTKISTQLDFASKRYEMLQDNVEGYRREITSLHERNQKLTATTQKQEQIINTMTQDLRGANEKLAVAEVRAENLKKEKEMLKLSEVRLSQQRESLLAEQRGQNLLLTNLQTIQGILERSETETKQRLSSQIEKLEHEISHLKKKLENEVEQRHTLTRNLDVQLLDTKRQLDTETNLHLNTKELLKNAQKEIATLKQHLSNMEVQVASQSSQRTGKGQPSNKEDVDDLVSQLRQTEEQVNDLKERLKTSTSNVEQYQAMVTSLEESLNKEKQVTEEVRKNIEVRLKESAEFQTQLEKKLMEVEKEKQELQDDKRRAIESMEQQLSELKKTLSSVQNEVQEALQRASTALSNEQQARRDCQEQAKIAVEAQNKYERELMLHAADVEALQAAKEQVSKMASVRQHLEETTQKAESQLLECKASWEERERMLKDEVSKCVCRCEDLEKQNRLLHDQIEKLSDKVVASVKEGVQGPLNVSLSEEGKSQEQILEILRFIRREKEIAETRFEVAQVESLRYRQRVELLERELQELQDSLNAEREKVQVTAKTMAQHEELMKKTETMNVVMETNKMLREEKERLEQDLQQMQAKVRKLELDILPLQEANAELSEKSGMLQAEKKLLEEDVKRWKARNQHLVSQQKDPDTEEYRKLLSEKEVHTKRIQQLTEEIGRLKAEIARSNASLTNNQNLIQSLKEDLNKVRTEKETIQKDLDAKIIDIQEKVKTITQVKKIGRRYKTQYEELKAQQDKVMETSAQSSGDHQEQHVSVQEMQELKETLNQAETKSKSLESQVENLQKTLSEKETEARNLQEQTVQLQSELSRLRQDLQDRTTQEEQLRQQITEKEEKTRKAIVAAKSKIAHLAGVKDQLTKENEELKQRNGALDQQKDELDVRITALKSQYEGRISRLERELREHQERHLEQRDEPQEPSNKVPEQQRQITLKTTPASGERGIASTSDPPTANIKPTPVVSTPSKVTAAAMAGNKSTPRASIRPMVTPATVTNPTTTPTATVMPTTQVESQEAMQSEGPVEHVPVFGSTSGSVRSTSPNVQPSISQPILTVQQQTQATAFVQPTQQSHPQIEPANQELSSNIVEVVQSSPVERPSTSTAVFGTVSATPSSSLPKRTREEEEDSTIEASDQVSDDTVEMPLPKKLKSVTPVGTEEEVMAEESTDGEVETQVYNQDSQDSIGEGVTQGDYTPMEDSEETSQSLQIDLGPLQSDQQTTTSSQDGQGKGDDVIVIDSDDDYEEDEEDDDDDEDDTGMGDEGEDSNEGTGSADGNDGYEADDAEGGDGTDPGTETEESMGGGEGNHRAADSQNSGEGNTGAAESSFSQEVSREQQPSSASERQAPRAPQSPRRPPHPLPPRLTIHAPPQELGPPVQRIQMTRRQSVGRGLQLTPGIGGMQQHFFDDEDRTVPSTPTLVVPHRTDGFAEAIHSPQVAGVPRFRFGPPEDMPQTSSSHSDLGQLASQGGLGMYETPLFLAHEEESGGRSVPTTPLQVAAPVTVFTESTTSDASEHASQSVPMVTTSTGTLSTTNETATGDDGDEVFVEAESEGISSEAGLEIDSQQEEEPVQASDESDLPSTSQDPPSSSSVDTSSSQPKPFRRVRLQTTLRQGVRGRQFNRQRGVSHAMGGRGGINRGNIN

SEQ ID NO: 861936 - protein, 2363 aa, Homo sapiens
MAAVLQQVLERTELNKLPKSVQNKLEKFLADQQSEIDGLKGRHEKFKVESEQQYFEIEKRLSHSQERLVNETRECQSLRLELEKLNNQLKALTEKNKELEIAQDRNIAIQSQFTRTKEELEAEKRDLIRTNERLSQELEYLTEDVKRLNEKLKESNTTKGELQLKLDELQASDVSVKYREKRLEQEKELLHSQNTWLNTELKTKTDELLALGREKGNEILELKCNLENKKEEVSRLEEQMNGLKTSNEHLQKHVEDLLTKLKEAKEQQASMEEKFHNELNAHIKLSNLYKSAADDSEAKSNELTRAVEELHKLLKEAGEANKAIQDHLLEVEQSKDQMEKEMLEKIGRLEKELENANDLLSATKRKGAILSEEELAAMSPTAAAVAKIVKPGMKLTELYNAYVETQDQLLLEKLENKRINKYLDEIVKEVEAKAPILKRQREEYERAQKAVASLSVKLEQAMKEIQRLQEDTDKANKQSSVLERDNRRMEIQVKDLSQQIRVLLMELEEARGNHVIRDEEVSSADISSSSEVISQHLVSYRNIEELQQQNQRLLVALRELGETREREEQETTSSKITELQLKLESALTELEQLRKSRQHQMQLVDSIVRQRDMYRILLSQTTGVAIPLHASSLDDVSLASTPKRPSTSQTVSTPAPVPVIESTEAIEAKAALKQLQEIFENYKKEKAENEKIQNEQLEKLQEQVTDLRSQNTKISTQLDFASKRYEMLQDNVEGYRREITSLHERNQKLTATTQKQEQIINTMTQDLRGANEKLAVAEVRAENLKKEKEMLKLSEVRLSQQRESLLAEQRGQNLLLTNLQTIQGILERSETETKQRLSSQIEKLEHEISHLKKKLENEVEQRHTLTRNLDVQLLDTKRQLDTETNLHLNTKELLKNAQKEIATLKQHLSNMEVQVASQSSQRTGKGQPSNKEDVDDLVSQLRQTEEQVNDLKERLKTSTSNVEQYQAMVTSLEESLNKEKQVTEEVRKNIEVRLKESAEFQTQLEKKLMEVEKEKQELQDDKRRAIESMEQQLSELKKTLSSVQNEVQEALQRASTALSNEQQARRDCQEQAKIAVEAQNKYERELMLHAADVEALQAAKEQVSKMASVRQHLEETTQKAESQLLECKASWEERERMLKDEVSKCVCRCEDLEKQNRLLHDQIEKLSDKVVASVKEGVQGPLNVSLSEEGKSQEQILEILRFIRREKEIAETRFEVAQVESLRYRQRVELLERELQELQDSLNAEREKVQVTAKTMAQHEELMKKTETMNVVMETNKMLREEKERLEQDLQQMQAKVRKLELDILPLQEANAELSEKSGMLQAEKKLLEEDVKRWKARNQHLVSQQKDPDTEEYRKLLSEKEVHTKRIQQLTEEIGRLKAEIARSNASLTNNQNLIQSLKEDLNKVRTEKETIQKDLDAKIIDIQEKVKTITQVKKIGRRYKTQYEELKAQQDKVMETSAQSSGDHQEQHVSVQEMQELKETLNQAETKSKSLESQVENLQKTLSEKETEARNLQEQTVQLQSELSRLRQDLQDRTTQEEQLRQQITEKEEKTRKAIVAAKSKIAHLAGVKDQLTKENEELKQRNGALDQQKDELDVRITALKSQYEGRISRLERELREHQERHLEQRDEPQEPSNKVPEQQRQITLKTTPASGERGIASTSDPPTANIKPTPVVSTPSKVTAAAMAGNKSTPRASIRPMVTPATVTNPTTTPTATVMPTTQVESQEAMQSEGPVEHVPVFGSTSGSVRSTSPNVQPSISQPILTVQQQTQATAFVQPTQQSHPQIEPANQELSSNIVEVVQSSPVERPSTSTAVFGTVSATPSSSLPKRTREEEEDSTIEASDQVSDDTVEMPLPKKLKSVTPVGTEEEVMAEESTDGEVETQVYNQDSQDSIGEGVTQGDYTPMEDSEETSQSLQIDLGPLQSDQQTTTSSQDGQGKGDDVIVIDSDDEEEDDDENDGEHEDYEEDEEDDDDDEDDTGMGDEGEDSNEGTGSADGNDGYEADDAEGGDGTDPGTETEESMGGGEGNHRAADSQNSGEGNTGAAESSFSQEVSREQQPSSASERQAPRAPQSPRRPPHPLPPRLTIHAPPQELGPPVQRIQMTRRQSVGRGLQLTPGIGGMQQHFFDDEDRTVPSTPTLVVPHRTDGFAEAIHSPQVAGVPRFRFGPPEDMPQTSSSHSDLGQLASQGGLGMYETPLFLAHEEESGGRSVPTTPLQVAAPVTVFTESTTSDASEHASQSVPMVTTSTGTLSTTNETATGDDGDEVFVEAESEGISSEAGLEIDSQQEEEPVQASDESDLPSTSQDPPSSSSVDTSSSQPKPFRRVRLQTTLRQGVRGRQFNRQRGVSHAMGGRGGINRGNIN

SEQ ID NO: 861937 - protein, 3021 aa, Homo sapiens
MAAVLQQVLERTELNKLPKSVQNKLEKFLADQQSEIDGLKGRHEKFKVESEQQYFEIEKRLSHSQERLVNETRECQSLRLELEKLNNQLKALTEKNKELEIAQDRNIAIQSQFTRTKEELEAEKRDLIRTNERLSQELEYLTEDVKRLNEKLKESNTTKGELQLKLDELQASDVSVKYREKRLEQEKELLHSQNTWLNTELKTKTDELLALGREKGNEILELKCNLENKKEEVSRLEEQMNGLKTSNEHLQKHVEDLLTKLKEAKEQQASMEEKFHNELNAHIKLSNLYKSAADDSEAKSNELTRAVEELHKLLKEAGEANKAIQDHLLEVEQSKDQMEKEMLEKIGRLEKELENANDLLSATKRKGAILSEEELAAMSPTAAAVAKIVKPGMKLTELYNAYVETQDQLLLEKLENKRINKYLDEIVKEVEAKAPILKRQREEYERAQKAVASLSVKLEQAMKEIQRLQEDTDKANKQSSVLERDNRRMEIQVKDLSQQIRVLLMELEEARGNHVIRDEEVSSADISSSSEVISQHLVSYRNIEELQQQNQRLLVALRELGETREREEQETTSSKITELQLKLESALTELEQLRKSRQHQMQLVDSIVRQRDMYRILLSQTTGVAIPLHASSLDDVSLASTPKRPSTSQTVSTPAPVPVIESTEAIEAKAALKQLQEIFENYKKEKAENEKIQNEQLEKLQEQVTDLRSQNTKISTQLDFASKRYLENYFFHTSYEMLQDNVEGYRREITSLHERNQKLTATTQKQEQIINTMTQDLRGANEKLAVAEVRAENLKKEKEMLKLSEVRLSQQRESLLAEQRGQNLLLTNLQTIQGILERSETETKQRLSSQIEKLEHEISHLKKKLENEVEQRHTLTRNLDVQLLDTKRQLDTETNLHLNTKELLKNAQKEIATLKQHLSNMEVQVASQSSQRTGKGQPSNKEDVDDLVSQLRQTEEQVNDLKERLKTSTSNVEQYQAMVTSLEESLNKEKQVTEEVRKNIEVRLKESAEFQTQLEKKLMEVEKEKQELQDDKRRAIESMEQQLSELKKTLSSVQNEVQEALQRASTALSNEQQARRDCQEQAKIAVEAQNKYERELMLHAADVEALQAAKEQVSKMASVRQHLEETTQKAESQLLECKASWEERERMLKDEVSKCVCRCEDLEKQNRLLHDQIEKLSDKVVASVKEGVQGPLNVSLSEEGKSQEQILEILRFIRREKEIAETRFEVAQVESLRYRQRVELLERELQELQDSLNAEREKVQVGILSFKKALVKSKEKHSFISLPFNVNVKFNYEVSILPKLVNFIKHLLNTEYSIVLKSKGSVTKLPGFRFYFIPLAVALGTLFNFPALSFFICNIWIIMRFNEFVHMKHLEACLVCSGCLINSSYLNLLKLWIIRVDSHSRIKDLNCYRISFSPKEQKVVKTNNQRKRSCGSEMDDNKTSLTPYPTLPPKAYLLSYFILRSYSNIPPPLEGRKLRSENIYLLLTDEYVKMTVEEETIEQGKVNNEFYGIYVFSKSYRFQNYILFNSNVSHHGNNRASSSIELILGGKGTESESLTKTAYCFSLFRFIFYSFGLQKVNTRKCPPTNEFIGGNQLLNTGRRESTSNIDYIKNNIMGRAWWLMPVIPALWEAEAGGSRGEEIETILANTVKPRLYQKYKKISWAWWWQAPVVPATREAEAGERREIREAELAVSRDHTTGLQSGRQSETPSQKKKKIIIVMECLSKHEQCSMATMKYAIALKTVGEESNTKCRRWIIITYEKEKILHRYFSKISHGQSDETMDQNERFLNKREKLRIRKHFRTNKFSAARKKRYRKVNERFGLMFLPNVNTLLVGFVASFHFCLCNSCICLKSAVRMPHRKVNVNFQNFSSQKLKLKSSLFCHEGGFELIGTGRLSTIVRCWYVYLFEMFEVTAKTMAQHEELMKKTETMNVVMETNKMLREEKERLEQDLQQMQAKVRKLELDILPLQEANAELSEKSGMLQAEKKLLEEDVKRWKARNQHLVSQQKDPDTEEYRKLLSEKEVHTKRIQQLTEEIGRLKAEIARSNASLTNNQNLIQSLKEDLNKVRTEKETIQKDLDAKIIDIQEKVKTITQVKKIGRRYKTQYEELKAQQDKVMETSAQSSGDHQEQHVSVQEMQELKETLNQAETKSKSLESQVENLQKTLSEKETEARNLQEQTVQLQSELSRLRQDLQDRTTQEEQLRQQITEKEEKTRKAIVAAKSKIAHLAGVKDQLTKENEELKQRNGALDQQKDELDVRITALKSQYEGRISRLERELREHQERHLEQRDEPQEPSNKVPEQQRQITLKTTPASGERGIASTSDPPTANIKPTPVVSTPSKVTAAAMAGNKSTPRASIRPMVTPATVTNPTTTPTATVMPTTQVESQEAMQSEGPVEHVPVFGSTSGSVRSTSPNVQPSISQPILTVQQQTQATAFVQPTQQSHPQIEPANQELSSNIVEVVQSSPVERPSTSTAVFGTVSATPSSSLPKRTREEEEDSTIEASDQVSDDTVEMPLPKKLKSVTPVGTEEEVMAEESTDGEVETQVYNQDSQDSIGEGVTQGDYTPMEDSEETSQSLQIDLGPLQSDQQTTTSSQDGQGKGDDVIVIDSDDEEEDDDENDGEHEDYEEDEEDDDDDEDDTGMGDEGEDSNEGTGSADGNDGYEADDAEGGDGTDPGTETEESMGGGEGNHRAADSQNSGEGNTGAAESSFSQEVSREQQPSSASERQAPRAPQSPRRPPHPLPPRLTIHAPPQELGPPVQRIQMTRRQSVGRGLQLTPGIGGMQQHFFDDEDRTVPSTPTLVVPHRTDGFAEAIHSPQVAGVPRFRFGPPEDMPQTSSSHSDLGQLASQGGLGMYETPLFLAHEEESGGRSVPTTPLQVAAPVTVFTESTTSDASEHASQSVPMVTTSTGTLSTTNETATGDDGDEVFVEAESEGISSEAGLEIDSQQEEEPVQASDESDLPSTSQDPPSSSSVDTSSSQPKPFRRVRLQTTLRQGVRGRQFNRQRGVSHAMGGRGGINRGNIN

SEQ ID NO: 861938 - protein, 2886 aa, Homo sapiens
MAAVLQQVLERTELNKLPKSVQNKLEKFLADQQSEIDGLKGRHEKFKVESEQQYFEIEKRLSHSQERLVNETRECQSLRLELEKLNNQLKALTEKNKELEIAQDRNIAIQSQFTRTKEELEAEKRDLIRTNERLSQELEYLTEDVKRLNEKLKESNTTKGELQLKLDELQASDVSVKYREKRLEQEKELLHSQNTWLNTELKTKTDELLALGREKGNEILELKCNLENKKEEVSRLEEQMNGLKTSNEHLQKHVEDLLTKLKEAKEQQASMEEKFHNELNAHIKLSNLYKSAADDSEAKSNELTRAVEELHKLLKEAGEANKAIQDHLLEVEQSKDQMEKEMLEKIGRLEKELENANDLLSATKRKGAILSEEELAAMSPTAAAVAKIVKPGMKLTELYNAYVETQDQLLLEKLENKRINKYLDEIVKEVEAKAPILKRQREEYERAQKAVASLSVKLEQAMKEIQRLQEDTDKANKQSSVLERDNRRMEIQVKDLSQQIRVLLMELEEARGNHVIRDEEVSSADISSSSEVISQHLVSYRNIEELQQQNQRLLVALRELGETREREEQETTSSKITELQLKLESALTELEQLRKSRQHQMQLVDSIVRQRDMYRILLSQTTGVAIPLHASSLDDVSLASTPKRPSTSQTVSTPAPVPVIESTEAIEAKAALKQLQEIFENYKKEKAENEKIQNEQLEKLQEQVTDLRSQNTKISTQLDFASKRYLENYFFHTSYEMLQDNVEGYRREITSLHERNQKLTATTQKQEQIINTMTQDLRGANEKLAVAEVRAENLKKEKEMLKLSEVRLSQQRESLLAEQRGQNLLLTNLQTIQGILERSETETKQRLSSQIEKLEHEISHLKKKLENEVEQRHTLTRNLDVQLLDTKRQLDTETNLHLNTKELLKNAQKEIATLKQHLSNMEVQVASQSSQRTGKGQPSNKEDVDDLVSQLRQTEEQVNDLKERLKTSTSNVEQYQAMVTSLEESLNKEKQVTEEVRKNIEVRLKESAEFQTQLEKKLMEVEKEKQELQDDKRRAIESMEQQLSELKKTLSSVQNEVQEALQRASTALSNEQQARRDCQEQAKIAVEAQNKYERELMLHAADVEALQAAKEQVSKMASVRQHLEETTQKAESQLLECKASWEERERMLKDEVSKCVCRCEDLEKQNRLLHDQIEKLSDKVVASVKEGVQGPLNVSLSEEGKSQEQILEILRFIRREKEIAETRFEVAQVESLRYRQRVELLERELQELQDSLNAEREKVQVGILSFKKALVKSKEKHSFISLPFNVNVKFNYEVSILPKLVNFIKHLLNTEYSIVLKSKGSVTKLPGFRFYFIPLAVALGTLFNFPALSFFICNIWIIMRFNEFVHMKHLEACLVCSGCLINSSYLNLLKLWIIRVDSHSRIKDLNCYRISFSPKEQKVVKTNNQRKRSCGSEMDDNKTSLTPYPTLPPKAYLLSYFILRSYSNIPPPLEGRKLRSENIYLLLTDEYVKMTVEEETIEQGKVNNEFYGIYVFSKSYRFQNYILFNSNVSHHGNNRASSSIELILGGKGTESESLTKTAYCFSLFRFIFYSFGLQKVNTRKCPPTNEFIGGNQLLNTGRRESTSNIDYIKNNIMGRAWWLMPVIPALWEAEAGGSRGEEIETILANTVKPRLYQKYKKISWAWWWQAPVVPATREAEAGERREIREAELAVSRDHTTGLQSGRQSETPSQKKKKIIIVMECLSKHEQCSMATMKYAIALKTVGEESNTKCRRWIIITYEKEKILHRYFSKISHGQSDETMDQNERFLNKREKLRIRKHFRTNKFSAARKKRYRKVNERFGLMFLPNVNTLLVGFVASFHFCLCNSCICLKSAVRMPHRKVNVNFQNFSSQKLKLKSSLFCHEGGFELIGTGRLSTIVRCWYVYLFEMFEVTAKTMAQHEELMKKTETMNVVMETNKMLREEKERLEQDLQQMQAKVRKLELDILPLQEANAELSEKSGMLQAEKKLLEEDVKRWKARNQHLVSQQKDPDTEEYRKLLSEKEVHTKRIQQLTEEIGRLKAEIARSNASLTNNQNLIQSLKEDLNKVRTEKETIQKDLDAKIIDIQEKVKTITQVKKIGRRYKTQYEELKAQQDKVMETSAQSSGDHQEQHVSVQEMQELKETLNQAETKSKSLESQVENLQKTLSEKETEARNLQEQTVQLQSELSRLRQDLQDRTTQEEQLRQQITEKEEKTRKAIVAAKSKIAHLAGVKDQLTKENEELKQRNGALDQQKDELDVRITALKSQYEGRISRLERELREHQERHLEQRDEPQEPSNKVPEQQRQITLKTTPASGERGIASTSDPPTANIKPTPVVSTPSKVTAAAMAGNKSTPRASIRPMVTPATVTNPTTTPTATVMPTTQVESQEAMQSEGPVEHVPVFGSTSGSVRSTSPNVQPSISQPILTVQQQTQATAFVQPTQQSHPQIEPANQELSSNIVEVVQSSPVERPSTSTAVFGTVSATPSSSLPKRTREEEEDSTIEASDQVSDDTVEMPLPKKLKSVTPVGTEEEVMAEESTDGEVETQVYNQDSQDSIGEGVTQGDYTPMEDSEETSQSLQIDLGPLQSDQQTTTSSQDGQGKGDDVIVIDSDDEEEDDDENDGEHEDYEEDEEDDDDDEDDTGMGDEGEDSNEGTGSADGNDGYEADDAEGGDGTDPGTETEESMGGGEGNHRAADSQNSGEGNTGAAESSFSQEVSREQQPSSASERQAPRAPQSPRRPPHPLPPRLTIHAPPQELGPPVQRIQMTRRQSVGRGLQLTPGIGGMQQHFFDDEDRTVPSTPTLVVPHRTDGFAEAIHSPQVAGVPRFRFGPPEDMPQTSSSHSDLGQLASQGGLGMYETPLFLAHEEESGGRSVPTTPLQVAAPVLVQKQA

SEQ ID NO: 861939 - protein, 1287 aa, Homo sapiens
MAAVLQQVLERTELNKLPKSVQNKLEKFLADQQSEIDGLKGRHEKFKVESEQQYFEIEKRLSHSQERLVNETRECQSLRLELEKLNNQLKALTEKNKELEIAQDRNIAIQSQFTRTKEELEAEKRDLIRTNERLSQELEYLTEDVKRLNEKLKESNTTKGELQLKLDELQASDVSVKYREKRLEQEKELLHSQNTWLNTELKTKTDELLALGREKGNEILELKCNLENKKEEVSRLEEQMNGLKTSNEHLQKHVEDLLTKLKEAKEQQASMEEKFHNELNAHIKLSNLYKSAADDSEAKSNELTRAVEELHKLLKEAGEANKAIQDHLLEVEQSKDQMEKEMLEKIGRLEKELENANDLLSATKRKGAILSEEELAAMSPTAAAVAKIVKPGMKLTELYNAYVETQDQLLLEKLENKRINKYLDEIVKEVEAKAPILKRQREEYERAQKAVASLSVKLEQAMKEIQRLQEDTDKANKQSSVLERDNRRMEIQVKDLSQQIRVLLMELEEARGNHVIRDEEVSSADISSSSEVISQHLVSYRNIEELQQQNQRLLVALRELGETREREEQETTSSKITELQLKLESALTELEQLRKSRQHQMQLVDSIVRQRDMYRILLSQTTGVAIPLHASSLDDVSLASTPKRPSTSQTVSTPAPVPVIESTEAIEAKAALKQLQEIFENYKKEKAENEKIQNEQLEKLQEQVTDLRSQNTKISTQLDFASKRYLENYFFHTSYEMLQDNVEGYRREITSLHERNQKLTATTQKQEQIINTMTQDLRGANEKLAVAEVRAENLKKEKEMLKLSEVRLSQQRESLLAEQRGQNLLLTNLQTIQGILERSETETKQRLSSQIEKLEHEISHLKKKLENEVEQRHTLTRNLDVQLLDTKRQLDTETNLHLNTKELLKNAQKEIATLKQHLSNMEVQVASQSSQRTGKGQPSNKEDVDDLVSQLRQTEEQVNDLKERLKTSTSNVEQYQAMVTSLEESLNKEKQVTEEVRKNIEVRLKESAEFQTQLEKKLMEVEKEKQELQDDKRRAIESMEQQLSELKKTLSSVQNEVQEALQRASTALSNEQQARRDCQEQAKIAVEAQNKYERELMLHAADVEALQAAKEQVSKMASVRQHLEETTQKAESQLLECKASWEERERMLKDEVSKCVCRCEDLEKQNRLLHDQIEKLSDKVVASVKEGVQGPLNVSLSEEGKSQEQILEILRFIRREKEIAETRFEVAQVESLRYRQRVELLERELQELQDSLNAEREKVQVGILSFKKALVKSKEKHSFISLPFNVM

SEQ ID NO: 861940 - protein, 1287 aa, Homo sapiens; identical to SEQ ID NO: 861939

SEQ ID NO: 861941 - protein, 1080 aa, Homo sapiens
MAAVLQQVLERTELNKLPKSVQNKLEKFLADQQSEIDGLKGRHEKFKVESEQQYFEIEKRLSHSQERLVNETRECQSLRLELEKLNNQLKALTEKNKELEIAQDRNIAIQSQFTRTKEELEAEKRDLIRTNERLSQELEYLTEDVKRLNEKLKESNTTKGELQLKLDELQASDVSVKYREKRLEQEKELLHSQNTWLNTELKTKTDELLALGREKGNEILELKCNLENKKEEVSRLEEQMNGLKTSNEHLQKHVEDLLTKLKEAKEQQASMEEKFHNELNAHIKLSNLYKSAADDSEAKSNELTRAVEELHKLLKEAGEANKAIQDHLLEVEQSKDQMEKEMLEKIGRLEKELENANDLLSATKRKGAILSEEELAAMSPTAAAVAKIVKPGMKLTELYNAYVETQDQLLLEKLENKRINKYLDEIVKEVEAKAPILKRQREEYERAQKAVASLSVKLEQAMKEIQRLQEDTDKANKQSSVLERDNRRMEIQVKDLSQQIRVLLMELEEARGNHVIRDEEVSSADISSSSEVISQHLVSYRNIEELQQQNQRLLVALRELGETREREEQETTSSKITELQLKLESALTELEQLRKSRQHQMQLVDSIVRQRDMYRILLSQTTGVAIPLHASSLDDVSLASTPKRPSTSQTVSTPAPVPVIESTEAIEAKAALKQLQEIFENYKKEKAENEKIQNEQLEKLQEQVTDLRSQNTKISTQLDFASKRYLENYFFHTSYEMLQDNVEGYRREITSLHERNQKLTATTQKQEQIINTMTQDLRGANEKLAVAEVRAENLKKEKEMLKLSEVRLSQQRESLLAEQRGQNLLLTNLQTIQGILERSETETKQRLSSQIEKLEHEISHLKKKLENEVEQRHTLTRNLDVQLLDTKRQLDTETNLHLNTKELLKNAQKEIATLKQHLSNMEVQVASQSSQRTGKGQPSNKEDVDDLVSQLRQTEEQVNDLKERLKTSTSNVEQYQAMVTSLEESLNKEKQVTEEVRKNIEVRLKESAEFQTQLEKKLMEVEKEKQELQDDKRRAIESMEQQLSFFHLDVSGSDATLGIILPFMYGQTSTSVTITCLYKN

SEQ ID NO: 861942 - protein, 232 aa, Homo sapiens
MQLVDSIVRQRDMYRILLSQTTGVAIPLHASSLDDVSLASTPKRPSTSQTVSTPAPVPVIESTEAIEAKAALKQLQEIFENYKKEKAENEKIQNEQLEKLQEQVTDLRSQNTKISTQLDFASKRYEMLQDNVEGYRREITSLHERNQKLTATTQKQEQIINTMTQDLRGANEKLAVAEVRAENLKKEKEMLKLSEVRLSQQRESLLAEQRGQNLLLTNLQTIQGNGNWVPSW

SEQ ID NO: 861943 - protein, 2350 aa, Homo sapiens; identical to SEQ ID NO: 861935

SEQ ID NO: 861944 - protein, 2423 aa, Homo sapiens [sequence omitted]

SEQ ID NO: 861945 - protein, 2398 aa, Homo sapiens
MYRILLSQTTGVAIPLHASSLDDVSLASTPKRPSTSQTVSTPAPVPVIESTEAIEAKAALKQLQEIFENYKKEKAENEKIQNEQLEKLQEQVTDLRSQNTKISTQLDFASKRYEMLQDNVEGYRREITSLHERNQKLTATTQKQEQIINTMTQDLRGANEKLAVAEVRAENLKKEKEMLKLSEVRLSQQRESLLAEQRGQNLLLTNLQTIQGILERSETETKQRLSSQIEKLEHEISHLKKKLENEVEQRHTLTRNLDVQLLDTKRQLDTETNLHLNTKELLKNAQKEIATLKQHLSNMEVQVASQSSQRTGKGQPSNKEDVDDLVSQLRQTEEQVNDLKERLKTSTSNVEQYQAMVTSLEESLNKEKQVTEEVRKNIEVRLKESAEFQTQLEKKLMEVEKEKQELQDDKRRAIESMEQQLSELKKTLSSVQNEVQEALQRASTALSNEQQARRDCQEQAKIAVEAQNKYERELMLHAADVEALQAAKEQVSKMASVRQHLEETTQKAESQLLECKASWEERERMLKDEVSKCVCRCEDLEKQNRLLHDQIEKLSDKVVASVKEGVQGPLNVSLSEEGKSQEQILEILRFIRREKEIAETRFEVAQVESLRYRQRVELLERELQELQDSLNAEREKVQVGILSFKKALVKSKEKHSFISLPFNCNVKFNYEVSILLNFKFIKHLLNTEYSIVLKSKGSVTKLPGFRFYFIPLAVALGTLFNFPALSFFICNIWIIMRFNEFVHMKHLEACLVCSGCLINSSYLNLLKLWIIRVDSHSRIKDLNCYRISFSPKEQKVVKTNNQRKRSCGSEMDDNKTSLTPYPTLPPKAYLLSYFILRSYSNIPPPLEGRKLRSENIYLLLTDESVKMTVEEETIEQGKVNNEFYGIYVFSKSYRFQNYILFNSNVSHHGNNRASSSIELILGGKGTESESLTKTAYCFSLFRFIFYSFGLYKVNTRKCPPTNEFIGGNQLLNTGRRESTSNIDYIKNNIMGRAWWLMPVIPALWEAEAGGSRGEEIETILANTVKPRLYQKYKKISWAWWWQAPVVPATREAEAGERREIREAELAVSRDHTTGLQSGRQSETPSQKKKKIIIVMECLSKHEQCSMATMKYAIALKTVGEESNTKCRRWIIITYEKEKILHRYFSKISHGQSDETMDQNERFLNKREKLRIRKHFRTNKFSAARKKRYRKVNERFGLMFLPNVNTLLVGFVASFHFCLCNSCICLKSAVRMPHRKVNVNFQNFSSQKLKLKSSLFCHKGGFELIGTGRLSTIVRCWYVYLFEMFEVTAKTMAQHEELMKKTETMNVVMETNKMLREEKERLEQDLQQMQAKVRKLELDILPLQEANAELSEKSGMLQAEKKLLEEDVKRWKARNQHLVSQQKDPDTEEYRKLLSEKEVHTKRIQQLTEEIGRLKAEIARSNASLTNNQNLIQSLKEDLNKVRTEKETIQKDLDAKIIDIQEKVKTITQVKKIGRRYKTQYEELKAQQDKVMETSAQSSGDHQEQHVSVQEMQELKETLNQAETKSKSLESQVENLQKTLSEKETEARNLQEQTVQLQSELSRLRQDLQDRTTQEEQLRQQITEKEEKTRKAIVAAKSKIAHLAGVKDQLTKENEELKQRNGALDQQKDELDVRITALKSQYEGRISRLERELREHQERHLEQRDEPQEPSNKVPEQQRQITLKTTPASGERGIASTSDPPTANIKPTPVVSTPSKVTAAAMAGNKSTPRASIRPMVTPATVTNPTTTPTATVMPTTQVESQEAMQSEGPVEHVPVFGSTSGSVRSTSPNVQPSISQPILTVQQQTQATAFVQPTQQSHPQIEPANQELSSNIVEVVQSSPVERPSTSTAVFGTVSATPSSSLPKRTREEEEDSTIEASDQVSDDTVEMPLPKKLKSVTPVGTEEEVMAEESTDGEVETQVYNQDSQDSIGEGVTQGDYTPMEDSEETSQSLQIDLGPLQSDQQTTTSSQDGQGKGDDVIVIDSDDEEEDDDENDGEHEDYEEDEEDDDDDEDDTGMGDEGEDSNEGTGSADGNDGYEADDAEGGDGTDPGTETEESMGGGEGNHRAADSQNSGEGNTGAAESSFSQEVSREQQPSSASERQAPRAPQSPRRPPHPLPPRLTIHAPPQELGPPVQRIQMTRRQSVGRGLQLTPGIGGMQQHFFDDEDRTVPSTPTLVVPHRTDGFAEAIHSPQVAGVPRFRFGPPEDMPQTSSSHSDLGQLASQGGLGMYETPLFLAHEEESGGRSVPTTPLQVAAPVTVFTESTTSDASEHASQSVPMVTTSTGTLSTTNETATGDDGDEVFVEAESEGISSEAGLEIDSQQEEEPVQASDESDLPSTSQDPPSSSSVDTSSSQPKPFRRVRLQTTLRQGVRGRQFNRQRGVSHAMGGRGGINRGNIN

SEQ ID NO: 861946 - protein, 1287 aa, Homo sapiens; identical to SEQ ID NO: 861939

SEQ ID NO: 861947 - protein, 1287 aa, Homo sapiens; identical to SEQ ID NO: 861939

SEQ ID NO: 861948 - protein, 1108 aa, Homo sapiens
MAQHEELMKKTETMNVVMETNKMLREEKERLEQDLQQMQAKVRKLELDILPLQEANAELSEKSGMLQAEKKLLEEDVKRWKARNQHLVSQQKDPDTEEYRKLLSEKEVHTKRIQQLTEEIGRLKAEIARSNASLTNNQNLIQSLKEDLNKVRTEKETIQKDLDAKIIDIQEKVKTITQVKKIGRRYKTQYEELKAQQDKVMETSAQSSGDHQEQHVSVQEMQELKETLNQAETKSKSLESQVENLQKTLSEKETEARNLQEQTVQLQSELSRLRQDLQDRTTQEEQLRQQITEKEEKTRKAIVAAKSKIAHLAGVKDQLTKENEELKQRNGALDQQKDELDVRITALKSQYEGRISRLERELREHQERHLEQRDEPQEPSNKVPEQQRQITLKTTPASGERGIASTSDPPTANIKPTPVVSTPSKVTAAAMAGNKSTPRASIRPMVTPATVTNPTTTPTATVMPTTQVESQEAMQSEGPVEHVPVFGSTSGSVRSTSPNVQPSISQPILTVQQQTQATAFVQPTQQSHPQIEPANQELSSNIVEVVQSSPVERPSTSTAVFGTVSATPSSSLPKRTREEEEDSTIEASDQVSDDTVEMPLPKKLKSVTPVGTEEEVMAEESTDGEVETQVYNQDSQDSIGEGVTQGDYTPMEDSEETSQSLQIDLGPLQSDQQTTTSSQDGQGKGDDVIVIDSDDEEEDDDENDGEHEDYEEDEEDDDDDEDDTGMGDEGEDSNEGTGSADGNDGYEADDAEGGDGTDPGTETEESMGGGEGNHRAADSQNSGEGNTGAAESSFSQEVSREQQPSSASERQAPRAPQSPRRPPHPLPPRLTIHAPPQELGPPVQRIQMTRRQSVGRGLQLTPGIGGMQQHFFDDEDRTVPSTPTLVVPHRTDGFAEAIHSPQVAGVPRFRFGPPEDMPQTSSSHSDLGQLASQGGLGMYETPLFLAHEEESGGRSVPTTPLQVAAPVTVFTESTTSDASEHASQSVPMVTTSTGTLSTTNETATGDDGDEVFVEAESEGISSEAGLEIDSQQEEEPVQASDESDLPSTSQDPPSSSSVDTSSSQPKPFRRVRLQTTLRQGVRGRQFNRQRGVSHAMGGRGGINRGNIN

SEQ ID NO: 861949 - protein, 261 aa, Homo sapiens
MTRRQSVGRGLQLTPGIGGMQQHFFDDEDRTVPSTPTLVVPHRTDGFAEAIHSPQVAGVPRFRFGPPEDMPQTSSSHSDLGQLASQGGLGMYETPLFLAHEEESGGRSVPTTPLQVAAPVTVFTESTTSDASEHASQSVPMVTTSTGTLSTTNETATGDDGDEVFVEAESEGISSEAGLEIDSQQEEEPVQASDESDLPSTSQDPPSSSSVDTSSSQPKPFRRVRLQTTLRQGVRGRQFNRQRGVSHAMGGRGGINRGNIN

SEQ ID NO: 861950 - protein, 832 aa, Homo sapiens
MAAVLQQVLERTELNKLPKSVQNKLEKFLADQQSEIDGLKGRHEKFKVESEQQYFEIEKRLSHSQERLVNETRECQSLRLELEKLNNQLKALTEKNKELEIAQDRNIAIQSQFTRTKEELEAEKRDLIRTNERLSQELEYLTEDVKRLNEKLKESNTTKGELQLKLDELQASDVSVKYREKRLEQEKELLHSQNTWLNTELKTKTDELLALGREKGNEILELKCNLENKKEEVSRLEEQMNGLKTSNEHLQKHVEDLLTKLKEAKEQQASMEEKFHNELNAHIKLSNLYKSAADDSEAKSNELTRAVEELHKLLKEAGEANKAIQDHLLEVEQSKDQMEKEMLEKIGRLEKELENANDLLSATKRKGAILSEEELAAMSPTAAAVAKIVKPGMKLTELYNAYVETQDQLLLEKLENKRINKYLDEIVKEVEAKAPILKRQREEYERAQKAVASLSVKLEQAMKEIQRLQEDTDKANKQSSVLERDNRRMEIQVKDLSQQIRVLLMELEEARGNHVIRDEEVSSADISSSSEVISQHLVSYRNIEELQQQNQRLLVALRELGETREREEQETTSSKITELQLKLESALTELEQLRKSRQHQMQLVDSIVRQRDMYRILLSQTTGVAIPLHASSLDDVSLASTPKRPSTSQTVSTPAPVPVIESTEAIEAKAALKQLQEIFENYKKEKAENEKIQNEQLEKLQEQVTDLRSQNTKISTQLDFASKRYEMLQDNVEGYRREITSLHERNQKLTATTQKQEQIINTMTQDLRGANEKLAVAEVRAENLKKEKEMLKLSEVRLSQQRESLLAEQRGQNLLLTNLQTIQGNGNWVPSW

SEQ ID NO: 861951 - protein, 149 aa, Homo sapiens
VGERELLGCRRALQDPAAREGSPGGTQLQGQGAMTFRSGGGDALGKAACLVPAASRPQSPILQMTSREVTPQVGNRAGFGIRVCLFPPRDPESWQPVSKLLYVHHTSGFRFIGVFLKLRLVSVQLLLVRHLSYTRHCPWCWRHSNEEDR

SEQ ID NO: 861952 - protein, 477 aa, Homo sapiens
MSWVQATLLARGLCRAWGGTCGAALTGTSISQVPRRLPRGLHCSAAAHSSEQSLVPSPPEPRQRPTKALVPFEDLFGQAPGGERDKASFLQTVQKFAEHSVRKRGHIDFIYLALRKMREYGVERDLAVYNQLLNIFPKEVFRPRNIIQRIFVHYPRQQECGIAVLEQMENHGVMPNKETEFLLIQIFGRKSYPMLKLVRLKLWFPRFMNVNPFPVPRDLPQDPVELAMFGLRHMEPDLSARVTIYQVPLPKDSTGAADPPQPHIVGIQSPDQQAALARHNPARPVFVEGPFSLWLRNKCVYYHILRADLLPPEERVRAESKACVGAGEWAGTTLRVHGRGWRRETERALASDPACTPHLGEEVEETPEEWNLYYPMQLDLEYVRSGWDNYEFDINEVEEGPVFAMCMAGAHDQATMAKWIQGLQETNPTLAQIPVVFRLAGSTRELQTSSAGLEEPPLPEDHQEEDDNLQRQQQGQS

SEQ ID NO: 861953 - protein, 300 aa, Homo sapiens
MSWVQATLLARGLCRAWGGTCGAALTGTSISQVPRRLPRGLHCSAAAHSSEQSLVPSPPEPRQRPTKALVPFEDLFGQAPGGERDKASFLQTVQKFAEHSVRKRGHIDFIYLALRKMREYGVERDLAVYNQLLNIFPKEVFRPRNIIQRIFVHYPRQQECGIAVLEQMENHGVMPNKETEFLLIQIFGRKSYPMLKLVRLKLWFPRFMNVNPFPVPRDLPQDPVELAMFGLRHMEPDLSARVTIYQVPLPKDSTGAADPPQPHIVGIQSPDQQAALARHNPARPVFVEGPFSLWLRNKCV

SEQ ID NO: 861954 - protein, 279 aa, Homo sapiens
MSWVQATLLARGLCRAWGGTCGAALTGTSISQVPRRLPRGLHCSAAAHSSEQSLVPSPPEPRQRPTKALVPFEDLFGQAPGGERDKASFLQTVQKFAEHSVRKRGHIDFIYLALRKMREYGVERDLAVYNQLLNIFPKEVFRPRNIIQRIFVHYPRQQECGIAVLEQMENHGVMPNKETEFLLIQIFGRKSYPMLKLVRLKLWFPRFMNVNPFPVPRDLPQDPVELAMFGLRHMEPDLSARVTIYQAPCAAPDAARLPPQRFLCPKTQQVQQIPPSPTS

SEQ ID NO: 861955 - protein, 315 aa, Homo sapiens
MREYGVERDLAVYNQLLNIFPKEVFRPRNIIQRIFVHYPRQQECGIAVLEQMENHGVMPNKETEFLLIQIFGRKSYPMLKLVRLKLWFPRFMNVNPFPVPRDLPQDPVELAMFGLRHMEPDLSARVTIYQVPLPKDSTGAADPPQPHIVGIQSPDQQAALARHNPARPVFVEGPFSLWLRNKCVYYHILRADLLPPEEREVEETPEEWNLYYPMQLDLEYVRSGWDNYEFDINEVEEGPVFAMCMAGAHDQATMAKWIQGLQETNPTLAQIPVVFRLAGSTRELQTSSAGLEEPPLPEDHQEEDDNLQRQQQGQS

SEQ ID NO: 861956 - protein, 431 aa, Homo sapiens
MSWVQATLLARGLCRAWGGTCGAALTGTSISQVPRRLPRGLHCSAAAHSSEQSLVPSPPEPRQRPTKALVPFEDLFGQAPGGERDKASFLQTVQKFAEHSVRKRGHIDFIYLALRKMREYGVERDLAVYNQLLNIFPKEVFRPRNIIQRIFVHYPRQQECGIAVLEQMENHGVMPNKETEFLLIQIFGRKSYPMLKLVRLKLWFPRFMNVNPFPVPRDLPQDPVELAMFGLRHMEPDLSARVTIYQVPLPKDSTGAADPPQPHIVGIQSPDQQAALARHNPARPVFVEGPFSLWLRNKCVYYHILRADLLPPEEREVEETPEEWNLYYPMQLDLEYVRSGWDNYEFDINEVEEGPVFAMCMAGAHDQATMAKWIQGLQETNPTLAQIPVVFRLAGSTRELQTSSAGLEEPPLPEDHQEEDDNLQRQQQGQS

SEQ ID NO: 861957 - protein, 431 aa, Homo sapiens; identical to SEQ ID NO: 861956

SEQ ID NO: 861958 - protein, 362 aa, Homo sapiens
MREYGVERDLAVYNQLLNIFPKEVFRPRNIIQRIFVHYPRQQECGIAVLEQMENHGVMPNKETEFLLIQIFGRKSYPMLKLVRLKLWFPRFMNVNPFPVPRDLPQDPVELAMFGLRHMEPDLSARVTIYQVPLPKDSTGAADPPQPHIVGKSESMGAAKSLTLPRPCQVLAGPEAGLPGPLGRVPCRAQGMYVSTPGIQSPDQQAALARHNPARPVFVEGPFSLWLRNKCVYYHILRADLLPPEEREVEETPEEWNLYYPMQLDLEYVRSGWDNYEFDINEVEEGPVFAMCMAGAHDQATMAKWIQGLQETNPTLAQIPVVFRLAGSTRELQTSSAGLEEPPLPEDHQEEDDNLQRQQQGQS

SEQ ID NO: 861959 - protein, 172 aa, Homo sapiens [sequence omitted]

SEQ ID NO: 861960 - protein, 217 aa, Homo sapiens
MSWVQATLLARGLCRAWGGTCGAALTGTSISQVPLPKDSTGAADPPQPHIVGIQSPDQQAALARHNPARPVFVEGPFSLWLRNKCVYYHILRADLLPPEEREVEETPEEWNLYYPMQLDLEYVRSGWDNYEFDINEVEEGPVFAMCMAGAHDQATMAKWIQGLQETNPTLAQIPVVFRLAGSTRELQTSSAGLEEPPLPEDHQEEDDNLQRQQQGQS

SEQ ID NO: 861961 - protein, 102 aa, Homo sapiens
MQLDLEYVRSGWDNYEFDINEVEEGPVFAMCMAGAHDQATMAKWIQGLQETNPTLAQIPVVFRLAGSTRELQTSSAGLEEPPLPEDHQEEDDNLQRQQQGQS

SEQ ID NO: 861962 - protein, 398 aa, Homo sapiens
MPFECTANQCFPAWGFLPSFHDQATMAKWIQGLQETNPTLAQIPVVFRLAGSTRELQNLQAPLVLRIQIKRGGSAVGCAQKKKKKNKKKQKKKNKKKNKKEQNNKKEERETTQQQKKTHIKKDQHKTKTKHTTKRIKKRKKTRKEEERREFSIKRGKEGKDQDTKKNEDSGQQKRDTGESNGRKKRSITASRGELKHKRGEHTQTTTETSALKQKPTKEEEKSNSTKEAKNVTKGMNKQNKTVEKIGADRRKNRNRGVIKRRESSGDGERRTGVRAAAGRKSGEKRGEVGEGEGKAGAGATGRRKREEVRSRGGRGERWRDRRQQDDERHRKDGDSKSNAKYRRAEKEEESDTRLQSKTDRREKQGKRTARGRQWHKTSGEDERKRDEDPRGHQRARN

SEQ ID NO: 861963 - protein, 431 aa, Homo sapiens; identical to SEQ ID NO: 861956

SEQ ID NO: 861964 - protein, 296 aa, Homo sapiens
MSWVQATLLARGLCRAWGGTCGAALTGTSISQVPRRLPRGLHCSAAAHSSEQSLVPSPPEPRQRPTKALVPFEDLFGQAPGGERDKASFLQTVQKFAEHSVRKRGHIDFIYLALRKMREYGVERDLAVYNQLLNIFPKEVFRPRNIIQRIFVHYPRQQECGIAVLEQMENHGVMPNKETEFLLIQIFGRKSYPMLKLVRLKLWFPRFMNVNPFPVPRDLPQDPVELAMFGLRHMEPDLSARVTIYQVPLPKDSTGAADPPQPHIVGSGRDAGGVEPLLPDAAGPGVCEEWLGQLRV

SEQ ID NO: 861965 - protein, 478 aa, Homo sapiens
MSWVQATLLARGLCRAWGGTCGAALTGTSISQVPRRLPRGLHCSAAAHSSEQSLVPSPPEPRQRPTKALVPFEDLFGQAPGGERDKASFLQTVQKFAEHSVRKRGHIDFIYLALRKMREYGVERDLAVYNQLLNIFPKEVFRPRNIIQRIFVHYPRQQECGIAVLEQMENHGVMPNKETEFLLIQIFGRKSYPMLKLVRLKLWFPRFMNVNPFPVPRDLPQDPVELAMFGLRHMEPDLSARVTIYQVPLPKDSTGAADPPQPHIVGKSESMGAAKSLTLPRPCQVLAGPEAGLPGPLGRVPCRAQGMYVSTPGIQSPDQQAALARHNPARPVFVEGPFSLWLRNKCVYYHILRADLLPPEEREVEETPEEWNLYYPMQLDLEYVRSGWDNYEFDINEVEEGPVFAMCMAGAHDQATMAKWIQGLQETNPTLAQIPVVFRLAGSTRELQTSSAGLEEPPLPEDHQEEDDNLQRQQQGQS

SEQ ID NO: 861966 - protein, 361 aa, Homo sapiens
MSWVQATLLARGLCRAWGGTCGAALTGTSISQVPRRLPRGLHCSAAAHSSEQSLVPSPPEPRQRPTKALVPFEDLFGQAPGGERDKASFLQTVQKFAEHSVRKRGHIDFIYLALRKMREYGVERDLAVYNQLLNIFPKEVFRPRNIIQRIFVHYPRQQECGIAVLEQMENHGVMPNKETEFLLIQIFGRKSYPMLKLVRLKLWFPRFMNVNPFPVPRDLPQDPVELAMFGLRHMEPDLSARVTIYQVPLPKDSTGAADPPQPHIVGIQSPDQQAALARHNPARPVFVEGPFSLWLRNKCVYYHILRADLLPPEEREVEETPEEWNLYYPMQLDLEYVRSGWDNYEFDINEAWSCPIHGSLL

SEQ ID NO: 861967 - protein, 431 aa, Homo sapiens; identical to SEQ ID NO: 861956

SEQ ID NO: 861968 - protein, 500 aa, Homo sapiens
VGERELLGCRRALQDPAAREGSPGGTQLQGQGAMTFRSGGGDALGKAACLVPAASRPQSPIFADDLARGHAASRQPGRIWNPRLPFSPKRPRILAAGFKAVVPRRLPRGLHCSAAAHSSEQSLVPSPPEPRQRPTKALVPFEDLFGQAPGGERDKASFLQTVQKFAEHSVRKRGHIDFIYLALRKMREYGVERDLAVYNQLLNIFPKEVFRPRNIIQRIFVHYPRQQECGIAVLEQMENHGVMPNKETEFLLIQIFGRKSYPMLKLVRLKLWFPRFMNVNPFPVPRDLPQDPVELAMFGLRHMEPDLSARVTIYQVPLPKDSTGAADPPQPHIVGIQSPDQQAALARHNPARPVFVEGPFSLWLRNKCVYYHILRADLLPPEEREVEETPEEWNLYYPMQLDLEYVRSGWDNYEFDINEVEEGPVFAMCMAGAHDQATMAKWIQGLQETNPTLAQIPVVFRLAGSTRELQTSSAGLEEPPLPEDHQEEDDNLQRQQQGQS

SEQ ID NO: 861969 - protein, 315 aa, Homo sapiens; identical to SEQ ID NO: 861955

SEQ ID NO: 861970 - protein, 237 aa, Homo sapiens
MVSSGTWLCTTSCSTSSPRRSSGLATSSSASSSTTLGSRSVGLLSWSRWRTTVPLPKDSTGAADPPQPHIVGIQSPDQQAALARHNPARPVFVEGPFSLWLRNKCVYYHILRADLLPPEEREVEETPEEWNLYYPMQLDLEYVRSGWDNYEFDINEVEEGPVFAMCMAGAHDQATMAKWIQGLQETNPTLAQIPVVFRLAGSTRELQTSSAGLEEPPLPEDHQEEDDNLQRQQQGQS

SEQ ID NO: 861971 - protein, 102 aa, Homo sapiens; identical to SEQ ID NO: 861961

SEQ ID NO: 861972 - protein, 109 aa, Homo sapiens
MRPPQMFSATFRKWNGGSLSIAAHRPPGSGNRIPACPFLTTLQIPLQPLPQTRCRNERSRIITSHRHSSSPRCPSGKRLEMRRMGVPSVRGLGGMCTCLSSPSGQGARG

SEQ ID NO: 861973 - protein, 167 aa, Homo sapiens
MPKRKKQNHHQPPTQQQPPLPEREETGDEEDGSPIALHRGPPGSRGPLIPPLLSLPPPPWGRGPIRRGLGPRSSPYGRGWWGVNAEPPFPGPGHGGPTRGSFHKEQRNPRRLKSWSLIKNTCPPKDDPQVMEDKSDRPVCRHFAKKGHCRYEDLCAFYHPGVNGPPL

SEQ ID NO: 861974 - protein, 167 aa, Homo sapiens; identical to SEQ ID NO: 861973

SEQ ID NO: 861975 - protein, 121 aa, Homo sapiens
MRPPQMFSATFRKWNGGSLSIAAHRPPGSGNRIPACPFLTTLQIPLQPLPQTRCRNERSRIITSHRHSSSPRCPSGKRLEMRRMGVPSDHPAFWALPPWPMENLATLSQPQTGYHPHVHHQ

SEQ ID NO: 861976 - protein, 121 aa, Homo sapiens; identical to SEQ ID NO: 861975

SEQ ID NO: 861977 - protein, 104 aa, Homo sapiens
MPKRKKQNHHQPPTQQQPPLPEREETGDEEDGSPIGPPSLLGPPPMANGKPGDPKSGEEEGALILVLGRREDSKGGDKTQEGLKNKRSGIPSLNEWREVVYLLI

SEQ ID NO: 861978 - protein, 121 aa, Homo sapiens; identical to SEQ ID NO: 861975

SEQ ID NO: 861979 - protein, 188 aa, Homo sapiens
MPKRKKQNHHQPPTQQQPPLPEREETGDEEDGSPIGPPSLLGPPPMANGKPGDPKSALHRGPPGSRGPLIPPLLSLPPPPWGRGPIRRGLGPRSSPYGRGWWGVNAEPPFPGPGHGGPTRGSFHKEQRNPRRLKSWSLIKNTCPPKDDPQVMEDKSDRPVCRHFAKKGHCRYEDLCAFYHPGVNGPPL

SEQ ID NO: 861980 - protein, 167 aa, Homo sapiens; identical to SEQ ID NO: 861973

SEQ ID NO: 861981 - protein, 107 aa, Homo sapiens [sequence omitted]

SEQ ID NO: 861982 - protein, 143 aa, Homo sapiens
MANGKPGDPKSALHRGPPGSRGPLIPPLLSLPPPPWGRGPIRRGLGPRSSPYGRGWWGVNAEPPFPGPGHGGPTRGSFHKEQRNPRRLKSWSLIKNTCPPKDDPQVMEDKSDRPVCRHFAKKGHCRYEDLCAFYHPGVNGPPL

SEQ ID NO: 861983 - protein, 154 aa, Homo sapiens
GGAYYLGERGLDTLRLYYKAPGLTLVESRDCVQVAGLHRGHGQRSLGEGGGLRVLGADLLGPKFLVGTMIRSRFTDHKCKSGREGKPKRDKDFWGEVKGHEVVPAAVTIVTEDRMWRSYGATVLFSGPLAREPVDSVTHSEELVVVFSSEGRKE

SEQ ID NO: 861984 - protein, 1305 aa, Homo sapiens
NSRARRPVDELEGRRARGRAPGPHPSQHPAPRALPAGSSRSHGAGAAVSTMELAALCRWGLLLALLPPGAASTQVCTGTDMKLRLPASPETHLDMLRHLYQGCQVVQGNLELTYLPTNASLSFLQDIQEVQGYVLIAHNQVRQVPLQRLRIVRGTQLFEDNYALAVLDNGDPLNNTTPVTGASPGGLRELQLRSLTEILKGGVLIQRNPQLCYQDTILWKDIFHKNNQLALTLIDTNRSRACHPCSPMCKGSRCWGESSEDCQSLTRTVCAGGCARCKGPLPTDCCHEQCAAGCTGPKHSDCLACLHFNHSGICELHCPALVTYNTDTFESMPNPEGRYTFGASCVTACPYNYLSTDVGSCTLVCPLHNQEVTAEDGTQRCEKCSKPCARVCYGLGMEHLREVRAVTSANIQEFAGCKKIFGSLAFLPESFDGDPASNTAPLQPEQLQVFETLEEITGYLYISAWPDSLPDLSVFQNLQVIRGRILHNGAYSLTLQGLGISWLGLRSLRELGSGLALIHHNTHLCFVHTVPWDQLFRNPHQALLHTANRPEDECVGEGLACHQLCARGHCWGPGPTQCVNCSQFLRGQECVEECRVLQGLPREYVNARHCLPCHPECQPQNGSVTCFGPEADQCVACAHYKDPPFCVARCPSGVKPDLSYMPIWKFPDEEGACQPCPINCTHSCVDLDDKGCPAEQRASPLTSIISAVVGILLVVVLGVVFGILIKRRQQKIRKYTMRRLLQETELVEPLTPSGAMPNQAQMRILKETELRKVKVLGSGAFGTVYKGIWIPDGENVKIPVAIKVLRENTSPKANKEILDEAYVMAGVGSPYVSRLLGICLTSTVQLVTQLMPYGCLLDHVRENRGRLGSQDLLNWCMQIAKGMSYLEDVRLVHRDLAARNVLVKSPNHVKITDFGLARLLDIDETEYHADGGKVPIKWMALESILRRRFTHQSDVWSYGVTVWELMTFGAKPYDGIPAREIPDLLEKGERLPQPPICTIDVYMIMVKCWMIDSECRPRFRELVSEFSRMARDPQRFVVIQNEDLGPASPLDSTFYRSLLEDDDMGDLVDAEEYLVPQQGFFCPDPAPGAGGMVHHRHRSSSTRSGGGDLTLGLEPSEEEAPRSPLAPSEGAGSDVFDGDLGMGAAKGLQSLPTHDPSPLQRYSEDPTVPLPSETDGYVAPLTCSPQPEYVNQPDVRPQPPSPREGPLPAARPAGATLERPKTLSPGKNGVVKDVFAFGGAVENPEYLTPQGGAAPQPHPPPAFSPAFDNLYYWDQDPPERGAPPSTFKGTPTAENPEYLGLDVPV

SEQ ID NO: 861985 - protein, 112 aa, Homo sapiens
MWLGALPKISKYWGTPGRPWGVAVFLFQPHSASPSQDIQEVQGYVLIAHNQVRQVPLQRLRIVRGTQLFEDNYALAVLDNGDQERPEGRGGRERQEQAVGKKEDRNNRFQRC

SEQ ID NO: 861986 - protein, 1255 aa, Homo sapiens [sequence omitted]

SEQ ID NO: 861987 - protein, 1255 aa, Homo sapiens [sequence omitted]

SEQ ID NO: 861988 - protein, 1396 aa, Homo sapiens
NSRARRPVDELEGRRARGRAPGPHPSQHPAPRALPAGSSRSHGAGAAVSTMELAALCRWGLLLALLPPGAASTQVCTGTDMKLRLPASPETHLDMLRHLYQGCQVVQGNLELTYLPTNASLSFLQDIQEVQGYVLIAHNQVRQVPLQRLRIVRGTQLFEDNYALAVLDNGDPLNNTTPVTGASPGGLRELQLRSLTEILKGGVLIQRNPQLCYQDTILWKDIFHKNNQLALTLIDTNRSRACHPCSPMCKGSRCWGESSEDCQSLTRTVCAGGCARCKGPLPTDCCHEQCAAGCTGPKHSDCLACLHFNHSGICELHCPALVTYNTDTFESMPNPEGRYTFGASCVTACPYNYLSTDVGSCTLVCPLHNQEVTAEDGTQRCEKCSKPCARGTHSLPPRPAAVPVPLRMQPGPAHPVLSFLRPSWDLVSAFYSLPLAPLSPTSVPISPVSVGRGPDPDAHVAVDLSRYEAETAPSPPTPTSSVCYGLGMEHLREVRAVTSANIQEFAGCKKIFGSLAFLPESFDGDPASNTAPLQPEQLQVFETLEEITGYLYISAWPDSLPDLSVFQNLQVIRGRILHNGAYSLTLQGLGISWLGLRSLRELGSGLALIHHNTHLCFVHTVPWDQLFRNPHQALLHTANRPEDECVGEGLACHQLCARGHCWGPGPTQCVNCSQFLRGQECVEECRVLQGLPREYVNARHCLPCHPECQPQNGSVTCFGPEADQCVACAHYKDPPFCVARCPSGVKPDLSYMPIWKFPDEEGACQPCPINCTHSCVDLDDKGCPAEQRASPLTSIISAVVGILLVVVLGVVFGILIKRRQQKIRKYTMRRLLQETELVEPLTPSGAMPNQAQMRILKETELRKVKVLGSGAFGTVYKGIWIPDGENVKIPVAIKVLRENTSPKANKEILDEAYVMAGVGSPYVSRLLGICLTSTVQLVTQLMPYGCLLDHVRENRGRLGSQDLLNWCMQIAKGMSYLEDVRLVHRDLAARNVLVKSPNHVKITDFGLARLLDIDETEYHADGGKVPIKWMALESILRRRFTHQSDVWSYGVTVWELMTFGAKPYDGIPAREIPDLLEKGERLPQPPICTIDVYMIMVKCWMIDSECRPRFRELVSEFSRMARDPQRFVVIQNEDLGPASPLDSTFYRSLLEDDDMGDLVDAEEYLVPQQGFFCPDPAPGAGGMVHHRHRSSSTRSGGGDLTLGLEPSEEEAPRSPLAPSEGAGSDVFDGDLGMGAAKGLQSLPTHDPSPLQRYSEDPTVPLPSETDGYVAPLTCSPQPEYVNQPDVRPQPPSPREGPLPAARPAGATLERPKTLSPGKNGVVKDVFAFGGAVENPEYLTPQGGAAPQPHPPPAFSPAFDNLYYWDQDPPERGAPPSTFKGTPTAENPEYLGLDVPV

SEQ ID NO: 861989 - protein, 1232 aa, Homo sapiens
SARYLSIFQLRLPASPETHLDMLRHLYQGCQVVQGNLELTYLPTNASLSFLQDIQEVQGYVLIAHNQVRQVPLQRLRIVRGTQLFEDNYALAVLDNGDPLNNTTPVTGASPGGLRELQLRSLTEILKGGVLIQRNPQLCYQDTILWKDIFHKNNQLALTLIDTNRSRACHPCSPMCKGSRCWGESSEDCQSLTRTVCAGGCARCKGPLPTDCCHEQCAAGCTGPKHSDCLACLHFNHSGICELHCPALVTYNTDTFESMPNPEGRYTFGASCVTACPYNYLSTDVGSCTLVCPLHNQEVTAEDGTQRCEKCSKPCARVCYGLGMEHLREVRAVTSANIQEFAGCKKIFGSLAFLPESFDGDPASNTAPLQPEQLQVFETLEEITGYLYISAWPDSLPDLSVFQNLQVIRGRILHNGAYSLTLQGLGISWLGLRSLRELGSGLALIHHNTHLCFVHTVPWDQLFRNPHQALLHTANRPEDECVGEGLACHQLCARGHCWGPGPTQCVNCSQFLRGQECVEECRVLQGLPREYVNARHCLPCHPECQPQNGSVTCFGPEADQCVACAHYKDPPFCVARCPSGVKPDLSYMPIWKFPDEEGACQPCPINCTHSCVDLDDKGCPAEQRASPLTSIISAVVGILLVVVLGVVFGILIKRRQQKIRKYTMRRLLQETELVEPLTPSGAMPNQAQMRILKETELRKVKVLGSGAFGTVYKGIWIPDGENVKIPVAIKVLRENTSPKANKEILDEAYVMAGVGSPYVSRLLGICLTSTVQLVTQLMPYGCLLDHVRENRGRLGSQDLLNWCMQIAKGMSYLEDVRLVHRDLAARNVLVKSPNHVKITDFGLARLLDIDETEYHADGGKVPIKWMALESILRRRFTHQSDVWSYGVTVWELMTFGAKPYDGIPAREIPDLLEKGERLPQPPICTIDVYMIMVKCWMIDSECRPRFRELVSEFSRMARDPQRFVVIQNEDLGPASPLDSTFYRSLLEDDDMGDLVDAEEYLVPQQGFFCPDPAPGAGGMVHHRHRSSSTRSGGGDLTLGLEPSEEEAPRSPLAPSEGAGSDVFDGDLGMGAAKGLQSLPTHDPSPLQRYSEDPTVPLPSETDGYVAPLTCSPQPEYVNQPDVRPQPPSPREGPLPAARPAGATLERPKTLSPGKNGVVKDVFAFGGAVENPEYLTPQGGAAPQPHPPPAFSPAFDNLYYWDQDPPERGAPPSTFKGTPTAENPEYLGLDVPV

SEQ ID NO: 861990 - protein, 1216 aa, Homo sapiens
MWLGALPKISKYWGTPGRPWGVAVFLFQPHSASPSQDIQEVQGYVLIAHNQVRQVPLQRLRIVRGTQLFEDNYALAVLDNGDPLNNTTPVTGASPGGLRELQLRSLTEILKGGVLIQRNPQLCYQDTILWKDIFHKNNQLALTLIDTNRSRACHPCSPMCKGSRCWGESSEDCQSLTRTVCAGGCARCKGPLPTDCCHEQCAAGCTGPKHSDCLACLHFNHSGICELHCPALVTYNTDTFESMPNPEGRYTFGASCVTACPYNYLSTDVGSCTLVCPLHNQEVTAEDGTQRCEKCSKPCARVCYGLGMEHLREVRAVTSANIQEFAGCKKIFGSLAFLPESFDGDPASNTAPLQPEQLQVFETLEEITGYLYISAWPDSLPDLSVFQNLQVIRGRILHNGAYSLTLQGLGISWLGLRSLRELGSGLALIHHNTHLCFVHTVPWDQLFRNPHQALLHTANRPEDECVGEGLACHQLCARGHCWGPGPTQCVNCSQFLRGQECVEECRVLQGLPREYVNARHCLPCHPECQPQNGSVTCFGPEADQCVACAHYKDPPFCVARCPSGVKPDLSYMPIWKFPDEEGACQPCPINCTHSCVDLDDKGCPAEQRASPLTSIISAVVGILLVVVLGVVFGILIKRRQQKIRKYTMRRLLQETELVEPLTPSGAMPNQAQMRILKETELRKVKVLGSGAFGTVYKGIWIPDGENVKIPVAIKVLRENTSPKANKEILDEAYVMAGVGSPYVSRLLGICLTSTVQLVTQLMPYGCLLDHVRENRGRLGSQDLLNWCMQIAKGMSYLEDVRLVHRDLAARNVLVKSPNHVKITDFGLARLLDIDETEYHADGGKVPIKWMALESILRRRFTHQSDVWSYGVTVWELMTFGAKPYDGIPAREIPDLLEKGERLPQPPICTIDVYMIMVKCWMIDSECRPRFRELVSEFSRMARDPQRFVVIQNEDLGPASPLDSTFYRSLLEDDDMGDLVDAEEYLVPQQGFFCPDPAPGAGGMVHHRHRSSSTRSGGGDLTLGLEPSEEEAPRSPLAPSEGAGSDVFDGDLGMGAAKGLQSLPTHDPSPLQRYSEDPTVPLPSETDGYVAPLTCSPQPEYVNQPDVRPQPPSPREGPLPAARPAGATLERPKTLSPGKNGVVKDVFAFGGAVENPEYLTPQGGAAPQPHPPPAFSPAFDNLYYWDQDPPERGAPPSTFKGTPTAENPEYLGLDVPV

SEQ ID NO: 861991 - protein, 1217 aa, Homo sapiens
MGLSFRLHSLLTTKQHAQSRGEKEGESCGPHEHLDLAWTTHSSLALALFLLRVWWWWDSKTVKIAFSPPWGIWGLFKRPAPLLEGRRAPREAEGDRRGKGPLIIAHPTEILKGGVLIQRNPQLCYQDTILWKDIFHKNNQLALTLIDTNRSRACHPCSPMCKGSRCWGESSEDCQSLTRTVCAGGCARCKGPLPTDCCHEQCAAGCTGPKHSDCLACLHFNHSGICELHCPALVTYNTDTFESMPNPEGRYTFGASCVTACPYNYLSTDVGSCTLVCPLHNQEVTAEDGTQRCEKCSKPCARVCYGLGMEHLREVRAVTSANIQEFAGCKKIFGSLAFLPESFDGDPASNTAPLQPEQLQVFETLEEITGYLYISAWPDSLPDLSVFQNLQVIRGRILHNGAYSLTLQGLGISWLGLRSLRELGSGLALIHHNTHLCFVHTVPWDQLFRNPHQALLHTANRPEDECVGEGLACHQLCARGHCWGPGPTQCVNCSQFLRGQECVEECRVLQGLPREYVNARHCLPCHPECQPQNGSVTCFGPEADQCVACAHYKDPPFCVARCPSGVKPDLSYMPIWKFPDEEGACQPCPINCTHSCVDLDDKGCPAEQRASPLTSIISAVVGILLVVVLGVVFGILIKRRQQKIRKYTMRRLLQETELVEPLTPSGAMPNQAQMRILKETELRKVKVLGSGAFGTVYKGIWIPDGENVKIPVAIKVLRENTSPKANKEILDEAYVMAGVGSPYVSRLLGICLTSTVQLVTQLMPYGCLLDHVRENRGRLGSQDLLNWCMQIAKGMSYLEDVRLVHRDLAARNVLVKSPNHVKITDFGLARLLDIDETEYHADGGKVPIKWMALESILRRRFTHQSDVWSYGVTVWELMTFGAKPYDGIPAREIPDLLEKGERLPQPPICTIDVYMIMVKCWMIDSECRPRFRELVSEFSRMARDPQRFVVIQNEDLGPASPLDSTFYRSLLEDDDMGDLVDAEEYLVPQQGFFCPDPAPGAGGMVHHRHRSSSTRSGGGDLTLGLEPSEEEAPRSPLAPSEGAGSDVFDGDLGMGAAKGLQSLPTHDPSPLQRYSEDPTVPLPSETDGYVAPLTCSPQPEYVNQPDVRPQPPSPREGPLPAARPAGATLERPKTLSPGKNGVVKDVFAFGGAVENPEYLTPQGGAAPQPHPPPAFSPAFDNLYYWDQDPPERGAPPSTFKGTPTAENPEYLGLDVPV

SEQ ID NO: 861992 - protein, 1144 aa, Homo sapiens
GKEALPASFPVPLHLWGSLSCLPLLIGCASGLGASQPVWVPPLLCSWPRGLCCCLCLSLLLTRPLAVRHLSHCLSLVLSSGHPCSPMCKGSRCWGESSEDCQSLTRTVCAGGCARCKGPLPTDCCHEQCAAGCTGPKHSDCLACLHFNHSGICELHCPALVTYNTDTFESMPNPEGRYTFGASCVTACPYNYLSTDVGSCTLVCPLHNQEVTAEDGTQRCEKCSKPCARVCYGLGMEHLREVRAVTSANIQEFAGCKKIFGSLAFLPESFDGDPASNTAPLQPEQLQVFETLEEITGYLYISAWPDSLPDLSVFQNLQVIRGRILHNGAYSLTLQGLGISWLGLRSLRELGSGLALIHHNTHLCFVHTVPWDQLFRNPHQALLHTANRPEDECVGEGLACHQLCARGHCWGPGPTQCVNCSQFLRGQECVEECRVLQGLPREYVNARHCLPCHPECQPQNGSVTCFGPEADQCVACAHYKDPPFCVARCPSGVKPDLSYMPIWKFPDEEGACQPCPINCTHSCVDLDDKGCPAEQRASPLTSIISAVVGILLVVVLGVVFGILIKRRQQKIRKYTMRRLLQETELVEPLTPSGAMPNQAQMRILKETELRKVKVLGSGAFGTVYKGIWIPDGENVKIPVAIKVLRENTSPKANKEILDEAYVMAGVGSPYVSRLLGICLTSTVQLVTQLMPYGCLLDHVRENRGRLGSQDLLNWCMQIAKGMSYLEDVRLVHRDLAARNVLVKSPNHVKITDFGLARLLDIDETEYHADGGKVPIKWMALESILRRRFTHQSDVWSYGVTVWELMTFGAKPYDGIPAREIPDLLEKGERLPQPPICTIDVYMIMVKCWMIDSECRPRFRELVSEFSRMARDPQRFVVIQNEDLGPASPLDSTFYRSLLEDDDMGDLVDAEEYLVPQQGFFCPDPAPGAGGMVHHRHRSSSTRSGGGDLTLGLEPSEEEAPRSPLAPSEGAGSDVFDGDLGMGAAKGLQSLPTHDPSPLQRYSEDPTVPLPSETDGYVAPLTCSPQPEYVNQPDVRPQPPSPREGPLPAARPAGATLERPKTLSPGKNGVVKDVFAFGGAVENPEYLTPQGGAAPQPHPPPAFSPAFDNLYYWDQDPPERGAPPSTFKGTPTAENPEYLGLDVPV

SEQ ID NO: 861993 - protein, 906 aa, Homo sapiens
QAGVQWYDLGSLQPLPPGFKQFSCLSLLSSWDYRDPASNTAPLQPEQLQVFETLEEITGYLYISAWPDSLPDLSVFQNLQVIRGRILHNGAYSLTLQGLGISWLGLRSLRELGSGLALIHHNTHLCFVHTVPWDQLFRNPHQALLHTANRPEDECVGEGLACHQLCARGHCWGPGPTQCVNCSQFLRGQECVEECRVLQGLPREYVNARHCLPCHPECQPQNGSVTCFGPEADQCVACAHYKDPPFCVARCPSGVKPDLSYMPIWKFPDEEGACQPCPINCTHSCVDLDDKGCPAEQRASPLTSIISAVVGILLVVVLGVVFGILIKRRQQKIRKYTMRRLLQETELVEPLTPSGAMPNQAQMRILKETELRKVKVLGSGAFGTVYKGIWIPDGENVKIPVAIKVLRENTSPKANKEILDEAYVMAGVGSPYVSRLLGICLTSTVQLVTQLMPYGCLLDHVRENRGRLGSQDLLNWCMQIAKGMSYLEDVRLVHRDLAARNVLVKSPNHVKITDFGLARLLDIDETEYHADGGKVPIKWMALESILRRRFTHQSDVWSYGVTVWELMTFGAKPYDGIPAREIPDLLEKGERLPQPPICTIDVYMIMVKCWMIDSECRPRFRELVSEFSRMARDPQRFVVIQNEDLGPASPLDSTFYRSLLEDDDMGDLVDAEEYLVPQQGFFCPDPAPGAGGMVHHRHRSSSTRSGGGDLTLGLEPSEEEAPRSPLAPSEGAGSDVFDGDLGMGAAKGLQSLPTHDPSPLQRYSEDPTVPLPSETDGYVAPLTCSPQPEYVNQPDVRPQPPSPREGPLPAARPAGATLERPKTLSPGKNGVVKDVFAFGGAVENPEYLTPQGGAAPQPHPPPAFSPAFDNLYYWDQDPPERGAPPSTFKGTPTAENPEYLGLDVPV

SEQ ID NO: 861994 - protein, 645 aa, Homo sapiens
MPIWKFPDEEGACQPCPINCTHSCVDLDDKGCPAEQRASPLTSIISAVVGILLVVVLGVVFGILIKRRQQKIRKYTMRRLLQETELVEPLTPSGAMPNQAQMRILKETELRKVKVLGSGAFGTVYKGIWIPDGENVKIPVAIKVLRENTSPKANKEILDEAYVMAGVGSPYVSRLLGICLTSTVQLVTQLMPYGCLLDHVRENRGRLGSQDLLNWCMQIAKGMSYLEDVRLVHRDLAARNVLVKSPNHVKITDFGLARLLDIDETEYHADGGKVPIKWMALESILRRRFTHQSDVWSYGVTVWELMTFGAKPYDGIPAREIPDLLEKGERLPQPPICTIDVYMIMVKCWMIDSECRPRFRELVSEFSRMARDPQRFVVIQNEDLGPASPLDSTFYRSLLEDDDMGDLVDAEEYLVPQQGFFCPDPAPGAGGMVHHRHRSSSTRSGGGDLTLGLEPSEEEAPRSPLAPSEGAGSDVFDGDLGMGAAKGLQSLPTHDPSPLQRYSEDPTVPLPSETDGYVAPLTCSPQPEYVNQPDVRPQPPSPREGPLPAARPAGATLERPKTLSPGKNGVVKDVFAFGGAVENPEYLTPQGGAAPQPHPPPAFSPAFDNLYYWDQDPPERGAPPSTFKGTPTAENPEYLGLDVPV

SEQ ID NO: 861995 - protein, 689 aa, Homo sapiens
MVARLGRRTCFGGEADQCVACAHYKDPPFCVARCPSGVKPDLSYMPIWKFPDEEGACQPCPINCTHSCVDLDDKGCPAEQRASPLTSIISAVVGILLVVVLGVVFGILIKRRQQKIRKYTMRRLLQETELVEPLTPSGAMPNQAQMRILKETELRKVKVLGSGAFGTVYKGIWIPDGENVKIPVAIKVLRENTSPKANKEILDEAYVMAGVGSPYVSRLLGICLTSTVQLVTQLMPYGCLLDHVRENRGRLGSQDLLNWCMQIAKGMSYLEDVRLVHRDLAARNVLVKSPNHVKITDFGLARLLDIDETEYHADGGKVPIKWMALESILRRRFTHQSDVWSYGVTVWELMTFGAKPYDGIPAREIPDLLEKGERLPQPPICTIDVYMIMVKCWMIDSECRPRFRELVSEFSRMARDPQRFVVIQNEDLGPASPLDSTFYRSLLEDDDMGDLVDAEEYLVPQQGFFCPDPAPGAGGMVHHRHRSSSTRSGGGDLTLGLEPSEEEAPRSPLAPSEGAGSDVFDGDLGMGAAKGLQSLPTHDPSPLQRYSEDPTVPLPSETDGYVAPLTCSPQPEYVNQPDVRPQPPSPREGPLPAARPAGATLERPKTLSPGKNGVVKDVFAFGGAVENPEYLTPQGGAAPQPHPPPAFSPAFDNLYYWDQDPPERGAPPSTFKGTPTAENPEYLGLDVPV

SEQ ID NO: 861996 - protein, 1225 aa, Homo sapiens
MKLRLPASPETHLDMLRHLYQGCQVVQGNLELTYLPTNASLSFLQDIQEVQGYVLIAHNQVRQVPLQRLRIVRGTQLFEDNYALAVLDNGDPLNNTTPVTGASPGGLRELQLRSLTEILKGGVLIQRNPQLCYQDTILWKDIFHKNNQLALTLIDTNRSRACHPCSPMCKGSRCWGESSEDCQSLTRTVCAGGCARCKGPLPTDCCHEQCAAGCTGPKHSDCLACLHFNHSGICELHCPALVTYNTDTFESMPNPEGRYTFGASCVTACPYNYLSTDVGSCTLVCPLHNQEVTAEDGTQRCEKCSKPCARVCYGLGMEHLREVRAVTSANIQEFAGCKKIFGSLAFLPESFDGDPASNTAPLQPEQLQVFETLEEITGYLYISAWPDSLPDLSVFQNLQVIRGRILHNGAYSLTLQGLGISWLGLRSLRELGSGLALIHHNTHLCFVHTVPWDQLFRNPHQALLHTANRPEDECVGEGLACHQLCARGHCWGPGPTQCVNCSQFLRGQECVEECRVLQGLPREYVNARHCLPCHPECQPQNGSVTCFGPEADQCVACAHYKDPPFCVARCPSGVKPDLSYMPIWKFPDEEGACQPCPINCTHSCVDLDDKGCPAEQRASPLTSIISAVVGILLVVVLGVVFGILIKRRQQKIRKYTMRRLLQETELVEPLTPSGAMPNQAQMRILKETELRKVKVLGSGAFGTVYKGIWIPDGENVKIPVAIKVLRENTSPKANKEILDEAYVMAGVGSPYVSRLLGICLTSTVQLVTQLMPYGCLLDHVRENRGRLGSQDLLNWCMQIAKGMSYLEDVRLVHRDLAARNVLVKSPNHVKITDFGLARLLDIDETEYHADGGKVPIKWMALESILRRRFTHQSDVWSYGVTVWELMTFGAKPYDGIPAREIPDLLEKGERLPQPPICTIDVYMIMVKCWMIDSECRPRFRELVSEFSRMARDPQRFVVIQNEDLGPASPLDSTFYRSLLEDDDMGDLVDAEEYLVPQQGFFCPDPAPGAGGMVHHRHRSSSTRSGGGDLTLGLEPSEEEAPRSPLAPSEGAGSDVFDGDLGMGAAKGLQSLPTHDPSPLQRYSEDPTVPLPSETDGYVAPLTCSPQPEYVNQPDVRPQPPSPREGPLPAARPAGATLERPKTLSPGKNGVVKDVFAFGGAVENPEYLTPQGGAAPQPHPPPAFSPAFDNLYYWDQDPPERGAPPSTFKGTPTAENPEYLGLDVPV

SEQ ID NO: 861997 - protein, 430 aa, Homo sapiens
GCFPFQGMSYLEDVRLVHRDLAARNVLVKSPNHVKITDFGLARLLDIDETEYHADGGKVPIKWMALESILRRRFTHQSDVWSYGVTVWELMTFGAKPYDGIPAREIPDLLEKGERLPQPPICTIDVYMIMVKCWMIDSECRPRFRELVSEFSRMARDPQRFVVIQNEDLGPASPLDSTFYRSLLEDDDMGDLVDAEEYLVPQQGFFCPDPAPGAGGMVHHRHRSSSTRSGGGDLTLGLEPSEEEAPRSPLAPSEGAGSDVFDGDLGMGAAKGLQSLPTHDPSPLQRYSEDPTVPLPSETDGYVAPLTCSPQPEYVNQPDVRPQPPSPREGPLPAARPAGATLERPKTLSPGKNGVVKDVFAFGGAVENPEYLTPQGGAAPQPHPPPAFSPAFDNLYYWDQDPPERGAPPSTFKGTPTAENPEYLGLDVPV

SEQ ID NO: 861998 - protein, 281 aa, Homo sapiens
MLGWGGATILPLLPPQNEDLGPASPLDSTFYRSLLEDDDMGDLVDAEEYLVPQQGFFCPDPAPGAGGMVHHRHRSSSTRSGGGDLTLGLEPSEEEAPRSPLAPSEGAGSDVFDGDLGMGAAKGLQSLPTHDPSPLQRYSEDPTVPLPSETDGYVAPLTCSPQPEYVNQPDVRPQPPSPREGPLPAARPAGATLERPKTLSPGKNGVVKDVFAFGGAVENPEYLTPQGGAAPQPHPPPAFSPAFDNLYYWDQDPPERGAPPSTFKGTPTAENPEYLGLDVPV

SEQ ID NO: 861999 - protein, 1020 aa, Homo sapiens
MKLRLPASPETHLDMLRHLYQGCQVVQGNLELTYLPTNASLSFLQDIQEVQGYVLIAHNQVRQVPLQRLRIVRGTQLFEDNYALAVLDNGDPLNNTTPVTGASPGGLRELQLRSLTEILKGGVLIQRNPQLCYQDTILWKDIFHKNNQLALTLIDTNRSRACHPCSPMCKGSRCWGESSEDCQSLTRTVCAGGCARCKGPLPTDCCHEQCAAGCTGPKHSDCLACLHFNHSGICELHCPALVTYNTDTFESMPNPEGRYTFGASCVTACPYNYLSTDVGSCTLVCPLHNQEVTAEDGTQRCEKCSKPCARVCYGLGMEHLREVRAVTSANIQEFAGCKKIFGSLAFLPESFDGDPASNTAPLQPEQLQVFETLEEITGYLYISAWPDSLPDLSVFQNLQVIRGRILHNGAYSLTLQGLGISWLGLRSLRELGSGLALIHHNTHLCFVHTVPWDQLFRNPHQALLHTANRPEDECVGEGLACHQLCARGHCWGPGPTQCVNCSQFLRGQECVEECRVLQGLPREYVNARHCLPCHPECQPQNGSVTCFGPEADQCVACAHYKDPPFCVARCPSGVKPDLSYMPIWKFPDEEGACQPCPINCTHSCVDLDDKGCPAEQRASPLTSIISAVVGILLVVVLGVVFGILIKRRQQKIRKYTMRRLLQETELVEPLTPSGAMPNQAQMRILKETELRKVKVLGSGAFGTVYKGIWIPDGENVKIPVAIKVLRENTSPKANKEILDEAYVMAGVGSPYVSRLLGICLTSTVQLVTQLMPYGCLLDHVRENRGRLGSQDLLNWCMQIAKGMSYLEDVRLVHRDLAARNVLVKSPNHVKITDFGLARLLDIDETEYHADGGKVPIKWMALESILRRRFTHQSDVWSYGVTVWELMTFGAKPYDGIPAREIPDLLEKGERLPQPPICTIDVYMIMVKCWMIDSECRPRFRELVSEFSRMARDPQRFVVIQNEDLGPASPLDSTFYRSLLEDDDMGDLVDAEEYLVPQQGFFCPDPFPSRSWVLKALGKLA

SEQ ID NO: 862000 - protein, 164 aa, Homo sapiens
SRGSLSTFCSALTDPSPLQRYSEDPTVPLPSETDGYVAPLTCSPQPEYVNQPDVRPQPPSPREGPLPAARPAGATLERPKTLSPGKNGVVKDVFAFGGAVENPEYLTPQGGAAPQPHPPPAFSPAFDNLYYWDQDPPERGAPPSTFKGTPTAENPEYLGLDVPV

SEQ ID NO: 862001 - protein, 930 aa, Homo sapiens
MKLRLPASPETHLDMLRHLYQGCQVVQGNLELTYLPTNASLSFLQDIQEVQGYVLIAHNQVRQVPLQRLRIVRGTQLFEDNYALAVLDNGDPLNNTTPVTGASPGGLRELQLRSLTEILKGGVLIQRNPQLCYQDTILWKDIFHKNNQLALTLIDTNRSRACHPCSPMCKGSRCWGESSEDCQSLTRTVCAGGCARCKGPLPTDCCHEQCAAGCTGPKHSDCLACLHFNHSGICELHCPALVTYNTDTFESMPNPEGRYTFGASCVTACPYNYLSTDVGSCTLVCPLHNQEVTAEDGTQRCEKCSKPCARVCYGLGMEHLREVRAVTSANIQEFAGCKKIFGSLAFLPESFDGDPASNTAPLQPEQLQVFETLEEITGYLYISAWPDSLPDLSVFQNLQVIRGRILHNGAYSLTLQGLGISWLGLRSLRELGSGLALIHHNTHLCFVHTVPWDQLFRNPHQALLHTANRPEDECVGEGLACHQLCARGHCWGPGPTQCVNCSQFLRGQECVEECRVLQGLPREYVNARHCLPCHPECQPQNGSVTCFGPEADQCVACAHYKDPPFCVARCPSGVKPDLSYMPIWKFPDEEGACQPCPINCTHSCVDLDDKGCPAEQRASPLTSIISAVVGILLVVVLGVVFGILIKRRQQKIRKYTMRRLLQETELVEPLTPSGAMPNQAQMRILKETELRKVKVLGSGAFGTVYKGIWIPDGENVKIPVAIKVLRENTSPKANKEILDEAYVMAGVGSPYVSRLLGICLTSTVQLVTQLMPYGCLLDHVRENRGRLGSQDLLNWCMQIAKGMSYLEDVRLVHRDLAARNVLVKSPNHVKITDFGLARLLDIDETEYHADGGKVPIKWMALESILRRRFTHQSDVWSYGVTVWELMTFGAKPYDGIPAREIPDLLEKGERLPQPPICTIDVYMIMVKLDD

SEQ ID NO: 862002 - protein, 942 aa, Homo sapiens
MKLRLPASPETHLDMLRHLYQGCQVVQGNLELTYLPTNASLSFLQDIQEVQGYVLIAHNQVRQVPLQRLRIVRGTQLFEDNYALAVLDNGDPLNNTTPVTGASPGGLRELQLRSLTEILKGGVLIQRNPQLCYQDTILWKDIFHKNNQLALTLIDTNRSRACHPCSPMCKGSRCWGESSEDCQSLTRTVCAGGCARCKGPLPTDCCHEQCAAGCTGPKHSDCLACLHFNHSGICELHCPALVTYNTDTFESMPNPEGRYTFGASCVTACPYNYLSTDVGSCTLVCPLHNQEVTAEDGTQRCEKCSKPCARVCYGLGMEHLREVRAVTSANIQEFAGCKKIFGSLAFLPESFDGDPASNTAPLQPEQLQVFETLEEITGYLYISAWPDSLPDLSVFQNLQVIRGRILHNGAYSLTLQGLGISWLGLRSLRELGSGLALIHHNTHLCFVHTVPWDQLFRNPHQALLHTANRPEDECVGEGLACHQLCARGHCWGPGPTQCVNCSQFLRGQECVEECRVLQGLPREYVNARHCLPCHPECQPQNGSVTCFGPEADQCVACAHYKDPPFCVARCPSGVKPDLSYMPIWKFPDEEGACQPCPINCTHSCVDLDDKGCPAEQRASPLTSIISAVVGILLVVVLGVVFGILIKRRQQKIRKYTMRRLLQETELVEPLTPSGAMPNQAQMRILKETELRKVKVLGSGAFGTVYKGIWIPDGENVKIPVAIKVLRENTSPKANKEILDEAYVMAGVGSPYVSRLLGICLTSTVQLVTQLMPYGCLLDHVRENRGRLGSQDLLNWCMQIAKGMSYLEDVRLVHRDLAARNVLVKSPNHVKITDFGLARLLDIDETEYHADGGKVPIKWMALESILRRRFTHQSDVWSYGVTVWELMTSAHELVTSKIALRKDLDNAEEKADALNKELLMTKQNLIDAEEEKRRLEEESAQLK

SEQ ID NO: 862003 - protein, 103 aa, Homo sapiens
MCRSQRCAAPNACAAPNACTLSPGKNGVVKDVFAFGGAVENPEYLTPQGGAAPQPHPPPAFSPAFDNLYYWDQDPPERGAPPSTFKGTPTAENPEYLGLDVPV

SEQ ID NO: 862004 - protein, 648 aa, Homo sapiens
MKLRLPASPETHLDMLRHLYQGCQVVQGNLELTYLPTNASLSFLQDIQEVQGYVLIAHNQVRQVPLQRLRIVRGTQLFEDNYALAVLDNGDPLNNTTPVTGASPGGLRELQLRSLTEILKGGVLIQRNPQLCYQDTILWKDIFHKNNQLALTLIDTNRSRACHPCSPMCKGSRCWGESSEDCQSLTRTVCAGGCARCKGPLPTDCCHEQCAAGCTGPKHSDCLACLHFNHSGICELHCPALVTYNTDTFESMPNPEGRYTFGASCVTACPYNYLSTDVGSCTLVCPLHNQEVTAEDGTQRCEKCSKPCARVCYGLGMEHLREVRAVTSANIQEFAGCKKIFGSLAFLPESFDGDPASNTAPLQPEQLQVFETLEEITGYLYISAWPDSLPDLSVFQNLQVIRGRILHNGAYSLTLQGLGISWLGLRSLRELGSGLALIHHNTHLCFVHTVPWDQLFRNPHQALLHTANRPEDECVGEGLACHQLCARGHCWGPGPTQCVNCSQFLRGQECVEECRVLQGLPREYVNARHCLPCHPECQPQNGSVTCFGPEADQCVACAHYKDPPFCVARCPSGVKPDLSYMPIWKFPDEEGACQPCPINCTHSCVDLDDKGCPAEQRARLAWTPGCTLHCPSLPHWMLGGHCCREGTP

SEQ ID NO: 862005 - protein, 545 aa, Homo sapiens [sequence omitted]

SEQ ID NO: 862006 - protein, 125 aa, Homo sapiens
VCASALCPMCSTPQDARGGHPAWYCPIAPGTPGQNSTVKASHLSPQACLHFNHSGICELHCPALVTYNTDTFESMPNPEGRYTFGASCVTACPCECQGETQFSHFGGEVCFCKWEHMGSTVCILL

SEQ ID NO: 862007 - protein, 168 aa, Homo sapiens
MCRSQRCAAPKRMCRSQRMCRSQRMCRSQRMCRSQRMCRSQDLLNWCMQIAKGMSYLEDVRLVHRDLAARNVLVKSPNHVKITDFGLARLLDIDETEYHADGGKVPIKWMALESILRRRFTHQSDVWSYGVTVWELMTFGAKPYDGIPAREIPDLLEKGERHMRWGIL

SEQ ID NO: 862008 - protein, 1255 aa, Homo sapiens [sequence omitted]

SEQ ID NO: 862009 - protein, 1225 aa, Homo sapiens; identical to SEQ ID NO: 861996

SEQ ID NO: 862010 - protein, 1225 aa, Homo sapiens; identical to SEQ ID NO: 861996

SEQ ID NO: 862011 - protein, 1258 aa, Homo sapiens
KSNVLLTCKKNTSKIPEDMPRGSWKPQVCTGTDMKLRLPASPETHLDMLRHLYQGCQVVQGNLELTYLPTNASLSFLQDIQEVQGYVLIAHNQVRQVPLQRLRIVRGTQLFEDNYALAVLDNGDPLNNTTPVTGASPGGLRELQLRSLTEILKGGVLIQRNPQLCYQDTILWKDIFHKNNQLALTLIDTNRSRACHPCSPMCKGSRCWGESSEDCQSLTRTVCAGGCARCKGPLPTDCCHEQCAAGCTGPKHSDCLACLHFNHSGICELHCPALVTYNTDTFESMPNPEGRYTFGASCVTACPYNYLSTDVGSCTLVCPLHNQEVTAEDGTQRCEKCSKPCARVCYGLGMEHLREVRAVTSANIQEFAGCKKIFGSLAFLPESFDGDPASNTAPLQPEQLQVFETLEEITGYLYISAWPDSLPDLSVFQNLQVIRGRILHNGAYSLTLQGLGISWLGLRSLRELGSGLALIHHNTHLCFVHTVPWDQLFRNPHQALLHTANRPEDECVGEGLACHQLCARGHCWGPGPTQCVNCSQFLRGQECVEECRVLQGLPREYVNARHCLPCHPECQPQNGSVTCFGPEADQCVACAHYKDPPFCVARCPSGVKPDLSYMPIWKFPDEEGACQPCPINCTHSCVDLDDKGCPAEQRASPLTSIISAVVGILLVVVLGVVFGILIKRRQQKIRKYTMRRLLQETELVEPLTPSGAMPNQAQMRILKETELRKVKVLGSGAFGTVYKGIWIPDGENVKIPVAIKVLRENTSPKANKEILDEAYVMAGVGSPYVSRLLGICLTSTVQLVTQLMPYGCLLDHVRENRGRLGSQDLLNWCMQIAKGMSYLEDVRLVHRDLAARNVLVKSPNHVKITDFGLARLLDIDETEYHADGGKVPIKWMALESILRRRFTHQSDVWSYGVTVWELMTFGAKPYDGIPAREIPDLLEKGERLPQPPICTIDVYMIMVKCWMIDSECRPRFRELVSEFSRMARDPQRFVVIQNEDLGPASPLDSTFYRSLLEDDDMGDLVDAEEYLVPQQGFFCPDPAPGAGGMVHHRHRSSSTRSGGGDLTLGLEPSEEEAPRSPLAPSEGAGSDVFDGDLGMGAAKGLQSLPTHDPSPLQRYSEDPTVPLPSETDGYVAPLTCSPQPEYVNQPDVRPQPPSPREGPLPAARPAGATLERPKTLSPGKNGVVKDVFAFGGAVENPEYLTPQGGAAPQPHPPPAFSPAFDNLYYWDQDPPERGAPPSTFKGTPTAENPEYLGLDVPV

SEQ ID NO: 862012 - protein, 1265 aa, Homo sapiens
MKLRLPASPETHLDMLRHLYQGCQVVQGNLELTYLPTNASLSFLQDIQEVQGYVLIAHNQVRQVPLQRLRIVRGTQLFEDNYALAVLDNGDPLNNTTPVTGASPGGLRELQLRSLTEILKGGVLIQRNPQLCYQDTILWKDIFHKNNQLALTLIDTNRSRACHPCSPMCKGSRCWGESSEDCQSLTRTVCAGGCARCKGPLPTDCCHEQCAAGCTGPKHSDCLACLHFNHSGICELHCPALVTYNTDTFESMPNPEGRYTFGASCVTACPYNYLSTDVGSCTLVCPLHNQEVTAEDGTQRCEKCSKPCARVCYGLGMEHLREVRAVTSANIQEFAGCKKIFGSLAFLPESFDGDPASNTAPLQPEQLQVFETLEEITGYLYISAWPDSLPDLSVFQNLQVIRGRILHNGAYSLTLQGLGISWLGLRSLRELGSGLALIHHNTHLCFVHTVPWDQLFRNPHQALLHTANRPEDECVGEGLACHQLCARGHCWGPGPTQCVNCSQFLRGQECVEECRVLQGLPREYVNARHCLPCHPECQPQNGSVTCFGPEADQCVACAHYKDPPFCVARCPSGVKPDLSYMPIWKFPDEEGACQPCPINCTHSCVDLDDKGCPAEQRASPLTSIISAVVGILLVVVLGVVFGILIKRRQQKIRKYTMRRLLQETELVEPLTPSGAMPNQAQMRILKETELRKVKVLGSGAFGTVYKGIWIPDGENVKIPVAIKVLRENTSPKANKEILDEAYVMAGVGSPYVSRLLGICLTSTVQLVTQLMPYGCLLDHVRENRGRLGSQDLLNWCMQIAKGMSYLEDVRLVHRDLAARNVLVKSPNHVKITDFGLARLLDIDETEYHADGGKVGEGPRSRGGWVEWCLAHGRTLSGHLPTHTVGGLPLLPSQVPIKWMALESILRRRFTHQSDVWSYGVTVWELMTFGAKPYDGIPAREIPDLLEKGERLPQPPICTIDVYMIMVKCWMIDSECRPRFRELVSEFSRMARDPQRFVVIQNEDLGPASPLDSTFYRSLLEDDDMGDLVDAEEYLVPQQGFFCPDPAPGAGGMVHHRHRSSSTRSGGGDLTLGLEPSEEEAPRSPLAPSEGAGSDVFDGDLGMGAAKGLQSLPTHDPSPLQRYSEDPTVPLPSETDGYVAPLTCSPQPEYVNQPDVRPQPPSPREGPLPAARPAGATLERPKTLSPGKNGVVKDVFAFGGAVENPEYLTPQGGAAPQPHPPPAFSPAFDNLYYWDQDPPERGAPPSTFKGTPTAENPEYLGLDVPV

SEQ ID NO: 862013 - protein, 853 aa, Homo sapiens
SGRSRSRTESGDPASNLPDLSVFQNLQVIRGRILHNGAYSLTLQGLGISWLGLRSLRELGSGLALIHHNTHLCFVHTVPWDQLFRNPHQALLHTANRPEDECVGEGLACHQLCARGHCWGPGPTQCVNCSQFLRGQECVEECRVLQGLPREYVNARHCLPCHPECQPQNGSVTCFGPEADQCVACAHYKDPPFCVARCPSGVKPDLSYMPIWKFPDEEGACQPCPINCTHSCVDLDDKGCPAEQRASPLTSIISAVVGILLVVVLGVVFGILIKRRQQKIRKYTMRRLLQETELVEPLTPSGAMPNQAQMRILKETELRKVKVLGSGAFGTVYKGIWIPDGENVKIPVAIKVLRENTSPKANKEILDEAYVMAGVGSPYVSRLLGICLTSTVQLVTQLMPYGCLLDHVRENRGRLGSQDLLNWCMQIAKGMSYLEDVRLVHRDLAARNVLVKSPNHVKITDFGLARLLDIDETEYHADGGKVPIKWMALESILRRRFTHQSDVWSYGVTVWELMTFGAKPYDGIPAREIPDLLEKGERLPQPPICTIDVYMIMVKCWMIDSECRPRFRELVSEFSRMARDPQRFVVIQNEDLGPASPLDSTFYRSLLEDDDMGDLVDAEEYLVPQQGFFCPDPAPGAGGMVHHRHRSSSTRSGGGDLTLGLEPSEEEAPRSPLAPSEGAGSDVFDGDLGMGAAKGLQSLPTHDPSPLQRYSEDPTVPLPSETDGYVAPLTCSPQPEYVNQPDVRPQPPSPREGPLPAARPAGATLERPKTLSPGKNGVVKDVFAFGGAVENPEYLTPQGGAAPQPHPPPAFSPAFDNLYYWDQDPPERGAPPSTFKGTPTAENPEYLGLDVPV

SEQ ID NO: 862014 - protein, 927 aa, Homo sapiens
MKLRLPASPETHLDMLRHLYQGCQVVQGNLELTYLPTNASLSFLQDIQEVQGYVLIAHNQVRQVPLQRLRIVRGTQLFEDNYALAVLDNGDPLNNTTPVTGASPGGLRELQLRSLTEILKGGVLIQRNPQLCYQDTILWKDIFHKNNQLALTLIDTNRSRACHPCSPMCKGSRCWGESSEDCQSLTRTVCAGGCARCKGPLPTDCCHEQCAAGCTGPKHSDCLACLHFNHSGICELHCPALVTYNTDTFESMPNPEGRYTFGASCVTACPYNYLSTDVGSCTLVCPLHNQEVTAEDGTQRCEKCSKPCARVCYGLGMEHLREVRAVTSANIQEFAGCKKIFGSLAFLPESFDGDPASNTAPLQPEQLQVFETLEEITGYLYISAWPDSLPDLSVFQNLQVIRGRILHNGAYSLTLQGLGISWLGLRSLRELGSGLALIHHNTHLCFVHTVPWDQLFRNPHQALLHTANRPEDECVGEGLACHQLCARGHCWGPGPTQCVNCSQFLRGQECVEECRVLQGLPREYVNARHCLPCHPECQPQNGSVTCFGPEADQCVACAHYKDPPFCVARCPSGVKPDLSYMPIWKFPDEEGACQPCPINCTHSCVDLDDKGCPAEQRASPLTSIISAVVGILLVVVLGVVFGILIKRRQQKIRKYTMRRLLQETELVEPLTPSGAMPNQAQMRILKETELRKVKVLGSGAFGTVYKGIWIPDGENVKIPVAIKVLRENTSPKANKEILDEAYVMAGVGSPYVSRLLGICLTSTVQLVTQLMPYGCLLDHVRENRGRLGSQDLLNWCMQIAKGMSYLEDVRLVHRDLAARNVLVKSPNHVKITDFGLARLLDIDETEYHADGGKVPIKWMALESILRRRFTHQSDVWSYGVTVWELMTFGAKPYDGIPAREIPDLLEKGERLPQPPICTIDVYMIMVK

SEQ ID NO: 862015 - protein, 1225 aa, Homo sapiens; identical to SEQ ID NO: 861996

SEQ ID NO: 862016 - protein, 510 aa, Homo sapiens
MVGRLCGVWGCVVSHTLSAYPCPQEAYVMAGVGSPYVSRLLGICLTSTVQLVTQLMPYGCLLDHVRENRGRLGSQDLLNWCMQIAKGMSYLEDVRLVHRDLAARNVLVKSPNHVKITDFGLARLLDIDETEYHADGGKVPIKWMALESILRRRFTHQSDVWSYGVTVWELMTFGAKPYDGIPAREIPDLLEKGERLPQPPICTIDVYMIMVKCWMIDSECRPRFRELVSEFSRMARDPQRFVVIQNEDLGPASPLDSTFYRSLLEDDDMGDLVDAEEYLVPQQGFFCPDPAPGAGGMVHHRHRSSSTRSGGGDLTLGLEPSEEEAPRSPLAPSEGAGSDVFDGDLGMGAAKGLQSLPTHDPSPLQRYSEDPTVPLPSETDGYVAPLTCSPQPEYVNQPDVRPQPPSPREGPLPAARPAGATLERPKTLSPGKNGVVKDVFAFGGAVENPEYLTPQGGAAPQPHPPPAFSPAFDNLYYWDQDPPERGAPPSTFKGTPTAENPEYLGLDVPV

SEQ ID NO: 862017 - protein, 380 aa, Homo sapiens
RRFLADGGVPIKWMALESILRRRFTHQSDVWSYGVTVWELMTFGAKPYDGIPAREIPDLLEKGERLPQPPICTIDVYMIMVKCWMIDSECRPRFRELVSEFSRMARDPQRFVVIQNEDLGPASPLDSTFYRSLLEDDDMGDLVDAEEYLVPQQGFFCPDPAPGAGGMVHHRHRSSSTRSGGGDLTLGLEPSEEEAPRSPLAPSEGAGSDVFDGDLGMGAAKGLQSLPTHDPSPLQRYSEDPTVPLPSETDGYVAPLTCSPQPEYVNQPDVRPQPPSPREGPLPAARPAGATLERPKTLSPGKNGVVKDVFAFGGAVENPEYLTPQGGAAPQPHPPPAFSPAFDNLYYWDQDPPERGAPPSTFKGTPTAENPEYLGLDVPV

SEQ ID NO: 862018 - protein, 1113 aa, Homo sapiens
MKLRLPASPETHLDMLRHLYQGCQVVQGNLELTYLPTNASLSFLQDIQEVQGYVLIAHNQVRQVPLQRLRIVRGTQLFEDNYALAVLDNGDPLNNTTPVTGASPGGLRELQLRSLTEILKGGVLIQRNPQLCYQDTILWKDIFHKNNQLALTLIDTNRSRACHPCSPMCKGSRCWGESSEDCQSLTRTVCAGGCARCKGPLPTDCCHEQCAAGCTGPKHSDCLACLHFNHSGICELHCPALVTYNTDTFESMPNPEGRYTFGASCVTACPYNYLSTDVGSCTLVCPLHNQEVTAEDGTQRCEKCSKPCARVCYGLGMEHLREVRAVTSANIQEFAGCKKIFGSLAFLPESFDGDPASNTAPLQPEQLQVFETLEEITGYLYISAWPDSLPDLSVFQNLQVIRGRILHNGAYSLTLQGLGISWLGLRSLRELGSGLALIHHNTHLCFVHTVPWDQLFRNPHQALLHTANRPEDECVGEGLACHQLCARGHCWGPGPTQCVNCSQFLRGQECVEECRVLQGLPREYVNARHCLPCHPECQPQNGSVTCFGPEADQCVACAHYKDPPFCVARCPSGVKPDLSYMPIWKFPDEEGACQPCPINCTHSCVDLDDKGCPAEQRASPLTSIISAVVGILLVVVLGVVFGILIKRRQQKIRKYTMRRLLQETELVEPLTPSGAMPNQAQMRILKETELRKVKVLGSGAFGTVYKGIWIPDGENVKIPVAIKVLRENTSPKANKEILDEAYVMAGVGSPYVSRLLGICLTSTVQLVTQLMPYGCLLDHVRENRGRLGSQDLLNWCMQIAKGMSYLEDVRLVHRDLAARNVLVKSPNHVKITDFGLARLLDIDETEYHADGGKVPIKWMALESILRRRFTHQSDVWSYGVTVWELMTFGAKPYDGIPAREIPDLLEKGERLPQPPICTIDVYMIMVKCWMIDSECRPRFRELVSEFSRMARDPQRFVVIQNEDLGPASPLDSTFYRSLLEDDDMGDLVDAEEYLVPQQGFFCPDPAPGAGGMVHHRHRSSSTRSGGGDLTLGLEPSEEEAPRSPLAPSEGAGSDVFDGDLGMGAAKGLQSLPTHDPSPLQRYSEDPTERASSFLQRKGRLGGHTNRAHSSGFY

SEQ ID NO: 862019 - protein, 927 aa, Homo sapiens; identical to SEQ ID NO: 862014

SEQ ID NO: 862020 - protein, 917 aa, Homo sapiens
MKLRLPASPETHLDMLRHLYQGCQVVQGNLELTYLPTNASLSFLQDIQEVQGYVLIAHNQVRQVPLQRLRIVRGTQLFEDNYALAVLDNGDPLNNTTPVTGASPGGLRELQLRSLTEILKGGVLIQRNPQLCYQDTILWKDIFHKNNQLALTLIDTNRSRACHPCSPMCKGSRCWGESSEDCQSLTRTVCAGGCARCKGPLPTDCCHEQCAAGCTGPKHSDCLACLHFNHSGICELHCPALVTYNTDTFESMPNPEGRYTFGASCVTACPYNYLSTDVGSCTLVCPLHNQEVTAEDGTQRCEKCSKPCARVCYGLGMEHLREVRAVTSANIQEFAGCKKIFGSLAFLPESFDGDPASNTAPLQPEQLQVFETLEEITGYLYISAWPDSLPDLSVFQNLQVIRGRILHNGAYSLTLQGLGISWLGLRSLRELGSGLALIHHNTHLCFVHTVPWDQLFRNPHQALLHTANRPEDECVGEGLACHQLCARGHCWGPGPTQCVNCSQFLRGQECVEECRVLQGLPREYVNARHCLPCHPECQPQNGSVTCFGPEADQCVACAHYKDPPFCVARCPSGVKPDLSYMPIWKFPDEEGACQPCPINCTHSCVDLDDKGCPAEQRASPLTSIISAVVGILLVVVLGVVFGILIKRRQQKIRKYTMRRLLQETELVEPLTPSGAMPNQAQMRILKETELRKVKVLGSGAFGTVYKGIWIPDGENVKIPVAIKVLRENTSPKANKEILDEAYVMAGVGSPYVSRLLGICLTSTVQLVTQLMPYGCLLDHVRENRGRLGSQDLLNWCMQIAKGMSYLEDVRLVHRDLAARNVLVKSPNHVKITDFGLARLLDIDETEYHADGGKVPIKWMALESILRRRFTHQSDVWSYGVTVWELMTFGAKPYDGIPAREIPDLLEKGERHMRWGIL

SEQ ID NO: 862021 - protein, 104 aa, Homo sapiens
GCQLLGVLHGPTLLLPSAQPSTTSITGTRTHQSGGLHPAPSKGHLRQRTQSTWVWTCQCEPEGQVRRSPDVSSGSREGLTSAGIKRWEGPPTTSRGTCHARNLS

SEQ ID NO: 862022 - protein, 603 aa, Homo sapiens
MKLRLPASPETHLDMLRHLYQGCQVVQGNLELTYLPTNASLSFLQDIQEVQGYVLIAHNQVRQVPLQRLRIVRGTQLFEDNYALAVLDNGDPLNNTTPVTGASPGGLRELQLRSLTEILKGGVLIQRNPQLCYQDTILWKDIFHKNNQLALTLIDTNRSRACHPCSPMCKGSRCWGESSEDCQSLTRTVCAGGCARCKGPLPTDCCHEQCAAGCTGPKHSDCLACLHFNHSGICELHCPALVTYNTDTFESMPNPEGRYTFGASCVTACPYNYLSTDVGSCTLVCPLHNQEVTAEDGTQRCEKCSKPCARVCYGLGMEHLREVRAVTSANIQEFAGCKKIFGSLAFLPESFDGDPASNTAPLQPEQLQVFETLEEITGYLYISAWPDSLPDLSVFQNLQVIRGRILHNGAYSLTLQGLGISWLGLRSLRELGSGLALIHHNTHLCFVHTVPWDQLFRNPHQALLHTANRPEDECVGEGLACHQLCARGHCWGPGPTQCVNCSQFLRGQECVEECRVLQGLPREYVNARHCLPCHPECQPQNGSVTCFGPEADQCVACAHYKDPPFCVARCPSGVKPDLSYMPIWKFPDEEGACQPCPINCTHS

SEQ ID NO: 862023 - protein, 302 aa, Homo sapiens
MKLRLPASPETHLDMLRHLYQGCQVVQGNLELTYLPTNASLSFLQDIQEVQGYVLIAHNQVRQVPLQRLRIVRGTQLFEDNYALAVLDNGDPLNNTTPVTGASPGGLRELQLRSLTEILKGGVLIQRNPQLCYQDTILWKDIFHKNNQLALTLIDTNRSRACHPCSPMCKGSRCWGESSEDCQSLTRTVCAGGCARCKGPLPTDCCHEQCAAGCTGPKHSDCLACLHFNHSGICELHCPALVTYNTDTFESMPNPEGRYTFGASCVTACPCECQGETQFSHFGGEVCFCKWEHMGSTVCILL

SEQ ID NO: 862024 - protein, 109 aa, Homo sapiens
ELILGLLSPSLARPWLSDLPCAVSQACPCPPGFVLFVGVPPPPVLVPRVLPLGPPLLHRVSTVPIWCPRVYTELGFSATLFVVPIGAPMSFFFFSFSFFYFLSKKFICM

SEQ ID NO: 862025 - protein, 78 aa, Homo sapiens
CSSGRITPVCKHLRKDKGLGFCEAPLSPDNRALSGFSETPVHSRIRRFLLHSQDPELHLPVRVFKLLNLASQDFCYCK

SEQ ID NO: 862026 - protein, 192 aa, Homo sapiens; identical to SEQ ID NO: 810935

SEQ ID NO: 862027 - protein, 185 aa, Homo sapiens
MQAIKAVGKTCLLISYTTNAFPGEYIPTVFDNYSANVMVDSKPVNLGLWDTAGQEDYDRLRPLSYPQTDVFLICFSLVSPASYENVRAKWFPEVRHHCPSTPIILVGTKLDLRDDKDTIEKLKEKKLAPITYPQGLALAKEIDSVKYLECSALTQRGLKTVFDEAIRAVLCPQPTRQQKRACSLL

SEQ ID NO: 862028 - protein, 161 aa, Homo sapiens
MYPWAFDNYSANVMVDSKPVNLGLWDTAGQEDYDRLRPLSYPQTDVFLICFSLVSPASYENVRAKWFPEVRHHCPSTPIILVGTKLDLRDDKDTIEKLKEKKLAPITYPQGLALAKEIDSVKYLECSALTQRGLKTVFDEAIRAVLCPQPTRQQKRACSLL

SEQ ID NO: 862029 - protein, 192 aa, Homo sapiens; identical to SEQ ID NO: 810935

SEQ ID NO: 862030 - protein, 192 aa, Homo sapiens; identical to SEQ ID NO: 810935

SEQ ID NO: 862031 - protein, 179 aa, Homo sapiens [sequence omitted]

SEQ ID NO: 862032 - protein, 192 aa, Homo sapiens; identical to SEQ ID NO: 810935

SEQ ID NO: 862033 - protein, 192 aa, Homo sapiens; identical to SEQ ID NO: 810935

SEQ ID NO: 862034 - protein, 192 aa, Homo sapiens; identical to SEQ ID NO: 810935

SEQ ID NO: 862035 - protein, 134 aa, Homo sapiens
GNLLPLLSLHPHTPSDPRTASLPPLDPYNLVSPHPPAQWFPEVRHHCPSTPIILVGTKLDLRDDKDTIEKLKEKKLAPITYPQGLALAKEIDSVKYLECSALTQRGLKTVFDEAIRAVLCPQPTRQQKRACSLL

SEQ ID NO: 862036 - protein, 192 aa, Homo sapiens; identical to SEQ ID NO: 810935

SEQ ID NO: 862037 - protein, 505 aa, Homo sapiens
MASGRRAPRTGLLELRAGAGSGAGGERWQRVLLSLAEDVLTVSPADGDPGPEPGAPREQEPAQLNGAAEPGAGPPQLPEALLLQRRRVTVRKADAGGLGISIKGGRENKMPILISKIFKGLAADQTEALFVGDAILSVNGEDLSSATHDEAVQVLKKTGKEVVLEVKYMKDVSPYFKNSTGGTSVGWDSPPASPLQRQPSSPGPTPRNFSEAKHMSLKMAYVSKRCTPNDPEPRYLEICSADGQDTLFLRAKDEASARSWATAIQAQVNTLTPRVKDELQALLAATSTAGSQDIKQIGWLTEQLPSGGTAPTLALLTEKELLLYLSLPETREALSRPARTAPLIATRLVHSGPSKGSVPYDAELSFALRTGTRHGVDTHLFSVESPQELAAWTRQLVDGCHRAAEGVQEVSTACTWNGRPCSLSVHIDKGFTLWAAEPGAARAVLLRQPFEKLQMSSDDGASLLFLDFGGAEGEIQLDLHSCPKTIVFIIHSFLSAKVTRLGLLA

SEQ ID NO: 862038 - protein, 129 aa, Homo sapiens
MASGRRAPRTGLLELRAGAGSGAGGERWQRVLLSLAEDVLTVSPADGDPGPEPGAPREQEPAQLNGAADSERPIPRVAMEALTTAIKRALNLKTAMINGENAKETCDDNRGNNEMERRKNDQKPIQVTK

SEQ ID NO: 862039 - protein, 505 aa, Homo sapiens; identical to SEQ ID NO: 862037

SEQ ID NO: 862040 - protein, 496 aa, Homo sapiens
MASGRRAPRTGLLELRAGAGSGAGGERWQRVLLSLAEDVLTVSPADGDPGPEPGAPREQEPAQLNGAAEPGAGPPQLPEALLLQRRRVTVRKADAGGLGISIKGGRENKMPILISKIFKGLAADQTEALFVGDAILSVNGEDLSSATHDEAVQVLKKTGKEVVLEVKYMKDVSPYFKNSTGGTSVGWDSPPASPLQRQPSSPGPTPRNFSEAKHMSLKMAYVSKRCTPNDPEPRYLEICSADGQDTLFLRAKDEASARSWATAIQAQVNTLTPRVKDELQALLAATSTAGSQDIKQIGWLTEQLPSGGTAPTLALLTEKELLLYLSLPETREALSRPARTAPLIATRLVHSGPSKGSVPYDAELSFALRTGTRHGVDTHLFSVESPQELAAWTRQLVDGCHRAAEGVQEVSTGVLGGSGSVPLPARGMGVPAACLCTSTRASHCGRLSQVQPELCSCDSPSRSCRCLQMTVPVSFSWILEVLKARSSWTCTRVPKP

SEQ ID NO: 862041 - protein, 442 aa, Homo sapiens
MASGRRAPRTGLLELRAGAGSGAGGERWQRVLLSLAEDVLTVSPADGDPGPEPGAPREQEPAQLNGAAEPGAGPPQLPEALLLQRRRVTVRKADAGGLGISIKGGRENKMPILISKIFKGLAADQTEALFVGDAILSVNGEDLSSATHDEAVQVLKKTGKEVVLEVKYMKDVSPYFKNSTGGTSVGWDSPPASPLQRQPSSPGPTPRNFSEAKHMSLKMAYVSKRCTPNDPEPRYLEICSADGQDTLFLRAKDEASARSWATAIQAQVNTLTPRVKDELQALLAATSTAGSQDIKQIGWLTEQLPSGGTAPTLALLTEKELLLYLSLPETREALSRPARTAPLIATRLVHSGPSKGSVPYDAELSFALRTGTRHGVDTHLFSVESPQELAAWTRQLVDGCHRAAEGVQEVSTACTWNGRPCSLSVPSCAPATALREAADVFR

SEQ ID NO: 862042 - protein, 125 aa, Homo sapiens
MQSSLLPCARARVTVWTLTCSAWSHRRSWLPGPASLWMAVTGPPRVCRRCLQPARGMGVPAACLCTSTRASHCGRLSQVQPELCSCDSPSRSCRCLQMTVPVSFSWILEVLKARSSWTCTRVPKP

SEQ ID NO: 862043 - protein, 168 aa, Homo sapiens [sequence omitted]

SEQ ID NO: 862044 - protein, 505 aa, Homo sapiens; identical to SEQ ID NO: 862037

SEQ ID NO: 862045 - protein, 300 aa, Homo sapiens
TKTTTPQTKLLKLSARSRPRCYSAEAEPRYLEICSADGQDTLFLRAKDEASARSWATAIQAQVNTLTPRVKDELQALLAATSTAGSQDIKQIGWLTEQLPSGGTAPTLALLTEKELLLYLSLPETREALSRPARTAPLIATRLVHSGPSKGSVPYDAELSFALRTGTRHGVDTHLFSVESPQELAAWTRQLVDGCHRAAEGVQEVSTACTWNGRPCSLSVHIDKGFTLWAAEPGAARAVLLRQPFEKLQMSSDDGASLLFLDFGGAEGEIQLDLHSCPKTIVFIIHSFLSAKVTRLGLLA

SEQ ID NO: 862046 - protein, 476 aa, Homo sapiens
MASGRRAPRTGLLELRAGAGSGAGGERWQRVLLSLAEDVLTVSPADGDPGPEPGAPREQEPAQLNGAAEPGAGPPQLPEALLLQRRRVTVRKADAGGLGISIKGGRENKMPILISKIFKGLAADQTEALFVGDAILSVNGEDLSSATHDEAVQVLKKTGKEVVLEVKYMKDVSPYFKNSTGGTSVGWDSPPASPLQRQPSSPGPTPRNFSEAKHMSLKMAYVSKRCTPNDPEPRYLEICSADGQDTLFLRAKDEASARSWATAIQAQVNTLTPRVKDELQALLAATSTAGSQDIKQIGWLTEQLPSGGTAPTLALLTEKELLLYLSLPETREALSRPARTAPLIATRYPQAGAVCLPQNLPGDAPAGPQKLGTPALSTLSYSPACTWNGRPCSLSVHIDKGFTLWAAEPGAARAVLLRQPFEKLQMSSDDGASLLFLDFGGAEGEIQLDLHSCPKTIVFIIHSFLSAKVTRLGLLA

SEQ ID NO: 862047 - protein, 505 aa, Homo sapiens; identical to SEQ ID NO: 862037

SEQ ID NO: 862048 - protein, 505 aa, Homo sapiens; identical to SEQ ID NO: 862037

SEQ ID NO: 862049 - protein, 100 aa, Homo sapiens
PMAELSLRSTAAALYGVLFEKSKEAAFANHRLWEALGFVIAFGYSTFLCVHVKLYILLGVLSLTMVAYGLVECVESKNPIRPHAPGQANQAEDEEIQTKM

SEQ ID NO: 862050 - protein, 78 aa, Homo sapiens
MANENHGSPREEASLLSHSPGTSNQSQPCSPKPIRLVQDLPEELVHAGWEKCWSGERHMGWGILRVEVHATASAGSQI

SEQ ID NO: 862051 - protein, 704 aa, Homo sapiens
MANENHGSPREEASLLSHSPGTSNQSQPCSPKPIRLVQDLPEELVHAGWEKCWSRRENRPYYFNRFTNQSLWEMPVLGQHDVISDPLGLNATPLPQDSSLVETPPAENKPRKRQLSEEQPSGNGVKKPKIEIPVTPTGQSVPSSPSIPGTPTLKMWGTSPEDKQQAALLRPTEVYWDLDIQTNAVIKHRGPSEVLPPHPEVELLRSQLILKLRQHYRELCQQREGIEPPRESFNRWMLERKVVDKGSDPLLPSNCEPVVSPSMFREIMNDIPIRLSRIKFREEAKRLLFKYAEAARRLIESRSASPDSRKVVKWNVEDTFSWLRKDHSASKEDYMDRLEHLRRQCGPHVSAAAKDSVEGICSKIYHISLEYVKRIREKHLAILKENNISEEVEAPEVEPRLVYCYPVRLAVSAPPMPSVEMHMENNVVCIRYKGEMVKVSRNYFSKLWLLYRYSCIDDSAFERFLPRVWCLLRRYQMMFGVGLYEGTGLQGSLPVHVFEALHRLFGVSFECFASPLNCYFRQYCSAFPDTDGYFGSRGPCLDFAPLSGSFEANPPFCEELMDAMVSHFERLLESSPEPLSFIVFIPEWREPPTPALTRMEQSRFKRHQLILPAFEHEYRSGSQHICKKEEMHYKAVHNTAVLFLQNDPGFAKWAPTPERLQELSAAYRQSGRSHSSGSSSSSSSEAKDRDSGREQGPSREPHPT

SEQ ID NO: 862052 - protein, 704 aa, Homo sapiens; identical to SEQ ID NO: 862051

SEQ ID NO: 862053 - protein, 704 aa, Homo sapiens; identical to SEQ ID NO: 862051

SEQ ID NO: 862054 - protein, 152 aa, Homo sapiens
ASEFIPSSVHPQAYKAVSPSSAPQGTAGTDGKKGRGPKASWVRGASRPCHTQDGGAAAARSLRGGTSACAARSPGPGHKMAAAALGRARRRRQNGRSSRTCSRVPSSPLRAGKSPRKPWSRSEPRQGLGIRSWGAAAPPALSARDCRLPCLC

SEQ ID NO: 862055 - protein, 704 aa, Homo sapiens; identical to SEQ ID NO: 862051

SEQ ID NO: 862056 - protein, 732 aa, Homo sapiens
MANENHGSPREEASLLSHSPGTSNQSQPCSPKPIRLVQDLPEELVHAGWEKCWSRRENRPYYFNRFTNQSLWEMPVLGQHDVISDPLGLNATPLPQDSSLVETPPAENKPRKRQLSEEQPSGNGVKKPKIEIPVTPTGQSVPSSPSIPGTPTLKMWGTSPEDKQQAALLRPTEVYWDLDIQTNAVIKHRGPSEVLPPHPEVELLRSQLILKLRQHYRELCQQREGIEPPRESFNRWMLERKVVDKGSDPLLPSNCEPVVSPSMFREIMNDIPIRLSRIKFREEAKRLLFKYAEAARRLIESRSASPDSRKVVKWNVEDTFSWLRKDHSASKEDYMDRLEHLRRQCGPHVSAAAKDSVEGICSKIYHISLEYVKRIREKHLAILKENNISEEVEAPEVEPRLVYCYPVRLAVSAPPMPSVEMHMENNVVCIRYKGEMVKVSRNYFSKLWLLYRYSCIDDSAFERFLPRVWCLLRRYQMMFGVGLYEGTGLQGSLPVHVFEALHRLFGVSFECFASPLNCYFRQYCSAFPDTDGYFGSRGPCLDFAPLSGSFEANPPFCEELMDAMVSHFERLLESSPEPLSFIVFIPEWREPPTPALTRMEQSRFKRHQLILPAFEHEYRSGSQHICKKWVPGRAGEGGWAGQARPSPTLAIAFARREEMHYKAVHNTAVLFLQNDPGFAKWAPTPERLQELSAAYRQSGRSHSSGSSSSSSSEAKDRDSGREQGPSREPHPT

SEQ ID NO: 862057 - protein, 704 aa, Homo sapiens; identical to SEQ ID NO: 862051

SEQ ID NO: 862058 - protein, 270 aa, Homo sapiens
ALLKAPPLCPAPQWLLYRYSCIDDSAFERFLPRVWCLLRRYQMMFGVGLYEGTGLQGSLPVHVFEALHRLFGVSFECFASPLNCYFRQYCSAFPDTDGYFGSRGPCLDFAPLSGSFEANPPFCEELMDAMVSHFERLLESSPEPLSFIVFIPEWREPPTPALTRMEQSRFKRHQLILPAFEHEYRSGSQHICKKEEMHYKAVHNTAVLFLQNDPGFAKWAPTPERLQELSAAYRQSGRSHSSGSSSSSSSEAKDRDSGREQGPSREPHPT

SEQ ID NO: 862059 - protein, 131 aa, Homo sapiens
MRCQPPPCCHTQLWLFHLHCCLESQHLRTHSADIDWFLLDTLFAALVIYNFLSLCYEYLGGESSIMSEIRGKPIESSCMYGTCCLWGKTYSIGFLRFCKQATLQFCVVKPLMAVSTVVLQAFGKYRDGDFE

SEQ ID NO: 862060 - protein, 204 aa, Homo sapiens
MRAAAALHWARDAPAAAETPGLRRRPPRPQSPAAAHRPQTPPPPWAPEVSRLAGLAREPQGGAATPERGGLLVSERPARGTPGFGRRLPGGEGTTEAGAAAEGGGIRLPTRASSPPREVARGCARSLSTPTWRGQLLECNRTCPGGGPGRGRRMDQGALQEGLCAPGWVCWRLARPSEWGRRPCPVRVAVTWEGGRRGAFGAAS

SEQ ID NO: 862061 - protein, 419 aa, Homo sapiens
MRAAAALHWARDAPAAAETPGLRRRPPRPQSPAAAHRPQTPPPPWAPEASLSLSAKVSLREPPAARHHDSEGGCAGPGSSVAHDRSSLAQRLRDPRGQPHCHGAACVPDDNCRSGHLWLLRVDGPAHHMPPALVIYNFLSLCYEYLGGESSIMSEIRGKPIESSCMYGTCCLWGKTYSIGFLRFCKQATLQFCVVKPLMAVSTVVLQAFGKYRDGDFDVTSGYLYVTIIYNISVSLALYALFLFYFATRELLSPYSPVLKFFMVKSVIFLSFWQGMLLAILEKCGAIPKIHSARVSVGEGTVAAGYQDFIICVEMFFAALALRHAFTYKVYADKRLDAQGRCAPMKSISSSLKETMNPHDIVQDAIHNFSPAYQQYTQQSTLEPGPTWRGGAHGLSRSHSLSGARDNEKTLLLSSDDEF

SEQ ID NO: 862062 - protein, 217 aa, Homo sapiens
PCLADALFNFHLNLDPALFYSKSSWVASVICPLCFLLISFRTLDAHPALRSARCPVLKFFMVKSVIFLSFWQGMLLAILEKCGAIPKIHSARVSVGEGTVAAGYQDFIICVEMFFAALALRHAFTYKVYADKRLDAQGRCAPMKSISSSLKETMNPHDIVQDAIHNFSPAYQQYTQQSTLEPGPTWRGGAHGLSRSHSLSGARDNEKTLLLSSDDEF

SEQ ID NO: 862063 - protein, 407 aa, Homo sapiens
MTVRGDVLAPDPASPTTAAASPSVSVIPEGSPTAMEQPVFLMTTAAQAISGFFVWTALLITCHQIYMHLRCYSCPNEQRYIVRILFIVPIYAFDSWLSLLFFTNDQYYVYFGTVRDCYEALVIYNFLSLCYEYLGGESSIMSEIRGKPIESSCMYGTCCLWGKTYSIGFLRFCKQATLQFCVVKPLMAVSTVVLQAFGKYRDGDFDVTSGYLYVTIIYNISVSLALYALFLFYFATRELLSPYSPVLKFFMVKSVIFLSFWQGMLLAILEKCGAIPKIHSARVSVGEGTVAAGYQDFIICVEMFFAALALRHAFTYKVYADKRLDAQGRCAPMKSISSSLKETMNPHDIVQDAIHNFSPAYQQYTQQSTLEPGPTWRGGAHGLSRSHSLSGARDNEKTLLLSSDDEF

SEQ ID NO: 862064 - protein, 407 aa, Homo sapiens; identical to SEQ ID NO: 862063

SEQ ID NO: 862065 - protein, 55 aa, Homo sapiens
ELLSPYSPVLKFFMVKSVIFLSFWQGEPPPSTWRLPMPPCPLRFLLPLLLMVPGA

SEQ ID NO: 862066 - protein, 407 aa, Homo sapiens; identical to SEQ ID NO: 862063

SEQ ID NO: 862067 - protein, 149 aa, Homo sapiens
MSVTVRDLLSEALVIYNFLSLCYEYLGGESSIMSEIRGKPIESSCMYGTCCLWGKTYSIGFLRFCKQATLQFCVVKPLMAVSTVVLQAFGKYRDGDFDVTSGYLYVTIIYNISYLGQARWLTPVIPALWEAEAGGSPEDRSSRPPWPTW

SEQ ID NO: 862068 - protein, 376 aa, Homo sapiens
PGLGWAKCDVMRAGTRHPGAAGLRTVVEQLLAFIYMHLRCYSCPNEQRYIVRILFIVPIYAFDSWLSLLFFTNDQYYVYFGTVRDCYEALVIYNFLSLCYEYLGGESSIMSEIRGKPIESSCMYGTCCLWGKTYSIGFLRFCKQATLQFCVVKPLMAVSTVVLQAFGKYRDGDFDVTSGYLYVTIIYNISVSLALYALFLFYFATRELLSPYSPVLKFFMVKSVIFLSFWQGMLLAILEKCGAIPKIHSARVSVGEGTVAAGYQDFIICVEMFFAALALRHAFTYKVYADKRLDAQGRCAPMKSISSSLKETMNPHDIVQDAIHNFSPAYQQYTQQSTLEPGPTWRGGAHGLSRSHSLSGARDNEKTLLLSSDDEF

SEQ ID NO: 862069 - protein, 426 aa, Homo sapiens
MTVRGDVLAPDPASPTTAAASPSVSVIPEGSPTAMEQPVFLMTTAAQAISGFFVWTALLITCHQIYMHLRCYSCPNEQRYIVRILFIVPIYAFDSWLSLLFFTNDQYYVYFGTVRDCYEALVIYNFLSLCYEYLGGESSIMSEIRGKPIESSCMYGTCCLWGKTYSIGFLRFCKQATLQFCVVKPLMAVSTVVLQAFGKYRDGDFDVTSGYLYVTIIYNISVSLALYALFLFYFATRELLSPYSPVLKFFMVKSVIFLSFWQGMLLAILEKCGAIPKIHSARVSVGEGTVAAGYQDFIICVEMFFAALALRHAFTYKVYADKRLDAQVPTYGPYASSPAPPAPCPAGRCAPMKSISSSLKETMNPHDIVQDAIHNFSPAYQQYTQQSTLEPGPTWRGGAHGLSRSHSLSGARDNEKTLLLSSDDEF

SEQ ID NO: 862070 - protein, 407 aa, Homo sapiens; identical to SEQ ID NO: 862063

SEQ ID NO: 862071 - protein, 206 aa, Homo sapiens
MTVRGDVLAPDPASPTTAAASPSVSVIPEGSPTAMEQPVFLMTTAAQAISGFFVWTALLITCHQIYMHLRCYSCPNEQRYIVRILFIVPIYAFDSWLSLLFFTNDQYYVYFGTVRDCYEALVIYNFLSLCYEYLGGESSIMSEIRGKPIESSCMYGTCCLWGKTYSIGFLRFCKQATLQFCVVKPLMAVSTVVLQAFGKYRDGDFE

SEQ ID NO: 862072 - protein, 318 aa, Homo sapiens
MAGLKRRASQVWPEEHGEQEHGLYSLHRMFDIVGTHLTHRDVRVLSFLFVDVIDDHERGLIRNGRDFLLALERQGRCDESNFRQVLQLLRIITRHDLLPYVTLKRRRAVCPDLVDKYLEETSIRYVTPRALSDPEPRPPQPSKTVPPHYPVVCCPTSGPQMCSKRPARGRATLGSQRKRRKSVTPDPKEKQTCDIRLRVRAEYCQHETALQGNVFSNKQDPLERQFERFNQANTILKSRDLGSIICDIKFSELTYLDAFWRDYINGSLLEALKGVFITDSLKQAVGHEAIKLLVNVDEEDYELGRQKLLRNLMLQALP

SEQ ID NO: 862073 - protein, 318 aa, Homo sapiens; identical to SEQ ID NO: 862072

SEQ ID NO: 862074 - protein, 318 aa, Homo sapiens; identical to SEQ ID NO: 862072

SEQ ID NO: 862075 - protein, 318 aa, Homo sapiens; identical to SEQ ID NO: 862072

SEQ ID NO: 862076 - protein, 318 aa, Homo sapiens; identical to SEQ ID NO: 862072

SEQ ID NO: 862077 - protein, 318 aa, Homo sapiens; identical to SEQ ID NO: 862072

SEQ ID NO: 862078 - protein, 303 aa, Homo sapiens
MAGLKRRASQVWPEEHGEQEHGLYSLHRMFDIVGTHLTHRDVRVLSFLFVDVIDDHERGLIRNGRDFLLALERQGRCDESNFRQVLQLLRIITRHDLLPYVTLKRRRAVCPDLVDKYLEETSIRYVTPRALSDPEPRPPQPSKTVPPHYPVVCCPTSGPQMCSKRPARGRATLGSQRKHIRLRVRAEYCQHETALQGNVFSNKQDPLERQFERFNQANTILKSRDLGSIICDIKFSELTYLDAFWRDYINGSLLEALKGVFITDSLKQAVGHEAIKLLVNVDEEDYELGRQKLLRNLMLQALP

SEQ ID NO: 862079 - protein, 158 aa, Homo sapiens
MCSKRPARGRATLGSQRKRRKSVTPDPKEKQTCDIRLRVRAEYCQHETALQGNVFSNKQDPLERQFERFNQANTILKSRDLGSIICDIKFSELTYLDAFWRDYINGSLLEALKGVFITDSLKQAVGHEAIKLLVNVDEEDYELGRQKLLRNLMLQALP

SEQ ID NO: 862080 - protein, 114 aa, Homo sapiens
MAGLKRRASQVWPEEHGEQEHGLYSLHRMFDIVGTHLTHRDVRVLSFLFVDVIDDHERGLIRNGRDFLLALERQGRCDESNFRQVLQLLRIITRHDLLPYVTLKRRRAARCILA

SEQ ID NO: 862081 - protein, 114 aa, Homo sapiens; identical to SEQ ID NO: 862080

SEQ ID NO: 862082 - protein, 318 aa, Homo sapiens; identical to SEQ ID NO: 862072

SEQ ID NO: 862083 - protein, 318 aa, Homo sapiens; identical to SEQ ID NO: 862072

SEQ ID NO: 862084 - protein, 318 aa, Homo sapiens; identical to SEQ ID NO: 862072

SEQ ID NO: 862085 - protein, 318 aa, Homo sapiens; identical to SEQ ID NO: 862072

SEQ ID NO: 862086 - protein, 318 aa, Homo sapiens; identical to SEQ ID NO: 862072

SEQ ID NO: 862087 - protein, 348 aa, Homo sapiens
MAGLKRRASQVWPEEHGEQEHGLYSLHRMFDIVGTHLTHRDVRVLSFLFVDVIDDHERGLIRNGRDFLLALERQGRCDESNFRQVLQLLRIITRHDLLPYVTLKRRRAVCPDLVDKYLEETSIRYVTPRALSDPEPRPPQPSKTVPPHYPVVCCPTSGPQMCSKRPARGRATLGSQRKRRKSVTPDPKEKQTCGEEVQGFQRWSRLEGEYKELLGHWAVYAIQYIRLRVRAEYCQHETALQGNVFSNKQDPLERQFERFNQANTILKSRDLGSIICDIKFSELTYLDAFWRDYINGSLLEALKGVFITDSLKQAVGHEAIKLLVNVDEEDYELGRQKLLRNLMLQALP

SEQ ID NO: 862088 - protein, 158 aa, Homo sapiens; identical to SEQ ID NO: 862079

SEQ ID NO: 862089 - protein, 233 aa, Homo sapiens
MAGLKRRASQVWPEEHGEQEHGLYSLHRMFDIVGTHLTHRDVRVLSFLFVDVIDDHERGLIRNGRDFLLALERQGRCDESNFRQVLQLLRIITRHDLLPYVTLKRRRAVCPDLVDKYLEETSIRYVTPRALSDPEPRPPQPSKTVPPHYPVVCCPTSGPQMCSKRPARGRATLGSQRKRRKSVTPDPKEKQTCGEEVQGFQRWSRLEGEYKELLGHWAVYAIQCGHPIVVVLR

SEQ ID NO: 862090 - protein, 94 aa, Homo sapiens
FLVGLQSEPIVVSILVVLHIPDKGLIFLLQSLHPQLTISGSGVSLQHRDLRHNTSRGFIRHLGPGRKRNAEVVLPVAYLKAPSSLLWEDETLGC

SEQ ID NO: 862091 - protein, 452 aa, Homo sapiens
MAELQMLLEEEIPSGKRALIESYQNLTRVADYCENNYIQATDKRKALEETKAYTTQSLASVAYQINALANNVLQLLDIQASQLRRMESSINHISQTVDIHKEKVARREIGILTTNKNTSRTHKIIAPANMERPVRYIRKPIDYTVLDDVGHGVKWLKAKHGNNQPARTGTLSRTNPPTQKPPSPPMSGRGTLGRNTPYKTLEPVKPPTVPNDYMTSPARLGSQHSPGRTASLNQRPRTHSGSSGGSGSRENSGSSSIGIPIAVPTPSPPTIGPAAPGSAPGSQYGTMTRQISRHNSTTSSTSSGGYRRTPSVTAQFSAQPHVNGGPLYSQNSIADSPTPPPPPPPDDIPMFDDSPPPPPPPPVDYEDEEAAVVQYNDPYADGDPAWAPKNYIEKVVAIYDYTKDKDDELSFMEGAIIYVIKKNDDGWYEGVCNRVTGLFPGNYVESIMHYTD

SEQ ID NO: 862092 - protein, 452 aa, Homo sapiens; identical to SEQ ID NO: 862091

SEQ ID NO: 862093 - protein, 452 aa, Homo sapiens; identical to SEQ ID NO: 862091

SEQ ID NO: 862094 - protein, 508 aa, Homo sapiens
MAELQMLLEEEIPSGKRALIESYQNLTRVADYCENNYIQATDKRKALEETKAYTTQSLASVAYQINALANNVLQLLDIQASQLRRMESSINHISQTVDIHKEKVARREIGILTTNKNTSRTHKIIAPANMERPVRYIRKPIDYTVLDDVGHGVKWLKAKHGNNQPARTGTLSRTNPPTQKPPSPPMSGRGTLGRNTPYKTLEPVKPPTVPNDYMTSPARLGSQHSPGRTASLNQRPRTHSGSSGGSGSRENSGSSSIGIPIAVPTPSPPTIGPENISVPPPSGAPPAPPLAPLLPVSTVIAAPGSAPGSQYGTMTRQISRHNSTTSSTSSGGYRRTPSVTAQFSAQPHVNGGPLYSQNSISIAPPPPPMPQLTPQIPLTGFVARVQENIADSPTPPPPPPPDDIPMFDDSPPPPPPPPVDYEDEEAAVVQYNDPYADGDPAWAPKNYIEKVVAIYDYTKDKDDELSFMEGAIIYVIKKNDDGWYEGVCNRVTGLFPGNYVESIMHYTD

SEQ ID NO: 862095 - protein, 481 aa, Homo sapiens
MAELQMLLEEEIPSGKRALIESYQNLTRVADYCENNYIQATDKRKALEETKAYTTQSLASVAYQINALANNVLQLLDIQASQLRRMESSINHISQTVDIHKEKVARREIGILTTNKNTSRTHKIIAPANMERPVRYIRKPIDYTVLDDVGHGVKWLKAKHGNNQPARTGTLSRTNPPTQKPPSPPMSGRGTLGRNTPYKTLEPVKPPTVPNDYMTSPARLGSQHSPGRTASLNQRPRTHSGSSGGSGSRENSGSSSIGIPIAVPTPSPPTIGPAAPGSAPGSQYGTMTRQISRHNSTTSSTSSGGYRRTPSVTAQFSAQPHVNGGPLYSQNSISIAPPPPPMPQLTPQIPLTGFVARVQENIADSPTPPPPPPPDDIPMFDDSPPPPPPPPVDYEDEEAAVVQYNDPYADGDPAWAPKNYIEKVVAIYDYTKDKDDELSFMEGAIIYVIKKNDDGWYEGVCNRVTGLFPGNYVESIMHYTD

SEQ ID NO: 862096 - protein, 459 aa, Homo sapiens
MAELQMLLEEEIPSGKRALIESYQNLTRVADYCENNYIQATDKRKALEETKAYTTQSLASVAYQINALANNVLQLLDIQASQLRRMESSINHISQTVDIHKEKVARREIGILTTNKNTSRTHKIIAPANMERPVRYIRKPIDYTVLDDVGHGVKWLKAKHGNNQPARTGTLSRTNPPTQKPPSPPMSGRGTLGRNTPYKTLEPVKPPTVPNDYMTSPARLGSQHSPGRTASLNQRPRTHSGSSGGSGSRENTAPGSAPGSQYGTMTRQISRHNSTTSSTSSGGYRRTPSVTAQFSAQPHVNGGPLYSQNSISIAPPPPPMPQLTPQIPLTGFVARVQENIADSPTPPPPPPPDDIPMFDDSPPPPPPPPVDYEDEEAAVVQYNDPYADGDPAWAPKNYIEKVVAIYDYTKDKDDELSFMEGAIIYVIKKNDDGWYEGVCNRVTGLFPGNYVESIMHYTD

SEQ ID NO: 862097 - protein, 393 aa, Homo sapiens
MAELQMLLEEEIPSGKRALIESYQNLTRVADYCENNYIQATDKRKALEETKAYTTQSLASVAYQINALANNVLQLLDIQASQLRRMESSINHISQTVDIHKEKVARREIGILTTNKNTSRTHKIIAPANMERPVRYIRKPIDYTVLDDVGHGVKWLKAKHGNNQPARTGTLSRTNPPTQKPPSPPMSGRGTLGRNTPYKTLEPVKPPTVPNDYMTSPARLGSQHSPGRTASLNQRPRTHSGSSGGSGSRENSGSSSIGIPIAVPTPSPPTIGPVADSPTPPPPPPPDDIPMFDDSPPPPPPPPVDYEDEEAAVVQYNDPYADGDPAWAPKNYIEKVVAIYDYTKDKDDELSFMEGAIIYVIKKNDDGWYEGVCNRVTGLFPGNYVESIMHYTD

SEQ ID NO: 862098 - protein, 288 aa, Homo sapiens
MAELQMLLEEEIPSGKRALIESYQNLTRVADYCENNYIQATDKRKALEETKAYTTQSLASVAYQINALANNVLQLLDIQASQLRRMESSINHISQTVDIHKEKVARREIGILTTNKNTSRTHKIIAPANMERPVRYIRKPIDYTVLDDVGHGVKWLKAKHGNNQPARTGTLSRTNPPTQKPPSPPMSGRGTLGRNTPYKTLEPVKPPTVPNDYMTSPARLGSQHSPGRTASLNQRPRTHSSPGLSSWFPVWHNDQADISTQLYYFFDIFWWIQTNSLCDCSIFCSASC

SEQ ID NO: 862099 - protein, 481 aa, Homo sapiens; identical to SEQ ID NO: 862095

SEQ ID NO: 862100 - protein, 103 aa, Homo sapiens
MFDDSPPPPPPPPVDYEDEEAAVVQYNDPYADGDPAWAPKNYIEKVVAIYDYTKDKDDELSFMEGAIIYVIKKNDDGWYEGVCNRVTGLFPGNYVESIMHYTD

SEQ ID NO: 862101 - protein, 395 aa, Homo sapiens
MAELQMLLEEEIPSGKRALIESYQNLTRVADYCENNYIQATDKRKALEETKAYTTQSLASVAYQINALANNVLQLLDIQASQLRRMESSINHISQTVDIHKEKVARREIGILTTNKNTSRTHKIIAPANMERPVRYIRKPIDYTVLDDVGHGVKWLKAKHGNNQPARTGTLSRTNPPTQKPPSPPMSGRGTLGRNTPYKTLEPVKPPTVPNDYMTSPARLGSQHSPGRTASLNQRPRTHSGSSGGSGSRENSGSSSIGIPIAVPTPSPPTIGPAAPGSAPGSQYGTMTRQISRHNSTTSSTSSGGYRRTPSVTAQFSAQPHVNGGPLYSQNSISIAPPPPPMPQLTPQIPLTGFVARVQENSKFGKTELWKSRGCLLIACMADDESSFSLLLLRS

SEQ ID NO: 862102 - protein, 176 aa, Homo sapiens
MAELQMLLEEEIPSGKRALIESYQNLTRVADYCENNYIQATDKRKALEETKAYTTQSLASVAYQINALANNVLQLLDIQASQLRRMESSINHISQTVDIHKEKVARREIGILTTNKNTSRTHKIIAPANMERPVRYIRKPIDYTVLDDVGHGVKWLKASILYYINKLICISSKYFG

SEQ ID NO: 862103 - protein, 508 aa, Homo sapiens; identical to SEQ ID NO: 862094

SEQ ID NO: 862104 - protein, 481 aa, Homo sapiens; identical to SEQ ID NO: 862095

SEQ ID NO: 862105 - protein, 452 aa, Homo sapiens; identical to SEQ ID NO: 862091

SEQ ID NO: 862106 - protein, 422 aa, Homo sapiens
MAELQMLLEEEIPSGKRALIESYQNLTRVADYCENNYIQATDKRKALEETKAYTTQSLASVAYQINALANNVLQLLDIQASQLRRMESSINHISQTVDIHKEKVARREIGILTTNKNTSRTHKIIAPANMERPVRYIRKPIDYTVLDDVGHGVKWLKAKHGNNQPARTGTLSRTNPPTQKPPSPPMSGRGTLGRNTPYKTLEPVKPPTVPNDYMTSPARLGSQHSPGRTASLNQRPRTHSGSSGGSGSRENSGSSSIGIPIAVPTPSPPTIGPVSIAPPPPPMPQLTPQIPLTGFVARVQENIADSPTPPPPPPPDDIPMFDDSPPPPPPPPVDYEDEEAAVVQYNDPYADGDPAWAPKNYIEKVVAIYDYTKDKDDELSFMEGAIIYVIKKNDDGWYEGVCNRVTGLFPGNYVESIMHYTD

SEQ ID NO: 862107 - protein, 481 aa, Homo sapiens; identical to SEQ ID NO: 862095

SEQ ID NO: 862108 - protein, 177 aa, Homo sapiens
VPSSFNCGLYPGCEVLGASADLAASVSLTREEAMQRGGKWQSPQIPLTGFVARVQENIADSPTPPPPPPPDDIPMFDDSPPPPPPPPVDYEDEEAAVVQYNDPYADGDPAWAPKNYIEKVVAIYDYTKDKDDELSFMEGAIIYVIKKNDDGWYEGVCNRVTGLFPGNYVESIMHYTD

SEQ ID NO: 862109 - protein, 352 aa, Homo sapiens
MAELQMLLEEEIPSGKRALIESYQNLTRVADYCENNYIQATDKRKALEETKAYTTQSLASVAYQINALANNVLQLLDIQASQLRRMESSINHISQTVDIHKEKVARREIGILTTNKNTSRTHKIIAPANMERPVRYIRKPIDYTVLDDVGHGVKWLKAKHGNNQPARTGTLSRTNPPTQKPPSPPMSGRGTLGRNTPYKTLEPVKPPTVPNDYMTSPARLGSQHSPGRTASLNQRPRTHSGSSGGSGSRENSGSSSIGIPIAVPTPSPPTIGPAAPGSAPGSQYGTMTRQISRHNSTTSSTSSGGYRRTPSVTAQFSAQPHVNGGPLYSQNSSKLVLCRHTATVELLLKEII

SEQ ID NO: 862110 - protein, 234 aa, Homo sapiens
MAELQMLLEEEIPSGKRALIESYQNLTRVADYCENNYIQATDKRKALEETKAYTTQSLASVAYQINALANNVLQLLDIQASQLRRMESSINHISQTVDIHKEKVARREIGILTTNKNTSRTHKIIAPANMERPVRYIRKPIDYTVLDDVGHGVKWLKAKHGNNQPARTGTLSRTNPPTQKPPSPPMSGRGTLGGYSYKTWNLETPKSSDYMTGCRVDVVSRGSSYRAALAPGRD

SEQ ID NO: 862111 - protein, 342 aa, Homo sapiens
MRKETPPPLVPPAAREWNLPPNAPACMERQLEAARYRSDGALLLGASSLSGRCWAGSLWLFKDPCAAPNEGFCSAGVQTEAGVADLTWVGERGILVASDSGAVELWELDENETLIVSKFCKYEHDDIVSTVSVLSSGTQAVSGSKDICIKVWDLAQQVVLSSYRAHAAQVTCVAASPHKDSVFLSCSEDNRILLWDTRCPKPASQIGCSAPGYLPTSLAWHPQQSEVFVFGDENGTVSLVDTKSTSCVLSSAVHSQCVTGLVFSPHSVPFLASLSEDCSLAVLDSSLSELFRSQAHRDFVRDATWSPLNHSLLTTVGWDHQVVHHVVPTEPLPAPGPASVTE

SEQ ID NO: 862112 - protein, 330 aa, Homo sapiens
MRKETPPPLVPPAAREWNLPPNAPACMERQLEAARYRSDGALLLGASSLSGRCWAGSLWLFKDPCAAPNEGFCSAGVQTEAGVADLTWVGERGILVASDSGAVELWELDENETLIVSKFCKYEHDDIVSTVSVLSSGTQAVSGSKDICIKVWDLAQQVVLSSYRAHAAQVTCVAASPHKDSVFLSCSEDNRILLWDTRCPKPASQIGCSAPGYLPTSLAWHPQQSEVFVFGDENGTVSLVDTKSTSCVLSSAVHSQCVTGLVFSPHSVPFLASLSEDCSLAVLDSSLSELFRSQAHRDFVRDATWSPLNHPLDLQVLLSRLDLRQKASPP

SEQ ID NO: 862113 - protein, 302 aa, Homo sapiens
MRKETPPPLVPPAAREWNLPPNAPACMERQLEAARYRSDGALLLGASSLSGRCWAGSLWLFKDPCAAPNEGFCSAGVQTEAGVADLTWVGERGILVASDSGAVELWELDENETLIVSKFCKYEHDDIVSTVSVLSSGTQAVSGSKDICIKVWDLAQQVVLSSYRAHAAQVTCVAASPHKDSVFLSCSEDNRILLWDTRCPKPASQIGCSAPGYLPTSLAWHPQQSEVFVFGDENGTVSLVDTKSTSCVLSSAVHSQCVTGLVFSPHSVPFLASLSEDCSLAVLDSSLSEFISSSMKIEDWIG

SEQ ID NO: 862114 - protein, 312 aa, Homo sapiens
MRKETPPPLVPPAAREWNLPPNAPACMERQLEAARYRSDGALLLGASSLSGRCWAGSLWLFKDPCAAPNEGFCSAGVQTEAGVADLTWVGERGILVASDSGAVELWELDENETLIVSKFCKYEHDDIVSTVSVLSSGTQAVSGSKDICIKVWDLAQQVVLSSYRAHAAQVTCVAASPHKDSVFLSCSEDNRILLWDTRCPKPASQIGCSAPGYLPTSLAWHPQQSEVFVFGDENGTVSLVDTKSTSCVLSSAVHSQCVTGLVFSPHRLDLSQPSPPSDSVFPSWPLSVKTAHLLCWTQAFLSCLEAKPTETL

SEQ ID NO: 862115 - protein, 342 aa, Homo sapiens; identical to SEQ ID NO: 862111

SEQ ID NO: 862116 - protein, 342 aa, Homo sapiens; identical to SEQ ID NO: 862111

SEQ ID NO: 862117 - protein, 342 aa, Homo sapiens; identical to SEQ ID NO: 862111

SEQ ID NO: 862118 - protein, 340 aa, Homo sapiens
MRKETPLGRIREQACVSRDRNSQWAWSDRAALYTFLDGALLLGASSLSGRCWAGSLWLFKDPCAAPNEGFCSAGVQTEAGVADLTWVGERGILVASDSGAVELWELDENETLIVSKFCKYEHDDIVSTVSVLSSGTQAVSGSKDICIKVWDLAQQVVLSSYRAHAAQVTCVAASPHKDSVFLSCSEDNRILLWDTRCPKPASQIGCSAPGYLPTSLAWHPQQSEVFVFGDENGTVSLVDTKSTSCVLSSAVHSQCVTGLVFSPHSVPFLASLSEDCSLAVLDSSLSELFRSQAHRDFVRDATWSPLNHSLLTTVGWDHQVVHHVVPTEPLPAPGPASVTE

SEQ ID NO: 862119 - protein, 321 aa, Homo sapiens
MEVPQGACVVTGEVGAADGALLLGASSLSGRCWAGSLWLFKDPCAAPNEGFCSAGVQTEAGVADLTWVGERGILVASDSGAVELWELDENETLIVSKFCKYEHDDIVSTVSVLSSGTQAVSGSKDICIKVWDLAQQVVLSSYRAHAAQVTCVAASPHKDSVFLSCSEDNRILLWDTRCPKPASQIGCSAPGYLPTSLAWHPQQSEVFVFGDENGTVSLVDTKSTSCVLSSAVHSQCVTGLVFSPHSVPFLASLSEDCSLAVLDSSLSELFRSQAHRDFVRDATWSPLNHSLLTTVGWDHQVVHHVVPTEPLPAPGPASVTE

SEQ ID NO: 862120 - protein, 260 aa, Homo sapiens
ESTHNAQYMSIFKKAFPPCDYRNPESSLPQAEETMPINGTEHDDIVSTVSVLSSGTQAVSGSKDICIKVWDLAQQVVLSSYRAHAAQVTCVAASPHKDSVFLSCSEDNRILLWDTRCPKPASQIGCSAPGYLPTSLAWHPQQSEVFVFGDENGTVSLVDTKSTSCVLSSAVHSQCVTGLVFSPHSVPFLASLSEDCSLAVLDSSLSELFRSQAHRDFVRDATWSPLNHSLLTTVGWDHQVVHHVVPTEPLPAPGPASVTE

SEQ ID NO: 862121 - protein, 342 aa, Homo sapiens; identical to SEQ ID NO: 862111

SEQ ID NO: 862122 - protein, 302 aa, Homo sapiens; identical to SEQ ID NO: 862113

SEQ ID NO: 862123 - protein, 275 aa, Homo sapiens
MRKETPPPLVPPAAREWNLPPNAPACMERQLEAARYRSDGALLLGASSLSGRCWAGSLWLFKDPCAAPNEGFCSAGVQTEAGVADLTWVGERGILVASDSGAVELWELDENETLIVSKFCKYEHDDIVSTVSVLSSGTQAVSGSKDICIKVWDLAQQVVLSSYRAHAAQVTCVAASPHKDSVFLSCSEDNRILLWDTRCPKPASQIGCSAPGYLPTSLAWHPQQSEVFVFGDENGTVSLVDTKSTSCVLSSAVHSQCVTGLVFSPHRYCSLSSGA

SEQ ID NO: 862124 - protein, 269 aa, Homo sapiens
MRKETPPPLVPPAAREWNLPPNAPACMERQLEAARYRSDGALLLGASSLSGRCWAGSLWLFKDPCAAPNEGFCSAGVQTEAGVADLTWVGERGILVASDSGAVELWELDENETLIVSKFCKYEHDDIVSTVSVLSSGTQAVSGSKDICIKLRTLLSRVVLEFIPRLHAGPGPFVFAALLQRAPGSFSWRGNRIKLGNPCPSAVRLGAGRGSLNTGGAPQESLFWAKERHSWANTVWRKTTVSSPTATRSHLLCIFLIISSCLSHDPLLE

SEQ ID NO: 862125 - protein, 110 aa, Homo sapiens
MPGRGWPAGTQAEARGGTPQNGLAHKEEGEGVRASRPGDWNTPGRWELNWTTRQPLGPQRGSGGPDHRARRTESGWTTRGESAPTAERRTLAPITCGAAPRQPANMTQGH

SEQ ID NO: 862126 - protein, 302 aa, Homo sapiens; identical to SEQ ID NO: 862113

SEQ ID NO: 862127 - protein, 342 aa, Homo sapiens; identical to SEQ ID NO: 862111

SEQ ID NO: 862128 - protein, 342 aa, Homo sapiens; identical to SEQ ID NO: 862111

SEQ ID NO: 862129 - protein, 342 aa, Homo sapiens; identical to SEQ ID NO: 862111

SEQ ID NO: 862130 - protein, 342 aa, Homo sapiens; identical to SEQ ID NO: 862111

SEQ ID NO: 862131 - protein, 196 aa, Homo sapiens
MRKETPPPLVPPAAREWNLPPNAPACMERQLEAARYRSDGALLLGASSLSGRCWAGSLWLFKDPCAAPNEGFCSAGVQTEAGVADLTWVGERGILVASDSGAVELWELDENETLIVSKFCKYEHDDIVSTVSVLSSGTQAVSGSKDICIKVWDLAQQVVLSSYRAHAAQVTCVAASPHKDSVFLSCSECSLPGLSQ

SEQ ID NO: 862132 - protein, 285 aa, Homo sapiens
VIQAHRGQSLQQLQHNTISLRWLGGLLEEERQRKSEDKPCCAHKGGAGLLANLVHPCLEGGGWGLQFQDQCLPEVIVGVLIYNVRSSKDICIKVWDLAQQVVLSSYRAHAAQVTCVAASPHKDSVFLSCSEDNRILLWDTRCPKPASQIGCSAPGYLPTSLAWHPQQSEVFVFGDENGTVSLVDTKSTSCVLSSAVHSQCVTGLVFSPHSVPFLASLSEDCSLAVLDSSLSELFRSQAHRDFVRDATWSPLNHSLLTTVGWDHQVVHHVVPTEPLPAPGPASVTE

SEQ ID NO: 862133 - protein, 68 aa, Homo sapiens
LGIREGEQWVGESFSSSENCVVLLENRFSICIRRDLVMEAGWLLTLSIPGAHSQPQGQAVSLVEGGGR

SEQ ID NO: 862134 - protein, 219 aa, Homo sapiens
MRKETPPPLVPPAAREWNLPPNAPACMERQLEAARYRSDGALLLGASSLSGRCWAGSLWLFKDPCAAPNEGFCSAGVQTEAGVADLTWVGERGILVASDSGAVELWELDENETLIVSKFCKYEHDDIVSTVSVLSSGTQAVSGSKDICIKVWDLAQQVVLSSYRAHAAQVTCVAASPHKDSVFLSCSERKILLWGIPPLFPSPSSTELGWQRPGLTFPN

SEQ ID NO: 862135 - protein, 864 aa, Homo sapiens
MKMKTFVIIHFHLIQLGLQELFPQGHSCAVCGKVKCKRHRPSLLLENYQPWLDLKISSKVDASLSEVLELVLENFVYPWYRDVTDDESFVDELRITLRFFASVLIRRIHKVDIPSIITKKLLKAAMKHIEVIVKARQKVKNTEFLQQAALEEYGPELHVALRSRRDELHYLRKLTELLFPYILPPKATDCRSLTLLIREILSGSVFLPSLDFLADPDTVNHLLIIFIDDSPPEKATEPASPLVPFLQKFAEPRNKKPSVLKLELKQIREQQDLLFRFMNFLKQEGAVHVLQFCLTVEEFNDRILRPELSNDEMLSLHEELQKIYKTYCLDESIDKIRFDPFIVEEIQRIAEGPYIDVVKLQTMRCLFEAYEHVLSLLENVFTPMFCHSDEYFRQLLRGAESPTRNSKLNRNTQKRGESFGISRIGSKIKGVFKSTTMEGAMLPNYGVAEGEDDFIEEGIVVMEDDSPVEAVSTPNTPRNLAAWKISIPYVDFFEDPSSERKEKKERIPVFCIDVERNDRRAVGHEPEHWSVYRRYLEFYVLESKLTEFHGAFPDAQLPSKRIIGPKNYEFLKSKREEFQEYLQKLLQHPELSNSQLLADFLSPNGGETQFLDKILPDVNLGKIIKSVPGKLMKEKGQHLEPFIMNFINSCESPKPKPSRPELTILSPTSENNKKLFNDLFKNNANRAENTERKQNQNYFMEVMTVEGVYDYLMYVGRVVFQVPDWLHHLLMGTRILFKNTLEMYTDYYLQCKLEQLFQEHRLVSLITLLRDAIFCENTEPRSLQDKQKGAKQTFEEMMNYIPDLLVKCIGEETKYESIRLLFDGLQQPVLNKQLTYVLLDIVIQELFPELNKVQKEVTSVTSWM

SEQ ID NO: 862136 - protein, 893 aa, Homo sapiens
MVPWVRTMGQKLKQRLRLDVGREICRQYPLFCFLLLCLSAASLLLNRYIHILMIFWSFVAGVVTFYCSLGPDSLLPNIFFTIKYKPKQLGLQELFPQGHSCAVCGKVKCKRHRPSLLLENYQPWLDLKISSKVDASLSEVDIPSIITKKLLKAAMKHIEVIVKARQKVKNTEFLQQAALEEYGPELHVALRSRRDELHYLRKLTELLFPYILPPKATDCRSLTLLIREILSGSVFLPSLDFLADPDTVNHLLIIFIDDSPPEKATEPASPLVPFLQKFAEPRNKKPSVLKLELKQIREQQDLLFRFMNFLKQEGAVHVLQFCLTVEEFNDRILRPELSNDEMLSLHEELQKIYKTYCLDESIDKIRFDPFIVEEIQRIAEGPYIDVVKLQTMRCLFEAYEHVLSLLENVFTPMFCHSDEYFRQLLRGAESPTRNSKLNRNTQKRGESFGISRIGSKIKGVFKSTTMEGAMLPNYGVAEGEDDFIEEGIVVMEDDSPVEAVSTPNTPRNLAAWKISIPYVDFFEDPSSERKEKKERIPVFCIDVERNDRRAVGHEPEHWSVYRRYLEFYVLESKLTEFHGAFPDAQLPSKRIIGPKNYEFLKSKREEFQEYLQKLLQHPELSNSQLLADFLSPNGGETQFLDKILPDVNLGKIIKSVPGKLMKEKGQHLEPFIMNFINSCESPKPKPSRPELTILSPTSENNKKLFNDLFKNNANRAENTERKQNQNYFMEVMTVEGVYDYLMYVGRVVFQVPDWLHHLLMGTRILFKNTLEMYTDYYLQCKLEQLFQEHRLVSLITLLRDAIFCENTEPRSLQDKQKGAKQTFEEMMNYIPDLLVKCIGEETKYESIRLLFDGLQQPVLNKQLTYVLLDIVIQELFPELNKVQKEVTSVTSWM

SEQ ID NO: 862137 - protein, 946 aa, Homo sapiens
MVPWVRTMGQKLKQRLRLDVGREICRQYPLFCFLLLCLSAASLLLNRYIHILMIFWSFVAGVVTFYCSLGPDSLLPNIFFTIKYKPKQLGLQELFPQGHSCAVCGKVKCKRHRPSLLLENYQPWLDLKISSKVDASLSEVLELVLENFVYPWYRDVTDDESFVDELRITLRFFASVLIRRIHKVDIPSIITKKLLKAAMKHIEVIVKARQKVKNTEFLQQAALEEYGPELHVALRSRRDELHYLRKLTELLFPYILPPKATDCRSLTLLIREILSGSVFLPSLDFLADPDTVNHLLIIFIDDSPPEKATEPASPLVPFLQKFAEPRNKKPSVLKLELKQIREQQDLLFRFMNFLKQEGAVHVLQFCLTVEEFNDRILRPELSNDEMLSLHEELQKIYKTYCLDESIDKIRFDPFIVEEIQRIAEGPYIDVVKLQTMRCLFEAYEHVLSLLENVFTPMFCHSDEYFRQLLRGAESPTRNSKLNRGSLSLDDFRNTQKRGESFGISRIGSKIKGVFKSTTMEGAMLPNYGVAEGEDDFIEEGIVVMEDDSPVEAVSTPNTPRNLAAWKISIPYVDFFEDPSSERKEKKERIPVFCIDVERNDRRAVGHEPEHWSVYRRYLEFYVLESKLTEFHGAFPDAQLPSKRIIGPKNYEFLKSKREEFQEYLQKLLQHPELSNSQLLADFLSPNGGETQFLDKILPDVNLGKIIKSVPGKLMKEKGQHLEPFIMNFINSCESPKPKPSRPELTILSPTSENNKKLFNDLFKNNANRAENTERKQNQNYFMEVMTVEGVYDYLMYVGRVVFQVPDWLHHLLMGTRILFKNTLEMYTDYYLQCKLEQLFQEHRLVSLITLLRDAIFCENTEPRSLQDKQKGAKQTFEEMMNYIPDLLVKCIGEETKYESIRLLFDGLQQPVLNKQLTYVLLDIVIQELFPELNKVQKEVTSVTSWM

SEQ ID NO: 862138 - protein, 893 aa, Homo sapiens; identical to SEQ ID NO: 862136

SEQ ID NO: 862139 - protein, 894 aa, Homo sapiens
MIFWSFVAGVVTFYCSLGPDSLLPNIFFTIKYKPKQLGLQELFPQGHSCAVCGKVKCKRHRPSLLLENYQPWLDLKISSKVDASLSEVLELVLENFVYPWYRDVTDDESFVDELRITLRFFASVLIRRIHKVDIPSIITKKLLKAAMKHIEVIVKARQKVKNTEFLQQAALEEYGPELHVALRSRRDELHYLRKLTELLFPYILPPKATDCRSLTLLIREILSGSVFLPSLDFLADPDTVNHLLIIFIDDSPPEKATEPASPLVPFLQKFAEPRNKKPSVLKLELKQIREQQDLLFRFMNFLKQEGAVHVLQFCLTVEEFNDRILRPELSNDEMLSLHEELQKIYKTYCLDESIDKIRFDPFIVEEIQRIAEGPYIDVVKLQTMRCLFEAYEHVLSLLENVFTPMFCHSDEYFRQLLRGAESPTRNSKLNRGSLSLDDFRNTQKRGESFGISRIGSKIKGVFKSTTMEGAMLPNYGVAEGEDDFIEEGIVVMEDDSPVEAVSTPNTPRNLAAWKISIPYVDFFEDPSSERKEKKERIPVFCIDVERNDRRAVGHEPEHWSVYRRYLEFYVLESKLTEFHGAFPDAQLPSKRIIGPKNYEFLKSKREEFQEYLQKLLQHPELSNSQLLADFLSPNGGETQFLDKILPDVNLGKIIKSVPGKLMKEKGQHLEPFIMNFINSCESPKPKPSRPELTILSPTSENNKKLFNDLFKNNANRAENTERKQNQNYFMEVMTVEGVYDYLMYVGRVVFQVPDWLHHLLMGTRILFKNTLEMYTDYYLQCKLEQLFQEHRLVSLITLLRDAIFCENTEPRSLQDKQKGAKQTFEEMMNYIPDLLVKCIGEETKYESIRLLFDGLQQPVLNKQLTYVLLDIVIQELFPELNKVQKEVTSVTSWM

SEQ ID NO: 862140 - protein, 1012 aa, Homo sapiens
MIIMVMITITIVVDMKIHTMVMKIFKLELEEGVVEEQGVLLHPEVVGLLLPAVEPVIHREEVLDQQEAFEVREEVPNNKEAAGEKGSRPVLTCYNEDMTCYVGLHQKLAVEYWYIHILMIFWSFVAGVVTFYCSLGPDSLLPNIFFTIKYKPKQLGLQELFPQGHSCAVCGKVKCKRHRPSLLLENYQPWLDLKISSKVDASLSEVLELVLENFVYPWYRDVTDDESFVDELRITLRFFASVLIRRIHKVDIPSIITKKLLKAAMKHIEVIVKARQKVKNTEFLQQAALEEYGPELHVALRSRRDELHYLRKLTELLFPYILPPKATDCRSLTLLIREILSGSVFLPSLDFLADPDTVNHLLIIFIDDSPPEKATEPASPLVPFLQKFAEPRNKKPSVLKLELKQIREQQDLLFRFMNFLKQEGAVHVLQFCLTVEEFNDRILRPELSNDEMLSLHEELQKIYKTYCLDESIDKIRFDPFIVEEIQRIAEGPYIDVVKLQTMRCLFEAYEHVLSLLENVFTPMFCHSDEYFRQLLRGAESPTRNSKLNRGSLSLDDFRNTQKRGESFGISRIGSKIKGVFKSTTMEGAMLPNYGVAEGEDDFIEEGIVVMEDDSPVEAVSTPNTPRNLAAWKISIPYVDFFEDPSSERKEKKERIPVFCIDVERNDRRAVGHEPEHWSVYRRYLEFYVLESKLTEFHGAFPDAQLPSKRIIGPKNYEFLKSKREEFQEYLQKLLQHPELSNSQLLADFLSPNGGETQFLDKILPDVNLGKIIKSVPGKLMKEKGQHLEPFIMNFINSCESPKPKPSRPELTILSPTSENNKKLFNDLFKNNANRAENTERKQNQNYFMEVMTVEGVYDYLMYVGRVVFQVPDWLHHLLMGTRILFKNTLEMYTDYYLQCKLEQLFQEHRLVSLITLLRDAIFCENTEPRSLQDKQKGAKQTFEEMMNYIPDLLVKCIGEETKYESIRLLFDGLQQPVLNKQLTYVLLDIVIQELFPELNKVQKEVTSVTSWM

SEQ ID NO: 862141 - protein, 465 aa, Homo sapiens [sequence omitted]

SEQ ID NO: 862142 - protein, 428 aa, Homo sapiens [sequence omitted]

SEQ ID NO: 862143 - protein, 369 aa, Homo sapiens
MYHKLQRPSRNKCSRLSTTLLIYPATVGHEPEHWSVYRRYLEFYVLESKLTEFHGAFPDAQLPSKRIIGPKNYEFLKSKREEFQEYLQKLLQHPELSNSQLLADFLSPNGGETQFLDKILPDVNLGKIIKSVPGKLMKEKGQHLEPFIMNFINSCESPKPKPSRPELTILSPTSENNKKLFNDLFKNNANRAENTERKQNQNYFMEVMTVEGVYDYLMYVGRVVFQVPDWLHHLLMGTRILFKNTLEMYTDYYLQCKLEQLFQEHRLVSLITLLRDAIFCENTEPRSLQDKQKGAKQTFEEMMNYIPDLLVKCIGEETKYESIRLLFDGLQQPVLNKQLTYVLLDIVIQELFPELNKVQKEVTSVTSWM

SEQ ID NO: 862144 - protein, 939 aa, Homo sapiens
MVPWVRTMGQKLKQRLRLDVGREICRQYPLFCFLLLCLSAASLLLNRYIHILMIFWSFVAGVVTFYCSLGPDSLLPNIFFTIKYKPKQLGLQELFPQGHSCAVCGKVKCKRHRPSLLLENYQPWLDLKISSKVDASLSEVLELVLENFVYPWYRDVTDDESFVDELRITLRFFASVLIRRIHKVDIPSIITKKLLKAAMKHIEVIVKARQKVKNTEFLQQAALEEYGPELHVALRSRRDELHYLRKLTELLFPYILPPKATDCRSLTLLIREILSGSVFLPSLDFLADPDTVNHLLIIFIDDSPPEKATEPASPLVPFLQKFAEPRNKKPSVLKLELKQIREQQDLLFRFMNFLKQEGAVHVLQFCLTVEEFNDRILRPELSNDEMLSLHEELQKIYKTYCLDESIDKIRFDPFIVEEIQRIAEGPYIDVVKLQTMRCLFEAYEHVLSLLENVFTPMFCHSDEYFRQLLRGAESPTRNSKLNRGSLSLDDFRNTQKRGESFGISRIGSKIKGVFKSTTMEGAMLPNYGVAEGEDDFIEEGIVVMEDDSPVEAVSTPNTPRNLAAWKISIPYVDFFEDPSSERKEKKERIPVFCIDVERNDRRAVGHEPEHWSVYRRYLEFYVLESKLTEFHGAFPDAQLPSKRIIGPKNYEFLKSKREEFQEYLQKLLQHPELSNSQLLADFLSPNGGETQFLDKILPDVNLGKIIKSVPGKLMKEKGQHLEPFIMNFINSCESPKPKPSRPELTILSPTSENNKKLFNDLFKNNANRAENTERKQNQNYFMEVMTVEGVYDYLMYVGRVVFQVPDWLHHLLMGTRILFKNTLEMYTDYYLQCKLEQLFQEHRLVSLITLLRDAIFCENTEPRSLQDKQKGAKQTFEEMMNYIPDLLVKCIGEETKYESIRLLFDGLQQPVLNKQLTYVLLDIVIQELFPELNKVTEKQ

SEQ ID NO: 862145 - protein, 880 aa, Homo sapiens
MVPWVRTMGQKLKQRLRLDVGREICRQYPLFCFLLLCLSAASLLLNRYIHILMIFWSFVAGVVTFYCSLGPDSLLPNIFFTIKYKPKQLGLQELFPQGHSCAVCGKVKCKRHRPSLLLENYQPWLDLKISSKVDASLSEVLELVLENFVYPWYRDVTDDESFVDELRITLRFFASVLIRRIHKVDIPSIITKKLLKAAMKHIEVIVKARQKVKNTEFLQQAALEEYGPELHVALRSRRDELHYLRKLTELLFPYILPPKATDCRSLTLLIREILSGSVFLPSLDFLADPDTVNHLLIIFIDDSPPEKATEPASPLVPFLQKFAEPRNKKPSVLKLELKQIREQQDLLFRFMNFLKQEGAVHVLQFCLTVEEFNDRILRPELSNDEMLSLHEELQKIYKTYCLDESIDKIRFDPFIVEEIQRIAEGPYIDVVKLQTMRCLFEAYEHVLSLLENVFTPMFCHSDEYFRQLLRGAESPTRNSKLNRGSLSLDDFRNTQKRGESFGISRIGSKIKGVFKSTTMEGAMLPNYGVAEGEDDFIEEGIVVMEDDSPVEAVSTPNTPRNLAAWKISIPYVDFFEDPSSERKEKKERIPVFCIDVERNDRRAVGHEPEHWSVYRRYLEFYVLESKLTEFHGAFPDAQLPSKRIIGPKNYEFLKSKREEFQEYLQKLLQHPELSNSQLLADFLSPNGGETQFLDKILPDVNLGKIIKSVPGKLMKEKGQHLEPFIMNFINSCESPKPKPSRPELTILSPTSENNKKLFNDLFKNNANRAENTERKQNQNYFMEVMTVEGVYDYLMYVDAIFCENTEPRSLQDKQKGAKQTFEEMMNYIPDLLVKCIGEETKYESIRLLFDGLQQPVLNKQELFPELNKVQKEVTSVTSWM

SEQ ID NO: 862146 - protein, 880 aa, Homo sapiens; identical to SEQ ID NO: 862145

SEQ ID NO: 862147 - protein, 783 aa, Homo sapiens
MVPWVRTMGQKLKQRLRLDVGREICRQYPLFCFLLLCLSAASLLLNRYIHILMIFWSFVAGVVTFYCSLGPDSLLPNIFFTIKYKPKQLGLQELFPQGHSCAVCGKVKCKRHRPSLLLENYQPWLDLKISSKVDASLSEVLELVLENFVYPWYRDVTDDESFVDELRITLRFFASVLIRRIHKVDIPSIITKKLLKAAMKHIEVIVKARQKVKNTEFLQQAALEEYGPELHVALRSRRDELHYLRKLTELLFPYILPPKATDCRSLTLLIREILSGSVFLPSLDFLADPDTVNHLLIIFIDDSPPEKATEPASPLVPFLQKFAEPRNKKPSVLKLELKQIREQQDLLFRFMNFLKQEGAVHVLQFCLTVEEFNDRILRPELSNDEMLSLHEELQKIYKTYCLDESIDKIRFDPFIVEEIQRIAEGPYIDVVKLQTMRCLFEAYEHVLSLLENVFTPMFCHSDEYFRQLLRGAESPTRNSKLNRGSLSLDDFRNTQKRGESFGISRIGSKIKGVFKSTTMEGAMLPNYGVAEGEDDFIEEGIVVMEDDSPVEAVSTPNTPRNLAAWKISIPYVDFFEDPSSERKEKKERIPVFCIDVERNDRRAVGHEPEHWSVYRRYLEFYVLESKLTEFHGAFPDAQLPSKRIIGPKNYEFLKSKREEFQEYLQKLLQHPELSNSQLLADFLSPNGGETQFLDKILPDVNLGKIIKSVPGKLMKEKGQHLEPFIMNFINSCESPKPKPSRPELTILSPTSENNKKLFNDLFKNNANRAENTERKQNQNYFVG

SEQ ID NO: 862148 - protein, 317 aa, Homo sapiens
MVPWVRTMGQKLKQRLRLDVGREICRQYPLFCFLLLCLSAASLLLNRYIHILMIFWSFVAGVVTFYCSLGPDSLLPNIFFTIKYKPKQLGLQELFPQGHSCAVCGKVKCKRHRPSLLLENYQPWLDLKISSKVDASLSEVLELVLENFVYPWYRDVTDDESFVDELRITLRFFASVLIRRIHKVDIPSIITKKLLKAAMKHIEVIVKARQKVKNTEFLQQAALEEYGPELHVALRSRRDELHYLRKLTELLFPYILPPKATDCRSLTLLIREILSGSVFLPSLDFLADPDTVNHLLIIFIDDSPVSIEYIRKHFRLH

SEQ ID NO: 862149 - protein, 303 aa, Homo sapiens
MYHKLQRPSRNKCSRLSTTLLIYPATVGHEPEHWSVYRRYLEFYVLESKLTEFHGAFPDAQLPSKRIIGPKNYEFLKSKREEFQEYLQKLLQHPELSNSQLLADFLSPNGGETQFLDKILPDVNLGKIIKSVPGKLMKEKGQHLEPFIMNFINSCESPKPKPSRPELTILSPTSENNKKLFNDLFKNNANRAENTERKQNQNYFMEVMTVEGVYDYLMYVGRVVFQVPDWLHHLLMGTRILFKNTLEMYTDYYLQCKLEQLFQEHRLVSLITLLRGLSQNAFSGKHGPLFQKRKGQTTLRMGF

SEQ ID NO: 862150 - protein, 893 aa, Homo sapiens; identical to SEQ ID NO: 862136

SEQ ID NO: 862151 - protein, 918 aa, Homo sapiens
MVPWVRTMGQKLKQRLRLDVGREICRQYPLFCFLLLCLSAASLLLNRYIHILMIFWSFVAGVVTFYCSLGPDSLLPNIFFTIKYKPKQLGLQELFPQGHSCAVCGKVKCKRHRPSLLLENYQPWLDLKISSKVDASLSEVLELVLENFVYPWYRDVTDDESFVDELRITLRFFASVLIRRIHKYKNTEFLQQAALEEYGPELHVALRSRRDELHYLRKLTELLFPYILPPKATDCRSLTLLIREILSGSVFLPSLDFLADPDTVNHLLIIFIDDSPPEKATEPASPLVPFLQKFAEPRNKKPSVLKLELKQIREQQDLLFRFMNFLKQEGAVHVLQFCLTVEEFNDRILRPELSNDEMLSLHEELQKIYKTYCLDESIDKIRFDPFIVEEIQRIAEGPYIDVVKLQTMRCLFEAYEHVLSLLENVFTPMFCHSDEYFRQLLRGAESPTRNSKLNRGSLSLDDFRNTQKRGESFGISRIGSKIKGVFKSTTMEGAMLPNYGVAEGEDDFIEEGIVVMEDDSPVEAVSTPNTPRNLAAWKISIPYVDFFEDPSSERKEKKERIPVFCIDVERNDRRAVGHEPEHWSVYRRYLEFYVLESKLTEFHGAFPDAQLPSKRIIGPKNYEFLKSKREEFQEYLQKLLQHPELSNSQLLADFLSPNGGETQFLDKILPDVNLGKIIKSVPGKLMKEKGQHLEPFIMNFINSCESPKPKPSRPELTILSPTSENNKKLFNDLFKNNANRAENTERKQNQNYFMEVMTVEGVYDYLMYVGRVVFQVPDWLHHLLMGTRILFKNTLEMYTDYYLQCKLEQLFQEHRLVSLITLLRDAIFCENTEPRSLQDKQKGAKQTFEEMMNYIPDLLVKCIGEETKYESIRLLFDGLQQPVLNKQLTYVLLDIVIQELFPELNKVQKEVTSVTSWM

SEQ ID NO: 862152 - protein, 893 aa, Homo sapiens; identical to SEQ ID NO: 862136

SEQ ID NO: 862153 - protein, 891 aa, Homo sapiens
MVPWVRTMGQKLKQRLRLDVGREICRQYPLFCFLLLCLSAASLLLNRYIHILMIFWSFVAGVVTFYCSLGPDSLLPNIFFTIKYKPKQLGLQELFPQGHSCAVCGKVKCKRHRPSLLLENYQPWLDLKISSKVDASLSEVLELVLENFVYPWYRDVTDDESFVDELRITLRFFASVLIRRIHKVDIPSIITKKLLKAAMKHIEVIVKARQKVKNTEFLQQAALEEYGPELHVALRSRRDELHYLRKLTELLFPYILPPKATDCRSLTLLIREILSGSVFLPSLDFLADPDTVNHLLIIFIDDSPPEKATEPASPLVPFLQKFAEPRNKKPSVLKLELKQIREQQDLLFRFMNFLKQEGAVHVLQFCLTVEEFNDRILRPELSNDEMLSLHEELQKIYKTYCLDESIDKIRFDPFIVEEIQRIAEGPYIDVVKLQTMRCLFEAYEHVLSLLENVFTPMFCHSDEYFRQLLRGAESPTRNSKLNRGSLSLDDFRNTQKRGESFGISRIGSKIKGVFKSTTMEGAMLPNYGVAEGEDDFIEEGIVVMEDDSPVEAVSTPNTPRNLAAWKISIPYVDFFEDPSSERKEKKERIPVFCIDVERNDRRAVGHEPEHWSVYRRYLEFYVLESKLTEFHGAFPDAQLPSKRIIGPKNYEFLKSKREEFQEYLQKLLQHPELSNSQLLADFLSPNGGETQFLDKILPDVNLGKIIKSVPGKLMKEKGQHLEPFIMNFINSCESPKPKPSRPELTILSPTSENNKKLFNDLFKNNANRAENTERKQNQNYFMEVMTVEGVYDYLMYVDAIFCENTEPRSLQDKQKGAKQTFEEMMNYIPDLLVKCIGEETKYESIRLLFDGLQQPVLNKQLTYVLLDIVIQELFPELNKVQKEVTSVTSWM

SEQ ID NO: 862154 - protein, 890 aa, Homo sapiens
MVPWVRTMGQKLKQRLRLDVGREICRQYPLFCFLLLCLSAASLLLNRYIHILMIFWSFVAGVVTFYCSLGPDSLLPNIFFTIKYKPKQLGLQELFPQGHSCAVCGKVKCKRHRPSLLLENYQPWLDLKISSKVDASLSEVLELVLENFVYPWYRDVTDDESFVDELRITLRFFASVLIRRIHKVDIPSIITKKLLKAAMKHIEVIVKARQKVKNTEFLQQAALEEYGPELHVALRSRRDELHYLRKLTELLFPYILPPKATDCRSLTLLIREILSGSVFLPSLDFLADPDTVNHLLIIFIDDSPPEKATEPASPLVPFLQKFAEPRNKKPSVLKLELKQIREQQDLLFRFMNFLKQEGAVHVLQFCLTVEEFNDRILRPELSNDEMLSLHEELQKIYKTYCLDESIDKIRFDPFIVEEIQRIAEGPYIDVVKLQTMRCLFEAYEHVLSLLENVFTPMFCHSDEYFRQLLRGAESPTRNSKLNRGSLSLDDFRNTQKRGESFGISRIGSKIKGVFKSTTMEGAMLPNYGVAEGEDDFIEEGIVVMEDDSPVEAVSTPNTPRNLAAWKISIPYVDFFEDPSSERKEKKERIPVFCIDVERNDRRAVGHEPEHWSVYRRYLEFYVLESKLTEFHGAFPDAQLPSKRIIGPKNYEFLKSKREEFQEYLQKLLQHPELSNSQLLADFLSPNGGETQFLDKILPDVNLGKIIKSVPGKLMKEKGQHLEPFIMNFINSCESPKPKPSRPELTILSPTSENNKKLFNDLFKNNANRAENTERKQNQNYFMEVMTVEGVYDYLMYVGRVVFQVPDWLHHLLMGTRILFKNTLEMYTDYYLQCKLEQLFQEHRLVSLITLLRDAIFCENTEPRSLQDKQKGAKQTFEEMMNYIPGVIFKK

SEQ ID NO: 862155 - protein, 880 aa, Homo sapiens
MVPWVRTMGQKLKQRLRLDVGREICRQYPLFCFLLLCLSAASLLLNRYIHILMIFWSFVAGVVTFYCSLGPDSLLPNIFFTIKYKPKQLGLQELFPQGHSCAVCGKVKCKRHRPSLLLENYQPWLDLKISSKVDASLSEVLELVLENFVYPWYRDVTDDESFVDELRITLRFFASVLIRRIHKVDIPSIITKKLLKAAMKHIEVIVKARQKVKNTEFLQQAALEEYGPELHVALRSRRDELHYLRKLTELLFPYILPPKATDCRSLTLLIREILSGSVFLPSLDFLADPDTVNHLLIIFIDDSPPEKATEPASPLVPFLQKFAEPRNKKPSVLKLELKQIREQQDLLFRFMNFLKQEGAVHVLQFCLTVEEFNDRILRPELSNDEMLSLHEELQKIYKTYCLDESIDKIRFDPFIVEEIQRIAEGPYIDVVKLQTMRCLFEAYEHVLSLLENVFTPMFCHSDEYFRQLLRGAESPTRNSKLNRGSLSLDDFRNTQKRGESFGISRIGSKIKGVFKSTTMEGAMLPNYGVAEGEDDFIEEGIVVMEDDSPVEAVSTPNTPRNLAAWKISIPYVDFFEDPSSERKEKKERIPVFCIDVERNDRRAVGHEPEHWSVYRRYLEFYVLESKLTEFHGAFPDAQLPSKRIIGPKNYEFLKSKREEFQEYLQKLLQHPELSNSQLLADFLSPNGGETQFLDKILPDVNLGKIIKSVPGKLMKEKGQHLEPFIMNFINSCESPKPKPSRPELTILSPTSENNKKLFNDLFKNNANRAENTERKQNQNYFMEVMTVEGVYDYLMYVGRVVFQVPDWLHHLLMGTRILFKNTLEMYTDYYLQCKLEQLFQEHRLVSLITLLRGLSQNAFSGKHGPLFQKRKGQTTLRMGF

SEQ ID NO: 862156 - protein, 765 aa, Homo sapiens
MVPWVRTMGQKLKQRLRLDVGREICRQYPLFCFLLLCLSAASLLLNRYIHILMIFWSFVAGVVTFYCSLGPDSLLPNIFFTIKYKPKQLGLQELFPQGHSCAVCGKVKCKRHRPSLLLENYQPWLDLKISSKVDASLSEVLELVLENFVYPWYRDVTDDESFVDELRITLRFFASVLIRRIHKVDIPSIITKKLLKAAMKHIEVIVKARQKVKNTEFLQQAALEEYGPELHVALRSRRDELHYLRKLTELLFPYILPPKATDCRSLTLLIREILSGSVFLPSLDFLADPDTVNHLLIIFIDDSPPEKATEPASPLVPFLQKFAEPRNKKPSVLKLELKQIREQQDLLFRFMNFLKQEGAVHVLQFCLTVEEFNDRILRPELSNDEMLSLHEELQKIYKTYCLDESIDKIRFDPFIVEEIQRIAEGPYIDVVKLQTMRCLFEAYEHVLSLLENVFTPMFCHSDEYFRQLLRGAESPTRNSKLNRGSLSLDDFRNTQKRGESFGISRIGSKIKGVFKSTTMEGAMLPNYGVAEGEDDFIEEGIVVMEDDSPVEAVSTPNTPRNLAAWKISIPYVDFFEDPSSERKEKKERIPVFCIDVERNDRRAVGHEPEHWSVYRRYLEFYVLESKLTEFHGAFPDAQLPSKRIIGPKNYEFLKSKREEFQEYLQKLLQHPELSNSQLLADFLSPNGGETQFLDKILPDVNLGKIIKSVPGKLMKEKGQHLEPFIMNFINSCESPKPKPSRPELTILSPTSENNKKVLHIALKNY

SEQ ID NO: 862157 - protein, 379 aa, Homo sapiens
MVPWVRTMGQKLKQRLRLDVGREICRQYPLFCFLLLCLSAASLLLNRYIHILMIFWSFVAGVVTFYCSLGPDSLLPNIFFTIKYKPKQLGLQELFPQGHSCAVCGKVKCKRHRPSLLLENYQPWLDLKISSKVDASLSEVLELVLENFVYPWYRDVTDDESFVDELRITLRFFASVLIRRIHKVDIPSIITKKLLKAAMKHIEVIVKARQKVKNTEFLQQAALEEYGPELHVALRSRRDELHYLRKLTELLFPYILPPKATDCRSLTLLIREILSGSVFLPSLDFLADPDTVNHLLIIFIDDSPPEKATEPASPLVPFLQKFAEPRNKKPSVLKLELKQIREQQDLLFRFMNFLKQEGAVHVLQFCLTVGEAYLCILRK

SEQ ID NO: 862158 - protein, 1175 aa, Homo sapiens
FVVAEGLTCLIKVGAEADQNYQNYILRALGQIMLYVDGMNGVINRNETIQWLYTLIGSKFRLVVKTALKLLLVFVEYSESNAPLLIQAVTAVDTKRGVKPWSNIMEILEEKDGVDTELLVYAMTLVNKTLSGLPDQDTFYDVVDCLEELGIAAVSQRHLNKKGTDLDLVEQLNIYEVALRHEDGDETTEPPPSGCRDRRRASVCSSGGGEHRGLDRRRSRRHSVQSIKSTLSAPTSPCSQSAPSFKPNQVRDLREKSSPSGLLTSSFRQHQESLAAERERRRQEREERLQRIEREERNKFSRDYLDKREEQRQAREERYKYLEQLAAEEHEKELRSRSVSRGRADLSLDLTSPAAPACLAPLSHSPSSSDSQEALTVSASSPGTPHHPQASAGDPEPESEAEPEAEAGAGQVADEAGQDIASAHEGAETEVEQALEQEPEERASLSEKERQNEGVNERDNCSASSVSSSSSTLEREEKEDKLSRDRTTGLWPAGVQDAGVNGQCGDILTNKRFMLDMLYAHNRKSPDDEEKGDGEAGRTQQEAEAVASLATRISTLQANSQTQDESVRRVDVGCLDNRGSVKAFAEKFNSGDLGRGSISPDAEPNDKVPETAPVQPKTESDYIWDQLMANPRELRIQDMDFTDLGEEDDIDVLDVDLGHREAPGPPPPPPPTFLGLPPPPPPPLLDSIPPPPVPGNLLVPPPPVFNAPQGLGWSQVPRGQPTFTKKKKTIRLFWNEVRPFDWPCKNNRRCREFLWSKLEPIKVDTSRLEHLFESKSKELSVSKKTAADGKRQEIIVLDSKRSNAINIGLTVLPPPRTIKIAILNFDEYALNKEGIEKILTMIPTDEEKQKIQEAQLANPEIPLGSAEQFLLTLSSISELSARLHLWAFKMDYETTEKEVAEPLLDLKEGIDQLENNKTLGFILSTLLAIGNFLNGTNAKAFELSYLEKVPEVKDTVHKQSLLHHVCTMVVENFPDSSDLYSEIGAITRSAKVDFDQLQDNLCQMERRCKASWDHLKAIAKHEMKPVLKQRMSEFLKDCAERIIILKIVHRRIINRFHSFLLFMGHPPYAIREVNINKFCRIISEFALEYRTTRERVLQQKQKRANHRERNKTRGKMITDSGKFSGSSPAPPSQPQGLSYAEDAAEHENMKAVLKTSSPSRSPLHIPSPSCQLCFS

SEQ ID NO: 862159 - protein, 200 aa, Homo sapiens
FVVAEGLTCLIKVGAEADQNYQNYILRALGQIMLYVDGMNGVINRNETIQWLYTLIGSKFRLVVKTALKLLLVFVEYSESNAPLLIQAVTAVDTKRGVKPWSNIMEILEEKDGVDTELLVYAMTLVNKTLSGLPDQDTFYDVVDCLEELGIAAVSQRHLNKKGTDLDLVEQLNIYEVPDHAFCKVSYSFGNCQRLRWRLL

SEQ ID NO: 862160 - protein, 1258 aa, Homo sapiens
FVVAEGLTCLIKVGAEADQNYQNYILRALGQIMLYVDGMNGVINRNETIQWLYTLIGSKFRLVVKTALKLLLVFVEYSESNAPLLIQAVTAVDTKRGVKPWSNIMEILEEKDGVDTELLVYAMTLVNKTLSGLPDQDTFYDVVDCLEELGIAAVSQRHLNKKGTDLDLVEQLNIYEVALRHEDGDETTEPPPSGCRDRRRASVCSSGGGEHRGLDRRRSRRHSVQSIKSTLSAPTSPCSQSAPSFKPNQVRDLREKSSPSGLLTSSFRQHQESLAAERERRRQEREERLQRIEREERNKFSRDYLDKREEQRQAREERYKYLEQLAAEEHEKELRSRSVSRGRADLSLDLTSPAAPACLAPLSHSPSSSDSQEALTVSASSPGTPHHPQASAGDPEPESEAEPEAEAGAGQVADEAGQDIASAHEGAETEVEQALEQEPEERASLSEKERQNEGVNERDNCSASSVSSSSSTLEREEKEDKLSRDRTTGLWPAGVQDAGVNGQCGDILTNKRFMLDMLYAHNRKSPDDEEKGDGEAGRTQQEAEAVASLATRISTLQANSQTQDESVRRVDVGCLDNRGSVKAFAEKFNSGDLGRGSISPDAEPNDKVPETAPVQPKTESDYIWDQLMANPRELRIQDMDFTDLGEEDDIDVLDVDLGHREAPGPPPPPPPTFLGLPPPPPPPLLDSIPPPPVPGNLLVPPPPVFNAPQGLGWSQVPRGQPTFTKKKKTIRLFWNEVRPFDWPCKNNRRCREFLWSKLEPIKVDTSRLEHLFESKSKELSVSKKTAADGKRQEIIVLDSKRSNAINIGLTVLPPPRTIKIAILNFDEYALNKEGIEKILTMIPTDEEKQKIQEAQLANPEIPLGSAEQFLLTLSSISELSARLHLWAFKMDYETTEKEVAEPLLDLKEGIDQLENNKTLGFILSTLLAIGNFLNGTNAKAFELSYLEKVPEVKDTVHKQSLLHHVCTMVVENFPDSSDLYSEIGAITRSAKVDFDQLQDNLCQMERRCKASWDHLKAIAKHEMKPVLKQRMSEFLKDCAERIIILKIVHRRIINRFHSFLLFMGHPPYAIREVNINKFCRIISEFALEYRTTRERVLQQKQKRANHRERNKTRGKMITDSGKFSGSSPAPPSQPQGLSYAEDAAEHENMKAVLKTSSPSVEDATPALGVRTRSRASRGSTSSWTMGTDDSPNVTDDAADEIMDRIVKSATQVPSQRVVPRERKRSRANRKSLRRTLKSGLTPEEARALGLVGTSELQL

SEQ ID NO: 862161 - protein, 369 aa, Homo sapiens
MDYDTTEKEVAEPLLDLKEGIDQLENNKTLGFILSTLLAIGNFLNGTNAKAFELSYLEKVPEVKDTVHKQSLLHHVCTMVVENFPDSSDLYSEIGAITRSAKVDFDQLQDNLCQMERRCKASWDHLKAIAKHEMKPVLKQRMSEFLKDCAERIIILKIVHRRIINRFHSFLLFMGHPPYAIREVNINKFCRIISEFALEYRTTRERVLQQKQKRANHRERNKTRGKMITDSGKFSGSSPAPPSQPQGLSYAEDAAEHENMKAVLKTSSPSVEDATPALGVRTRSRASRGSTSSWTMGTDDSPNVTDDAADEIMDRIVKSATQVPSQRVVPRERKRSRANRKSLRRTLKSGLTPEEARALGLVGTSELQL

SEQ ID NO: 862162 - protein, 741 aa, Homo sapiens
FVVAEGLTCLIKVGAEADQNYQNYILRALGQIMLYVDGMNGVINRNETIQWLYTLIGSKFRLVVKTALKLLLVFVEYSESNAPLLIQAVTAVDTKRGVKPWSNIMEILEEKDGVDTELLVYAMTLVNKTLSGLPDQDTFYDVVDCLEELGIAAVSQRHLNKKGTDLDLVEQLNIYEVALRHEDGDETTEPPPSGCRDRRRASVCSSGGGEHRGLDRRRSRRHSVQSIKSTLSAPTSPCSQSAPSFKPNQVRDLREKSSPSGLLTSSFRQHQESLAAERERRRQEREERLQRIEREERNKFSRDYLDKREEQRQAREERYKYLEQLAAEEHEKELRSRSVSRGRADLSLDLTSPAAPACLAPLSHSPSSSDSQEALTVSASSPGTPHHPQASAGDPEPESEAEPEAEAGAGQVADEAGQDIASAHEGAETEVEQALEQEPEERASLSEKERQNEGVNERDNCSASSVSSSSSTLEREEKEDKLSRDRTTGLWPAGVQDAGVNGQCGDILTNKRFMLDMLYAHNRKSPDDEEKGDGEAGRTQQEAEAVASLATRISTLQANSQTQDESVRRVDVGCLDNRGSVKAFAEKFNSGDLGRGSISPDAEPNDKVPETAPVQPKTESDYIWDQLMANPRELRIQDMDFTDLGEEDDIDVLDVDLGHREAPGPPPPPPPTFLGLPPPPPPPLLDSIPPPPVPGNLLVPPPPVFNAPQGLGWSQKKPEPWAWLAPRSCSCDTHRLLPGVC

SEQ ID NO: 862163 - protein, 490 aa, Homo sapiens
FVVAEGLTCLIKVGAEADQNYQNYILRALGQIMLYVDGMNGVINRNETIQWLYTLIGSKFRLVVKTALKLLLVFVEYSESNAPLLIQAVTAVDTKRGVKPWSNIMEILEEKDGVDTELLVYAMTLVNKTLSGLPDQDTFYDVVDCLEELGIAAVSQRHLNKKGTDLDLVEQLNIYEVALRHEDGDETTEPPPSGCRDRRRASVCSSGGGEHRGLDRRRSRRHSVQSIKSTLSAPTSPCSQSAPSFKPNQVRDLREKSSPSGLLTSSFRQHQESLAAERERRRQEREERLQRIEREERNKFSRDYLDKREEQRQAREERYKYLEQLAAEEHEKELRSRSVSRGRADLSLDLTSPAAPACLAPLSHSPSSSDSQEALTVSASSPGTPHHPQASAGDPEPESEAEPEAEAGAGQVADEAGQDIASAHEGAETEVEQALEQEPEERASLSEKERQNEGVNERDNCSASSVSSSSSTLEREEKEDKLSRDRTTGK

SEQ ID NO: 862164 - protein, 114 aa, Homo sapiens
MAEAGAGLSETVTETTVTVTTEPENRSLTIKLRKRKPEKKVEWTSDTVDNEHMGRRSSKCCCIYEKPRAFGESSTESDEEEEEGCGHTHCVRGHRKGRRRATLGPDPHHPSPAS

SEQ ID NO: 862165 - protein, 114 aa, Homo sapiens; identical to SEQ ID NO: 862164

SEQ ID NO: 862166 - protein, 114 aa, Homo sapiens; identical to SEQ ID NO: 862164

SEQ ID NO: 862167 - protein, 137 aa, Homo sapiens
MSAIRGCNFSHEAGGGPGGGGIKKVEDPGYHSESDTASLRPQRQKKENRSLTIKLRKRKPEKKVEWTSDTVDNEHMGRRSSKCCCIYEKPRAFGESSTESDEEEEEGCGHTHCVRGHRKGRRRATLGPDPHHPSPAS

SEQ ID NO: 862168 - protein, 114 aa, Homo sapiens; identical to SEQ ID NO: 862164

SEQ ID NO: 862169 - protein, 114 aa, Homo sapiens; identical to SEQ ID NO: 862164

SEQ ID NO: 862170 - protein, 114 aa, Homo sapiens; identical to SEQ ID NO: 862164

SEQ ID NO: 862171 - protein, 114 aa, Homo sapiens; identical to SEQ ID NO: 862164

SEQ ID NO: 862172 - protein, 114 aa, Homo sapiens; identical to SEQ ID NO: 862164

SEQ ID NO: 862173 - protein, 114 aa, Homo sapiens; identical to SEQ ID NO: 862164

SEQ ID NO: 862174 - protein, 117 aa, Homo sapiens
MECLRSLPCLLPRAMRLPRRTLCALALDVTSVGPPVAACGRRANLIGRSRAAQLCGPDRLRVAGEVHRFRTSDVSQATLASVAPVFTVTKFDKQGNVTSFVFESCDNSRVSSDIRLS

SEQ ID NO: 862175 - protein, 360 aa, Homo sapiens
MECLRSLPCLLPRAMRLPRRTLCALALDVTSVGPPVAACGRRANLIGRSRAAQLCGPDRLRVAGEVHRFRTSDVSQATLASVAPVFTVTKFDKQGNVTSFERKKTELYQELGLQARDLRFQHVMSITVRNNRIIMRMEYLKAVITPECLLILDYRNLNLEQWLFRELPSQLSGEGQLVTYPLPFEFRAIEALLQYWINTLQGKLSILQPLILETLDALVDPKHSSVDRSKLHILLQNGKSLSELETDIKIFKESILEILDEEELLEELCVSKWSDPQVFEKSSAGIDHAEEMELLLENYYRLADDLSNAARELRVLIDDSQSIIFINLDSHRNVMMRLNLQLTMGTFSLSLFGLMGVALE

SEQ ID NO: 862176 - protein, 360 aa, Homo sapiens; identical to SEQ ID NO: 862175

SEQ ID NO: 862177 - protein, 117 aa, Homo sapiens; identical to SEQ ID NO: 862174

SEQ ID NO: 862178 - protein, 115 aa, Homo sapiens
MECLRSLPCLLPRAMRLPRRTLCALALDVTSVGPPVAACGRRANLIGRSRAAQLCGPDRLRVAGEVHRFRTSDVSQATLASVAPVFTVTKFDKQGNVTSFERKKTELYQELVYQS

SEQ ID NO: 862179 - protein, 360 aa, Homo sapiens; identical to SEQ ID NO: 862175

SEQ ID NO: 862180 - protein, 360 aa, Homo sapiens; identical to SEQ ID NO: 862175

SEQ ID NO: 862181 - protein, 115 aa, Homo sapiens; identical to SEQ ID NO: 862178

SEQ ID NO: 862182 - protein, 134 aa, Homo sapiens
MECLRSLPCLLPRAMRLPRRTLCALALDVTSVGPPVAACGRRANLIGRSRAAQLCGPDRLRVAGEVHRFRTSDVSQATLASVAPVFTVTKFDKQGNVTSFVKRKKNLNYYQRVKGLKPRFISKPLNGGYSKGGK

SEQ ID NO: 862183 - protein, 360 aa, Homo sapiens; identical to SEQ ID NO: 862175

SEQ ID NO: 862184 - protein, 360 aa, Homo sapiens; identical to SEQ ID NO: 862175

SEQ ID NO: 862185 - protein, 257 aa, Homo sapiens
MECLRSLPCLLPRAMRLPRRTLCALALDVTSVGPPVAACGRRANLIGRSRAAQLCGPDRLRVAGEVHRFRTSDVSQATLASVAPVFTVTKFDKQGNVTSFVSILQPLILETLDALVDPKHSSVDRSKLHILLQNGKSLSELETDIKIFKESILEILDEEELLEELCVSKWSDPQVFEKSSAGIDHAEEMELLLENYYRLADDLSNAARELRVLIDDSQSIIFINLDSHRNVMMRLNLQLTMGTFSLSLFGLMGVALE

SEQ ID NO: 862186 - protein, 103 aa, Homo sapiens
LVHRVCRSGGSDRSELRPEQPASGMKVWGLAAACFLLQHHGMPAQFTLPPAPRDETSPADAVCPGLGRDLCGSSRCCLRPPSQPDWKEPSGAALRARPAPRGR

SEQ ID NO: 862187 - protein, 342 aa, Homo sapiens
MECLRSLPCLLPRAMRLPRRTLCALALDVTSVGPPVAACGRRANLIGRSRAAQLCGPDRLRVAGEVHRFRTSDVSQATLASVAPVFTVTKFDKQGNVTSFERKKTELYQELGLQARDLRFQHVMSITVRNNRIIMRMEYLKAVITPECLLILDYRNLNLEQWLFRELPSQLSGEGQLVTYPLPFEFRAIEALLQYWINTLQGKLSILQPLILETLDALVDPKHSSVDRSKLHILLQNGKSLSELETDIKIFKESILEILDEEELLEELCVSKWSDPQVFEKSSAGIDHAEEMELLLVLIDDSQSIIFINLDSHRNVMMRLNLQLTMGTFSLSLFGLMGVALE

SEQ ID NO: 862188 - protein, 416 aa, Homo sapiens
MSTKQITCRYFMHGVCREGSQCLFSHDLANSKPSTICKYYQKGYCAYGTRCRYDHTRPSAAAGGAVGTMAHSVPSPAFHSPHPPSEVTASIVKTNSHEPGKREKRTLVLRDRNLSGMAERKTQPSMVSNPGSCSDPQPSPEMKPHSYLDAIRSGLDDVEASSSYSNEQQLCPYAAAGECRFGDACVYLHGEVCEICRLQVLHPFDPEQRKAHEKICMLTFEHEMEKAFAFQASQDKVCSICMEVILEKASASERRFGILSNCNHTYCLSCIRQWRCAKQFENPIIKSCPECRVISEFVIPSVYWVEDQNKKNELIEAFKQGMGKKACKYFEQGKGTCPFGSKCLYRHAYPDGRLAEPEKPRKQLSSQGTVRFFNSVRLWDFIENRESRHVPNNEDVDMTELGDLFMHLSGVESSEP

SEQ ID NO: 862189 - protein, 460 aa, Homo sapiens
PEGRRAPACAGVTRLRGMGRARPRPRRQRLREAAARRRSLSPATMSTKQITCRYFMHGVCREGSQCLFSHDLANSKPSTICKYYQKGYCAYGTRCRYDHTRPSAAAGGAVGTMAHSVPSPAFHSPHPPSEVTASIVKTNSHEPGKREKRTLVLRDRNLSGMAERKTQPSMVSNPGSCSDPQPSPEMKPHSYLDAIRSGLDDVEASSSYSNEQQLCPYAAAGECRFGDACVYLHGEVCEICRLQVLHPFDPEQRKAHEKICMLTFEHEMEKAFAFQASQDKVCSICMEVILEKASASERRFGILSNCNHTYCLSCIRQWRCAKQFENPIIKSCPECRVISEFVIPSVYWVEDQNKKNELIEAFKQGMGKKACKYFEQGKGTCPFGSKCLYRHAYPDGRLAEPEKPRKQLSSQGTVRFFNSVRLWDFIENRESRHVPNNEDVDMTELGDLFMHLSGVESSEP

SEQ ID NO: 862190 - protein, 460 aa, Homo sapiens; identical to SEQ ID NO: 862189

SEQ ID NO: 862191 - protein, 312 aa, Homo sapiens
MCSPQESGMTALSARMLTRSRSLGPGAGPRGCREEPGPLRRREAAAEARKSHSPVKRPRKAQRLRVAYEGSDSEKGEGAEPLKVPVWEPQDWQQQLVNIRAMRNKKDAPVDHLGTEHCYDSSAPPKVRRYQVLLSLMLSSQTKDQVTAGAMQRLRARGLTVDSILQTDDATLGKLIYPVGFWRSKVKYIKQTSAILQQHYGGDIPASVAELVALPGVGPKMAHLAMAVAWGTVSGIAVDTHVHRIANRLRWTKKATKSPEETRAALEEWLPRELWHEINGLLVGFGQQTCLPVHPRCHACLNQALCPAAQGL

SEQ ID NO: 862192 - protein, 113 aa, Homo sapiens
MSNWRATGVVADSPLGGEGHGLGWWSVPLFTPLGLPAAVDTHVHRIANRLRWTKKATKSPEETRAALEEWLPRELWHEINGLLVGFGQQTCLPVHPRCHACLNQALCPAAQGL

SEQ ID NO: 862193 - protein, 194 aa, Homo sapiens
MRARTVRKVRRYQVLLSLMLSSQTKDQVTAGAMQRLRARGLTVDSILQTDDATLGKLIYPVGFWRSKVKYIKQTSAILQQHYGGDIPASVAELVALPGVGPKMAHLAMAVAWGTVSGIAVDTHVHRIANRLRWTKKATKSPEETRAALEEWLPRELWHEINGLLVGFGQQTCLPVHPRCHACLNQALCPAAQGL

SEQ ID NO: 862194 - protein, 139 aa, Homo sapiens
MCSPQESGMTALSARMLTRSRSLGPGAGPRGCREEPGPLRRREAAAEARKSHSPVKRPRKAQRLRVAYEGSDSEKGEGAEPLKVPVWEPQDWQQQLVNIRAMRNKKDAPVDHLGTEHCYDSSAPPKVGRGPICPDDPPS

SEQ ID NO: 862195 - protein, 312 aa, Homo sapiens; identical to SEQ ID NO: 862191

SEQ ID NO: 862196 - protein, 255 aa, Homo sapiens
MCSPQESGMTALSARMLTRSRSLGPGAGPRGCREEPGPLRRREAAAEARKSHSPVKRPRKAQRLRVAYEGSDSEKGEGAEPLKVPVWEPQDWQQQLVNIRAMRNKKDAPVDHLGTEHCYDSSAPPKSKVKYIKQTSAILQQHYGGDIPASVAELVALPGVGPKMAHLAMAVAWGTVSGIAVDTHVHRIANRLRWTKKATKSPEETRAALEEWLPRELWHEINGLLVGFGQQTCLPVHPRCHACLNQALCPAAQGL

SEQ ID NO: 862197 - protein, 114 aa, Homo sapiens [sequence omitted]

SEQ ID NO: 862198 - protein, 877 aa, Homo sapiens
MTTEKSLVTEAENSQHQQKEEGEEAINSGQQEPQQEESCQTAAEGDNWCEQKLKASNGDTPTHEDLTKNKERTSESRGLSRLFSSFLKRPKSQVSEEEGKEVESDKEKGEGGQKEIEFGTSLDEEIILKAPIAAPEPELKTDPSLDLHSLSSAETQPHHYKLRIIFRVFLFLKHVNIISIVKSPAQEELREDPDFEIKEGEGLEECSKIEVKEESPQSKAETELKASQKPIRKHRNMHCKVSLLDDTVYECVVEKHAKGQDLLKRVCEHLNLLEEDYFGLAIWDNATSKTWLDSAKEIKKQVRGVPWNFTFNVKFYPPDPAQLTEDITRYYLCLQLRQDIVAGRLPCSFATLALLGSYTIQSELGDYDPELHGVDYVSDFKLAPNQTKELEEKVMELHKSYRSMTPAQADLEFLENAKKLSMYGVDLHKAKDLEGVDIILGVCSSGLLVYKDKLRINRFPWPKVLKISYKRSSFFIKIRPGEQEQYESTIGFKLPSYRAAKKLWKVCVEHHTFFRLTSTDTIPKSKFLALGSKFRYSGRTQAQTRQASALIDRPAPHFERTASKRASRSLDGAAAVDSADRSPRPTSAPAITQGQVAEGGVLDASAKKTVVPKAQKETVKAEVKKEDEPPEQAEPEPTEAWKVEKTHIEVTVPTSNGDQTQKKRERLDGENIYIRHSNLMLEDLDKSQEEIKKHHASISELKKNFMESVPEPRPSEWDKRLSTHSPFRTLNINGQIPTGEGPPLVKTQTVTISDNANAVKSEIPTKDVPIVHTETKTITYEAAQTDDNSGDLDPGVLLTAQTITSETPSSTTTTQITKTVKGGISETRIEKRIVITGDADIDHDQVLVQAIKEAKEQHPDMSVTKVVVHQETEIADE

SEQ ID NO: 862199 - protein, 864 aa, Homo sapiens
MTTEKSLVTEAENSQHQQKEEGEEAINSGQQEPQQEESCQTAAEGDNWCEQKLKASNGDTPTHEDLTKNKERTSESRGLSRLFSSFLKRPKSQVSEEEGKEVESDKEKGEGGQKEIEFGTSLDEEIILKAPIAAPEPELKTDPSLDLHSLSSAETQPAQEELREDPDFEIKEGEGLEECSKIEVKEESPQSKAETELKASQKPIRKHRNMHCKVSLLDDTVYECVVEKHAKGQDLLKRVCEHLNLLEEDYFGLAIWDNATSKTWLDSAKEIKKQVRGVPWNFTFNVKFYPPDPAQLTEDITRYYLCLQLRQDIVAGRLPCSFATLALLGSYTIQSELGDYDPELHGVDYVSDFKLAPNQTKELEEKVMELHKSYRSMTPAQADLEFLENAKKLSMYGVDLHKAKDLEGVDIILGVCSSGLLVYKDKLRINRFPWPKVLKISYKRSSFFIKIRPGEQEQYESTIGFKLPSYRAAKKLWKVCVEHHTFFRLTSTDTIPKSKFLALGSKFRYSGRTQAQTRQASALIDRPAPHFERTASKRASRSLDGAAAVDSADRSPRPTSAPAITQGQVAEGGVLDASAKKTVVPKAQKETVKAEVKKEDEPPEQAEPEPTEAWKVEKTHIEVTVPTSNGDQTQKLAEKTEDLIRMRKKKRERLDGENIYIRHSNLMLEDLDKSQEEIKKHHASISELKKNFMESVPEPRPSEWDKRLSTHSPFRTLNINGQIPTGEGPPLVKTQTVTISDNANAVKSEIPTKDVPIVHTETKTITYEAAQTDDNSGDLDPGVLLTAQTITSETPSSTTTTQITKTVKGGISETRIEKRIVITGDADIDHDQVLVQAIKEAKEQHPDMSVTKVVVHQETEIADE

SEQ ID NO: 862200 - protein, 794 aa, Homo sapiens
MTTEKSLVTEAENSQHQQKEEGEEAINSGQQEPQQEESCQTAAEGDNWCEQKLKASNGDTPTHEDLTKNKERTSESRGLSRLFSSFLKRPKSQVSEEEGKEVESDKEKGEGGQKEIEFGTSLDEEIILKAPIAAPEPELKTDPSLDLHSLSSAETQPAQEELREDPDFEIKEGEGLEECSKIEVKEESPQSKAETELKASQKPIRKHRNMHCKVSLLDDTVYECVVETWLDSAKEIKKQVRGVPWNFTFNVKFYPPDPAQLTEDITRYYLCLQLRQDIVAGRLPCSFATLALLGSYTIQSELGDYDPELHGVDYVSDFKLAPNQTKELEEKVMELHKSYRSMTPAQADLEFLENAKKLSMYGVDLHKAKDLEGVDIILGVCSSGLLVYKDKLRINRFPWPKVLKISYKRSSFFIKIRPGEQEQYESTIGFKLPSYRAAKKLWKVCVEHHTFFRLTSTDTIPKSKFLALGSKFRYSGRTQAQTRQASALIDRPAPHFERTASKRASRSLDGAAAVDSADRSPRPTSAPAITQGQVAEGGVLDASAKKTVVPKAQKETVKAEVKKEDEPPEQAEPEPTEAWKVEKTHIEVTVPTSNGDQTQDLDKSQEEIKKHHASISELKKNFMESVPEPRPSEWDKRLSTHSPFRTLNINGQIPTGEGPPLVKTQTVTISDNANAVKSEIPTKDVPIVHTETKTITYEAAQTDDNSGDLDPGVLLTAQTITSETPSSTTTTQITKTVKGGISETRIEKRIVITGDADIDHDQVLVQAIKEAKEQHPDMSVTKVVVHQETEIADE

SEQ ID NO: 862201 - protein, 250 aa, Homo sapiens
PAGRILENPLFAAGGVCGVHCRSPSCSQYTESHAKKRERLDGENIYIRHSNLMLEDLDKSQEEIKKHHASISELKKNFMESVPEPRPSEWDKRLSTHSPFRTLNINGQIPTGEGPPLVKTQTVTISDNANAVKSEIPTKDVPIVHTETKTITYEAAQTDDNSGDLDPGVLLTAQTITSETPSSTTTTQITKTVKGGISETRIEKRIVITGDADIDHDQVLVQAIKEAKEQHPDMSVTKVVVHQETEIADE

SEQ ID NO: 862202 - protein, 145 aa, Homo sapiens
MRFRGTQPNHIILPQSLPNLMSSHFKTSHAFPTKDVPIVHTETKTITYEAAQTDDNSGDLDPGVLLTAQTITSETPSSTTTTQITKTVKGGISETRIEKRIVITGDADIDHDQVLVQAIKEAKEQHPDMSVTKVVVHQETEIADE

SEQ ID NO: 862203 - protein, 864 aa, Homo sapiens; identical to SEQ ID NO: 862199

SEQ ID NO: 862204 - protein, 742 aa, Homo sapiens
MTTEKSLVTEAENSQHQQKEEGEEAINSGQQEPQQEESCQTAAEGDNWCEQKLKASNGDTPTHEDLTKNKERTSESRGLSRLFSSFLKRPKSQVSEEEGKEVESDKEKGEGGQKEIEFGTSLDEEIILKAPIAAPEPELKTDPSLDLHSLSSAETQPAQEELREDPDFEIKEGEGLEECSKIEVKEESPQSKAETELKASQKPIRKHRNMHCKVSLLDDTVYECVVETWLDSAKEIKKQVRGVPWNFTFNVKFYPPDPAQLTEDITRYYLCLQLRQDIVAGRLPCSFATLALLGSYTIQSELGDYDPELHGVDYVSDFKLAPNQTKELEEKVMELHKSYRSMTPAQADLEFLENAKKLSMYGVDLHKAKDLEGVDIILGVCSSGLLVYKDKLRINRFPWPKVLKISYKRSSFFIKIRPGEQEQYESTIGFKLPSYRAAKKLWKVCVEHHTFFRLTSTDTIPKSKFLALGSKFRYSGRTQAQTRQASALIDRPAPHFERTASKRASRSLDGAAAVDSADRSPRPTSAPAITQGQVAEGGVLDASAKKTVVPKAQKETVKAEVKKEDEPPEQAEPEPTEAWKDLDKSQEEIKKHHASISELKKNFMESVPEPRPSEWDKRLSTHSPFRTLNINGQIPTGEGPPLVKTQTVTISDNANAVKSEIPTKDVPIVHTETKTITYEAAQTDDNSGDLDPGVLLTAQTITSETPSSTTTTQITKVTDQLEPLYGTQGQAKLAATSLQEGP

SEQ ID NO: 862205 - protein, 824 aa, Homo sapiens
MTTEKSLVTEAENSQHQQKEEGEEAINSGQQEPQQEESCQTAAEGDNWCEQKLKASNGDTPTHEDLTKNKERTSESRGLSRLFSSFLKRPKSQVSEEEGKEVESDKEKGEGGQKEIEFGTSLDEEIILKAPIAAPEPELKTDPSLDLHSLSSAETQPHHYKLRIIFRVFLFLKHVNIISIVKSPAQEELREDPDFEIKEGEGLEECSKIEVKEESPQSKAETELKASQKPIRKHRNMHCKVSLLDDTVYECVVEKHAKGQDLLKRVCEHLNLLEEDYFGLAIWDNATSKTWLDSAKEIKKQVRGVPWNFTFNVKFYPPDPAQLTEDITRYYLCLQLRQDIVAGRLPCSFATLALLGSYTIQSELGDYDPELHGVDYVSDFKLAPNQTKELEEKVMELHKSYRSMTPAQADLEFLENAKKLSMYGVDLHKAKDLEGVDIILGVCSSGLLVYKDKLRINRFPWPKVLKISYKRSSFFIKIRPGEQEQYESTIGFKLPSYRAAKKLWKVCVEHHTFFRLTSTDTIPKSKFLALGSKFRYSGRTQAQTRQASALIDRPAPHFERTASKRASRSLDGAAAVDSADRSPRPTSAPAITQGQVAEGGVLDASAKKTVVPKAQKETVKAEVKKEDEPPEQAEPEPTEAWKKKRERLDGENIYIRHSNLMLEDLDKSQEEIKKHHASISELKKNFMESVPEPRPSEWDKRLSTHSPFRTLNINGQIPTGEGPPLVKTQTVTISDNANAVKSEIPTKDVPIVHTETKTITYEAAQTVKGGISETRIEKRIVITGDADIDHDQVLVQAIKEAKEQHPDMSVTKVVVHQETEIADE

SEQ ID NO: 862206 - protein, 775 aa, Homo sapiens
MTTEKSLVTEAENSQHQQKEEGEEAINSGQQEPQQEESCQTAAEGDNWCEQKLKASNGDTPTHEDLTKNKERTSESRGLSRLFSSFLKRPKSQVSEEEGKEVESDKEKGEGGQKEIEFGTSLDEEIILKAPIAAPEPELKTDPSLDLHSLSSAETQPAQEELREDPDFEIKEGEGLEECSKIEVKEESPQSKAETELKASQKPIRKHRNMHCKVSLLDDTVYECVVETWLDSAKEIKKQVRGVPWNFTFNVKFYPPDPAQLTEDITRYYLCLQLRQDIVAGRLPCSFATLALLGSYTIQSELGDYDPELHGVDYVSDFKLAPNQTKELEEKVMELHKSYRSMTPAQADLEFLENAKKLSMYGVDLHKAKDLEGVDIILGVCSSGLLVYKDKLRINRFPWPKVLKISYKRSSFFIKIRPGEQEQYESTIGFKLPSYRAAKKLWKVCVEHHTFFRLTSTDTIPKSKFLALGSKFRYSGRTQAQTRQASALIDRPAPHFERTASKRASRSLDGAAAVDSADRSPRPTSAPAITQGQVAEGGVLDASAKKTVVPKAQKETVKAEVKKEDEPPEQAEPEPTEAWKDLDKSQEEIKKHHASISELKKNFMESVPEPRPSEWDKRLSTHSPFRTLNINGQIPTGEGPPLVKTQTVTISDNANAVKSEIPTKDVPIVHTETKTITYEAAQTDDNSGDLDPGVLLTAQTITSETPSSTTTTQITKTVKGGISETRIEKRIVITGDADIDHDQVLVQAIKEAKEQHPDMSVTKVVVHQETEIADE

SEQ ID NO: 862207 - protein, 824 aa, Homo sapiens; identical to SEQ ID NO: 862205

SEQ ID NO: 862208 - protein, 172 aa, Homo sapiens [sequence omitted]

SEQ ID NO: 862209 - protein, 824 aa, Homo sapiens; identical to SEQ ID NO: 862205

SEQ ID NO: 862210 - protein, 864 aa, Homo sapiens; identical to SEQ ID NO: 862199

SEQ ID NO: 862211 - protein, 423 aa, Homo sapiens
MKLCSLAVLVPIVLFCEQHVFAFQSGQVLAALPRTSRQVQVLQNLTTTYEIVLWQPVTADLIVKKKQVHFFVNASDVDNVKAHLNVSGIPCSVLLADVEDLIQQQISNDTVSPRASASYYEQYHSLNEIYSWIEFITERHPDMLTKIHIGSSFEKYPLYVLKVSGKEQAAKNAIWIDCGIHAREWISPAFCLWFIGHITQFYGIIGQYTNLLRLVDFYVMPVVNVDGYDYSWKKNRMWRKNRSFYANNHCIGTDLNRNFASKHWCEEGASSSSCSETYCGLYPESEPEVKAVASFLRRNINQIKAYISMHSYSQHIVFPYSYTRSKSKDHEELSLVASEAVRAIEKTSKNTRYTHGHGSETLYLAPGGGDDWIYDLGIKYSFTIELRDTGTYGFLLPERYIKPTCREAFAAVSKIAWHVIRNV

SEQ ID NO: 862212 - protein, 360 aa, Homo sapiens
MKLCSLAVLVPIVLFCEQHVFAFQSGQVLAALPRTSRQVQVLQNLTTTYEIVLWQPVTADLIVKKKQVHFFVNASDVDNVKAHLNVSGIPCSVLLADVEDLIQQQISNDTVSPRASASYYEQYHSLNEIYSWIEFITERHPDMLTKIHIGSSFEKYPLYVLKVSGKEQAAKNAIWIDCGIHAREWISPAFCLWFIGHNRMWRKNRSFYANNHCIGTDLNRNFASKHWCEEGASSSSCSETYCGLYPESEPEVKAVASFLRRNINQIKAYISMHSYSQHIVFPYSYTRSKSKDHEELSLVASEAVRAIEKTSKNTRYTHGHGSETLYLAPGGGDDWIYDLGIKYSFTSNPPVEKLLPLSLK

SEQ ID NO: 862213 - protein, 402 aa, Homo sapiens
MKLCSLAVLVPIVLFCEQHVFAFQSGQVLAALPRTSRQVQVLQNLTTTYEIVLWQPVTADLIVKKKQVHFFVNASDVDNVKAHLNVSGIPCSVLLADVEDLIQQQISNDTVSPRASASYYEQYHSLNEIYSWIEFITERHPDMLTKIHIGSSFEKYPLYVLKFWEPATFCLWFIGHITQFYGIIGQYTNLLRLVDFYVMPVVNVDGYDYSWKKNRMWRKNRSFYANNHCIGTDLNRNFASKHWCEEGASSSSCSETYCGLYPESEPEVKAVASFLRRNINQIKAYISMHSYSQHIVFPYSYTRSKSKDHEELSLVASEAVRAIEKTSKNTRYTHGHGSETLYLAPGGGDDWIYDLGIKYSFTIELRDTGTYGFLLPERYIKPTCREAFAAVSKIAWHVIRNV

SEQ ID NO: 862214 - protein, 404 aa, Homo sapiens
MKLCSLAVLVPIVLFCEQHVFAFQSGQVLAALPRTSRQVQVLQNLTTTYEIVLWQPVTADLIVKKKQVHFFVNASDVDNVKAHLNVSGIPCSVLLADVEDLIQQQISNDTVSPRASASYYEQYHSLNEIYSWIEFITERHPDMLTKIHIGSSFEKYPLYVLKVSGKEQAAKNAIWIDCGIHAREWISPAFCLWFIGHITQFYGIIGQYTNLLRLVDFYVMPVVNVDGYDYSWKKQPWIGTLLSTLGEEGASSSSCSETYCGLYPESEPEVKAVASFLRRNINQIKAYISMHSYSQHIVFPYSYTRSKSKDHEELSLVASEAVRAIEKTSKNTRYTHGHGSETLYLAPGGGDDWIYDLGIKYSFTIELRDTGTYGFLLPERYIKPTCREAFAAVSKIAWHVIRNV

SEQ ID NO: 862215 - protein, 281 aa, Homo sapiens
MLTKIHIGSSFEKYPLYVLKVSGKEQAAKNAIWIDCGIHAREWISPAFCLWFIGHITQFYGIIGQYTNLLRLVDFYVMPVVNVDGYDYSWKKNRMWRKNRSFYANNHCIGTDLNRNFASKHWCEEGASSSSCSETYCGLYPESEPEVKAVASFLRRNINQIKAYISMHSYSQHIVFPYSYTRSKSKDHEELSLVASEAVRAIEKTSKNTRYTHGHGSETLYLAPGGGDDWIYDLGIKYSFTIELRDTGTYGFLLPERYIKPTCREAFAAVSKIAWHVIRNV

SEQ ID NO: 862216 - protein, 417 aa, Homo sapiens
MKLCSLAVLVPIVLFCEQHVFAFQSGQVLAALPRTSRQVQVLQNLTTTYEIVLWQPVTADLIVKKKQVHFFVNASDVDNVKAHLNVSGIPCSVLLADVEDLIQQQISNDTVSPRASASYYEQYHSLNEIYSWIEFITERHPDMLTKIHIGSSFEKYPLYVLKVSGKEQAAKNAIWIDCGIHAREWISPAFCLWFIGHITQFYGIIGQYTNLLRLVDFYVMPVVNVDGYDYSWKKNRMWRKNRSFYANNHCIGTDLNRNFASKHWCEEGASSSSCSETYCGLYPESEPEVKAVASFLRRNINQIKAYISMHSYSQHIVFPYSYTRSKSKDHEELSLVASEAVRAIEKTSKNTRYTHGHGSETLYLAPGGGDDWIYDLGIKYSFTIELRDTGTYGFLLPERYIKPTCREAFAAVSASVF

SEQ ID NO: 862217 - protein, 423 aa, Homo sapiens; identical to SEQ ID NO: 862211

SEQ ID NO: 862218 - protein, 200 aa, Homo sapiens
MKLCSLAVLVPIVLFCEQHVFAFQSGQVLAALPRTSRQVQVLQNLTTTYEIVLWQPVTADLIVKKKQVHFFVNASDVDNVKAHLNVSGIPCSVLLADVEDLIQQQISNDTVSPRASASYYEQYHSLNEIYSWIEFITERHPDMLTKIHIGSSFEKYPLYVLKVSGKEQAAKNAIWIDCGIHAREWISPAFCLWFIGHVTS

SEQ ID NO: 862219 - protein, 423 aa, Homo sapiens; identical to SEQ ID NO: 862211

SEQ ID NO: 862220 - protein, 405 aa, Homo sapiens
MKLCSLAVLVPIVLFCEQHVFAFQSGQVLAALPRTSRQVQVLQNLTTTYEIVLWQPVTADLIVKNLNVSGIPCSVLLADVEDLIQQQISNDTVSPRASASYYEQYHSLNEIYSWIEFITERHPDMLTKIHIGSSFEKYPLYVLKVSGKEQAAKNAIWIDCGIHAREWISPAFCLWFIGHITQFYGIIGQYTNLLRLVDFYVMPVVNVDGYDYSWKKNRMWRKNRSFYANNHCIGTDLNRNFASKHWCEEGASSSSCSETYCGLYPESEPEVKAVASFLRRNINQIKAYISMHSYSQHIVFPYSYTRSKSKDHEELSLVASEAVRAIEKTSKNTRYTHGHGSETLYLAPGGGDDWIYDLGIKYSFTIELRDTGTYGFLLPERYIKPTCREAFAAVSKIAWHVIRNV

SEQ ID NO: 862221 - protein, 290 aa, Homo sapiens
MKLCSLAVLVPIVLFCEQHVFAFQSGQVLAALPRTSRQVQVLQNLTTTYEIVLWQPVTADLIVKKKQVHFFVNASDVDNVKAHLNVSGIPCSVLLADVEDLIQQQISNDTVSPRASASYYEQYHSLNEIYSWIEFITERHPDMLTKIHIGSSFEKYPLYVLKVSGKEQAAKNAIWIDCGIHAREWISPAFCLWFIGHITQFYGIIGQYTNLLRLVDFYVMPVVNVDGYDYSWKKNRMWRKNRSFYANNHCIGTDLNRNFASKHWCALFTRAKTWNQSRCLSMADWIKKMW

SEQ ID NO: 862222 - protein, 126 aa, Homo sapiens
MQIYSWIEFITERHPDMLTKIHIGSSFEKYPLYVLKSLVASEAVRAIEKTSKNTRYTHGHGSETLYLAPGGGDDWIYDLGIKYSFTIELRDTGTYGFLLPERYIKPTCREAFAAVSKIAWHVIRNV

SEQ ID NO: 862223 - protein, 890 aa, Homo sapiens
MSQGILSPPAGLLSDDDVVVSPMFESTAADLGSVVRKNLLSDCSVVSTSLEDKQQVPSEDSMEKVKVYLRVRPLLPSELERQEDQGCVRIENVETLVLQAPKDSFALKSNERGIGQATHRFTFSQIFGPEVGQASFFNLTVKEMVKDVLKGQNWLIYTYGVTNSGKTHTIQGTIKDGGILPRSLALIFNSLQGQLHPTPDLKPLLSNEVIWLDSKQIRQEEMKKLSLLNGGLQEEELSTSLKRSVYIESRIGTSTSFDSGIAGLSSISQCTSSSQLDETSHRWAQPDTAPLPVPANIRFSIWISFFEIYNELLYDLLEPPSQQRKRQTLRLCEDQNGNPYVKDLNWIHVQDAEEAWKLLKVGRKNQSFASTHLNQNSSRSHSIFSIRILHLQGEGDIVPKISELSLCDLAGSERCKDQKSGERLKEAGNINTSLHTLGRCIAALRQNQQNRSKQNLVPFRDSKLTRVFQGFFTGRGRSCMIVNVNPCASTYDETLHVAKFSAIASQLVHAPPMQLGFPSLHSFIKEHSLQVSPSLEKGAKADTGLDDDIENEADISMYGKEELLQVVEAMKTLLLKERQEKLQLEMHLRDEICNEMVEQMQQREQWCSEHLDTQKELLEEMYEEKLNILKESLTSFYQEEIQERDEKIEELEALLQEARQQSVAHQQSGSELALRRSQRLAASASTQQLQEVKAKLQQCKAELNSTTEELHKYQKMLEPPPSAKPFTIDVDKKLEEGQKNIRLLRTELQKLGESLQSAERACCHSTGAGKLRQALTTCDDILIKQDQTLAELQNNMVLVKLDLRKKAACIAEQYHTVLKLQGQVSAKKRLGTNQENQQPNQQPPGKKPFLRNLLPRTPTCQSSTDCSPYARILRSRRSPLLKSGPFGKKY

SEQ ID NO: 862224 - protein, 890 aa, Homo sapiens; identical to SEQ ID NO: 862223

SEQ ID NO: 862225 - protein, 650 aa, Homo sapiens [sequence omitted]

SEQ ID NO: 862226 - protein, 890 aa, Homo sapiens; identical to SEQ ID NO: 862223

SEQ ID NO: 862227 - protein, 890 aa, Homo sapiens; identical to SEQ ID NO: 862223

SEQ ID NO: 862228 - protein, 190 aa, Homo sapiens
GAGRGRSAGRRLLWRLPRLRLAASGPAPVTLGRARPRPARRRSPMAPSRLQLGLRAAYSGISSVAGFSIFLVWTVVYRQPGTAAMGGLAGVLALWVLVTHVMYMQDYWRTWLKGLRGFFFVGVLFSAVSIAAFCTFLVLAITRHQSLTDPTSYYLSSVWSFISFKWAFLLSLYAHRYRADFADISILSDF

SEQ ID NO: 862229 - protein, 92 aa, Homo sapiens
PPYPPSCFFSSSHSRAGSSKRLGGPQRPPSALIRGSGGCQWVICCVHTLRNAGGVLNASPGKEESLRMNLTSDPNPFNGVLVIWKKEEQPGN

SEQ ID NO: 862230 - protein, 146 aa, Homo sapiens
KPRLGTSLVVNRPRGRLSSVAGFSIFLVWTVVYRQPGTAAMGGLAGVLALWVLVTHVMYMQDYWRTWLKGLRGFFFVGVLFSAVSIAAFCTFLVLAITRHQSLTDPTSYYLSSVWSFISFKWAFLLSLYAHRYRADFADISILSDF

SEQ ID NO: 862231 - protein, 190 aa, Homo sapiens; identical to SEQ ID NO: 862228

SEQ ID NO: 862232 - protein, 160 aa, Homo sapiens [sequence omitted]

SEQ ID NO: 862233 - protein, 190 aa, Homo sapiens; identical to SEQ ID NO: 862228

SEQ ID NO: 862234 - protein, 190 aa, Homo sapiens; identical to SEQ ID NO: 862228

SEQ ID NO: 862235 - protein, 150 aa, Homo sapiens
MMGLPMWILSAVAEALVIVLGFSLQLPAGSWAHVGAQCPPATDLSLPYNGVLALWVLVTHVMYMQDYWRTWLKGLRGFFFVGVLFSAVSIAAFCTFLVLAITRHQSLTDPTSYYLSSVWSFISFKWAFLLSLYAHRYRADFADISILSDF

SEQ ID NO: 862236 - protein, 118 aa, Homo sapiens
KPRLGTSLVVNRPRGRLRVLALWVLVTHVMYMQDYWRTWLKGLRGFFFVGVLFSAVSIAAFCTFLVLAITRHQSLTDPTSYYLSSVWSFISFKWAFLLSLYAHRYRADFADISILSDF

SEQ ID NO: 862237 - protein, 160 aa, Homo sapiens [sequence omitted]

SEQ ID NO: 862238 - protein, 190 aa, Homo sapiens; identical to SEQ ID NO: 862228

SEQ ID NO: 862239 - protein, 190 aa, Homo sapiens; identical to SEQ ID NO: 862228

SEQ ID NO: 862240 - protein, 138 aa, Homo sapiens
AQDGDETAIAPRPTHLLTWARLSRSQSRSAGAKTIDNRPHDPGRDTERGSTKTGRHARDSSVVHRAYSAKDTQAHGHTHTNPQRVGKKHTETERQREKGEWETHTHTNKGSYSRGIETHTTRQPLRLRGSAVNQNDPR

SEQ ID NO: 862241 - protein, 690 aa, Homo sapiens
MGSSGLGKAATLDELLCTCIEMFDDNGELDNSYLPRIVLLMHRWYLSSTELAEKLLCMYRNATGESCNEFRLKICYFMRYWILKFPAEFNLDLGLIRMTEEFREVASQLGYEKHVSLIDISSIPSYDWMRRVTQRKKVSKKGKACLLFDHLEPIELAEHLTFLEHKSFRRISFTDYQSYVIHGCLENNPTLERSIALFNGISKWVQLMVLSKPTPQQRAEVITKFINVAKKLLQLKNFNTLMAVVGGLSHSSISRLKETHSHLSSEVTKNWNEMTELVSSNGNYCNYRKAFADCDGFKIPILGVHLKDLIAVHVIFPDWTEENKVNIVKMHQLSVTLSELVSLQNASHHLEPNMDLINLLTLSLDLYHTEDDIYKLSLVLEPRNSKSQPTSPTTPNKPVVPLEWALGVMPKPDPTVINKHIRKLVESVFRNYDHDHDGYISQEDFESIAANFPFLDSFCVLDKDQDGLISKDEMMAYFLRAKSQLHCKMGPGFIHNFQEMTYLKPTFCEHCAGFLWGIIKQGYKCKDCGANCHKQCKDLLVLACRRFARAPSLSSGHGSLPGSPSLPPAQDEVFEFPGVTAGHRDLDSRAITLVTGSSRKISVRLQRATTSQATQTEPVWSEAGWGDSGSHTFPKMKSKFHDKAAKDKGFAKWENEKPRVHAGVDVVDRGTEFELDQDEGEETRQDGEDG

SEQ ID NO: 862242 - protein, 690 aa, Homo sapiens; identical to SEQ ID NO: 862241

SEQ ID NO: 862243 - protein, 690 aa, Homo sapiens; identical to SEQ ID NO: 862241

SEQ ID NO: 862244 - protein, 108 aa, Homo sapiens
MFPQSHLKNCFLGTLLFCYMRSSHAIGSNLCFRMADFRLRKLKAIMLAFGRGKTRNSEESSDSQEVIWKDTWMFTALGHCGISMFGLWDRELTLTNYELFISSSPTPS

SEQ ID NO: 862245 - protein, 690 aa, Homo sapiens; identical to SEQ ID NO: 862241

SEQ ID NO: 862246 - protein, 429 aa, Homo sapiens
MGSSGLGKAATLDELLCTCIEMFDDNGELDNSYLPRIVLLMHRWYLSSTELAEKLLCMYRNATGESCNEFRLKICYFMRYWILKFPAEFNLDLGLIRMTEEFREVASQLGYEKHVSLIDISSIPSYDWMRRVTQRKKVSKKGKACLLFDHLEPIELAEHLTFLEHKSFRRISFTDYQSYVIHGCLENNPTLERSIALFNGISKWVQLMVLSKPTPQQRAEVITKFINVAKKLLQLKNFNTLMAVVGGLSHSSISRLKETHSHLSSEVTKNWNEMTELVSSNGNYCNYRKAFADCDGFKIPILGVHLKDLIAVHVIFPDWTEENKVNIVKMHQLSVTLSELVSLQNASHHLEPNMDLINLLTLSLDLYHTEDDIYKLSLVLEPRNSKSQPTSPTTPNKPVVPLEWALGVMPKPDPTVINKHIRKLVEVSG

SEQ ID NO: 862247 - protein, 375 aa, Homo sapiens
MGSSGLGKAATLDELLCTCIEMFDDNGELDNSYLPRIVLLMHRWYLSSTELAEKLLCMYRNATGESCNEFRLKICYFMRYWILKFPAEFNLDLGLIRMTEEFREVASQLGYEKHVSLIDISSIPSYDWMRRVTQRKKVSKKGKACLLFDHLEPIELAEHLTFLEHKSFRRISFTDYQSYVIHGCLENNPTLERSIALFNGISKWVQLMVLSKPTPQQRAEVITKFINVAKKLLQLKNFNTLMAVVGGLSHSSISRLKETHSHLSSEVTKNWNEMTELVSSNGNYCNYRKAFADCDGFKIPILGVHLKDLIAVHVIFPDWTEENKVNIVKMHQLSVTLSELVSLQNASHHLEPNMDLINLLTGISGEDICLTSQFT

SEQ ID NO: 862248 - protein, 690 aa, Homo sapiens; identical to SEQ ID NO: 862241

SEQ ID NO: 862249 - protein, 690 aa, Homo sapiens; identical to SEQ ID NO: 862241

SEQ ID NO: 862250 - protein, 690 aa, Homo sapiens; identical to SEQ ID NO: 862241

SEQ ID NO: 862251 - protein, 429 aa, Homo sapiens; identical to SEQ ID NO: 862246

SEQ ID NO: 862252 - protein, 147 aa, Homo sapiens
MSYPTRDPSGRLISYVCSALEATFQHLLFPDFLMIAILTGVRWYLIVVKSFCTAKETTIRVNRQPTEWEKIFAIYSSDKGLISRIYNELQQIYKKKTTPSKVGKGYEQTLSKEDIYAAKRHKKKCSSSLAIRETQIRRRLFNLFFSL

SEQ ID NO: 862253 - protein, 114 aa, Homo sapiens
MIAILTGVRWYLIVVKSFCTAKETTIRVNRQPTEWEKIFAIYSSDKGLISRIYNELQQIYKKKTTPSKVGKGYEQTLSKEDIYAAKRHKKKCSSSLAIRETQIRRRLFNLFFSL

SEQ ID NO: 862254 - protein, 588 aa, Homo sapiens
SPGAGRTGRGPGSGKAPPAEISSGAPDFPGGKANVVGGGAGLGGGGSSLRDLKAPLASGGVANHAGGGGLDAGHQAVLRAASEKAVKMAASWRLGCDPRLLRYLVGFPGRRSVGLVKGALGWSVSRGANWRWFHSTQWLRGDPIKILMPSLSPTMEEGNIVKWLKKEGEAVSAGDALCEIETDKAVVTLDASDDGILAKIVVEEGSKNIRLGSLIGLIVEEGEDWKHVEIPKDVGPPPPVSKPSEPRPSPEPQISIPVKKEHIPGTLRFRLSPAARNILEKHSLDASQGTATGPRGIFTKEDALKLVQLKQTGKITESRPTPAPTATPTAPSPLQATAGPSYPRPVIPPVSTPGQPNAVGTFTEIPASNIRRVIAKRLTESKSTVPHAYATADCDLGAVLKVRQDLVKDDIKVSVNDFIIKAAAVTLKQMPDVNVSWDGEGPKQLPFIDISVAVATDKGLLTPIIKDAAAKGIQEIADSVKALSKKARDGKLLPEEYQGGSFSISNLGMFGIDEFTAVINPPQACILAVGRFRPVLKLTEDEEGNAKLQQRQLITVTMSSDSRVVDDELATRFLKSFKANLENPIRLA

SEQ ID NO: 862255 - protein, 588 aa, Homo sapiens; identical to SEQ ID NO: 862254

SEQ ID NO: 862256 - protein, 478 aa, Homo sapiens
SPGAGRTGRGPGSGKAPPAEISSGAPDFPGGDPIKILMPSLSPTMEEGNIVKWLKKEGEAVSAGDALCEIETDKAVVTLDASDDGILAKIVVEEGSKNIRLGSLIGLIVEEGEDWKHVEIPKDVGPPPPVSKPSEPRPSPEPQISIPVKKEHIPGTLRFRLSPAARNILEKHSLDASQGTATGPRGIFTKEDALKLVQLKQTGKITESRPTPAPTATPTAPSPLQATAGPSYPRPVIPPVSTPGQPNAVGTFTEIPASNIRRVIAKRLTESKSTVPHAYATADCDLGAVLKVRQDLVKDDIKVSVNDFIIKAAAVTLKQMPDVNVSWDGEGPKQLPFIDISVAVATDKGLLTPIIKDAAAKGIQEIADSVKALSKKARDGKLLPEEYQGGSFSISNLGMFGIDEFTAVINPPQACILAVGRFRPVLKLTEDEEGNAKLQQRQLITVTMSSDSRVVDDELATRFLKSFKANLENPIRLA

SEQ ID NO: 862257 - protein, 460 aa, Homo sapiens
SPGAGRTGRGPGSGKAPPAEISSGAPDFPGGDPIKILMPSLSPTMEEGNIVKWLKKEGEAVSAGDALCEIETDKAVVTLDASDDGILAKIVVEEGSKNIRLGSLIGLIVEEGEDWKHVEIPKDVGPPPPVSKEHIPGTLRFRLSPAARNILEKHSLDASQGTATGPRGIFTKEDALKLVQLKQTGKITESRPTPAPTATPTAPSPLQATAGPSYPRPVIPPVSTPGQPNAVGTFTEIPASNIRRVIAKRLTESKSTVPHAYATADCDLGAVLKVRQDLVKDDIKVSVNDFIIKAAAVTLKQMPDVNVSWDGEGPKQLPFIDISVAVATDKGLLTPIIKDAAAKGIQEIADSVKALSKKARDGKLLPEEYQGGSFSISNLGMFGIDEFTAVINPPQACILAVGRFRPVLKLTEDEEGNAKLQQRQLITVTMSSDSRVVDDELATRFLKSFKANLENPIRLA

SEQ ID NO: 862258 - protein, 518 aa, Homo sapiens
SPGAGRTGRGPGSGKAPPAEISSGAPDFPGGKANVVGGGAGLGGGGSSLRDLKAPLASGGVANHAGGGGLDAGHQAVLRAASEKAVKMAASWRLGCDPRLLRYLVGFPGRRSVGLVKGALGWSVSRGANWRWFHSTQWLRGDPIKILMPSLSPTMEEGNIVKWLKKEGEAVSAGDALCEIETDKAVVTLDASDDGILAKIVVEEGSKNIRLGSLIGLIVEEGEDWKHVEIPKDVGPPPPVSKPSEPRPSPEPQISIPVKKEHIPGTLRFRLSPAARNILEKHSLDASQGTATGPRGIFTKEDALKLVQLKQTGKITESRPTPAPTATPTAPSPLQATAGPSYPRPVIPPVSTPGQPNAVGTFTEIPASNIRRVIAKRLTESKSTVPHAYATADCDLGAVLKVRQDLVKDDIKVSVNDFIIKAAAVTLKQMPDVNVSWDGEGPKQLPFIDISVAVATDKGLLTPIIKDAAAKGIQEIADSVKALSKKARDGKLLPEEYQGGSFRWSLALSPRLQCSGMI

SEQ ID NO: 862259 - protein, 588 aa, Homo sapiens; identical to SEQ ID NO: 862254

SEQ ID NO: 862260 - protein, 588 aa, Homo sapiens; identical to SEQ ID NO: 862254

SEQ ID NO: 862261 - protein, 361 aa, Homo sapiens
SPGAGRTGRGPGSGKAPPAEISSGAPDFPGGKANVVGGGAGLGGGGSSLRDLKAPLASGGVANHAGGGGLDAGHQAVLRAASEKAVKMAASWRLGCDPRLLRYLVGFPGRRSVGLVKGALGWSVSRGANWRWFHSTQWLRGDPIKILMPSLSPTMEEGNIVKWLKKEGEAVSAGDALCEIETDKAVVTLDASDDGILAKIVQMPDVNVSWDGEGPKQLPFIDISVAVATDKGLLTPIIKDAAAKGIQEIADSVKALSKKARDGKLLPEEYQGGSFSISNLGMFGIDEFTAVINPPQACILAVGRFRPVLKLTEDEEGNAKLQQRQLITVTMSSDSRVVDDELATRFLKSFKANLENPIRLA

SEQ ID NO: 862262 - protein, 711 aa, Homo sapiens
MESGAVLLESKSSPFNLLHEMHELRLLGHLCDVTVSVEYQGVRKDFMAHKAVLAATSKFFKEVFLNEKSVDGTRTNVYLNEVQVADFASFLEFVYTAKVQVEEDRVQRMLEVAEKLKCLDLSETCFQLKKQMLESVLLELQNFSESQEVEVSSGSQVSAAPAPRASVATDGPHPSGLTDSLDYPGERASNGMSSDLPPKKSKDKLDKKKEVVKPPYPKIRRASGRLAGRKVFVEIPKKKYTRRLREQQKTAEGDVGDYRCPQDQSPDRVGTEMEQVSKNEGCQAGAELEELSKKAGPEEEEEEEEEDEEGEKKKSNFKCSICEKAFLYEKSFLKHSKHRHGVATEVVYRCDTCGQTFANRCNLKSHQRHVHSSERHFPCELCGKKFKRKKDVKRHVLQVHEGGGERHRCGQCGKGLSSKTALRLHERTHTGDRPYGCTECGARFSQPSALKTHMRIHTGEKPFVCDECGARFTQNHMLIYHKRCHTGERPFMCETCGKSFASKEYLKHHNRIHTGSKPFKCEVCFRTFAQRNSLYQHIKVHTGERPYCCDQCGKQFTQLNALQRHRRIHTGERPFMCNACGRTFTDKSTLRRHTSIHDKNTPWKSFLVIVDGSPKNDDGHKTEQPDEEYVSSKLSDKLLSFAENGHFHNLAAVQDTVPTMQENSSADTACKADDSVVSQDTLLATTISELSELTPQTDSMPTQLHSLSNME

SEQ ID NO: 862263 - protein, 711 aa, Homo sapiens; identical to SEQ ID NO: 862262

SEQ ID NO: 862264 - protein, 127 aa, Homo sapiens
DSGCSGGAGWEIHDKNTPWKSFLVIVDGSPKNDDGHKTEQPDEEYVSSKLSDKLLSFAENGHFHNLAAVQDTVPTMQENSSADTACKADDSVVSQDTLLATTISELSELTPQTDSMPTQLHSLSNME

SEQ ID NO: 862265 - protein, 711 aa, Homo sapiens; identical to SEQ ID NO: 862262

SEQ ID NO: 862266 - protein, 711 aa, Homo sapiens; identical to SEQ ID NO: 862262

SEQ ID NO: 862267 - protein, 679 aa, Homo sapiens
MESGAVLLESKSSPFNLLHEMHELRLLGHLCDVTVSVEYQGVRKDFMAHKAVLAATSKFFKEVFLNEKSVDGTRTNVYLNEVQVADFASFLEFVYTAKVQVEEDRVQRMLEVAEKLKCLDLSETCFQLKKQMLESVLLELQNFSESQEVEVSSGSQVSAAPAPRASVATDGPHPSGLTDSLDYPGERASNGMSSDLPPKKSKDKLDKKKEVVKPPYPKIRRASGRLAGRKVFVEIPKKKYTRRLREQQKTAEGDVGDYRCPQDQSPDRVGTEMEQVSKNEGCQAGAELEELSKKAGPEEEEEEEEEDEEGEKKKSNFKCSICEKAFLYEKSFLKHSKHRHGVATEVVYRCDTCGQTFANRCNLKSHQRHVHSSERHFPCELCGKKFKRKKDVKRHVLQVHEGGGERHRCGQCGKGLSSKTALRLHERTHTGDRPYGCTECGARFSQPSALKTHMRERPFMCETCGKSFASKEYLKHHNRIHTGSKPFKCEVCFRTFAQRNSLYQHIKVHTGERPYCCDQCGKQFTQLNALQRHRRIHTGERPFMCNACGRTFTDKSTLRRHTSIHDKNTPWKSFLVIVDGSPKNDDGHKTEQPDEEYVSSKLSDKLLSFAENGHFHNLAAVQDTVPTMQENSSADTACKADDSVVSQDTLLATTISELSELTPQTDSMPTQLHSLSNME

SEQ ID NO: 862268 - protein, 455 aa, Homo sapiens
MESGAVLLESKSSPFNLLHEMHELRLLGHLCDVTVSVEYQGVRKDFMAHKAVLAATSKFFKEVFLNEKSVDGTRTNVYLNEVQVADFASFLEFVYTAKVQVEEDRVQRMLEVAEKLKCLDLSETCFQLKKQMLESVLLELQNFSESQEVEVSSGSQVSAAPAPRASVATDGPHPSGLTDSLDYPGERASNGMSSDLPPKKSKDKLDKKKEVVKPPYPKIRRASGRLAGRKVFVEIPKKKYTRRLREQQKTAEGDVGDYRCPQDQSPDRVGTEMEQVSKNEGCQAGAELEELSKKAGPEEEEEEEEEDEEGEKKKSNFKCSICEKAFLYEKSFLKHSKHRHGVATEVVYRCDTCGQTFANRCNLKSHQRHVHSSERHFPCELCGKKFKRKKDVKRHVLQVHEGGGERHRCGQCGKGLSSKTALRLHERTHTGDRPYGCTECGARFSQPSALKTHMR

SEQ ID NO: 862269 - protein, 125 aa, Homo sapiens
WNAYMSLDPRQAPYPVSSLGGFNCPETEVSFLFRPFPRLLLAVLVRARAQRASSPCLGKLRKSRTSCSQPDRKDAKSVKIKKNKDNVKFKVRCSRYLYTLVITDKEKAEKLKQSLPPGLAVKELK

SEQ ID NO: 862270 - protein, 108 aa, Homo sapiens
LFGPLFSVCCARERTRGVYTVGRDKVLVRARAQRASSPCLGKLRKSRTSCSQPDRKDAKSVKIKKNKDNVKFKVRCSRYLYTLVITDKEKAEKLKQSLPPGLAVKELK

SEQ ID NO: 862271 - protein, 90 aa, Homo sapiens
AAAYYYYYCSEFKLLTMYGDSLGKLRKSRTSCSQPDRKDAKSVKIKKNKDNVKFKVRCSRYLYTLVITDKEKAEKLKQSLPPGLAVKELK

SEQ ID NO: 862272 - protein, 149 aa, Homo sapiens
SPLFLQSESSRLLMDRSGVKVVLIMYLLIDPHKKKCEVFFYYLSFIKQRPLLGGGLGEHISNLNEMKSIFSENLLTLKKSLGKLRKSRTSCSQPDRKDAKSVKIKKNKDNVKFKVRCSRYLYTLVITDKEKAEKLKQSLPPGLAVKELK

SEQ ID NO: 862273 - protein, 116 aa, Homo sapiens
AAAYYYYYCSEFKLLTMYGDMEFQKINIQGPSFKFSSNVIHKVDNTCLGKLRKSRTSCSQPDRKDAKSVKIKKNKDNVKFKVRCSRYLYTLVITDKEKAEKLKQSLPPGLAVKELK

SEQ ID NO: 862274 - protein, 108 aa, Homo sapiens; identical to SEQ ID NO: 862270

SEQ ID NO: 862275 - protein, 173 aa, Homo sapiens
MGGPGAEGVITGFGSLAETRPLAGRVGWDRSQMLLGTYTQSSLPTLWPLERAALCRRQTALAPYCGWTAQLPVANTPGNQGWQWGVPAGPSSFMARGRTTFIRHTHALQGEGYPESAGRSRFPGCDLGQPVGGSFTAPVCAIPGWHTRRWLWYGLPRRDPQSHLPRVARRRYN

SEQ ID NO: 862276 - protein, 65 aa, Homo sapiens
IPIIHEHEEDAKSVKIKKNKDNVKFKVRCSRYLYTLVITDKEKAEPAVAQIAPLHSSLGDSETPP

SEQ ID NO: 862277 - protein, 94 aa, Homo sapiens
KFSGRVDWVRKVLVRARAQRASSPCLGKLRKSRTSCSQPDRKDAKSVKIKKNKDNVKFKVRCSRYLYTLVITDKEKAEKLKQSLPPGLAVKELK

SEQ ID NO: 862278 - protein, 114 aa, Homo sapiens
IDPGPRAIVLKPANSAIMAGLFRPFPRLLLAVLVRARAQRASSPCLGKLRKSRTSCSQPDRKDAKSVKIKKNKDNVKFKVRCSRYLYTLVITDKEKAEKLKQSLPPGLAVKELK

SEQ ID NO: 862279 - protein, 39 aa, Homo sapiens
MDAAANSGGPRGCEKTTGGSTHADASALRILFSSLILSL

SEQ ID NO: 862280 - protein, 114 aa, Homo sapiens; identical to SEQ ID NO: 862278

SEQ ID NO: 862281 - protein, 97 aa, Homo sapiens
TTTKFAAARRLLLAVLVRARAQRASSPCLGKLRKSRTSCSQPDRKDAKSVKIKKNKDNVKFKVRCSRYLYTLVITDKEKAEKLKQSLPPGLAVKELK

SEQ ID NO: 862282 - protein, 94 aa, Homo sapiens; identical to SEQ ID NO: 862277

SEQ ID NO: 862283 - protein, 111 aa, Homo sapiens
FLCLLFVSDDQGVKVSAASNFKLHVVLIFLDLDRFGIASSPCLGKLRKSRTSCSQPDRKDAKSVKIKKNKDNVKFKVRCSRYLYTLVITDKEKAEKLKQSLPPGLAVKELK

SEQ ID NO: 862284 - protein, 90 aa, Homo sapiens
PCNPSSRTWVRKVLVRARAQRASSPCLGKLRKSRTSCSQPDRKDAKSVKIKKNKDNVKFKVRCSRYLYTLVITDKEKAEKLKQSLPPVAE

SEQ ID NO: 862285 - protein, 97 aa, Homo sapiens
LVLTGSLACQWVRKVLVRARAQRASSPCLGKLRKSRTSCSQPDRKDAKSVKIKKNKDNVKFKVRCSRYLYTLVITDKEKAEKLKQSLPPGLAVKELK

SEQ ID NO: 862286 - protein, 108 aa, Homo sapiens
TLQAYWEKSRKLVRQPFSGQEEGGALGAVPEPSAPRRHCLGKLRKSRTSCSQPDRKDAKSVKIKKNKDNVKFKVRCSRYLYTLVITDKEKAEKLKQSLPPGLAVKELK

SEQ ID NO: 862287 - protein, 111 aa, Homo sapiens; identical to SEQ ID NO: 862283

SEQ ID NO: 862288 - protein, 132 aa, Homo sapiens
FLCLLFVSDDQGVKVSAASNFKLHVVLIFLDLDRFGIASSPCLGKLRKSRTSCSQPDRKDAKSVRINIIQFQSVCLVHFSSFTAKPGGRELLQFLCLLFVSDDQGVKVSAASNFKLYVVLIFLDLGRRAANL

SEQ ID NO: 862289 - protein, 385 aa, Homo sapiens
MSLILNILREMLEYFGVPVEQVLLIWENKDYGSTRSIVRIIGKMLPLEPCRRPNFELIPLLNSVDSDNCGSMVPSFADILYVANDEEASYLRFRNSIWKNEEEKVEIFHPLRLVRDPLSPAVRQKETVKNDLPVNEAAIRKIAALENELTFLRSQIAAIVEMQELKNSTNSSSFGLSDERISLGQLSSSRAAHLSVDPDQLPGSVLSPPPPPPLPPQFSSLQPPCFPPVQPGSNNICDSDNPATEMSKQNPAANKTNYSHHSKSQRNKDIPNMLDVLKDMNKVKLRAIERSPGGRPIHKRKRQNSHWDPVSLISHALKQKFAFQEDDSFEKENRSWESSPFSSPETSRFGHHISQSEGQRTKEEMVNTKAVDQGISNTSLLNSRI

SEQ ID NO: 862290 - protein, 385 aa, Homo sapiens; identical to SEQ ID NO: 862289

SEQ ID NO: 862291 - protein, 234 aa, Homo sapiens
CLQLWQRTVPLDTLKGLGTCFPSGPELRGAGIAAAMERASERRTASALFAGFRALGLFSNDIPHVVRFSALKRRFYVTTCVGKSFHTYDVQKLSLVAVSNSVPQDICCMAADGRLVFAAYGNVFSAFARNKEIVHTFKGHKAEIHFLQPFGDHIISVDTDGILIIWHIYSEEEYLQLTFDKSVFKISAILHPSTYLNKILLGSEQGSLQLWNVKSNKLLYTFPGWKVGVTALQQ

SEQ ID NO: 862292 - protein, 95 aa, Homo sapiens
CLQLWQRTVPLDTLKGLGTCFPSGPELRGAGIAAAMERASERRTASALFAGFRALGLFSNDIPHVVRFSALKRRFYVTTCVGKSFHTYDVSDFFC

SEQ ID NO: 862293 - protein, 180 aa, Homo sapiens
MTTTLSHGIPREVSLRAQHTHITTNLLGSAHTSGSNLAHSEMSVGPLASLFQNKSPKTRDIQEEELEVLLEEEAAGGDEDREKEILIERIQSIKEEKEDITYRLPELDPRGSDEENLDSETSASTESLLEERAGRGASEGPPAPALPCPGAHQTQKTHKINVKRQTRGKTENKVKEKKMR

SEQ ID NO: 862294 - protein, 2022 aa, Homo sapiens
MSVKEAGSSGRREQAAYHLHIYPQLSTTESQASCRVTATKDSTTSDVIKDAIASLRLDGTKCYVLVEVKESGGEEWVLDANDSPVHRVLLWPRRAQDEHPQEDGYYFLLQERNADGTIKYVHMQLVAQATATRRLVERGLLPRQQADFDDLCNLPELTEGNLLKNLKHRFLQQKIYTYAGSILVAINPFKFLPIYNPKYVKMYENQQLGKLEPHVFALADVAYYTMLRKRVNQCIVISGESGSGKTQSTNFLIHCLTALSQKGYASGVERTILGAGPVLEAFGNAKTAHNNNSSRFGKFIQVSYLESGIVRGAVVEKYLLEKSRLVSQEKDERNYHVFYYLLLGVSEEERQEFQLKQPEDYFYLNQHNLKIEDGEDLKHDFERLKQAMEMVGFLPATKKQIFAVLSAILYLGNVTYKKRATGREEGLEVGPPEVLDTLSQLLKVKREILVEVLTKRKTVTVNDKLILPYSLSEAITARDSMAKSLYSALFDWIVLRINHALLNKKDVEEAVSCLSIGVLDIFGFEDFERNSFEQFCINYANEQLQYYFNQHIFKLEQEEYQGEGITWHNIGYTDNVGCIHLISKKPTGLFYLLDEESNFPHATSQTLLAKFKQQHEDNKYFLGTPVMEPAFIIQHFAGKVKYQIKDFREKNMDYMRPDIVALLRGSDSSYVRELIGMDPVAVFRWAVLRAAIRAMAVLREAGRLRAERAEKAAGMSSPGAQSHPEELPRGASTPSEKLYRDLHNQMIKSIKGLPWQGEDPRSLLQSLSRLQKPRAFILKSKGIKQKQIIPKNLLDSKSLKLIISMTLHDRTTKSLLHLHKKKKPPSISAQFQTSLNKLLEALGKAEPFFIRCIRSNAEKKELCFDDELVLQQLRYTGMLETVRIRRSGYSAKYTFQDFTEQFQVLLPKDAQPCREVISTLLEKMKIDKRNYQIGKTKVFLKETERQALQETLHREVVRKILLLQSWFRMVLERRHFLQMKRAAVTIQACWRSYRVRRALERTQAAVYLQASWRGYWQRKLYRHQKQSIIRLQSLCRGHLQRKSFSQMISEKQKAEEKEREALEAARAGAEEGGQGQAAGGQQVAEQGPEPAEDGGHLASEPEVQPSDRSPLEHSSPEKEAPSPEKTLPPQKTVAAESHEKVPSSREKRESRRQRGLEHVKFQNKHIQSCKEESALREPSRRVTQEQGVSLLEDKKESREDETLLVVETEAENTSQKQPTEQPQAMAVGKVSEETEKTLPSGSPRPGQLERPTSLALDSRVSPPAPGSAPETPEDKSKPCGSPRVQEKPDSPGGSTQIQRYLDAERLASAVELWRGKKLVAAASPSAMLSQSLDLSDRHRATGAALTPTEERRTSFSTSDVSKLLPSLAKAQPAAETTDGERSAKKPAVQKKKPGDASSLPDAGLSPGSQVDSKSTFKRLFLHKTKDKKYSLEGAEELENAVSGHVVLEATTMKKGLEAPSGQQHRHAAGEKRTKEPGGKGKKNRNVKIGKITVSEKWRESVFRQITNANELKYLDEFLLNKINDLRSQKTPIESLFIEATEKFRSNIKTMYSVPNGKIHVGYKDLMENYQIVVSNLATERGQKDTNLVLNLFQSLLDEFTRGYTKNDFEPVKQSKAQKKKRKQERAVQEHNGHVFASYQVSIPQSCEQCLSYIWLMDKALLCSVCKMTCHKKCVHKIQSHCSYTYGRKGEPGAEPGHFGVCVDSLTSDKASVPIVLEKLLEHVEMHGLYTEGLYRKSGAANRTRELRQALQTDPAAVKLENFPIHAITGVLKQWLRELPEPLMTFAQYGDFLRAVELPEKQEQLAAIYAVLEHLPEANHNSLERLIFHLVKVALLEDVNRMSPGALAIIFAPCLLRCPDNSDPLTSMKDVLKITTCVEMLIKEQMRKYKVKMEEISQLEAAESIAFRRLSLLRQNANKSPKTREPAGGAGRLLTTSRVSPSPSTRNLALGSWRSAALRTRGTGRPARPGRARALRRRPPRPARESPAQPPRSRPRVRTETPSPLSSGPPPSRSNTGMAPLRR

SEQ ID NO: 862295 - protein, 2022 aa, Homo sapiens [sequence omitted]

SEQ ID NO: 862296 - protein, 2014 aa, Homo sapiens
MSVKEAGSSGRREQAAYHLHIYPQLSTTESQASCRVTATKDSTTSDVIKDAIASLRLDGTKCYVLVEVKESGGEEWVLDANDSPVHRVLLWPRRAQDEHPQEDGYYFLLQERNADGTIKYVHMQLVAQATATRRLVERGLLPRQQADFDDLCNLPELTEGNLLKNLKHRFLQQKIYTYAGSILVAINPFKFLPIYNPKYVKMYENQQLGKLEPHVFALADVAYYTMLRKRVNQCIVISGESGSGKTQSTNFLIHCLTALSQKGYASGVERTILGAGPVLEAFGNAKTAHNNNSSRFGKFIQVSYLESGIVRGAVVEKYLLEKSRLVSQEKDERNYHVFYYLLLGVSEEERQEFQLKQPEDYFYLNQHNLKIEDGEDLKHDFERLKQAMEMVGFLPATKKQIFAVLSAILYLGNVTYKKRATGREEGLEVGPPEVLDTLSQLLKVKREILVEVLTKRKTVTVNDKLILPYSLSEAITARDSMAKSLYSALFDWIVLRINHALLNKKDVEEAVSCLSIGVLDIFGFEDFERNSFEQFCINYANEQLQYYFNQHIFKLEQEEYQGEGITWHNIGYTDNVGCIHLISKKPTGLFYLLDEESNFPHATSQTLLAKFKQQHEDNKYFLGTPVMEPAFIIQHFAGKVKYQIKDFREKNMDYMRPDIVALLRGSDSSYVRELIGMDPVAVFRWAVLRAAIRAMAVLREAGRLRAERAEKAAGMSSPGAQSHPEELPRGASTPSEKLYRCSMLDFSFDGSEEFDINAFEDIIAFYESKKKSKGIKQKQIIPKNLLDSKSLKLIISMTLHDRTTKSLLHLHKKKKPPSISAQFQTSLNKLLEALGKAEPFFIRCIRSNAEKKELCFDDELVLQQLRYTGMLETVRIRRSGYSAKYTFQDFTEQFQVLLPKDAQPCREVISTLLEKMKIDKRNYQIGKTKVFLKETERQALQETLHREVVRKILLLQSWFRMVLERRHFLQMKRAAVTIQACWRSYRVRRALERTQAAVYLQASWRGYWQRKLYRHQKQSIIRLQSLCRGHLQRKSFSQMISEKQKAEEKEREALEAARAGAEEGGQGQAAGGQQVAEQGPEPAEDGGHLASEPEVQPSDRSPLEHSSPEKEAPSPEKTLPPQKTVAAESHEKVPSSREKRESRRQRGLEHVKFQNKHIQSCKEESALREPSRRVTQEQGVSLLEDKKESREDETLLVVETEAENTSQKQPTEQPQAMAVGKVSEETEKTLPSGSPRPGQLERPTSLALDSRVSPPAPGSAPETPEDKSKPCGSPRVQEKPDSPGGSTQIQRYLDAERLASAVELWRGKKLVAAASPSAMLSQSLDLSDRHRATGAALTPTEERRTSFSTSDVSKLLPSLAKAQPAAETTDGERSAKKPAVQKKKPGDASSLPDAGLSPGSQVDSKSTFKRLFLHKTKDKKYSLEGAEELENAVSGHVVLEATTMKKGLEAPSGQQHRHAAGEKRTKEPGGKGKKNRNVKIGKITVSEKWRESVFRQITNANELKYLDEFLLNKINDLRSQKTPIESLFIEATEKFRSNIKTMYSVPNGKIHVGYKDLMENYQIVVSNLATERGQKDTNLVLNLFQSLLDEFTRGYTKNDFEPVKQSKAQKKKRKQERAVQEHNGHVFASYQVSIPQSCEQCLSYIWLMDKALLCSVCKMTCHKKCVHKIQSHCSYTYGRKGEPGAEPGHFGVCVDSLTSDKASVPIVLEKLLEHVEMHGLYTEGLYRKSGAANRTRELRQALQTDPAAVKLENFPIHAITGVLKQWLRELPEPLMTFAQYGDFLRAVELPEKQEQLAAIYAVLEHLPEANHNSLERLIFHLVKVALLEDVNRMSPGALAIIFAPCLLRCPDNSDPLTSMKDVLKITTCVEMLIKEQMRKYKVKMEEISQLEAAESIAFRRLSLLRQNAPWPLKLGFSSPYEGVLNKSPKTRDIQEEELEVLLEEEAAGGDEDREKEILIERIQSIKEEKEDITYRLPELDPRGSDEENLDSETSASTESLLEERAGRGASEGQY

SEQ ID NO: 862297 - protein, 2113 aa, Homo sapiens
MSVKEAGSSGRREQAAYHLHIYPQLSTTESQASCRVTATKDSTTSDVIKDAIASLRLDGTKCYVLVEVKESGGEEWVLDANDSPVHRVLLWPRRAQDEHPQEDGYYFLLQERNADGTIKYVHMQLVAQATATRRLVERGLLPRQQADFDDLCNLPELTEGNLLKNLKHRFLQQKIYTYAGSILVAINPFKFLPIYNPKYVKMYENQQLGKLEPHVFALADVAYYTMLRKRVNQCIVISGESGSGKTQSTNFLIHCLTALSQKGYASGVERTILGAGPVLEAFGNAKTAHNNNSSRFGKFIQVSYLESGIVRGAVVEKYLLEKSRLVSQEKDERNYHVFYYLLLGVSEEERQEFQLKQPEDYFYLNQHNLKIEDGEDLKHDFERLKQAMEMVGFLPATKKQIFAVLSAILYLGNVTYKKRATGREEGLEVGPPEVLDTLSQLLKVKREILVEVLTKRKTVTVNDKLILPYSLSEAITARDSMAKSLYSALFDWIVLRINHALLNKKDVEEAVSCLSIGVLDIFGFEDFERNSFEQFCINYANEQLQYYFNQHIFKLEQEEYQGEGITWHNIGYTDNVGCIHLISKKPTGLFYLLDEESNFPHATSQTLLAKFKQQHEDNKYFLGTPVMEPAFIIQHFAGKVKYQIKDFREKNMDYMRPDIVALLRGSDSSYVRELIGMDPVAVFRWAVLRAAIRAMAVLREAGRLRAERAEKAAGMSSPGAQSHPEELPRGASTPSEKLYRCSMLDFSFDGSEEFDINAFEDIIAFYESKKYSAERAFDPEATLSTVSFPQLHVLASVPGDGPNGAGNPEVAGLLLTPSSFCHCAPSTPPLSDLHNQMIKSIKGLPWQGEDPRSLLQSLSRLQKPRAFILKSKGIKQKQIIPKNLLDSKSLKLIISMTLHDRTTKSLLHLHKKKKPPSISAQFQTSLNKLLEALGKAEPFFIRCIRSNAEKKELCFDDELVLQQLRYTGMLETVRIRRSGYSAKYTFQDFTEQFQVLLPKDAQPCREVISTLLEKMKIDKRNYQIGKTKVFLKETERQALQETLHREVVRKILLLQSWFRMVLERRHFLQMKRAAVTIQACWRSYRVRRALERTQAAVYLQASWRGYWQRKLYRHQKQSIIRLQSLCRGHLQRKSFSQMISEKQKAEEKEREALEAARAGAEEGGQGQAAGGQQVAEQGPEPAEDGGHLASEPEVQPSDRSPLEHSSPEKEAPSPEKTLPPQKTVAAESHEKVPSSREKRESRRQRGLEHVKFQNKHIQSCKEESALREPSRRVTQEQGVSLLEDKKESREDETLLVVETEAENTSQKQPTEQPQAMAVGKVSEETEKTLPSGSPRPGQLERPTSLALDSRVSPPAPGSAPETPEDKSKPCGSPRVQEKPDSPGGSTQIQRYLDAERLASAVELWRGKKLVAAASPSAMLSQSLDLSDRHRATGAALTPTEERRTSFSTSDVSKLLPSLAKAQPAAETTDGERSAKKPAVQKKKPGDASSLPDAGLSPGSQVDSKSTFKRLFLHKTKDKKYSLEGAEELENAVSGHVVLEATTMKKGLEAPSGQQHRHAAGEKRTKEPGGKGKKNRNVKIGKITVSEKWRESVFRQITNANELKYLDEFLLNKINDLRSQKTPIESLFIEATEKFRSNIKTMYSVPNGKIHVGYKDLMENYQIVVSNLATERGQKDTNLVLNLFQSLLDEFTRGYTKNDFEPVKQSKAQKKKRKQERAVQEHNGHVFASYQVSIPQSCEQCLSYIWLMDKALLCSVCKMTCHKKCVHKIQSHCSYTYGRKGEPGAEPGHFGVCVDSLTSDKASVPIVLEKLLEHVEMHGLYTEGLYRKSGAANRTRELRQALQTDPAAVKLENFPIHAITGVLKQWLRELPEPLMTFAQYGDFLRAVELPEKQEQLAAIYAVLEHLPEANHNSLERLIFHLVKVALLEDVNRMSPGALAIIFAPCLLRCPDNSDPLTSMKDVLKITTCVEMLIKEQMRKYKVKMEEISQLEAAESIAFRRLSLLRQNAPWPLKLGFSSPYEGVLNKSPKTRDIQEEELEVLLEEEAAGGDEDREKEILIERIQSIKEEKEDITYRLPELDPRGSDEENLDSETSASTESLLEERAGRGASEGQY

SEQ ID NO: 862298 - protein, 2110 aa, Homo sapiens
MSVKEAGSSGRREQAAYHLHIYPQLSTTESQASCRVTATKDSTTSDVIKDAIASLRLDGTKCYVLVEVKESGGEEWVLDANDSPVHRVLLWPRRAQDEHPQEDGYYFLLQERNADGTIKYVHMQLVAQATATRRLVERGLLPRQQADFDDLCNLPELTEGNLLKNLKHRFLQQKIYTYAGSILVAINPFKFLPIYNPKYVKMYENQQLGKLEPHVFALADVAYYTMLRKRVNQCIVISGESGSGKTQSTNFLIHCLTALSQKGYASGVERTILGAGPVLEAFGNAKTAHNNNSSRFGKFIQVSYLESGIVRGAVVEKYLLEKSRLVSQEKDERNYHVFYYLLLGVSEEERQEFQLKQPEDYFYLNQHNLKIEDGEDLKHDFERLKQAMEMVGFLPATKKQIFAVLSAILYLGNVTYKKRATGREEGLEVGPPEVLDTLSQLLKVKREILVEVLTKRKTVTVNDKLILPYSLSEAITARDSMAKSLYSALFDWIVLRINHALLNKKDVEEAVSCLSIGVLDIFGFEDFERNSFEQFCINYANEQLQYYFNQHIFKLEQEEYQGEGITWHNIGYTDNVGCIHLISKKPTGLFYLLDEESNFPHATSQTLLAKFKQQHEDNKYFLGTPVMEPAFIIQHFAGKVKYQIKDFREKNMDYMRPDIVALLRGSDSSYVRELIGMDPVAVFRWAVLRAAIRAMAVLREAGRLRAERAEKAAGMSSPGAQSHPEELPRGASTPSEKLYRDLHNQMIKSIKGLPWQGEDPRSLLQSLSRLQKPRAFILKSKGIKQKQIIPKNLLDSKSLKLIISMTLHDRTTKSLLHLHKKKKPPSISAQFQTSLNKLLEALGKAEPFFIRCIRSNAEKKELCFDDELVLQQLRYTGMLETVRIRRSGYSAKYTFQDFTEQFQVLLPKDAQPCREVISTLLEKMKIDKRNYQIGKTKVFLKETERQALQETLHREVVRKILLLQSWFRMVLERRHFLQMKRAAVTIQACWRSYRVRRALERTQAAVYLQASWRGYWQRKLYRHQKQSIIRLQSLCRGHLQRKSFSQMISEKQKAEEKEREALEAARAGAEEGGQGQAAGGQQVAEQGPEPAEDGGHLASEPEVQPSDRSPLEHSSPEKEAPSPEKTLPPQKTVAAESHEKVPSSREKRESRRQRGLEHVKFQNKHIQSCKEESALREPSRRVTQEQGVSLLEDKKESREDETLLVVETEAENTSQKQPTEQPQAMAVGKVSEETEKTLPSGSPRPGQLERPTSLALDSRVSPPAPGSAPETPEDKSKPCGSPRVQEKPDSPGGSTQIQRYLDAERLASAVELWRGKKLVAAASPSAMLSQSLDLSDRHRATGAALTPTEERRTSFSTSDVSKLLPSLAKAQPAAETTDGERSAKKPAVQKKKPGDASSLPDAGLSPGSQVDSKSTFKRLFLHKTKDKKYSLEGAEELENAVSGHVVLEATTMKKGLEAPSGQQHRHAAGEKRTKEPGGKGKKNRNVKIGKITVSEKWRESVFRQITNANELKYLDEFLLNKINDLRSQKTPIESLFIEATEKFRSNIKTMYSVPNGKIHVGYKDLMENYQIVVSNLATERGQKDTNLVLNLFQSLLDEFTRGYTKNDFEPVKQSKAQKKKRKQERAVSRLHIDESPSRRTLAGACTCVSVSMCAWARLHAYVCVDTCECVFPPAYTEPYVLNKSPLRSHGSSSTSGWGGLPSPFPAQRLPLASQVQEHNGHVFASYQVSIPQSCEQCLSYIWLMDKALLCSVCKMTCHKKCVHKIQSHCSYTYGRKGEPGAEPGHFGVCVDSLTSDKASVPIVLEKLLEHVEMHGLYTEGLYRKSGAANRTRELRQALQTDPAAVKLENFPIHAITGVLKQWLRELPEPLMTFAQYGDFLRAVELPEKQEQLAAIYAVLEHLPEANHNSLERLIFHLVKVALLEDVNRMSPGALAIIFAPCLLRCPDNSDPLTSMKDVLKITTCVEMLIKEQMRKYKVKMEEISQLEAAESIAFRRLSLLRQNAPWPLKLGFSSPYEGVLNKSPKTRDIQEEELEVLLEEEAAGGDEDREKEILIERIQSIKEEKEDITYRLPELDPRGSDEENLDSETSASTESLLEERAGRGASEGQY

SEQ ID NO: 862299 - protein, 1543 aa, Homo sapiens
WRPELTLRVNSHGNVGFSRPKKQILPSSRHPETCLSIGVLDIFGFEDFERNSFEQFCINYANEQLQYYFNQHIFKLEQEEYQGEGITWHNIGYTDNVGCIHLISKKPTGLFYLLDEESNFPHATSQTLLAKFKQQHEDNKYFLGTPVMEPAFIIQHFAGKVKYQIKDFREKNMDYMRPDIVALLRGSDSSYVRELIGMDPVAVFRWAVLRAAIRAMAVLREAGRLRAERAEKAAGMSSPGAQSHPEELPRGASTPSEKLYRDLHNQMIKSIKGLPWQGEDPRSLLQSLSRLQKPRAFILKSKGIKQKQIIPKNLLDSKSLKLIISMTLHDRTTKSLLHLHKKKKPPSISAQFQTSLNKLLEALGKAEPFFIRCIRSNAEKKELCFDDELVLQQLRYTGMLETVRIRRSGYSAKYTFQDFTEQFQVLLPKDAQPCREVISTLLEKMKIDKRNYQIGKTKVFLKETERQALQETLHREVVRKILLLQSWFRMVLERRHFLQMKRAAVTIQACWRSYRVRRALERTQAAVYLQASWRGYWQRKLYRHQKQSIIRLQSLCRGHLQRKSFSQMISEKQKAEEKEREALEAARAGAEEGGQGQAAGGQQVAEQGPEPAEDGGHLASEPEVQPSDRSPLEHSSPEKEAPSPEKTLPPQKTVAAESHEKVPSSREKRESRRQRGLEHVKFQNKHIQSCKEESALREPSRRVTQEQGVSLLEDKKESREDETLLVVETEAENTSQKQPTEQPQAMAVGKVSEETEKTLPSGSPRPGQLERPTSLALDSRVSPPAPGSAPETPEDKSKPCGSPRVQEKPDSPGGSTQIQRYLDAERLASAVELWRGKKLVAAASPSAMLSQSLDLSDRHRATGAALTPTEERRTSFSTSDVSKLLPSLAKAQPAAETTDGERSAKKPAVQKKKPGDASSLPDAGLSPGSQVDSKSTFKRLFLHKTKDKKYSLEGAEELENAVSGHVVLEATTMKKGLEAPSGQQHRHAAGEKRTKEPGGKGKKNRNVKIGKITVSEKWRESVFRQITNANELKYLDEFLLNKINDLRSQKTPIESLFIEATEKFRSNIKTMYSVPNGKIHVGYKDLMENYQIVVSNLATERGQKDTNLVLNLFQSLLDEFTRGYTKNDFEPVKQSKAQKKKRKQERAVQEHNGHVFASYQVSIPQSCEQCLSYIWLMDKALLCSVCKMTCHKKCVHKIQSHCSYTYGRKGEPGAEPGHFGVCVDSLTSDKASVPIVLEKLLEHVEMHGLYTEGLYRKSGAANRTRELRQALQTDPAAVKLENFPIHAITGVLKQWLRELPEPLMTFAQYGDFLRAVELPEKQEQLAAIYAVLEHLPEANHNSLERLIFHLVKVALLEDVNRMSPGALAIIFAPCLLRCPDNSDPLTSMKDVLKITTCVEMLIKEQMRKYKVKMEEISQLEAAESIAFRRLSLLRQNAPWPLKLGFSSPYEGVLNKSPKTRDIQEEELEVLLEEEAAGGDEDREKEILIERIQSIKEEKEDITYRLPELDPRGSDEENLDSETSASTESLLEERAGRGASEGQY

SEQ ID NO: 862300 - protein, 1322 aa, Homo sapiens
MFWLQWPGDGPNGAGNPEVAGLLLTPSSFCHCAPSTPPLSDLHNQMIKSIKGLPWQGEDPRSLLQSLSRLQKPRAFILKSKGIKQKQIIPKNLLDSKSLKLIISMTLHDRTTKSLLHLHKKKKPPSISAQFQTSLNKLLEALGKAEPFFIRCIRSNAEKKELCFDDELVLQQLRYTGMLETVRIRRSGYSAKYTFQDFTEQFQVLLPKDAQPCREVISTLLEKMKIDKRNYQIGKTKVFLKETERQALQETLHREVVRKILLLQSWFRMVLERRHFLQMKRAAVTIQACWRSYRVRRALERTQAAVYLQASWRGYWQRKLYRHQKQSIIRLQSLCRGHLQRKSFSQMISEKQKAEEKEREALEAARAGAEEGGQGQAAGGQQVAEQGPEPAEDGGHLASEPEVQPSDRSPLEHSSPEKEAPSPEKTLPPQKTVAAESHEKVPSSREKRESRRQRGLEHVKFQNKHIQSCKEESALREPSRRVTQEQGVSLLEDKKESREDETLLVVETEAENTSQKQPTEQPQAMAVGKVSEETEKTLPSGSPRPGQLERPTSLALDSRVSPPAPGSAPETPEDKSKPCGSPRVQEKPDSPGGSTQIQRYLDAERLASAVELWRGKKLVAAASPSAMLSQSLDLSDRHRATGAALTPTEERRTSFSTSDVSKLLPSLAKAQPAAETTDGERSAKKPAVQKKKPGDASSLPDAGLSPGSQVDSKSTFKRLFLHKTKDKKYSLEGAEELENAVSGHVVLEATTMKKGLEAPSGQQHRHAAGEKRTKEPGGKGKKNRNVKIGKITVSEKWRESVFRQITNANELKYLDEFLLNKINDLRSQKTPIESLFIEATEKFRSNIKTMYSVPNGKIHVGYKDLMENYQIVVSNLATERGQKDTNLVLNLFQSLLDEFTRGYTKNDFEPVKQSKAQKKKRKQERAVQEHNGHVFASYQVSIPQSCEQCLSYIWLMDKALLCSVCKMTCHKKCVHKIQSHCSYTYGRKGEPGAEPGHFGVCVDSLTSDKASVPIVLEKLLEHVEMHGLYTEGLYRKSGAANRTRELRQALQTDPAAVKLENFPIHAITGVLKQWLRELPEPLMTFAQYGDFLRAVELPEKQEQLAAIYAVLEHLPEANHNSLERLIFHLVKVALLEDVNRMSPGALAIIFAPCLLRCPDNSDPLTSMKDVLKITTCVEMLIKEQMRKYKVKMEEISQLEAAESIAFRRLSLLRQNAPWPLKLGFSSPYEGVLNKSPKTRDIQEEELEVLLEEEAAGGDEDREKEILIERIQSIKEEKEDITYRLPELDPRGSDEENLDSETSASTESLLEERAGRGASEGQY

SEQ ID NO: 862301 - protein, 1322 aa, Homo sapiens; identical to SEQ ID NO: 862300

SEQ ID NO: 862302 - protein, 2157 aa, Homo sapiens [sequence omitted]

SEQ ID NO: 862303 - protein, 2038 aa, Homo sapiens
MSVKEAGSSGRREQAAYHLHIYPQLSTTESQASCRVTATKDSTTSDVIKDAIASLRLDGTKCYVLVEVKESGGEEWVLDANDSPVHRVLLWPRRAQDEHPQEDGYYFLLQERNADGTIKYVHMQLVAQATATRRLVERGLLPRQQADFDDLCNLPELTEGNLLKNLKHRFLQQKIYTYAGSILVAINPFKFLPIYNPKYVKMYENQQLGKLEPHVFALADVAYYTMLRKRVNQCIVISGESGSGKTQSTNFLIHCLTALSQKGYASGVERTILGAGPVLEAFGNAKTAHNNNSSRFGKFIQVSYLESGIVRGAVVEKYLLEKSRLVSQEKDERNYHVFYYLLLGVSEEERQEFQLKQPEDYFYLNQHNLKIEDGEDLKHDFERLKQAMEMVGFLPATKKQIFAVLSAILYLGNVTYKKRATGREEGLEVGPPEVLDTLSQLLKVKREILVEVLTKRKTVTVNDKLILPYSLSEAITARDSMAKSLYSALFDWIVLRINHALLNKKDVEEAVSCLSIGVLDIFGFEDFERNSFEQFCINYANEQLQYYFNQHIFKLEQEEYQGEGITWHNIGYTDNVGCIHLISKKPTGLFYLLDEESNFPHATSQTLLAKFKQQHEDNKYFLGTPVMEPAFIIQHFAGKVKYQIKDFREKNMDYMRPDIVALLRGSDSSYVRELIGMDPVAVFRWAVLRAAIRAMAVLREAGRLRAERAEKAAGMSSPGAQSHPEELPRGASTPSEKLYRDLHNQMIKSIKGLPWQGEDPRSLLQSLSRLQKPRAFILKSKGIKQKQIIPKNLLDSKSLKLIISMTLHDRTTKSLLHLHKKKKPPSISAQFQTSLNKLLEALGKAEPFFIRCIRSNAEKKELCFDDELVLQQLRYTGMLETVRIRRSGYSAKYTFQDFTEQFQVLLPKDAQPCREVISTLLEKMKIDKRNYQIGKTKVFLKETERQALQETLHREVVRKILLLQSWFRMVLERRHFLQMKRAAVTIQACWRSYRVRRALERTQAAVYLQASWRGYWQRKLYRHQKQSIIRLQSLCRGHLQRKSFSQMISEKQKAEEKEREALEAARAGAEEGGQGQAAGGQQVAEQGPEPAEDGGHLASEPEVQPSDRSPLEHSSPEKEAPSPEKTLPPQKTVAAESHEKVPSSREKRESRRQRGLEHVKFQNKHIQSCKEESALREPSRRVTQEQGVSLLEDKKESREDETLLVVETEAENTSQKQPTEQPQAMAVGKVSEETEKTLPSGSPRPGQLERPTSLALDSRVSPPAPGSAPETPEDKSKPCGSPRVQEKPDSPGGSTQIQRYLDAERLASAVELWRGKKLVAAASPSAMLSQSLDLSDRHRATGAALTPTEERRTSFSTSDVSKLLPSLAKAQPAAETTDGERSAKKPAVQKKKPGDASSLPDAGLSPGSQVDSKSTFKRLFLHKTKDKKYSLEGAEELENAVSGHVVLEATTMKKGLEAPSGQQHRHAAGEKRTKEPGGKGKKNRNVKIGKITVSEKWRESVFRQITNANELKYLDEFLLNKINDLRSQKTPIESLFIEATEKFRSNIKTMYSVPNGKIHVGYKDLMENYQIVVSNLATERGQKDTNLVLNLFQSLLDEFTRGYTKNDFEPVKQSKAQKKKRKQERAVQEHNGHVFASYQVSIPQSCEQCLSYIWLMDKALLCSVCKMTCHKKCVHKIQSHCSYTYGRKGEPGAEPGHFGVCVDSLTSDKASVPIVLEKLLEHVEMHGLYTEGLYRKSGAANRTRELRQALQTDPAAVKLENFPIHAITGVLKQWLRELPEPLMTFAQYGDFLRAVELPEKQEQLAAIYAVLEHLPEANHNSLERLIFHLVKVALLEDVNRMSPGALAIIFAPCLLRCPDNSDPLTSMKDVLKITTCVEMLIKEQMRKYKVKMEEISQLEAAESIAFRRLSLLRQNAPWPLKLGFSSPYEGVLNKSPKTRDIQEEELEVLLEEEAAGGDEDREKEILIERIQSIKEEKEDITYRLPELDPRGSDEENLDSETSASTESLLEERAGRGASEGPPAPALPCPRRAPNPEDP

SEQ ID NO: 862304 - protein, 142 aa, Homo sapiens [sequence omitted]

SEQ ID NO: 862305 - protein, 1686 aa, Homo sapiens
MSVKEAGSSGRREQAAYHLHIYPQLSTTESQASCRVTATKDSTTSDVIKDAIASLRLDGTKCYVLVEVKESGGEEWVLDANDSPVHRVLLWPRRAQDEHPQEDGYYFLLQERNADGTIKYVHMQLVAQATATRRLVERGLLPRQQADFDDLCNLPELTEGNLLKNLKHRFLQQKIYTYAGSILVAINPFKFLPIYNPKYVKMYENQQLGKLEPHVFALADVAYYTMLRKRVNQCIVISGESGSGKTQSTNFLIHCLTALSQKGYASGVERTILGAGPVLEAFGNAKTAHNNNSSRFGKFIQVSYLESGIVRGAVVEKYLLEKSRLVSQEKDERNYHVFYYLLLGVSEEERQEFQLKQPEDYFYLNQHNLKIEDGEDLKHDFERLKQAMEMVGFLPATKKQIFAVLSAILYLGNVTYKKRATGREEGLEVGPPEVLDTLSQLLKVKREILVEVLTKRKTVTVNDKLILPYSLSEAITARDSMAKSLYSALFDWIVLRINHALLNKKDVEEAVSCLSIGVLDIFGFEDFERNSFEQFCINYANEQLQYYFNQHIFKLEQEEYQGEGITWHNIGYTDNVGCIHLISKKPTGLFYLLDEESNFPHATSQTLLAKFKQQHEDNKYFLGTPVMEPAFIIQHFAGKVKYQIKDFREKNMDYMRPDIVALLRGSDSSYVRELIGMDPVAVFRWAVLRAAIRAMAVLREAGRLRAERAEKAAGMSSPGAQSHPEELPRGASTPSEKLYRDLHNQMIKSIKGLPWQGEDPRSLLQSLSRLQKPRAFILKSKGIKQKQIIPKNLLDSKSLKLIISMTLHDRTTKSLLHLHKKKKPPSISAQFQTSLNKLLEALGKAEPFFIRCIRSNAEKKELCFDDELVLQQLRYTGMLETVRIRRSGYSAKYTFQDFTEQFQVLLPKDAQPCREVISTLLEKMKIDKRNYQIGKTKVFLKETERQALQETLHREVVRKILLLQSWFRMVLERRHFLQMKRAAVTIQACWRSYRVRRALERTQAAVYLQASWRGYWQRKLYRHQKQSIIRLQSLCRGHLQRKSFSQMISEKQKAEEKEREALEAARAGAEEGGQGQAAGGQQVAEQGPEPAEDGGHLASEPEVQPSDRSPLEHSSPEKEAPSPEKTLPPQKTVAAESHEKVPSSREKRESRRQRGLEHVKFQNKHIQSCKEESALREPSRRVTQEQGVSLLEDKKESREDETLLVVETEAENTSQKQPTEQPQAMAVGKVSEETEKTLPSGSPRPGQLERPTSLALDSRVSPPAPGSAPETPEDKSKPCGSPRVQEKPDSPGGSTQIQRYLDAERLASAVELWRGKKLVAAASPSAMLSQSLDLSDRHRATGAALTPTEERRTSFSTSDVSKLLPSLAKAQPAAETTDGERSAKKPAVQKKKPGDASSLPDAGLSPGSQVDSKSTFKRLFLHKTKDKKYSLEGAEELENAVSGHVVLEATTMKKGLEAPSGQQHRHAAGEKRTKEPGGKGKKNRNVKIGKITVSEKWRESVFRQITNANELKYLDEFLLNKINDLRSQKTPIESLFIEATEKFRSNIKTMYSVPNGKIHVGYKDLMENYQIVVSNLATERGQKDTNLVLNLFQSLLDEFTRGYTKNDFEPVKQSKAQKKKRKQERAVSRLHIDESPSRRDNDEDKQKILDKCNEIINWLDKNQTAEKEEFEHQQKELEKVCKRITR

SEQ ID NO: 862306 - protein, 420 aa, Homo sapiens
MSVKEAGSSGRREQAAYHLHIYPQLSTTESQASCRVTATKDSTTSDVIKDAIASLRLDGTKCYVLVEVKESGGEEWVLDANDSPVHRVLLWPRRAQDEHPQEDGYYFLLQERNADGTIKYVHMQLVAQATATRRLVERGLLPRQQADFDDLCNLPELTEGNLLKNLKHRFLQQKIYTYAGSILVAINPFKFLPIYNPKYVKMYENQQLGKLEPHVFALADVAYYTMLRKRVNQCIVISGESGSGKTQSTNFLIHCLTALSQKGYASGVERTILGAGPVLEAFGNAKTAHNNNSSRFGKFIQVSYLESGIVRGAVVEKYLLEKSRLVSQEKDERNYHVFYYLLLGVSEEERQEFQLKQPEDYFYLNQHNLKIEDGEDLKHDFERLKQAMEMVGFLPATKKQIFAVLSAILYLGNRARHCFQ

SEQ ID NO: 862307 - protein, 316 aa, Homo sapiens [sequence omitted]

SEQ ID NO: 862308 - protein, 70 aa, Homo sapiens
KKDVEEAVSVSAPICFLKPGQGRPHPHYQYPWWATWNIRSRGICNQEAVSPQGQAQETGQATKFNRPRAE

SEQ ID NO: 862309 - protein, 115 aa, Homo sapiens
NLLDSKSLKLIISMTLHDRTTKSLLHLHKKKKPPSISAQFQEVEQERQKVAVSSASGLCSFTRHRAQPVSSKNTKIGRARWLKPVIPALWEAEAGGSRGQEIETILANTVKPHLY

SEQ ID NO: 862310 - protein, 162 aa, Homo sapiens
TVRIRRSGYSAKYTLQDFTEQFQVLLPKDAQPCREVISTLLEKMKITRGASTPSEKLYRDLHNQMIKSIKGLPWQGEDPRSLLQSLSRLQKPRAFILKSKGIKQKQIIPKVKKKTHPARHVPRYLASLPVLRAFTSATSFPPPSHYLPLPPRKKKCSRVEMI

SEQ ID NO: 862311 - protein, 2157 aa, Homo sapiens [sequence omitted]

SEQ ID NO: 862312 - protein, 1984 aa, Homo sapiens
MSVKEAGSSGRREQAAYHLHIYPQLSTTESQASCRVTATKDSTTSDVIKDAIASLRLDGTKCYVLVEVKESGGEEWVLDANDSPVHRVLLWPRRAQDEHPQEDGYYFLLQERNADGTIKYVHMQLVAQATATRRLVERGLLPRQQADFDDLCNLPELTEGNLLKNLKHRFLQQKIYTYAGSILVAINPFKFLPIYNPKYVKMYENQQLGKLEPHVFALADVAYYTMLRKRVNQCIVISGESGSGKTQSTNFLIHCLTALSQKGYASGVERTILGAGPVLEAFGNAKTAHNNNSSRFGKFIQVSYLESGIVRGAVVEKYLLEKSRLVSQEKDERNYHVFYYLLLGVSEEERQEFQLKQPEDYFYLNQHNLKIEDGEDLKHDFERLKQAMEMVGFLPATKKQIFAVLSAILYLGNVTYKKRATGREEGLEVGPPEVLDTLSQLLKVKREILVEVLTKRKTVTVNDKLILPYSLSEAITARDSMAKSLYSALFDWIVLRINHALLNKKDVEEAVSCLSIGVLDIFGFEDFERNSFEQFCINYANEQLQYYFNQHIFKLEQEEYQGEGITWHNIGYTDNVGCIHLISKKPTGLFYLLDEESNFPHATSQTLLAKFKQQHEDNKYFLGTPVMEPAFIIQHFAGKVKYQIKDFREKNMDYMRPDIVALLRGSDSSYVRELIGMDPVAVFRWAVLRAAIRAMAVLREAGRLRAERAEKAAGMSSPGAQSHPEELPRGASTPSEKLYRKSKGIKQKQIIPKNLLDSKSLKLIISMTLHDRTTKSLLHLHKKKKPPSISAQFQTSLNKLLEALGKAEPFFIRCIRSNAEKKELCFDDELVLQQLRYTGMLETVRIRRSGYSAKYTFQDFTEQFQVLLPKDAQPCREVISTLLEKMKIDKRNYQIGKTKVFLKETERQALQETLHREVVRKILLLQSWFRMVLERRHFLQMKRAAVTIQACWRSYRVRRALERTQAAVYLQASWRGYWQRKLYRHQKQSIIRLQSLCRGHLQRKSFSQMISEKQKAEEKEREALEAARAGAEEGGQGQAAGGQQVAEQGPEPAEDGGHLASEPEVQPSDRSPLEHSSPEKEAPSPEKTLPPQKTVAAESHEKVPSSREKRESRRQRGLEHVKFQNKHIQSCKEESALREPSRRVTQEQGVSLLEDKKESREDETLLVVETEAENTSQKQPTEQPQAMAVGKVSEETEKTLPSGSPRPGQLERPTSLALDSRVSPPAPGSAPETPEDKSKPCGSPRVQEKPDSPGGSTQIQRYLDAERLASAVELWRGKKLVAAASPSAMLSQSLDLSDRHRATGAALTPTEERRTSFSTSDVSKLLPSLAKAQPAAETTDGERSAKKPAVQKKKPGDASSLPDAGLSPGSQVDSKSTFKRLFLHKTKDKKYSLEGAEELENAVSGHVVLEATTMKKGLEAPSGQQHRHAAGEKRTKEPGGKGKKNRNVKIGKITVSEKWRESVFRQITNANELKYLDEFLLNKINDLRSQKTPIESLFIEATEKFRSNIKTMYSVPNGKIHVGYKDLMENYQIVVSNLATERGQKDTNLVLNLFQSLLDEFTRGYTKNDFEPVKQSKAQKKKRKQERAVQEHNGHVFASYQVSIPQSCEQCLSYIWLMDKALLCSVCKMTCHKKCVHKIQSHCSYTYGRKGEPGAEPGHFGVCVDSLTSDKASVPIVLEKLLEHVEMHGLYTEGLYRKSGAANRTRELRQALQTDPAAVKLENFPIHAITGVLKQWLRELPEPLMTFAQYGDFLRAVELPEKQEQLAAIYAVLEHLPEANHNSLERLIFHLVKVALLEDVNRMSPGALAIIFAPCLLRCPDNSDPLTSMKDVLKITTCVEMLIKEQMRKYKVKMEEISQLEAAESIAFRRLSLLRQNAPWPLKLGFSSPYEGVLNKSPKTRDIQEEELEVLLEEEAAGGDEDREKEILIERIQSIKEEKEDITYRLPELDPRGSDEENLDSETSASTESLLEERAGRGASEGQY

SEQ ID NO: 862313 - protein, 1635 aa, Homo sapiens
MEMVGFLPATKKQIFAVLSAILYLGNVTYKKRATGREEGLEVGPPEVLDTLSQLLKVKREILVEVLTKRKTVTVNDKLILPYSLSEAITARDSMAKSLYSALFDWIVLRINHALLNKKDVEEAVSCLSIGVLDIFGFEDFERNSFEQFCINYANEQLQYYFNQHIFKLEQEEYQGEGITWHNIGYTDNVGCIHLISKKPTGLFYLLDEESNFPHATSQTLLAKFKQQHEDNKYFLGTPVMEPAFIIQHFAGKVKYQIKDFREKNMDYMRPDIVALLRGSDSSYVRELIGMDPVAVFRWAVLRAAIRAMAVLREAGRLRAERAEKAAGMSSPGAQSHPEELPRGASTPSEKLYRDLHNQMIKSIKGLPWQGEDPRSLLQSLSRLQKPRAFILKSKGIKQKQIIPKNLLDSKSLKLIISMTLHDRTTKSLLHLHKKKKPPSISAQFQTSLNKLLEALGKAEPFFIRCIRSNAEKKELCFDDELVLQQLRYTGMLETVRIRRSGYSAKYTFQDFTEQFQVLLPKDAQPCREVISTLLEKMKIDKRNYQIGKTKVFLKETERQALQETLHREVVRKILLLQSWFRMVLERRHFLQMKRAAVTIQACWRSYRVRRALERTQAAVYLQASWRGYWQRKLYRHQKQSIIRLQSLCRGHLQRKSFSQMISEKQKAEEKEREALEAARAGAEEGGQGQAAGGQQVAEQGPEPAEDGGHLASEPEVQPSDRSPLEHSSPEKEAPSPEKTLPPQKTVAAESHEKVPSSREKRESRRQRGLEHVKFQNKHIQSCKEESALREPSRRVTQEQGVSLLEDKKESREDETLLVVETEAENTSQKQPTEQPQAMAVGKVSEETEKTLPSGSPRPGQLERPTSLALDSRVSPPAPGSAPETPEDKSKPCGSPRVQEKPDSPGGSTQIQRYLDAERLASAVELWRGKKLVAAASPSAMLSQSLDLSDRHRATGAALTPTEERRTSFSTSDVSKLLPSLAKAQPAAETTDGERSAKKPAVQKKKPGDASSLPDAGLSPGSQVDSKSTFKRLFLHKTKDKKYSLEGAEELENAVSGHVVLEATTMKKGLEAPSGQQHRHAAGEKRTKEPGGKGKKNRNVKIGKITVSEKWRESVFRQITNANELKYLDEFLLNKINDLRSQKTPIESLFIEATEKFRSNIKTMYSVPNGKIHVGYKDLMENYQIVVSNLATERGQKDTNLVLNLFQSLLDEFTRGYTKNDFEPVKQSKAQKKKRKQERAVQEHNGHVFASYQVSIPQSCEQCLSYIWLMDKALLCSVCKMTCHKKCVHKIQSHCSYTYGRKGEPGAEPGHFGVCVDSLTSDKASVPIVLEKLLEHVEMHGLYTEGLYRKSGAANRTRELRQALQTDPAAVKLENFPIHAITGVLKQWLRELPEPLMTFAQYGDFLRAVELPEKQEQLAAIYAVLEHLPEANHNSLERLIFHLVKVALLEDVNRMSPGALAIIFAPCLLRCPDNSDPLTSMKDVLKITTCVEMLIKEQMRKYKVKMEEISQLEAAESIAFRRLSLLRQNAPWPLKLGFSSPYEGVLNKSPKTRDIQEEELEVLLEEEAAGGDEDREKEILIERIQSIKEEKEDITYRLPELDPRGSDEENLDSETSASTESLLEERAGRGASEGQY

SEQ ID NO: 862314 - protein, 1531 aa, Homo sapiens
MKAGSLGVHLRAVTIFSVFSQCLSIGVLDIFGFEDFERNSFEQFCINYANEQLQYYFNQHIFKLEQEEYQGEGITWHNIGYTDNVGCIHLISKKPTGLFYLLDEESNFPHATSQTLLAKFKQQHEDNKYFLGTPVMEPAFIIQHFAGKVKYQIKDFREKNMDYMRPDIVALLRGSDSSYVRELIGMDPVAVFRWAVLRAAIRAMAVLREAGRLRAERAEKAAGMSSPGAQSHPEELPRGASTPSEKLYRDLHNQMIKSIKGLPWQGEDPRSLLQSLSRLQKPRAFILKSKGIKQKQIIPKNLLDSKSLKLIISMTLHDRTTKSLLHLHKKKKPPSISAQFQTSLNKLLEALGKAEPFFIRCIRSNAEKKELCFDDELVLQQLRYTGMLETVRIRRSGYSAKYTFQDFTEQFQVLLPKDAQPCREVISTLLEKMKIDKRNYQIGKTKVFLKETERQALQETLHREVVRKILLLQSWFRMVLERRHFLQMKRAAVTIQACWRSYRVRRALERTQAAVYLQASWRGYWQRKLYRHQKQSIIRLQSLCRGHLQRKSFSQMISEKQKAEEKEREALEAARAGAEEGGQGQAAGGQQVAEQGPEPAEDGGHLASEPEVQPSDRSPLEHSSPEKEAPSPEKTLPPQKTVAAESHEKVPSSREKRESRRQRGLEHVKFQNKHIQSCKEESALREPSRRVTQEQGVSLLEDKKESREDETLLVVETEAENTSQKQPTEQPQAMAVGKVSEETEKTLPSGSPRPGQLERPTSLALDSRVSPPAPGSAPETPEDKSKPCGSPRVQEKPDSPGGSTQIQRYLDAERLASAVELWRGKKLVAAASPSAMLSQSLDLSDRHRATGAALTPTEERRTSFSTSDVSKLLPSLAKAQPAAETTDGERSAKKPAVQKKKPGDASSLPDAGLSPGSQVDSKSTFKRLFLHKTKDKKYSLEGAEELENAVSGHVVLEATTMKKGLEAPSGQQHRHAAGEKRTKEPGGKGKKNRNVKIGKITVSEKWRESVFRQITNANELKYLDEFLLNKINDLRSQKTPIESLFIEATEKFRSNIKTMYSVPNGKIHVGYKDLMENYQIVVSNLATERGQKDTNLVLNLFQSLLDEFTRGYTKNDFEPVKQSKAQKKKRKQERAVQEHNGHVFASYQVSIPQSCEQCLSYIWLMDKALLCSVCKMTCHKKCVHKIQSHCSYTYGRKGEPGAEPGHFGVCVDSLTSDKASVPIVLEKLLEHVEMHGLYTEGLYRKSGAANRTRELRQALQTDPAAVKLENFPIHAITGVLKQWLRELPEPLMTFAQYGDFLRAVELPEKQEQLAAIYAVLEHLPEANHNSLERLIFHLVKVALLEDVNRMSPGALAIIFAPCLLRCPDNSDPLTSMKDVLKITTCVEMLIKEQMRKYKVKMEEISQLEAAESIAFRRLSLLRQNAPWPLKLGFSSPYEGVLNKSPKTRDIQEEELEVLLEEEAAGGDEDREKEILIERIQSIKEEKEDITYRLPELDPRGSDEENLDSETSASTESLLEERAGRGASEGQY

SEQ ID NO: 862315 - protein, 1218 aa, Homo sapiens
MTLHDRTTKSLLHLHKKKKPPSISAQFQTSLNKLLEALGKAEPFFIRCIRSNAEKKELCFDDELVLQQLRYTGMLETVRIRRSGYSAKYTFQDFTEQFQVLLPKDAQPCREVISTLLEKMKIDKRNYQIGKTKVFLKETERQALQETLHREVVRKILLLQSWFRMVLERRHFLQMKRAAVTIQACWRSYRVRRALERTQAAVYLQASWRGYWQRKLYRHQKQSIIRLQSLCRGHLQRKSFSQMISEKQKAEEKEREALEAARAGAEEGGQGQAAGGQQVAEQGPEPAEDGGHLASEPEVQPSDRSPLEHSSPEKEAPSPEKTLPPQKTVAAESHEKVPSSREKRESRRQRGLEHVKFQNKHIQSCKEESALREPSRRVTQEQGVSLLEDKKESREDETLLVVETEAENTSQKQPTEQPQAMAVGKVSEETEKTLPSGSPRPGQLERPTSLALDSRVSPPAPGSAPETPEDKSKPCGSPRVQEKPDSPGGSTQIQRYLDAERLASAVELWRGKKLVAAASPSAMLSQSLDLSDRHRATGAALTPTEERRTSFSTSDVSKLLPSLAKAQPAAETTDGERSAKKPAVQKKKPGDASSLPDAGLSPGSQVDSKSTFKRLFLHKTKDKKYSLEGAEELENAVSGHVVLEATTMKKGLEAPSGQQHRHAAGEKRTKEPGGKGKKNRNVKIGKITVSEKWRESVFRQITNANELKYLDEFLLNKINDLRSQKTPIESLFIEATEKFRSNIKTMYSVPNGKIHVGYKDLMENYQIVVSNLATERGQKDTNLVLNLFQSLLDEFTRGYTKNDFEPVKQSKAQKKKRKQERAVQEHNGHVFASYQVSIPQSCEQCLSYIWLMDKALLCSVCKMTCHKKCVHKIQSHCSYTYGRKGEPGAEPGHFGVCVDSLTSDKASVPIVLEKLLEHVEMHGLYTEGLYRKSGAANRTRELRQALQTDPAAVKLENFPIHAITGVLKQWLRELPEPLMTFAQYGDFLRAVELPEKQEQLAAIYAVLEHLPEANHNSLERLIFHLVKVALLEDVNRMSPGALAIIFAPCLLRCPDNSDPLTSMKDVLKITTCVEMLIKEQMRKYKVKMEEISQLEAAESIAFRRLSLLRQNAPWPLKLGFSSPYEGVLNKSPKTRDIQEEELEVLLEEEAAGGDEDREKEILIERIQSIKEEKEDITYRLPELDPRGSDEENLDSETSASTESLLEERAGRGASEGQY

SEQ ID NO: 862316 - protein, 1218 aa, Homo sapiens; identical to SEQ ID NO: 862315

SEQ ID NO: 862317 - protein, 2141 aa, Homo sapiens
MSVKEAGSSGRREQAAYHLHIYPQLSTTESQASCRVTATKDSTTSDVIKDAIASLRLDGTKCYVLVEVKESGGEEWVLDANDSPVHRVLLWPRRAQDEHPQEDGYYFLLQERNADGTIKYVHMQLVAQATATRRLVERGLLPRQQADFDDLCNLPELTEGNLLKNLKHRFLQQKIYTYAGSILVAINPFKFLPIYNPKYVKMYENQQLGKLEPHVFALADVAYYTMLRKRVNQCIVISGESGSGKTQSTNFLIHCLTALSQKGYASGVERTILGAGPVLEAFGNAKTAHNNNSSRFGKFIQVSYLESGIVRGAVVEKYLLEKSRLVSQEKDERNYHVFYYLLLGVSEEERQEFQLKQPEDYFYLNQHNLKIEDGEDLKHDFERLKQAMEMVGFLPATKKQIFAVLSAILYLGNVTYKKRATGREEGLEVGPPEVLDTLSQLLKVKREILVEVLTKRKTVTVNDKLILPYSLSEAITARDSMAKSLYSALFDWIVLRINHALLNKKDVEEAVSCLSIGVLDIFGFEDFERNSFEQFCINYANEQLQYYFNQHIFKLEQEEYQGEGITWHNIGYTDNVGCIHLISKKPTGLFYLLDEESNFPHATSQTLLAKFKQQHEDNKYFLGTPVMEPAFIIQHFAGKVKYQIKDFREKNMDYMRPDIVALLRGSDSSYVRELIGMDPVAVFRWAVLRAAIRAMAVLREAGRLRAERAEKAAGMSSPGAQSHPEELPRGASTPSEKLYRDLHNQMIKSIKGLPWQGEDPRSLLQSLSRLQKPRAFILKSKGIKQKQIIPKNLLDSKSLKLIISMTLHDRTTKSLLHLHKKKKPPSISAQFQTSLNKLLEALGKAEPFFIRCIRSNAEKKELCFDDELVLQQLRYTGMLETVRIRRSGYSAKYTFQDFTEQFQVLLPKDAQPCREVISTLLEKMKIDKRNYQIGKTKVFLKETERQALQETLHREVVRKILLLQSWFRMVLERRHFLQMKRAAVTIQACWRSYRVRRALERTQAAVYLQASWRGYWQRKLYRHQKQSIIRLQSLCRGHLQRKSFSQMISEKQKAEEKEREALEAARAGAEEGGQGQAAGGQQVAEQGPEPAEDGGHLASEPEVQPSDRSPLEHSSPEKEAPSPEKTLPPQKTVAAESHEKVPSSREKRESRRQRGLEHVKFQNKHIQSCKEESALREPSRRVTQEQGVSLLEDKKESREDETLLVVETEAENTSQKQPTEQPQAMAVGKVSEETEKTLPSGSPRPGQLERPTSLALDSRVSPPAPGSAPETPEDKSKPCGSPRVQEKPDSPGGSTQIQRYLDAERLASAVELWRGKKLVAAASPSAMLSQSLDLSDRHRATGAALTPTEERRTSFSTSDVSKLLPSLAKAQPAAETTDGERSAKKPAVQKKKPGDASSLPDAGLSPGSQVDSKSTFKRLFLHKTKDKKYSLEGAEELENAVSGHVVLEATTMKKGLEAPSGQQHRHAAGEKRTKEPGGKGKKNRNVKIGKITVSEKWRESVFRQITNANELKYLDEFLLNKINDLRSQKTPIESLFIEATEKFRSNIKTMYSVPNGKIHVGYKDLMENYQIVVSNLATERGQKDTNLVLNLFQSLLDEFTRGYTKNDFEPVKQSKAQKKKRKQERAVQEHNGHVFASYQVSIPQSCEQCLSYIWLMDKALLCSVCKMTCHKKCVHKIQSHCSYTYGRKGEPGAEPGHFGVCVDSLTSDKASVPIVLEKLLEHVEMHGLYTEGLYRKSGAANRTRELRQALQTDPAAVKLENFPIHAITGVLKQWLRELPEPLMTFAQYGDFLRAVELPEKQEQLAAIYAVLEHLPEANHNSLERLIFHLVKVALLEDVNRMSPGALAIIFAPCLLRCPDNSDPLTSMKDVLKITTCVEMLIKEQMRKYKVKMEEISQLEAAESIAFRRLSLLRQNANKSPKTRDIQEEELEVLLEEEAAGGDEDREKEILIERIQSIKEEKEDITYRLPELDPRGSDEENLDSETSASTESLLEERAGRGASEGPPAPALPCPGAPTPSPLPTVAAPPRRRPSSFVTVRVKTPRRTPIMPTANIKLPPGLPSHLPRWAPGAREAAAPVRRREPPARRPDQIHSVYITPGADLPVQGALEPLEEDGQPPGAKRRYSDPPTYCLPPASGQTNG

SEQ ID NO: 862318 - protein, 1298 aa, Homo sapiens
PATRCPGHDARGTQRSVYGSLTAKTPPLSPWQGEDPRSLLQSLSRLQKPRAFILKSKGIKQKQIIPKNLLDSKSLKLIISMTLHDRTTKSLLHLHKKKKPPSISAQFQTSLNKLLEALGKAEPFFIRCIRSNAEKKELCFDDELVLQQLRYTGMLETVRIRRSGYSAKYTFQDFTEQFQVLLPKDAQPCREVISTLLEKMKIDKRNYQIGKTKVFLKETERQALQETLHREVVRKILLLQSWFRMVLERRHFLQMKRAAVTIQACWRSYRVRRALERTQAAVYLQASWRGYWQRKLYRHQKQSIIRLQSLCRGHLQRKSFSQMISEKQKAEEKEREALEAARAGAEEGGQGQAAGGQQVAEQGPEPAEDGGHLASEPEVQPSDRSPLEHSSPEKEAPSPEKTLPPQKTVAAESHEKVPSSREKRESRRQRGLEHVKFQNKHIQSCKEESALREPSRRVTQEQGVSLLEDKKESREDETLLVVETEAENTSQKQPTEQPQAMAVGKVSEETEKTLPSGSPRPGQLERPTSLALDSRVSPPAPGSAPETPEDKSKPCGSPRVQEKPDSPGGSTQIQRYLDAERLASAVELWRGKKLVAAASPSAMLSQSLDLSDRHRATGAALTPTEERRTSFSTSDVSKLLPSLAKAQPAAETTDGERSAKKPAVQKKKPGDASSLPDAGLSPGSQVDSKSTFKRLFLHKTKDKKYSLEGAEELENAVSGHVVLEATTMKKGLEAPSGQQHRHAAGEKRTKEPGGKGKKNRNVKIGKITVSEKWRESVFRQITNANELKYLDEFLLNKINDLRSQKTPIESLFIEATEKFRSNIKTMYSVPNGKIHVGYKDLMENYQIVVSNLATERGQKDTNLVLNLFQSLLDEFTRGYTKNDFEPVKQSKAQKKKRKQERAVQEHNGHVFASYQVSIPQSCEQCLSYIWLMDKALLCSVCKMTCHKKCVHKIQSHCSYTYGRKGEPGAEPGHFGVCVDSLTSDKASVPIVLEKLLEHVEMHGLYTEGLYRKSGAANRTRELRQALQTDPAAVKLENFPIHAITGVLKQWLRELPEPLMTFAQYGDFLRAVELPEKQEQLAAIYAVLEHLPEANHNSLERLIFHLVKVALLEDVNRMSPGALAIIFAPCLLRCPDNSDPLTSMKDVLKITTCVEMLIKEQMRKYKVKMEEISQLEAAESIAFRRLSLLRQNAPWPLKLGFSSPYEGVLNKSPKTRDIQEEELEVLLEEEAAGGDEDREKEILIERIQSIKEEKEDITYRLPELDPRGSDEENLDSETSASTESLLEERAGRGASEGQY

SEQ ID NO: 862319 - protein, 1380 aa, Homo sapiens
MSVKEAGSSGRREQAAYHLHIYPQLSTTESQASCRVTATKDSTTSDVIKDAIASLRLDGTKCYVLVEVKESGGEEWVLDANDSPVHRVLLWPRRAQDEHPQEDGYYFLLQERNADGTIKYVHMQLVAQATATRRLVERGLLPRQQADFDDLCNLPELTEGNLLKNLKHRFLQQKIYTYAGSILVAINPFKFLPIYNPKYVKMYENQQLGKLEPHVFALADVAYYTMLRKRVNQCIVISGESGSGKTQSTNFLIHCLTALSQKGYASGVERTILGAGPVLEAFGNAKTAHNNNSSRFGKFIQVSYLESGIVRGAVVEKYLLEKSRLVSQEKDERNYHVFYYLLLGVSEEERQEFQLKQPEDYFYLNQHNLKIEDGEDLKHDFERLKQAMEMVGFLPATKKQIFAVLSAILYLGNVTYKKRATGREEGLEVGPPEVLDTLSQLLKVKREILVEVLTKRKTVTVNDKLILPYSLSEAITARDSMAKSLYSALFDWIVLRINHALLNKKDVEEAVSCLSIGVLDIFGFEDFERNSFEQFCINYANEQLQYYFNQHIFKLEQEEYQGEGITWHNIGYTDNVGCIHLISKKPTGLFYLLDEESNFPHATSQTLLAKFKQQHEDNKYFLGTPVMEPAFIIQHFAGKVKYQIKDFREKNMDYMRPDIVALLRGSDSSYVRELIGMDPVAVFRWAVLRAAIRAMAVLREAGRLRAERAEKAAGMSSPGAQSHPEELPRGASTPSEKLYRDLHNQMIKSIKGLPWQGEDPRSLLQSLSRLQKPRAFILKSKGIKQKQIIPKNLLDSKSLKLIISMTLHDRTTKSLLHLHKKKKPPSISAQFQTSLNKLLEALGKAEPFFIRCIRSNAEKKELCFDDELVLQQLRYTGMLETVRIRRSGYSAKYTFQDFTEQFQVLLPKDAQPCREVISTLLEKMKIDKRNYQIGKTKVFLKETERQALQETLHREVVRKILLLQSWFRMVLERRHFLQMKRAAVTIQACWRSYRVRRALERTQAAVYLQASWRGYWQRKLYRHQKQSIIRLQSLCRGHLQRKSFSQMISEKQKAEEKEREALEAARAGAEEGGQGQAAGGQQVAEQGPEPAEDGGHLASEPEVQPSDRSPLEHSSPEKEAPSPEKTLPPQKTVAAESHEKVPSSREKRESRRQRGLEHVKFQNKHIQSCKEESALREPSRRVTQEQGVSLLEDKKESREDETLLVVETEAENTSQKQPTEQPQAMAVGKVSEETEKTLPSGSPRPGQLERPTSLALDSRVSPPAPGSAPETPEDKSKPCGSPRVQEKPDSPGGSTQIQRYLDAERLASAVELWRGKKLVAAASPSAMLSQSLDLSDRHRATGAALTPTEERRTSFSTSDVSKLLPSLAKAQVTTTRQNPV

SEQ ID NO: 862320 - protein, 340 aa, Homo sapiens [sequence omitted]

SEQ ID NO: 862321 - protein, 340 aa, Homo sapiens [sequence omitted]

SEQ ID NO: 862322 - protein, 96 aa, Homo sapiens
MDYMRPDIVALLRGSDSSYVRELIGMDPVAVFRWAVLRAAIRAMAVLREAGRLRAERAEKAAGGSWGVNPQKRHCREGGTSWVHLKVNTSVAFSTF

SEQ ID NO: 862323 - protein, 112 aa, Homo sapiens
MDPPFAVNRFSADSQVPFCACSHVHLPVVAATGKARGAQDANGHVKSLGKVLPILCDAPTSDAPEVVRNEEEVVGCVGIQGHIHCEKEKKLIRKWTEANPMPLLYFKGPNIS

SEQ ID NO: 862324 - protein, 112 aa, Homo sapiens; identical to SEQ ID NO: 862323

SEQ ID NO: 862325 - protein, 626 aa, Homo sapiens
MVAPWRVSVRVCLSHLRCFELRQGLSLLRPSECPRDARLCWLLLGTLPKVVSLCGDVGEGAPDVLSRRRVRCSGAAGAGPAESLPRAGPLGGVFLHLRLWLRAGALLVKFFPLLLLYPLTYLAPSVSTLWLHLLLKATETSGPTYIKLGQWASTRRDLFSEAFCAQFSKLHVRVTPHPWTHTERFLRQAFGDDWGSILSFENREPVGSGCVAQVYKAYANTAFLETDSVQRLGRASCLPPFSHTGAVGGLRELFGYLGNGRKPPENLADQSFLERLLLPKADLVGSNAGVSRAQVPGHQPEATNLISVAVKVLHPGLLAQVHMDLLLMKIGSRVLGVLPGIKWLSLPEIVEEFEKLMVQQIDLRYEAQNLEHFQVNFRNVKAVKFPTPLRPFVTREVLVETYEESVPVSSYQQAGIPVDLKRKIARLGINMLLKMIFVDNFVHADLHPGNILVQGANGLSSSQEAQLQQADICDTLVVAVPSSLCPLRLVLLDAGIVAELQAPDLRNFRAVFMAVVMGQGQRVAELILHHARASECRDVEGFKTEMAMLVTQARKNTITLEKLHVSSLLSSVFKLLMTHKVKLESNFASIVFAIMVLEGLGRSLDPKLDILEAARPFLLTGPVCPP

SEQ ID NO: 862326 - protein, 626 aa, Homo sapiens; identical to SEQ ID NO: 862325

SEQ ID NO: 862327 - protein, 590 aa, Homo sapiens
MVAPWRVSVRVCLSHLRCFELRQGLSLLRPSECPRDARLCWLLLGTLPKVVSLCGDVGEGAPDVLSRRRVRCSGAAGAGPAESLPRAGPLGGVFLHLRLWLRAGALLVKFFPLLLLYPLTYLAPSVSTLWLHLLLKATETSGPTYIKLGQWASTRRDLFSEAFCAQFSKLHVRVTPHPWTHTERFLRQAFGDDWGSILSFENREPVGSGCVAQVYKAYANTAFLETDSVQRLGRASCLPPFSHTGAVGGLRELFGYLGNGRKPPENLADQSFLERLLLPKADLVGSNAGVSRAQVPGHQPEATNLISVAVKVLHPGLLAQVHMDLLLMKIGSRVLGVLPGIKWLSLPEIVEEFEKLMVQQIDLRYEAQNLEHFQVNFRNVKAVKFPTPLRPFVTREVLVETYEESVPVSSYQQAGIPVDLKRKIARLGINMLLKMIFVDNFVHADLHPGNILVQGANGLSSSQEAQLQQADICDTLVVAVPSSLCPLRLVLLDAGIVAELQAPDLRNFRAVFMAVVMGQGQRVAELILHHARASECRDVEGFKTEMAMLVTQARKNTITLEKLHVSSLLSSVFKLLMTHKVKSQFIPAPS

SEQ ID NO: 862328 - protein, 304 aa, Homo sapiens [sequence omitted]

SEQ ID NO: 862329 - protein, 626 aa, Homo sapiens; identical to SEQ ID NO: 862325

SEQ ID NO: 862330 - protein, 643 aa, Homo sapiens
MVAPWRVSVRVCLSHLRCFELRQGLSLLRPSECPRDARLCWLLLGTLPKVVSLCGDVGEGAPDVLSRRRVRCSGAAGAGPAESLPRAGPLGGVFLHLRLWLRAGALLVKFFPLLLLYPLTYLAPSVSTLWLHLLLKATETSGPTYIKLGQWASTRRDLFSEAFCAQFSKLHVRVTPHPWTHTERFLRQAFGDDWGSILSFENREPVGSGCVAQVYKAYANTAFLETDSVQRLGRASCLPPFSHTGAVGGLRELFGYLGNGRKPPENLADQSFLERLLLPKADLVGSNAGVSRAQVPGHQPEATNLISVAVKVLHPGLLAQVHMDLLLMKIGSRVLGVLPGIKWLSLPEIVEEFEKLMVQQIDLRYEAQNLEHFQVNFRNVKAVKFPTPLRPFVTREVLVETYEESVPVSSYQQAGIPVDLKRKIARLGINMLLKMIFVDNFVHADLHPGNILVQGANGLSSSQEAQLQQADICDTLVVAVPSSLCPLRLVLLDAGIVAELQAPDLRNFRAVFMAVVMGQGQRVAELILHHARASECRDVEGFKTEMAMLVTQARKNTITLEKLHVSSLLSSVFKLLMTHKVKLESNFASIVFAIMVLEGLGRQCAPRDGAVASVGPCQELEATPKSLSYGSWDVLKLGHQFQM

SEQ ID NO: 862331 - protein, 407 aa, Homo sapiens
MVAPWRVSVRVCLSHLRCFELRQGLSLLRPSECPRDARLCWLLLGTLPKVVSLCGDVGEGAPDVLSRRRVRCSGAAGAGPAESLPRAGPLGGVFLHLRLWLRAGALLVKFFPLLLLYPLTYLAPSVSTLWLHLLLKATETSGPTYIKLGQWASTRRDLFSEAFCAQFSKLHVRVTPHPWTHTERFLRQAFGDDWGSILSFENREPVGSGCVAQVYKAYANTAFLETDSVQRLGRASCLPPFSHTGAVGGLRELFGYLGNGRKPPENLADQSFLERLLLPKADLVGSNAGVSRAQVPGHQPEATNLISVAVKVLHPGLLAQVHMDLLLMKIGSRVLGVLPGIKWLSLPEIVEEFEKLMVQQIDLRYEAQNLEHFQVNFRNVKAVKFPTPKSLSYGSWDVLKLGHQFQM

SEQ ID NO: 862332 - protein, 590 aa, Homo sapiens; identical to SEQ ID NO: 862327

SEQ ID NO: 862333 - protein, 109 aa, Homo sapiens
FLATSFNPPNRKKSLGAPRPEASTTKRKAVDTYCLDYKPSKGRRWAARAPSTRITYGTITKERDYCAEDQTIESWREEGFPVGLKLAVLGIFIIVVFVYLTVENKSLFG

SEQ ID NO: 862334 - protein, 174 aa, Homo sapiens
SGSAGNCEADCEGKGALLSPPGFYHQKRGQTSIIMVDVKCLSDCKLQNQLEKLGFSPGPILQLNIILQGNIILSTEKSKKLKKWPEASTTKRKAVDTYCLDYKPSKGRRWAARAPSTRITYGTITKERDYCAEDQTIESWREEGFPVGLKLAVLGIFIIVVFVYLTVENKSLFG

SEQ ID NO: 862335 - protein, 101 aa, Homo sapiens
SGSAGNCEADCEGKGALLSPPGFYHQKRGQTSIIMVDVKCLSDCKLQNQLEKLGFSPGPILRGLQEHQAPESHMGLSPKRETTARKTRLSRAGEKKVSQWA

SEQ ID NO: 862336 - protein, 142 aa, Homo sapiens
SGSAGNCEADCEGKGALLSPPGFYHQKRGQTSIIMVDVKCLSDCKLQNQLEKLGFSPGPILPSTRKLYEKKLVQLLVSPPCAPPVMNGPRELDGAQDSDDSEGGLQEHQAPESHMGLSPKRETTARKTRLSRAGEKKVSQWA

SEQ ID NO: 862337 - protein, 181 aa, Homo sapiens
MVDVKCLSDCKLQNQLEKLGFSPGPILPSTRKLYEKKLVQLLVSPPCAPPVMNGPRELDGAQDSDDSEELNIILQGNIILSTEKSKKLKKWPEASTTKRKAVDTYCLDYKPSKGRRWAARAPSTRITYGTITKERDYCAEDQTIESWREEGFPVGLKLAVLGIFIIVVFVYLTVENKSLFG

SEQ ID NO: 862338 - protein, 112 aa, Homo sapiens [sequence omitted]

SEQ ID NO: 862339 - protein, 438 aa, Homo sapiens
MQNSHMDEYRNSSNGSTGNSSEVVVEHPTDFSTEIMNVTEMEQSPDDSPNVNASTEETEMASAVDLPVTLTETEANFPPEYEKFWKTVENNPQDFTGWVYLLQYVEQENHLMAARKAFDRFFIHYPYCYGYWKKYADLEKRHDNIKPSDEVYRRGLQAIPLSVDLWIHYINFLKETLDPGDPETNNTIRGTFEHAVLAAGTDFRSDRLWEMYINWENEQGNLREVTAIYDRILGIPTQLYSHHFQRFKEHVQNNLPRDLLTGEQFIQLRRELASVNGHSGDDGPPGDDLPSGIEDITDPAKLITEIENMRHRIIEIHQEMFNYNEHEVSKRWTFEEGIKRPYFHVKPLEKAQLKNWKEYLEFEIENGTHERVVVLFERCVISCALYEEFWIKVRKSCALKLEYIINIDLVTNLFCTSVECCSYNYICCIRRWSACNQI

SEQ ID NO: 862340 - protein, 217 aa, Homo sapiens [sequence omitted]

SEQ ID NO: 862341 - protein, 247 aa, Homo sapiens
LECGQKGVARVWELLSQVAGNAKSTWLNVLSTVGLISIIISNAPFPLYPGEVDLVPNSARGNAKSNNESSFYAVKLARHLFKIQKNLPKSRKVLLEAIERDKENTKLYLNLLEMEYSGDLKQNEENILNCFDKAVHGSLPIKMRITFSQRKVEFLEDFGSDVNKLLNAYDEHQTLLKEQDSLKRKAENGSEEPEEKKAHTEDTTSSSTQMIDGDLQANQAVYNYSAWYQYNYQNPWNYGQYYPPPPT

SEQ ID NO: 862342 - protein, 217 aa, Homo sapiens [sequence omitted]

SEQ ID NO: 862343 - protein, 548 aa, Homo sapiens
MQGLLRFEDQDSARGDQNIAMFYPTSTQMVYRRGLQAIPLSVDLWIHYINFLKETLDPGDPETNNTIRGTFEHAVLAAGTDFRSDRLWEMYINWENEQGNLREVTAIYDRILGIPTQLYSHHFQRFKEHVQNNLPRDLLTGEQFIQLRRELASVNGHSGDDGPPGDDLPSGIEDITDPAKLITEIENMRHRIIEIHQEMFNYNEHEVSKRWTFEEGIKRPYFHVKPLEKAQLKNWKEYLEFEIENGTHERVVVLFERCVISCALYEEFWIKYAKYMENHSIEGVRHVFSRACTIHLPKKPMVHMLWAAFEEQQGNINEARNILKTFEECVLGLAMVRLRRVSLERRHGNLEEAEHLLQDAIKNAKSNNESSFYAVKLARHLFKIQKNLPKSRKVLLEAIERDKENTKLYLNLLEMEYSGDLKQNEENILNCFDKAVHGSLPIKMRITFSQRKVEFLEDFGSDVNKLLNAYDEHQTLLKEQDSLKRKAENGSEEPEEKKAHTEDTTSSSTQMIDGDLQANQAVYNYSAWYQYNYQNPWNYGQYYPPPPT

SEQ ID NO: 862344 - protein, 217 aa, Homo sapiens [sequence omitted]

SEQ ID NO: 862345 - protein, 217 aa, Homo sapiens [sequence omitted]

SEQ ID NO: 862346 - protein, 1006 aa, Homo sapiens
MPDQISVSEFVAETHEDYKAPTASSFTTRTAQCRNTVAAIEEALDVDRMVLYKMKKSVKAINSSGLAHVENEEQYTQALEKFGGNCVCRDDPDLGSAFLKFSVFTKELTALFKNLIQNMNNIISFPLDSLLKGDLKGVKGDLKKPFDKAWKDYETKITKIEKEKKEHAKLHGMIRTEISGAEIAEEMEKERRFFQLQMCEYLLKVNEIKIKKGVDLLQNLIKYFHAQCNFFQDGLKAVESLKPSIETLSTDLHTIKQAQDEERRQLIQLRDILKSALQVEQKEDSQIRQSTAYSLHQPQGNKEHGTERNGSLYKKSDGIRKVWQKRKCSVKNGFLTISHGTANRPPAKLNLLTCQVKTNPEEKKCFDLISHDRTYHFQAEDEQECQIWMSVLQNSKEEALNNAFKGDDNTGENNIVQELTKEIISEVQRMTGNDVCCDCGAPDPTWLSTNLGILTCIECSGIHRELGVHYSRMQSLTLDVLGTSELLLAKNIGNAGFNEIMECCLPAEDSVKPNPGSDMNARKDYITAKYIERRYARKKHADNAAKLHSLCEAVKTRDIFGLLQAYADGVDLTEKIPLANGHEPDETALHLAVRSVDRTSLHIVDFLVQNSGNLDKQTGKGSTALHYCCLTDNAECLKLLLRGKASIEIANESGETPLDIAKRLKHEHCEELLTQALSGRFNSHVHVEYEWRLLHEDLDESDDDMDEKLQPSPNRREDRPISFYQLGSNQLQSNAVSLARDAANLAKEKQRAFMPSILQNETYGALLSGSPPPAQPAAPSTTSAPPLPPRNVGKVQTASSANTLWKTNSVSVDGGSRQRSSSDPPAVHPPLPPLRVTSTNPLTPTPPPPVAKTPSVMEALSQPSKPAPPGISQIRPPPLPPQPPSRLPQKKPAPGADKSTPLTNKGQPRGPVDLSATEALGPLSNAMVLQPPAPMPRKSQATKLKPKRVKALYNCVADNPDELTFSEGDVIIVDGEEDQEWWIGHIDGDPGRKGAFPVSFVHFIAD

SEQ ID NO: 862347 - protein, 91 aa, Homo sapiens
MECCLPAEDSVKPNPGSDMNARKDYITAKYIERRYARKKHADNAAKLHSLCEAVKTRDIFGLLQAYADGVDLTEKIPLANGHVRVWVVATL

SEQ ID NO: 862348 - protein, 1006 aa, Homo sapiens; identical to SEQ ID NO: 862346

SEQ ID NO: 862349 - protein, 805 aa, Homo sapiens
MPDQISVSEFVAETHEDYKAPTASSFTTRTAQCRNTVAAIEEALDVDRMVLYKMKKSVKAINSSGLAHVENEEQYTQALEKFGGNCVCRDDPDLGSAFLKFSVFTKELTALFKNLIQNMNNIISFPLDSLLKGDLKGVKGDLKKPFDKAWKDYETKITKIEKEKKEHAKLHGMIRTEISGAEIAEEMEKERRFFQLQMCEYLLKVNEIKIKKGVDLLQNLIKYFHAQCNFFQDGLKAVESLKPSIETLSTDLHTIKQAQDEERRQLIQLRDILKSALQVEQKEDSQIRQSTAYSLHQPQGNKEHGTERNGSLYKKSDGIRKVWQKRKCSVKNGFLTISHGTANRPPAKLNLLTCQVKTNPEEKKCFDLISHDRTYHFQAEDEQECQIWMSVLQNSKEEALNNAFKGDDNTGENNIVQELTKEIISEVQRMTGNDVCCDCGAPDPTWLSTNLGILTCIECSGIHRELGVHYSRMQSLTLDVLGTSELLLAKNIGNAGFNEIMECCLPAEDSVKPNPGSDMNARKDYITAKYIERRYARKKHADNAAKLHSLCEAVKTRDIFGLLQAYADGVDLTEKIPLANGHEPDETALHLAVRSVDRTSLHIVDFLVQNSGNLDKQTGKGSTALHYCCLTDNAECLKLLLRGKASIEIANESGETPLDIAKRLKHEHCEELLTQALSGRFNSHVHVEYEWRLLHEDLDESDDDMDEKLQPSPNRREDRPISFYQLGSNQLQSNAVSLARDAANLAKEKQRAFMPSILQNETYGALLSGSPPPAQPAAPSTTSAPPLPPRNVGKDPLTPKPSPMQ

SEQ ID NO: 862350 - protein, 127 aa, Homo sapiens
DIAKHTDREVRRARCGGGDMGVPCPPWVPPSRTLCVVCHPEAREPVLFDFYGSFLVSASLPPGYRVRPSLGRALRPTVRKVGDDKSPALGQEKFREILSPEALTLHVITEDCNKGFESYEPGTVDEN

SEQ ID NO: 862351 - protein, 1027 aa, Homo sapiens
RTSLHIVDFLVQNSGNLDKQTGKGSTALHYCCLTDNAECLKLLLRGKASIEIANESGETPLDIAKRLKHEHCEELLTQALSGRFNSHAHVENEEQYTQALEKFGGNCVCRDDPDLGSAFLKFSVFTKELTALFKNLIQNMNNIISFPLDSLLKGDLKGVKGDLKKPFDKAWKDYETKITKIEKEKKEHAKLHGMIRTEISGAEIAEEMEKERRFFQLQMCEYLLKVNEIKIKKGVDLLQNLIKYFHAQCNFFQDGLKAVESLKPSIETLSTDLHTIKQAQDEERRQLIQLRDILKSALQVEQKEDSQIRQSTAYSLHQPQGNKEHGTERNGSLYKKSDGIRKVWQKRKCSVKNGFLTISHGTANRPPAKLNLLTCQVKTNPEEKKCFDLISHDRTYHFQAEDEQECQIWMSVLQNSKEEALNNAFKGDDNTGENNIVQELTKEIISEVQRMTGNDVCCDCGAPDPTWLSTNLGILTCIECSGIHRELGVHYSRMQSLTLDVLGTSELLLAKNIGNAGFNEIMECCLPAEDSVKPNPGSDMNARKDYITAKYIERRYARKKHADNAAKLHSLCEAVKTRDIFGLLQAYADGVDLTEKIPLANGHEPDETALHLAVRSVDRTSLHIVDFLVQNSGNLDKQTGKGSTALHYCCLTDNAECLKLLLRGKASIEIANESGETPLDIAKRLKHEHCEELLTQALSGRFNSHVHVEYEWRLLHEDLDESDDDMDEKLQPSPNRREDRPISFYQLGSNQLQSNAVSLARDAANLAKEKQRAFMPSILQNETYGALLSGSPPPAQPAAPSTTSAPPLPPRNVGKVQTASSANTLWKTNSVSVDGGSRQRSSSDPPAVHPPLPPLRVTSTNPLTPTPPPPVAKTPSVMEALSQPSKPAPPGISQIRPPPLPPQPPSRLPQKKPAPGADKSTPLTNKGQPRGPVDLSATEALGPLSNAMVLQPPAPMPRKSQATKLKPKRVKALYNCVADNPDELTFSEGDVIIVDGEEDQEWWIGHIDGDPGRKGAFPVSFVHFIAD

SEQ ID NO: 862352 - protein, 1006 aa, Homo sapiens; identical to SEQ ID NO: 862346

SEQ ID NO: 862353 - protein, 1006 aa, Homo sapiens; identical to SEQ ID NO: 862346

SEQ ID NO: 862354 - protein, 711 aa, Homo sapiens
MPDQISVSEFVAETHEDYKAPTASSFTTRTAQCRNTVAAIEEALDVDRMVLYKMKKSVKAINSSGLAHVENEEQYTQALEKFGGNCVCRDDPDLGSAFLKFSVFTKELTALFKNLIQNMNNIISFPLDSLLKGDLKGVKGDLKKPFDKAWKDYETKITKIEKEKKEHAKLHGMIRTEISGAEIAEEMEKERRFFQLQMCEYLLKVNEIKIKKGVDLLQNLIKYFHAQCNFFQDGLKAVESLKPSIETLSTDLHTIKQAQDEERRQLIQLRDILKSALQVEQKEDSQIRQSTAYSLHQPQGNKEHGTERNGSLYKKSDGIRKVWQKRKCSVKNGFLTISHGTANRPPAKLNLLTCQVKTNPEEKKCFDLISHDRTYHFQAEDEQECQIWMSVLQNSKEEALNNAFKGDDNTGENNIVQELTKEIISEVQRMTGNDVCCDCGAPDPTWLSTNLGILTCIECSGIHRELGVHYSRMQSLTLDVLGTSELLLAKNIGNAGFNEIMECCLPAEDSVKPNPGSDMNARKDYITAKYIERRYARKKHADNAAKLHSLCEAVKTRDIFGLLQAYADGVDLTEKIPLANGHEPDETALHLAVRSVDRTSLHIVDFLVQNSGNLDKQTGKGSTALHYCCLTDNAECLKLLLRGKASIEIANESGETPLDIAKRLKHEHCEELLTQALSGRFNSHVHVEYEWRLLHEDLDESDDDMDEKLQG

SEQ ID NO: 862355 - protein, 110 aa, Homo sapiens [sequence omitted]

SEQ ID NO: 862356 - protein, 583 aa, Homo sapiens
MTFYLFGIRSFPKLWKSPYLGLGPGHSYVSLFLADRCGIRNQQRLFSLKTMSPQNTKATNLIAKARYLRKDEGSNKQVYSVPHFFLAGAAKERSQMNSQTEDHALAPVRNTIQLPTQPLNSEEWDKLKEDLKENTGKTSFESWIISQMAGCHSSIDVAKSLLAWVAAKNNGIVSYDLLVKYLYLCVFHMQTSEVIDVFEIMKARYKTLEPRGYSLLIRGLIHSDRWREALLLLEDIKKVITPSKKNYNDCIQGALLHQDVNTAWNLYQELLGHDIVPMLETLKAFFDFGKDIKDDNYSNKLLDILSYLRNNQLYPGESFAHSIKTWFESVPGKQWKGQFTTVRKSGQCSGCGKTIESIQLSPEEYECLKGKIMRDVIDGGDQYRKTTPQELKRFENFIKSRPPFDVVIDGLNVAKMFPKVRESQLLLNVVSQLAKRNLRLLVLGRKHMLRRSSQWSRDEMEEVQKQASCFFADDISEDDPFLLYATLHSGNHCRFITRDLMRDHKACLPDAKTQRLFFKWQQGHQLAIVNRFPGSKLTFQRILSYDTVVQTTGDSWHIPYDEDLVERCSCEVPTKWLCLHQKT

SEQ ID NO: 862357 - protein, 490 aa, Homo sapiens
MVEPGCKSAEGLAPVRNTIQLPTQPLNSEEWDKLKEDLKENTGKTSFESWIISQMAGCHSSIDVAKSLLAWVAAKNNGIVSYDLLVKYLYLCVFHMQTSEVIDVFEIMKARYKTLEPRGYSLLIRGLIHSDRWREALLLLEDIKKVITPSKKNYNDCIQGALLHQDVNTAWNLYQELLGHDIVPMLETLKAFFDFGKDIKDDNYSNKLLDILSYLRNNQLYPGESFAHSIKTWFESVPGKQWKGQFTTVRKSGQCSGCGKTIESIQLSPEEYECLKGKIMRDVIDGGDQYRKTTPQELKRFENFIKSRPPFDVVIDGLNVAKMFPKVRESQLLLNVVSQLAKRNLRLLVLGRKHMLRRSSQWSRDEMEEVQKQASCFFADDISEDDPFLLYATLHSGNHCRFITRDLMRDHKACLPDAKTQRLFFKWQQGHQLAIVNRFPGSKLTFQRILSYDTVVQTTGDSWHIPYDEDLVERCSCEVPTKWLCLHQKT

SEQ ID NO: 862358 - protein, 565 aa, Homo sapiens
MTFYLFGIRSFPKLWKSPYLGLGPGHSYVSLFLADRCGIRNQQRLFSLKTMSPQNTKATNLIAKARYLRKDEGSNKQVYSVPHFFLAGAAKERSQMNSQTEDHALAPVRNTIQLPTQPLNSEEWDKLKEDLKENTGKTSFESWIISQMAGCHSSIDVAKSLLAWVAAKNNGIVSYDLLVKYLYLCVFHMQTSEVIDVFEIMKARYKTLEPRGYSLLIRGLIHSDRWREALLLLEDIKKVITPSKKNYNDCIQGALLHQDVNTAWNLYQELLGHDIVPMLETLKAFFDFGKDIKDDNYSNKLLDILSYLRNNQLYPGESFAHSIKTWFESVPGKQWKGQFTTVRKSGQCSGCGKTIESIQLSPEEYECLKGKIMRDVIDGGDQYRKTTPQELKRFENFIKSRPPFDVVIDGLNVAIAKRNLRLLVLGRKHMLRRSSQWSRDEMEEVQKQASCFFADDISEDDPFLLYATLHSGNHCRFITRDLMRDHKACLPDAKTQRLFFKWQQGHQLAIVNRFPGSKLTFQRILSYDTVVQTTGDSWHIPYDEDLVERCSCEVPTKWLCLHQKT

SEQ ID NO: 862359 - protein, 123 aa, Homo sapiens
SSAVLDCVLSYAWFSSEDDPFLLYATLHSGNHCRFITRDLMRDHKACLPDAKTQRLFFKWQQGHQLAIVNRFPGSKLTFQRILSYDTVVQTTGDSWHIPYDEDLVERCSCEVPTKWLCLHQKT

SEQ ID NO: 862360 - protein, 567 aa, Homo sapiens
MTFYLFGIRSFPKLWKSPYLGLGPGHSYVSLFLADRCGIRNQQRLFSLKTMSPQNTKATNLIAKARYLRKDEGSNKQVYSVPHFFLAGAAKERSQMNSQTEDHALAPVRNTIQLPTQPLNSEEWDKLKEDLKENTGKTSFESWIISQMAGCHSSIDVAKSLLAWVAAKNNGIVSYDLLVKYLYLCVFHMQTSEVIDVFEIMKARYKTLEPRGYSLLIRGLIHSDRWREALLLLEDIKKVITPSKKNYNDCIQGALLHQDVNTAWNLYQELLGHDIVPMLETLKAFFDFGKDIKDDNYSNKLLDILSYLRNNQLYPGESFAHSIKTWFESGQCSGCGKTIESIQLSPEEYECLKGKIMRDVIDGGDQYRKTTPQELKRFENFIKSRPPFDVVIDGLNVAKMFPKVRESQLLLNVVSQLAKRNLRLLVLGRKHMLRRSSQWSRDEMEEVQKQASCFFADDISEDDPFLLYATLHSGNHCRFITRDLMRDHKACLPDAKTQRLFFKWQQGHQLAIVNRFPGSKLTFQRILSYDTVVQTTGDSWHIPYDEDLVERCSCEVPTKWLCLHQKT

SEQ ID NO: 862361 - protein, 583 aa, Homo sapiens; identical to SEQ ID NO: 862356

SEQ ID NO: 862362 - protein, 211 aa, Homo sapiens
MRDVIDGGDQYRKTTPQELKRFENFIKSRPPFDVVIDGLNVAKMFPKVRESQLLLNVVSQLAKRNLRLLVLGRKHMLRRSSQWSRDEMEEVQKQASCFFADDISEDDPFLLYATLHSGNHCRFITRDLMRDHKACLPDAKTQRLFFKWQQGHQLAIVNRFPGSKLTFQRILSYDTVVQTTGDSWHIPYDEDLVERCSCEVPTKWLCLHQKT

SEQ ID NO: 862363 - protein, 211 aa, Homo sapiens; identical to SEQ ID NO: 862362

SEQ ID NO: 862364 - protein, 328 aa, Homo sapiens
GSQRSSGPRSLCVLRGRRRGEAASAAGEGGGAEAQTEARRLGERRRGGRDRAWTAVDTASCAGKRAARSRRRAPGTEKGSPGDLRPSMHRAPSPTAEQPPGGGDSARRTLQPRLKPSARAMALPRTLGELQLYRVLQRANLLSYYETFIQQGGDDVQQLCEAGEEEFLEIMALVGMATKPLHVRRLQKALREWATNPGLFSQPVPAVPVSSIPLFKISETAGTRKGSMSNGHGSPGEKAGSARSFSPKSPLELGEKLSPLPGGPGAGDPRIWPGRSTPESDVGAGGEEEAGAGGTGGGPDRLEPEMVPPACLGRVWMDICRLWGHVQG

SEQ ID NO: 862365 - protein, 612 aa, Homo sapiens
GSQRSSGPRSLCVLRGRRRGEAASAAGEGGGAEAQTEARRLGERRRGGRDRAWTAVDTASCAGKRAARSRRRAPGTEKGSPGDLRPSMHRAPSPTAEQPPGGGDSARRTLQPRLKPSARAMALPRTLGELQLYRVLQRANLLSYYETFIQQGGDDVQQLCEAGEEEFLEIMALVGMATKPLHVRRLQKALREWATNPGLFSQPVPAVPVSSIPLFKISETAGTRKGSMSNGHGSPGEKAGSARSFSPKSPLELGEKLSPLPGGPGAGDPRIWPGRSTPESDVGAGGEEEAGSPPFSPPAGGGVPEGTGAGGLAAGGTGGGPDRLEPEMVRMVVESVERIFRSFPRGDAGEVTSLLKLNKKLARSVGHIFEMDDNDSQKEEEIRKYSIIYGRFDSKRREGKQLSLHELTINEAAAQFCMRDNTLLLRRVELFSLSRQVARESTYLSSLKGSRLHPEELGGPPLKKLKQEVGEQSHPEIQQPPPGPESYVPPYRPSLEEDSASLSGESLDGHLQAVGSCPRLTPPPADLPLALPAHGLWSRHILQQTLMDEGLRLARLVSHDRVGRLSPCVPAKPPLAEFEEGLLDRCPAPGPHPALVEGRRSSVKVEAEASRQ

SEQ ID NO: 862366 - protein, 446 aa, Homo sapiens
GSQRSSGPRSLCVLRGRRRGEAASAAGEGGGAEAQTEARRLGERRRGGRDRAWTAVDTASCAGKRAARSRRRAPGTEKGSPGDLRPSMHRAPSPTAEQPPGGGDSARRTLQPRLKPSARAMALPRTLGELQLYRVLQRANLLSYYETFIQQGGDDVQQLCEAGEEEFLEIMALVGMATKPLHVRRLQKALREWATNPGLFSQPVPAVPVSSIPLFKISETAGTRKGSMSNGHGSPGEKAGSARSFSPKSPLELGEKLSPLPGGPGAGDPRIWPGRSTPESDVGAGGEEEAGSPPFSPPAGGGVPEGTGAGGLAAGGTGGGPDRLEPEMVRMVVESVERIFRSFPRGDAGEVTSLLKLNKKLARSVGHIFEMDDNDSQKEEEIRKYSIIYGRFDSKRREGKQLSLHEVRTPRPPRIALDFQVSSRLPLRVSTVSDYLSLSLDQDPRP

SEQ ID NO: 862367 - protein, 492 aa, Homo sapiens
GSQRSSGPRSLCVLRGRRRGEAASAAGEGGGAEAQTEARRLGERRRGGRDRAWTAVDTASCAGKRAARSRRRAPGTEKGSPGDLRPSMHRAPSPTAEQPPGGGDSARRTLQPRLKPSARAMALPRTLGELQLYRVLQRANLLSYYETFIQQGGDDVQQLCGGRELKRWTFLGRIIAHYVRDIGHNTEGTHSQMSGDRPCDERHLDEDVGHYHTFQRGTRYMVQTLVSLVLAILGSSQSRVALALVKGFVVEAMSGGTRRGEMRDVELEGKNGGGNLGSGPGGEKAGSARSFSPKSPLELGEKLSPLPGGPGAGDPRIWPGRSTPESDVGAGGEEEAGSPPFSPPAGGGVPEGTGAGGLAAGGTGGGPDRLEPEMVRMVVESVERIFRSFPRGDAGEVTSLLKLNKKLARSVGHIFEMDDNDSQKEEEIRKYSIIYGRFDSKRREGKQLSLHEVRTPRPPRIALDFQVSSRLPLRVSTVSDYLSLSLDQDPRP

SEQ ID NO: 862368 - protein, 548 aa, Homo sapiens
GSQRSSGPRSLCVLRGRRRGEAASAAGEGGGAEAQTEARRLGERRRGGRDRAWTAVDTASCAGKRAARSRRRAPGTEKGSPGDLRPSMHRAPSPTAEQPPGGGDSARRTLQPRLKPSARAMALPRTLGELQLYRVLQRANLLSYYETFIQQGGDDVQQLCEAGEEEFLEIMALVGMATKPLHVRRLQKALREWATNPGLFSQPVPAVPVSSIPLFKISETAGTRKGSMSNGHGSPGEKAGSARSFSPKSPLELGEKLSPLPGGPGAGDPRIWPGRSTPESDVGAGGEEEAGSPPFSPPAGGGVPEGTGAGGLAAGGTGGGPDRLEPEMVRMVVESVERIFRSFPRGDAGEVTSLLKLNKKLARSVGHIFEMDDNDSQKEEEIRKYSIIYGRFDSKRREGKQLSLHELTINEAAAQFCMRDNTLLLRRVELFSLSRQVARESTYLSSLKGSRLHPEELGGPPLKKLKQEVGEQSHPEIQQPPPGPESYVPPYRPSLEEDSASLSGESLDGHLQEFEEGLLDRCPAPGPHPALVEGRRSSVKVEAEASRQ

SEQ ID NO: 862369 - protein, 132 aa, Homo sapiens
GSQRSSGPRSLCVLRGRRRGEAASAAGEGGGAEAQTEARRLGERRRGGRDRAWTAVDTASCAGKRAARSRRRAPGTEKGSPGDLRPSMHRAPSPTAEQPPGGGDSARRTLQPRLKSARMAKIPSYSVSRSYI

SEQ ID NO: 862370 - protein, 446 aa, Homo sapiens; identical to SEQ ID NO: 862366

SEQ ID NO: 862371 - protein, 92 aa, Homo sapiens
SRALAELRDRAGQRQEHDEQDELPRAAALLQPADQRQLAQGHGSGAPLRARCAVPFISKGETNRCPLTSLELCRPSEGTVGARAVFLKSYLE

SEQ ID NO: 862372 - protein, 200 aa, Homo sapiens
PGVSRPLRDVELRKMSPKPRASGPPAKATEAGKRKSSSQPSPSDPKKKTTKVAKKGKAVRRGRRGKKGAATKMAAVTAPEAESGPAAPGPSDQPSQELPQHELPPEEPVSEGTQHDPLSQEAELEEPLSQESEVEEPLSQESQVEEPLSQESEVEEPLSQESQVEEPLSQESEVEEPLSQESQVEEPLSQESEMEELPSV

SEQ ID NO: 862373 - protein, 172 aa, Homo sapiens
PGVSRPLRDVELRKMSPKPRASGPPAKATEAGKRKSSSQPSPSDPKKKTTKVAKKGKAVRRGRRGKKGAATKMAAVTAPEAESGPAAPGPSDQPSQELPQHELPPEEPVSEGTQHDPLSQEAELEEPLSQESEVEEPLMCRRPATPLSPRAATKFRPSRQTSEISPAGCLPF

SEQ ID NO: 862374 - protein, 284 aa, Homo sapiens
MAVDIEYRYNCMAPSLRQERFAFKISPKPSKPLRPCIQLSSKNEASGMVAPAVQEKKVKKRVSFADNQGLALTMVKVFSEFDDPLDMPFNITELLDNIVSLTTAESESFVLDFSQPSADYLDFRNRLQADHVCLENCVLKDKAIAGTAKVQNLAFEKTVKIRMTFDTWKSYTDFPCQYVKDTYAGSDRDTFSFDISLPEKIQSYERMEFAVYYECNGQTYWDSNRGKNYRIIRAELKSTQGMTKPHSGPDLGISFDQFGSPRCSYGLFPEWPSYLGYEKLGPYY

SEQ ID NO: 862375 - protein, 284 aa, Homo sapiens; identical to SEQ ID NO: 862374

SEQ ID NO: 862376 - protein, 284 aa, Homo sapiens; identical to SEQ ID NO: 862374

SEQ ID NO: 862377 - protein, 284 aa, Homo sapiens; identical to SEQ ID NO: 862374

SEQ ID NO: 862378 - protein, 284 aa, Homo sapiens; identical to SEQ ID NO: 862374

SEQ ID NO: 862379 - protein, 437 aa, Homo sapiens
MASPSSFTYYCPPSSSPVWSEPLYSLRPEHARERLQDDSVETVTSIEQAKVEEKIQEVFSSYKFNHLVPRLVLQREKHFHYLKRGLRQLTDAYECLDASRPWLCYWILHSLELLDEPIPQIVATDVCQFLELCQSPEGGFGGGPGQYPHLAPTYAAVNALCIIGTEEAYDIINREKLLQYLYSLKQPDGSFLMHVGGEVDVRSAYCAASVASLTNIITPDLFEGTAEWIARCQNWEGGIGGVPGMEAHGGYTFCGLAALVILKRERSLNLKSLLQWVTSRQMRFEGGFQGRCNKLVDGCYSFWQAGLLPLLHRALHAQGDPALSMSHWMFHQQALQEYILMCCQCPAGGLLDKPGKSRDFYHTCYCLSGLSIAQHFGSGAMLHDVVLGVPENALQPTHPVYNIGPDKVIQATTYFLQKPVPGFEELKDETSAEPATD

SEQ ID NO: 862380 - protein, 96 aa, Homo sapiens
MASPSSFTYYCPPSSSPVWSEPLYSLRPEHARERLQDDSVETVTSIEQKMCQRNFKNHFTQISMTRNTSNHLLLICFYRLNYTVVLGVSFSRVMLQ

SEQ ID NO: 862381 - protein, 437 aa, Homo sapiens; identical to SEQ ID NO: 862379

SEQ ID NO: 862382 - protein, 505 aa, Homo sapiens
AVPFLWEAPGAQAWASSWSVCAASLGKGRFKVGLGGEGSSRVPSALKNEKNRVLCLEDRGSPCGSDSPLCSASTSGGSGVHSALFPTCPQLLEAESRARLLSCRFTICLIFDLQCQAKVEEKIQEVFSSYKFNHLVPRLVLQREKHFHYLKRGLRQLTDAYECLDASRPWLCYWILHSLELLDEPIPQIVATDVCQFLELCQSPEGGFGGGPGQYPHLAPTYAAVNALCIIGTEEAYDIINREKLLQYLYSLKQPDGSFLMHVGGEVDVRSAYCAASVASLTNIITPDLFEGTAEWIARCQNWEGGIGGVPGMEAHGGYTFCGLAALVILKRERSLNLKSLLQWVTSRQMRFEGGFQGRCNKLVDGCYSFWQAGLLPLLHRALHAQGDPALSMSHWMFHQQALQEYILMCCQCPAGGLLDKPGKSRDFYHTCYCLSGLSIAQHFGSGAMLHDVVLGVPENALQPTHPVYNIGPDKVIQATTYFLQKPVPGFEELKDETSAEPATD

SEQ ID NO: 862383 - protein, 424 aa, Homo sapiens
MASPSSFTYYCPPSSSPVWSEPLYSLRPEHARERLQDDSVETVTSIEQAKVEEKIQEVFSSYKFNHLVPRLVLQREKHFHYCLDASRPWLCYWILHSLELLDEPIPQIVATDVCQFLELCQSPEGGFGGGPGQYPHLAPTYAAVNALCIIGTEEAYDIINREKLLQYLYSLKQPDGSFLMHVGGEVDVRSAYCAASVASLTNIITPDLFEGTAEWIARCQNWEGGIGGVPGMEAHGGYTFCGLAALVILKRERSLNLKSLLQWVTSRQMRFEGGFQGRCNKLVDGCYSFWQAGLLPLLHRALHAQGDPALSMSHWMFHQQALQEYILMCCQCPAGGLLDKPGKSRDFYHTCYCLSGLSIAQHFGSGAMLHDVVLGVPENALQPTHPVYNIGPDKVIQATTYFLQKPVPGFEELKDETSAEPATD

SEQ ID NO: 862384 - protein, 334 aa, Homo sapiens
GIWCFDMNALLTLFLPFGCVPSVCQFLELCQSPEGGFGGGPGQYPHLAPTYAAVNALCIIGTEEAYDIINREKLLQYLYSLKQPDGSFLMHVGGEVDVRSAYCAASVASLTNIITPDLFEGTAEWIARCQNWEGGIGGVPGMEAHGGYTFCGLAALVILKRERSLNLKSLLQWVTSRQMRFEGGFQGRCNKLVDGCYSFWQAGLLPLLHRALHAQGDPALSMSHWMFHQQALQEYILMCCQCPAGGLLDKPGKSRDFYHTCYCLSGLSIAQHFGSGAMLHDVVLGVPENALQPTHPVYNIGPDKVIQATTYFLQKPVPGFEELKDETSAEPATD

SEQ ID NO: 862385 - protein, 367 aa, Homo sapiens
MRDFSASVCQFLELCQSPEGGFGGGPGQYPHLAPTYAAVNALCIIGTEEAYDIINREKLLQYLYSLKQPDGSFLMHVGGEVDVRLDHVEVGRIECHVLSLKPCREQLYPNRMSHLSVGDPGGLTVCQEEDRRSAYCAASVASLTNIITPDLFEGTAEWIARCQNWEGGIGGVPGMEAHGGYTFCGLAALVILKRERSLNLKSLLQWVTSRQMRFEGGFQGRCNKLVDGCYSFWQAGLLPLLHRALHAQGDPALSMSHWMFHQQALQEYILMCCQCPAGGLLDKPGKSRDFYHTCYCLSGLSIAQHFGSGAMLHDVVLGVPENALQPTHPVYNIGPDKVIQATTYFLQKPVPGFEELKDETSAEPATD

SEQ ID NO: 862386 - protein, 63 aa, Homo sapiens
VPAVDIVVPQEQGIGTCRKRQPTHPVYNIGPDKVIQATTYFLQKPVPGFEELKDETSAEPATD

SEQ ID NO: 862387 - protein, 170 aa, Homo sapiens
AVPFLWEAPGAQAWASSWSVCAASLGKGRFKVGLGGEGSSRVPSALKNEKNRVLCLEDRGSPCGSDSPLCSASTSGGSGVHSALFPTCPQLLEAESRARLLSCRFTICLIFDLQCQVWGPASWVGILVVIQPFEHQLRVGHNIKRWKYKEIKQLLTRSLVGGQAGKQFGK

SEQ ID NO: 862388 - protein, 437 aa, Homo sapiens; identical to SEQ ID NO: 862379

SEQ ID NO: 862389 - protein, 359 aa, Homo sapiens
VIVNKGCFLSCLSPSVCLDASRPWLCYWILHSLELLDEPIPQIVATDVCQFLELCQSPEGGFGGGPGQYPHLAPTYAAVNALCIIGTEEAYDIINREKLLQYLYSLKQPDGSFLMHVGGEVDVRSAYCAASVASLTNIITPDLFEGTAEWIARCQNWEGGIGGVPGMEAHGGYTFCGLAALVILKRERSLNLKSLLQWVTSRQMRFEGGFQGRCNKLVDGCYSFWQAGLLPLLHRALHAQGDPALSMSHWMFHQQALQEYILMCCQCPAGGLLDKPGKSRDFYHTCYCLSGLSIAQHFGSGAMLHDVVLGVPENALQPTHPVYNIGPDKVIQATTYFLQKPVPGFEELKDETSAEPATD

SEQ ID NO: 862390 - protein, 407 aa, Homo sapiens
KRSSAAYKFMHALERGLCERCREKHVSTISDKEAVLTNRVPVCRNRRMSCDAKGCPSGIVVVIAIHATSSVERCYTMKPNLPPWISVLSRVDRRSSSPRKLVVKSPEGGFGGGPGQYPHLAPTYAAVNALCIIGTEEAYDIINREKLLQYLYSLKQPDGSFLMHVGGEVDVRSAYCAASVASLTNIITPDLFEGTAEWIARCQNWEGGIGGVPGMEAHGGYTFCGLAALVILKRERSLNLKSLLQWVTSRQMRFEGGFQGRCNKLVDGCYSFWQAGLLPLLHRALHAQGDPALSMSHWMFHQQALQEYILMCCQCPAGGLLDKPGKSRDFYHTCYCLSGLSIAQHFGSGAMLHDVVLGVPENALQPTHPVYNIGPDKVIQATTYFLQKPVPGFEELKDETSAEPATD

SEQ ID NO: 862391 - protein, 533 aa, Homo sapiens
MAAPRAGRGAGWSLRAWRALGGIRWGRRPRLTPDLRALLTSGTSDPRARVTYGTPSLWARLSVGVTEPRACLTSGTPGPRAQLTAVTPDTRTREASENSGTRSRAWLAVALGAGGAVLLLLWGGGRGPPAVLAAVPSPPPASPRSQYNFIADVVEKTAPAVVYIEILDRHPFLGREVPISNGSGFVVAADGLIVTNAHVVADRRRVRVRLLSGDTYEAVVTAVDPVADIATLRIQTKEPLPTLPLGRSADVRQGEFVVAMGSPFALQNTITSGIVSSAQRPARDLGLPQTNVEYIQTDAAIDFGNSGGPLVNLVSETSFLPRIPAPGQCGKGRFPLIQGCLVKFLSSSLLAISQYPTRSPQHLLVLLFGCPHPLLFVLARELGAVSLQDGEVIGVNTMKVTAGISFAIPSDRLREFLHRGEKKNSSSGISGSQRRYIGVMMLTLSPSILAELQLREPSFPDVQHGVLIHKVILGSPAHRAGLRPGDVILAIGEQMVQNAEDVYEAVRTQSQLAVQIRRGRETLTLYVTPEVTE

SEQ ID NO: 862392 - protein, 426 aa, Homo sapiens
MAAPRAGRGAGWSLRAWRALGGIRWGRRPRLTPDLRALLTSGTSDPRARVTYGTPSLWARLSVGVTEPRACLTSGTPGPRAQLTAVTPDTRTREASENSGTRSRAWLAVALGAGGAVLLLLWGGGRGPPAVLAAVPSPPPASPRSQYNFIADVVEKTAPAVVYIEILDRHPFLGREVPISNGSGFVVAADGLIVTNAHVVADRRRVRVRLLSGDTYEAVVTAVDPVADIATLRIQTKEPLPTLPLGRSADVRQGEFVVAMGSPFALQNTITSGIVSSAQRPARDLGLPQTNVEYIQTDAAIDFGNSGGPLVNLDGEVIGVNTMKVTAGISFAIPSDRLREFLHRGEKKNSSSGISGSQRRYIGVMMLTLSPRAGLRPGDVILAIGEQMVQNAEDVYEAVRTQSQLAVQIRRGRETLTLYVTPEVTE

SEQ ID NO: 862393 - protein, 536 aa, Homo sapiens
MAAPRAGRGAGWSLRAWRALGGIRWGRRPRLTPDLRALLTSGTSDPRARVTYGTPSLWARLSVGVTEPRACLTSGTPGPRAQLTAVTPDTRTREASENSGTRSRAWLAVALGAGGAVLLLLWGGGRGPPAVLAAVPSPPPASPRSQYNFIADVVEKTAPAVVYIEILDRHPFLGREVPISNGSGFVVAADGLIVTNAHVVADRRRVRVRLLSGDTYEAVVTAVDPVADIATLRIQTKEPLPTLPLGRSADVRQGEFVVAMGSPFALQNTITSGIVSSAQRPARDLGLPQTNVEYIQTDAAIDVRPDRREMTNDGGGGRGCVVQAPTDIWWMSLYRASGCKNVATYSWAEKEENLEKVPTSWYAPRLRIPRSLSCFLLVLQFGNSGGPLVNLDGEVIGVNTMKVTAGISFAIPSDRLREFLHRGEKKNSSSGISGSQRRYIGVMMLTLSPSILAELQLREPSFPDVQHGVLIHKVILGSPAHRAGLRPGDVILAIGEQMVQNAEDVYEAVRTQSQLAVQIRRGRETLTLYVTPEVTE

SEQ ID NO: 862394 - protein, 336 aa, Homo sapiens
MAAPRAGRGAGWSLRAWRALGGIRWGRRPRLTPDLRALLTSGTSDPRARVTYGTPSLWARLSVGVTEPRACLTSGTPGPRAQLTAVTPDTRTREASENSGTRSRAWLAVALGAGGAVLLLLWGGGRGPPAVLAAVPSPPPASPRSQYNFIADVVEKTAPAVVYIEILDRHPFLGREVPISNGSGFVVAADGLIVTNAHVVADRRRVRVRLLSGDTYEAVVTAVDPVADIATLRIQTKEPLPTLPLGRSADVRQGEFVVAMGSPFALQNTITSGIVSSAQRPARDLGLPQTNVEYIQTDAAIDVRPDRREMTNDGGGGRGCVVQAPTDIWWMSLYRA

SEQ ID NO: 862395 - protein, 199 aa, Homo sapiens
MGSPFALQNTITSGIVSSAQRPARDLGLPQTNVEYIQTDAAIDFGNSGGPLVNLDGEVIGVNTMKVTAGISFAIPSDRLREFLHRGEKKNSSSGISGSQRRYIGVMMLTLSPSILAELQLREPSFPDVQHGVLIHKVILGSPAHRAGLRPGDVILAIGEQMVQNAEDVYEAVRTQSQLAVQIRRGRETLTLYVTPEVTE

SEQ ID NO: 862396 - protein, 136 aa, Homo sapiens
MKVTAGISFAIPSDRLREFLHRGEKKNSSSGISGSQRRYIGVMMLTLSPSILAELQLREPSFPDVQHGVLIHKVILGSPAHRAGLRPGDVILAIGEQMVQNAEDVYEAVRTQSQLAVQIRRGRETLTLYVTPEVTE

SEQ ID NO: 862397 - protein, 458 aa, Homo sapiens
MAAPRAGRGAGWSLRAWRALGGIRWGRRPRLTPDLRALLTSGTSDPRARVTYGTPSLWARLSVGVTEPRACLTSGTPGPRAQLTAVTPDTRTREASENSGTRSRAWLAVALGAGGAVLLLLWGGGRGPPAVLAAVPSPPPASPRSQYNFIADVVEKTAPAVVYIEILDRHPFLGREVPISNGSGFVVAADGLIVTNAHVVADRRRVRVRLLSGDTYEAVVTAVDPVADIATLRIQTKEPLPTLPLGRSADVRQGEFVVAMGSPFALQNTITSGIVSSAQRPARDLGLPQTNVEYIQTDAAIDFGNSGGPLVNLDGEVIGVNTMKVTAGISFAIPSDRLREFLHRGEKKNSSSGISGSQRRYIGVMMLTLSPSILAELQLREPSFPDVQHGVLIHKVILGSPAHRAGLRPGDVILAIGEQMVQNAEDVYEAVRTQSQLAVQIRRGRETLTLYVTPEVTE

SEQ ID NO: 862398 - protein, 458 aa, Homo sapiens; identical to SEQ ID NO: 862397

SEQ ID NO: 862399 - protein, 436 aa, Homo sapiens
MAAPRAGRGAGWSLRAWRALGGIRWGRRPRLTPDLRALLTSGTSDPRARVTYGTPSLWARLSVGVTEPRACLTSGTPGPRAQLTAVTPDTRTREASENSGTRSRAWLAVALGAGGAVLLLLWGGGRGPPAVLAAVPSPPPASPRSQYNFIADVVEKTAPAVVYIEILDRHPFLGREVPISNGSGFVVAADGLIVTNAHVVADRRRVRVRLLSGDTYEAVVTAVDPVADIATLRIQTKEPLPTLPLGRSADVRQGEFVVAMGSPFALQNTITSGIVSSAQRPARDLGLPQTNVEYIQTDAAIDFGNSGGPLVNLARELGAVSLQDGEVIGVNTMKVTAGISFAIPSDRLREFLHRGEKKNSSSGISGSQRRYIGVMMLTLSPRAGLRPGDVILAIGEQMVQNAEDVYEAVRTQSQLAVQIRRGRETLTLYVTPEVTE

SEQ ID NO: 862400 - protein, 440 aa, Homo sapiens
MAAPRAGRGAGWSLRAWRALGGIRWGRRPRLTPDLRALLTSGTSDPRARVTYGTPSLWARLSVGVTEPRACLTSGTPGPRAQLTAVTPDTRTREASENSGTRSRAWLAVALGAGGAVLLLLWGGGRGPPAVLAAVPSPPPASPRSQYNFIADVVEKTAPAVVYIEILDRHPFLGREVPISNGSGFVVAADGLIVTNAHVVADRRRVRVRLLSGDTYEAVVTAVDPVADIATLRIQTKEPLPTLPLGRSADVRQGEFVVAMGSPFALQNTITSGIVSSAQRPARDLGLPQTNVEYIQTDAAIDFGNSGGPLVNLDGEVIGVNTMKVTAGISFAIPSDRLREFLHRGEKKNSSSGISGSQRRYIGVMMLTLSPSILAELQLREPSFPDVQHGVLIHKVILGSPAHRAGLRPGDVILAIGEQMVQIRRGRETLTLYVTPEVTE

SEQ ID NO: 862401 - protein, 369 aa, Homo sapiens
MGPEVLRRAGRASGPSIPRGPLGRLTTRVRRRPQFPAFVGQGGVGLPESWSRRALLKDFSIADVVEKTAPAVVYIEILDRHPFLGREVPISNGSGFVVAADGLIVTNAHVVADRRRVRVRLLSGDTYEAVVTAVDPVADIATLRIQTKEPLPTLPLGRSADVRQGEFVVAMGSPFALQNTITSGIVSSAQRPARDLGLPQTNVEYIQTDAAIDFGNSGGPLVNLDGEVIGVNTMKVTAGISFAIPSDRLREFLHRGEKKNSSSGISGSQRRYIGVMMLTLSPSILAELQLREPSFPDVQHGVLIHKVILGSPAHRAGLRPGDVILAIGEQMVQNAEDVYEAVRTQSQLAVQIRRGRETLTLYVTPEVTE

SEQ ID NO: 862402 - protein, 361 aa, Homo sapiens
MAAPRAGRGAGWSLRAWRALGGIRWGRRPRLTPDLRALLTSGTSDPRARVTYGTPSLWARLSVGVTEPRACLTSGTPGPRAQLTAVTPDTRTREASENSGTRSRAWLAVALGAGGAVLLLLWGGGRGPPAVLAAVPSPPPASPRSQYNFIADVVEKTAPAVVYIEILDRHPFLGREVPISNGSGFVVAADGLIVTNAHVVADRRRVRVRLLSGDTYEAVVTAVDPVADIATLRIQTKFGNSGGPLVNLDGEVIGVNTMKVTAGISFAIPSDRLREFLHRGEKKNSSSGISGSQRRYIGVMMLTLSPRAGLRPGDVILAIGEQMVQNAEDVYEAVRTQSQLAVQIRRGRETLTLYVTPEVTE

SEQ ID NO: 862403 - protein, 88 aa, Homo sapiens
LEGDPLNSSCLDLVGLPASSPQLRNTVQLYFGFSFLHCNLEVVSRWEQWQKPLMKHFPLRQQRQYLKTMKHLLSPFVPSSFFLILIAP

SEQ ID NO: 862404 - protein, 249 aa, Homo sapiens
MKITRQKHAKKHLGFFRNNFGVREPYQILLDGTFCQAALRGRIQLREQLPRYLMGETQLCTTRCVLKELETLGKDLYGAKLIAQKCQVRNCPHFKNAVSGSECLLSMVEEGNPHHYFVATQDQNLSVKVKKKPGVPLMFIIQNTMVLDKPSPKTIAFVKAVESGQLVSVHEKESIKHLKEEQGLVKNTEQSRRKKRKKISGPNPLSCLKKKKKAPDTQSSASEKKRKRKRIRNRSNPKVLSEKQNAEGE

SEQ ID NO: 862405 - protein, 105 aa, Homo sapiens
MKITRQKHAKKHLGFFRNNFGVREPYQILLDGTFCQAALRGRIQLREQLPRYLMGETQLCTTREQWQKPLMKHFPLRQQRQYLKTMKHLLSPFVPSSFFLILIAP

SEQ ID NO: 862406 - protein, 249 aa, Homo sapiens; identical to SEQ ID NO: 862404

SEQ ID NO: 862407 - protein, 249 aa, Homo sapiens; identical to SEQ ID NO: 862404

SEQ ID NO: 862408 - protein, 205 aa, Homo sapiens
FCPPQSAGDSGTSAFLLPGRNRKLGKGWGGKEEPQEDGSGSPHSLEDLPPPSPWAAFSRDSSLSHPPGKVAQQGLLFTVRPLLWPGPGLMTSHAAFTSQVYCGITYTHKAHPFSMYSRRLGKGLEWGTSAPTEAAHILPLCSQAPSRPPTTTCLSSLLQLCVLQNCPVSDSRRMETFVSGFLHFAAGFAGPVWWHQRPALGTAEL

SEQ ID NO: 862409 - protein, 1024 aa, Homo sapiens
AASSPAPRGGDASAPPTAARTPSTGHLRRRPGRRPRFNARPGDPQAGPTPPSPPASRGAGRANMLAPRGAAVLLLHLVLQRWLAAGAQATPQVFDLLPSSSQRLNPGALLPVLTDPALNDLYVISTFKLQTKSSATIFGLYSSTDNSKYFEFTVMGRLNKAILRYLKNDGKVHLVVFNNLQLADGRRHRILLRLSNLQRGAGSLELYLDCIQVDSVHNLPRAFAGPSQKPETIELRTFQRKPQDFLEELKLVVRGSLFQVASLQDCFLQQSEPLAATGTGDFNRQFLGQMTQLNQLLGEVKDLLRQQVKETSFLRNTIAECQACGPLKFQSPTPSTVVAPAPPAPPTRPPRRCDSNPCFRGVQCTDSRDGFQCGPCPEGYTGNGITCIDVDECKYHPCYPGVHCINLSPGFRCDACPVGFTGPMVQGVGISFAKSNKQVCTDIDECRNGACVPNSICVNTLGSYRCGPCKPGYTGDQIRGCKAERNCRNPELNPCSVNAQCIEERQGDVTCVCGVGWAGDGYICGKDVDIDSYPDEELPCSARNCKKDNCKYVPNSGQEDADRDGIGDACDEDADGDGILNEQDNCVLIHNVDQRNSDKDIFGDACDNCLSVLNNDQKDTDGDGRGDACDDDMDGDGIKNILDNCPKFPNRDQRDKDGDGVGDACDSCPDVSNPNQSDVDNDLVGDSCDTNQDSDGDGHQDSTDNCPTVINSAQLDTDKDGIGDECDDDDDNDGIPDLVPPGPDNCRLVPNPAQEDSNSDGVGDICESDFDQDQVIDRIDVCPENAEVTLTDFRAYQTVVLDPEGDAQIDPNWVVLNQGMEIVQTMNSDPGLAVGYTAFNGVDFEGTFHVNTQTDDDYAGFIFGYQDSSSFYVVMWKQTEQTYWQATPFRAVAEPGIQLKAVKSKTGPGEHLRNSLWHTGDTSDQVRLLWKDSRNVGWKDKVSYRWFLQHRPQVGYIRVRFYEGSELVADSGVTIDTTMRGGRLGVFCFSQENIIWSNLKYRCNDTIPEDFQEFQTQNFDRFDN

SEQ ID NO: 862410 - protein, 246 aa, Homo sapiens
CVGRACFAFAFHHDLFDLLPSSSQRLNPGALLPVLTDPALNDLYVISTFKLQTKSSATIFGLYSSTDNSKYFEFTVMGRLNKAILRYLKNDGKVHLVVFNNLQLADGRRHRILLRLSNLQRGAGSLELYLDCIQVDSVHNLPRAFAGPSQKPETIELRTFQRKPQDFLEELKLVVRGSLFQVASLQDCFLQQSEPLAATGTGDFNRQFLGQMTQLNQLLGEVKDLLRQQVRTHHFAKNHSECRVAA

SEQ ID NO: 862411 - protein, 649 aa, Homo sapiens
AASSPAPRGGDASAPPTAARTPSTGHLRRRPGRRPRFNARPGDPQAGPTPPSPPASRGAGRANMLAPRGAAVLLLHLVLQRWLAAGAQATPQVFDLLPSSSQRLNPGALLPVLTDPALNDLYVISTFKLQTKSSATIFGLYSSTDNSKYFEFTVMGRLNKAILRYLKNDGKVHLVVFNNLQLADGRRHRILLRLSNLQRGAGSLELYLDCIQVDSVHNLPRAFAGPSQKPETIELRTFQRKPQDFLEELKLVVRGSLFQVASLQDCFLQQSEPLAATGTGDFNRQFLGQMTQLNQLLGEVKDLLRQQVKETSFLRNTIAECQACGPLKFQSPTPSTVVAPAPPAPPTRPPRRCDSNPCFRGVQCTDSRDGFQCGPCPEGYTGNGITCIDVDECKYHPCYPGVHCINLSPGFRCDACPVGFTGPMVQGVGISFAKSNKQVCTDIDECRNGACVPNSICVNTLGSYRCGPCKPGYTGDQIRGCKAERNCRNPELNPCSVNAQCIEERQGDVTCVCGVGWAGDGYICGKDVDIDSYPDEELPCSARNCKKDNCKYVPNSGQEDADRDGIGDACDEDADGDGILNEQDNCVLIHNVDQRNSDKDIFGDACDNCLSVLNNDQKDTDGDGRGDACDDDMDGDGLYLTPRDPLDSS

SEQ ID NO: 862412 - protein, 791 aa, Homo sapiens
AASSPAPRGGDASAPPTAARTPSTGHLRRRPGRRPRFNARPGDPQAGPTPPSPPASRGAGRANMLAPRGAAVLLLHLVLQRWLAAGAQATPQVFDLLPSSSQRLNPGALLPVLTDPALNDLYVISTFKLQTKSSATIFGLYSSTDNSKYFEFTVMGRLNKAILRYLKNDGKVHLVVFNNLQLADGRRHRILLRLSNLQRGAGSLELYLDCIQVDSVHNLPRAFAGPSQKPETIELRTFQRKPQDFLEELKLVVRGSLFQVASLQDCFLQQSEPLAATGTGDFNRQFLGQMTQLNQLLGEVKDLLRQQVKETSFLRNTIAECQACGPLKFQSPTPSTVVAPAPPAPPTRPPRRCDSNPCFRGVQCTDSRDGFQCGPCPEGYTGNGITCIDVDECKYHPCYPGVHCINLSPGFRCDACPVGFTGPMVQGVGISFAKSNKQVCTDIDECRNGACVPNSICVNTLGSYRCGPCKPGYTGDQIRGCKAERNCRNPELNPCSVNAQCIEERQGDVTCVCGVGWAGDGYICGKDVDIDSYPDEELPCSARNCKKDNCKYVPNSGQEDADRDGIGDACDEDADGDGILNEQDNCVLIHNVDQRNSDKDIFGDACDNCLSVLNNDQKDTDGDGRGDACDDDMDGDGIKNILDNCPKFPNRDQRDKDGDGVGDACDSCPDVSNPNQSDVDNDLVGDSCDTNQDRLLWKDSRNVGWKDKVSYRWFLQHRPQVGYIRVRFYEGSELVADSGVTIDTTMRGGRLGVFCFSQENIIWSNLKYRCNDTIPEDFQEFQTQNFDRFDN

SEQ ID NO: 862413 - protein, 559 aa, Homo sapiens
MATALSEEELDNEDYYSLLNVRREASSEELKAAYRRLCMLYHPDKHRDPELKSQAERLFNLVHQAYEVLSDPQTRAIYDIYGKRGLEMEGWEVVERRRTPAEIREEFERLQREREERRLQQRTNPKGTISVGVDATDLFDRYDEEYEDVSGSSFPQIEINKMHISQSIEAPLTATDTAILSGSLSTQNGNGGGSINFALRRVTSAKGWGELEFGAGDLQGPLFGLKLFRNLTPRCFVTTNCALQFSSRGIRPGLTTVLARNLDKNTVGYLQWRWGIQSAMNTSIVRDTKTSHFTVALQLGIPHSFALISYQHKFQDDDQTRVKGSLKAGFFGTVVEYGAERKISRHSVLGAAVSVGVPQGVSLKVKLNRASQTYFFPIHLTDQLLPSAMFYATVGPLVVYFAMHRLIIKPYLRAQKEKELEKQRESAATDVLQKKQEAESAVRLMQESVRRIIEAEESRMGLIIVNAWYGKFVNDKSRKSEKVKVIDVTVPLQCLVKDSKLILTEASKAGLPGFYDPCVGEEKNLKVLYQFRGVLHQVMVLDSEALRIPKQSHRIDTDG

SEQ ID NO: 862414 - protein, 316 aa, Homo sapiens [sequence omitted]

SEQ ID NO: 862415 - protein, 576 aa, Homo sapiens
EDYRRLLVVFMRGRCYDVDGCVVSRQLDNEDYYSLLNVRREASSEELKAAYRRLCMLYHPDKHRDPELKSQAERLFNLVHQAYEVLSDPQTRAIYDIYGKRGLEMEGWEVVERRRTPAEIREEFERLQREREERRLQQRTNPKGTISVGVDATDLFDRYDEEYEDVSGSSFPQIEINKMHISQSIEAPLTATDTAILSGSLSTQNGNGGGSINFALRRVTSAKGWGELEFGAGDLQGPLFGLKLFRNLTPRCFVTTNCALQFSSRGIRPGLTTVLARNLDKNTVGYLQWRWGIQSAMNTSIVRDTKTSHFTVALQLGIPHSFALISYQHKFQDDDQTRVKGSLKAGFFGTVVEYGAERKISRHSVLGAAVSVGVPQGVSLKVKLNRASQTYFFPIHLTDQLLPSAMFYATVGPLVVYFAMHRLIIKPYLRAQKEKELEKQRESAATDVLQKKQEAESAVRLMQESVRRIIEAEESRMGLIIVNAWYGKFVNDKSRKSEKVKVIDVTVPLQCLVKDSKLILTEASKAGLPGFYDPCVGEEKNLKVLYQFRGVLHQVMVLDSEALRIPKQSHRIDTDG

SEQ ID NO: 862416 - protein, 280 aa, Homo sapiens [sequence omitted]

SEQ ID NO: 862417 - protein, 343 aa, Homo sapiens
MDAWVRFSAQSQARERLCSFVTTNCALQFSSRGIRPGLTTVLARNLDKNTVGYLQWRWGIQSAMNTSIVRDTKTSHFTVALQLGIPHSFALISYQHKFQDDDQTRVKGSLKAGFFGTVVEYGAERKISRHSVLGAAVSVGVPQGVSLKVKLNRASQTYFFPIHLTDQLLPSAMFYATVGPLVVYFAMHRLIIKPYLRAQKEKELEKQRESAATDVLQKKQEAESAVRLMQESVRRIIEAEESRMGLIIVNAWYGKFVNDKSRKSEKVKVIDVTVPLQCLVKDSKLILTEASKAGLPGFYDPCVGEEKNLKVLYQFRGVLHQVMVLDSEALRIPKQSHRIDTDG

SEQ ID NO: 862418 - protein, 496 aa, Homo sapiens
MATALSEEELDNEDYYSLLNVRREASSEELKAAYRRLCMLYHPDKHRDPELKSQAERLFNLVHQAYEVLSDPQTRAIYDIYGKRGLEMEGWEVVERRRTPAEIREEFERLQREREERRLQQRTNPKGTISVGVDATDLFDRYDEEYEDVSGSSFPQIEINKMHISQSIEAPLTATDTAILSGSLSTQNGNGGGSINFALRRVTSAKGWGELEFGAGDLQGPLFGLKLFRNLTPRCFVTTNCALQFSSRGIRPGLTTVLARNLDKNTVGYLQWRWGIQSAMNTSIVRDTKTSHFTVALQLGIPHSFALISYQHKFQDDDQTRVKGSLKAGFFGTVVEYGAERKISRHSVLGAAVSVGVPQGVSLKVKLNRASQTYFFPIHLTDQLLPSAMFYATVGPLVVYFAMHRLIIKPYLRAQKEKELEKQRESAATDVLQKKQEAESAVSAAPPFPSEGCRGHTPDPTCWSQGLRGQTSLLQQLGSPLSLYCGMRHWALQSLP

SEQ ID NO: 862419 - protein, 461 aa, Homo sapiens
MATALSEEELDNEDYYSLLNVRREASSEELKAAYRRLCMLYHPDKHRDPELKSQAERLFNLVHQAYEVLSDPQTRAIYDIYGKRGLEMEGWEVVERRRTPAEIREEFERLQREREERRLQQRTNPKGTISVGVDATDLFDRYDEEYEDVSGSSFPQIEINKMHISQSIEAPLTATDTAILSGSLSTQNGNGGGSINFALRRVTSAKGWGELEFGAGDLQGPLFGLKLFRNLTPRCFVTTNCALQFSSRGIRPGLTTVLARNLDKNTVGYLQWRWGIQSAMNTSIVRDTKTSHFTVALQLGIPHSFALISYQHKFQDDDQTRVKGSLKAGFFGTVVEYGAERKISRHSVLGAAVSVGVPQGVSLKVKLNRASQTYFFPIHLTDQLLPSAMFYATVGPLVVYFAMHRLIIKPYLRAQKEKCLWSTLPSPQEREPLLQSTLNMGNNLKSRQASRSGSLCCAGFP

SEQ ID NO: 862420 - protein, 507 aa, Homo sapiens
MATALSEEELDNEDYYSLLNVRREASSEELKAAYRRLCMLYHPDKHRDPELKSQAERLFNLVHQAYEVLSDPQTRAIYDIYGKRGLEMEGWEVVERRRTPAEIREEFERLQREREERRLQQRTNPKGTISVGVDATDLFDRYDEEYEDVSGSSFPQIEINKMHISQSIEAPLTATDTAILSGSLSTQNGNGGGSINFALRRVTSAKGWGELEFGAGDLQGPLFGLKLFRNLTPRCFVTTNCALQFSSRGIRPGLTTVLARNLDKNTVGYLQWRWGIQSAMNTSIVRDTKTSHFTVALQLGIPHSFALISYQHKFQDDDQTRVKGSLKAGFFGTVVEYGAERKISRHSVLGAAVSVGVPQGVSLKVKELEKQRESAATDVLQKKQEAESAVRLMQESVRRIIEAEESRMGLIIVNAWYGKFVNDKSRKSEKVKVIDVTVPLQCLVKDSKLILTEASKAGLPGFYDPCVGEEKNLKVLYQFRGVLHQVMVLDSEALRIPKQSHRIDTDG

SEQ ID NO: 862421 - protein, 496 aa, Homo sapiens; identical to SEQ ID NO: 862418

SEQ ID NO: 862422 - protein, 438 aa, Homo sapiens
MATALSEEELDNEDYYSLLNVRREASSEELKAAYRRLCMLYHPDKHRDPELKSQAERLFNLVHQAYEVLSDPQTRAIYDIYGKRGLEMEGWEVVERRRTPAEIREEFERLQREREERRLQQRTNPKGTISVGVDATDLFDRYDEEYEDVSGSSFPQIEINKMHISQSIEAPLTATDTAILSGSLSTQNGNGGGSINFALRRVTSAKGWGELEFGAGDLQGPLFGLKLFRNLTPRCFVTTNCALQFSSRGIRPGLTTVLARNLDKNTVGYLQWRWGIQSAMNTSIVRDTKTSHFTVALQLGIPHSFALISYQHKFQDDDQTRVKGSLKAGFFGTVRWPNWANAPSSSSLSSFTVNCCVRWPNVGPTHRRLLEEIFRDEGGKAFFKGAWSNVLRGMGGAFVLVLYDELTKVISGPRPPPHTHTHQATQENHENPKRARQR

SEQ ID NO: 862423 - protein, 108 aa, Homo sapiens
AEGSREVTRKILARTLPLCVDRGLTSCFFFYWELAQGCIDVTVSEVLARQRGSNRTAESRCYPGPILSLCLSSFVTTNCALQFSSRGIRPGLTTVLARNLDKNTVGYL

SEQ ID NO: 862424 - protein, 571 aa, Homo sapiens
MSIEEAGVLYRTMATALSEEELDNEDYYSLLNVRREASSEELKAAYRRLCMLYHPDKHRDPELKSQAERLFNLVHQAYEVLSDPQTRAIYDIYGKRGLEMEGWEVVERRRTPAEIREEFERLQREREERRLQQRTNPKGTISVGVDATDLFDRYDEEYEDVSGSSFPQIEINKMHISQSIEAPLTATDTAILSGSLSTQNGNGGGSINFALRRVTSAKGWGELEFGAGDLQGPLFGLKLFRNLTPRCFVTTNCALQFSSRGIRPGLTTVLARNLDKNTVGYLQWRWGIQSAMNTSIVRDTKTSHFTVALQLGIPHSFALISYQHKFQDDDQTRVKGSLKAGFFGTVVEYGAERKISRHSVLGAAVSVGVPQGVSLKVKLNRASQTYFFPIHLTDQLLPSAMFYATVGPLVVYFAMHRLIIKPYLRAQKEKELEKQRESAATDVLQKKQEAESAVRLMQESVRRIIEAEESRMGLIIVNAWYGKFVNDKSRKSEKVKVIDVTVPLQCLVKDSKLILTEASKAGLPGFYDPCVGEEKNLKVLYQFRGVLHQVMVLDSEALRIPKQSHRIDTDG

SEQ ID NO: 862425 - protein, 566 aa, Homo sapiens
VFQYGAWALIEVYDGCLGYTHIYSLLNVRREASSEELKAAYRRLCMLYHPDKHRDPELKSQAERLFNLVHQAYEVLSDPQTRAIYDIYGKRGLEMEGWEVVERRRTPAEIREEFERLQREREERRLQQRTNPKGTISVGVDATDLFDRYDEEYEDVSGSSFPQIEINKMHISQSIEAPLTATDTAILSGSLSTQNGNGGGSINFALRRVTSAKGWGELEFGAGDLQGPLFGLKLFRNLTPRCFVTTNCALQFSSRGIRPGLTTVLARNLDKNTVGYLQWRWGIQSAMNTSIVRDTKTSHFTVALQLGIPHSFALISYQHKFQDDDQTRVKGSLKAGFFGTVVEYGAERKISRHSVLGAAVSVGVPQGVSLKVKLNRASQTYFFPIHLTDQLLPSAMFYATVGPLVVYFAMHRLIIKPYLRAQKEKELEKQRESAATDVLQKKQEAESAVRLMQESVRRIIEAEESRMGLIIVNAWYGKFVNDKSRKSEKVKVIDVTVPLQCLVKDSKLILTEASKAGLPGFYDPCVGEEKNLKVLYQFRGVLHQVMVLDSEALRIPKQSHRIDTDG

SEQ ID NO: 862426 - protein, 469 aa, Homo sapiens
MKVVERRRTPAEIREEFERLQREREERRLQQRTNPKGTISVGVDATDLFDRYDEEYEDVSGSSFPQIEINKMHISQSIEAPLTATDTAILSGSLSTQNGNGGGSINFALRRVTSAKGWGELEFGAGDLQGPLFGLKLFRNLTPRCFVTTNCALQFSSRGIRPGLTTVLARNLDKNTVGYLQWRWGIQSAMNTSIVRDTKTSHFTVALQLGIPHSFALISYQHKFQDDDQTRVKGSLKAGFFGTVVEYGAERKISRHSVLGAAVSVGVPQGVSLKVKLNRASQTYFFPIHLTDQLLPSAMFYATVGPLVVYFAMHRLIIKPYLRAQKEKELEKQRESAATDVLQKKQEAESAVRLMQESVRRIIEAEESRMGLIIVNAWYGKFVNDKSRKSEKVKVIDVTVPLQCLVKDSKLILTEASKAGLPGFYDPCVGEEKNLKVLYQFRGVLHQVMVLDSEALRIPKQSHRIDTDG

SEQ ID NO: 862427 - protein, 434 aa, Homo sapiens
MGTISVGVDATDLFDRYDEEYEDVSGSSFPQIEINKMHISQSIEAPLTATDTAILSGSLSTQNGNGGGSINFALRRVTSAKGWGELEFGAGDLQGPLFGLKLFRNLTPRCFVTTNCALQFSSRGIRPGLTTVLARNLDKNTVGYLQWRWGIQSAMNTSIVRDTKTSHFTVALQLGIPHSFALISYQHKFQDDDQTRVKGSLKAGFFGTVVEYGAERKISRHSVLGAAVSVGVPQGVSLKVKLNRASQTYFFPIHLTDQLLPSAMFYATVGPLVVYFAMHRLIIKPYLRAQKEKELEKQRESAATDVLQKKQEAESAVRLMQESVRRIIEAEESRMGLIIVNAWYGKFVNDKSRKSEKVKVIDVTVPLQCLVKDSKLILTEASKAGLPGFYDPCVGEEKNLKVLYQFRGVLHQVMVLDSEALRIPKQSHRIDTDG

SEQ ID NO: 862428 - protein, 559 aa, Homo sapiens; identical to SEQ ID NO: 862413

SEQ ID NO: 862429 - protein, 559 aa, Homo sapiens; identical to SEQ ID NO: 862413

SEQ ID NO: 862430 - protein, 356 aa, Homo sapiens
MATALSEEELDNEDYYSLLNVRREASSEELKAAYRRLCMLYHPDKHRDPELKSQAERLFNLVHQAYEVLSDPQTRAIYDIYGKRGLEMEGWEVVERRRTPAEIREEFERLQREREERRLQQRTNPKGTISVGVDATDLFDRYDEEYEDVSGSSFPQIEINKMHISQSIEAPLTATDTAILSGSLSTQNGNGGGSINFALRRVTSAKGWGELEFGAGDLQGPLFGLKLFRNLTPRCFVTTNCALQFSSRGIRPGLTTVLARNLDKNTVGYLQWHCSSPLLQVQRPHRNTRACAPEPSFRPFLHVPTWDAECSGARTPSTAWTSAAVKLREACLSGPGSGSHQLLLLTPRSKRRTGGG

SEQ ID NO: 862431 - protein, 216 aa, Homo sapiens
MATALSEEELDNEDYYSLLNVRREASSEELKAAYRRLCMLYHPDKHRDPELKSQAERLFNLVHQAYEVLSDPQTRAIYDIYGKRGLEMEGWEVVERRRTPAEIREEFERLQREREERRLQQRTNPKGTISVGVDATDLFDRYDEEYEDVSGSSFPQIEINKMHISQSIEAPLTATDTAILSGSLSTQNGNGGGSINFALRRVTSAKGWGEVRMSIG

SEQ ID NO: 862432 - protein, 101 aa, Homo sapiens
MGVPTFFCHESAPWGSRRLEGGKGRYLASSQMTAAPEVMNEGHRHRPRSLPAEQASLGRWWSTELRGRSPGTAFWVQLSALEFHRAFLSKSSKLNLGLSGQ

SEQ ID NO: 862433 - protein, 133 aa, Homo sapiens
MEPVRGGAVTLRDKQAGYISFRRLGSTQIFSSSCCLPERRLQRPSAYTIPTMSQAGAQEAPIKKKRPPVKEEDLKGARGNLTKNQEIKSKTYQVMRECEQAGSAAPSVFSRTRTGTETVFEKPKAGPTKSVFG

SEQ ID NO: 862434 - protein, 769 aa, Homo sapiens
SPLAVEFRSLLADTGATMKPPRPVRTCSKVLVLLSLLAIHQTTTAEKNGIDIYSLTVDSRVSSRFAHTVVTSRVVNRANTVQEATFQMELPKKAFITNFSMIIDGMTYPGIIKEKAEAQAQYSAAVAKGKSAGLVKATGRNMEQFQVSVSVAPNAKITFELVYEELLKRRLGVYELLLKVRPQQLVKHLQMDIHIFEPQGISFLETESTFMTNQLVDALTTWQNKTKAHIRFKPTLSQQQKSPEQQETVLDGNLIIRYDVDRAISGGSIQIENGYFVHYFAPEGLTTMPKNVVFVIDKSGSMSGRKIQQTREALIKILDDLSPRDQFNLIVFSTEATQWRPSLVPASAENVNKARSFAAGIQALGGTNINDAMLMAVQLLDSSNQEERLPEGSVSLIILLTDGDPTVGETNPRSIQNNVREAVSGRYSLFCLGFGFDVSYAFLEKLALDNGGLARRIHEDSDSALQLQDFYQEVANPLLTAVTFEYPSNAVEEVTQNNFRLLFKGSEMVVAGKLQDRGPDVLTATVSGKLPTQNITFQTESSVAEQEAEFQSPKYIFHNFMERLWAYLTIQQLLEQTVSASDADQQALRNQALNLSLAYSFVTPLTSMVVTKPDDQEQSQVAEKPMEGESRNRNVHSGSTFFKYYLQGAKIPKPEASFSPRRGWNRQAGAAGSRMNFRPGVLSSRQLGLPGPPDVPDHAAYHPFRRLAILPASAPPATSNPDPAVSRVMNMKKTTMTTQTPDRLPLPSCHCLGRVWSGSVWTPDTARGQ

SEQ ID NO: 862435 - protein, 752 aa, Homo sapiens
MKPPRPVRTCSKVLVLLSLLAIHQTTTAEKNGIDIYSLTVDSRVSSRFAHTVVTSRVVNRANTVQEATFQMELPKKAFITNFSMIIDGMTYPGIIKEKAEAQAQYSAAVAKGKSAGLVKATGRNMEQFQVSVSVAPNAKITFELVYEELLKRRLGVYELLLKVRPQQLVKHLQMDIHIFEPQGISFLETESTFMTNQLVDALTTWQNKTKAHIRFKPTLSQQQKSPEQQETVLDGNLIIRYDVDRAISGGSIQIENGYFVHYFAPEGLTTMPKNVVFVIDKSGSMSGRKIQQTREALIKILDDLSPRDQFNLIVFSTEATQWRPSLVPASAENVNKARSFAAGIQALGGTNINDAMLMAVQLLDSSNQEERLPEGSVSLIILLTDGDPTVGETNPRSIQNNVREAVSGRYSLFCLGFGFDVSYAFLEKLALDNGGLARRIHEDSDSALQLQDFYQEVANPLLTAVTFEYPSNAVEEVTQNNFRLLFKGSEMVVAGKLQDRGPDVLTATVSGKLPTQNITFQTESSVAEQEAEFQSPKYIFHNFMERLWAYLTIQQLLEQTVSASDADQQALRNQALNLSLAYSFVTPLTSMVVTKPDDQEQSQVAEKPMEGESRNRNVHSGSTFFKYYLQGAKIPKPEASFSPRRGWNRQAGAAGSRMNFRPGVLSSRQLGLPGPPDVPDHAAYHPFRRLAILPASAPPATSNPDPAVSRVMNMKKTTMTTQTPDRLPLPSCHCLGRVWSGSVWTPDTARGQ

SEQ ID NO: 862436 - protein, 647 aa, Homo sapiens
MPKNVVFVIDKSGSMSGRKIQQTREALIKILDDLSPRDQFNLIVFSTEATQWRPSLVPASAENVNKARSFAAGIQALGGTNINDAMLMAVQLLDSSNQEERLPEGSVSLIILLTDGDPTVGETNPRSIQNNVREAVSGRYSLFCLGFGFDVSYAFLEKLALDNGGLARRIHEDSDSALQLQDFYQEVANPLLTAVTFEYPSNAVEEVTQNNFRLLFKGSEMVVAGKLQDRGPDVLTATVSGKLPTQNITFQTESSVAEQEAEFQSPKYIFHNFMERLWAYLTIQQLLEQTVSASDADQQALRNQALNLSLAYSFVTPLTSMVVTKPDDQEQSQVAEKPMEGESRNRNVHSAGAAGSRMNFRPGVLSSRQLGLPGPPDVPDHAAYHPFRRLAILPASAPPATSNPDPAVSRVMNMKSSQPPWPLSTSLPPACPSCSRSRAPAVPAPIQAPSAILPLPGQSVERLCVDPRHRQGPVNLLSDPEQGVEVTGQYEREKAGFSWIEVTFKNPLVWVHASPEHVVVTRNRRSSAYKWKETLFSVMPGLKMTMDKTGLLLLSDPDKVTIGLLFWDGRGEGLRLLLRDTDRFSSHVGGTLGQFYQEVLWGSPAASDDGRRTLRVQGNDHSATRERRLDYQEGPPGVEISCWSVEL

SEQ ID NO: 862437 - protein, 89 aa, Homo sapiens
NTTKFAAASPAGAQEAPIKKKRPPVKEEDLKGARGNLTKNQEIKSKTYQVMRECEQAGSAAPSVFSRTRTGTETVFEKPKAGPTKSVFG

SEQ ID NO: 862438 - protein, 648 aa, Homo sapiens
MKPPRPVRTCSKVLVLLSLLAIHQTTTAEKNGIDIYSLTVDSRVSSRFAHTVVTSRVVNRANTVQEATFQMELPKKAFITNFSMIIDGMTYPGIIKEKAEAQAQYSAAVAKGKSAGLVKATGRNMEQFQVSVSVAPNAKITFELVYEELLKRRLGVYELLLKVRPQQLVKHLQMDIHIFEPQGISFLETESTFMTNQLVDALTTWQNKTKAHIRFKPTLSQQQKSPEQQETVLDGNLIIRYDVDRAISGGSIQIENGYFVHYFAPEGLTTMPKNVVFVIDKSGSMSGRKIQQTREALIKILDDLSPRDQFNLIVFSTEATQWRPSLVPASAENVNKARSFAAGIQALGGTNINDAMLMAVQLLDSSNQEERLPEGSVSLIILLTDGDPTVGETNPRSIQNNVREAVSGRYSLFCLGFGFDVSYAFLEKLALDNGGLARRIHEDSDSALQLQDFYQEVANPLLTAVTFEYPSNAVEEVTQNNFRLLFKGSEMVVAGKLQDRGPDVLTATVSGKLPTQNITFQTESSVAEQEAEFQSPKYIFHNFMERLWAYLTIQQLLEQTVSASDADQQALRNQALNLSLAYSFVTPLTSMVVTKPDDQEQSQVAEKPMEGESRNRNVHSGSTFFKYYLQGAKIPKPGDKVGGGGRGD

SEQ ID NO: 862439 - protein, 722 aa, Homo sapiens
MKPPRPVRTCSKVLVLLSLLAIHQTTTAEKNGIDIYSLTVDSRVSSRFAHTVVTSRVVNRANTVQEATFQMELPKKAFITNFSMIIDGMTYPGIIKEKAEAQAQYSAAVAKGKSAGLVKATGRNMEQFQVSVSVAPNAKITFELVYEELLKRRLGVYELLLKVRPQQLVKHLQMDIHIFEPQGISFLETESTFMTNQLVDALTTWQNKTKAHIRFKPTLSQQQKSPEQQETVLDGNLIIRYDVDRAISGGSIQIENGYFVHYFAPEGLTTMPKNVVFVIDKSGSMSGRKIQQTREALIKILDDLSPRDQFNLIVFSTEATQWRPSLVPASAENVNKARSFAAGIQALGGTNINDAMLMAVQLLDSSNQEERLPEGSVSLIILLTDGDPTVGETNPRSIQNNVREAVSGRYSLFCLGFGFDVSYAFLEKLALDNGGLARRIHEDSDSALQLQDFYQEVANPLLTAVTFEYPSNAVEEVTQNNFRLLFKGSEMVVAGKLQDRGPDVLTATVSGKLPTQNITFQTESSVAEQEAEFQSPKYIFHNFMERLWAYLTIQQLLEQTVSASDADQQALRNQALNLSLAYSFVTPLTSMVVTKPDDQEQSQVAEKPMEGESRNRNVHSAGAAGSRMNFRPGVLSSRQLGLPGPPDVPDHAAYHPFRRLAILPASAPPATSNPDPAVSRVMNMKKTTMTTQTPDRLPLPSCHCLGRVWSGSVWTPDTARGQ

SEQ ID NO: 862440 - protein, 648 aa, Homo sapiens; identical to SEQ ID NO: 862438

SEQ ID NO: 862441 - protein, 701 aa, Homo sapiens
MKPPRPVRTCSKVLVLLSLLAIHQTTTAEKNGIDIYSLTVDSRVSSRFAHTVVTSRVVNRANTVQEATFQMELPKKAFITNFSMIIDGMTYPGIIKEKAEAQAQYSAAVAKGKSAGLVKATGRNMEQFQVSVSVAPNAKITFELVYEELLKRRLGVYELLLKVRPQQLVKHLQMDIHIFEPQGISFLETESTFMTNQLVDALTTWQNKTKAHIRFKPTLSQQQKSPEQQETVLDGNLIIRYDVDRAISGGSIQIENGYFVHYFAPEGLTTMPKNVVFVIDKSGSMSGRKIQQTREALIKILDDLSPRDQFNLIVFSTEATQWRPSLVPASAENVNKARSFAAGIQALGGTNINDAMLMAVQLLDSSNQEERLPEGSVSLIILLTDGDPTVGETNPRSIQNNVREAVSGRYSLFCLGFGFDVSYAFLEKLALDNGGLARRIHEDSDSALQLQDFYQEVANPLLTAVTFEYPSNAVEEVTQNNFRLLFKGSEMVVAGKLQDRGPDVLTATVSGKLPTQNITFQTESSVAEQEAEFQSPKYIFHNFMERLWAYLTIQQLLEQTVSASDADQQALRNQALNLSLAYSFVTPLTSMVVTKPDDQEQSQVAEKPMEGESRNRNVHSGSTFFKYYLQGAKIPKPEASFSPRRGWNRQAGAAGSRMNFRPGVLSSRQLGLPGPPDVPDHAAYHPFRRLAISAQPGWTYP

SEQ ID NO: 862442 - protein, 701 aa, Homo sapiens; identical to SEQ ID NO: 862441

SEQ ID NO: 862443 - protein, 648 aa, Homo sapiens; identical to SEQ ID NO: 862438

SEQ ID NO: 862444 - protein, 639 aa, Homo sapiens
MKPPRPVRTCSKVLVLLSLLAIHQTTTAEKNGIDIYSLTVDSRVSSRFAHTVVTSRVVNRANTVQEATFQMELPKKAFITNFSMIIDGMTYPGIIKEKAEAQAQYSAAVAKGKSAGLVKATGRNMEQFQVSVSVAPNAKITFELVYEELLKRRLGVYELLLKVRPQQLVKHLQMDIHIFEPQGISFLETESTFMTNQLVDALTTWQNKTKAHIRFKPTLSQQQKSPEQQETVLDGNLIIRYDVDRAISGGSIQIENGYFVHYFAPEGLTTMPKNVVFVIDKSGSMSGRKIQQTREALIKILDDLSPRDQFNLIVFSTEATQWRPSLVPASAENVNKARSFAAGIQALGGTNINDAMLMAVQLLDSSNQEERLPEGSVSLIILLTDGDPTVGETNPRSIQNNVREAVSGRYSLFCLGFGFDVSYAFLEKLALDNGGLARRIHEDSDSALQLQDFYQEVANPLLTAVTFEYPSNAVEEVTQNNFRLLFKGSEMVVAGKLQDRGPDVLTATVSGKLPTQNITFQTESSVAEQEAEFQSPKYIFHNFMERLWAYLTIQQLLEQTVSASDADQQALRNQALNLSLAYSFVTPLTSMVVTKPDDQEQSQVAEKPMEGESRNRCATQVPLSSNIISREHKYLLAPG

SEQ ID NO: 862445 - protein, 657 aa, Homo sapiens
MKPPRPVRTCSKVLVLLSLLAIHQTTTAEKNGIDIYSLTVDSRVSSRFAHTVVTSRVVNRANTVQEATFQMELPKKAFITNFSMIIDGMTYPGIIKEKAEAQAQYSAAVAKGKSAGLVKATGRNMEQFQVSVSVAPNAKITFELVYEELLKRRLGVYELLLKVRPQQLVKHLQMDIHIFEPQGISFLETESTFMTNQLVDALTTWQNKTKAHIRFKPTLSQQQKSPEQQETVLDGNLIIRYDVDRAISGGSIQIENGYFVHYFAPEGLTTMPKNVVFVIDKSGSMSGRKIQQTREALIKILDDLSPRDQFNLIVFSTEATQWRPSLVPASAENVNKARSFAAGIQALGGTNINDAMLMAVQLLDSSNQEERLPEGSVSLIILLTDGDPTVGETNPRSIQNNVREAVSGRYSLFCLGFGFDVSYAFLEKLALDNGGLARRIHEDSDSALQLQDFYQEVANPLLTAVTFEYPSNAVEEVTQNNFRLLFKGSEMVVAGKLQDRGPDVLTATVSGKLPTQNITFQTESSVAEQEAEFQSPKYIFHNFMERLWAYLTIQQLLEQTVSASDADQQALRNQALNLSLAYSFVTPLTSMVVTKPDDQEQSQVAEKPMEGGGCGVEISASQVAEFGPSVLPDLPCILTKTPTVPPTDSPWEIQPIH

SEQ ID NO: 862446 - protein, 331 aa, Homo sapiens
AGWYALELDGCGFGGAAPAGSEAGRALGPRAPPARPVMQGPAGNASRGLPGGPPSTVASGAGRCESGALMHSFGIFLQGLLGVVAFSTLMLKRFREPKHERRPWRIWFLDTSKQAIGMLFIHFANVYLADLTEEDPCSLYLINFLLDATVGMLLIYVGVRAVSVLVEWQQWESLRFGEYGDPLQCGAWVGQCALYIVIMIFEKSVVFIVLLILQWKKVALLNPIENPDLKLAIVMLIVPFFVNALMFWVVDNFLMRKGKTKAKLEERGANQDSRNGSKVRYRRAASHEESESEILISADDEMEESDVEEDLRRLTPLKPVKKKKHRFGLPV

SEQ ID NO: 862447 - protein, 508 aa, Homo sapiens
MKPPRPVRTCSKVLVLLSLLAIHQTTTAEKNGIDIYSLTVDSRVSSRFAHTVVTSRVVNRANTVQEATFQMELPKKAFITNFSMIIDGMTYPGIIKEKAEAQAQYSAAVAKGKSAGLVKATGRNMEQFQVSVSVAPNAKITFELVYEELLKRRLGVYELLLKVRPQQLVKHLQMDIHIFEPQGISFLETESTFMTNQLVDALTTWQNKTKAHIRFKPTLSQQQKSPEQQETVLDGNLIIRYDVDRAISGGSIQIENGYFVHYFAPEGLTTMPKNVVFVIDKSGSMSGRKIQQTREALIKILDDLSPRDQFNLIVFSTEATQWRPSLVPASAENVNKARSFAAGIQALGGTNINDAMLMAVQLLDSSNQEERLPEGSVSLIILLTDGDPTVGETNPRSIQNNVREAVSGRYSLFCLGFGFDVSYAFLEKLALDNGGLARRIHEDSDSALQLQDFYQEVANPLLTAVTFEYPSNAVEEVTQNNFRLLFKGSEMVVAGGGPPLFGGGGGGG

SEQ ID NO: 862448 - protein, 238 aa, Homo sapiens
MTTQTPGSQPPWPLSTSLPPACPSCSRSRAPAVPAPIQAPSAILPLPGQSVERLCVDPRHRQGPVNLLSDPEQGVEVTGQYEREKAGFSWIEVTFKNPLVWVHASPEHVVVTRNRRSSAYKWKETLFSVMPGLKMTMDKTGLLLLSDPDKVTIGLLFWDGRGEGLRLLLRDTDRFSSHVGGTLGQFYQEVLWGSPAASDDGRRTLRVQGNDHSATRERRLDYQEGPPGVEISCWSVEL

SEQ ID NO: 862449 - protein, 395 aa, Homo sapiens
AGWYALELDGCGFGGAAPAGSEAGRALGPRAPPARPVMQGPAGNASRGLPGGPPSTVASGAGRCESGALMHSFGIFLQGLLGVVAFSTLMLKRFREPKHERRPWRIWFLDTSKQAIGMLFIHFANVYLADLTEEDPCSLYLINFLLDATVGMLLIYVGVRAVSVLVEWQQWESLRFGEYGDPLQCGAWVGQCALYIVIMIFEKSVVFIVLLILQWKKVALLNPIENPDLKLAIVMLIVPFFVNALMFWVVDNFLMRKGKTKAKLEERGANQDSRNGSKVRYRRAASHEESESEILISADDEMEESDVEEDLRRLTPLKPVKKKKHRFGLPLLPAREAPSETQRLHNTHHVPGWCSGSPYQEEAPPCEGGGPEGGPRKPDQEPGNQVQDLPGHARV

SEQ ID NO: 862450 - protein, 195 aa, Homo sapiens
AGWYALELDGCGFGGAAPAGSEAGRALGPRAPPARPVMQGPAGNASRGLPGGPPSTVASGAGRCESGALMHSFGIFLQGLLGVVAFSTLMLKRFREPKHERRPWRIWFLDTSKQAIGMLFIHFANVYLADLTEEDPCSLYLINFLLDATVGMLLIYVGVRAVSVLVEWQQWESLRFGEYEEKAKSLLMRMRDSGK

SEQ ID NO: 862451 - protein, 648 aa, Homo sapiens; identical to SEQ ID NO: 862438

SEQ ID NO: 862452 - protein, 701 aa, Homo sapiens; identical to SEQ ID NO: 862441

SEQ ID NO: 862453 - protein, 996 aa, Homo sapiens
MKPPRPVRTCSKVLVLLSLLAIHQTTTAEKNGIDIYSLTVDSRVSSRFAHTVVTSRVVNRANTVQEATFQMELPKKAFITNFSMIIDGMTYPGIIKEKAEAQAQYSAAVAKGKSAGLVKATGRNMEQFQVSVSVAPNAKITFELVYEELLKRRLGVYELLLKVRPQQLVKHLQMDIHIFEPQGISFLETESTFMTNQLVDALTTWQNKTKAHIRFKPTLSQQQKSPEQQETVLDGNLIIRYDVDRAISGGSIQIENGYFVHYFAPEGLTTMPKNVVFVIDKSGSMSGRKIQQTREALIKILDDLSPRDQFNLIVFSTEATQWRPSLVPASAENVNKARSFAAGIQALGGTNINDAMLMAVQLLDSSNQEERLPEGSVSLIILLTDGDPTVGETNPRSIQNNVREAVSGRYSLFCLGFGFDVSYAFLEKLALDNGGLARRIHEDSDSALQLQDFYQEVANPLLTAVTFEYPSNAVEEVTQNNFRLLFKGSEMVVAGKLQDRGPDVLTATVSGKLPTQNITFQTESSVAEQEAEFQSPKYIFHNFMERLWAYLTIQQLLEQTVSASDADQQALRNQALNLSLAYSFVTPLTSMVVTKPDDQEQSQVAEKPMEGESRNRNVHSGSTFFKYYLQGAKIPKPGDKVGGGEEGRLTDWAQSWLWRVVPCPAPLAGDSPRASVQLYLIRTDHTEASFSPRRGWNRQAGAAGSRMNFRPGVLSSRQLGLPGPPDVPDHAAYHPFRRLAILPASAPPATSNPDPAVSRVMNMKSSQPPWPLSTSLPPACPSCSRSRAPAVPAPIQAPSAILPLPGQSVERLCVDPRHRQGPVNLLSDPEQGVEVTGQYEREKAGFSWIEVTFKNPLVWVHASPEHVVVTRNRRSSAYKWKETLFSVMPGLKMTMDKTGLLLLSDPDKVTIGLLFWDGRGEGLRLLLRDTDRFSSHVGGTLGQFYQEVLWGSPAASDDGRRTLRVQGNDHSATRERRLDYQEGPPGVEISCWSVEL

SEQ ID NO: 862454 - protein, 713 aa, Homo sapiens
MKPPRPVRTCSKVLVLLSLLAIHQTTTAEKNGIDIYSLTVDSRVSSRFAHTVVTSRVVNRANTVQEATFQMELPKKAFITNFSMIIDGMTYPGIIKEKAEAQAQYSAAVAKGKSAGLVKATGRNMEQFQVSVSVAPNAKITFELVYEELLKRRLGVYELLLKVRPQQLVKHLQMDIHIFEPQGISFLETESTFMTNQLVDALTTWQNKTKAHIRFKPTLSQQQKSPEQQETVLDGNLIIRYDVDRAISGGSIQIENGYFVHYFAPEGLTTMPKNVVFVIDKSGSMSGRKIQQTREALIKILDDLSPRDQFNLIVFSTEATQWRPSLVPASAENVNKARSFAAGIQALGGTNINDAMLMAVQLLDSSNQEERLPEGSVSLIILLTDGDPTVGETNPRSIQNNVREAVSGRYSLFCLGFGFDVSYAFLEKLALDNGGLARRIHEDSDSALQLQDFYQEVANPLLTAVTFEYPSNAVEEVTQNNFRLLFKGSEMVVAGKLQDRGPDVLTATVSGKLPTQNITFQTESSVAEQEAEFQSPKYIFHNFMERLWAYLTIQQLLEQTVSASDADQQALRNQALNLSLAYSFVTPLTSMVVTKPDDQEQSQVAEKPMEGESRNRNVHSAGAAGSRMNFRPGVLSSRQLGLPGPPDVPDHAAYHPFRRLAILPASAPPATSNPDPAVSRVMNMKNRLPLPSCHCLGRVWSGSVWTPDTARGQ

SEQ ID NO: 862455 - protein, 850 aa, Homo sapiens
MKPPRPVRTCSKVLVLLSLLAIHQTTTAEKNGIDIYSLTVDSRVSSRFAHTVVTSRVVNRANTVQEATFQMELPKKAFITNFSMIIDGMTYPGIIKEKAEAQAQYSAAVAKGKSAGLVKATGRNMEQFQVSVSVAPNAKITFELVYEELLKRRLGVYELLLKVRPQQLVKHLQMDIHIFEPQGISFLETESTFMTNQLVDALTTWQNKTKAHIRFKPTLSQQQKSPEQQETVLDGNLIIRYDVDRAISGGSIQIENGYFVHYFAPEGLTTMPKNVVFVIDKSGSMSGRKIQQTREALIKILDDLSPRDQFNLIVFSTEATQWRPSLVPASAENVNKARSFAAGIQALGGTNINDAMLMAVQLLDSSNQEERLPEGSVSLIILLTDGDPTVGETNPRSIQNNVREAVSGRYSLFCLGFGFDVSYAFLEKLALDNGGLARRIHEDSDSALQLQDFYQEVANPLLTAVTFEYPSNAVEEVTQNNFRLLFKGSEMVVAGKLQDRGPDVLTATVSGKLPTQNITFQTESSVAEQEAEFQSPKYIFHNFMERLWAYLTIQQLLEQTVSASDADQQALRNQALNLSLAYSFVTPLTSMVVTKPDDQEQSQVAEKPMEGESRNRNVHSAGAAGSRMNFRPGVLSSRQLGLPGPPDVPDHAAYHPFRRLAILPASAPPATSNPDPAVSRVMNMKRVEVTGQYEREKAGFSWIEVTFKNPLVWVHASPEHVVVTRNRRSSAYKWKETLFSVMPGLKMTMDKTGLLLLSDPDKVTIGLLFWDGRGEGLRLLLRDTDRFSSHVGGTLGQFYQEVLWGSPAASDDGRRTLRVQGNDHSATRERRLDYQEGPPGVEISCWSVEL

SEQ ID NO: 862456 - protein, 648 aa, Homo sapiens; identical to SEQ ID NO: 862438

SEQ ID NO: 862457 - protein, 648 aa, Homo sapiens; identical to SEQ ID NO: 862438

SEQ ID NO: 862458 - protein, 648 aa, Homo sapiens; identical to SEQ ID NO: 862438

SEQ ID NO: 862459 - protein, 395 aa, Homo sapiens; identical to SEQ ID NO: 862449

SEQ ID NO: 862460 - protein, 722 aa, Homo sapiens; identical to SEQ ID NO: 862439

SEQ ID NO: 862461 - protein, 510 aa, Homo sapiens
MKPPRPVRTCSKVLVLLSLLAIHQTTTAEKNGIDIYSLTVDSRVSSRFAHTVVTSRVVNRANTVQEATFQMELPKKAFITNFSMIIDGMTYPGIIKEKAEAQAQYSAAVAKGKSAGLVKATGRNMEQFQVSVSVAPNAKITFELVYEELLKRRLGVYELLLKVRPQQLVKHLQMDIHIFEPQGISFLETESTFMTNQLVDALTTWQNKTKAHIRFKPTLSQQQKSPEQQETVLDGNLIIRYDVDRAISGGSIQIENGYFVHYFAPEGLTTMPKNVVFVIDKSGSMSGRKIQQTREALIKILDDLSPRDQFNLIVFSTEATQWRPSLVPASAENVNKARSFAAGIQALGGTNINDAMLMAVQLLDSSNQEERLPEGSVSLIILLTDGDPTVGETNPRSIQNNVREAVSGRYSLFCLGFGFDVSYAFLEKLALDNGGLARRIHEDSDSALQLQDFYQEVANPLLTAVTFEYPSNAVEEVTQNNFRLLFKGSRFGGGFLGRGGGFSGGGGGAP

SEQ ID NO: 862462 - protein, 114 aa, Homo sapiens
MDKTGLLLLSDPDKVTIGLLFWDGRGEGLRLLLRDTDRFSSHVGGTLGTEPITGAQAFLRNQLCLGTGSAPPLRVSPRLPLSLTLTDPPFVSQASFTRRCSGDLQQHQMTADAR

SEQ ID NO: 862463 - protein, 71 aa, Homo sapiens
MGPGETNPRSIQNNVREAVSGRYSLFCLGFGFDVSYAFLEKLALDNGGLARRIHEDSDSALQLQVPVCPRW

SEQ ID NO: 862464 - protein, 300 aa, Homo sapiens
MATSVGHRCLGLLHGVAPWRSSLHPCEITALSQSLQPLRKLPFRAFRTDARKIHTAPARTMFLLRPLPILLVTGGGYAGYRQYEKYRERELEKLGLEIPPKLAGHWEVALYKSVPTRLLSRAWGRLNQVELPHWLRRPVYSLYIWTFGVNMKEAAVEDLHHYRNLSEFFRRKLKPQARPVCGLHSVISPSDGRILNFGQVKNCEVEQVKGVTYSLESFLGPRMCTEDLPFPPGGGGLQNSGPGGWLFTGSSRPGVTVIPVVSPASGRWTAAGALSRGAAKVYPGGAIGKQANEEGGFSSV

SEQ ID NO: 862465 - protein, 93 aa, Homo sapiens
MCQSEARQGPELRAAKWLHFPQLALRRRLGQLSCMSRPALKLRSWPLTVLYYLLPFGALRPLSRVGWRPVSRGLSSQCNALAVRLGPPRGSPV

SEQ ID NO: 862466 - protein, 409 aa, Homo sapiens
MATSVGHRCLGLLHGVAPWRSSLHPCEITALSQSLQPLRKLPFRAFRTDARKIHTAPARTMFLLRPLPILLVTGGGYAGYRQYEKYRERELEKLGLEIPPKLAGHWEVALYKSVPTRLLSRAWGRLNQVELPHWLRRPVYSLYIWTFGVNMKEAAVEDLHHYRNLSEFFRRKLKPQARPVCGLHSVISPSDGRILNFGQVKNCEVEQVKGVTYSLESFLGPRMCTEDLPFPPAASCDSFKNQLVTREGNELYHCVIYLAPGDYHCFHSPTDWTVSHRRHFPGSLMSVNPGMARWIKELFCHNERVVLTGDWKHGFFSLTAVGATNVGSIRIYFDRDLHTNSPRHSKGSYNDFSFVTHTNREGVPMRKGEHLGEFNLGSTIVLIFEAPKDFNFQLKTGQKIRFGEALGSL

SEQ ID NO: 862467 - protein, 433 aa, Homo sapiens
MCQSEARQGPELRAAKWLHFPQLALRRRLGQLSCMSRPALKLRSWPLTVLYYLLPFGALRPLSRVGWRPVSRVALYKSVPTRLLSRAWGRLNQVELPHWLRRPVYSLYIWTFGVNMKEAAVEDLHHYRNLSEFFRRKLKPQARPVCGLHSVVRPDPFLLQETGLFPASPAQPPWSPAYLEGAGMTRGGGGCLLGGGDPALPGSKPLLPFQISPSDGRILNFGQVKNCEVEQVKGVTYSLESFLGPRMCTEDLPFPPAASCDSFKNQLVTREGNELYHCVIYLAPGDYHCFHSPTDWTVSHRRHFPGSLMSVNPGMARWIKELFCHNERVVLTGDWKHGFFSLTAVGATNVGSIRIYFDRDLHTNSPRHSKGSYNDFSFVTHTNREGVPMRKGEHLGEFNLGSTIVLIFEAPKDFNFQLKTGQKIRFGEALGSL

SEQ ID NO: 862468 - protein, 433 aa, Homo sapiens; identical to SEQ ID NO: 862467

SEQ ID NO: 862469 - protein, 433 aa, Homo sapiens; identical to SEQ ID NO: 862467

SEQ ID NO: 862470 - protein, 433 aa, Homo sapiens; identical to SEQ ID NO: 862467

SEQ ID NO: 862471 - protein, 340 aa, Homo sapiens [sequence omitted]

SEQ ID NO: 862472 - protein, 149 aa, Homo sapiens
MCHGVDTPGSGRGVAAFPASAGSLMSVNPGMARWIKELFCHNERVVLTGDWKHGFFSLTAVGATNVGSIRIYFDRDLHTNSPRHSKGSYNDFSFVTHTNREGVPMRKGEHLGEFNLGSTIVLIFEAPKDFNFQLKTGQKIRFGEALGSL

SEQ ID NO: 862473 - protein, 470 aa, Homo sapiens
MATSVGHRCLGLLHGVAPWRSSLHPCEITALSQSLQPLRKLPFRAFRTDARKIHTAPARTMFLLRPLPILLVTGGGYAGYRQYEKYRERELEKLGLEIPPKLAGHWEVALYKSVPTRLLSRAWGRLNQVELPHWLRRPVYSLYIWTFGVNMKEAAVEDLHHYRNLSEFFRRKLKPQARPVCGLHSVVRPDPFLLQETGLFPASPAQPPWSPAYLEGAGMTRGGGGCLLGGGDPALPGSKPLLPFQISPSDGRILNFGQVKNCEVEQVKGVTYSLESFLGPRMCTEDLPFPPGGSLHSGARQPCCCVAGPGGRGMLGKELRLACGASLRIHVQTTLGLRAGCSLFGGPHVCSYSTAASCDSFKNQLVTREGNELYHCVIYLAPGDYHCFHSPTDWTVSHRRHFPGSLMSVNPGMARWIKELFCHNERVVLTGDWKHGFFSLTAVGATNVGSIRIYFDRDLHTNSPRTSISS

SEQ ID NO: 862474 - protein, 197 aa, Homo sapiens
MRGQHSQVCCPPCPQGLPFWVSVCDQRPWLPRVLLSQHHAWRPLGPTVPCPPWAQFTAGVKAVCEIWLEQAHLALRCHPHLPFGAGLGGGGDKQQREWDSNTCGGDTVHLVAWAPLTPSLSPQDLHTNSPRHSKGSYNDFSFVTHTNREGVPMRKGEHLGEFNLGSTIVLIFEAPKDFNFQLKTGQKIRFGEALGSL

SEQ ID NO: 862475 - protein, 374 aa, Homo sapiens
MCQSEARQGPELRAAKWLHFPQLALRRRLGQLSCMSRPALKLRSWPLTVLYYLLPFGALRPLSRVGWRPVSRVALYKSVPTRLLSRAWGRLNQVELPHWLRRPVYSLYIWTFGVNMKEAAVEDLHHYRNLSEFFRRKLKPQARPVCGLHSVISPSDGRILNFGQVKNCEVEQVKGVTYSLESFLGPRMCTEDLPFPPAASCDSFKNQLVTREGNELYHCVIYLAPGDYHCFHSPTDWTVSHRRHFPGSLMSVNPGMARWIKELFCHNERVVLTGDWKHGFFSLTAVGATNVGSIRIYFDRDLHTNSPRHSKGSYNDFSFVTHTNREGVPMRKGEHLGEFNLGSTIVLIFEAPKDFNFQLKTGQKIRFGEALGSL

SEQ ID NO: 862476 - protein, 374 aa, Homo sapiens; identical to SEQ ID NO: 862475

SEQ ID NO: 862477 - protein, 374 aa, Homo sapiens; identical to SEQ ID NO: 862475

SEQ ID NO: 862478 - protein, 468 aa, Homo sapiens
MATSVGHRCLGLLHGVAPWRSSLHPCEITALSQSLQPLRKLPFRAFRTDARKIHTAPARTMFLLRPLPILLVTGGGYAGYRQYEKYRERELEKLGLEIPPKLAGHWEVALYKSVPTRLLSRAWGRLNQVELPHWLRRPVYSLYIWTFGVNMKEAAVEDLHHYRNLSEFFRRKLKPQARPVCGLHSVVRPDPFLLQETGLFPASPAQPPWSPAYLEGAGMTRGGGGCLLGGGDPALPGSKPLLPFQISPSDGRILNFGQVKNCEVEQVKGVTYSLESFLGPRMCTEDLPFPPAASCDSFKNQLVTREGNELYHCVIYLAPGDYHCFHSPTDWTVSHRRHFPGSLMSVNPGMARWIKELFCHNERVVLTGDWKHGFFSLTAVGATNVGSIRIYFDRDLHTNSPRHSKGSYNDFSFVTHTNREGVPMRKGEHLGEFNLGSTIVLIFEAPKDFNFQLKTGQKIRFGEALGSL

SEQ ID NO: 862479 - protein, 78 aa, Homo sapiens
MCQSEARQGPELRAAKWLHFPQLALRRRLGQLSCMSRPALKLRSWPLTVLYYLLPFGALRPLSRVGWRPVSRGSVCTG

SEQ ID NO: 862480 - protein, 531 aa, Homo sapiens
MATSVGHRCLGLLHGVAPWRSSLHPCEITALSQSLQPLRKLPFRAFRTDARKIHTAPARTMFLLRPLPILLVTGGGYAGYRQYEKYRERELEKLGLEIPPKLAGHWEVALYKSVPTRLLSRAWGRLNQVELPHWLRRPVYSLYIWTFGVNMKEAAVEDLHHYRNLSEFFRRKLKPQARPVCGLHSVVRPDPFLLQETGLFPASPAQPPWSPAYLEGAGMTRGGGGCLLGGGDPALPGSKPLLPFQISPSDGRILNFGQVKNCEVEQVKGVTYSLESFLGPRMCTEDLPFPPGGSLHSGARQPCCCVAGPGGRGMLGKELRLACGASLRIHVQTTLGLRAGCSLFGGPHVCSYSTAASCDSFKNQLVTREGNELYHCVIYLAPGDYHCFHSPTDWTVSHRRHFPGSLMSVNPGMARWIKELFCHNERVVLTGDWKHGFFSLTAVGATNVGSIRIYFDRDLHTNSPRHSKGSYNDFSFVTHTNREGVPMRKGEHLGEFNLGSTIVLIFEAPKDFNFQLKTGQKIRFGEALGSL

SEQ ID NO: 862481 - protein, 433 aa, Homo sapiens; identical to SEQ ID NO: 862467

SEQ ID NO: 862482 - protein, 393 aa, Homo sapiens
MATSVGHRCLGLLHGVAPWRSSLHPCEITALSQSLQPLRKLPFRAFRTDARKIHTAPARTMFLLRPLPILLVTGGGYAGYRQYEKYRERELEKLGLEIPPKLAGHWEVALYKSVPTRLLSRAWGRLNQVELPHWLRRPVYSLYIWTFGVNMKEAAVEDLHHYRNLSEFFRRKLKPQARPVCGLHSVISPSDGRILNFGQVKNCEVEQVKGVTYSLESFLGPRMCTEDLPFPPAASCDSFKNQLVTREGNELYHCVIYLAPGDYHCFHSPTDWTVSHRRHFPGSLMSVNPGMARWIKELFCHNERVVLTGDWKHGFFSLTAVGATWASSLFCRLANGRRGSKGVVLAPHRGSLGGGRGYPGPRVLATVIRKRARGAGATPLGRSQGGGRRALGV

SEQ ID NO: 862483 - protein, 132 aa, Homo sapiens [sequence omitted]

SEQ ID NO: 862484 - protein, 413 aa, Homo sapiens
MAPPSVFAEVPQAQPVLVFKLTADFREDPDPRKVNLGVGAYRTDDCHPWVLPVVKKVEQKIANDNSLNHEYLPILGLAEFRSCASRLALGDDSPALKEKRVGGVQSLGGTGALRIGADFLARWYNGTNNKNTPVYVSSPTWENHNAVFSAAGFKDIRSYRYWDAEKRGLDLQGFLNDLENAPEFSIVVLHACAHNPTGIDPTPEQWKQIASVMKHRFLFPFFDSAYQGFASGNLERDAWAIRYFVSEGFEFFCAQSFSKNFGLYNERVGNLTVVGKEPESILQVLSQMEKIVRITWSNPPAQGARIVASTLSNPELFEEWTGNVKTMADRILTMRSELRARLEALKTPGTWNHITDQIGMFSFTGLNPKQVEYLVNEKHIYLLPSGRINVSGLTTKNLDYVATSIHEAVTKIQ

SEQ ID NO: 862485 - protein, 413 aa, Homo sapiens; identical to SEQ ID NO: 862484

SEQ ID NO: 862486 - protein, 413 aa, Homo sapiens; identical to SEQ ID NO: 862484

SEQ ID NO: 862487 - protein, 442 aa, Homo sapiens
MAPPSVFAEVPQAQPVLVFKLTADFREDPDPRKVNLGVGAYRTDDCHPWVLPVVKKVEQKIANDNSLNHEYLPILGLAEFRSCASRLALGDDSPALKEKRVGGVQSLGGTGALRIGADFLARWYNGTNNKNTPVYVSSPTWENHNAVFSAAGFKDIRSYRYWDAEKRGLDLQGFLNDLENAPEFSIVVLHACAHNPTGIDPTPEQWKQIASVMKHRFLFPFFDSAYQGFASGNLERDAWAIRYFVSEGFEFFCAQSFSKNFGLYNERVGNLTVVGKEPESILQVLSQMEKIVRITWSNPPAQGARIVASTLSNPELFEEWTGNVKTMADRILTMRSELRARLEALKTPGTWNHITDQIGMFSFTGLNPKQVEYLVNEKHIYLLPSGRINVSGLTTKNLDYVATSIHEAVTMCVPCLHKPTCTYHGLETLAGLKGCSGEAASV

SEQ ID NO: 862488 - protein, 413 aa, Homo sapiens; identical to SEQ ID NO: 862484

SEQ ID NO: 862489 - protein, 224 aa, Homo sapiens
LGKEGRCLRLVPEGFPALTHFASPQHRFLFPFFDSAYQGFASGNLERDAWAIRYFVSEGFEFFCAQSFSKNFGLYNERVGNLTVVGKEPESILQVLSQMEKIVRITWSNPPAQGARIVASTLSNPELFEEWTGNVKTMADRILTMRSELRARLEALKTPGTWNHITDQIGMFSFTGLNPKQVEYLVNEKHIYLLPSGRINVSGLTTKNLDYVATSIHEAVTKIQ

SEQ ID NO: 862490 - protein, 104 aa, Homo sapiens
MAPPSVFAEVPQAQPVLVFKLTADFREDPDPRKVNLGVGAYRTDDCHPWVLPVVKKVEQKIANDNSLNHEYLPILGLAEFRSCASRLALGDDSPALKEKRVSFG

SEQ ID NO: 862491 - protein, 78 aa, Homo sapiens
HPVQKSPDSSFSCPCVCLCLLGTYMYIPTGIRDSLLDMKGVCICVERSPSDINPFPHDRVTSPLKKRNIGRTVDCDAV

SEQ ID NO: 862492 - protein, 413 aa, Homo sapiens; identical to SEQ ID NO: 862484

SEQ ID NO: 862493 - protein, 413 aa, Homo sapiens; identical to SEQ ID NO: 862484

SEQ ID NO: 862494 - protein, 443 aa, Homo sapiens
MAPPSVFAEVPQAQPVLVFKLTADFREDPDPRKVNLGVGAYRTDDCHPWVLPVVKKVEQKIANDNSLNHEYLPILGLAEFRSCASRLALGDDSPALKEKRVGGVQSLGGTGALRIGADFLARWYNGTNNKNTPVYVSSPTWENHNAVFSAAGFKDIRSYRYWDAEKRGLDLQGFLNDLENAPEFSIVVLHACAHNPTGIDPTPEQWKQIASVMKHRFLFPFFDSAYQGFASGNLERDAWAIRYFVSEGFEFFCAQSFSKNFGLYSECSPEELQPHLLASLPASAATADSGPSLSDERVGNLTVVGKEPESILQVLSQMEKIVRITWSNPPAQGARIVASTLSNPELFEEWTGNVKTMADRILTMRSELRARLEALKTPGTWNHITDQIGMFSFTGLNPKQVEYLVNEKHIYLLPSGRINVSGLTTKNLDYVATSIHEAVTKIQ

SEQ ID NO: 862495 - protein, 220 aa, Homo sapiens
MAPPSVFAEVPQAQPVLVFKLTADFREDPDPRKVNLGVGAYRTDDCHPWVLPVVKKVEQKIANDNSLNHEYLPILGLAEFRSCASRLALGDDSPALKEKRVGGVQSLGGTGALRIGADFLARWYNGTNNKNTPVYVSSPTWENHNAVFSAAGFKDIRSYRYWDAEKRGLDLQGFLNDLENAPEFSIVVLHACAHNPTGIDPTPEQWKQIASVMKMRESGI

SEQ ID NO: 862496 - protein, 400 aa, Homo sapiens
MVNRVAKLWTRLDHWRPRARPRRLGEAYRTDDCHPWVLPVVKKVEQKIANDNSLNHEYLPILGLAEFRSCASRLALGDDSPALKEKRVGGVQSLGGTGALRIGADFLARWYNGTNNKNTPVYVSSPTWENHNAVFSAAGFKDIRSYRYWDAEKRGLDLQGFLNDLENAPEFSIVVLHACAHNPTGIDPTPEQWKQIASVMKHRFLFPFFDSAYQGFASGNLERDAWAIRYFVSEGFEFFCAQSFSKNFGLYNERVGNLTVVGKEPESILQVLSQMEKIVRITWSNPPAQGARIVASTLSNPELFEEWTGNVKTMADRILTMRSELRARLEALKTPGTWNHITDQIGMFSFTGLNPKQVEYLVNEKHIYLLPSGRINVSGLTTKNLDYVATSIHEAVTKIQ

SEQ ID NO: 862497 - protein, 254 aa, Homo sapiens
LGKEGRCLRLVPEGFPALTHFASPQHRFLFPFFDSAYQGFASGNLERDAWAIRYFVSEGFEFFCAQSFSKNFGLYSECSPEELQPHLLASLPASAATADSGPSLSDERVGNLTVVGKEPESILQVLSQMEKIVRITWSNPPAQGARIVASTLSNPELFEEWTGNVKTMADRILTMRSELRARLEALKTPGTWNHITDQIGMFSFTGLNPKQVEYLVNEKHIYLLPSGRINVSGLTTKNLDYVATSIHEAVTKIQ

SEQ ID NO: 862498 - protein, 68 aa, Homo sapiens
MAPPSVFAEVPQAQPVLVFKLTADFREDPDPRKVNLGVGGKDVVLWSVSSSGSGADPTQVVETVGEAE

SEQ ID NO: 862499 - protein, 313 aa, Homo sapiens
MGAVCTSGARSERTMTPVRMQHSLAGQTYAVPLIQPDLRREEAVQQMADALQYLQKVSGDIFSRISQRVEQSRSQVQAIGEKVSLAQAKIEKIKGSKKAIKVFSSAKYPAPERLQEYGSIFTGAQDPGLQRRPRHRIQSKHRPLDERALQEKLKDFPVCVSTKPEPEDDAEEGLGGLPSNISSVSSLLLFNTTENLYKKYVFLDPLAGAVTKTHVMLGAETEEKLFDAPLSISKREQLEQQVPENYFYVPDLGQVPEIDVPSYLPDLPGIANDLMYIADLGPGIAPSAPGTIPELPTFHTEVAEPLKTYKMGY

SEQ ID NO: 862500 - protein, 233 aa, Homo sapiens
MTPVRMQHSLAGQTYAVPLIQPDLRREEAVQQMADALQYLQKVSGDIFSRISQRVEQSRSQVQAIGEKVSLAQAKIEKIKGSKKAIKVFSSAKYPAPERLQEYGSIFTGAQDPGLQRRPRHRIQSKHRPLDERALQEKLKDFPVCVSTKPEPEDDAEEGLGGLPSNISSVSSLLLFNTTENLYKKYVFLDPLAGAVTKTHVMLGAETEEKLFDAPLSISPRELLLCARPGPGA

SEQ ID NO: 862501 - protein, 214 aa, Homo sapiens
MGAVCTSGARSERTMTPVRMQHSLAGQTYAVPLIQPDLRREEAVQQMADALQYLQKVSGDIFSRISQRVEQSRSQVQAIGEKVSLAQAKIEKIKGSKKAIKVFSSAKYPAPERLQEYGSIFTGAQDPGLQRRPRHRIQSKHRPLDERALQEKLKDFPVCVSTKPEPEDDAEEGLGGLPSNISSVSSLLLFNTTENLLYGQKAGPRGVGGRPGLA

SEQ ID NO: 862502 - protein, 379 aa, Homo sapiens
MTPVRMQHSLAGQTYAVPLIQPDLRREEAVQQMADALQYLQKVSGDIFSRISQRVEQSRSQVQAIGEKVSLAQAKIEKIKGSKKAIKVFSSAKYPAPERLQEYGSIFTGAQDPGLQRRPRHRIQSKHRPLDERALQEKLKDFPVCVSTKPEPEDDAEEGLGGLPSNISSVSSLLLFNTTENLLYGQKAGPRGVGGRPGWLSGDPGHQTQVQHMGQEPGGDWGGSAREAWDPKCTLLPLMMWERNMGSGQRVSACLTPCHLCRYKKYVFLDPLAGAVTKTHVMLGAETEEKLFDAPLSISKREQLEQQVPENYFYVPDLGQVPEIDVPSYLPDLPGIANDLMYIADLGPGIAPSAPGTIPELPTFHTEVAEPLKTYKMGY

SEQ ID NO: 862503 - protein, 299 aa, Homo sapiens
MTPVRMQHSLAGQTYAVPLIQPDLRREEAVQQMADALQYLQKVSGDIFSRISQRVEQSRSQVQAIGEKVSLAQAKIEKIKGSKKAIKVFSSAKYPAPERLQEYGSIFTGAQDPGLQRRPRHRIQSKHRPLDERALQEKLKDFPVCVSTKPEPEDDAEEGLGGLPSNISSVSSLLLFNTTENLYKKYVFLDPLAGAVTKTHVMLGAETEEKLFDAPLSISKREQLEQQVPENYFYVPDLGQVPEIDVPSYLPDLPGIANDLMYIADLGPGIAPSAPGTIPELPTFHTEVAEPLKTYKMGY

SEQ ID NO: 862504 - protein, 358 aa, Homo sapiens
MGAVCTSGARSERTMTPVRMQHSLAGQTYAVPLIQPDLRREEAVQQMADALQYLQKVSGDIFSRISQRVEQSRSQVQAIGEKVSLAQAKIEKIKGSKKAIKVFSSAKYPAPERLQEYGSIFTGAQDPGLQRRPRHRIQSKHRPLDERALQEKLKDFPVCVSTKPEPEDDAEEGLGGLPSNISSVSSLLLFNTTENLTPTAPTTPPAPEVLASAPPLPPSTAAPVGQGARQDDSSSSASPSVQGAPREVVDPSGGRATLLESIRQAGGIGKAKLRSMKERKLEKKKQKEQEQVRATSQGGHLMSDLFNKLVMRRKGISGKGPGAGEGPGGAFARVSDSIPPLPPPQQPQAEEDEDDWES

SEQ ID NO: 862505 - protein, 233 aa, Homo sapiens; identical to SEQ ID NO: 862500

SEQ ID NO: 862506 - protein, 299 aa, Homo sapiens; identical to SEQ ID NO: 862503

SEQ ID NO: 862507 - protein, 317 aa, Homo sapiens
MGAVCTSGARSERTMTPVRMQHSLAGQTYAVPLIQPDLRREEAVQQMADALQYLQKVSGDIFSRISQRVEQSRSQVQAIGEKVSLAQAKIEKIKGSKKAIKVFSSAKYPAPERLQEYGSIFTGAQDPGLQRRPRHRIQSKHRPLDERALQEKLKDFPVCVSTKPEPEDDAEEGLGGLPSNISSVSSLLLFNTTENLYKKYVFLDPLAGAVTKTHVMLGAETEEKLFDAPLSISSMKERKLEKKKQKEQEQVRATSQGGHLMSDLFNKLVMRRKGISGKGPGAGEGPGGAFARVSDSIPPLPPPQQPQAEEDEDDWES

SEQ ID NO: 862508 - protein, 106 aa, Homo sapiens [sequence omitted]

SEQ ID NO: 862509 - protein, 299 aa, Homo sapiens; identical to SEQ ID NO: 862503

SEQ ID NO: 862510 - protein, 299 aa, Homo sapiens; identical to SEQ ID NO: 862503

SEQ ID NO: 862511 - protein, 299 aa, Homo sapiens; identical to SEQ ID NO: 862503

SEQ ID NO: 862512 - protein, 254 aa, Homo sapiens
MAGSPISQRVEQSRSQVQAIGEKVSLAQAKIEKIKGSKKAIKVFSSAKYPAPERLQEYGSIFTGAQDPGLQRRPRHRIQSKHRPLDERALQEKLKDFPVCVSTKPEPEDDAEEGLGGLPSNISSVSSLLLFNTTENLYKKYVFLDPLAGAVTKTHVMLGAETEEKLFDAPLSISKREQLEQQVPENYFYVPDLGQVPEIDVPSYLPDLPGIANDLMYIADLGPGIAPSAPGTIPELPTFHTEVAEPLKTYKMGY

SEQ ID NO: 862513 - protein, 217 aa, Homo sapiens
MKEKKTTAGAGVSDEGAPGGRSQVFSSAKYPAPERLQEYGSIFTGAQDPGLQRRPRHRIQSKHRPLDERALQEKLKDFPVCVSTKPEPEDDAEEGLGGLPSNISSVSSLLLFNTTENLLYGQKAGPRGVGGRPGWLSGDPGHQTQVPENYFYVPDLGQVPEIDVPSYLPDLPGIANDLMYIADLGPGIAPSAPGTIPELPTFHTEVAEPLKTYKMGY

SEQ ID NO: 862514 - protein, 167 aa, Homo sapiens
MAFASFIEGIEVAGLIKVDAKQERNKPSTAAPVGQGARQDDSSSSASPSVQGAPREVVDPSGGRATLLESIRQAGGIGKAKLRSMKERKLEKKKQKEQEQVRATSQGGHLMSDLFNKLVMRRKGISGKGPGAGEGPGGAFARVSDSIPPLPPPQQPQAEEDEDDWES

SEQ ID NO: 862515 - protein, 194 aa, Homo sapiens [sequence omitted]

SEQ ID NO: 862516 - protein, 1304 aa, Homo sapiens
LPGPGSFAALGWANPERRSGTMWGSDRLAGAGGGGAAVTVAFTNARDCFLHLPRRLVAQLHLLQNQAIEVVWSHQPAFLSWVEGRHFSDQGENVAEINRQVGQKLGLSNGGQVFLKPCSHVVSCQQVEVEPLSADDWEILELHAVSLEQHLLDQIRIVFPKAIFPVWVDQQTYIFIQIVALIPAASYGRLETDTKLLIQPKTRRAKENTFSKADAEYKKLHSYGRDQKGMMKELQTKQLQSNTVGITESNENESEIPVDSSSVASLWTMIGSIFSFQSEKKQETSWGLTEINAFKNMQSKVVPLDNIFRVCKSQPPSIYNASATSVFHKHCAIHVFPWDQEYFDVEPSFTVTYGKLVKLLSPKQQQSKTKQNVLSPEKEKQMSEPLDQKKIRSDHNEEDEKACVLQVVWNGLEELNNAIKYTKNVEVLHLGKVWIPDDLRKRLNIEMHAVVRITPVEVTPKIPRSLKLQPRENLPKDISEEDIKTVFYSWLQQSTTTMLPLVISEEEFIKLETKDGLKEFSLSIVHSWEKEKDKNIFLLSPNLLQKTTIQVLLDPMVKEENSEEIDFILPFLKLSSLGGVNSLGVSSLEHITHSLLGRPLSRQLMSLVAGLRNGALLLTGGKGSGKSTLAKAICKEAFDKLDAHVERVDCKALRGKRLENIQKTLEVAFSEAVWMQPSVVLLDDLDLIAGLPAVPEHEHSPDAVQSQRLAHALNDMIKEFISMGSLVALIATSQSQQSLHPLLVSAQGVHIFQCVQHIQPPNQEQRCEILCNVIKNKLDCDINKFTDLDLQHVAKETGGFVARDFTVLVDRAIHSRLSRQSISTREKLVLTTLDFQKALRGFLPASLRSVNLHKPRDLGWDKIGGLHEVRQILMDTIQLPAKYPELFANLPIRQRTGILLYGPPGTGKTLLAGVIARESRMNFISVKGPELLSKYIGASEQAVRDIFIRAQAAKPCILFFDEFESIAPRRGHDNTGVTDRVVNQLLTQLDGVEGLQGVYVLAATSRPDLIDPALLRPGRLDKCVYCPPPDQVSRLEILNVLSDSLPLADDVDLQHVASVTDSFTGADLKALLYNAQLEALHGMLLSSGLQDGSSSSDSDLSLSSMVFLNHSSGSDDSAGDGECGLDQSLVSLEMSEILPDESKFNMYRLYFGSSYESELGNGTSSDLSSQCLSAPSSMTQDLPGVPGKDQLFSQPPVLRTASQEGCQELTQEQRDQLRADISIIKGRYRSQSGEDESMNQPGPIKTRLAISQSHLMTALGHTRPSISEDDWKNFAELYESFQNPKRRKNQSGTMFRPGQKVTLA

SEQ ID NO: 862517 - protein, 1304 aa, Homo sapiens; identical to SEQ ID NO: 862516

SEQ ID NO: 862518 - protein, 1247 aa, Homo sapiens
LPGPGSFAALGWANPERRSGTMWGSDRLAGAGGGGAAVTVAFTNARDCFLHLPRRLVAQLHLLQNQAIEVVWSHQPAFLSWVEGRHFSDQGENVAEINRQVGQKLGLSNGGQVFLKPCSHVVSCQQVEVEPLSADDWEILELHAVSLEQHLLDQIRIVFPKAIFPVWVDQQTYIFIQIVALIPAASYGRLETDTKLLIQPKTRRAKENTFSKADAEYKKLHSYGRDQKGMMKELQTKQLQSNTVGITESNENESEIPVDSSSVASLWTMIGSIFSFQSEKKQETSWGLTEINAFKNMQSKVVPLDNIFRVCKSQPPSIYNASATSVFHKHCAIHVFPWDQEYFDVEPSFTVTYGKLVKLLSPKQQQSKTKQNVLSPEKEKQMSEPLDQKKIRSDHNEEDEKACVLQVVWNGLEELNNAIKYTKNVEVLHLGKVWIPDDLRKRLNIEMHAVVRITPVEVTPKIPRSLKLQPRENLPKDISEEDIKTVFYSWLQQSTTTMLPLVISEEEFIKLETKDGLKEFSLSIVHSWEKEKDKNIFLLSPNLLQKTTIQVLLDPMVKEENSEEIDFILPFLKLSSLGGVNSLGVSSLEHITHSLLGRPLSRQLMSLVAGLRNGALLLTGGKGSGKSTLAKAICKEAFDKLDAHVERVDCKALRALNDMIKEFISMGSLVALIATSQSQQSLHPLLVSAQGVHIFQCVQHIQPPNQEQRCEILCNVIKNKLDCDINKFTDLDLQHVAKETGGFVARDFTVLVDRAIHSRLSRQSISTREKLVLTTLDFQKALRGFLPASLRSVNLHKPRDLGWDKIGGLHEVRQILMDTIQLPAKYPELFANLPIRQRTGILLYGPPGTGKTLLAGVIARESRMNFISVKGPELLSKYIGASEQAVRDIFIRAQAAKPCILFFDEFESIAPRRGHDNTGVTDRVVNQLLTQLDGVEGLQGVYVLAATSRPDLIDPALLRPGRLDKCVYCPPPDQVSRLEILNVLSDSLPLADDVDLQHVASVTDSFTGADLKALLYNAQLEALHGMLLSSGLQDGSSSSDSDLSLSSMVFLNHSSGSDDSAGDGECGLDQSLVSLEMSEILPDESKFNMYRLYFGSSYESELGNGTSSDLSSQCLSAPSSMTQDLPGVPGKDQLFSQPPVLRTASQEGCQELTQEQRDQLRADISIIKGRYRSQSGEDESMNQPGPIKTRLAISQSHLMTALGHTRPSISEDDWKNFAELYESFQNPKRRKNQSGTMFRPGQKVTLA

SEQ ID NO: 862519 - protein, 749 aa, Homo sapiens [sequence omitted]

SEQ ID NO: 862520 - protein, 1256 aa, Homo sapiens
MWGSDRLAGAGGGGAAVTVAFTNARDCFLHLPRRLVAQLHLLQNQAIEVVWSHQPAFLSWVEGRHFSDQGENVAEINRQVGQKLGLSNGGQVFLKPCSHVVSCQQVEVEPLSADDWEILELHAVSLEQHLLDQIRIVFPKAIFPVWVDQQTYIFIQIVALIPAASYGRLETDTKLLIQPKTRRAKENTFSKADAEYKKLHSYGRDQKGMMKELQTKQLQSNTVGITESNENESEIPVDSSSVASLWTMIGSIFSFQSEKKQETSWGLTEINAFKNMQSKVVPLDNIFRVCKSQPPSIYNASATSVFHKHCAIHVFPWDQEYFDVEPSFTVTYGKLVKLLSPKQQQSKTKQNVLSPEKEKQMSEPLDQKKIRSDHNEEDEKACVLQVVWNGLEELNNAIKYTKNVEVLHLGKVWIPDDLRKRLNIEMHAVVRITPVEVTPKIPRSLKLQPRENLPKDISEEDIKTVFYSWLQQSTTTMLPLVISEEEFIKLETKDGLKEFSLSIVHSWEKEKDKNIFLLSPNLLQKTTIQVLLDPMVKEENSEEIDFILPFLKLSSLGGVNSLGVSSLEHITHSLLGRPLSRQLMSLVAGLRNGALLLTGGKGSGKSTLAKAICKEAFDKLDAHVERVDCKALRGKRLENIQKTLEVAFSEAVWMQPSVVLLDDLDLIAGLPAVPEHEHSPDAVQSQRLAHALNDMIKEFISMGSLVALIATSQSQQSLHPLLVSAQGVHIFQCVQHIQPPNQEQRCEILCNVIKNKLDCDINKFTDLDLQHVAKETGGFVARDFTVLVDRAIHSRLSRQSISTREKLVLTTLDFQKALRGFLPASLRSVNLHKPRDLGWDKIGGLHEVRQILMDTIQLPAKYPELFANLPIRQRTGILLYGPPGTGKTLLAGVIARESRMNFISVKGPELLSKYIGASEQAVRDIFIRAQAAKPCILFFDEFESIAPRRGHDNTGVTDRVVNQLLTQLDGVEGLQGVYVLAATSRPDLIDPALLRPGRLDKCVYCPPPDQVSRLEILNVLSDSLPLADDVDLQHVASVTDSFTGADLKALLYNAQLEALHGMLLSSGLQDGSSSSDSDLSLSSMVFLNHSSGSDDSAGDGECGLDQSLVSLEMSEILPDESKFNMYRLYFGSSYESELGNGTSSDLSSQCLSAPSSMTQDLPGVPGKDQLFSQPPVLRTASQEGCQELTQEQRDQLRADISIIKGRYRSQSGEDESMNQPGPIKTRLAISQSHLMTALGHTRPSISEDDWKNFAEL

SEQ ID NO: 862521 - protein, 1007 aa, Homo sapiens
LPGPGSFAALGWANPERRSGTMWGSDRLAGAGGGGAAVTVAFTNARDCFLHLPRRLVAQLHLLQNQAIEVVWSHQPAFLSWVEGRHFSDQGENVAEINRQVGQKLGLSNGGQVFLKPCSHVVSCQQVEVEPLSADDWEILELHAVSLEQHLLDQIRIVFPKAIFPVWVDQQTYIFIQIVALIPAASYGRLETDTKLLIQPKTRRAKENTFSKADAEYKKLHSYGRDQKGMMKELQTKQLQSNTVGITESNENESEIPVDSSSVASLWTMIGSIFSFQSEKKQETSWGLTEINAFKNMQSKVVPLDNIFRVCKSQPPSIYNASATSVFHKHCAIHVFPWDQEYFDVEPSFTVTYGKLVKLLSPKQQQSKTKQNVLSPEKEKQMSEPLDQKKIRSDHNEEDEKACVLQVVWNGLEELNNAIKYTKNVEVLHLGKVWIPDDLRKRLNIEMHAVVRITPVEVTPKIPRSLKLQPRENLPKDISEEDIKTVFYSWLQQSTTTMLPLVISEEEFIKLETKDGLKEFSLSIVHSWEKEKDKNIFLLSPNLLQKTTIQVLLDPMVKEENSEEIDFILPFLKLSSLGGVNSLGVSSLEHITHSLLGRPLSRQLMSLVAGLRNGALLLTGGKGSGKSTLAKAICKEAFDKLDAHVERVDCKALRGKRLENIQKTLEVAFSEAVWMQPSVVLLDDLDLIAGLPAVPEHEHSPDAVQSQRLAHALNDMIKEFISMGSLVALIATSQSQQSLHPLLVSAQGVHIFQCVQHIQPPNQEQRCEILCNVIKNKLDCDINKFTDLDLQHVAKETGGFVARDFTVLVDRAIHSRLSRQSISTREKLVLTTLDFQKALRGFLPASLRSVNLHKPRDLGWDKIGGLHEVRQILMDTIQLPAKYPELFANLPIRQRTGILLYGPPGTGKTLLAGVIARESRMNFISVKGPELLSKYIGASEQAVRDIFIRAQAAKPCILFFDEFESIAPRRGHDNTGVTDRVVNQLLTQLDGVEGLQGNNYKYRNRML

SEQ ID NO: 862522 - protein, 831 aa, Homo sapiens
LPGPGSFAALGWANPERRSGTMWGSDRLAGAGGGGAAVTVAFTNARDCFLHLPRRLVAQLHLLQNQAIEVVWSHQPAFLSWVEGRHFSDQGENVAEINRQVGQKLGLSNGGQVFLKPCSHVVSCQQVEVEPLSADDWEILELHAVSLEQHLLDQIRIVFPKAIFPVWVDQQTYIFIQIVALIPAASYGRLETDTKLLIQPKTRRAKENTFSKADAEYKKLHSYGRDQKGMMKELQTKQLQSNTVGITESNENESEIPVDSSSVASLWTMIGSIFSFQSEKKQETSWGLTEINAFKNMQSKVVPLDNIFRVCKSQPPSIYNASATSVFHKHCAIHVFPWDQEYFDVEPSFTVTYGKLVKLLSPKQQQSKTKQNVLSPEKEKQMSEPLDQKKIRSDHNEEDEKACVLQVVWNGLEELNNAIKYTKNVEVLHLGKVWIPDDLRKRLNIEMHAVVRITPVEVTPKIPRSLKLQPRENLPKDISEEDIKTVFYSWLQQSTTTMLPLVISEEEFIKLETKDGLKEFSLSIVHSWEKEKDKNIFLLSPNLLQKTTIQVLLDPMVKEENSEEIDFILPFLKLSSLGGVNSLGVSSLEHITHSLLGRPLSRQLMSLVAGLRNGALLLTGGKGSGKSTLAKAICKEAFDKLDAHVERVDCKALRGKRLENIQKTLEVAFSEAVWMQPSVVLLDDLDLIAGLPAVPEHEHSPDAVQSQRLAHALNDMIKEFISMGSLVALIATSQSQQSLHPLLVSAQGVHIFQCVQHIQPPNQEQRCEILCNVIKNKLDCDINKFTDLDLQHVAKETGGFVARDFTVLVDRAIHSRLSRQSISTRESMFYY

SEQ ID NO: 862523 - protein, 448 aa, Homo sapiens
LPGPGSFAALGWANPERRSGTMWGSDRLAGAGGGGAAVTVAFTNARDCFLHLPRRLVAQLHLLQNQAIEVVWSHQPAFLSWVEGRHFSDQGENVAEINRQVGQKLGLSNGGQVFLKPCSHVVSCQQVEVEPLSADDWEILELHAVSLEQHLLDQIRIVFPKAIFPVWVDQQTYIFIQIVALIPAASYGRLETDTKLLIQPKTRRAKENTFSKADAEYKKLHSYGRDQKGMMKELQTKQLQSNTVGITESNENESEIPVDSSSVASLWTMIGSIFSFQSEKKQETSWGLTEINAFKNMQSKVVPLDNIFRVCKSQPPSIYNASATSVFHKHCAIHVFPWDQEYFDVEPSFTVTYGKLVKLLSPKQQQSKTKQNVLSPEKEKQMSEPLDQKKIRSDHNEEDEKACVLQVVWNGLEELNNAIKYTKNVEVLHLGKVWVSINFITWEKFYVA

SEQ ID NO: 862524 - protein, 1304 aa, Homo sapiens; identical to SEQ ID NO: 862516

SEQ ID NO: 862525 - protein, 1304 aa, Homo sapiens; identical to SEQ ID NO: 862516

SEQ ID NO: 862526 - protein, 1243 aa, Homo sapiens
LPGPGSFAALGWANPERRSGTMWGSDRLAGAGGGGAAVTVAFTNARDCFLHLPRRLVAQLHLLQNQAIEVVWSHQPAFLSWVEGRHFSDQGENVAEINRQVGQKLGLSNGGQVFLKPCSHVVSCQQVEVEPLSADDWEILELHAVSLEQHLLDQIRIVFPKAIFPVWVDQQTYIFIQIVALIPAASYGRLETDTKLLIQPKTRRAKENTFSKADAEYKKLHSYGRDQKGMMKELQTKQLQSNTVGITESNENESEIPVDSSSVASLWTMIGSIFSFQSEKKQETSWGLTEINAFKNMQSKVVPLDNIFRVCKSQPPSIYNASATSVFHKHCAIHVFPWDQEYFDVEPSFTVTYGKLVKLLSPKQQQSKTKQNVLSPEKEKQMSEPLDQKKIRSDHNEEDEKACVLQVVWNGLEELNNAIKYTKNVEVLHLGKVWIPDDLRKRLNIEMHAVVRITPVEVTPKIPRSLKLQPRENLPKDISEEDIKTVFYSWLQQSTTTMLPLVISEEEFIKLETKDGLKEFSLSIVHSWEKEKDKNIFLLSPNLLQKTTIQVLLDPMVKEENSEEIDFILPFLKLSSLGGVNSLGVSSLEHITHSLLGRPLSRQLMSLVAGLRNGALLLTGGKGSGKSTLAKAICKEAFDKLDAHVERVDCKALRGKRLENIQKTLEVAFSEAVWMQPSVVLLDDLDLIAGLPAVPEHEHSPDAVQSQRLAHALNDMIKEFISMGSLVALIATSQSQQSLHPLLVSAQGVHIFQCVQHIQPPNQEQRCEILCNVIKNKLDCDINKFTDLDLQHVAKETGGFVARDFTVLVDRAIHSRLSRQSISTREKLVLTTLDFQKALRGFLPASLRSVNLHKPRDLGWDKIGGLHEVRQILMDTIQLPAKYPELFANLPIRQRTGILLYGPPGTGKTLLAGVIARESRMNFISVKGPELLSKYIGASEQAVRDIFIRAQAAKPCILFFDEFESIAPRRGHDNTGVTDRVVNQLLTQLDGVEGLQGVYVLAATSRPDLIDPALLRPGRLDKCVYCPPPDQVSRLEILNVLSDSLPLADDVDLQHVASVTDSFTGADLKALLYNAQLEALHGMLLSSGLQDGSSSSDSDLSLSSMVFLNHSSGSDDSAGDGECGLDQSLVSLEMSEILPDESKFNMYRLYFGSSYESELGNGTSSDLSSQCLSAPSSMTQDLPGVPGKDQLFSQPPVLRTASQEGCQELTQEQRDQLRADISIIKGRYRSQSGVWLFPPHYNC

SEQ ID NO: 862527 - protein, 222 aa, Homo sapiens
MLLSSGLQDGSSSSDSDLSLSSMVFLNHSSGSDDSAGDGECGLDQSLVSLEMSEILPDESKFNMYRLYFGSSYESELGNGTSSDLSSQCLSAPSSMTQDLPGVPGKDQLFSQPPVLRTASQEGCQELTQEQRDQLRADISIIKGRYRSQSGEDESMNQPGPIKTRLAISQSHLMTALGHTRPSISEDDWKNFAELYESFQNPKRRKNQSGTMFRPGQKVTLA

SEQ ID NO: 862528 - protein, 1056 aa, Homo sapiens
LPGPGSFAALGWANPERRSGTMWGSDRLAGAGGGGAAVTVAFTNARDCFLHLPRRLVAQLHLLQNQAIEVVWSHQPAFLSWVEGRHFSDQGENVAEINRQVGQKLGLSNGGQVFLKPCSHVVSCQQVEVEPLSADDWEILELHAVSLEQHLLDQIRIVFPKAIFPVWVDQQTYIFIQIVALIPAASYGRLETDTKLLIQPKTRRAKENTFSKADAEYKKLHSYGRDQKGMMKELQTKQLQSNTVGITESNENESEIPVDSSSVASLWTMIGSIFSFQSEKKQETSWGLTEINAFKNMQSKVVPLDNIFRVCKSQPPSIYNASATSVFHKHCAIHVFPWDQEYFDVEPSFTVTYGKLVKLLSPKQQQSKTKQNVLSPEKEKQMSEPLDQKKIRSDHNEEDEKACVLQVVWNGLEELNNAIKYTKNVEVLHLGKVWIPDDLRKRLNIEMHAVVRITPVEVTPKIPRSLKLQPRENLPKDISEEDIKTVFYSWLQQSTTTMLPLVISEEEFIKLETKDGLKEFSLSIVHSWEKEKDKNIFLLSPNLLQKTTIQVLLDPMVKEENSEEIDFILPFLKLSSLGGVNSLGVSSLEHITHSLLGRPLSRQLMSLVAGLRNGALLLTGGKGSGKSTLAKAICKEAFDKLDAHVERVDCKALRGKRLENIQKTLEVAFSEAVWMQPSVVLLDDLDLIAGLPAVPEHEHSPDAVQSQRLAHALNDMIKEFISMGSLVALIATSQSQQSLHPLLVSAQGVHIFQCVQHIQPPNQEQRCEILCNVIKNKLDCDINKFTDLDLQHVAKETGGFVARDFTVLVDRAIHSRLSRQSISTREKLVLTTLDFQKALRGFLPASLRSVNLHKPRDLGWDKIGGLHEVRQILMDTIQLPAKYPELFANLPIRQRTGILLYGPPGTGKTLLAGVIARESRMNFISVKGPELLSKYIGASEQAVRDIFIRAQAAKPCILFFDEFESIAPRRGHDNTGVTDRVVNQLLTQLDGVEGLQGVYVLAATSRPDLIDPALLRPGRLDKCVYCPPPDQVTISYLESKTQQMLHSFLVSFTSAR

SEQ ID NO: 862529 - protein, 1098 aa, Homo sapiens
LPGPGSFAALGWANPERRSGTMWGSDRLAGAGGGGAAVTVAFTNARDCFLHLPRRLVAQLHLLQNQAIEVVWSHQPAFLSWVEGRHFSDQGENVAEINRQVGQKLGLSNGGQVFLKPCSHVVSCQQVEVEPLSADDWEILELHAVSLEQHLLDQIRIVFPKAIFPVWVDQQTYIFIQIVALIPAASYGRLETDTKLLIQPKTRRAKENTFSKADAEYKKLHSYGRDQKGMMKELQTKQLQSNTVGITESNENESEIPVDSSSVASLWTMIGSIFSFQSEKKQETSWGLTEINAFKNMQSKVVPLDNIFRVCKSQPPSIYNASATSVFHKHCAIHVFPWDQEYFDVEPSFTVTYGKLVKLLSPKQQQSKTKQNVLSPEKEKQMSEPLDQKKIRSDHNEEDEKACVLQVVWNGLEELNNAIKYTKNVEVLHLGKVWIPDDLRKRLNIEMHAVVRITPVEVTPKIPRSLKLQPRENLPKDISEEDIKTVFYSWLQQSTTTMLPLVISEEEFIKLETKDGLKEFSLSIVHSWEKEKDKNIFLLSPNLLQKTTIQVLLDPMVKEENSEEIDFILPFLKLSSLGGVNSLGVSSLEHITHSLLGRPLSRQLMSLVAGLRNGALLLTGGKGSGKSTLAKAICKEAFDKLDAHVERVDCKALRGKRLENIQKTLEVAFSEAVWMQPSVVLLDDLDLIAGLPAVPEHEHSPDAVQSQRLAHALNDMIKEFISMGSLVALIATSQSQQSLHPLLVSAQGVHIFQCVQHIQPPNQEQRCEILCNVIKNKLDCDINKFTDLDLQHVAKETGGFVARDFTVLVDRAIHSRLSRQSISTREKLVLTTLDFQKALRGFLPASLRSVNLHKPRDLGWDKIGGLHEVRQILMDTIQLPAKYPELFANLPIRQRTGILLYGPPGTGKTLLAGVIARESRMNFISVKGPELLSKYIGASEQAVRDIFIRAQAAKPCILFFDEFESIAPRRGHDNTGVTDRVVNQLLTQLDGVEGLQGVYVLAATSRPDLIDPALLRPGRLDKCVYCPPPDQVSRLEILNVLSDSLPLADDVDLQHVASVTDSFTGADLKALLYNAQLEALHGMLLSSGLQASYMRKLL

SEQ ID NO: 862530 - protein, 844 aa, Homo sapiens
LPGPGSFAALGWANPERRSGTMWGSDRLAGAGGGGAAVTVAFTNARDCFLHLPRRLVAQLHLLQNQAIEVVWSHQPAFLSWVEGRHFSDQGENVAEINRQVGQKLGLSNGGQVFLKPCSHVVSCQQVEVEPLSADDWEILELHAVSLEQHLLDQIRIVFPKAIFPVWVDQQTYIFIQIVALIPAASYGRLETDTKLLIQPKTRRAKENTFSKADAEYKKLHSYGRDQKGMMKELQTKQLQSNTVGITESNENESEIPVDSSSVASLWTMIGSIFSFQSEKKQETSWGLTEINAFKNMQSKVVPLDNIFRVCKSQPPSIYNASATSVFHKHCAIHVFPWDQEYFDVEPSFTVTYGKLVKLLSPKQQQSKTKQNVLSPEKEKQMSEPLDQKKIRSDHNEEDEKACVLQVVWNGLEELNNAIKYTKNVEVLHLGKVWIPDDLRKRLNIEMHAVVRITPVEVTPKIPRSLKLQPRENLPKDISEEDIKTVFYSWLQQSTTTMLPLVISEEEFIKLETKDGLKEFSLSIVHSWEKEKDKNIFLLSPNLLQKTTIQVLLDPMVKEENSEEIDFILPFLKLSSLGGVNSLGVSSLEHITHSLLGRPLSRQLMSLVAGLRNGALLLTGGKGSGKSTLAKAICKEAFDKLDAHVERVDCKALRGKRLENIQKTLEVAFSEAVWMQPSVVLLDDLDLIAGLPAVPEHEHSPDAVQSQRLAHALNDMIKEFISMGSLVALIATSQSQQSLHPLLVSAQGVHIFQCVQHIQPPNQEQRCEILCNVIKNKLDCDINKFTDLDLQHVAKETGGFVARDFTVLVDRAIHSRLSRQSISTREKIFEKLEFPKKGPPRNYF

SEQ ID NO: 862531 - protein, 1208 aa, Homo sapiens
SSWPGREKGLERAWPLRGMEGTEAAAAKPAGGSPQGPKTGSGTASPVEGTSAVEWSGPEPQLDNGHPPRPWPCPQENRTSSLMAPQPPRVWGVQLQGPSVLESKVRALKEKMTVAKQGVSPCSASQEWSSPKKPQCRRGKAGRAGTPSEGSFLPGAVVAPRTQNLPDGQLDGSINEEQPARDGGPRLPRPPAPGREYCNRGSPWPPEAEWTLPDHDRGPLLGPSSLQQSPIHGVTPGRPGGPGHCNKIIHIPSPRTGRSYPFPDGVVTEADLDSTSLTSEEVFVPRTALLGERWRAGDLEALGAGSSVLSLSDRVERNRLLLQEMLNVSGQSPRKVGTPAWTPSWDTAAPERPVGDVDWASGTSLQDSGQNRTVGPNPEPVLSPRHEEATHLLQRARMKARTRPLRASHDIVPTITQGSRDGHRSPARDPRTTPACRDSLQNGHTSDSSSGESSGGHRPRRGPSPSHVRFEDESAREAEFRHLERLQQRQRQVLSTVLQAADQGPLRSKPDLADYINGAPRLRDAGQGTFHRLVGSLDRRGHPAPPAPGSERRCQACGSCIDDPRPAQGKAPPVPRTLQELQAACGMERVLGGLSSPLRLLPAEPRLHMEWIRETHIGDTVCPAEVDSALDSTDNSDNCRTDSEEAGTSQAGWACGRTQGSSPRLRLRGSRPRGHRWSKKAEAELPWGLQAQQHLPRADDVEVENEVKEGRGHTPEGTLFLREDAKPPDLELKRVSLGPQWQPGPGLGSHQPHPLDSRTPCRTAYATTAPMTPESSGPGGQAQVTESHESLEIVSPSSLQQSHAEPSAPHQAWQPTASLCPEGWAPTPPPSRKTTSPVSHRKAALAGLLRLGDQTEPVGIPRPPSRSAVLRTCELPPSQTQPSRPQVRHPLLALSTNNCNNSAPRGLQEPYGGAVHEGRVERGPCSREPEPPLENSRDGGPQGFLGSADVATINSTGITLSLSSEESESSKESEGSLQRTGSGSGGHVLSRASAGAGTGPGSPSAAPLDQNKKRSSSIASTLGLKKLFSALGQSSRPKLGKSRSYSVEQLQPAPPGLTSQSRAPSLQSLHPVSPSHQRRKAASFQNLHSLLSSKGDRSSLYLVAGPGDHSAAGRPAKTSPRRALSVEDVGAPSLARTVGRLVEVFPDGTSQLQLQRSPGGTFGFCVASGNGRPDSGMPSPLPQPHGWGGLSKQGRAFWLWSEAFLVFG

SEQ ID NO: 862532 - protein, 1239 aa, Homo sapiens
SSWPGREKGLERAWPLRGMEGTEAAAAKPAGGSPQGPKTGSGTASPVEGTSAVEWSGPEPQLDNGHPPRPWPCPQENRTSSLMAPQPPRVWGVQLQGPSVLESKVRALKEKMTVAKQGVSPCSASQEWSSPKKPQCRRGKAGRAGTPSEGSFLPGAVVAPRTQNLPDGQLDGSINEEQPARDGGPRLPRPPAPGREYCNRGSPWPPEAEWTLPDHDRGPLLGPSSLQQSPIHGVTPGRPGGPGHCNKIIHIPSPRTGRSYPFPDGVVTEADLDSTSLTSEEVFVPRTALLGERWRAGDLEALGAGSSVLSLSDRVERNRLLLQEMLNVSGQSPRKVGTPAWTPSWDTAAPERPVGDVDWASGTSLQDSGQNRTVGPNPEPVLSPRHEEATHLLQRARMKARTRPLRASHDIVPTITQGSRDGHRSPARDPRTTPACRDSLQNGHTSDSSSGESSGGHRPRRGPSPSHVRFEDESAREAEFRHLERLQQRQRQVLSTVLQAADQGPLRSKPDLADYINGAPRLRDAGQGTFHRLVGSLDRRGHPAPPAPGSERRCQACGSCIDDPRPAQGKAPPVPRTLQELQAACGMERVLGGLSSPLRLLPAEPRLHMEWIRETHIGDTVCPAEVDSALDSTDNSDNCRTDSEEAGTSQAGWACGRTQGSSPRLRLRGSRPRGHRWSKKAEAELPWGLQAQQHLPRADDVEVENEVKEGRGHTPEGTLFLREDAKPPDLELKRVSLGPQWQPGPGLGSHQPHPLDSRTPCRTAYATTAPMTPESSGPGGQAQVTESHESLEIVSPSSLQQSHAEPSAPHQAWQPTASLCPEGWAPTPPPSRKTTSPVSHRKAALAGLLRLGDQTEPVGIPRPPSRSAVLRTCELPPSQTQPSRPQVRHPLLALSTNNCNNSAPRGLQEPYGGAVHEGRVERGPCSREPEPPLENSRDGGPQGFLGSADVATINSTGITLSLSSEESESSKESEGSLQRTGSGSGGHVLSRASAGAGTGPGSPSAAPLDQNKKRSSSIASTLGLKKLFSALGQSSRPKLGKSRSYSVEQLQPAPPGLTSQSRAPSLQSLHPVSPSHQRRKAASFQNLHSLLSSKGDRSSLYLVAGPGDHSAAGRPAKTSPRRALSVEDVGAPSLARTVGRLVEVFPDGTSQLQLQRSPGGTFGFCVASGNGRPDSGIYVQEMADMSMAKLYSGLLGVGDEILEVNGAKVAGLGLAHIKELLAHSESLSIRVLRQRPVPR

SEQ ID NO: 862533 - protein, 720 aa, Homo sapiens
SSWPGREKGLERAWPLRGMEGTEAAAAKPAGGSPQGPKTGSGTASPVEGTSAVEWSGPEPQLDNGHPPRPWPCPQENRTSSLMAPQPPRVWGVQLQGPSVLESKVRALKEKMTVAKQGVSPCSASQEWSSPKKPQCRRGKAGRAGTPSEGSFLPGAVVAPRTQNLPDGQLDGSINEEQPARDGGPRLPRPPAPGREYCNRGSPWPPEAEWTLPDHDRGPLLGPSSLQQSPIHGVTPGRPGGPGHCNKIIHIPSPRTGRSYPFPDGVVTEADLDSTSLTSEEVFVPRTALLGERWRAGDLEALGAGSSVLSLSDRVERNRLLLQEMLNVSGQSPRKVGTPAWTPSWDTAAPERPVGDVDWASGTSLQDSGQNRTVGPNPEPVLSPRHEEATHLLQRARMKARTRPLRASHDIVPTITQGSRGPQGFLGSADVATINSTGITLSLSSEESESSKESEGSLQRTGSGSGGHVLSRASAGAGTGPGSPSAAPLDQNKKRSSSIASTLGLKKLFSALGQSSRPKLGKSRSYSVEQLQPAPPGLTSQSRAPSLQSLHPVSPSHQRRKAASFQNLHSLLSSKGDRSSLYLVAGPGDHSAAGRPAKTSPRRALSVEDVGAPSLARTVGRLVEVFPDGTSQLQLQRSPGGTFGFCVASGNGRPDSGIYVQEMADMSMAKLYSGLLGVGDEILEVNGAKVAGLGLAHIKELLAHSESLSIRVLRQRPVPR

SEQ ID NO: 862534 - protein, 218 aa, Homo sapiens
MVVPVEFLEAMIKACAVTFLQGPQVHGGAKSSVSTSQVAFLTRNIVPFSSGVTLSPASESCLFSEPPFSAEQQGGPVQPLPGSRARGPQCSWQAGQDFTTACPQCGGVGAPSLARTVGRLVEVFPDGTSQLQLQRSPGGTFGFCVASGNGRPDSGIYVQEMADMSMAKLYSGLLGVGDEILEVNGAKVAGLGLAHIKELLAHSESLSIRVLRQRPVPR

SEQ ID NO: 862535 - protein, 623 aa, Homo sapiens
MTAQSRSPTTPTFPGPSQRTPLTPCPVQTPRLGKALIHCWTDPGQPLGEQQRVRRQRTETSEPTMRLHRLRARLSAVACGLLLLLVRGQGQDSASPIRTTHTGQVLGSLVHVKGANAGVQTFLGIPFAKPPLGPLRFAPPEPPESWSGVRDGTTHPAMCLQDLTAVESEFLSQFNMTFPSDSMSEDCLYLSIYTPAHSHEGSNLPVMVWIHGGALVFGMASLYDGSMLAALENVVVVIIQYRLGVLGFFSTGDKHATGNWGYLDQVAALRWVQQNIAHFGGNPDRVTIFGESAGGTSVSSLVVSPISQGLFHGAIMESGVALLPGLIASSADVISTVVANLSACDQVDSEALVGCLRGKSKEEILAINKPFKMIPGVVDGVFLPRHPQELLASADFQPVPSIVGVNNNEFGWLIPKVMRIYDTQKEMDREASQAALQKMLTLLMLPPTFGDLLREEYIGDNGDPQTLQAQFQEMMADSMFVIPALQVAHFQCSRAPVYFYEFQHQPSWLKNIRPPHMKADHGDELPFVFRSFFGGNYIKFTEEEEQLSRKMMKYWANFARNGNPNGEGLPHWPLFDQEEQYLQLNLQPAVGRALKAHRLQFWKKALPQKIQELEEPEERHTEL

SEQ ID NO: 862536 - protein, 592 aa, Homo sapiens
EPRPADTLLFDPGQPLGEQQRVRRQRTETSEPTMRLHRLRARLSAVACGLLLLLVRGQGQDSASPIRTTHTGQVLGSLVHVKGANAGVQTFLGIPFAKPPLGPLRFAPPEPPESWSGVRDGTTHPAMCLQDLTAVESEFLSQFNMTFPSDSMSEDCLYLSIYTPAHSHEGSNLPVMVWIHGGALVFGMASLYDGSMLAALENVVVVIIQYRLGVLGFFSTGDKHATGNWGYLDQVAALRWVQQNIAHFGGNPDRVTIFGESAGGTSVSSLVVSPISQGLFHGAIMESGVALLPGLIASSADVISTVVANLSACDQVDSEALVGCLRGKSKEEILAINKPFKMIPGVVDGVFLPRHPQELLASADFQPVPSIVGVNNNEFGWLIPKVMRIYDTQKEMDREASQAALQKMLTLLMLPPTFGDLLREEYIGDNGDPQTLQAQFQEMMADSMFVIPALQVAHFQCSRAPVYFYEFQHQPSWLKNIRPPHMKADHGDELPFVFRSFFGGNYIKFTEEEEQLSRKMMKYWANFARNGNPNGEGLPHWPLFDQEEQYLQLNLQPAVGRALKAHRLQFWKKALPQKIQELEEPEERHTEL

SEQ ID NO: 862537 - protein, 678 aa, Homo sapiens
MTAQSRSPTTPTFPGPSQRTPLTPCPVQTPRLGKALIHCWTDPGQPLGEQQRVRRQRTETSEPTMRLHRLRARLSAVACGLLLLLVRGQGEAPSEGRQGPGSDLPNAAEAEPDSAGGQAAWEVGAGGDDSVELVSPTQRLPAAQGQDSASPIRTTHTGQVLGSLVHVKGANAGVQTFLGIPFAKPPLGPLRFAPPEPPESWSGVRDGTTHPAMCLQDLTAVESEFLSQFNMTFPSDSMSEDCLYLSIYTPAHSHEGSNLPVMVWIHGGALVFGMASLYDGSMLAALENVVVVIIQYRLGVLGFFSTGDKHATGNWGYLDQVAALRWVQQNIAHFGGNPDRVTIFGESAGGTSVSSLVVSPISQGLFHGAIMESGVALLPGLIASSADVISTVVANLSACDQVDSEALVGCLRGKSKEEILAINKPFKMIPGVVDGVFLPRHPQELLASADFQPVPSIVGVNNNEFGWLIPKVMRIYDTQKEMDREASQAALQKMLTLLMLPPTFGDLLREEYIGDNGDPQTLQAQFQEMMADSMFVIPALQVAHFQCSRAPVYFYEFQHQPSWLKNIRPPHMKADHGDELPFVFRSFFGGNYIKFTEEEEQLSRKMMKYWANFARNGNPNGEGLPHWPLFDQEEQYLQLNLQPAVGRALKAHRLQFWKKALPQKIQELEEPEERHTEL

SEQ ID NO: 862538 - protein, 748 aa, Homo sapiens
MTAQSRSPTTPTFPGPSQRTPLTPCPVQTPRLGKALIHCWTDPGQPLGEQQRVRRQRTETSEPTMRLHRLRARLSAVACGLLLLLVRGQGQDSASPIRTTHTGQVLGSLVHVKGANAGVQTFLGIPFAKPPLGPLRFAPPEPPESWSGVRDGTTHPAMCLQDLTAVESEFLSQFNMTFPSDSMSEDCLYLSIYTPAHSHEGSNLPVMVWIHGGALVFGMASLYDGSMLAALENVVVVIIQYRLGVLGFFSTGDKHATGNWGYLDQVAALRWVQQNIAHFGGNPDRVTIFGESAGGTSVSSLVVSPISQGLFHGAIMESGVALLPGLIASSADVISTVVANLSACDQVDSEALVGCLRGKSKEEILAINKPFKMIPGVVDGVFLPRHPQELLASADFQPVPSIVGVNNNEFGWLIPKVSPNPSPQVPGEPIWYGGCSGLHSSRLIPSPATDSLLAIQVMRIYDTQKEMDREASQAALQKMLTLLEGSWGPSPMETGSSPVLRQRKFNPQIPFLCSDPHEQRPGCVCLGVGSPQSLAFAPPSCAIPKPETTSSLPLASSLTCLFLIHLGEMLPPTFGDLLREEYIGDNGDPQTLQAQFQEMMADSMFVIPALQVAHFQCSRAPVYFYEFQHQPSWLKNIRPPHMKADHGDELPFVFRSFFGGNYIKFTEEEEQLSRKMMKYWANFARNGNPNGEGLPHWPLFDQEEQYLQLNLQPAVGRALKAHRLQFWKKALPQKIQELEEPEERHTEL

SEQ ID NO: 862539 - protein, 607 aa, Homo sapiens
MTAQSRSPTTPTFPGPSQRTPLTPCPVQTPRLGKALIHCWTDPGQPLGEQQRVRRQRTETSEPTMRLHRLRARLSAVACGLLLLLVRGQGQDSASPIRTTHTGQVLGSLVHVKGANAGVQTFLGIPFAKPPLGPLRFAPPEPPESWSGVRDGTTHPAMCLQDLTAVESEFLSQFNMTFPSDSMSEDCLYLSIYTPAHSHEGSNLPVMVWIHGGALVFGMASLYDGSMLAALENVVVVIIQYRLGVLGFFSTGDKHATGNWGYLDQVAALRWVQQNIAHFGGNPDRVTIFGESAGGTSVSSLVVSPISQGLFHGAIMESGVALLPGLIASSADVISTVVANLSACDQVDSEALVGCLRGKSKEEILAINKPFKMIPGVVDGVFLPRHPQELLASADFQPVPSIVGVNNNEFGWLIPKVMRIYDTQKEMDREASQAALQKMLTLLMLPPTFGDLLREEYIGDNGDPQTLQAQFQEMMADSMFVIPALQVAHFQCSRAPVYFYEFQHQPSWLKNIRPPHMKADHVKFTEEEEQLSRKMMKYWANFARNGNPNGEGLPHWPLFDQEEQYLQLNLQPAVGRALKAHRLQFWKKALPQKIQELEEPEERHTEL

SEQ ID NO: 862540 - protein, 562 aa, Homo sapiens
MTAQSRSPTTPTFPGPSQRTPLTPCPVQTPRLGKALIHCWTDPGQPLGEQQRVRRQRTETSEPTMRLHRLRARLSAVACGLLLLLVRGQGQDSASPIRTTHTGQVLGSLVHVKGANAGVQTFLGIPFAKPPLGPLRFAPPEPPESWSGVRDGTTHPAMCLQDLTAVESEFLSQFNMTFPSDSMSEDCLYLSIYTPAHSHEGSNLPVMVWIHGGALVFGMASLYDGSMLAALENVVVVIIQYRLGVLGFFSTGDKHATGNWGYLDQVAALRWVQQNIAHFGGNPDRVTIFGESAGGTSVSSLVVSPISQGLFHGAIMESGVALLPGLIASSADVISTVVANLSACDQVDSEALVGCLRGKSKEEILAINKPFKMIPGVVDGVFLPRHPQELLASADFQPVPSIVGVNNNEFGWLIPKVMRIYDTQKEMDREASQAALQKMLTLLMLPPTFGDLLREEYIGDNGDPQTLQAQFQEMMADSMFVIPALQVAHFQCSRAPVYFYEFQHQPSWLKNIRPPHMKADHGDELPFVFRSFFGGNYIKFTEEEEQLSRKMMKYWANFARNG

SEQ ID NO: 862541 - protein, 137 aa, Homo sapiens
MGEARSLQGAGATVSWAVHPTGSRAPVYFYEFQHQPSWLKNIRPPHMKADHVKFTEEEEQLSRKMMKYWANFARNGNPNGEGLPHWPLFDQEEQYLQLNLQPAVGRALKAHRLQFWKKALPQKIQELEEPEERHTEL

SEQ ID NO: 862542 - protein, 158 aa, Homo sapiens
MTAQSRSPTTPTFPGPSQRTPLTPCPVQTPRLGKALIHCWTDPGQPLGEQQRVRRQRTETSEPTMRLHRLRARLSAVACGLLLLLVRGQGQDSASPIRTTHTGQVLGSLVHVKGANAGVQTFLGIPFAKPPLGPLRFAPPEPLPSSPPPSPCLLSSLV

SEQ ID NO: 862543 - protein, 623 aa, Homo sapiens; identical to SEQ ID NO: 862535

SEQ ID NO: 862544 - protein, 623 aa, Homo sapiens; identical to SEQ ID NO: 862535

SEQ ID NO: 862545 - protein, 596 aa, Homo sapiens
TVAYWKLKKKKRKNDPGQPLGEQQRVRRQRTETSEPTMRLHRLRARLSAVACGLLLLLVRGQGQDSASPIRTTHTGQVLGSLVHVKGANAGVQTFLGIPFAKPPLGPLRFAPPEPPESWSGVRDGTTHPAMCLQDLTAVESEFLSQFNMTFPSDSMSEDCLYLSIYTPAHSHEGSNLPVMVWIHGGALVFGMASLYDGSMLAALENVVVVIIQYRLGVLGFFSTGDKHATGNWGYLDQVAALRWVQQNIAHFGGNPDRVTIFGESAGGTSVSSLVVSPISQGLFHGAIMESGVALLPGLIASSADVISTVVANLSACDQVDSEALVGCLRGKSKEEILAINKPFKMIPGVVDGVFLPRHPQELLASADFQPVPSIVGVNNNEFGWLIPKVMRIYDTQKEMDREASQAALQKMLTLLMLPPTFGDLLREEYIGDNGDPQTLQAQFQEMMADSMFVIPALQVAHFQCSRAPVYFYEFQHQPSWLKNIRPPHMKADHGDELPFVFRSFFGGNYIKFTEEEEQLSRKMMKYWANFARNGNPNGEGLPHWPLFDQEEQYLQLNLQPAVGRALKAHRLQFWKKALPQKIQELEEPEERHTEL

SEQ ID NO: 862546 - protein, 466 aa, Homo sapiens
MCLQDLTAVESEFLSQFNMTFPSDSMSEDCLYLSIYTPAHSHEGSNLPVMVWIHGGALVFGMASLYDGSMLAALENVVVVIIQYRLGVLGFFSTGDKHATGNWGYLDQVAALRWVQQNIAHFGGNPDRVTIFGESAGGTSVSSLVVSPISQGLFHGAIMESGVALLPGLIASSADVISTVVANLSACDQVDSEALVGCLRGKSKEEILAINKPFKMIPGVVDGVFLPRHPQELLASADFQPVPSIVGVNNNEFGWLIPKVMRIYDTQKEMDREASQAALQKMLTLLMLPPTFGDLLREEYIGDNGDPQTLQAQFQEMMADSMFVIPALQVAHFQCSRAPVYFYEFQHQPSWLKNIRPPHMKADHGDELPFVFRSFFGGNYIKFTEEEEQLSRKMMKYWANFARNGNPNGEGLPHWPLFDQEEQYLQLNLQPAVGRALKAHRLQFWKKALPQKIQELEEPEERHTEL

SEQ ID NO: 862547 - protein, 623 aa, Homo sapiens; identical to SEQ ID NO: 862535

SEQ ID NO: 862548 - protein, 468 aa, Homo sapiens
MTAQSRSPTTPTFPGPSQRTPLTPCPVQTPRLGKALIHCWTDPGQPLGEQQRVRRQRTETSEPTMRLHRLRARLSAVACGLLLLLVRGQGQDSASPIRTTHTGQVLGSLVHVKGANAGVQTFLGIPFAKPPLGPLRFAPPEPPESWSGVRDGTTHPAMCLQDLTAVESEFLSQFNMTFPSDSMSEDCLYLSIYTPAHSHEGSNLPVMVWIHGGALVFGMASLYDGSMLAALENVVVVIIQYRLGVLGFFSTGDKHATGNWGYLDQVAALRWVQQNIAHFGGNPDRVTIFGESAGGTSVSSLVVSPISQGLFHGAIMESGVALLPGLIASSADVISTVVANLSACDQVDSEALVGCLRGKSKEEILAINKPFKMIPGVVDGVFLPRHPQELLASADFQPVPSIVGVNNNEFGWLIPKVMRIYDTQKEMDREASQAALQKMLTLLVPGPLCTSTSSSISPAGSRTSGHRT

SEQ ID NO: 862549 - protein, 279 aa, Homo sapiens
MLSPANGEQLHLVNYVEDYLDSIESLPFDLQRNVSLMREIDAKYQEILKELDECYERFSRETDGAQKRRMLHCVQRALIRSQELGDEKIQIVSQMVELVENRTRQVDSHVELFEAQQELGDTAGNSGKAGADRPKGEAAAQADKPNSKRSRRQRNNENRENASSNHDHDDGASGTPKEKKAKTSKKKKRSKAKAEREASPADLPIDPNEPTYCLCNQVSYGEMIGCDNDECPIEWFHFSCVGLNHKPKGKWYCPKCRGENEKTMDKALEKSKKERAYNR

SEQ ID NO: 862550 - protein, 299 aa, Homo sapiens
SNPIICRCARRREFPDIAVAVIPGLWARGRGCSSDRLPRPAGPARRQFQAASLLTRGWGRAWPWKQILKELDECYERFSRETDGAQKRRMLHCVQRALIRSQELGDEKIQIVSQMVELVENRTRQVDSHVELFEAQQELGDTAGNSGKAGADRPKGEAAAQADKPNSKRSRRQRNNENRENASSNHDHDDGASGTPKEKKAKTSKKKKRSKAKAEREASPADLPIDPNEPTYCLCNQVSYGEMIGCDNDECPIEWFHFSCVGLNHKPKGKWYCPKCRGENEKTMDKALEKSKKERAYNR

SEQ ID NO: 862551 - protein, 279 aa, Homo sapiens; identical to SEQ ID NO: 862549

SEQ ID NO: 862552 - protein, 210 aa, Homo sapiens
MLHCVQRALIRSQELGDEKIQIVSQMVELVENRTRQVDSHVELFEAQQELGDTAGNSGKAGADRPKGEAAAQADKPNSKRSRRQRNNENRENASSNHDHDDGASGTPKEKKAKTSKKKKRSKAKAEREASPADLPIDPNEPTYCLCNQVSYGEMIGCDNDECPIEWFHFSCVGLNHKPKGKWYCPKCRGENEKTMDKALEKSKKERAYNR

SEQ ID NO: 862553 - protein, 230 aa, Homo sapiens
MLSPANGEQLHLVNYVEDYLDSIESLPFDLQRNVSLMREIDAKYQEILKELDECYERFSRETDGAQKRRMLHCVQRALIRSQELGDEKIQIVSQMVELVENRTRQVDSHVELFEANHDHDDGASGTPKEKKAKTSKKKKRSKAKAEREASPADLPIDPNEPTYCLCNQVSYGEMIGCDNDECPIEWFHFSCVGLNHKPKGKWYCPKCRGENEKTMDKALEKSKKERAYNR

SEQ ID NO: 862554 - protein, 330 aa, Homo sapiens
SGDGAGAAGNPECCPMALGPRCGAIRACRRVLERAFSLRKAHSIKDMENTLQLVRNIIPPLSSTKHKGQDGRIGVVGGCQEYTGAPYFAAISALNSEILKELDECYERFSRETDGAQKRRMLHCVQRALIRSQELGDEKIQIVSQMVELVENRTRQVDSHVELFEAQQELGDTAGNSGKAGADRPKGEAAAQADKPNSKRSRRQRNNENRENASSNHDHDDGASGTPKEKKAKTSKKKKRSKAKAEREASPADLPIDPNEPTYCLCNQVSYGEMIGCDNDECPIEWFHFSCVGLNHKPKGKWYCPKCRGENEKTMDKALEKSKKERAYNR

SEQ ID NO: 862555 - protein, 422 aa, Homo sapiens
MSFVECPYHSPAERLVAEADEGGPSAITGMGLCFRCLLFSFSGRSGVEGGRVDLNVFGSLGLQPWIGSSRCWGGPCSSALRCGWFSSWPPPSKSAIPIGGGSRGAGRVSRWPPPHWLEAWRVSPRPLSPLSPATFGRGFIAVAVIPGLWARGRGCSSDRLPRPAGPARRQFQAASLLTRGWGRAWPWKQILKELDECYERFSRETDGAQKRRMLHCVQRALIRSQELGDEKIQIVSQMVELVENRTRQVDSHVELFEAQQELGDTAGNSGKAGADRPKGEAAAQADKPNSKRSRRQRNNENRENASSNHDHDDGASGTPKEKKAKTSKKKKRSKAKAEREASPADLPIDPNEPTYCLCNQVSYGEMIGCDNDECPIEWFHFSCVGLNHKPKGKWYCPKCRGENEKTMDKALEKSKKERAYNR

SEQ ID NO: 862556 - protein, 279 aa, Homo sapiens; identical to SEQ ID NO: 862549

SEQ ID NO: 862557 - protein, 235 aa, Homo sapiens
MEILKELDECYERFSRETDGAQKRRMLHCVQRALIRSQELGDEKIQIVSQMVELVENRTRQVDSHVELFEAQQELGDTAGNSGKAGADRPKGEAAAQADKPNSKRSRRQRNNENRENASSNHDHDDGASGTPKEKKAKTSKKKKRSKAKAEREASPADLPIDPNEPTYCLCNQVSYGEMIGCDNDECPIEWFHFSCVGLNHKPKGKWYCPKCRGENEKTMDKALEKSKKERAYNR

SEQ ID NO: 862558 - protein, 262 aa, Homo sapiens
MSFVECPYHSPAERLVAEADEGGPSAITEILKELDECYERFSRETDGAQKRRMLHCVQRALIRSQELGDEKIQIVSQMVELVENRTRQVDSHVELFEAQQELGDTAGNSGKAGADRPKGEAAAQADKPNSKRSRRQRNNENRENASSNHDHDDGASGTPKEKKAKTSKKKKRSKAKAEREASPADLPIDPNEPTYCLCNQVSYGEMIGCDNDECPIEWFHFSCVGLNHKPKGKWYCPKCRGENEKTMDKALEKSKKERAYNR

SEQ ID NO: 862559 - protein, 280 aa, Homo sapiens
TQQYFTIWICSENLSLQLKPYHKPLQHVRDWPEILAELTNLDPQRETPQLFLRRDVRLPLEVEKQIEDPLAILILFDEARYNLLKGFYTAPDAKLITLASLLLQIVYGNYESKKHKQGFLNEENLKSIVPVTKLKSKAPHWTNRILHEYKNLSTSEGVSKEMHHLQRMFLQNCWEIPTYGAAFFTGQIFTKASPSNHKVIPVYVGVNIKGLHLLNMETKALLISLKYGCFMWQLGDTDTCFQIHSMENKMSFIVHTKQAGLVVKLLMKLNGQLMPTERNS

SEQ ID NO: 862560 - protein, 172 aa, Homo sapiens
MSVPGPSSPDGALTRPPYCLEAGEPTPGLSDTSPDEGLIEDLTIEDKAVEQLAEGLLSHYLPDLQRSKQALQELTQNQVVLLDTLEQEISKFKECHSMLDINALFAEAKHYHAKLVNIRKEMLMLHEKTSKLKKRALKLQQKRQKEELEREQQREKEFEREKQLTARPAKRM

SEQ ID NO: 862561 - protein, 172 aa, Homo sapiens; identical to SEQ ID NO: 862560

SEQ ID NO: 862562 - protein, 205 aa, Homo sapiens
TASGARRRYQRGVPTTPWGRANSRARDRSPQFFRPRHFRVRQSLLSGQPLESLGAALLLTSHTFASSLCSQLEGHECPWAVVSGRGPDTATLLPGGRGADACVVFVSEQNQVVLLDTLEQEISKFKECHSMLDINALFAEAKHYHAKLVNIRKEMLMLHEKTSKLKKRALKLQQKRQKEELEREQQREKEFEREKQLTARPAKRM

SEQ ID NO: 862563 - protein, 104 aa, Homo sapiens
TASGARRRYQRGVPTTPWGRANSRARDRSPQFFRPRHFRVRQSLLSGQPLESLGAALLLTSHTFASSLCSQLEGHECPWAVVSGRGPDTATLLPGGRGADAWFK

SEQ ID NO: 862564 - protein, 172 aa, Homo sapiens; identical to SEQ ID NO: 862560

SEQ ID NO: 862565 - protein, 182 aa, Homo sapiens
MSVPGPSSPDGALTRPPYCLEAGEPTPGLSDTSPDEGLIEDLTIEDKAVEQLAEGLLSHYLPDLQRSKQALQELTQNQVVLLDTLEQEISKFKECHSMLDINALFAEAKHYHAKLVNIRKEMLMLHEKTSKLKEFKDEDINDQHRDVIFLSATHLGVSLIFLLRVSFMSSNFFSYSHIWLDF

SEQ ID NO: 862566 - protein, 172 aa, Homo sapiens; identical to SEQ ID NO: 862560

SEQ ID NO: 862567 - protein, 113 aa, Homo sapiens
TASGARRRYQRGVPTTPWGRANSRARDRSPQFFRPRHFRVRQSLLSGQPLESLGAALLLTSHTFASSLCSQLEGHECPWAVVSGRGPDTATLLPGGRGADACLLRLNTIMPSW

SEQ ID NO: 862568 - protein, 177 aa, Homo sapiens
MGGTEVPRGSFVLGVQLKAVDGEAILSLCVDSGLSDTSPDEGLIEDLTIEDKAVEQLAEGLLSHYLPDLQRSKQALQELTQNQVVLLDTLEQEISKFKECHSMLDINALFAEAKHYHAKLVNIRKEMLMLHEKTSKLKKRALKLQQKRQKEELEREQQREKEFEREKQLTARPAKRM

SEQ ID NO: 862569 - protein, 143 aa, Homo sapiens
MSVPGPSSPDGALTRPPYCLEAGEPTPGLSDTSPDEGLIEDLTIEDKAVEQLAEGLLSHYLPDLQRSKQALQELTQNQVVLLDTLEQEISKFKECHSMLDINALKRALKLQQKRQKEELEREQQREKEFEREKQLTARPAKRM

SEQ ID NO: 862570 - protein, 172 aa, Homo sapiens; identical to SEQ ID NO: 862560

SEQ ID NO: 862571 - protein, 113 aa, Homo sapiens; identical to SEQ ID NO: 862567

SEQ ID NO: 862572 - protein, 118 aa, Homo sapiens
SQREQGSTLSPWGEVLTPLASSSVTHLSSKQEEYVKVAKTLFTDEALKPCPRCQSPAKYQPYKKRGLCSRTACGFDFCVLCLCAYHGSEECSRGAAKPRNRKDALPGSAQSKRNLKRL

SEQ ID NO: 862573 - protein, 118 aa, Homo sapiens; identical to SEQ ID NO: 862572

SEQ ID NO: 862574 - protein, 118 aa, Homo sapiens; identical to SEQ ID NO: 862572

SEQ ID NO: 862575 - protein, 118 aa, Homo sapiens; identical to SEQ ID NO: 862572

SEQ ID NO: 862576 - protein, 66 aa, Homo sapiens
AASHSHWMSSPRPHGWVSPSSPRFCLRTHRVAPDPPVRTSRISSEQPLRAGGLGFSVSLGALGHVL

SEQ ID NO: 862577 - protein, 66 aa, Homo sapiens; identical to SEQ ID NO: 862576

SEQ ID NO: 862578 - protein, 66 aa, Homo sapiens; identical to SEQ ID NO: 862576

SEQ ID NO: 862579 - protein, 66 aa, Homo sapiens; identical to SEQ ID NO: 862576

SEQ ID NO: 862580 - protein, 66 aa, Homo sapiens; identical to SEQ ID NO: 862576

SEQ ID NO: 862581 - protein, 430 aa, Homo sapiens
GARPELRDRGPEGIQRVSCRRGTSAGLAAAAIPTIPDRACPGSAPGGAARPSPGTARSGTPTAPSPARGLRGRTRRKGGLAGDPAMALDFLAGCAGGVAGVLVGHPFDTVKVRLQVQSVEKPQYRGTLHCFKSIIKQESVLGLYKGLGSPLMGLTFINALVFGVQGNTLRALGHDSPLNQFLAGAAAGAIQCVICCPMELAKTRLQLQDAGPARTYKGSLDCLAQIYGHEGLRGVNRGMVSTLLRETPSFGVYFLTYDALTRALGCEPGDRLLVPKLLLAGGTSGIVSWLSTYPVDVVKSRLQADGLRGAPRYRGILDCVHQSYRAEGWRVFTRGLASTLLRAFPVNAATFATVTVVLTYARGEEAGPEGEAVPAAPAGPALAQPPACDAHPGLLPQGSFSETWDINWPLSRLPCFLLGCCELWSLSDVG

SEQ ID NO: 862582 - protein, 279 aa, Homo sapiens
MGLTFINALVFGVQGNTLRALGHDSPLNQFLAGAAAGAIQCVICCPMELAKTRLQLQDAGPARTYKGSLDCLAQIYGHEGLRGVNRGMVSTLLRETPSFGVYFLTYDALTRALGCEPGDRLLVPKLLLAGGTSGIVSWLSTYPVDVVKSRLQADGLRGAPRYRGILDCVHQSYRAEGWRVFTRGLASTLLRAFPVNAATFATVTVVLTYARGEEAGPEGEAVPAAPAGPALAQPPACDAHPGLLPQGSFSETWDINWPLSRLPCFLLGCCELWSLSDVG

SEQ ID NO: 862583 - protein, 279 aa, Homo sapiens
MGLTFINALVFGVQGNTLRALGHDSPLNQFLAGAAAGAIQCVICCPMELAKTRLQLQDAGPARTYKGSLDCLAQIYGHEGLRGVNRGMVSTLLRETPSFGVYFLTYDALTRALGCEPGDRLLVPKLLLAGGTSGIVSWLSTYPVDVVKSRLQADGLRGAPRYRGILDCVHQSYRAEGWRVFTRGLASTLLRAFPVNAATFATVTVVLTYARGEEAGPEGEAVPAAPAGPAWRSPPACDAHPGLLPQGSFSETWDINWPLSRLPCFLLGCCELWSLSDVG

SEQ ID NO: 862584 - protein, 279 aa, Homo sapiens; identical to SEQ ID NO: 862582

SEQ ID NO: 862585 - protein, 279 aa, Homo sapiens; identical to SEQ ID NO: 862582

SEQ ID NO: 862586 - protein, 279 aa, Homo sapiens; identical to SEQ ID NO: 862582

SEQ ID NO: 862587 - protein, 430 aa, Homo sapiens; identical to SEQ ID NO: 862581

SEQ ID NO: 862588 - protein, 430 aa, Homo sapiens; identical to SEQ ID NO: 862581

SEQ ID NO: 862589 - protein, 474 aa, Homo sapiens
MGYPRNSVCSLPGDNFCCQPPRPVSRGEQQPADGTPVLSGTGAGLALGCHMHTLPVDVRIPGAHGICLLHPTGVAGVLVGHPFDTVKALGTERIQDLDLLYSAQNHSHRPEAHGLHTFLHEGSFLSCFLGHSNNQGAVVLTYDEGMGVSLTLESAVRLQVQSVEKPQYRGTLHCFKSIIKQESVLGLYKGLGSPLMGLTFINALVFGVQGNTLRALGHDSPLNQFLAGAAAGAIQCVICCPMELAKTRLQLQDAGPARTYKGSLDCLAQIYGHEGLRGVNRGMVSTLLRETPSFGVYFLTYDALTRALGCEPGDRLLVPKLLLAGGTSGIVSWLSTYPVDVVKSRLQADGLRGAPRYRGILDCVHQSYRAEGWRVFTRGLASTLLRAFPVNAATFATVTVVLTYARGEEAGPEGEAVPAAPAGPALAQPPACDAHPGLLPQGSFSETWDINWPLSRLPCFLLGCCELWSLSDVG

SEQ ID NO: 862590 - protein, 430 aa, Homo sapiens; identical to SEQ ID NO: 862581

SEQ ID NO: 862591 - protein, 430 aa, Homo sapiens; identical to SEQ ID NO: 862581

SEQ ID NO: 862592 - protein, 408 aa, Homo sapiens
SPEADGGGGGGASGGPGLLRRPPLLATGAAAMQPPPPGPLGDCLRDWEDLQQDFQNIQETHRLYRLKLEELTKLQNNCTSSITRQKKRLQELALALKKCKPSLPAEAEGAAQELENQMKERQGLFFDMEAYLPKKNGLYLSLVLGNVNVTLLSKQAKFAYKDEYEKFKLYLTIILILISFTCRFLLNSRVTDAAFNFLLVWYYCTLTIRESILINNGSRWAGRALREGSMEWGARTSGKQEQALGVMVALCSRIKGWWVFHHYVSTFLSGVMLTWPDGLMYQKFRNQFLSFSMYQSFVQFLQYYYQSGCLYRLRALGERHTMDLTVEGFQSWMWRGLTFLLPFLFFGHFWQLFNALTLFNLAQDPQCKEWQVLMCGFPFLLLFLGNFFTTLRVVHHKFHSQRHGSKKD

SEQ ID NO: 862593 - protein, 336 aa, Homo sapiens
MAHCSLNFPGLKRSSHLNLLETHRLYRLKLEELTKLQNNCTSSITRQKKRLQELALALKKCKPSLPAEAEGAAQELENQMKERQGLFFDMEAYLPKKNGLYLSLVLGNVNVTLLSKQAKFAYKDEYEKFKLYLTIILILISFTCRFLLNSRVTDAAFNFLLVWYYCTLTIRESILINNGSRIKGWWVFHHYVSTFLSGVMLTWPDGLMYQKFRNQFLSFSMYQSFVQFLQYYYQSGCLYRLRALGERHTMDLTVEGFQSWMWRGLTFLLPFLFFGHFWQLFNALTLFNLAQDPQCKEWQVLMCGFPFLLLFLGNFFTTLRVVHHKFHSQRHGSKKD

SEQ ID NO: 862594 - protein, 357 aa, Homo sapiens
SPEADGGGGGGASGGPGLLRRPPLLATGAAAMQPPPPGPLGDCLRDWEDLQQDFQNIQETHRLYRLKLEELTKLQNNCTSSITRQKKRLQELALALKKCKPSLPAEAEGAAQELENQMKERQGLFFDMEAYLPKKNGLYLSLVLGNVNVTLLSKQAKFAYKDEYEKFKLYLTIILILISFTCRFLLNSRVTDAAFNFLLVWYYCTLTIRESILINNGSRIKGWWVFHHYVSTFLSGVMLTWPDGLMYQKFRNQFLSFSMYQSFVQFLQYYYQSGCLYRLRALGERHTMDLTVEGFQSWMWRGLTFLLPFLFFGHVSRASVSLPCLSVLCAGFGLQQGLGLLSKMPPPCLVSGSFLTR

SEQ ID NO: 862595 - protein, 390 aa, Homo sapiens
SPEADGGGGGGASGGPGLLRRPPLLATGAAAMQPPPPGPLGDCLRDWEDLQQDFQNIQETHRLYRLKLEELTKLQNNCTSSITRQKKRLQELALALKKCKPSLPAEAEGAAQELENQMKERQGLFFDMEAYLPKKNGLYLSLVLGNVNVTLLSKQAKFAYKDEYEKFKLYLTIILILISFTCRFLLNSRVTDAAFNFLLVWYYCTLTIRESILINNGSRIKGWWVFHHYVSTFLSGVMLTWPDGLMYQKFRNQFLSFSMYQSFVQFLQYYYQSGCLYRLRALGERHTMDLTVEGFQSWMWRGLTFLLPFLFFGHFWQLFNALTLFNLAYLPKKNGLYLSLVLGNVNVTLLSKQAKFAYKDEYEKFTAPLECACIRGSLLFSLGFYGRCGP

SEQ ID NO: 862596 - protein, 441 aa, Homo sapiens
SPEADGGGGGGASGGPGLLRRPPLLATGAAAMQPPPPGPLGDCLRDWEDLQQDFQNIQETHRLYRLKLEELTKLQNNCTSSITRQKKRLQELALALKKCKPSLPAEAEGAAQELENQMKERQGLFFDMEAYLPKKNGLYLSLVLGNVNVTLLSKQAKFAYKDEYEKFKLYLTIILILISFTCRFLLNSRVTDAAFNFLLVWYYCTLTIRESILINNGSRWAGRALREGSMEWGARTLREAGTGAGGDGGSLLQDQRLVGVPSLRVHLPVGSHADVVSGWAPAGAGAGTRRGYTASPRVPTLPSTFYLRPDGLMYQKFRNQFLSFSMYQSFVQFLQYYYQSGCLYRLRALGERHTMDLTVEGFQSWMWRGLTFLLPFLFFGHFWQLFNALTLFNLAQDPQCKEWQVLMCGFPFLLLFLGNFFTTLRVVHHKFHSQRHGSKKD

SEQ ID NO: 862597 - protein, 311 aa, Homo sapiens
SPEADGGGGGGASGGPGLLRRPPLLATGAAAMQPPPPGPLGDCLRDWEDLQQDFQNIQETHRLYRLKLEELTKLQNNCTSSITRQKKRLQELALALKKCKPSLPAEAEGAAQELENQMKERQGLFFDMEAYLPKKNGLYLSLVLGNVNVTLLSKQAKFAYKDEYEKFKLYLTIILILISFTCRFLLNSRVTDAAFNFLLVWYYCTLTIRESILINNGSRIKGWWVFHHYVSTFLSGVMLTWPDGLMYQKFRNQFLSFSMYQSFVQFLQYYYQSGCLYRLRALGERHTMDLTVGESGVALASGHSPFLPSRV

SEQ ID NO: 862598 - protein, 312 aa, Homo sapiens
LGSAALPGWGHTWAPPAPHPSHRPAPPRFAYKDEYEKFKLYLTIILILISFTCRFLLNSRVTDAAFNFLLVWYYCTLTIRESILINNGSRWAGRALREGSMEWGARTLREAGTGAGGDGGSLLQDQRLVGVPSLRVHLPVGSHADVVSGWAPAGAGAGTRRGYTASPRVPTLPSTFYLRPDGLMYQKFRNQFLSFSMYQSFVQFLQYYYQSGCLYRLRALGERHTMDLTVEGFQSWMWRGLTFLLPFLFFGHFWQLFNALTLFNLAQDPQCKEWQVLMCGFPFLLLFLGNFFTTLRVVHHKFHSQRHGSKKD

SEQ ID NO: 862599 - protein, 374 aa, Homo sapiens
SPEADGGGGGGASGGPGLLRRPPLLATGAAAMQPPPPGPLGDCLRDWEDLQQDFQNIQETHRLYRLKLEELTKLQNNCTSSITRQKKRLQELALALKKCKPSLPAEAEGAAQELENQMKERQGLFFDMEAYLPKKNGLYLSLVLGNVNVTLLSKQAKFAYKDEYEKFKLYLTIILILISFTCRFLLNSRVTDAAFNFLLVWYYCTLTIRESILINNGSRIKGWWVFHHYVSTFLSGVMLTWPDGLMYQKFRNQFLSFSMYQSFVQFLQYYYQSGCLYRLRALGERHTMDLTVEGFQSWMWRGLTFLLPFLFFGHFWQLFNALTLFNLAQDPQCKEWQVLMCGFPFLLLFLGNFFTTLRVVHHKFHSQRHGSKKD

SEQ ID NO: 862600 - protein, 374 aa, Homo sapiens; identical to SEQ ID NO: 862599

SEQ ID NO: 862601 - protein, 400 aa, Homo sapiens
SPEADGGGGGGASGGPGLLRRPPLLATGAAAMQPPPPGPLGDCLRDWEDLQQDFQNIQETHRLYRLKLEELTKLQNNCTSSITRQKKRLQELALALKKCKPSLPAEAEGAAQELENQMKERQGLFFDMEAYLPKKNGLYLSLVLGNVNVTLLSKQAKFAYKDEYEKFKLYLTIILILISFTCRFLLNSRVTDAAFNFLLVWYYCTLTIRESILINNGSRIKGWWVFHHYVSTFLSGVMLTWPDGLMYQKFRNQFLSFSMYQSFVQFLQYYYQSGCLYRLRALGERHTMDLTVEGFQSWMWRGLTFLLPFLFFGHFWQLFNALTLFNLAQDPQCKEWQGCAPQVSQSAAREQEGLRLGLPLPAQRGFCPVCCGRGWEAPLECACIRGSLLFSLGFYGRCGP

SEQ ID NO: 862602 - protein, 345 aa, Homo sapiens
AGMGEDYPWRFHHKHHGSALLIFSEAHRRETHRLYRLKLEELTKLQNNCTSSITRQKKRLQELALALKKCKPSLPAEAEGAAQELENQMKERQGLFFDMEAYLPKKNGLYLSLVLGNVNVTLLSKQAKFAYKDEYEKFKLYLTIILILISFTCRFLLNSRVTDAAFNFLLVWYYCTLTIRESILINNGSRIKGWWVFHHYVSTFLSGVMLTWPDGLMYQKFRNQFLSFSMYQSFVQFLQYYYQSGCLYRLRALGERHTMDLTVEGFQSWMWRGLTFLLPFLFFGHFWQLFNALTLFNLAQDPQCKEWQVLMCGFPFLLLFLGNFFTTLRVVHHKFHSQRHGSKKD

SEQ ID NO: 862603 - protein, 286 aa, Homo sapiens
ALTVSGLTRRCKPSLPAEAEGAAQELENQMKERQGLFFDMEAYLPKKNGLYLSLVLGNVNVTLLSKQAKFAYKDEYEKFKLYLTIILILISFTCRFLLNSRVTDAAFNFLLVWYYCTLTIRESILINNGSRIKGWWVFHHYVSTFLSGVMLTWPDGLMYQKFRNQFLSFSMYQSFVQFLQYYYQSGCLYRLRALGERHTMDLTVEGFQSWMWRGLTFLLPFLFFGHFWQLFNALTLFNLAQDPQCKEWQVLMCGFPFLLLFLGNFFTTLRVVHHKFHSQRHGSKKD

SEQ ID NO: 862604 - protein, 354 aa, Homo sapiens
SPEADGGGGGGASGGPGLLRRPPLLATGAAAMQPPPPGPLGDCLRDWEDLQQDFQNIQETHRLYRLKLEELTKLQNNCTSSITRQKKRLQELALALKKCKPSLPAEAEGAAQELENQMKERQGLFFDMEAYLPKKNGFAYKDEYEKFKLYLTIILILISFTCRFLLNSRVTDAAFNFLLVWYYCTLTIRESILINNGSRIKGWWVFHHYVSTFLSGVMLTWPDGLMYQKFRNQFLSFSMYQSFVQFLQYYYQSGCLYRLRALGERHTMDLTVEGFQSWMWRGLTFLLPFLFFGHFWQLFNALTLFNLAQDPQCKEWQVLMCGFPFLLLFLGNFFTTLRVVHHKFHSQRHGSKKD

SEQ ID NO: 862605 - protein, 297 aa, Homo sapiens
SPEADGGGGGGASGGPGLLRRPPLLATGAAAMQPPPPGPLGDCLRDWEDLQQDFQNIQETHRLYRLKLEELTKLQNNCTSSITRQKKRLQELALALKKCKPSLPAEAEGAAQELENQMKERQGLFFDMEAYLPKKNGLYLSLVLGNVNVTLLSKQAKFAYKDEYEKFKLYLTIILILISFTCRFLLNSRVTDAAFNFLLVWYYCTLTIRESILINNGSRIKGWWVFHHYVSTFLSGVMLTWPDGLMYQKFRNQFLSFSMYQSFVQFLQYYYQSGCLYRLRALGERHTMDLTVVLAAF

SEQ ID NO: 862606 - protein, 297 aa, Homo sapiens; identical to SEQ ID NO: 862605

SEQ ID NO: 862607 - protein, 234 aa, Homo sapiens
CWNGRRLSLEIPSQTSWIRSTDLLRGPPKGDPSALPPEAGGADQTSEQLHQLHHAAEEAAPGAGPRPEEMQTLPPSRGRIKGWWVFHHYVSTFLSGVMLTWPDGLMYQKFRNQFLSFSMYQSFVQFLQYYYQSGCLYRLRALGERHTMDLTVEGFQSWMWRGLTFLLPFLFFGHFWQLFNALTLFNLAQDPQCKEWQVLMCGFPFLLLFLGNFFTTLRVVHHKFHSQRHGSKKD

SEQ ID NO: 862608 - protein, 334 aa, Homo sapiens
SPEADGGGGGGASGGPGLLRRPPLLATGAAAMQPPPPGPLGDCLRDWEDLQQDFQNIQETHRLYRLKLEELTKLQNNCTSSITRQKKRLQELALALKKCKPSLPAEAEGAAQELENQMKERQGLFFDMEAYLPKKNGLYLSLVLGNVNVTLLSKQAKFAYKDEYEKFKLYLTIILILISFTCRFLLNSRVTDAAFNFLLVWYYCTLTIRESILINNGSRWAGRALREGSMEWGARTLREAGTGAGGDGGSLLQDQRLVGVPSLRVHLPVGSHADVARRSHVPEIPEPIPLLFHVPELRAVSPVLLPERLPLPPAGAGRAAHHGPHCGSGSFLTR

SEQ ID NO: 862609 - protein, 33 aa, Homo sapiens
MSRRQQQETAGTEGGACWLVLDLGDEGGGLVKG

SEQ ID NO: 862610 - protein, 536 aa, Homo sapiens
PCPGRGQSGPAQVRPGVGPESGRCAAPPRTCPLGLPPRESESVGPAEVKDRGAGPARSWEREPGTPGAMDGLGRRLRASLRLKRGHGGPPQDNSGEALKEPERAQEHSLPNFAGGQHFFEYLLVVSLKKKRSEDDYEPIITYQFPKRENLLRGQQEEEERLLKAIPLFCFPDGNEWASLTEYPRETFSFVLTNVDGSRKIGYCRRLLPAGPGPRLPKVYCIISCIGCFGLFSKILDEVEKRHQISMAVIYPFMQGLREAAFPAPGKTVTLKSFIPDSGTEFISLTRPLDSHLEHVDFSSLLHCLSFEQILQIFASAVLERKIIFLAEGLSTLSQCIHAAAALLYPFSWAHTYIPVVPESLLATVCCPTPFMVGVQMRFQQEVMDSPMEEVLLVNLCEGTFLMSVGDEKDILPPKLQDDILDSLGQGINELKTAEQINEHVSGPFVQFFVKIVGHYASYIKREANGQGHFQERSFCKALTSKTNRRFVKKFVKTQLFSLFIQEAEKSKNPPAGYFQQKILEYEEQKKQKKPREKTVK

SEQ ID NO: 862611 - protein, 540 aa, Homo sapiens
CLAWVPSHPSCSTTGCTGWKLLFPLWKTARGLASQSCGWRPKQPLSQAYCHQSVCVRGEGSPLCPEGPEMEGQVVGRVFRLFQRRLLQLRAGPPQDNSGEALKEPERAQEHSLPNFAGGQHFFEYLLVVSLKKKRSEDDYEPIITYQFPKRENLLRGQQEEEERLLKAIPLFCFPDGNEWASLTEYPRETFSFVLTNVDGSRKIGYCRRLLPAGPGPRLPKVYCIISCIGCFGLFSKILDEVEKRHQISMAVIYPFMQGLREAAFPAPGKTVTLKSFIPDSGTEFISLTRPLDSHLEHVDFSSLLHCLSFEQILQIFASAVLERKIIFLAEGLSTLSQCIHAAAALLYPFSWAHTYIPVVPESLLATVCCPTPFMVGVQMRFQQEVMDSPMEEVLLVNLCEGTFLMSVGDEKDILPPKLQDDILDSLGQGINELKTAEQINEHVSGPFVQFFVKIVGHYASYIKREANGQGHFQERSFCKALTSKTNRRFVKKFVKTQLFSLFIQEAEKSKNPPAGYFQQKILEYEEQKKQKKPREKTVK

SEQ ID NO: 862612 - protein, 193 aa, Homo sapiens
MGSGLISGPPQDNSGEALKEPERAQEHSLPNFAGGQHFFEYLLVVSLKKKRSEDDYEPIITYQFPKRENLLRGQQEEEERLLKAIPLFCFPDGNEWASLTEYPRETFSFVLTNVDGSRKIGYCRRLLPAGPGPRLPKVYCIISCIGCFGLFSKILDGSGERDLDFHWGTLHRDIAGLQRNFPVLEKCALKSFP

SEQ ID NO: 862613 - protein, 401 aa, Homo sapiens
PCPGRGQSGPAQVRPGVGPESGRCAAPPRTCPLGLPPRESESVGPAEVKDRGAGPARSWEREPGTPGAMDGLGRRLRASLRLKRGHGDVGTDPKAPHSRGKLYTGTQQQGPGATSFAPILLGGAATFLVKLPFPCRIPSSKHGKRSRRDCIYRRPYLNSALNQSFPQRRGGTLAYRRGSRAGKGGQGQQDMLQKSIPTCICFPKNGDIELGHSPHPRYSQGSTLSTIRYTDPKLLAIGAASNTHWELTARAPSLPCQGPVGPSGHFPKKGGTLAFQSIGCNQSWRTGLVHSERFRWESDNGGAQQQDQIRRDLSQCGHGVIAYPTEYQMRQGALSTEAGDRPFIPLGYTLRKRTWYASLSKRRRFHLPPRDLSSQLRAVIKFHTSEKTGPLRGTSTRCKET

SEQ ID NO: 862614 - protein, 456 aa, Homo sapiens
MGSGLISGPPQDNSGEALKEPERAQEHSLPNFAGGQHFFEYLLVVSLKKKRSEDDYEPIITYQFPKRENLLRGQQEEEERLLKAIPLFCFPDGNEWASLTEYPRETFSFVLTNVDGSRKIGYCRRLLPAGPGPRLPKVYCIISCIGCFGLFSKILDEVEKRHQISMAVIYPFMQGLREAAFPAPGKTVTLKSFIPDSGTEFISLTRPLDSHLEHVDFSSLLHCLSFEQILQIFASAVLERKIIFLAEGLSTLSQCIHAAAALLYPFSWAHTYIPVVPESLLATVCCPTPFMVGVQMRFQQEVMDSPMEEVLLVNLCEGTFLMSVGDEKDILPPKLQDDILDSLGQGINELKTAEQINEHVSGPFVQFFVKIVGHYASYIKREANGQGHFQERSFCKALTSKTNRRFVKKFVKTQLFSLFIQEAEKSKNPPAGYFQQKILEYEEQKKQKKPREKTVK

SEQ ID NO: 862615 - protein, 502 aa, Homo sapiens
MGGVSAGRGERGEDGVGTGEPGLGLAAGARWRAARGVEIREQLEGDSGGCAGAGPPQDNSGEALKEPERAQEHSLPNFAGGQHFFEYLLVVSLKKKRSEDDYEPIITYQFPKRENLLRGQQEEEERLLKAIPLFCFPDGNEWASLTEYPRETFSFVLTNVDGSRKIGYCRRLLPAGPGPRLPKVYCIISCIGCFGLFSKILDEVEKRHQISMAVIYPFMQGLREAAFPAPGKTVTLKSFIPDSGTEFISLTRPLDSHLEHVDFSSLLHCLSFEQILQIFASAVLERKIIFLAEGLSTLSQCIHAAAALLYPFSWAHTYIPVVPESLLATVCCPTPFMVGVQMRFQQEVMDSPMEEVLLVNLCEGTFLMSVGDEKDILPPKLQDDILDSLGQGINELKTAEQINEHVSGPFVQFFVKIVGHYASYIKREANGQGHFQERSFCKALTSKTNRRFVKKFVKTQLFSLFIQEAEKSKNPPAGYFQQKILEYEEQKKQKKPREKTVK

SEQ ID NO: 862616 - protein, 457 aa, Homo sapiens
FAQLCWGAKSAPGPFLVPLKLPLNVLGHSLPNFAGGQHFFEYLLVVSLKKKRSEDDYEPIITYQFPKRENLLRGQQEEEERLLKAIPLFCFPDGNEWASLTEYPRETFSFVLTNVDGSRKIGYCRRLLPAGPGPRLPKVYCIISCIGCFGLFSKILDEVEKRHQISMAVIYPFMQGLREAAFPAPGKTVTLKSFIPDSGTEFISLTRPLDSHLEHVDFSSLLHCLSFEQILQIFASAVLERKIIFLAEGLSTLSQCIHAAAALLYPFSWAHTYIPVVPESLLATVCCPTPFMVGVQMRFQQEVMDSPMEEVLLVNLCEGTFLMSVGDEKDILPPKLQDDILDSLGQGINELKTAEQINEHVSGPFVQFFVKIVGHYASYIKREANGQGHFQERSFCKALTSKTNRRFVKKFVKTQLFSLFIQEAEKSKNPPAGYFQQKILEYEEQKKQKKPREKTVK

SEQ ID NO: 862617 - protein, 135 aa, Homo sapiens [sequence omitted]

SEQ ID NO: 862618 - protein, 291 aa, Homo sapiens
MAVIYPFMQGLREAAFPAPGKTVTLKSFIPDSGTEFISLTRPLDSHLEHVDFSSLLHCLSFEQILQIFASAVLERKIIFLAEGLSTLSQCIHAAAALLYPFSWAHTYIPVVPESLLATVCCPTPFMVGVQMRFQQEVMDSPMEEVLLVNLCEGTFLMSVGDEKDILPPKLQDDILDSLGQGINELKTAEQINEHVSGPFVQFFVKIVGHYASYIKREANGQGHFQERSFCKALTSKTNRRFVKKFVKTQLFSLFIQEAEKSKNPPAGYFQQKILEYEEQKKQKKPREKTVK

SEQ ID NO: 862619 - protein, 151 aa, Homo sapiens
MGGVSAGRGERGEDGVGTGEPGLGLAAGARWRAARGVEIREQLEGDSGGCAGAGPPQDNSGEALKEPERAQEHSLPNFAGGQHFFEYLLVVSLKKKRSEDDYEPIITYQFPKVRTEGGAGPARGLGCLEGGRGGGSTSFSLPYRGLSLELP

SEQ ID NO: 862620 - protein, 291 aa, Homo sapiens; identical to SEQ ID NO: 862618

SEQ ID NO: 862621 - protein, 291 aa, Homo sapiens; identical to SEQ ID NO: 862618

SEQ ID NO: 862622 - protein, 291 aa, Homo sapiens; identical to SEQ ID NO: 862618

SEQ ID NO: 862623 - protein, 105 aa, Homo sapiens
MRGATRVSIMLLLVTVSDCAVITGACERDVQCGAGTCCAISLWLRGLRMCTPLGREGEECHPGSHKVPFFRKRKHHTCPCLPNLLCSRFPDGRYRCSMDLKNINF

SEQ ID NO: 862624 - protein, 105 aa, Homo sapiens; identical to SEQ ID NO: 862623

SEQ ID NO: 862625 - protein, 105 aa, Homo sapiens; identical to SEQ ID NO: 862623

SEQ ID NO: 862626 - protein, 105 aa, Homo sapiens; identical to SEQ ID NO: 862623

SEQ ID NO: 862627 - protein, 88 aa, Homo sapiens
TAWTPLHVGALDCLELEEGTLMCLQKPSFPFLWGLTVVGRRPAGPGPSRGLHRLLRNLLCLCLIEPGHEIKHEVICNGTGAVAVSAWL

SEQ ID NO: 862628 - protein, 106 aa, Homo sapiens
HSMDTTSCRGTGLPRVGGRDPVLTSLSCFPLLQYGFDILIITATAKIPLCFINPEENTMSAGAVGILQQLSVLPVSPGKNIFLSSEQCLPLQASSLSNKRSTSPNL

SEQ ID NO: 862629 - protein, 988 aa, Homo sapiens
MCVTKKLFFIVQRTIFVGCVIWKFCLHYVLRGFLCFNSMQLDRNTLPKKGLRYTPSSRQANQEEGKEWLRSHSTGGLQDTGNQSPLVSPSAMSSSAAGKYHFSNLVSPTNLSQFNLPGPSMMRSNSIPAQDSSFDLYDDSQLCGSATSLEERPRAISHSGSFRDSMEEVHGSSLSLVSSTSSLYSTAEEKAHSEQIHKLRRELVASQEKVATLTSQLSANAHLVAAFEKSLGNMTGRLQSLTMTAEQKESELIELRETIEMLKAQNSAAQAAIQGALNGPDHPPKDLRIRRQHSSESVSSINSATSHSSIGSGNDADSKKKKKKNWVNSRGSELRSSFKQAFGKKKSTKPPSSHSDIEELTDSSLPASPKLPHNAGDCGSASMKPSQSASAICECTEAEAEIILQLKSELREKELKLTDIRLEALSSAHHLDQIREAMNRMQNEIEILKAENDRLKAETGNTAKPTRPPSESSSSTSSSSSRQSLGLSLNNLNITEAVSSDILLDDAGDATGHKDGRSVKIIVSISKGYGRAKDQKSQAYLIGSIGVSGKTKWDVLDGVIRRLFKEYVFRIDTSTSLGLSSDCIASYCIGDLIRSHNLEVPELLPCGYLVGDNNIITVNLKGVEENSLDSFVFDTLIPKPITQRYFNLLMEHHRIILSGPSGTGKTYLANKLAEYVITKSGRKKTEDAIATFNVDHKSSKELQQYLANLAEQCSADNNGVELPVVIILDNLHHVGSLSDIFNGFLNCKYNKCPYIIGTMNQGVSSSPNLELHHNFRWVLCANHTEPVKGFLGRYLRRKLIEIEIERNIRNNDLVKIIDWIPKTWHHLNSFLETHSSSDVTIGPRLFLPCPMDVEGSRVWFMDLWNYSLVPYILEAVREGLQMYGKRTPWEDPSKWVLDTYPWSSATLPQESPALLQLRPEDVGYESCTSTKEATTSKHIPQTDTEGDPLMNMLMKLQEAANYSSTQSCDSESTSHHEDILDSSLESTL

SEQ ID NO: 862630 - protein, 988 aa, Homo sapiens; identical to SEQ ID NO: 862629

SEQ ID NO: 862631 - protein, 594 aa, Homo sapiens
MAAESGELIGACEFMKDRLYFATLRNRPKSTVNTHYFSIDEELVYENFYADFGPLNLAMVYRYCCKLNKKLKSYSLSRKKIVHYTCFDQRKRANAAFLIGAYAVIYLKKTPEEAYRALLSGSNPPYLPFRDASFGNCTYNLTILDCLQGIRKGLQHGFFDFETFDVDEYEHYERVENGDFNWIVPGKFLAFSGPHPKSKIENGYPLHAPEAYFPYFKKHNVTAVVRLNKKIYEAKRFTDAGFEHYDLFFIDGSTPSDNIVRRFLNICENTEGAIAVHCKAGLGRTGTLIACYVMKHYRFTHAEIIAWIRICRPGSIIGPQQHFLEEKQASLWVQGDIFRSKLKNRPSSEGSINKILSGLDDMSIGGNLSKTQNMERFGEDNLEDDDVEMKNGITQGDKLRALKSQRQPRTSPSCAFRSDDTKGHPRAVSQPFRLSSSLQGSAVTLKTSKMALSPSATAKRINRTSLSSGATVRSFSINSRLASSLGNLNAATDDPENKKTSSSSKAGFTASPFTNLLNGSSQPTTRNYPELNNNQYNRSSNSNGGNLNSPPGPHSAKTEEHTTILRPSYTGLSSSSARFLSRSIPSLQSEYVHY

SEQ ID NO: 862632 - protein, 383 aa, Homo sapiens
MAAESGELIGACEFMKDRLYFATLRNRPKSTVNTHYFSIDEELVYENFYADFGPLNLAMVYRYCCKLNKKLKSYSLSRKKIVHYTCFDQRKRANAAFLIGAYAVIYLKKTPEEAYRALLSGSNPPYLPFRDASFGNCTYNLTILDCLQGIRKGLQHGFFDFETFDVDEYEHYERVENGDFNWIVPGKFLAFSGPHPKSKIENGYPLHAPEAYFPYFKKHNVTAVVRLNKKIYEAKRFTDAGFEHYDLFFIDGSTPSDNIVRRFLNICENTEGAIAVHCKAGLGRTGTLIACYVMKHYRFTHAEIIAWIRICRPGSIIGPQQHFLEEKQASLWVQGDIFRSKLKNRPSSEGSINKILSGLDDMSIGGNLSKTQNMERFGEVSFP

SEQ ID NO: 862633 - protein, 623 aa, Homo sapiens
MAAESGELIGACEFMKDRLYFATLRNRPKSTVNTHYFSIDEELVYENFYADFGPLNLAMVYRYCCKLNKKLKSYSLSRKKIVHYTCFDQRKRANAAFLIGAYAVIYLKKTPEEAYRALLSGSNPPYLPFRDASFGNCTYNLTILDCLQGIRKGLQHGFFDFETFDVDEYEHYERVENGDFNWIVPGKFLAFSGPHPKSKIENGYPLHAPEAYFPYFKKHNVTAVVRLNKKIYEAKRFTDAGFEHYDLFFIDGSTPSDNIVRRFLNICENTEGAIAVHCKAGLGRTGTLIACYVMKHYRFTHAEIIAWIRICRPGSIIGPQQHFLEEKQASLWVQGDIFRSKLKNRPSSEGSINKILSGLDDMSIGGNLSKTQNMERFGEDNLEDDDVEMKNGITQGDKLRALKSQRQPRTSPSCAFRSDDTKGHPRAVSQPFRLSSSLQGSAVTLKTSKMALSPSATAKRINRTSLSSGATVRSFSINSRLASSLGNLNAATDDPENKKTSSSSKAGFTASPFTNLLNGSSQPTTRNYPELNNNQYNRSSNSNGGNLNSPPGPHSAKTEEHTTILRPSYTGLSSSSARFLSRSIPVSAQTPPPGPQNPECNFCALPSQPRLPPKKFNSAKEAF

SEQ ID NO: 862634 - protein, 595 aa, Homo sapiens
MGNFLSRENKVQVISESDRLYFATLRNRPKSTVNTHYFSIDEELVYENFYADFGPLNLAMVYRYCCKLNKKLKSYSLSRKKIVHYTCFDQRKRANAAFLIGAYAVIYLKKTPEEAYRALLSGSNPPYLPFRDASFGNCTYNLTILDCLQGIRKGLQHGFFDFETFDVDEYEHYERVENGDFNWIVPGKFLAFSGPHPKSKIENGYPLHAPEAYFPYFKKHNVTAVVRLNKKIYEAKRFTDAGFEHYDLFFIDGSTPSDNIVRRFLNICENTEGAIAVHCKAGLGRTGTLIACYVMKHYRFTHAEIIAWIRICRPGSIIGPQQHFLEEKQASLWVQGDIFRSKLKNRPSSEGSINKILSGLDDMSIGGNLSKTQNMERFGEDNLEDDDVEMKNGITQGDKLRALKSQRQPRTSPSCAFRSDDTKGHPRAVSQPFRLSSSLQGSAVTLKTSKMALSPSATAKRINRTSLSSGATVRSFSINSRLASSLGNLNAATDDPENKKTSSSSKAGFTASPFTNLLNGSSQPTTRNYPELNNNQYNRSSNSNGGNLNSPPGPHSAKTEEHTTILRPSYTGLSSSSARFLSRSIPSLQSEYVHY

SEQ ID NO: 862635 - protein, 515 aa, Homo sapiens
MSTIAAFYGGKSILITGATGFLGKVLMEKLFRTSPDLKVIYILVRPKAGQTLQQRVFQILDSKLFEKVKEVCPNVHEKIRAIYADLNQNDFAISKEDMQELLSCTNIIFHCAATVRFDDTLRHAVQLNVTATRQLLLMASQMPKLEAFIHISTAYSNCNLKHIDEVIYPCPVEPKKIIDSLEWLDDAIIDEITPKLIRDWPNIYTYTKALGEMVVQQESRNLNIAIIRPSIVGATWQEPFPGWVDNINGPNGIIIATGKGFLRAIKATPMAVADVIPVDTVVNLMLAVGWYTAVHRPKSTLVYHITSGNMNPCNWHKMGVQVLATFEKIPFERPFRRPNANFTSNSFTSQYWNAVSHRAPAIIYDCYLRLTGRKPRMTKLMNRLLRTVSMLEYFINRSWEWSTYNTEMLMSELSPEDQRVFNFDVRQLNWLEYIENYVLGVKKYLLKEDMAGIPKAKQRLKRLRNIHYLFNTALFLIAWRLLIARSQMARNVWFFIVSFCYKFLSYFRASSTLKV

SEQ ID NO: 862636 - protein, 515 aa, Homo sapiens; identical to SEQ ID NO: 862635

SEQ ID NO: 862637 - protein, 67 aa, Homo sapiens
ACARGRPAHDAVAPATCRAFAGPSPSSRPGLRLPPVSRPVPRQRRSRGRSEGGWFPPAPHPVSEPDI

SEQ ID NO: 862638 - protein, 497 aa, Homo sapiens
MSTIAAFYGGKSILITGATGFLGKVLMEKLFRTSPDLKVIYILVRPKAGQTLQQRVFQILDSKLFEKVKEVCPNVHEKIRAIYADLNQNDFAISKEDMQELLSCTNIIFHCAATVRFDDTLRHAVQLNVTATRQLLLMASQMPKLEAFIHISTAYSNCNLKHIDEVIYPCPVEPKKIIDSLEWLDDAIIDEITPKLIRDWPNIYTYTKALGEMVVQQESRNLNIAIIRPSIVGATWQEPFPGWVDNINGPNGIIIATGKGFLRAIKATPMAVADVIPVDTVVNLMLAVGWYTAVHRPKSTLVYHITSGNMNPCNWHKMGVQVLATFEKIPFERPFRRPNANFTSNSFTSQYWNAVSHRAPAIIYDCYLRLTGRKPRMTKLMNRLLRTVSMLEYFINRSWEWSTYNTEMLMSELSPEDQRVFNFDVRQLNWLEYIENYVLGVKKYLLKEDMAGIPKAKQRLKRLRNIHYLFNTALFLIAWRLLIARSQMARNVWFFIM

SEQ ID NO: 862639 - protein, 515 aa, Homo sapiens; identical to SEQ ID NO: 862635

SEQ ID NO: 862640 - protein, 453 aa, Homo sapiens
MLFEKVKEVCPNVHEKIRAIYADLNQNDFAISKEDMQELLSCTNIIFHCAATVRFDDTLRHAVQLNVTATRQLLLMASQMPKLEAFIHISTAYSNCNLKHIDEVIYPCPVEPKKIIDSLEWLDDAIIDEITPKLIRDWPNIYTYTKALGEMVVQQESRNLNIAIIRPSIVGATWQEPFPGWVDNINGPNGIIIATGKGFLRAIKATPMAVADVIPVDTVVNLMLAVGWYTAVHRPKSTLVYHITSGNMNPCNWHKMGVQVLATFEKIPFERPFRRPNANFTSNSFTSQYWNAVSHRAPAIIYDCYLRLTGRKPRMTKLMNRLLRTVSMLEYFINRSWEWSTYNTEMLMSELSPEDQRVFNFDVRQLNWLEYIENYVLGVKKYLLKEDMAGIPKAKQRLKRLRNIHYLFNTALFLIAWRLLIARSQMARNVWFFIVSFCYKFLSYFRASSTLKV

SEQ ID NO: 862641 - protein, 1127 aa, Homo sapiens
MAENKGGGEAESGGGGSGSAPVTAGAAGPAAQEAEPPLTAVLVEEEEEEGGRAGAEGGAAGPDDGGVAAASSGSAQAASSPAASVGTGVAGGAVSTPAPAPASAPAPGPSAGPPPGPPASLLDTCAVCQQSLQSRREAEPKLLPCLHSFCLRCLPEPERQLSVPIPGGSNGDIQQVGVIRCPVCRQECRQIDLVDNYFVKDTSEAPSSSDEKSEQVCTSCEDNASAVGFCVECGEWLCKTCIEAHQRVKFTKDHLIRKKEDVSESVGASGQRPVFCPVHKQEQLKLFCETCDRLTCRDCQLLEHKEHRYQFLEEAFQNQKGAIENLLAKLLEKKNYVHFAATQVQNRIKEVNETNKRVEQEIKVAIFTLINEINKKGKSLLQQLENVTKERQMKLLQQQNDITGLSRQVKHVMNFTNWAIASGSSTALLYSKRLITFQLRHILKARCDPVPAANGAIRFHCDPTFWAKNVVNLGNLVIESKPAPGYTPNVVVGQVPPGTNHISKTPGQINLAQLRLQHMQQQVYAQKHQQLQQMRMQQPPAPVPTTTTTTQQHPRQAAPQMLQQQPPRLISVQTMQRGNMNCGAFQAHQMRLAQNAARIPGIPRHSGPQYSMMQPHLQRQHSNPGHAGPFPVVSVHNTTINPTSPTTATMANANRGPTSPSVTAIELIPSVTNPENLPSLPDIPPIQLEDAGSSSLDNLLSRYISGSHLPPQPTSTMNPSPGPSALSPGSSGLSNSHTPVRPPSTSSTGSRGSCGSSGRTAEKTSLSFKSDQVKVKQEPGTEDEICSFSGGVKQEKTEDGRRSACMLSSPESSLTPPLSTNLHLESELDALASLENHVKTEPADMNESCKQSGLSSLVNGKSPIRSLMHRSARIGGDGNNKDDDPNEDWCAVCQNGGDLLCCEKCPKVFHLTCHVPTLLSFPSGDWICTFCRDIGKPEVEYDCDNLQHSKKGKTAQGLSPVDQRKCERLLLYLYCHELSIEFQEPVPASIPNYYKIIKKPMDLSTVKKKLQKKHSQHYQIPDDFVADVRLIFKNCERFNEMMKVVQVYADTQEINLKADSEVAQAGKAVALYFEDKLTEIYSDRTFAPLPEFEQEEDDGEVTEDSDEDFIQPRRKRLKSDERPVHIK

SEQ ID NO: 862642 - protein, 984 aa, Homo sapiens
TPCHKQEQLKLFCETCDRLTCRDCQLLEHKEHVGVIRCPVCRQECRQIDLVDNYFVKDTSEAPSSSDEKSEQVCTSCEDNASAVGFCVECGEWLCKTCIEAHQRVKFTKDHLIRKKEDVSESVGASGQRPVFCPVHKQEQLKLFCETCDRLTCRDCQLLEHKEHRYQFLEEAFQNQKGAIENLLAKLLEKKNYVHFAATQVQNRIKEVNETNKRVEQEIKVAIFTLINEINKKGKSLLQQLENVTKERQMKLLQQQNDITGLSRQVKHVMNFTNWAIASGSSTALLYSKRLITFQLRHILKARCDPVPAANGAIRFHCDPTFWAKNVVNLGNLVIESKPAPGYTPNVVVGQVPPGTNHISKTPGQINLAQLRLQHMQQQVYAQKHQQLQQMRMQQPPAPVPTTTTTTQQHPRQAAPQMLQQQPPRLISVQTMQRGNMNCGAFQAHQMRLAQNAARIPGIPRHSGPQYSMMQPHLQRQHSNPGHAGPFPVVSVHNTTINPTSPTTATMANANRGPTSPSVTAIELIPSVTNPENLPSLPDIPPIQLEDAGSSSLDNLLSRYISGSHLPPQPTSTMNPSPGPSALSPGSSGLSNSHTPVRPPSTSSTGSRGSCGSSGRTAEKTSLSFKSDQVKVKQEPGTEDEICSFSGGVKQEKTEDGRRSACMLSSPESSLTPPLSTNLHLESELDALASLENHVKTEPADMNESCKQSGLSSLVNGKSPIRSLMHRSARIGGDGNNKDDDPNEDWCAVCQNGGDLLCCEKCPKVFHLTCHVPTLLSFPSGDWICTFCRDIGKPEVEYDCDNLQHSKKGKTAQGLSPVDQRKCERLLLYLYCHELSIEFQEPVPASIPNYYKIIKKPMDLSTVKKKLQKKHSQHYQIPDDFVADVRLIFKNCERFNEMMKVVQVYADTQEINLKADSEVAQAGKAVALYFEDKLTEIYSDRTFAPLPEFEQEEDDGEVTEDSDEDFIQPRRKRLKSDERPVHIK

SEQ ID NO: 862643 - protein, 979 aa, Homo sapiens
MFANISFRNVESIRWSGLQFSSFDIAFVGVIRCPVCRQECRQIDLVDNYFVKDTSEAPSSSDEKSEQVCTSCEDNASAVGFCVECGEWLCKTCIEAHQRVKFTKDHLIRKKEDVSESVGASGQRPVFCPVHKQEQLKLFCETCDRLTCRDCQLLEHKEHRYQFLEEAFQNQKGAIENLLAKLLEKKNYVHFAATQVQNRIKEVNETNKRVEQEIKVAIFTLINEINKKGKSLLQQLENVTKERQMKLLQQQNDITGLSRQVKHVMNFTNWAIASGSSTALLYSKRLITFQLRHILKARCDPVPAANGAIRFHCDPTFWAKNVVNLGNLVIESKPAPGYTPNVVVGQVPPGTNHISKTPGQINLAQLRLQHMQQQVYAQKHQQLQQMRMQQPPAPVPTTTTTTQQHPRQAAPQMLQQQPPRLISVQTMQRGNMNCGAFQAHQMRLAQNAARIPGIPRHSGPQYSMMQPHLQRQHSNPGHAGPFPVVSVHNTTINPTSPTTATMANANRGPTSPSVTAIELIPSVTNPENLPSLPDIPPIQLEDAGSSSLDNLLSRYISGSHLPPQPTSTMNPSPGPSALSPGSSGLSNSHTPVRPPSTSSTGSRGSCGSSGRTAEKTSLSFKSDQVKVKQEPGTEDEICSFSGGVKQEKTEDGRRSACMLSSPESSLTPPLSTNLHLESELDALASLENHVKTEPADMNESCKQSGLSSLVNGKSPIRSLMHRSARIGGDGNNKDDDPNEDWCAVCQNGGDLLCCEKCPKVFHLTCHVPTLLSFPSGDWICTFCRDIGKPEVEYDCDNLQHSKKGKTAQGLSPVDQRKCERLLLYLYCHELSIEFQEPVPASIPNYYKIIKKPMDLSTVKKKLQKKHSQHYQIPDDFVADVRLIFKNCERFNEMMKVVQVYADTQEINLKADSEVAQAGKAVALYFEDKLTEIYSDRTFAPLPEFEQEEDDGEVTEDSDEDFIQPRRKRLKSDERPVHIK

SEQ ID NO: 862644 - protein, 609 aa, Homo sapiens
MQQQVYAQKHQQLQQMRMQQPPAPVPTTTTTTQQHPRQAAPQMLQQQPPRLISVQTMQRGNMNCGAFQAHQMRLAQNAARIPGIPRHSGPQYSMMQPHLQRQHSNPGHAGPFPVVSVHNTTINPTSPTTATMANANRGPTSPSVTAIELIPSVTNPENLPSLPDIPPIQLEDAGSSSLDNLLSRYISGSHLPPQPTSTMNPSPGPSALSPGSSGLSNSHTPVRPPSTSSTGSRGSCGSSGRTAEKTSLSFKSDQVKVKQEPGTEDEICSFSGGVKQEKTEDGRRSACMLSSPESSLTPPLSTNLHLESELDALASLENHVKTEPADMNESCKQSGLSSLVNGKSPIRSLMHRSARIGGDGNNKDDDPNEDWCAVCQNGGDLLCCEKCPKVFHLTCHVPTLLSFPSGDWICTFCRDIGKPEVEYDCDNLQHSKKGKTAQGLSPVDQRKCERLLLYLYCHELSIEFQEPVPASIPNYYKIIKKPMDLSTVKKKLQKKHSQHYQIPDDFVADVRLIFKNCERFNEMMKVVQVYADTQEINLKADSEVAQAGKAVALYFEDKLTEIYSDRTFAPLPEFEQEEDDGEVTEDSDEDFIQPRRKRLKSDERPVHIK

SEQ ID NO: 862645 - protein, 917 aa, Homo sapiens
TPCHKQEQLKLFCETCDRLTCRDCQLLEHKEHVGVIRCPVCRQECRQIDLVDNYFVKDTSEAPSSSDEKSEQVCTSCEDNASAVGFCVECGEWLCKTCIEAHQRVKFTKDHLIRKKEDVSESVGASGQRPVFCPVHKQEQLKLFCETCDRLTCRDCQLLEHKEHRYQFLEEAFQNQKGAIENLLAKLLEKKNYVHFAATQVQNRIKEVNETNKRVEQEIKVAIFTLINEINKKGKSLLQQLENVTKERQMKLLQQQNDITGLSRQVKHVMNFTNWAIASGSSTALLYSKRLITFQLRHILKARCDPVPAANGAIRFHCDPTFWAKNVVNLGNLVIESKPAPGYTPNVVVGQVPPGTNHISKTPGQINLAQLRLQHMQQQVYAQKHQQLQQMRMQQPPAPVPTTTTTTQQHPRQAAPQMLQQQPPRLISVQTMQRGNMNCGAFQAHQMRLAQNAARIPGIPRHSGPQYSMMQPHLQRQLEDAGSSSLDNLLSRYISGSHLPPQPTSTMNPSPGPSALSPGSSGLSNSHTPVRPPSTSSTGSRGSCGSSGRTAEKTSLSFKSDQVKVKQEPGTEDEICSFSGGVKQEKTEDGRRSACMLSSPESSLTPPLSTNLHLESELDALASLENHVKTEPADMNESCKQSGLSSLVNGKSPIRSLMHRSARIGGDGNNKDDDPNEDWCAVCQNGGDLLCCEKCPKVFHLTCHVPTLLSFPSGDWICTFCRDIGKPEVEYDCDNLQHSKKGKTAQGLSPVDQRKCERLLLYLYCHELSIEFQEPVPASIPNYYKIIKKPMDLSTVKKKLQKKHSQHYQIPDDFVADVRLIFKNCERFNEMMKVVQVYADTQEINLKADSEVAQAGKAVALYFEDKLTEIYSDRTFAPLPEFEQEEDDGEVTEDSDEDFIQPRRKRLKSDERPVHIK

SEQ ID NO: 862646 - protein, 984 aa, Homo sapiens; identical to SEQ ID NO: 862642

SEQ ID NO: 862647 - protein, 110 aa, Homo sapiens
MDLSTVKKKLQKKHSQHYQIPDDFVADVRLIFKNCERFNEADSEVAQAGKAVALYFEDKLTEIYSDRTFAPLPEFEQEEDDGEVTEDSDEDFIQPRRKRLKSDERPVHIK

SEQ ID NO: 862648 - protein, 984 aa, Homo sapiens; identical to SEQ ID NO: 862642

SEQ ID NO: 862649 - protein, 984 aa, Homo sapiens; identical to SEQ ID NO: 862642

SEQ ID NO: 862650 - protein, 941 aa, Homo sapiens
TPCHKQEQLKLFCETCDRLTCRDCQLLEHKEHVGVIRCPVCRQECRQIDLVDNYFVKDTSEAPSSSDEKSEQVCTSCEDNASAVGFCVECGEWLCKTCIEAHQRVKFTKDHLIRKKEDVSESVGASGQRPVFCPVHKQEQLKLFCETCDRLTCRDCQLLEHKEHRYQFLEEAFQNQKGAIENLLAKLLEKKNYVHFAATQVQNRIKEVNETNKRVEQEIKVAIFTLINEINKKGKSLLQQLENVTKERQMKLLQQQNDITGLSRQVKHVMNFTNWAIASGSSTALLYSKRLITFQLRHILKARCDPVPAANGAIRFHCDPTFWAKNVVNLGNLVIESKPAPGYTPNVVVGQVPPGTNHISKTPGQINLAQLRLQHMQQQVYAQKHQQLQQMRMQQPPAPVPTTTTTTQQHPRQAAPQMLQQQPPRLISVQTMQRGNMNCGAFQAHQMRLAQNAARIPGIPRHSGPQYSMMQPHLQRQHSNPGHAGPFPVVSVHNTTINPTSPTTATMANANRGPTSPSVTAIELIPSVTNPENLPSLPDIPPIQLEDAGSSSLDNLLSRYISGSHLPPQPTSTMNPSPGPSALSPGSSGLSNSHTPVRPPSTSSTGSRGSCGSSGRTAEKTSLSFKSDQVKVKQEPGTEDEICSFSGGVKQEKTEDGRRSACMLSSPESSLTPPLSTNLHLESELDALASLENHVKTEPADMNESCKQSGLSSLVNGKSPIRSLMHRSARIGGDGNNKDDDPNEDWCAVCQNGGDLLCCEKCPKVFHLTCHVPTLLSFPSGDWICTFCRDIGKPEVEYDCDNLQHSKKGKTAQGLSPVDQRKCERLLLYLYCHELSIEFQEPVPASIPNYYKIIKKPMDLSTVKKKLQKKHSQHYQIPDDFVADVRLIFKNCERFNEMMKVVQVYADTQEINLKVSFSDHANLVKEYALPIGEYSYLLLAG

SEQ ID NO: 862651 - protein, 547 aa, Homo sapiens
TPCHKQEQLKLFCETCDRLTCRDCQLLEHKEHVGVIRCPVCRQECRQIDLVDNYFVKDTSEAPSSSDEKSEQVCTSCEDNASAVGFCVECGEWLCKTCIEAHQRVKFTKDHLIRKKEDVSESVGASGQRPVFCPVHKQEQLKLFCETCDRLTCRDCQLLEHKEHRYQFLEEAFQNQKGAIENLLAKLLEKKNYVHFAATQVQNRIKEVNETNKRVEQEIKVAIFTLINEINKKGKSLLQQLENVTKERQMKLLQQQNDITGLSRQVKHVMNFTNWAIASGSSTALLYSKRLITFQLRHILKARCDPVPAANGAIRFHCDPTFWAKNVVNLGNLVIESKPAPGYTPNVVVGQVPPGTNHISKTPGQINLAQLRLQHMQQQVYAQKHQQLQQMRMQQPPAPVPTTTTTTQQHPRQAAPQMLQQQPPRLISVQTMQRGNMNCGAFQAHQMRLAQNAARIPGIPRHSGPQYSMMQPHLQRQHSNPGHAGPFPVVSVHNTTINPTSPTTATMANANRGPTSPSVTAIELIPSVTNPENLPSLPDIPPIQVCI

SEQ ID NO: 862652 - protein, 967 aa, Homo sapiens
TPCHKQEQLKLFCETCDRLTCRDCQLLEHKEHVGVIRCPVCRQECRQIDLVDNYFVKDTSEAPSSSDEKSEQVCTSCEDNASAVGFCVECGEWLCKTCIEAHQRVKFTKDHLIRKKEDVSESVGASGQRPVFCPVHKQEQLKLFCETCDRLTCRDCQLLEHKEHRYQFLEEAFQNQKGAIENLLAKLLEKKNYVHFAATQVQNRIKEVNETNKRVEQEIKVAIFTLINEINKKGKSLLQQLENVTKERQMKLLQQQNDITGLSRQVKHVMNFTNWAIASGSSTALLYSKRLITFQLRHILKARCDPVPAANGAIRFHCDPTFWAKNVVNLGNLVIESKPAPGYTPNVVVGQVPPGTNHISKTPGQINLAQLRLQHMQQQVYAQKHQQLQQMRMQQPPAPVPTTTTTTQQHPRQAAPQMLQQQPPRLISVQTMQRGNMNCGAFQAHQMRLAQNAARIPGIPRHSGPQYSMMQPHLQRQHSNPGHAGPFPVVSVHNTTINPTSPTTATMANANRGPTSPSVTAIELIPSVTNPENLPSLPDIPPIQLEDAGSSSLDNLLSRYISGSHLPPQPTSTMNPSPGPSALSPGSSGLSNSHTPVRPPSTSSTGSRGSCGSSGRTAEKTSLSFKSDQVKVKQEPGTEDEICSFSGGVKQEKTEDGRRSACMLSSPESSLTPPLSTNLHLESELDALASLENHVKTEPADMNESCKQSGLSSLVNGKSPIRSLMHRSARIGGDGNNKDDDPNEDWCAVCQNGGDLLCCEKCPKVFHLTCHVPTLLSFPSGDWICTFCRDIGKPEVEYDCDNLQHSKKGKTAQGLSPVDQRKCERLLLYLYCHELSIEFQEPVPASIPNYYKIIKKPMDLSTVKKKLQKKHSQHYQIPDDFVADVRLIFKNCERFNEADSEVAQAGKAVALYFEDKLTEIYSDRTFAPLPEFEQEEDDGEVTEDSDEDFIQPRRKRLKSDERPVHIK

SEQ ID NO: 862653 - protein, 609 aa, Homo sapiens; identical to SEQ ID NO: 862644

SEQ ID NO: 862654 - protein, 976 aa, Homo sapiens
TPCHKQEQLKLFCETCDRLTCRDCQLLEHKEHVGVIRCPVCRQECRQIDLVDNYFVKDTSEAPSSSDEKSEQVCTSCEDNASAVGFCVECGEWLCKTCIEAHQRVKFTKDHLIRKKEDVSESVGASGQRPVFCPVHKQEQLKLFCETCDRLTCRDCQLLEHKEHRYQFLEEAFQNQKGAIENLLAKLLEKKNYVHFAATQVQNRIKEVNETNKRVEQEIKVAIFTLINEINKKGKSLLQQLENVTKERQMKLLQQQNDITGLSRQVKHVMNFTNWAIASGSSTALLYSKRLITFQLRHILKARCDPVPAANGAIRFHCDPTFWAKNVVNLGNLVIESKPAPGYTPNVVVGQVPPGTNHISKTPGQINLAQLRLQHMQQQVYAQKHQQLQQMRMQQPPAPVPTTTTTTQQHPRQAAPQMLQQQPPRLISVQTMQRGNMNCGAFQAHQMRLAQNAARIPGIPRHSGPQYSMMQPHLQRQHSNPGHAGPFPVVSVHNTTINPTSPTTATMANANRGPTSPSVTAIELIPSVTNPENLPSLPDIPPIQLEDAGSSSLDNLLSRYISGSHLPPQPTSTMNPSPGPSALSPGSSGLSNSHTPVRPPSTSSTGSRGSCGSSGRTAEKTSLSFKSDQVKVKQEPGTEDEICSFSGGVKQEKTEDGRRSACMLSSPESSLTPPLSTNLHLESELDALASLENHVKTEPADMNESCKQSGLSSLVNGKSPIRSLMHRSARIGGDGNNKDDDPNEDWCAVCQNGGDLLCCEKCPKVFHLTCHVPTLLSFPSGDWICTFCRDIGKPEVEYDCDNLQHSKKGKTAQGLSPVDQRKCERLLLYLYCHELSIEFQEPVPASIPNYYKIIKKPMDLSTVKKKLQKKHSQHYQIPDDFVADVRLIFKNCERFNEMMKVVQVYADTQEINLKADSEVAQAGKAVALYFEDKLTEIYSDRTFAPLPEFEQEEDDGERTDFSKNLQKQLIIEISKY

SEQ ID NO: 862655 - protein, 984 aa, Homo sapiens; identical to SEQ ID NO: 862642

SEQ ID NO: 862656 - protein, 566 aa, Homo sapiens
TPCHKQEQLKLFCETCDRLTCRDCQLLEHKEHVGVIRCPVCRQECRQIDLVDNYFVKDTSEAPSSSDEKSEQVCTSCEDNASAVGFCVECGEWLCKTCIEAHQRVKFTKDHLIRKKEDVSESVGASGQRPVFCPVHKQEQLKLFCETCDRLTCRDCQLLEHKEHRYQFLEEAFQNQKGAIENLLAKLLEKKNYVHFAATQVQNRIKEVNETNKRVEQEIKVAIFTLINEINKKGKSLLQQLENVTKERQMKLLQQQNDITGLSRQVKHVMNFTNWAIASGSSTALLYSKRLITFQLRHILKARCDPVPAANGAIRFHCDPTFWAKNVVNLGNLVIESKPAPGYTPNVVVGQVPPGTNHISKTPGQINLAQLRLQHMQQQVYAQKHQQLQQMRMQQPPAPVPTTTTTTQQHPRQAAPQMLQQQPPRLISVQTMQRGNMNCGAFQAHQMRLAQNAARIPGIPRHSGPQYSMMQPHLQRQHSNPGHAGPFPVVSVHNTTINPTSPTTATMANANRGPTSPSVTAIELIPSVTNPENLPSLPDIPPIQANVVPMMHSWYEFGAREKTQDQ

SEQ ID NO: 862657 - protein, 782 aa, Homo sapiens
TPCHKQEQLKLFCETCDRLTCRDCQLLEHKEHVGVIRCPVCRQECRQIDLVDNYFVKDTSEAPSSSDEKSEQVCTSCEDNASAVGFCVECGEWLCKTCIEAHQRVKFTKDHLIRKKEDVSESVGASGQRPVFCPVHKQEQLKLFCETCDRLTCRDCQLLEHKEHRYQFLEEAFQNQKGAIENLLAKLLEKKNYVHFAATQVQNRIKEVNETNKRVEQEIKVAIFTLINEINKKGKSLLQQLENVTKERQMKLLQQQNDITGLSRQVKHVMNFTNWAIASGSSTALLYSKRLITFQLRHILKARCDPVPAANGAIRFHCDPTFWAKNVVNLGNLVIESKPAPGYTPNVVVGQVPPGTNHISKTPGQINLAQLRLQHMQQQVYAQKHQQLQQMRMQQPPAPVPTTTTTTQQHPRQAAPQMLQQQPPRLISVQTMQRGNMNCGAFQAHQMRLAQNAARIPGIPRHSGPQYSMMQPHLQRQHSNPGHAGPFPVVSVHNTTINPTSPTTATMANANRGPTSPSVTAIELIPSVTNPENLPSLPDIPPIQLEDAGSSSLDNLLSRYISGSHLPPQPTSTMNPSPGPSALSPGSSGLSNSHTPVRPPSTSSTGSRGSCGSSGRTAEKTSLSFKSDQVKVKQEPGTEDEICSFSGGVKQEKTEDGRRSACMLSSPESSLTPPLSTNLHLESELDALASLENHVKTEPADMNESCKQSGLSSLVNGKSPIRSLMHRSARIGGDGNNKDDDPNEDWCAVCQNGGDLLCCEKCPKVFHLTCHVPTLLSFPRYQ

SEQ ID NO: 862658 - protein, 1110 aa, Homo sapiens
MAENKGGGEAESGGGGSGSAPVTAGAAGPAAQEAEPPLTAVLVEEEEEEGGRAGAEGGAAGPDDGGVAAASSGSAQAASSPAASVGTGVAGGAVSTPAPAPASAPAPGPSAGPPPGPPASLLDTCAVCQQSLQSRREAEPKLLPCLHSFCLRCLPEPERQLSVPIPGGSNGDIQQVGVIRCPVCRQECRQIDLVDNYFVKDTSEAPSSSDEKSEQVCTSCEDNASAVGFCVECGEWLCKTCIEAHQRVKFTKDHLIRKKEDVSESVGASGQRPVFCPVHKQEQLKLFCETCDRLTCRDCQLLEHKEHRYQFLEEAFQNQKGAIENLLAKLLEKKNYVHFAATQVQNRIKEVNETNKRVEQEIKVAIFTLINEINKKGKSLLQQLENVTKERQMKLLQQQNDITGLSRQVKHVMNFTNWAIASGSSTALLYSKRLITFQLRHILKARCDPVPAANGAIRFHCDPTFWAKNVVNLGNLVIESKPAPGYTPNVVVGQVPPGTNHISKTPGQINLAQLRLQHMQQQVYAQKHQQLQQMRMQQPPAPVPTTTTTTQQHPRQAAPQMLQQQPPRLISVQTMQRGNMNCGAFQAHQMRLAQNAARIPGIPRHSGPQYSMMQPHLQRQHSNPGHAGPFPVVSVHNTTINPTSPTTATMANANRGPTSPSVTAIELIPSVTNPENLPSLPDIPPIQLEDAGSSSLDNLLSRYISGSHLPPQPTSTMNPSPGPSALSPGSSGLSNSHTPVRPPSTSSTGSRGSCGSSGRTAEKTSLSFKSDQVKVKQEPGTEDEICSFSGGVKQEKTEDGRRSACMLSSPESSLTPPLSTNLHLESELDALASLENHVKTEPADMNESCKQSGLSSLVNGKSPIRSLMHRSARIGGDGNNKDDDPNEDWCAVCQNGGDLLCCEKCPKVFHLTCHVPTLLSFPSGDWICTFCRDIGKPEVEYDCDNLQHSKKGKTAQGLSPVDQRKCERLLLYLYCHELSIEFQEPVPASIPNYYKIIKKPMDLSTVKKKLQKKHSQHYQIPDDFVADVRLIFKNCERFNEADSEVAQAGKAVALYFEDKLTEIYSDRTFAPLPEFEQEEDDGEVTEDSDEDFIQPRRKRLKSDERPVHIK

SEQ ID NO: 862659 - protein, 182 aa, Homo sapiens
RRRRLPACSLVAAEPAAGRLRQPRPGRPGPRQRGRMALKRIQKELTDLQRDPPAQCSAGPVGDDLFHWQATIMGPNDSPYQGGVFFLTIHFPTDYPFKPPKVAFTTKIYHPNINSNGSICLDILRSQWSPALTVSKVLLSICSLLCDPNPDDPLVPEIAHTYKADREKYNRLAREWTQKYAM

SEQ ID NO: 862660 - protein, 167 aa, Homo sapiens
MVPASASGEASGSLQSWQKAKEKQACHLELTDLQRDPPAQCSAGPVGDDLFHWQATIMGPNDSPYQGGVFFLTIHFPTDYPFKPPKVAFTTKIYHPNINSNGSICLDILRSQWSPALTVSKVLLSICSLLCDPNPDDPLVPEIAHTYKADREKYNRLAREWTQKYAM

SEQ ID NO: 862661 - protein, 171 aa, Homo sapiens
MALKRIQKELTDLQRDPPAQCSAGPVGDDLFHWQATIMGPNDSPYQGGVFFLTIHFPTDYPFKPPKVRSLSQLPCCLDEGQHVTRGPSSQVAFTTKIYHPNINSNGSICLDILRSQWSPALTVSKVLLSICSLLCDPNPDDPLVPEIAHTYKADREKYNRLAREWTQKYAM

SEQ ID NO: 862662 - protein, 157 aa, Homo sapiens
MALKRIQKELTDLQRDPPAQCSAGPVGDDLFHWQATIMGPNDSPYQGGVFFLTIHFPTDYPFKPPKVAFTTKIYHPNINSNGSICLDILRSQWSPALTVSKVLLSICSLLCDPNPDDPLVPEIAHTYKADREKTQCHPGCPGQSRLCSHLICCRTTS

SEQ ID NO: 862663 - protein, 171 aa, Homo sapiens
MALKRIQKELTDLQRDPPAQCSAGPVGDDLFHWQATIMGPNDSPYQGGVFFLTIHFPTDYPFKPPKVAFTTKIYHPNINSNGSICLDILRSQWSPALTVSKVLLSICSLLCDPNPDDPLVPEIAHTYKADREKYNRLAREWTQKYAITQCHPGCPGQSRLCSHLICCRTTS

SEQ ID NO: 862664 - protein, 147 aa, Homo sapiens
MALKRIQKELTDLQRDPPAQCSAGPVGDDLFHWQATIMGPNDSPYQGGVFFLTIHFPTDYPFKPPKVAFTTKIYHPNINSNGSICLDILRSQWSPALTVSKVLLSICSLLCDPNPDDPLVPEIAHTYKADREKYNRLAREWTQKYAM

SEQ ID NO: 862665 - protein, 119 aa, Homo sapiens
RERERERERERERERERERERERERAAGRLRQPRPGRPGPRQRGRMALKRIQKELTDLQRDPPAQCSAGPVGDDLFHWQATIMGPNDSPYQGGVFFLTIHFPTDYPFKPPKVRSLSQLP

SEQ ID NO: 862666 - protein, 147 aa, Homo sapiens; identical to SEQ ID NO: 862664

SEQ ID NO: 862667 - protein, 109 aa, Homo sapiens
MTNDSPYQGGVFFLTIHFPTDYPFKPPKVAFTTKIYHPNINSNGSICLDILRSQWSPALTVSKVLLSICSLLCDPNPDDPLVPEIAHTYKADREKYNRLAREWTQKYAM

SEQ ID NO: 862668 - protein, 140 aa, Homo sapiens
MVPASASGEASGSLQSWQKAKEKQACHLELTDLQRDPPAQCSAGPVGDDLFHWQATIMGPNDSPYQGGVFFLTIHFPTDYPFKPPKSFALVAQDGVQWRDLGSPQHPPPRLLSQPKFITLISTAMAASALISCGLSGLQR

SEQ ID NO: 862669 - protein, 182 aa, Homo sapiens; identical to SEQ ID NO: 862659

SEQ ID NO: 862670 - protein, 147 aa, Homo sapiens; identical to SEQ ID NO: 862664

SEQ ID NO: 862671 - protein, 122 aa, Homo sapiens
MALKRIQKELTDLQRDPPAQCSAGPVGDDLFHWQATIMGPNDSPYQGGVFFLTIHFPTDYPFKPPKVAFTTKIYHPNINSNGSICLDILRSQWSPALTVSKGRDADGMLCVLFYTCFYPSTD

SEQ ID NO: 862672 - protein, 167 aa, Homo sapiens
MVPASASGEASGSLQSWQKAKEKQACHLELTDLQRDPPAQCSAGPVGDDLFHWQATIMGPNDSPYQGGVFFLTIHFPTDYPFKPPKVAFTTKIYHPNINSNGSICLDILRSQWSPSDFKSEGDKEEGQGLCHGHCYLFDEAGQVYVPFCKAGTLMGAQRDVDLVVHV

SEQ ID NO: 862673 - protein, 542 aa, Homo sapiens
MNGKRPAEPGPARVGKKGKKEVMAEFSDAVTEETLKKQVAEAWSRRTPFSHEVIVMDMDPFLHCVIPNFIQSQDFLEGLQKELMNLDFHEKYNDLYKFQQSDDLKKRREPHISTLRKILFEDFRSWLSDISKIDLESTIDMSCAKYEFTDALLCHDDELEGRRIAFILYLVPPWDRSMGGTLDLYSIDEHFQPKQIVKSLIPSWNKLVFFEVSPVSFHQVSEVLSEEKSRLSISGWFHGPSLTRPPNYFEPPIPRSPHIPQDHEILYDWINPTYLDMDYQVQIQEEFEESSEILLKEFLKPEKFTKVCEALEHGHVEWSSRGPPNKRFYEKAEESKLPEILKECMKLFRSEALFLLLSNFTGLKLHFLAPSEEDEMNDKKEAETTDITEEGTSHSPPEPENNQMAISNNSQQSNEQTDPEPEENETKKESSVPMCQGELRHWKTGHYTLIHDHSKAEFALDLILYCGCEGWEPEYGGFTSYIAKGEDEELLTVNPESNSLALVYRDRETLKFVKHINHRSLEQKKTFPNRTGFWDFSFIYYE

SEQ ID NO: 862674 - protein, 506 aa, Homo sapiens
NTIKGTCRELQYPQEEVIVMDMDPFLHCVIPNFIQSQDFLEGLQKELMNLDFHEKYNDLYKFQQSDDLKKRREPHISTLRKILFEDFRSWLSDISKIDLESTIDMSCAKYEFTDALLCHDDELEGRRIAFILYLVPPWDRSMGGTLDLYSIDEHFQPKQIVKSLIPSWNKLVFFEVSPVSFHQVSEVLSEEKSRLSISGWFHGPSLTRPPNYFEPPIPRSPHIPQDHEILYDWINPTYLDMDYQVQIQEEFEESSEILLKEFLKPEKFTKVCEALEHGHVEWSSRGPPNKRFYEKAEESKLPEILKECMKLFRSEALFLLLSNFTGLKLHFLAPSEEDEMNDKKEAETTDITEEGTSHSPPEPENNQMAISNNSQQSNEQTDPEPEENETKKESSVPMCQGELRHWKTGHYTLIHDHSKAEFALDLILYCGCEGWEPEYGGFTSYIAKGEDEELLTVNPESNSLALVYRDRETLKFVKHINHRSLEQKKTFPNRTGFWDFSFIYYE

SEQ ID NO: 862675 - protein, 526 aa, Homo sapiens
MNGKRPAEPGPARVGKKGKKEVMAEFSDAVTEETLKVIVMDMDPFLHCVIPNFIQSQDFLEGLQKELMNLDFHEKYNDLYKFQQSDDLKKRREPHISTLRKILFEDFRSWLSDISKIDLESTIDMSCAKYEFTDALLCHDDELEGRRIAFILYLVPPWDRSMGGTLDLYSIDEHFQPKQIVKSLIPSWNKLVFFEVSPVSFHQVSEVLSEEKSRLSISGWFHGPSLTRPPNYFEPPIPRSPHIPQDHEILYDWINPTYLDMDYQVQIQEEFEESSEILLKEFLKPEKFTKVCEALEHGHVEWSSRGPPNKRFYEKAEESKLPEILKECMKLFRSEALFLLLSNFTGLKLHFLAPSEEDEMNDKKEAETTDITEEGTSHSPPEPENNQMAISNNSQQSNEQTDPEPEENETKKESSVPMCQGELRHWKTGHYTLIHDHSKAEFALDLILYCGCEGWEPEYGGFTSYIAKGEDEELLTVNPESNSLALVYRDRETLKFVKHINHRSLEQKKTFPNRTGFWDFSFIYYE

SEQ ID NO: 862676 - protein, 542 aa, Homo sapiens; identical to SEQ ID NO: 862673

SEQ ID NO: 862677 - protein, 526 aa, Homo sapiens; identical to SEQ ID NO: 862675

SEQ ID NO: 862678 - protein, 485 aa, Homo sapiens
MNGKRPAEPGPARVGKKGKKEVMAEFSDAVTEETLKVIVMDMDPFLHCVIPNFIQSQDFLEGLQKELMNLDFHEKYNDLYKFQQSDDLKKRREPHISTLRKILFEDFRSWLSDISKIDLESTIDMSCAKYEFTDALLCHDDELEGRRIAFILYLVPPWDRSMGGTLDLYSIDEHFQPKQIVKSLIPSWNKLVFFEVSPVSFHQVSEVLSEEKSRLSISGWFHGPSLTRPPNYFEPPIPRSPHIPQDHEILYDWINPTYLDMDYQVQIQEEFEESSEILLKEFLKPEKFTKVCEALEHGHVEWSSRGPPNKRFYEKAEESKLPEILKECMKLFRSEALFLLLSNFTGLKLHFLAPSEEDEMNDKKEAETTDITEEGTSHSPPEPENNQMAISNNSQQSNEQTDPEPEENETKKESSVPMCQGELRHWKTGHYTLIHDHSKAEFALDLILYCGCEGWEPEYGGFTSYIAKGEDEELLQLIPSWGPSR

SEQ ID NO: 862679 - protein, 145 aa, Homo sapiens
MNGKRPAEPGPARVGKKGKKEVMAEFSDAVTEETLKKQVAEAWSRRTPFSHEVIVMDMDPFLHCVIPNFIQSQDFLEGLQKELMNLDFHEKYNDLYKFQQSDDLKKRREPHISTLRKTSNHICWVLICARQSSKCFKCYNIVYVI

SEQ ID NO: 862680 - protein, 506 aa, Homo sapiens; identical to SEQ ID NO: 862674

SEQ ID NO: 862681 - protein, 542 aa, Homo sapiens; identical to SEQ ID NO: 862673

SEQ ID NO: 862682 - protein, 225 aa, Homo sapiens
MNNLTLLFFRFYEKAEESKLPEILKECMKLFRSEALFLLLSNFTGLKLHFLAPSEEDEMNDKKEAETTDITEEGTSHSPPEPENNQMAISNNSQQSNEQTDPEPEENETKKESSVPMCQGELRHWKTGHYTLIHDHSKAEFALDLILYCGCEGWEPEYGGFTSYIAKGEDEELLTVNPESNSLALVYRDRETLKFVKHINHRSLEQKKTFPNRTGFWDFSFIYYE

SEQ ID NO: 862683 - protein, 237 aa, Homo sapiens
MNGKRPAEPGPARVGKKGKKEVMAEFSDAVTEETLKVIVMDMDPFLHCVIPNFIQSQDFLEGLQKELMNLDFHEKYNDLYKFQQSDDLKKRREPHISTLRKILFEDFRSWLSDISKIDLESTIDMSCAKYEFTDALLCHDDELEGRRIAFILYLVPPWDRSMGGTLDLYSIDEHFQPKQIVKSLIPSWNKLVFFEVSPVSFHQVSEVLSEEKSRLSISGWFHGPSLTRPPNYFEPPL

SEQ ID NO: 862684 - protein, 108 aa, Homo sapiens
MVAVEGMPTVLGPVRPASAAAHPGWSRARGQPDLTMTRCALLLLMVLMLGRVLVVPVTPIPTFQLRPQNSPQTTPRPAASESPSAAPTWPWAAQSHCSPTRHPGSRIV

SEQ ID NO: 862685 - protein, 3023 aa, Homo sapiens
MTLRLLVAALCAGILAEAPRVRAQHRERVTCTRLYAADIVFLLDGSSSIGRSNFREVRSFLEGLVLPFSGAASAQGVRFATVQYSDDPRTEFGLDALGSGGDVIRAIRELSYKGGNTRTGAAILHVADHVFLPQLARPGVPKVCILITDGKSQDLVDTAAQRLKGQGVKLFAVGIKNADPEELKRVASQPTSDFFFFVNDFSILRTLLPLVSRRVCTTAGGVPVTRPPDDSTSAPRDLVLSEPSSQSLRVQWTAASGPVTGYKVQYTPLTGLGQPLPSERQEVNVPAGETSVRLRGLRPLTEYQVTVIALYANSIGEAVSGTARTTALEGPELTIQNTTAHSLLVAWRSVPGATGYRVTWRVLSGGPTQQQELGPGQGSVLLRDLEPGTDYEVTVSTLFGRSVGPATSLMARTDASVEQTLRPVILGPTSILLSWNLVPEARGYRLEWRRETGLEPPQKVVLPSDVTRYQLDGLQPGTEYRLTLYTLLEGHEVATPATVVPTGPELPVSPVTDLQATELPGQRVRVSWSPVPGATQYRIIVRSTQGVERTLVLPGSQTAFDLDDVQAGLSYTVRVSARVGPREGSASVLTVRREPETPLAVPGLRVVVSDATRVRVAWGPVPGASGFRISWSTGSGPESSQTLPPDSTATDITGLQPGTTYQVAVSVLRGREEGPAAVIVARTDPLGPVRTVHVTQASSSSVTITWTRVPGATGYRVSWHSAHGPEKSQLVSGEATVAELDGLEPDTEYTVHVRAHVAGVDGPPASVVVRTAPEPVGRVSRLQILNASSDVLRITWVGVTGATAYRLAWGRSEGGPMRHQILPGNTDSAEIRGLEGGVSYSVRVTALVGDREGTPVSIVVTTPPEAPPALGTLHVVQRGEHSLRLRWEPVPRAQGFLLHWQPEGGQEQSRVLGPELSSYHLDGLEPATQYRVRLSVLGPAGEGPSAEVTARTESPRVPSIELRVVDTSIDSVTLAWTPVSRASSYILSWRPLRGPGQEVPGSPQTLPGISSSQRVTGLEPGVSYIFSLTPVLDGVRGPEASVTQTPVCPRGLADVVFLPHATQDNAHRAEATRRVLERLVLALGPLGPQAVQVGLLSYSHRPSPLFPLNGSHDLGIILQRIRDMPYMDPSGNNLGTAVVTAHRYMLAPDAPGRRQHVPGVMVLLVDEPLRGDIFSPIREAQASGLNVVMLGMAGADPEQLRRLAPGMDSVQTFFAVDDGPSLDQAVSGLATALCQASFTTQPRPEPCPVYCPKGQKGEPGEMGLRGQVGPPGDPGLPGRTGAPGPQGPPGSATAKGERGFPGADGRPGSPGRAGNPGTPGAPGLKGSPGLPGPRGDPGERGPRGPKGEPGAPGQVIGGEGPGLPGRKGDPGPSGPPGPRGPLGDPGPRGPPGLPGTAMKGDKGDRGERGPPGPGEGGIAPGEPGLPGLPGSPGPQGPVGPPGKKGEKGDSEDGAPGLPGQPGSPGEQGPRGPPGAIGPKGDRGFPGPLGEAGEKGERGPPGPAGSRGLPGVAGRPGAKGPEGPPGPTGRQGEKGEPGRPGDPAVVGPAVAGPKGEKGDVGPAGPRGATGVQGERGPPGLVLPGDPGPKGDPGDRGPIGLTGRAGPPGDSGPPGEKGDPGRPGPPGPVGPRGRDGEVGEKGDEGPPGDPGLPGKAGERGLRGAPGVRGPVGEKGDQGDPGEDGRNGSPGSSGPKGDRGEPGPPGPPGRLVDTGPGAREKGEPGDRGQEGPRGPKGDPGLPGAPGERGIEGFRGPPGPQGDPGVRGPAGEKGDRGPPGLDGRSGLDGKPGAAGPSGPNGAAGKAGDPGRDGLPGLRGEQGLPGPSGPPGLPGKPGEDGKPGLNGKNGEPGDPGEDGRKGEKGDSGASGREGRDGPKGERGAPGILGPQGPPGLPGPVGPPGQGFPGVPGGTGPKGDRGETGSKGEQGLPGERGLRGEPGSVPNVDRLLETAGIKASALREIVETWDESSGSFLPVPERRRGPKGDSGEQGPPGKEGPIGFPGERGLKGDRGDPGPQGPPGLALGERGPPGPSGLAGEPGKPGIPGLPGRAGGVGEAGRPGERGERGEKGERGEQGRDGPPGLPGTPGPPGPPGPKVSVDEPGPGLSGEQGPPGLKGAKGEPGSNGDQGPKGDRGVPGIKGDRGEPGPRGQDGNPGLPGERGMAGPEGKPGLQGPRGPPGPVGGHGDPGPPGAPGLAGPAGPQGPSGLKGEPGETGPPGRGLTGPTGAVGLPGPPGPSGLVGPQGSPGLPGQVGETGKPGAPGRDGASGKDGDRGSPGVPGSPGLPGPVGPKGEPGPTGAPGQAVVGLPGAKGEKGAPGGLAGDLVGEPGAKGDRGLPGPRGEKGEAGRAGEPGDPGEDGQKGAPGPKGFKVCVPRRVPAGVLVVRSLSLIRCLFSSKGDPGVGVPGSPGPPGPPGVKGDLGLPGLPGAPGVVGFPGQTGPRGEMGQPGPSGERGLAGPPGREGIPGPLGPPGPPGSVGPPGASGLKGDKGDPGVGLPGPRGERGEPGIRVRMSYSTAELPSSQLLPLISNLWVNEPNVTIQGEDGRPGQEGPRGLTGPPGSRGERGEKGDVGSAGLKGDKGDSAVILGPPGPRGAKGDMGERGPRGLDGDKGPRGDNGDPGDKGSKGEPGDKGSAGLPGLRGLLGPQGQPGAAGIPGDPGDSLWSLTDSSDLTWTLSLLGSPGKDGVPGIRGEKGDVGFMGPRGLKGERGVKGACGLDGEKGDKGEAGPPGRPGLAGHKGEMGEPGVPGQSGAPGKEGLIGPKGDRGFDGQPGPKGDQGEKGERGTPGIGGFPGPSGNDGSAGPPGPPGSVGPRGPEGLQGQKGERGPPGERVVGAPGVPGAPGERGEQGRPGPAGPRGEKGEAALTEDDIRGFVRQEMSQHCACQGQFIASGSRPLPSYAADTAGSQLHAVPVLRVSHAEEEERVPPEDDEYSEYSEYSVEEYQDPEAPWDSDDPCSLPLDEGSCTAYTLRWYHRAVTGSTEACHPFVYGGCGGNANRFGTREACERRCPPRVVQSQGTGTAQD

SEQ ID NO: 862686 - protein, 2668 aa, Homo sapiens
MTLRLLVAALCAGILAEAPRVRAQHRERVTCTRLYAADIVFLLDGSSSIGRSNFREVRSFLEGLVLPFSGAASAQGVRFATVQYSDDPRTEFGLDALGSGGDVIRAIRELSYKGGNTRTGAAILHVADHVFLPQLARPGVPKVCILITDGKSQDLVDTAAQRLKGQGVKLFAVGIKNADPEELKRVASQPTSDFFFFVNDFSILRTLLPLVSRRVCTTAGGVPVTRPPDDSTSAPRDLVLSEPSSQSLRVQWTAASGPVTGYKVQYTPLTGLGQPLPSERQEVNVPAGETSVRLRGLRPLTEYQVTVIALYANSIGEAVSGTARTTALEGPELTIQNTTAHSLLVAWRSVPGATGYRVTWRVLSGGPTQQQELGPGQGSVLLRDLEPGTDYEVTVSTLFGRSVGPATSLMARTDASVEQTLRPVILGPTSILLSWNLVPEARGYRLEWRRETGLEPPQKVVLPSDVTRYQLDGLQPGTEYRLTLYTLLEGHEVATPATVVPTGPELPVSPVTDLQATELPGQRVRVSWSPVPGATQYRIIVRSTQGVERTLVLPGSQTAFDLDDVQAGLSYTVRVSARVGPREGSASVLTVRREPETPLAVPGLRVVVSDATRVRVAWGPVPGASGFRISWSTGSGPESSQTLPPDSTATDITGLQPGTTYQVAVSVLRGREEGPAAVIVARTDPLGPVRTVHVTQASSSSVTITWTRVPGATGYRVSWHSAHGPEKSQLVSGEATVAELDGLEPDTEYTVHVRAHVAGVDGPPASVVVRTAPEPVGRVSRLQILNASSDVLRITWVGVTGATAYRLAWGRSEGGPMRHQILPGNTDSAEIRGLEGGVSYSVRVTALVGDREGTPVSIVVTTPPEAPPALGTLHVVQRGEHSLRLRWEPVPRAQGFLLHWQPEGGQEQSRVLGPELSSYHLDGLEPATQYRVRLSVLGPAGEGPSAEVTARTESPRVPSIELRVVDTSIDSVTLAWTPVSRASSYILSWRPLRGPGQEVPGSPQTLPGISSSQRVTGLEPGVSYIFSLTPVLDGVRGPEASVTQTPVCPRGLADVVFLPHATQDNAHRAEATRRVLERLVLALGPLGPQAVQVGLLSYSHRPSPLFPLNGSHDLGIILQRIRDMPYMDPSGNNLGTAVVTAHRYMLAPDAPGRRQHVPGVMVLLVDEPLRGDIFSPIREAQASGLNVVMLGMAGADPEQLRRLAPGMDSVQTFFAVDDGPSLDQAVSGLATALCQASFTTQPRPEPCPVYCPKGQKGEPGEMGLRGQVGPPGDPGLPGRTGAPGPQGPPGSATAKGERGFPGADGRPGSPGRAGNPGTPGAPGLKGSPGLPGPRGDPGERGPRGPKGEPGAPGQVIGGEGPGLPGRKGDPGPSGPPGPRGPLGDPGPRGPPGLPGTAMKGDKGDRGERGPPGPGEGGIAPGEPGLPGLPGSPGPQGPVGPPGKKGEKGDSEDGAPGLPGQPGSPGEQGPRGPPGAIGPKGDRGFPGPLGEAGEKGERGPPGPAGSRGLPGVAGRPGAKGPEGPPGPTGRQGEKGEPGRPGDPAVVGPAVAGPKGEKGDVGPAGPRGATGVQGERGPPGLVLPGDPGPKGDPGDRGPIGLTGRAGPPGDSGPPGEKGDPGRPGPPGPVGPRGRDGEVGEKGDEGPPGDPGLPGKAGERGLRGAPGVRGPVGEKGDQGDPGEDGRNGSPGSSGPKGDRGEPGPPGPPGRLVDTGPGAREKGEPGDRGQEGPRGPKGDPGLPGAPGERGIEGFRGPPGPQGDPGVRGPAGEKGDRGPPGLDGRSGLDGKPGAAGPSGPNGAAGKAGDPGRDGLPGLRGEQGLPGPSGPPGLPGKPGEDGKPGLNGKNGEPGDPGEDGRKGEKGDSGASGREGRDGPKGERGAPGILGPQGPPGLPGPVGPPGQGFPGVPGGTGPKGDRGETGSKGEQGLPGERGLRGEPGSVPNVDRLLETAGIKASALREIVETWDESSGSFLPVPERRRGPKGDSGEQGPPGKEGPIGFPGERGLKGDRGDPGPQGPPGLALGERGPPGPSGLAGEPGKPGIPGLPGRAGGVGEAGRPGERGERGEKGERGEQGRDGPPGLPGTPGPPGPPGPKVSVDEPGPGLSGEQGPPGLKGAKGEPGSNGDQGPKGDRGVPGIKGDRGEPGPRGQDGNPGLPGERGMAGPEGKPGLQGPRGPPGPVGGHGDPGPPGAPGLAGPAGPQGPSGLKGEPGETGPPGRGLTGPTGAVGLPGPPGPSGLVGPQGSPGLPGQVGETGKPGAPGRDGASGKDGDRGSPGVPGSPGLPGPVGPKGEPGPTGAPGQAVVGLPGAKGEKGAPGGLAGDLVGEPGAKGDRGLPGPRGEKGEAGRAGEPGDPGEDGQKGAPGPKGFKVCVPRRVPAGVLVVRSLSLIRCLFSSKGDPGVGVPGSPGPPGPPGVKGDLGLPGLPGAPGVVGFPGQTGPRGEMGQPGPSGERGLAGPPGREGIPGPLGPPGPPGSVGPPGASGLKGDKGDPGVGLPGPRGERGEPGIRVRMSYSTAELPSSQLLPLISNLWVNEPNVTIQGEDGRPGQEGPRGLTGPPGSRGERGEKGDVGSAGLKGDKGDSAVILGPPGPRGAKGDMGERGPRGLDGDKGPRGDNGDPGDKGSKGEPGDKGSAGLPGLRGLLGPQGQPGAAGIPGDPGDSLWSLTDLL

SEQ ID NO: 862687 - protein, 2388 aa, Homo sapiens
MTLRLLVAALCAGILAEAPRVRAQHRERVTCTRLYAADIVFLLDGSSSIGRSNFREVRSFLEGLVLPFSGAASAQGVRFATVQYSDDPRTEFGLDALGSGGDVIRAIRELSYKGGNTRTGAAILHVADHVFLPQLARPGVPKVCILITDGKSQDLVDTAAQRLKGQGVKLFAVGIKNADPEELKRVASQPTSDFFFFVNDFSILRTLLPLVSRRVCTTAGGVPVTRPPDDSTSAPRDLVLSEPSSQSLRVQWTAASGPVTGYKVQYTPLTGLGQPLPSERQEVNVPAGETSVRLRGLRPLTEYQVTVIALYANSIGEAVSGTARTTALEGPELTIQNTTAHSLLVAWRSVPGATGYRVTWRVLSGGPTQQQELGPGQGSVLLRDLEPGTDYEVTVSTLFGRSVGPATSLMARTDASVEQTLRPVILGPTSILLSWNLVPEARGYRLEWRRETGLEPPQKVVLPSDVTRYQLDGLQPGTEYRLTLYTLLEGHEVATPATVVPTGPELPVSPVTDLQATELPGQRVRVSWSPVPGATQYRIIVRSTQGVERTLVLPGSQTAFDLDDVQAGLSYTVRVSARVGPREGSASVLTVRREPETPLAVPGLRVVVSDATRVRVAWGPVPGASGFRISWSTGSGPESSQTLPPDSTATDITGLQPGTTYQVAVSVLRGREEGPAAVIVARTDPLGPVRTVHVTQASSSSVTITWTRVPGATGYRVSWHSAHGPEKSQLVSGEATVAELDGLEPDTEYTVHVRAHVAGVDGPPASVVVRTAPEPVGRVSRLQILNASSDVLRITWVGVTGATAYRLAWGRSEGGPMRHQILPGNTDSAEIRGLEGGVSYSVRVTALVGDREGTPVSIVVTTPPEAPPALGTLHVVQRGEHSLRLRWEPVPRAQGFLLHWQPEGGQEQSRVLGPELSSYHLDGLEPATQYRVRLSVLGPAGEGPSAEVTARTESPRVPSIELRVVDTSIDSVTLAWTPVSRASSYILSWRPLRGPGQEVPGSPQTLPGISSSQRVTGLEPGVSYIFSLTPVLDGVRGPEASVTQTPVCPRGLADVVFLPHATQDNAHRAEATRRVLERLVLALGPLGPQAVQVGLLSYSHRPSPLFPLNGSHDLGIILQRIRDMPYMDPSGNNLGTAVVTAHRYMLAPDAPGRRQHVPGVMVLLVDEPLRGDIFSPIREAQASGLNVVMLGMAGADPEQLRRLAPGMDSVQTFFAVDDGPSLDQAVSGLATALCQASFTTQPRPEPCPVYCPKGQKGEPGEMGLRGQVGPPGDPGLPGRTGAPGPQGPPGSATAKGERGFPGADGRPGSPGRAGNPGTPGAPGLKGSPGLPGPRGDPGERGPRGPKGEPGAPGQVIGGEGPGLPGRKGDPGPSGPPGPRGPLGDPGPRGPPGLPGTAMKGDKGDRGERGPPGPGEGGIAPGEPGLPGLPGSPGPQGPVGPPGKKGEKGDSEDGAPGLPGQPGSPGEQGPRGPPGAIGPKGDRGFPGPLGEAGEKGERGPPGPAGSRGLPGVAGRPGAKGPEGPPGPTGRQGEKGEPGRPGDPAVVGPAVAGPKGEKGDVGPAGPRGATGVQGERGPPGLVLPGDPGPKGDPGDRGPIGLTGRAGPPGDSGPPGEKGDPGRPGPPGPVGPRGRDGEVGEKGDEGPPGDPGLPGKAGERGLRGAPGVRGPVGEKGDQGDPGEDGRNGSPGSSGPKGDRGEPGPPGPPGRLVDTGPGAREKGEPGDRGQEGPRGPKGDPGLPGAPGERGIEGFRGPPGPQGDPGVRGPAGEKGDRGPPGLDGRSGLDGKPGAAGPSGPNGAAGKAGDPGRDGLPGLRGEQGLPGPSGPPGLPGKPGEDGKPGLNGKNGEPGDPGEDGRKGEKGDSGASGREGRDGPKGERGAPGILGPQGPPGLPGPVGPPGQGFPGVPGGTGPKGDRGETGSKGEQGLPGERGLRGEPGSVPNVDRLLETAGIKASALREIVETWDESSGSFLPVPERRRGPKGDSGEQGPPGKEGPIGFPGERGLKGDRGDPGPQGPPGLALGERGPPGPSGLAGEPGKPGIPGLPGRAGGVGEAGRPGERGERGEKGERGEQGRDGPPGLPGTPGPPGPPGPKVSVDEPGPGLSGEQGPPGLKGAKGEPGSNGDQGPKGDRGVPGIKGDRGEPGPRGQDGNPGLPGERGMAGPEGKPGLQGPRGPPGPVGGHGDPGPPGAPGLAGPAGPQGPSGLKGEPGETGPPGRGLTGPTGAVGLPGPPGPSGLVGPQGSPGLPGQVGETGKPGAPGRDGASGKDGDRGSPGVPGSPGLPGPVGPKGEPGPTGAPGQAVVGLPGAKGEKGAPGGLAGDLVGEPGAKGDRGLPGPRGEKGEAGRAGEPGDPGEDVSPGPRQGRAWPEECDGGHKGPLLGRGTCLSP

SEQ ID NO: 862688 - protein, 530 aa, Homo sapiens
MGQPGPSGERGLAGPPGREGIPGPLGPPGPPGSVGPPGASGLKGDKGDPGVGLPGPRGERGEPGIRGEDGRPGQEGPRGLTGPPGSRGERGEKGDVGSAGLKGDKGDSAVILGPPGPRGAKGDMGERGPRGLDGDKGPRGDNGDPGDKGSKGEPGDKGSAGLPGLRGLLGPQGQPGAAGIPGDPGSPGKDGVPGIRGEKGDVGFMGPRGLKGERGVKGACGLDGEKGDKGEAGPPGRPGLAGHKGEMGEPGVPGQSGAPGKEGLIGPKGDRGFDGQPGPKGDQGEKGERGTPGIGGFPGPSGNDGSAGPPGPPGSVGPRGPEGLQGQKGERGPPGERVVGAPGVPGAPGERGEQGRPGPAGPRGEKGEAALTEDDIRGFVRQEMSQHCACQGQFIASGSRPLPSYAADTAGSQLHAVPVLRVSHAEEEERVPPEDDEYSEYSEYSVEEYQDPEAPWDSDDPCSLPLDEGSCTAYTLRWYHRAVTGSTEACHPFVYGGCGGNANRFGTREACERRCPPRVVQSQGTGTAQD

SEQ ID NO: 862689 - protein, 91 aa, Homo sapiens
AWDLAAEHLSGHTCSGWASVGDSPTEGLPHLCFSQGQPGAAGIPGDPVRCPCSHRGPLSPEGPRHHGGPTSVVAFDLIVTQCSHGVLMSPR

SEQ ID NO: 862690 - protein, 2944 aa, Homo sapiens
MTLRLLVAALCAGILAEAPRVRAQHRERVTCTRLYAADIVFLLDGSSSIGRSNFREVRSFLEGLVLPFSGAASAQGVRFATVQYSDDPRTEFGLDALGSGGDVIRAIRELSYKGGNTRTGAAILHVADHVFLPQLARPGVPKVCILITDGKSQDLVDTAAQRLKGQGVKLFAVGIKNADPEELKRVASQPTSDFFFFVNDFSILRTLLPLVSRRVCTTAGGVPVTRPPDDSTSAPRDLVLSEPSSQSLRVQWTAASGPVTGYKVQYTPLTGLGQPLPSERQEVNVPAGETSVRLRGLRPLTEYQVTVIALYANSIGEAVSGTARTTALEGPELTIQNTTAHSLLVAWRSVPGATGYRVTWRVLSGGPTQQQELGPGQGSVLLRDLEPGTDYEVTVSTLFGRSVGPATSLMARTDASVEQTLRPVILGPTSILLSWNLVPEARGYRLEWRRETGLEPPQKVVLPSDVTRYQLDGLQPGTEYRLTLYTLLEGHEVATPATVVPTGPELPVSPVTDLQATELPGQRVRVSWSPVPGATQYRIIVRSTQGVERTLVLPGSQTAFDLDDVQAGLSYTVRVSARVGPREGSASVLTVRREPETPLAVPGLRVVVSDATRVRVAWGPVPGASGFRISWSTGSGPESSQTLPPDSTATDITGLQPGTTYQVAVSVLRGREEGPAAVIVARTDPLGPVRTVHVTQASSSSVTITWTRVPGATGYRVSWHSAHGPEKSQLVSGEATVAELDGLEPDTEYTVHVRAHVAGVDGPPASVVVRTAPEPVGRVSRLQILNASSDVLRITWVGVTGATAYRLAWGRSEGGPMRHQILPGNTDSAEIRGLEGGVSYSVRVTALVGDREGTPVSIVVTTPPEAPPALGTLHVVQRGEHSLRLRWEPVPRAQGFLLHWQPEGGQEQSRVLGPELSSYHLDGLEPATQYRVRLSVLGPAGEGPSAEVTARTESPRVPSIELRVVDTSIDSVTLAWTPVSRASSYILSWRPLRGPGQEVPGSPQTLPGISSSQRVTGLEPGVSYIFSLTPVLDGVRGPEASVTQTPVCPRGLADVVFLPHATQDNAHRAEATRRVLERLVLALGPLGPQAVQVGLLSYSHRPSPLFPLNGSHDLGIILQRIRDMPYMDPSGNNLGTAVVTAHRYMLAPDAPGRRQHVPGVMVLLVDEPLRGDIFSPIREAQASGLNVVMLGMAGADPEQLRRLAPGMDSVQTFFAVDDGPSLDQAVSGLATALCQASFTTQPRPEPCPVYCPKGQKGEPGEMGLRGQVGPPGDPGLPGRTGAPGPQGPPGSATAKGERGFPGADGRPGSPGRAGNPGTPGAPGLKGSPGLPGPRGDPGERGPRGPKGEPGAPGQVIGGEGPGLPGRKGDPGPSGPPGPRGPLGDPGPRGPPGLPGTAMKGDKGDRGERGPPGPGEGGIAPGEPGLPGLPGSPGPQGPVGPPGKKGEKGDSEDGAPGLPGQPGSPGEQGPRGPPGAIGPKGDRGFPGPLGEAGEKGERGPPGPAGSRGLPGVAGRPGAKGPEGPPGPTGRQGEKGEPGRPGDPAVVGPAVAGPKGEKGDVGPAGPRGATGVQGERGPPGLVLPGDPGPKGDPGDRGPIGLTGRAGPPGDSGPPGEKGDPGRPGPPGPVGPRGRDGEVGEKGDEGPPGDPGLPGKAGERGLRGAPGVRGPVGEKGDQGDPGEDGRNGSPGSSGPKGDRGEPGPPGPPGRLVDTGPGAREKGEPGDRGQEGPRGPKGDPGLPGAPGERGIEGFRGPPGPQGDPGVRGPAGEKGDRGPPGLDGRSGLDGKPGAAGPSGPNGAAGKAGDPGRDGLPGLRGEQGLPGPSGPPGLPGKPGEDGKPGLNGKNGEPGDPGEDGRKGEKGDSGASGREGRDGPKGERGAPGILGPQGPPGLPGPVGPPGQGFPGVPGGTGPKGDRGETGSKGEQGLPGERGLRGEPGSVPNVDRLLETAGIKASALREIVETWDESSGSFLPVPERRRGPKGDSGEQGPPGKEGPIGFPGERGLKGDRGDPGPQGPPGLALGERGPPGPSGLAGEPGKPGIPGLPGRAGGVGEAGRPGERGERGEKGERGEQGRDGPPGLPGTPGPPGPPGPKVSVDEPGPGLSGEQGPPGLKGAKGEPGSNGDQGPKGDRGVPGIKGDRGEPGPRGQDGNPGLPGERGMAGPEGKPGLQGPRGPPGPVGGHGDPGPPGAPGLAGPAGPQGPSGLKGEPGETGPPGRGLTGPTGAVGLPGPPGPSGLVGPQGSPGLPGQVGETGKPGAPGRDGASGKDGDRGSPGVPGSPGLPGPVGPKGEPGPTGAPGQAVVGLPGAKGEKGAPGGLAGDLVGEPGAKGDRGLPGPRGEKGEAGRAGEPGDPGEDGQKGAPGPKGFKGDPGVGVPGSPGPPGPPGVKGDLGLPGLPGAPGVVGFPGQTGPRGEMGQPGPSGERGLAGPPGREGIPGPLGPPGPPGSVGPPGASGLKGDKGDPGVGLPGPRGERGEPGIRGEDGRPGQEGPRGLTGPPGSRGERGEKGDVGSAGLKGDKGDSAVILGPPGPRGAKGDMGERGPRGLDGDKGPRGDNGDPGDKGSKGEPGDKGSAGLPGLRGLLGPQGQPGAAGIPGDPGSPGKDGVPGIRGEKGDVGFMGPRGLKGERGVKGACGLDGEKGDKGEAGPPGRPGLAGHKGEMGEPGVPGQSGAPGKEGLIGPKGDRGFDGQPGPKGDQGEKGERGTPGIGGFPGPSGNDGSAGPPGPPGSVGPRGPEGLQGQKGERGPPGERVVGAPGVPGAPGERGEQGRPGPAGPRGEKGEAALTEDDIRGFVRQEMSQHCACQGQFIASGSRPLPSYAADTAGSQLHAVPVLRVSHAEEEERVPPEDDEYSEYSEYSVEEYQDPEAPWDSDDPCSLPLDEGSCTAYTLRWYHRAVTGSTEACHPFVYGGCGGNANRFGTREACERRCPPRVVQSQGTGTAQD

SEQ ID NO: 862691 - protein, 2703 aa, Homo sapiens
MTLRLLVAALCAGILAEAPRVRAQHRERVTCTRLYAADIVFLLDGSSSIGRSNFREVRSFLEGLVLPFSGAASAQGVRFATVQYSDDPRTEFGLDALGSGGDVIRAIRELSYKGGNTRTGAAILHVADHVFLPQLARPGVPKVCILITDGKSQDLVDTAAQRLKGQGVKLFAVGIKNADPEELKRVASQPTSDFFFFVNDFSILRTLLPLVSRRVCTTAGGVPVTRPPDDSTSAPRDLVLSEPSSQSLRVQWTAASGPVTGYKVQYTPLTGLGQPLPSERQEVNVPAGETSVRLRGLRPLTEYQVTVIALYANSIGEAVSGTARTTALEGPELTIQNTTAHSLLVAWRSVPGATGYRVTWRVLSGGPTQQQELGPGQGSVLLRDLEPGTDYEVTVSTLFGRSVGPATSLMARTDASVEQTLRPVILGPTSILLSWNLVPEARGYRLEWRRETGLEPPQKVVLPSDVTRYQLDGLQPGTEYRLTLYTLLEGHEVATPATVVPTGPELPVSPVTDLQATELPGQRVRVSWSPVPGATQYRIIVRSTQGVERTLVLPGSQTAFDLDDVQAGLSYTVRVSARVGPREGSASVLTVRREPETPLAVPGLRVVVSDATRVRVAWGPVPGASGFRISWSTGSGPESSQTLPPDSTATDITGLQPGTTYQVAVSVLRGREEGPAAVIVARTDPLGPVRTVHVTQASSSSVTITWTRVPGATGYRVSWHSAHGPEKSQLVSGEATVAELDGLEPDTEYTVHVRAHVAGVDGPPASVVVRTAPEPVGRVSRLQILNASSDVLRITWVGVTGATAYRLAWGRSEGGPMRHQILPGNTDSAEIRGLEGGVSYSVRVTALVGDREGTPVSIVVTTPPEAPPALGTLHVVQRGEHSLRLRWEPVPRAQGFLLHWQPEGGQEQSRVLGPELSSYHLDGLEPATQYRVRLSVLGPAGEGPSAEVTARTESPRVPSIELRVVDTSIDSVTLAWTPVSRASSYILSWRPLRGPGQEVPGSPQTLPGISSSQRVTGLEPGVSYIFSLTPVLDGVRGPEASVTQTPVCPRGLADVVFLPHATQDNAHRAEATRRVLERLVLALGPLGPQAVQVGLLSYSHRPSPLFPLNGSHDLGIILQRIRDMPYMDPSGNNLGTAVVTAHRYMLAPDAPGRRQHVPGVMVLLVDEPLRGDIFSPIREAQASGLNVVMLGMAGADPEQLRRLAPGMDSVQTFFAVDDGPSLDQAVSGLATALCQASFTTQPRPEPCPVYCPKGQKGEPGEMGLRGQVGPPGDPGLPGRTGAPGPQGPPGSATAKGERGFPGADGRPGSPGRAGNPGTPGAPGLKGSPGLPGPRGDPGERGPRGPKGEPGAPGQVIGGEGPGLPGRKGDPGPSGPPGPRGPLGDPGPRGPPGLPGTAMKGDKGDRGERGPPGPGEGGIAPGEPGLPGLPGSPGPQGPVGPPGKKGEKGDSEDGAPGLPGQPGSPGEQGPRGPPGAIGPKGDRGFPGPLGEAGEKGERGPPGPAGSRGLPGVAGRPGAKGPEGPPGPTGRQGEKGEPGRPGDPAVVGPAVAGPKGEKGDVGPAGPRGATGVQGERGPPGLVLPGDPGPKGDPGDRGPIGLTGRAGPPGDSGPPGEKGDPGRPGPPGPVGPRGRDGEVGEKGDEGPPGDPGLPGKAGERGLRGAPGVRGPVGEKGDQGDPGEDGRNGSPGSSGPKGDRGEPGPPGPPGRLVDTGPGAREKGEPGDRGQEGPRGPKGDPGLPGAPGERGIEGFRGPPGPQGDPGVRGPAGEKGDRGPPGLDGRSGLDGKPGAAGPSGPNGAAGKAGDPGRDGLPGLRGEQGLPGPSGPPGLPGKPGEDGKPGLNGKNGEPGDPGEDGRKGEKGDSGASGREGRDGPKGERGAPGILGPQGPPGLPGPVGPPGQGFPGVPGGTGPKGDRGETGSKGEQGLPGERGLRGEPGSVPNVDRLLETAGIKASALREIVETWDESSGSFLPVPERRRGPKGDSGEQGPPGKEGPIGFPGERGLKGDRGDPGPQGPPGLALGERGPPGPSGLAGEPGKPGIPGLPGRAGGVGEAGRPGERGERGEKGERGEQGRDGPPGLPGTPGPPGPPGPKVSVDEPGPGLSGEQGPPGLKGAKGEPGSNGDQGPKGDRGVPGIKGDRGEPGPRGQDGNPGLPGERGMAGPEGKPGLQGPRGPPGPVGGHGDPGPPGAPGLAGPAGPQGPSGLKGEPGETGPPGRGLTGPTGAVGLPGPPGPSGLVGPQGSPGLPGQVGETGKPGAPGRDGASGKDGDRGSPGVPGSPGLPGPVGPKGEPGPTGAPGQAVVGLPGAKGEKGAPGGLAGDLVGEPGAKGDRGLPGPRGEKGEAGRAGEPGDPGEDGQKGAPGPKGFKVCVPRRVPAGVLVVRSLSLIRCLFSSKGDPGVGVPGSPGPPGPPGVKGDLGLPGLPGAPGVVGFPGQTGPRGEMGQPGPSGERGLAGPPGREGIPGPLGPPGPPGSVGPPGASGLKGDKGDPGVGLPGPRGERGEPGIRGEDGRPGQEGPRGLTGPPGSRGERGEKGDVGSAGLKGDKGDSAVILGPPGPRGAKGDMGERGPRGLDGDKGPRGDNGDPGDKGSKGEPGDKGSAGLPGLRGLLGPQGQPGAAGIPGDPGSPGKDGVPGIRGEKGDVGFMGPRGLKGERGVKGACGLDGEKGDKDTGKKLDPQAAPGLQGPPGDDGERTDVRASGGP

SEQ ID NO: 862692 - protein, 536 aa, Homo sapiens
MTLRPPLIPLTDPRCPVGLQGDPGVGLPGPRGERGEPGIRVRMSYSTAELPSSQLLPLISNLWVNEPNVTIQGEDGRPGQEGPRGLTGPPGSRGERGEKGDVGSAGLKGDKGDSAVILGPPGPRGAKGDMGERGPRGLDGDKGPRGDNGDPGDKGSKGEPGDKGSAGLPGLRGLLGPQGQPGAAGIPGDPGSPGKDGVPGIRGEKGDVGFMGPRGLKGERGVKGACGLDGEKGDKGEAGPPGRPGLAGHKGEMGEPGVPGQSGAPGKEGLIGPKGDRGFDGQPGPKGDQGEKGERGTPGIGGFPGPSGNDGSAGPPGPPGSVGPRGPEGLQGQKGERGPPGERVVGAPGVPGAPGERGEQGRPGPAGPRGEKGEAALTEDDIRGFVRQEMSQHCACQGQFIASGSRPLPSYAADTAGSQLHAVPVLRVSHAEEEERVPPEDDEYSEYSEYSVEEYQDPEAPWDSDDPCSLPLDEGSCTAYTLRWYHRAVTGSTEACHPFVYGGCGGNANRFGTREACERRCPPRVVQSQGTGTAQD

SEQ ID NO: 862693 - protein, 659 aa, Homo sapiens
MLYKQLRQACEDHVQAQILPFREDSLDSVLFLKKINTCWQDHCRQMIMIRSIFLFLDRTYVLQNSTLPSIWDMGLELFRTHIISDKMVQSKTIDGILLLIERERSGEAVDRSLLRSLLGMLSDLQVYKDSFELKFLEETNCLYAAEGQRLMQEREVPEYLNHVSKRLEEEGDRVITYLDHSTQKPLIACVEKQLLGEHLTAILQKGLDHLLDENRVPDLAQMYQLFSRVRGGQQALLQHWSEYIKTFGTAIVINPEKDKDMVQDLLDFKDKVDHVIEVCFQKNERFVNLMKESFETFINKRPNKPAELIAKHVDSKLRAGNKEATDEELERTLDKIMILFRFIHGKDVFEAFYKKDLAKRLLVGKSASVDAEKSMLSKLKHECGAAFTSKLEGMFKDMELSKDIMVHFKQHMQNQSDSGPIDLTVNILTMGYWPTYTPMEVHLTPEMIKLQEVFKAFYLGKHSGRKLQWQTTLGHAVLKAEFKEGKKEFQVSLFQTLVLLMFNEGDGFSFEEIKMATGIEDSELRRTLQSLACGKARVLIKSPKGKEVEDGDKFIFNGEFKHKLFRIKINQIQMKETVEEQVSTTERVFQDRQYQIDAAIVRIMKMRKTLGHNLLVSELYNQLKFPVKPGDLKKRIESLIDRDYMERDKDNPNQYHYVA

SEQ ID NO: 862694 - protein, 472 aa, Homo sapiens
LTLRLPLVKTRPRRTLRAWLGQGLGARAPEEGEGEGHGARSRALIRCLRRALPSLQELGHVPARTPEPSRWSHARGGGAEPSGGARPGALRRVSRLPIPSGGVPAARIPEPGGGARSPGGRVSVRPPEPGVRVPIPQDGSPGARPRARRGVSESLRGSPIPQEGFPARVPKPSGVAGRGGGWARARGRGGAGRARRRGGGRADRGGRSGARRAAALGAGRGGSGPAMADEAPRKGSFSALVGRTNGLTKPAALAAAPAKPGGAGGSKKLVIKNFRDRPRLPDNYTQDTWRKLHEAVRAVQSSTSIRYNLEELYQAVENLCSHKVSPMLYKQLRQACEDHVQAQILPFREPSALAFCDRQQSPIDLATYGDTHLSAHSCVCQEARQDSVDSMLSLTGRVKVSARLGPHLRSLLARAGSWRKPVPVVVGLRALPSVPCCLVSLSAPHAQVLASPLTARLFSASRPAGESACLTC

SEQ ID NO: 862695 - protein, 756 aa, Homo sapiens
RPTWGEGPEIRAGPGSGGAGAPAGSGVATRGASRRALSRPLSLRPADRPRLPDNYTQDTWRKLHEAVRAVQSSTSIRYNLEELYQAVENLCSHKVSPMLYKQLRQACEDHVQAQILPFREDSLDSVLFLKKINTCWQDHCRQMIMIRSIFLFLDRTYVLQNSTLPSIWDMGLELFRTHIISDKMVQSKTIDGILLLIERERSGEAVDRSLLRSLLGMLSDLQVYKDSFELKFLEETNCLYAAEGQRLMQEREVPEYLNHVSKRLEEEGDRVITYLDHSTQKPLIACVEKQLLGEHLTAILQKGLDHLLDENRVPDLAQMYQLFSRVRGGQQALLQHWSEYIKTFGTAIVINPEKDKDMVQDLLDFKDKVDHVIEVCFQKNERFVNLMKESFETFINKRPNKPAELIAKHVDSKLRAGNKEATDEELERTLDKIMILFRFIHGKDVFEAFYKKDLAKRLLVGKSASVDAEKSMLSKLKHECGAAFTSKLEGMFKDMELSKDIMVHFKQHMQNQSDSGPIDLTVNILTMGYWPTYTPMEVHLTPEMIKLQEVFKAFYLGKHSGRKLQWQTTLGHAVLKAEFKEGKKEFQVSLFQTLVLLMFNEGDGFSFEEIKMATGIEDSELRRTLQSLACGKARVLIKSPKGKEVEDGDKFIFNGEFKHKLFRIKINQIQMKETVEEQVSTTERVFQDRQYQIDAAIVRIMKMRKTLGHNLLVSELYNQLKFPVKPGDLKKRIESLIDRDYMERDKDNPNQYHYVA

SEQ ID NO: 862696 - protein, 659 aa, Homo sapiens; identical to SEQ ID NO: 862693

SEQ ID NO: 862697 - protein, 985 aa, Homo sapiens
LTLRLPLVKTRPRRTLRAWLGQGLGARAPEEGEGEGHGARSRALIRCLRRALPSLQELGHVPARTPEPSRWSHARGGGAEPSGGARPGALRRVSRLPIPSGGVPAARIPEPGGGARSPGGRVSVRPPEPGVRVPIPQDGSPGARPRARRGVSESLRGSPIPQEGFPARVPKPSGVAGRGGGWARARGRGGAGRARRRGGGRADRGGRSGARRAAALGAGRGGSGPAMADEAPRKGSFSALVGRTNGLTKPAALAAAPAKPGGAGGSKKLVIKNFRDRPRLPDNYTQDTWRKLHEAVRAVQSSTSIRYNLEELYQAVENLCSHKVSPMLYKQLRQACEDHVQAQILPFREDSLDSVLFLKKINTCWQDHCRQMIMIRSIFLFLDRTYVLQNSTLPSIWDMGLELFRTHIISDKMVQSKTIDGILLLIERERSGEAVDRSLLRSLLGMLSDLQVYKDSFELKFLEETNCLYAAEGQRLMQEREVPEYLNHVSKRLEEEGDRVITYLDHSTQKPLIACVEKQLLGEHLTAILQKGLDHLLDENRVPDLAQMYQLFSRVRGGQQALLQHWSEYIKTFGTAIVINPEKDKDMVQDLLDFKDKVDHVIEVCFQKNERFVNLMKESFETFINKRPNKPAELIAKHVDSKLRAGNKEATDEELERTLDKIMILFRFIHGKDVFEAFYKKDLAKRLLVGKSASVDAEKSMLSKLKHECGAAFTSKLEGMFKDMELSKDIMVHFKQHMQNQSDSGPIDLTVNILTMGYWPTYTPMEVHLTPEMIKLQEVFKAFYLGKHSGRKLQWQTTLGHAVLKAEFKEGKKEFQVSLFQTLVLLMFNEGDGFSFEEIKMATGIEDSELRRTLQSLACGKARVLIKSPKGKEVEDGDKFIFNGEFKHKLFRIKINQIQMKETVEEQVSTTERVFQDRQYQIDAAIVRIMKMRKTLGHNLLVSELYNQLKFPVKPGDLKKRIESLIDRDYMERDKDNPNQYHYVA

SEQ ID NO: 862698 - protein, 985 aa, Homo sapiens; identical to SEQ ID NO: 862697

SEQ ID NO: 862699 - protein, 934 aa, Homo sapiens
LTLRLPLVKTRPRRTLRAWLGQGLGARAPEEGEGEGHGARSRALIRCLRRALPSLQELGHVPARTPEPSRWSHARGGGAEPSGGARPGALRRVSRLPIPSGGVPAARIPEPGGGARSPGGRVSVRPPEPGVRVPIPQDGSPGARPRARRGVSESLRGSPIPQEGFPARVPKPSGVAGRGGGWARARGRGGAGRARRRGGGRADRGGRSGARRAAALGAGRGGSGPAMADEAPRKGSFSALVGRTNGLTKPAALAAAPAKPGGAGGSKKLVIKNFRDRPRLPDNYTQDTWRKLHEAVRAVQSSTSIRYNLEELYQAVENLCSHKVSPMLYKQLRQACEDHVQAQILPFREDSLDSVLFLKKINTCWQDHCRQMIMIRSIFLFLDRTYVLQNSTLPSIWDMGLELFRTHIISDKMVQSKTIDGILLLIERERSGEAVDRSLLRSLLGMLSDLQVYKDSFELKFLEETNCLYAAEGQRLMQEREVPEYLNHVSKRLEEEGDRVITYLDHSTQKPLIACVEKQLLGEHLTAILQKGLDHLLDENRVPDLAQMYQLFSRVRGGQQALLQHWSEYIKTFGTAIVINPEKDKDMVQDLLDFKDKVDHVIEVCFQKNERFVNLMKESFETFINKRPNKPAELIAKHVDSKLRAGNKEATDEELERTLDKIMILFRFIHGKDVFEAFYKKDLAKRLLVGKSASVDAEKSMLSKLKHECGAAFTSKLEGMFKDMELSKDIMVHFKQHMQNQSDSGPIDLTVNILTMGYWPTYTPMEVHLTPEMIKLQEVFKAFYLGKHSGRKLQWQTTLGHAVLKAEFKEGKKEFQVSLFQTLVLLMFNEGDGFSFEEIKMATGIEDSELRRTLQSLACGKARVLIKSPKGKEVEDGDKFIFNGEFKHKLFRIKINQIQMKETPGDLKKRIESLIDRDYMERDKDNPNQYHYVA

SEQ ID NO: 862700 - protein, 507 aa, Homo sapiens
MAVVPEYLNHVSKRLEEEGDRVITYLDHSTQKPLIACVEKQLLGEHLTAILQKGLDHLLDENRVPDLAQMYQLFSRVRGGQQALLQHWSEYIKTFGTAIVINPEKDKDMVQDLLDFKDKVDHVIEVCFQKNERFVNLMKESFETFINKRPNKPAELIAKHVDSKLRAGNKEATDEELERTLDKIMILFRFIHGKDVFEAFYKKDLAKRLLVGKSASVDAEKSMLSKLKHECGAAFTSKLEGMFKDMELSKDIMVHFKQHMQNQSDSGPIDLTVNILTMGYWPTYTPMEVHLTPEMIKLQEVFKAFYLGKHSGRKLQWQTTLGHAVLKAEFKEGKKEFQVSLFQTLVLLMFNEGDGFSFEEIKMATGIEDSELRRTLQSLACGKARVLIKSPKGKEVEDGDKFIFNGEFKHKLFRIKINQIQMKETVEEQVSTTERVFQDRQYQIDAAIVRIMKMRKTLGHNLLVSELYNQLKFPVKPGDLKKRIESLIDRDYMERDKDNPNQYHYVA

SEQ ID NO: 862701 - protein, 199 aa, Homo sapiens
QRSVYTSRRGNYFGTCCVKAEFKEGKKEFQVSLFQTLVLLMFNEGDGFSFEEIKMATGIEDSELRRTLQSLACGKARVLIKSPKGKEVEDGDKFIFNGEFKHKLFRIKINQIQMKETVEEQVSTTERVFQDRQYQIDAAIVRIMKMRKTLGHNLLVSELYNQLKFPVKPGDLKKRIESLIDRDYMERDKDNPNQYHYVA

SEQ ID NO: 862702 - protein, 169 aa, Homo sapiens
PVCLLNPFLWDFYQHTCFATGQDCSVLRNSLSSIPVAIFIFLKAEAISLVEHEEHQCLEDGDKFIFNGEFKHKLFRIKINQIQMKETVEEQVSTTERVFQDRQYQIDAAIVRIMKMRKTLGHNLLVSELYNQLKFPVKPGDLKKRIESLIDRDYMERDKDNPNQYHYVA

SEQ ID NO: 862703 - protein, 829 aa, Homo sapiens
LTLRLPLVKTRPRRTLRAWLGQGLGARAPEEGEGEGHGARSRALIRCLRRALPSLQELGHVPARTPEPSRWSHARGGGAEPSGGARPGALRRVSRLPIPSGGVPAARIPEPGGGARSPGGRVSVRPPEPGVRVPIPQDGSPGARPRARRGVSESLRGSPIPQEGFPARVPKPSGVAGRGGGWARARGRGGAGRARRRGGGRADRGGRSGARRAAALGAGRGGSGPAMADEAPRKGSFSALVGRTNGLTKPAALAAAPAKPGGAGGSKKLVIKNFRDRPRLPDNYTQDTWRKLHEAVRAVQSSTSIRYNLEELYQAVENLCSHKVSPMLYKQLRQACEDHVQAQILPFREDSLDSVLFLKKINTCWQDHCRQMIMIRSIFLFLDRTYVLQNSTLPSIWDMGLELFRTHIISDKMVQSKTIDGILLLIERERSGEAVDRSLLRSLLGMLSDLQVYKDSFELKFLEETNCLYAAEGQRLMQEREVPEYLNHVSKRLEEEGDRVITYLDHSTQKPLIACVEKQLLGEHLTAILQKGLDHLLDENRVPDLAQMYQLFSRVRGGQQALLQHWSEYIKTFGTAIVINPEKDKDMVQDLLDFKDKVDHVIEVCFQKNERFVNLMKESFETFINKRPNKPAELIAKHVDSKLRAGNKEATDEELERTLDKIMILFRFIHGKDVFEAFYKKDLAKRLLVGKSASVDAEKSMLSKLKHECGAAFTSKLEGMFKDMELSKDIMVHFKQHMQNQSDSGPIDLTVNILTMGYWPTYTPMEVHLTPEMIKLQEVFKAFYLGKHSGRKLQWQTTLGHAVLKAEFKERIVNCAERCSPWPVAKHVC

SEQ ID NO: 862704 - protein, 509 aa, Homo sapiens
LTLRLPLVKTRPRRTLRAWLGQGLGARAPEEGEGEGHGARSRALIRCLRRALPSLQELGHVPARTPEPSRWSHARGGGAEPSGGARPGALRRVSRLPIPSGGVPAARIPEPGGGARSPGGRVSVRPPEPGVRVPIPQDGSPGARPRARRGVSESLRGSPIPQEGFPARVPKPSGVAGRGGGWARARGRGGAGRARRRGGGRADRGGRSGARRAAALGAGRGGSGPAMADEAPRKGSFSALVGRTNGLTKPAALAAAPAKPGGAGGSKKLVIKNFRDRPRLPDNYTQDTWRKLHEAVRAVQSSTSIRYNLEELYQAVENLCSHKVSPMLYKQLRQACEDHVQAQILPFREDSLDSVLFLKKINTCWQDHCRQMIMIRSIFLFLDRTYVLQNSTLPSIWDMGLELFRTHIISDKMVQSKTIDGILLLIERERSGEAVDRSLLRSLLGMLSDLQVYKDSFELKFLEETNCLYAAEGQRLMQEREVPEYLNHVSKRLEEEGDRVITYLDHSTQ

SEQ ID NO: 862705 - protein, 400 aa, Homo sapiens
LTLRLPLVKTRPRRTLRAWLGQGLGARAPEEGEGEGHGARSRALIRCLRRALPSLQELGHVPARTPEPSRWSHARGGGAEPSGGARPGALRRVSRLPIPSGGVPAARIPEPGGGARSPGGRVSVRPPEPGVRVPIPQDGSPGARPRARRGVSESLRGSPIPQEGFPARVPKPSGVAGRGGGWARARGRGGAGRARRRGGGRADRGGRSGARRAAALGAGRGGSGPAMADEAPRKGSFSALVGRTNGLTKPAALAAAPAKPGGAGGSKKLVIKNFRDRPRLPDNYTQDTWRKLHEAVRAVQSSTSIRYNLEELYQAVENLCSHKVSPMLYKQLRQACEDHVQAQILPFREDSLDSVLFLKKINTCWQDHCRQMIMIRSIFLFLDRTYVLQNSTLPSICQNH

SEQ ID NO: 862706 - protein, 400 aa, Homo sapiens; identical to SEQ ID NO: 862705

SEQ ID NO: 862707 - protein, 421 aa, Homo sapiens
LTLRLPLVKTRPRRTLRAWLGQGLGARAPEEGEGEGHGARSRALIRCLRRALPSLQELGHVPARTPEPSRWSHARGGGAEPSGGARPGALRRVSRLPIPSGGVPAARIPEPGGGARSPGGRVSVRPPEPGVRVPIPQDGSPGARPRARRGVSESLRGSPIPQEGFPARVPKPSGVAGRGGGWARARGRGGAGRARRRGGGRADRGGRSGARRAAALGAGRGGSGPAMADEAPRKGSFSALVGRTNGLTKPAALAAAPAKPGGAGGSKKLVIKNFRDRPRLPDNYTQDTWRKLHEAVRAVQSSTSIRYNLEELYQAVENLCSHKVSPMLYKQLRQACEDHVQAQILPFRDHRPSSFGDCIHQGFWGLSSAAFAATDPTCPLLTPVCPLWPPHGAESCRLLQADFGQKLCPVSPSDLSCSLLM

SEQ ID NO: 862708 - protein, 985 aa, Homo sapiens; identical to SEQ ID NO: 862697

SEQ ID NO: 862709 - protein, 725 aa, Homo sapiens
GPSGSWRPRPRRGCADRPRLPDNYTQDTWRKLHEAVRAVQSSTSIRYNLEELYQAVENLCSHKVSPMLYKQLRQACEDHVQAQILPFREDSLDSVLFLKKINTCWQDHCRQMIMIRSIFLFLDRTYVLQNSTLPSIWDMGLELFRTHIISDKMVQSKTIDGILLLIERERSGEAVDRSLLRSLLGMLSDLQVYKDSFELKFLEETNCLYAAEGQRLMQEREVPEYLNHVSKRLEEEGDRVITYLDHSTQKPLIACVEKQLLGEHLTAILQKGLDHLLDENRVPDLAQMYQLFSRVRGGQQALLQHWSEYIKTFGTAIVINPEKDKDMVQDLLDFKDKVDHVIEVCFQKNERFVNLMKESFETFINKRPNKPAELIAKHVDSKLRAGNKEATDEELERTLDKIMILFRFIHGKDVFEAFYKKDLAKRLLVGKSASVDAEKSMLSKLKHECGAAFTSKLEGMFKDMELSKDIMVHFKQHMQNQSDSGPIDLTVNILTMGYWPTYTPMEVHLTPEMIKLQEVFKAFYLGKHSGRKLQWQTTLGHAVLKAEFKEGKKEFQVSLFQTLVLLMFNEGDGFSFEEIKMATGIEDSELRRTLQSLACGKARVLIKSPKGKEVEDGDKFIFNGEFKHKLFRIKINQIQMKETVEEQVSTTERVFQDRQYQIDAAIVRIMKMRKTLGHNLLVSELYNQLKFPVKPGDLKKRIESLIDRDYMERDKDNPNQYHYVA

SEQ ID NO: 862710 - protein, 965 aa, Homo sapiens
LTLRLPLVKTRPRRTLRAWLGQGLGARAPEEGEGEGHGARSRALIRCLRRALPSLQELGHVPARTPEPSRWSHARGGGAEPSGGARPGALRRVSRLPIPSGGVPAARIPEPGGGARSPGGRVSVRPPEPGVRVPIPQDGSPGARPRARRGVSESLRGSPIPQEGFPARVPKPSGVAGRGGGWARARGRGGAGRARRRGGGRADRGGRSGARRAAALGAGRGGSGPAMADEAPRKGSFSALVGRTNGLTKPAALAAAPAKPGGAGGSKKLVIKNFRDRPRLPDNYTQDTWRKLHEAVRAVQSSTSIRYNLEELYQACEDHVQAQILPFREDSLDSVLFLKKINTCWQDHCRQMIMIRSIFLFLDRTYVLQNSTLPSIWDMGLELFRTHIISDKMVQSKTIDGILLLIERERSGEAVDRSLLRSLLGMLSDLQVYKDSFELKFLEETNCLYAAEGQRLMQEREVPEYLNHVSKRLEEEGDRVITYLDHSTQKPLIACVEKQLLGEHLTAILQKGLDHLLDENRVPDLAQMYQLFSRVRGGQQALLQHWSEYIKTFGTAIVINPEKDKDMVQDLLDFKDKVDHVIEVCFQKNERFVNLMKESFETFINKRPNKPAELIAKHVDSKLRAGNKEATDEELERTLDKIMILFRFIHGKDVFEAFYKKDLAKRLLVGKSASVDAEKSMLSKLKHECGAAFTSKLEGMFKDMELSKDIMVHFKQHMQNQSDSGPIDLTVNILTMGYWPTYTPMEVHLTPEMIKLQEVFKAFYLGKHSGRKLQWQTTLGHAVLKAEFKEGKKEFQVSLFQTLVLLMFNEGDGFSFEEIKMATGIEDSELRRTLQSLACGKARVLIKSPKGKEVEDGDKFIFNGEFKHKLFRIKINQIQMKETVEEQVSTTERVFQDRQYQIDAAIVRIMKMRKTLGHNLLVSELYNQLKFPVKPGDLKKRIESLIDRDYMERDKDNPNQYHYVA

SEQ ID NO: 862711 - protein, 399 aa, Homo sapiens [sequence omitted]

SEQ ID NO: 862712 - protein, 985 aa, Homo sapiens; identical to SEQ ID NO: 862697

SEQ ID NO: 862713 - protein, 438 aa, Homo sapiens
MYQLFSRVRGGQQALLQHWSEYIKTFGTAIVINPEKDKDMVQDLLDFKDKVDHVIEVCFQKNERFVNLMKESFETFINKRPNKPAELIAKHVDSKLRAGNKEATDEELERTLDKIMILFRFIHGKDVFEAFYKKDLAKRLLVGKSASVDAEKSMLSKLKHECGAAFTSKLEGMFKDMELSKDIMVHFKQHMQNQSDSGPIDLTVNILTMGYWPTYTPMEVHLTPEMIKLQEVFKAFYLGKHSGRKLQWQTTLGHAVLKAEFKEGKKEFQVSLFQTLVLLMFNEGDGFSFEEIKMATGIEDSELRRTLQSLACGKARVLIKSPKGKEVEDGDKFIFNGEFKHKLFRIKINQIQMKETVEEQVSTTERVFQDRQYQIDAAIVRIMKMRKTLGHNLLVSELYNQLKFPVKPGDLKKRIESLIDRDYMERDKDNPNQYHYVA

SEQ ID NO: 862714 - protein, 323 aa, Homo sapiens
MILFRFIHGKDVFEAFYKKDLAKRLLVGKSASVDAEKSMLSKLKHECGAAFTSKLEGMFKDMELSKDIMVHFKQHMQNQSDSGPIDLTVNILTMGYWPTYTPMEVHLTPEMIKLQEVFKAFYLGKHSGRKLQWQTTLGHAVLKAEFKEGKKEFQVSLFQTLVLLMFNEGDGFSFEEIKMATGIEDSELRRTLQSLACGKARVLIKSPKGKEVEDGDKFIFNGEFKHKLFRIKINQIQMKETVEEQVSTTERVFQDRQYQIDAAIVRIMKMRKTLGHNLLVSELYNQLKFPVKPGDLKKRIESLIDRDYMERDKDNPNQYHYVA

SEQ ID NO: 862715 - protein, 531 aa, Homo sapiens
LTLRLPLVKTRPRRTLRAWLGQGLGARAPEEGEGEGHGARSRALIRCLRRALPSLQELGHVPARTPEPSRWSHARGGGAEPSGGARPGALRRVSRLPIPSGGVPAARIPEPGGGARSPGGRVSVRPPEPGVRVPIPQDGSPGARPRARRGVSESLRGSPIPQEGFPARVPKPSGVAGRGGGWARARGRGGAGRARRRGGGRADRGGRSGARRAAALGAGRGGSGPAMADEAPRKGSFSALVGRTNGLTKPAALAAAPAKPGGAGGSKKLVIKNFRDRPRLPDNYTQDTWRKLHEAVRAVQSSTSIRYNLEELYQAVENLCSHKVSPMLYKQLRQACEDHVQAQILPFREDSLDSVLFLKKINTCWQDHCRQMIMIRSIFLFLDRTYVLQNSTLPSIWDMGLELFRTHIISDKMVQSKTIDGILLLIERERSGEAVDRSLLRSLLGMLSDLQVYKDSFELKFLEETNCLYAAEGQRLMQEREVPEYLNHVSKRLEEEGDRVITYLDHSTQKPLIACVEKQLLGDKNGHGDRG

SEQ ID NO: 862716 - protein, 923 aa, Homo sapiens
LTLRLPLVKTRPRRTLRAWLGQGLGARAPEEGEGEGHGARSRALIRCLRRALPSLQELGHVPARTPEPSRWSHARGGGAEPSGGARPGALRRVSRLPIPSGGVPAARIPEPGGGARSPGGRVSVRPPEPGVRVPIPQDGSPGARPRARRGVSESLRGSPIPQEGFPARVPKPSGVAGRGGGWARARGRGGAGRARRRGGGRADRGGRSGARRAAALGAGRGGSGPAMADEAPRKGSFSALVGRTNGLTKPAALAAAPAKPGGAGGSKKLVIKNFRDRPRLPDNYTQDTWRKLHEAVRAVQSSTSIRYNLEELYQAVENLCSHKVSPMLYKQLRQACEDHVQAQILPFREDSLDSVLFLKKINTCWQDHCRQMIMIRSIFLFLDRTYVLQNSTLPSIWDMGLELFRTHIISDKMVQSKTIDGILLLIERERSGEAVDRSLLRSLLGMLSDLQVYKDSFELKFLEETNCLYAAEGQRLMQEREVPEYLNHVSKRLEEEGDRVITYLDHSTQKPLIACVEKQLLGEHLTAILQKGLDHLLDENRVPDLAQMYQLFSRVRGGQQALLQHWSEYIKTFGTAIVINPEKDKDMVQDLLDFKDKVDHVIEVCFQKNERFVNLMKESFETFINKRPNKPAELIAKHVDSKLRAGNKEATDEELERTLDKIMILFRFIHGKDVFEAFYKKDLAKRLLVGKSASVDAEKSMLSKLKHECGAAFTSKLEGMFKDMELSKDIMVHFKQHMQNQSDSGPIDLTVNILTMGYWPTYTPMEVHLTPEMIKLQEVFKAFYLGKHSGRKLQWQTTLGHAVLKAEFKEGKKEFQVSLFQTLVLLMFNEGDGFSFEEIKMATGIEDSELRRTLQSLACGKARVLIKSPKGKEVEDGDKFIFNGEFKHKLFRIKINQIQMKETVCINFLFLLIGGLAGNHLFL

SEQ ID NO: 862717 - protein, 509 aa, Homo sapiens; identical to SEQ ID NO: 862704

SEQ ID NO: 862718 - protein, 171 aa, Homo sapiens
RPTWGEGPEIRAGPGSGGAGAPAGSGVATRGASRRALSRPLSLRPADRPRLPDNYTQDTWRKLHEAVRAVQSSTSIRYNLEELYQAVENLCSHKVSPMLYKQLRQACEDHVQAQILPFREDSLDSVLFLKKINTCWQDHCRQMIMIRSIFLFLDRTYVLQNSTLPSICQNH

SEQ ID NO: 862719 - protein, 400 aa, Homo sapiens; identical to SEQ ID NO: 862705

SEQ ID NO: 862720 - protein, 316 aa, Homo sapiens
GHPASATYYRTAKKATGRKKSSSHDSGTDITSVTLGDTTAVKTKILIKKGRGNLEKTNLDLGPTAPSLEKEKTLCLSTPSSSTVKHSTSSIGSMLAQADKLPMTDKRVASLLKKAKAQLCKIEKSKSLKQTDQPKAQGQESDSSETSVRGPRIKHVCRRAAVALGRKRAVFPDDMPTLSALPWEEREKILSSMGNDDKSSIAGSEDAEPLAPPIKPIKPVTRNKAPQEPPVKKGRRSRRCGQCPGCQVPEDCGVCTNCLDKPKFGGRNIKKQCCKMRKCQNLQWMPSKAYLQKQAKGGGLFGFRPRGRDIPFFTLF

SEQ ID NO: 862721 - protein, 135 aa, Homo sapiens
MNPRAIPGPGPYTASHSPFLHLHPLPPPQADRSSPIPPFSSRHFIIDPPFPRPILGLGRGGGSQVGVRRVDKGQLYFSVVAVVALGWEKKDYQAKLFLRKDLGLSLILVRGPKVDEGSERCPFPISTGARTELLL

SEQ ID NO: 862722 - protein, 3976 aa, Homo sapiens
ASLHGANMAHSCRWRFPARPGTTGGGGGGGRRGLGGAPRQRVPALLLPPGPPVGGGGPGAPPSPPAVAAAAAAAGSSGAGVPGGAAAASAASSSSASSSSSSSSSASSGPALLRVGPGFDAALQVSAAIGTNLRRFRAVFGESGGGGGSGEDEQFLGFGSDEEVRVRSPTRSPSVKTSPRKPRGRPRSGSDRNSAILSDPSVFSPLNKSETKSGDKIKKKDSKSIEKKRGRPPTFPGVKIKITHGKDISELPKGNKEDSLKKIKRTPSATFQQATKIKKLRAGKLSPLKSKFKTGKLQIGRKGVQIVRRRGRPPSTERIKTPSGLLINSELEKPQKVRKDKEGTPPLTKEDKTVVRQSPRRIKPVRIIPSSKRTDATIAKQLLQRAKKGAQKKIEKEAAQLQGRKVKTQVKNIRQFIMPVVSAISSRIIKTPRRFIEDEDYDPPIKIARLESTPNSRFSAPSCGSSEKSSAASQHSSQMSSDSSRSSSPSVDTSTDSQASEEIQVLPEERSDTPEVHPPLPISQSPENESNDRRSRRYSVSERSFGSRTTKKLSTLQSAPQQQTSSSPPPPLLTPPPPLQPASSISDHTPWLMPPTIPLASPFLPASTAPMQGKRKSILREPTFRWTSLKHSRSEPQYFSSAKYAKEGLIRKPIFDNFRPPPLTPEDVGFASGFSASGTAASARLFSPLHSGTRFDMHKRSPLLRAPRFTPSEAHSRIFESVTLPSNRTSAGTSSSGVSNRKRKRKVFSPIRSEPRSPSHSMRTRSGRLSSSELSPLTPPSSVSSSLSISVSPLATSALNPTFTFPSHSLTQSGESAEKNQRPRKQTSAPAEPFSSSSPTPLFPWFTPGSQTERGRNKDKAPEELSKDRDADKSVEKDKSRERDREREKENKRESRKEKRKKGSEIQSSSALYPVGRVSKEKVVGEDVATSSSAKKATGRKKSSSHDSGTDITSVTLGDTTAVKTKILIKKGRGNLEKTNLDLGPTAPSLEKEKTLCLSTPSSSTVKHSTSSIGSMLAQADKLPMTDKRVASLLKKAKAQLCKIEKSKSLKQTDQPKAQGQESDSSETSVRGPRIKHVCRRAAVALGRKRAVFPDDMPTLSALPWEEREKILSSMGNDDKSSIAGSEDAEPLAPPIKPIKPVTRNKAPQEPPVKKGRRSRRCGQCPGCQVPEDCGVCTNCLDKPKFGGRNIKKQCCKMRKCQNLQWMPSKAYLQKQAKAVKKKEKKSKTSEKKDSKESSVVKNVVDSSQKPTPSAREDPAPKKSSSEPPPRKPVEEKSEEGNVSAPGPESKQATTPASRKSSKQVSQPAVVIPPQPPTTGPPRKEVPKTTPSEPKKKQPPPPESGPEQSKQKKVAPRPSIPVKQKPKEKEKPPPVNKQENAGTLNILSTLSNGNSSKQKIPADGVHRIRVDFKEDCEAENVWEMGGLGILTSVPITPRVVCFLCASSGHVEFVYCQVCCEPFHKFCLEENERPLEDQLENWCCRRCKFCHVCGRQHQATKQLLECNKCRNSYHPECLGPNYPTKPTKKKKVWICTKCVRCKSCGSTTPGKGWDAQWSHDFSLCHDCAKLFAKGNFCPLCDKCYDDDDYESKMMQCGKCDRWVHSKCENLSDEMYEILSNLPESVAYTCVNCTERHPAEWRLALEKELQISLKQVLTALLNSRTTSHLLRYRQAAKPPDLNPETEESIPSRSSPEGPDPPVLTEVSKQDDQQPLDLEGVKRKMDQGNYTSVLEFSDDIVKIIQAAINSDGGQPEIKKANSMVKSFFIRQMERVFPWFSVKKSRFWEPNKVSSNSGMLPNAVLPPSLDHNYAQWQEREENSHTEQPPLMKKIIPAPKPKGPGEPDSPTPLHPPTPPILSTDRSREDSPELNPPPGIEDNRQCALCLTYGDDSANDAGRLLYIGQNEWTHVNCALWSAEVFEDDDGSLKNVHMAVIRGKQLRCEFCQKPGATVGCCLTSCTSNYHFMCSRAKNCVFLDDKKVYCQRHRDLIKGEVVPENGFEVFRRVFVDFEGISLRRKFLNGLEPENIHMMIGSMTIDCLGILNDLSDCEDKLFPIGYQCSRVYWSTTDARKRCVYTCKIVECRPPVVEPDINSTVEHDENRTIAHSPTSFTESSSKESQNTAEIISPPSPDRPPHSQTSGSCYYHVISKVPRIRTPSYSPTQRSPGCRPLPSAGSPTPTTHEIVTVGDPLLSSGLRSIGSRRHSTSSLSPQRSKLRIMSPMRTGNTYSRNNVSSVSTTGTATDLESSAKVVDHVLGPLNSSTSLGQNTSTSSNLQRTVVTVGNKNSHLDGSSSSEMKQSSASDLVSKSSSLKGEKTKVLSSKSSEGSAHNVAYPGIPKLAPQVHNTTSRELNVSKIGSFAEPSSVSFSSKEALSFPHLHLRGQRNDRDQHTDSTQSANSSPDEDTEVKTLKLSGMSNRSSIINEHMGSSSRDRRQKGKKSCKETFKEKHSSKSFLEPGQVTTGEEGNLKPEFMDEVLTPEYMGQRPCNNVSSDKIGDKGLSMPGVPKAPPMQVEGSAKELQAPRKRTVKVTLTPLKMENESQSKNALKESSPASPLQIESTSPTEPISASENPGDGPVAQPSPNNTSCQDSQSNNYQNLPVQDRNLMLPDGPKPQEDGSFKRRYPRRSARARSNMFFGLTPLYGVRSYGEEDIPFYSSSTGKKRGKRSAEGQVDGADDLSTSDEDDLYYYNFTRTVISSGGEERLASHNLFREEEQCDLPKISQLDGVDDGTESDTSVTATTRKSSQIPKRNGKENGTENLKIDRPEDAGEKEHVTKSSVGHKNEPKMDNCHSVSRVKTQGQDSLEAQLSSLESSRRVHTSTPSDKNLLDTYNTELLKSDSDNNNSDDCGNILPSDIMDFVLKNTPSMQALGESPESSSSELLNLGEGLGLDSNREKDMGLFEVFSQQLPTTEPVDSSVSSSISAEEQFELPLELPSDLSVLTTRSPTVPSQNPSRLAVISDSGEKRVTITEKSVASSESDPALLSPGVDPTPEGHMTPDHFIQGHMDADHISSPPCGSVEQGHGNNQDLTRNSSTPGLQVPVSPTVPIQNQKYVPNSTDSPGPSQISNAAVQTTPPHLKPATEKLIVVNQNMQPLYVLQTLPNGVTQKIQLTSSVSSTPSVMETNTSVLGPMGGGLTLTTGLNPSLPTSQSLFPSASKGLLPMSHHQHLHSFPAATQSSFPPNISNPPSGLLIGVQPPPDPQLLVSESSQRTDLSTTVATPSSGLKKRPISRLQTRKNKKLAPSSTPSNIAPSDVVSNMTLINFTPSQLPNHPSLLDLGSLNTSSHRTVPNIIKRSKSSIMYFEPAPLLPQSVGGTAATAAGTSTISQDTSHLTSGSVSGLASSSSVLNVVSMQTTTTPTSSASVPGHVTLTNPRLLGTPDIGSISNLLIKASQQSLGIQDQPVALPPSSGMFPQLGTSQTPSTAAITAASSICVLPSTQTTGITAASPSGEADEHYQLQHVNQLLASKTGIHSSQRDLDSASGPQVSNFTQTVDAPNSMGLEQNKALSSAVQASPTSPGGSPSSPSSGQRSASPSVPGPTKPKPKTKRFQLPLDKGNGKKHKVSHLRTSSSEAHIPDQETTSLTSGTGTPGAEAEQQDTASVEQSSQKECGQPAGQVAVLPEVQVTQNPANEQESAEPKTVEEEESNFSSPLMLWLQQEQKRKESITEKKPKKGLVFEISSDDGFQICAESIEDAWKSLTDKVQEARSNARLKQLSFAGVNGLRMLGILHDAVVFLIEQLSGAKHCRNYKFRFHKPEEANEPPLNPHGSARAEVHLRKSAFDMFNFLASKHRQPPEYNPNDEEEEEVQLKSARRATSMDLPMPMRFRHLKKTSKEAVGVYRSPIHGRGLFCKRNIDAGEMVIEYAGNVIRSIQTDKREKYYDSKGIGCYMFRIDDSEVVDATMHGNAARFINHSCEPNCYSRVINIDGQKHIVIFAMRKIYRGEELTYDYKFPIEDASNKLPCNCGAKKCRKFLN

SEQ ID NO: 862723 - protein, 3976 aa, Homo sapiens; identical to SEQ ID NO: 862722

SEQ ID NO: 862724 - protein, 3976 aa, Homo sapiens; identical to SEQ ID NO: 862722

SEQ ID NO: 862725 - protein, 3760 aa, Homo sapiens
MAHSCRWRFPARPGTTGGGGGGGRRGLGGAPRQRVPALLLPPGPPVGGGGPGAPPSPPAVAAAAAAAGSSGAGVPGGAAAASAASSSSASSSSSSSSSASSGPALLRVGPGFDAALQVSAAIGTNLRRFRAVFGESGGGGGSGEDEQFLGFGSDEEVRVRSPTRSPSVKTSPRKPRGRPRSGSDRNSAILSDPSVFSPLNKSETKSGDKIKKKDSKSIEKKRGRPPTFPGVKIKITHGKDISELPKGNKEDSLKKIKRTPSATFQQATKIKKLRAGKLSPLKSKFKTGKLQIGRKGVQIVRRRGRPPSTERIKTPSGLLINSELEKPQKVRKDKEGTPPLTKEDKTVVRQSPRRIKPVRIIPSSKRTDATIAKQLLQRAKKGAQKKIEKEAAQLQGRKVKTQVKNIRQFIMPVVSAISSRIIKTPRRFIEDEDYDPPIKIARLESTPNSRFSAPSCGSSEKSSAASQHSSQMSSDSSRSSSPSVDTSTDSQASEEIQVLPEERSDTPEVHPPLPISQSPENESNDRRSRRYSVSERSFGSRTTKKLSTLQSAPQQQTSSSPPPPLLTPPPPLQPASSISDHTPWLMPPTIPLASPFLPASTAPMQGKRKSILREPTFRWTSLKHSRSEPQYFSSAKYAKEGLIRKPIFDNFRPPPLTPEDVGFASGFSASGTAASARLFSPLHSGTRFDMHKRSPLLRAPRFTPSEAHSRIFESVTLPSNRTSAGTSSSGVSNRKRKRKVFSPIRSEPRSPSHSMRTRSGRLSSSELSPLTPPSSVSSSLSISVSPLATSALNPTFTFPSHSLTQSGESAEKNQRPRKQTSAPAEPFSSSSPTPLFPWFTPGSQTERGRNKDKAPEELSKDRDADKSVEKDKSRERDREREKENKRESRKEKRKKGSEIQSSSALYPVGRVSKEKVVGEDVATSSSAKKATGRKKSSSHDSGTDITSVTLGDTTAVKTKILIKKGRGNLEKTNLDLGPTAPSLEKEKTLCLSTPSSSTVKHSTSSIGSMLAQADKLPMTDKRVASLLKKAKAQLCKIEKSKSLKQTDQPKAQGQESDSSETSVRGPRIKHVCRRAAVALGRKRAVFPDDMPTLSALPWEEREKILSSMGNDDKSSIAGSEDAEPLAPPIKPIKPVTRNKAPQEPPVKKGRRSRRCGQCPGCQVPEDCGVCTNCLDKPKFGGRNIKKQCCKMRKCQNLQWMPSKAYLQKQAKAVKKKEKKSKTSEKKDSKESSVVKNVVDSSQKPTPSAREDPAPKKSSSEPPPRKPVEEKSEEGNVSAPGPESKQATTPASRKSSKQVSQPAVVIPPQPPTTGPPRKEVPKTTPSEPKKKQPPPPESGPEQSKQKKVAPRPSIPVKQKPKEKEKPPPVNKQENAGTLNILSTLSNGNSSKQKIPADGVHRIRVDFKEDCEAENVWEMGGLGILTSVPITPRVVCFLCASSGHVEFVYCQVCCEPFHKFCLEENERPLEDQLENWCCRRCKFCHVCGRQHQATKQLLECNKCRNSYHPECLGPNYPTKPTKKKKVWICTKCVRCKSCGSTTPGKGWDAQWSHDFSLCHDCAKLFAKGNFCPLCDKCYDDDDYESKMMQCGKCDRWVHSKCENLSDEMYEILSNLPESVAYTCVNCTERHPAEWRLALEKELQISLKQVLTALLNSRTTSHLLRYRQAAKPPDLNPETEESIPSRSSPEGPDPPVLTEVSKQDDQQPLDLEGVKRKMDQGNYTSVLEFSDDIVKIIQAAINSDGGQPEIKKANSMVKSFFIRQMERVFPWFSVKKSRFWEPNKVSSNSGMLPNAVLPPSLDHNYAQWQEREENSHTEQPPLMKKIIPAPKPKGPGEPDSPTPLHPPTPPILSTDRSREDSPELNPPPGIEDNRQCALCLTYGDDSANDAGRLLYIGQNEWTHVNCALWSAEVFEDDDGSLKNVHMAVIRGKQLRCEFCQKPGATVGCCLTSCTSNYHFMCSRAKNCVFLDDKKVYCQRHRDLIKGEVVPENGFEVFRRVFVDFEGISLRRKFLNGLEPENIHMMIGSMTIDCLGILNDLSDCEDKLFPIGYQCSRVYWSTTDARKRCVYTCKIVECRPPVVEPDINSTVEHDENRTIAHSPTSFTESSSKESQNTAEIISPPSPDRPPHSQTSGSCYYHVISKVPRIRTPSYSPTQRSPGCRPLPSAGSPTPTTHEIVTVGDPLLSSGLRSIGSRRHSTSSLSPQRSKLRIMSPMRTGNTYSRNNVSSVSTTGTATDLESSAKVVDHVLGPLNSSTSLGQNTSTSSNLQRTVVTVGNKNSHLDGSSSSEMKQSSASDLVSKSSSLKGEKTKVLSSKSSEGSAHNVAYPGIPKLAPQVHNTTSRELNVSKIGSFAEPSSVSFSSKEALSFPHLIQDSQSNNYQNLPVQDRNLMLPDGPKPQEDGSFKRRYPRRSARARSNMFFGLTPLYGVRSYGEEDIPFYSSSTGKKRGKRSAEGQVDGADDLSTSDEDDLYYYNFTRTVISSGGEERLASHNLFREEEQCDLPKISQLDGVDDGTESDTSVTATTRKSSQIPKRNGKENGTENLKIDRPEDAGEKEHVTKSSVGHKNEPKMDNCHSVSRVKTQGQDSLEAQLSSLESSRRVHTSTPSDKNLLDTYNTELLKSDSDNNNSDDCGNILPSDIMDFVLKNTPSMQALGESPESSSSELLNLGEGLGLDSNREKDMGLFEVFSQQLPTTEPVDSSVSSSISAEEQFELPLELPSDLSVLTTRSPTVPSQNPSRLAVISDSGEKRVTITEKSVASSESDPALLSPGVDPTPEGHMTPDHFIQGHMDADHISSPPCGSVEQGHGNNQDLTRNSSTPGLQVPVSPTVPIQNQKYVPNSTDSPGPSQISNAAVQTTPPHLKPATEKLIVVNQNMQPLYVLQTLPNGVTQKIQLTSSVSSTPSVMETNTSVLGPMGGGLTLTTGLNPSLPTSQSLFPSASKGLLPMSHHQHLHSFPAATQSSFPPNISNPPSGLLIGVQPPPDPQLLVSESSQRTDLSTTVATPSSGLKKRPISRLQTRKNKKLAPSSTPSNIAPSDVVSNMTLINFTPSQLPNHPSLLDLGSLNTSSHRTVPNIIKRSKSSIMYFEPAPLLPQSVGGTAATAAGTSTISQDTSHLTSGSVSGLASSSSVLNVVSMQTTTTPTSSASVPGHVTLTNPRLLGTPDIGSISNLLIKASQQSLGIQDQPVALPPSSGMFPQLGTSQTPSTAAITAASSICVLPSTQTTGITAASPSGEADEHYQLQHVNQLLASKTGIHSSQRDLDSASGPQVSNFTQTVDAPNSMGLEQNKALSSAVQASPTSPGGSPSSPSSGQRSASPSVPGPTKPKPKTKRFQLPLDKGNGKKHKVSHLRTSSSEAHIPDQETTSLTSGTGTPGAEAEQQDTASVEQSSQKECGQPAGQVAVLPEVQVTQNPANEQESAEPKTVEEEESNFSSPLMLWLQQEQKRKESITEKKPKKGLVFEISSDDGFQICAESIEDAWKSLTDKVQEARSNARLKQLSFAGVNGLRMLGILHDAVVFLIEQLSGAKHCRNYKFRFHKPEEANEPPLNPHGSARAEVHLRKSAFDMFNFLASKHRQPPEYNPNDEEEEEVQLKSARRATSMDLPMPMRFRHLKKTSKEAVGVYRSPIHGRGLFCKRNIDAGEMVIEYAGNVIRSIQTDKREKYYDSKGIGCYMFRIDDSEVVDATMHGNAARFINHSCEPNCYSRVINIDGQKHIVIFAMRKIYRGEELTYDYKFPIEDASNKLPCNCGAKKCRKFLN

SEQ ID NO: 862726 - protein, 4009 aa, Homo sapiens
ASLHGANMAHSCRWRFPARPGTTGGGGGGGRRGLGGAPRQRVPALLLPPGPPVGGGGPGAPPSPPAVAAAAAAAGSSGAGVPGGAAAASAASSSSASSSSSSSSSASSGPALLRVGPGFDAALQVSAAIGTNLRRFRAVFGESGGGGGSGELTTQIPCSWRTKGHIHDKKTEPFRLLAWSWCLNDEQFLGFGSDEEVRVRSPTRSPSVKTSPRKPRGRPRSGSDRNSAILSDPSVFSPLNKSETKSGDKIKKKDSKSIEKKRGRPPTFPGVKIKITHGKDISELPKGNKEDSLKKIKRTPSATFQQATKIKKLRAGKLSPLKSKFKTGKLQIGRKGVQIVRRRGRPPSTERIKTPSGLLINSELEKPQKVRKDKEGTPPLTKEDKTVVRQSPRRIKPVRIIPSSKRTDATIAKQLLQRAKKGAQKKIEKEAAQLQGRKVKTQVKNIRQFIMPVVSAISSRIIKTPRRFIEDEDYDPPIKIARLESTPNSRFSAPSCGSSEKSSAASQHSSQMSSDSSRSSSPSVDTSTDSQASEEIQVLPEERSDTPEVHPPLPISQSPENESNDRRSRRYSVSERSFGSRTTKKLSTLQSAPQQQTSSSPPPPLLTPPPPLQPASSISDHTPWLMPPTIPLASPFLPASTAPMQGKRKSILREPTFRWTSLKHSRSEPQYFSSAKYAKEGLIRKPIFDNFRPPPLTPEDVGFASGFSASGTAASARLFSPLHSGTRFDMHKRSPLLRAPRFTPSEAHSRIFESVTLPSNRTSAGTSSSGVSNRKRKRKVFSPIRSEPRSPSHSMRTRSGRLSSSELSPLTPPSSVSSSLSISVSPLATSALNPTFTFPSHSLTQSGESAEKNQRPRKQTSAPAEPFSSSSPTPLFPWFTPGSQTERGRNKDKAPEELSKDRDADKSVEKDKSRERDREREKENKRESRKEKRKKGSEIQSSSALYPVGRVSKEKVVGEDVATSSSAKKATGRKKSSSHDSGTDITSVTLGDTTAVKTKILIKKGRGNLEKTNLDLGPTAPSLEKEKTLCLSTPSSSTVKHSTSSIGSMLAQADKLPMTDKRVASLLKKAKAQLCKIEKSKSLKQTDQPKAQGQESDSSETSVRGPRIKHVCRRAAVALGRKRAVFPDDMPTLSALPWEEREKILSSMGNDDKSSIAGSEDAEPLAPPIKPIKPVTRNKAPQEPPVKKGRRSRRCGQCPGCQVPEDCGVCTNCLDKPKFGGRNIKKQCCKMRKCQNLQWMPSKAYLQKQAKAVKKKEKKSKTSEKKDSKESSVVKNVVDSSQKPTPSAREDPAPKKSSSEPPPRKPVEEKSEEGNVSAPGPESKQATTPASRKSSKQVSQPAVVIPPQPPTTGPPRKEVPKTTPSEPKKKQPPPPESGPEQSKQKKVAPRPSIPVKQKPKEKEKPPPVNKQENAGTLNILSTLSNGNSSKQKIPADGVHRIRVDFKEDCEAENVWEMGGLGILTSVPITPRVVCFLCASSGHVEFVYCQVCCEPFHKFCLEENERPLEDQLENWCCRRCKFCHVCGRQHQATKQLLECNKCRNSYHPECLGPNYPTKPTKKKKVWICTKCVRCKSCGSTTPGKGWDAQWSHDFSLCHDCAKLFAKGNFCPLCDKCYDDDDYESKMMQCGKCDRWVHSKCENLSDEMYEILSNLPESVAYTCVNCTERHPAEWRLALEKELQISLKQVLTALLNSRTTSHLLRYRQAAKPPDLNPETEESIPSRSSPEGPDPPVLTEVSKQDDQQPLDLEGVKRKMDQGNYTSVLEFSDDIVKIIQAAINSDGGQPEIKKANSMVKSFFIRQMERVFPWFSVKKSRFWEPNKVSSNSGMLPNAVLPPSLDHNYAQWQEREENSHTEQPPLMKKIIPAPKPKGPGEPDSPTPLHPPTPPILSTDRSREDSPELNPPPGIEDNRQCALCLTYGDDSANDAGRLLYIGQNEWTHVNCALWSAEVFEDDDGSLKNVHMAVIRGKQLRCEFCQKPGATVGCCLTSCTSNYHFMCSRAKNCVFLDDKKVYCQRHRDLIKGEVVPENGFEVFRRVFVDFEGISLRRKFLNGLEPENIHMMIGSMTIDCLGILNDLSDCEDKLFPIGYQCSRVYWSTTDARKRCVYTCKIVECRPPVVEPDINSTVEHDENRTIAHSPTSFTESSSKESQNTAEIISPPSPDRPPHSQTSGSCYYHVISKVPRIRTPSYSPTQRSPGCRPLPSAGSPTPTTHEIVTVGDPLLSSGLRSIGSRRHSTSSLSPQRSKLRIMSPMRTGNTYSRNNVSSVSTTGTATDLESSAKVVDHVLGPLNSSTSLGQNTSTSSNLQRTVVTVGNKNSHLDGSSSSEMKQSSASDLVSKSSSLKGEKTKVLSSKSSEGSAHNVAYPGIPKLAPQVHNTTSRELNVSKIGSFAEPSSVSFSSKEALSFPHLHLRGQRNDRDQHTDSTQSANSSPDEDTEVKTLKLSGMSNRSSIINEHMGSSSRDRRQKGKKSCKETFKEKHSSKSFLEPGQVTTGEEGNLKPEFMDEVLTPEYMGQRPCNNVSSDKIGDKGLSMPGVPKAPPMQVEGSAKELQAPRKRTVKVTLTPLKMENESQSKNALKESSPASPLQIESTSPTEPISASENPGDGPVAQPSPNNTSCQDSQSNNYQNLPVQDRNLMLPDGPKPQEDGSFKRRYPRRSARARSNMFFGLTPLYGVRSYGEEDIPFYSSSTGKKRGKRSAEGQVDGADDLSTSDEDDLYYYNFTRTVISSGGEERLASHNLFREEEQCDLPKISQLDGVDDGTESDTSVTATTRKSSQIPKRNGKENGTENLKIDRPEDAGEKEHVTKSSVGHKNEPKMDNCHSVSRVKTQGQDSLEAQLSSLESSRRVHTSTPSDKNLLDTYNTELLKSDSDNNNSDDCGNILPSDIMDFVLKNTPSMQALGESPESSSSELLNLGEGLGLDSNREKDMGLFEVFSQQLPTTEPVDSSVSSSISAEEQFELPLELPSDLSVLTTRSPTVPSQNPSRLAVISDSGEKRVTITEKSVASSESDPALLSPGVDPTPEGHMTPDHFIQGHMDADHISSPPCGSVEQGHGNNQDLTRNSSTPGLQVPVSPTVPIQNQKYVPNSTDSPGPSQISNAAVQTTPPHLKPATEKLIVVNQNMQPLYVLQTLPNGVTQKIQLTSSVSSTPSVMETNTSVLGPMGGGLTLTTGLNPSLPTSQSLFPSASKGLLPMSHHQHLHSFPAATQSSFPPNISNPPSGLLIGVQPPPDPQLLVSESSQRTDLSTTVATPSSGLKKRPISRLQTRKNKKLAPSSTPSNIAPSDVVSNMTLINFTPSQLPNHPSLLDLGSLNTSSHRTVPNIIKRSKSSIMYFEPAPLLPQSVGGTAATAAGTSTISQDTSHLTSGSVSGLASSSSVLNVVSMQTTTTPTSSASVPGHVTLTNPRLLGTPDIGSISNLLIKASQQSLGIQDQPVALPPSSGMFPQLGTSQTPSTAAITAASSICVLPSTQTTGITAASPSGEADEHYQLQHVNQLLASKTGIHSSQRDLDSASGPQVSNFTQTVDAPNSMGLEQNKALSSAVQASPTSPGGSPSSPSSGQRSASPSVPGPTKPKPKTKRFQLPLDKGNGKKHKVSHLRTSSSEAHIPDQETTSLTSGTGTPGAEAEQQDTASVEQSSQKECGQPAGQVAVLPEVQVTQNPANEQESAEPKTVEEEESNFSSPLMLWLQQEQKRKESITEKKPKKGLVFEISSDDGFQICAESIEDAWKSLTDKVQEARSNARLKQLSFAGVNGLRMLGILHDAVVFLIEQLSGAKHCRNYKFRFHKPEEANEPPLNPHGSARAEVHLRKSAFDMFNFLASKHRQPPEYNPNDEEEEEVQLKSARRATSMDLPMPMRFRHLKKTSKEAVGVYRSPIHGRGLFCKRNIDAGEMVIEYAGNVIRSIQTDKREKYYDSKGIGCYMFRIDDSEVVDATMHGNAARFINHSCEPNCYSRVINIDGQKHIVIFAMRKIYRGEELTYDYKFPIEDASNKLPCNCGAKKCRKFLN

SEQ ID NO: 862727 - protein, 3805 aa, Homo sapiens
MKKSECEVPQGLLQLKLVLENLVGDLEVALTEIQLNKSETKSGDKIKKKDSKSIEKKRGRPPTFPGVKIKITHGKDISELPKGNKEDSLKKIKRTPSATFQQATKIKKLRAGKLSPLKSKFKTGKLQIGRKGVQIVRRRGRPPSTERIKTPSGLLINSELEKPQKVRKDKEGTPPLTKEDKTVVRQSPRRIKPVRIIPSSKRTDATIAKQLLQRAKKGAQKKIEKEAAQLQGRKVKTQVKNIRQFIMPVVSAISSRIIKTPRRFIEDEDYDPPIKIARLESTPNSRFSAPSCGSSEKSSAASQHSSQMSSDSSRSSSPSVDTSTDSQASEEIQVLPEERSDTPEVHPPLPISQSPENESNDRRSRRYSVSERSFGSRTTKKLSTLQSAPQQQTSSSPPPPLLTPPPPLQPASSISDHTPWLMPPTIPLASPFLPASTAPMQGKRKSILREPTFRWTSLKHSRSEPQYFSSAKYAKEGLIRKPIFDNFRPPPLTPEDVGFASGFSASGTAASARLFSPLHSGTRFDMHKRSPLLRAPRFTPSEAHSRIFESVTLPSNRTSAGTSSSGVSNRKRKRKVFSPIRSEPRSPSHSMRTRSGRLSSSELSPLTPPSSVSSSLSISVSPLATSALNPTFTFPSHSLTQSGESAEKNQRPRKQTSAPAEPFSSSSPTPLFPWFTPGSQTERGRNKDKAPEELSKDRDADKSVEKDKSRERDREREKENKRESRKEKRKKGSEIQSSSALYPVGRVSKEKVVGEDVATSSSAKKATGRKKSSSHDSGTDITSVTLGDTTAVKTKILIKKGRGNLEKTNLDLGPTAPSLEKEKTLCLSTPSSSTVKHSTSSIGSMLAQADKLPMTDKRVASLLKKAKAQLCKIEKSKSLKQTDQPKAQGQESDSSETSVRGPRIKHVCRRAAVALGRKRAVFPDDMPTLSALPWEEREKILSSMGNDDKSSIAGSEDAEPLAPPIKPIKPVTRNKAPQEPPVKKGRRSRRCGQCPGCQVPEDCGVCTNCLDKPKFGGRNIKKQCCKMRKCQNLQWMPSKAYLQKQAKAVKKKEKKSKTSEKKDSKESSVVKNVVDSSQKPTPSAREDPAPKKSSSEPPPRKPVEEKSEEGNVSAPGPESKQATTPASRKSSKQVSQPAVVIPPQPPTTGPPRKEVPKTTPSEPKKKQPPPPESGPEQSKQKKVAPRPSIPVKQKPKEKEKPPPVNKQENAGTLNILSTLSNGNSSKQKIPADGVHRIRVDFKEDCEAENVWEMGGLGILTSVPITPRVVCFLCASSGHVEFVYCQVCCEPFHKFCLEENERPLEDQLENWCCRRCKFCHVCGRQHQATKQLLECNKCRNSYHPECLGPNYPTKPTKKKKVWICTKCVRCKSCGSTTPGKGWDAQWSHDFSLCHDCAKLFAKGNFCPLCDKCYDDDDYESKMMQCGKCDRWVHSKCENLSDEMYEILSNLPESVAYTCVNCTERHPAEWRLALEKELQISLKQVLTALLNSRTTSHLLRYRQAAKPPDLNPETEESIPSRSSPEGPDPPVLTEVSKQDDQQPLDLEGVKRKMDQGNYTSVLEFSDDIVKIIQAAINSDGGQPEIKKANSMVKSFFIRQMERVFPWFSVKKSRFWEPNKVSSNSGMLPNAVLPPSLDHNYAQWQEREENSHTEQPPLMKKIIPAPKPKGPGEPDSPTPLHPPTPPILSTDRSREDSPELNPPPGIEDNRQCALCLTYGDDSANDAGRLLYIGQNEWTHVNCALWSAEVFEDDDGSLKNVHMAVIRGKQLRCEFCQKPGATVGCCLTSCTSNYHFMCSRAKNCVFLDDKKVYCQRHRDLIKGEVVPENGFEVFRRVFVDFEGISLRRKFLNGLEPENIHMMIGSMTIDCLGILNDLSDCEDKLFPIGYQCSRVYWSTTDARKRCVYTCKIVECRPPVVEPDINSTVEHDENRTIAHSPTSFTESSSKESQNTAEIISPPSPDRPPHSQTSGSCYYHVISKVPRIRTPSYSPTQRSPGCRPLPSAGSPTPTTHEIVTVGDPLLSSGLRSIGSRRHSTSSLSPQRSKLRIMSPMRTGNTYSRNNVSSVSTTGTATDLESSAKVVDHVLGPLNSSTSLGQNTSTSSNLQRTVVTVGNKNSHLDGSSSSEMKQSSASDLVSKSSSLKGEKTKVLSSKSSEGSAHNVAYPGIPKLAPQVHNTTSRELNVSKIGSFAEPSSVSFSSKEALSFPHLHLRGQRNDRDQHTDSTQSANSSPDEDTEVKTLKLSGMSNRSSIINEHMGSSSRDRRQKGKKSCKETFKEKHSSKSFLEPGQVTTGEEGNLKPEFMDEVLTPEYMGQRPCNNVSSDKIGDKGLSMPGVPKAPPMQVEGSAKELQAPRKRTVKVTLTPLKMENESQSKNALKESSPASPLQIESTSPTEPISASENPGDGPVAQPSPNNTSCQDSQSNNYQNLPVQDRNLMLPDGPKPQEDGSFKRRYPRRSARARSNMFFGLTPLYGVRSYGEEDIPFYSSSTGKKRGKRSAEGQVDGADDLSTSDEDDLYYYNFTRTVISSGGEERLASHNLFREEEQCDLPKISQLDGVDDGTESDTSVTATTRKSSQIPKRNGKENGTENLKIDRPEDAGEKEHVTKSSVGHKNEPKMDNCHSVSRVKTQGQDSLEAQLSSLESSRRVHTSTPSDKNLLDTYNTELLKSDSDNNNSDDCGNILPSDIMDFVLKNTPSMQALGESPESSSSELLNLGEGLGLDSNREKDMGLFEVFSQQLPTTEPVDSSVSSSISAEEQFELPLELPSDLSVLTTRSPTVPSQNPSRLAVISDSGEKRVTITEKSVASSESDPALLSPGVDPTPEGHMTPDHFIQGHMDADHISSPPCGSVEQGHGNNQDLTRNSSTPGLQVPVSPTVPIQNQKYVPNSTDSPGPSQISNAAVQTTPPHLKPATEKLIVVNQNMQPLYVLQTLPNGVTQKIQLTSSVSSTPSVMETNTSVLGPMGGGLTLTTGLNPSLPTSQSLFPSASKGLLPMSHHQHLHSFPAATQSSFPPNISNPPSGLLIGVQPPPDPQLLVSESSQRTDLSTTVATPSSGLKKRPISRLQTRKNKKLAPSSTPSNIAPSDVVSNMTLINFTPSQLPNHPSLLDLGSLNTSSHRTVPNIIKRSKSSIMYFEPAPLLPQSVGGTAATAAGTSTISQDTSHLTSGSVSGLASSSSVLNVVSMQTTTTPTSSASVPGHVTLTNPRLLGTPDIGSISNLLIKASQQSLGIQDQPVALPPSSGMFPQLGTSQTPSTAAITAASSICVLPSTQTTGITAASPSGEADEHYQLQHVNQLLASKTGIHSSQRDLDSASGPQVSNFTQTVDAPNSMGLEQNKALSSAVQASPTSPGGSPSSPSSGQRSASPSVPGPTKPKPKTKRFQLPLDKGNGKKHKVSHLRTSSSEAHIPDQETTSLTSGTGTPGAEAEQQDTASVEQSSQKECGQPAGQVAVLPEVQVTQNPANEQESAEPKTVEEEESNFSSPLMLWLQQEQKRKESITEKKPKKGLVFEISSDDGFQICAESIEDAWKSLTDKVQEARSNARLKQLSFAGVNGLRMLGILHDAVVFLIEQLSGAKHCRNYKFRFHKPEEANEPPLNPHGSARAEVHLRKSAFDMFNFLASKHRQPPEYNPNDEEEEEVQLKSARRATSMDLPMPMRFRHLKKTSKEAVGVYRSPIHGRGLFCKRNIDAGEMVIEYAGNVIRSIQTDKREKYYDSKGIGCYMFRIDDSEVVDATMHGNAARFINHSCEPNCYSRVINIDGQKHIVIFAMRKIYRGEELTYDYKFPIEDASNKLPCNCGAKKCRKFLN

SEQ ID NO: 862728 - protein, 3849 aa, Homo sapiens
PEQSKQKKVAPRPSIPVKQKPKEKDEQFLGFGSDEEVRVRSPTRSPSVKTSPRKPRGRPRSGSDRNSAILSDPSVFSPLNKSETKSGDKIKKKDSKSIEKKRGRPPTFPGVKIKITHGKDISELPKGNKEDSLKKIKRTPSATFQQATKIKKLRAGKLSPLKSKFKTGKLQIGRKGVQIVRRRGRPPSTERIKTPSGLLINSELEKPQKVRKDKEGTPPLTKEDKTVVRQSPRRIKPVRIIPSSKRTDATIAKQLLQRAKKGAQKKIEKEAAQLQGRKVKTQVKNIRQFIMPVVSAISSRIIKTPRRFIEDEDYDPPIKIARLESTPNSRFSAPSCGSSEKSSAASQHSSQMSSDSSRSSSPSVDTSTDSQASEEIQVLPEERSDTPEVHPPLPISQSPENESNDRRSRRYSVSERSFGSRTTKKLSTLQSAPQQQTSSSPPPPLLTPPPPLQPASSISDHTPWLMPPTIPLASPFLPASTAPMQGKRKSILREPTFRWTSLKHSRSEPQYFSSAKYAKEGLIRKPIFDNFRPPPLTPEDVGFASGFSASGTAASARLFSPLHSGTRFDMHKRSPLLRAPRFTPSEAHSRIFESVTLPSNRTSAGTSSSGVSNRKRKRKVFSPIRSEPRSPSHSMRTRSGRLSSSELSPLTPPSSVSSSLSISVSPLATSALNPTFTFPSHSLTQSGESAEKNQRPRKQTSAPAEPFSSSSPTPLFPWFTPGSQTERGRNKDKAPEELSKDRDADKSVEKDKSRERDREREKENKRESRKEKRKKGSEIQSSSALYPVGRVSKEKVVGEDVATSSSAKKATGRKKSSSHDSGTDITSVTLGDTTAVKTKILIKKGRGNLEKTNLDLGPTAPSLEKEKTLCLSTPSSSTVKHSTSSIGSMLAQADKLPMTDKRVASLLKKAKAQLCKIEKSKSLKQTDQPKAQGQESDSSETSVRGPRIKHVCRRAAVALGRKRAVFPDDMPTLSALPWEEREKILSSMGNDDKSSIAGSEDAEPLAPPIKPIKPVTRNKAPQEPPVKKGRRSRRCGQCPGCQVPEDCGVCTNCLDKPKFGGRNIKKQCCKMRKCQNLQWMPSKAYLQKQAKAVKKKEKKSKTSEKKDSKESSVVKNVVDSSQKPTPSAREDPAPKKSSSEPPPRKPVEEKSEEGNVSAPGPESKQATTPASRKSSKQVSQPAVVIPPQPPTTGPPRKEVPKTTPSEPKKKQPPPPESGPEQSKQKKVAPRPSIPVKQKPKEKEKPPPVNKQENAGTLNILSTLSNGNSSKQKIPADGVHRIRVDFKEDCEAENVWEMGGLGILTSVPITPRVVCFLCASSGHVEFVYCQVCCEPFHKFCLEENERPLEDQLENWCCRRCKFCHVCGRQHQATKQLLECNKCRNSYHPECLGPNYPTKPTKKKKVWICTKCVRCKSCGSTTPGKGWDAQWSHDFSLCHDCAKLFAKGNFCPLCDKCYDDDDYESKMMQCGKCDRWVHSKCENLSDEMYEILSNLPESVAYTCVNCTERHPAEWRLALEKELQISLKQVLTALLNSRTTSHLLRYRQAAKPPDLNPETEESIPSRSSPEGPDPPVLTEVSKQDDQQPLDLEGVKRKMDQGNYTSVLEFSDDIVKIIQAAINSDGGQPEIKKANSMVKSFFIRQMERVFPWFSVKKSRFWEPNKVSSNSGMLPNAVLPPSLDHNYAQWQEREENSHTEQPPLMKKIIPAPKPKGPGEPDSPTPLHPPTPPILSTDRSREDSPELNPPPGIEDNRQCALCLTYGDDSANDAGRLLYIGQNEWTHVNCALWSAEVFEDDDGSLKNVHMAVIRGKQLRCEFCQKPGATVGCCLTSCTSNYHFMCSRAKNCVFLDDKKVYCQRHRDLIKGEVVPENGFEVFRRVFVDFEGISLRRKFLNGLEPENIHMMIGSMTIDCLGILNDLSDCEDKLFPIGYQCSRVYWSTTDARKRCVYTCKIVECRPPVVEPDINSTVEHDENRTIAHSPTSFTESSSKESQNTAEIISPPSPDRPPHSQTSGSCYYHVISKVPRIRTPSYSPTQRSPGCRPLPSAGSPTPTTHEIVTVGDPLLSSGLRSIGSRRHSTSSLSPQRSKLRIMSPMRTGNTYSRNNVSSVSTTGTATDLESSAKVVDHVLGPLNSSTSLGQNTSTSSNLQRTVVTVGNKNSHLDGSSSSEMKQSSASDLVSKSSSLKGEKTKVLSSKSSEGSAHNVAYPGIPKLAPQVHNTTSRELNVSKIGSFAEPSSVSFSSKEALSFPHLHLRGQRNDRDQHTDSTQSANSSPDEDTEVKTLKLSGMSNRSSIINEHMGSSSRDRRQKGKKSCKETFKEKHSSKSFLEPGQVTTGEEGNLKPEFMDEVLTPEYMGQRPCNNVSSDKIGDKGLSMPGVPKAPPMQVEGSAKELQAPRKRTVKVTLTPLKMENESQSKNALKESSPASPLQIESTSPTEPISASENPGDGPVAQPSPNNTSCQDSQSNNYQNLPVQDRNLMLPDGPKPQEDGSFKRRYPRRSARARSNMFFGLTPLYGVRSYGEEDIPFYSSSTGKKRGKRSAEGQVDGADDLSTSDEDDLYYYNFTRTVISSGGEERLASHNLFREEEQCDLPKISQLDGVDDGTESDTSVTATTRKSSQIPKRNGKENGTENLKIDRPEDAGEKEHVTKSSVGHKNEPKMDNCHSVSRVKTQGQDSLEAQLSSLESSRRVHTSTPSDKNLLDTYNTELLKSDSDNNNSDDCGNILPSDIMDFVLKNTPSMQALGESPESSSSELLNLGEGLGLDSNREKDMGLFEVFSQQLPTTEPVDSSVSSSISAEEQFELPLELPSDLSVLTTRSPTVPSQNPSRLAVISDSGEKRVTITEKSVASSESDPALLSPGVDPTPEGHMTPDHFIQGHMDADHISSPPCGSVEQGHGNNQDLTRNSSTPGLQVPVSPTVPIQNQKYVPNSTDSPGPSQISNAAVQTTPPHLKPATEKLIVVNQNMQPLYVLQTLPNGVTQKIQLTSSVSSTPSVMETNTSVLGPMGGGLTLTTGLNPSLPTSQSLFPSASKGLLPMSHHQHLHSFPAATQSSFPPNISNPPSGLLIGVQPPPDPQLLVSESSQRTDLSTTVATPSSGLKKRPISRLQTRKNKKLAPSSTPSNIAPSDVVSNMTLINFTPSQLPNHPSLLDLGSLNTSSHRTVPNIIKRSKSSIMYFEPAPLLPQSVGGTAATAAGTSTISQDTSHLTSGSVSGLASSSSVLNVVSMQTTTTPTSSASVPGHVTLTNPRLLGTPDIGSISNLLIKASQQSLGIQDQPVALPPSSGMFPQLGTSQTPSTAAITAASSICVLPSTQTTGITAASPSGEADEHYQLQHVNQLLASKTGIHSSQRDLDSASGPQVSNFTQTVDAPNSMGLEQNKALSSAVQASPTSPGGSPSSPSSGQRSASPSVPGPTKPKPKTKRFQLPLDKGNGKKHKVSHLRTSSSEAHIPDQETTSLTSGTGTPGAEAEQQDTASVEQSSQKECGQPAGQVAVLPEVQVTQNPANEQESAEPKTVEEEESNFSSPLMLWLQQEQKRKESITEKKPKKGLVFEISSDDGFQICAESIEDAWKSLTDKVQEARSNARLKQLSFAGVNGLRMLGILHDAVVFLIEQLSGAKHCRNYKFRFHKPEEANEPPLNPHGSARAEVHLRKSAFDMFNFLASKHRQPPEYNPNDEEEEEVQLKSARRATSMDLPMPMRFRHLKKTSKEAVGVYRSPIHGRGLFCKRNIDAGEMVIEYAGNVIRSIQTDKREKYYDSKGIGCYMFRIDDSEVVDATMHGNAARFINHSCEPNCYSRVINIDGQKHIVIFAMRKIYRGEELTYDYKFPIEDASNKLPCNCGAKKCRKFLN

SEQ ID NO: 862729 - protein, 3137 aa, Homo sapiens
ASLHGANMAHSCRWRFPARPGTTGGGGGGGRRGLGGAPRQRVPALLLPPGPPVGGGGPGAPPSPPAVAAAAAAAGSSGAGVPGGAAAASAASSSSASSSSSSSSSASSGPALLRVGPGFDAALQVSAAIGTNLRRFRAVFGESGGGGGSGEDEQFLGFGSDEEVRVRSPTRSPSGSMLAQADKLPMTDKRVASLLKKAKAQLCKIEKSKSLKQTDQPKAQGQESDSSETSVRGPRIKHVCRRAAVALGRKRAVFPDDMPTLSALPWEEREKILSSMGNDDKSSIAGSEDAEPLAPPIKPIKPVTRNKAPQEPPVKKGRRSRRCGQCPGCQVPEDCGVCTNCLDKPKFGGRNIKKQCCKMRKCQNLQWMPSKAYLQKQAKAVKKKEKKSKTSEKKDSKESSVVKNVVDSSQKPTPSAREDPAPKKSSSEPPPRKPVEEKSEEGNVSAPGPESKQATTPASRKSSKQVSQPAVVIPPQPPTTGPPRKEVPKTTPSEPKKKQPPPPESGPEQSKQKKVAPRPSIPVKQKPKEKEKPPPVNKQENAGTLNILSTLSNGNSSKQKIPADGVHRIRVDFKEDCEAENVWEMGGLGILTSVPITPRVVCFLCASSGHVEFVYCQVCCEPFHKFCLEENERPLEDQLENWCCRRCKFCHVCGRQHQATKQLLECNKCRNSYHPECLGPNYPTKPTKKKKVWICTKCVRCKSCGSTTPGKGWDAQWSHDFSLCHDCAKLFAKGNFCPLCDKCYDDDDYESKMMQCGKCDRWVHSKCENLSDEMYEILSNLPESVAYTCVNCTERHPAEWRLALEKELQISLKQVLTALLNSRTTSHLLRYRQAAKPPDLNPETEESIPSRSSPEGPDPPVLTEVSKQDDQQPLDLEGVKRKMDQGNYTSVLEFSDDIVKIIQAAINSDGGQPEIKKANSMVKSFFIRQMERVFPWFSVKKSRFWEPNKVSSNSGMLPNAVLPPSLDHNYAQWQEREENSHTEQPPLMKKIIPAPKPKGPGEPDSPTPLHPPTPPILSTDRSREDSPELNPPPGIEDNRQCALCLTYGDDSANDAGRLLYIGQNEWTHVNCALWSAEVFEDDDGSLKNVHMAVIRGKQLRCEFCQKPGATVGCCLTSCTSNYHFMCSRAKNCVFLDDKKVYCQRHRDLIKGEVVPENGFEVFRRVFVDFEGISLRRKFLNGLEPENIHMMIGSMTIDCLGILNDLSDCEDKLFPIGYQCSRVYWSTTDARKRCVYTCKIVECRPPVVEPDINSTVEHDENRTIAHSPTSFTESSSKESQNTAEIISPPSPDRPPHSQTSGSCYYHVISKVPRIRTPSYSPTQRSPGCRPLPSAGSPTPTTHEIVTVGDPLLSSGLRSIGSRRHSTSSLSPQRSKLRIMSPMRTGNTYSRNNVSSVSTTGTATDLESSAKVVDHVLGPLNSSTSLGQNTSTSSNLQRTVVTVGNKNSHLDGSSSSEMKQSSASDLVSKSSSLKGEKTKVLSSKSSEGSAHNVAYPGIPKLAPQVHNTTSRELNVSKIGSFAEPSSVSFSSKEALSFPHLHLRGQRNDRDQHTDSTQSANSSPDEDTEVKTLKLSGMSNRSSIINEHMGSSSRDRRQKGKKSCKETFKEKHSSKSFLEPGQVTTGEEGNLKPEFMDEVLTPEYMGQRPCNNVSSDKIGDKGLSMPGVPKAPPMQVEGSAKELQAPRKRTVKVTLTPLKMENESQSKNALKESSPASPLQIESTSPTEPISASENPGDGPVAQPSPNNTSCQDSQSNNYQNLPVQDRNLMLPDGPKPQEDGSFKRRYPRRSARARSNMFFGLTPLYGVRSYGEEDIPFYSSSTGKKRGKRSAEGQVDGADDLSTSDEDDLYYYNFTRTVISSGGEERLASHNLFREEEQCDLPKISQLDGVDDGTESDTSVTATTRKSSQIPKRNGKENGTENLKIDRPEDAGEKEHVTKSSVGHKNEPKMDNCHSVSRVKTQGQDSLEAQLSSLESSRRVHTSTPSDKNLLDTYNTELLKSDSDNNNSDDCGNILPSDIMDFVLKNTPSMQALGESPESSSSELLNLGEGLGLDSNREKDMGLFEVFSQQLPTTEPVDSSVSSSISAEEQFELPLELPSDLSVLTTRSPTVPSQNPSRLAVISDSGEKRVTITEKSVASSESDPALLSPGVDPTPEGHMTPDHFIQGHMDADHISSPPCGSVEQGHGNNQDLTRNSSTPGLQVPVSPTVPIQNQKYVPNSTDSPGPSQISNAAVQTTPPHLKPATEKLIVVNQNMQPLYVLQTLPNGVTQKIQLTSSVSSTPSVMETNTSVLGPMGGGLTLTTGLNPSLPTSQSLFPSASKGLLPMSHHQHLHSFPAATQSSFPPNISNPPSGLLIGVQPPPDPQLLVSESSQRTDLSTTVATPSSGLKKRPISRLQTRKNKKLAPSSTPSNIAPSDVVSNMTLINFTPSQLPNHPSLLDLGSLNTSSHRTVPNIIKRSKSSIMYFEPAPLLPQSVGGTAATAAGTSTISQDTSHLTSGSVSGLASSSSVLNVVSMQTTTTPTSSASVPGHVTLTNPRLLGTPDIGSISNLLIKASQQSLGIQDQPVALPPSSGMFPQLGTSQTPSTAAITAASSICVLPSTQTTGITAASPSGEADEHYQLQHVNQLLASKTGIHSSQRDLDSASGPQVSNFTQTVDAPNSMGLEQNKALSSAVQASPTSPGGSPSSPSSGQRSASPSVPGPTKPKPKTKRFQLPLDKGNGKKHKVSHLRTSSSEAHIPDQETTSLTSGTGTPGAEAEQQDTASVEQSSQKECGQPAGQVAVLPEVQVTQNPANEQESAEPKTVEEEESNFSSPLMLWLQQEQKRKESITEKKPKKGLVFEISSDDGFQICAESIEDAWKSLTDKVQEARSNARLKQLSFAGVNGLRMLGILHDAVVFLIEQLSGAKHCRNYKFRFHKPEEANEPPLNPHGSARAEVHLRKSAFDMFNFLASKHRQPPEYNPNDEEEEEVQLKSARRATSMDLPMPMRFRHLKKTSKEAVGVYRSPIHGRGLFCKRNIDAGEMVIEYAGNVIRSIQTDKREKYYDSKGIGCYMFRIDDSEVVDATMHGNAARFINHSCEPNCYSRVINIDGQKHIVIFAMRKIYRGEELTYDYKFPIEDASNKLPCNCGAKKCRKFLN

SEQ ID NO: 862730 - protein, 3679 aa, Homo sapiens
ASLHGANMAHSCRWRFPARPGTTGGGGGGGRRGLGGAPRQRVPALLLPPGPPVGGGGPGAPPSPPAVAAAAAAAGSSGAGVPGGAAAASAASSSSASSSSSSSSSASSGPALLRVGPGFDAALQVSAAIGTNLRRFRAVFGESGGGGGSGEDEQFLGFGSDEEVRVRSPTRSPSVKTSPRKPRGRPRSGSDRNSAILSDPSVFSPLNKSETKSGDKIKKKDSKSIEKKRGRPPTFPGVKIKITHGKDISELPKGNKEDSLKKIKRTPSATFQQATKIKKLRAGKLSPLKSKFKTGKLQIGRKGVQIVRRRGRPPSTERIKTPSGLLINSELEKPQKVRKDKEGTPPLTKEDKTVVRQSPRRIKPVRIIPSSKRTDATIAKQLLQRAKKGAQKKIEKEAAQLQGRKVKTQVKNIRQFIMPVVSAISSRIIKTPRRFIEDEDYDPPIKIARLESTPNSRFSAPSCGSSEKSSAASQHSSQMSSDSSRSSSPSVDTSTDSQASEEIQVLPEERSDTPEVHPPLPISQSPENESNDRRSRRYSVSERSFGSRTTKKLSTLQSAPQQQTSSSPPPPLLTPPPPLQPASSISDHTPWLMPPTIPLASPFLPASTAPMQGKRKSILREPTFRWTSLKHSRSEPQYFSSAKYAKEGLIRKPIFDNFRPPPLTPEDVGFASGFSASGTAASARLFSPLHSGTRFDMHKRSPLLRAPRFTPSEAHSRIFESVTLPSNRTSAGTSSSGVSNRKRKRKVFSPIRSEPRSPSHSMRTRSGRLSSSELSPLTPPSSVSSSLSISVSPLATSALNPTFTFPSHSLTQSGESAEKNQRPRKQTSAPAEPFSSSSPTPLFPWFTPGSQTERGRNKDKAPEELSKDRDADKSVEKDKSRERDREREKENKRESRKEKRKKGSEIQSSSALYPVGRVSKEKVVGEDVATSSSAKKATGRKKSSSHDSGTDITSVTLGDTTAVKTKILIKKGRGNLEKTNLDLGPTAPSLEKEKTLCLSTPSSSTVKHSTSSIGSMLAQADKLPMTDKRVASLLKKAKAQLCKIEKSKSLKQTDQPKAQGQESDSSETSVRGPRIKHVCRRAAVALGRKRAVFPDDMPTLSALPWEEREKILSSMGNDDKSSIAGSEDAEPLAPPIKPIKPVTRNKAPQEPPVKKGRRSRRCGQCPGCQVPEDCGVCTNCLDKPKFGGRNIKKQCCKMRKCQNLQWMPSKAYLQKQAKAVKKKEKKSKTSEKKDSKESSVVKNVVDSSQKPTPSAREDPAPKKSSSEPPPRKPVEEKSEEGNVSAPGPESKQATTPASRKSSKQVSQPAVVIPPQPPTTGPPRKEVPKTTPSEPKKKQPPPPESGPEQSKQKKVAPRPSIPVKQKPKEKEKPPPVNKQENAGTLNILSTLSNGNSSKQKIPADGVHRIRVDFKEDCEAENVWEMGGLGILTSVPITPRVVCFLCASSGHVEFVYCQVCCEPFHKFCLEENERPLEDQLENWCCRRCKFCHVCGRQHQATKQLLECNKCRNSYHPECLGPNYPTKPTKKKKVWICTKCVRCKSCGSTTPGKGWDAQWSHDFSLCHDCAKLFAKGNFCPLCDKCYDDDDYESKMMQCGKCDRWVHSKCENLSDEMYEILSNLPESVAYTCVNCTERHPAEWRLALEKELQISLKQVLTALLNSRTTSHLLRYRQAAKPPDLNPETEESIPSRSSPEGPDPPVLTEVSKQDDQQPLDLEGVKRKMDQGNYTSVLEFSDDIVKIIQAAINSDGGQPEIKKANSMVKSFFIRQMERVFPWFSVKKSRFWEPNKVSSNSGMLPNAVLPPSLDHNYAQWQEREENSHTEQPPLMKKIIPAPKPKGPGEPDSPTPLHPPTPPILSTDRSREDSPELNPPPGIEDNRQCALCLTYGDDSANDAGRLLYIGQNEWTHVNCALWSAEVFEDDDGSLKNVHMAVIRGKQLRCEFCQKPGATVGCCLTSCTSNYHFMCSRAKNCVFLDDKKVYCQRHRDLIKGEVVPENGFEVFRRVFVDFEGISLRRKFLNGLEPENIHMMIGSMTIDCLGILNDLSDCEDKLFPIGYQCSRVYWSTTDARKRCVYTCKIVECRPPVVEPDINSTVEHDENRTIAHSPTSFTESSSKESQNTAEIISPPSPDRPPHSQTSGSCYYHVISKVPRIRTPSYSPTQRSPGCRPLPSAGSPTPTTHEIVTVGDPLLSSGLRSIGSRRHSTSSLSPQRSKLRIMSPMRTGNTYSRNNVSSVSTTGTATDLESSAKVVDHVLGPLNSSTSLGQNTSTSSNLQRTVVTVGNKNSHLDGSSSSEMKQSSASDLVSKSSSLKGEKTKVLSSKSSEGSAHNVAYPGIPKLAPQVHNTTSRELNVSKIGSFAEPSSVSFSSKEALSFPHLHLRGQRNDRDQHTDSTQSANSSPDEDTEVKTLKLSGMSNRSSIINEHMGSSSRDRRQKGKKSCKETFKEKHSSKSFLEPGQVTTGEEGNLKPEFMDEVLTPEYMGQRPCNNVSSDKIGDKGLSMPGVPKAPPMQVEGSAKELQAPRKRTVKVTLTPLKMENESQSKNALKESSPASPLQIESTSPTEPISASENPGDGPVAQPSPNNTSCQDSQSNNYQNLPVQDRNLMLPDGPKPQEDGSFKRRYPRRSARARSNMFFGLTPLYGVRSYGEEDIPFYSSSTGKKRGKRSAEGQVDGADDLSTSDEDDLYYYNFTRTVISSGGEERLASHNLFREEEQCDLPKISQLDGVDDGTESDTSVTATTRKSSQIPKRNGKENGTENLKIDRPEDAGEKEHVTKSSVGHKNEPKMDNCHSVSRVKTQGQDSLEAQLSSLESSRRVHTSTPSDKNLLDTYNTELLKSDSDNNNSDDCGNILPSDIMDFVLKNTPSMQALGESPESSSSELLNLGEGLGLDSNREKDMGLFEVFSQQLPTTEPVDSSVSSSISAEEQFELPLELPSDLSVLTTRSPTVPSQNPSRLAVISDSGEKRVTITEKSVASSESDPALLSPGVDPTPEGHMTPDHFIQGHMDADHISSPPCGSVEQGHGNNQDLTRNSSTPGLQVPVSPTVPIQNQKYVPNSTDSPGPSQISNAAVQTTPPHLKPATEKLIVVNQNMQPLYVLQTLPNGVTQKIQLTSSVSSTPSVMETNTSVLGPMGGGLTLTTGLNPSLPTSQSLFPSASKGLLPMSHHQHLHSFPAATQSSFPPNISNPPSGLLIGVQPPPDPQLLVSESSQRTDLSTTVATPSSGLKKRPISRLQTRKNKKLAPSSTPSNIAPSDVVSNMTLINFTPSQLPNHPSLLDLGSLNTSSHRTVPNIIKRSKSSIMYFEPAPLLPQSVGGTAATAAGTSTISQDTSHLTSGSVSGLASSSSVLNVVSMQTTTTPTSSASVPGHVTLTNPRLLGTPDIGSISNLLIKASQQSLGIQDQPVALPPSSGMFPQLGTSQTPSTAAITAASSICVLPSTQTTGITAASPSGEADEHYQLQHVNQLLASKTGIHSSQRDLDSASGPQVSNFTQTVDAPNSMGLEQNKALSSAVQASPTSPGGSPSSPSSGQRSASPSVPGPTKPKPKTKRFQLPLDKGNGKKHKVSHLRTSSSEAHIPDQETTSLTSGTGTPGAEAEQQDTASVEQSSQKECGQPAGQVAVLPEVQVTQNPANEQESAGMWVGKRLESENINAKRIMRITHFTYLFSTFKKKNLSSKEVK

SEQ ID NO: 862731 - protein, 3616 aa, Homo sapiens
ASLHGANMAHSCRWRFPARPGTTGGGGGGGRRGLGGAPRQRVPALLLPPGPPVGGGGPGAPPSPPAVAAAAAAAGSSGAGVPGGAAAASAASSSSASSSSSSSSSASSGPALLRVGPGFDAALQVSAAIGTNLRRFRAVFGESGGGGGSGEDEQFLGFGSDEEVRVRSPTRSPSVKTSPRKPRGRPRSGSDRNSAILSDPSVFSPLNKSETKSGDKIKKKDSKSIEKKRGRPPTFPGVKIKITHGKDISELPKGNKEDSLKKIKRTPSATFQQATKIKKLRAGKLSPLKSKFKTGKLQIGRKGVQIVRRRGRPPSTERIKTPSGLLINSELEKPQKVRKDKEGTPPLTKEDKTVVRQSPRRIKPVRIIPSSKRTDATIAKQLLQRAKKGAQKKIEKEAAQLQGRKVKTQVKNIRQFIMPVVSAISSRIIKTPRRFIEDEDYDPPIKIARLESTPNSRFSAPSCGSSEKSSAASQHSSQMSSDSSRSSSPSVDTSTDSQASEEIQVLPEERSDTPEVHPPLPISQSPENESNDRRSRRYSVSERSFGSRTTKKLSTLQSAPQQQTSSSPPPPLLTPPPPLQPASSISDHTPWLMPPTIPLASPFLPASTAPMQGKRKSILREPTFRWTSLKHSRSEPQYFSSAKYAKEGLIRKPIFDNFRPPPLTPEDVGFASGFSASGTAASARLFSPLHSGTRFDMHKRSPLLRAPRFTPSEAHSRIFESVTLPSNRTSAGTSSSGVSNRKRKRKVFSPIRSEPRSPSHSMRTRSGRLSSSELSPLTPPSSVSSSLSISVSPLATSALNPTFTFPSHSLTQSGESAEKNQRPRKQTSAPAEPFSSSSPTPLFPWFTPGSQTERGRNKDKAPEELSKDRDADKSVEKDKSRERDREREKENKRESRKEKRKKGSEIQSSSALYPVGRVSKEKVVGEDVATSSSAKKATGRKKSSSHDSGTDITSVTLGDTTAVKTKILIKKGRGNLEKTNLDLGPTAPSLEKEKTLCLSTPSSSTVKHSTSSIGSMLAQADKLPMTDKRVASLLKKAKAQLCKIEKSKSLKQTDQPKAQGQESDSSETSVRGPRIKHVCRRAAVALGRKRAVFPDDMPTLSALPWEEREKILSSMGNDDKSSIAGSEDAEPLAPPIKPIKPVTRNKAPQEPPVKKGRRSRRCGQCPGCQVPEDCGVCTNCLDKPKFGGRNIKKQCCKMRKCQNLQWMPSKAYLQKQAKAVKKKEKKSKTSEKKDSKESSVVKNVVDSSQKPTPSAREDPAPKKSSSEPPPRKPVEEKSEEGNVSAPGPESKQATTPASRKSSKQVSQPAVVIPPQPPTTGPPRKEVPKTTPSEPKKKQPPPPESGPEQSKQKKVAPRPSIPVKQKPKEKEKPPPVNKQENAGTLNILSTLSNGNSSKQKIPADGVHRIRVDFKEDCEAENVWEMGGLGILTSVPITPRVVCFLCASSGHVEFVYCQVCCEPFHKFCLEENERPLEDQLENWCCRRCKFCHVCGRQHQATKQLLECNKCRNSYHPECLGPNYPTKPTKKKKVWICTKCVRCKSCGSTTPGKGWDAQWSHDFSLCHDCAKLFAKGNFCPLCDKCYDDDDYESKMMQCGKCDRWVHSKCENLSDEMYEILSNLPESVAYTCVNCTERHPAEWRLALEKELQISLKQVLTALLNSRTTSHLLRYRQAAKPPDLNPETEESIPSRSSPEGPDPPVLTEVSKQDDQQPLDLEGVKRKMDQGNYTSVLEFSDDIVKIIQAAINSDGGQPEIKKANSMVKSFFIRQMERVFPWFSVKKSRFWEPNKVSSNSGMLPNAVLPPSLDHNYAQWQEREENSHTEQPPLMKKIIPAPKPKGPGEPDSPTPLHPPTPPILSTDRSREDSPELNPPPGIEDNRQCALCLTYGDDSANDAGRLLYIGQNEWTHVNCALWSAEVFEDDDGSLKNVHMAVIRGKQLRCEFCQKPGATVGCCLTSCTSNYHFMCSRAKNCVFLDDKKVYCQRHRDLIKGEVVPENGFEVFRRVFVDFEGISLRRKFLNGLEPENIHMMIGSMTIDCLGILNDLSDCEDKLFPIGYQCSRVYWSTTDARKRCVYTCKIVECRPPVVEPDINSTVEHDENRTIAHSPTSFTESSSKESQNTAEIISPPSPDRPPHSQTSGSCYYHVISKVPRIRTPSYSPTQRSPGCRPLPSAGSPTPTTHEIVTVGDPLLSSGLRSIGSRRHSTSSLSPQRSKLRIMSPMRTGNTYSRNNVSSVSTTGTATDLESSAKVVDHVLGPLNSSTSLGQNTSTSSNLQRTVVTVGNKNSHLDGSSSSEMKQSSASDLVSKSSSLKGEKTKVLSSKSSEGSAHNVAYPGIPKLAPQVHNTTSRELNVSKIGSFAEPSSVSFSSKEALSFPHLHLRGQRNDRDQHTDSTQSANSSPDEDTEVKTLKLSGMSNRSSIINEHMGSSSRDRRQKGKKSCKETFKEKHSSKSFLEPGQVTTGEEGNLKPEFMDEVLTPEYMGQRPCNNVSSDKIGDKGLSMPGVPKAPPMQVEGSAKELQAPRKRTVKVTLTPLKMENESQSKNALKESSPASPLQIESTSPTEPISASENPGDGPVAQPSPNNTSCQDSQSNNYQNLPVQDRNLMLPDGPKPQEDGSFKRRYPRRSARARSNMFFGLTPLYGVRSYGEEDIPFYSSSTGKKRGKRSAEGQVDGADDLSTSDEDDLYYYNFTRTVISSGGEERLASHNLFREEEQCDLPKISQLDGVDDGTESDTSVTATTRKSSQIPKRNGKENGTENLKIDRPEDAGEKEHVTKSSVGHKNEPKMDNCHSVSRVKTQGQDSLEAQLSSLESSRRVHTSTPSDKNLLDTYNTELLKSDSDNNNSDDCGNILPSDIMDFVLKNTPSMQALGESPESSSSELLNLGEGLGLDSNREKDMGLFEVFSQQLPTTEPVDSSVSSSISAEEQFELPLELPSDLSVLTTRSPTVPSQNPSRLAVISDSGEKRVTITEKSVASSESDPALLSPGVDPTPEGHMTPDHFIQGHMDADHISSPPCGSVEQGHGNNQDLTRNSSTPGLQVPVSPTVPIQNQKYVPNSTDSPGPSQISNAAVQTTPPHLKPATEKLIVVNQNMQPLYVLQTLPNGVTQKIQLTSSVSSTPSVMETNTSVLGPMGGGLTLTTGLNPSLPTSQSLFPSASKGLLPMSHHQHLHSFPAATQSSFPPNISNPPSGLLIGVQPPPDPQLLVSESSQRTDLSTTVATPSSGLKKRPISRLQTRKNKKLAPSSTPSNIAPSDVVSNMTLINFTPSQLPNHPSLLDLGSLNTSSHRTVPNIIKRSKSSIMYFEPAPLLPQSVGGTAATAAGTSTISQDTSHLTSGSVSGLASSSSVLNVVSMQTTTTPTSSASVPGHVTLTNPRLLGTPDIGSISNLLIKASQQSLGIQDQPVALPPSSGMFPQLGTSQTPSTAAITAASSICVLPSTQTTGITAASPSGEADEHYQLQHVNQLLASKTGIHSSQRDLDSASGPQVSNFTQTVDAPNSMGLEQNKALSSAVQASPTSPGGSPSSPSSGQRSASPSVPGPTKPKPKTKRFQLPLDKGNGKKHKVSHLRTSSSEAHIPDQETTSLTSGTGTPGAEAEQQDTASVEQSSQKECGQPAG

SEQ ID NO: 862732 - protein, 1860 aa, Homo sapiens
ASLHGANMAHSCRWRFPARPGTTGGGGGGGRRGLGGAPRQRVPALLLPPGPPVGGGGPGAPPSPPAVAAAAAAAGSSGAGVPGGAAAASAASSSSASSSSSSSSSASSGPALLRVGPGFDAALQVSAAIGTNLRRFRAVFGESGGGGGSGEDEQFLGFGSDEEVRVRSPTRSPSVKTSPRKPRGRPRSGSDRNSAILSDPSVFSPLNKSETKSGDKIKKKDSKSIEKKRGRPPTFPGVKIKITHGKDISELPKGNKEDSLKKIKRTPSATFQQATKIKKLRAGKLSPLKSKFKTGKLQIGRKGVQIVRRRGRPPSTERIKTPSGLLINSELEKPQKVRKDKEGTPPLTKEDKTVVRQSPRRIKPVRIIPSSKRTDATIAKQLLQRAKKGAQKKIEKEAAQLQGRKVKTQVKNIRQFIMPVVSAISSRIIKTPRRFIEDEDYDPPIKIARLESTPNSRFSAPSCGSSEKSSAASQHSSQMSSDSSRSSSPSVDTSTDSQASEEIQVLPEERSDTPEVHPPLPISQSPENESNDRRSRRYSVSERSFGSRTTKKLSTLQSAPQQQTSSSPPPPLLTPPPPLQPASSISDHTPWLMPPTIPLASPFLPASTAPMQGKRKSILREPTFRWTSLKHSRSEPQYFSSAKYAKEGLIRKPIFDNFRPPPLTPEDVGFASGFSASGTAASARLFSPLHSGTRFDMHKRSPLLRAPRFTPSEAHSRIFESVTLPSNRTSAGTSSSGVSNRKRKRKVFSPIRSEPRSPSHSMRTRSGRLSSSELSPLTPPSSVSSSLSISVSPLATSALNPTFTFPSHSLTQSGESAEKNQRPRKQTSAPAEPFSSSSPTPLFPWFTPGSQTERGRNKDKAPEELSKDRDADKSVEKDKSRERDREREKENKRESRKEKRKKGSEIQSSSALYPVGRVSKEKVVGEDVATSSSAKKATGRKKSSSHDSGTDITSVTLGDTTAVKTKILIKKGRGNLEKTNLDLGPTAPSLEKEKTLCLSTPSSSTVKHSTSSIGSMLAQADKLPMTDKRVASLLKKAKAQLCKIEKSKSLKQTDQPKAQGQESDSSETSVRGPRIKHVCRRAAVALGRKRAVFPDDMPTLSALPWEEREKILSSMGNDDKSSIAGSEDAEPLAPPIKPIKPVTRNKAPQEPPVKKGRRSRRCGQCPGCQVPEDCGVCTNCLDKPKFGGRNIKKQCCKMRKCQNLQWMPSKAYLQKQAKAVKKKEKKSKTSEKKDSKESSVVKNVVDSSQKPTPSAREDPAPKKSSSEPPPRKPVEEKSEEGNVSAPGPESKQATTPASRKSSKQVSQPAVVIPPQPPTTGPPRKEVPKTTPSEPKKKQPPPPESGPEQSKQKKVAPRPSIPVKQKPKEKEKPPPVNKQENAGTLNILSTLSNGNSSKQKIPADGVHRIRVDFKEDCEAENVWEMGGLGILTSVPITPRVVCFLCASSGHVELENAGGDLKDGHHHYEGAVVILDAGAQYGKVIDRRVRELFVQSEIFPLETPAFAIKEQGFRAIIISGGPNSVYAEDAPWFDPAIFTIGKPVLGICYGMQMMNKVFGGTVHKKSDREDGVFNISVDNTCSLFRGLQKEEVVLLTHGDSVDKVADGFKVVARSGNIVAGIANESKKLYGAQFHPEVGLTENGKVILKNFLYDIAGCSGTFTVQNRELECIREIKERVGTSKVLVLLSGGVDSTVCTALLNRALNQEQVIAVHIDNGFMRKRESQSVEEALKKLGIQVKVINAAHSFYNGTTTLPISDEDRTPRKRISKTLNMTTSPEEKRKIIGDTFVKIANEVIGEMNLKPEEVFLAQGTLRPDLIESASLVASGKAELIKTHHNDTEAGVVACLDSGPGAETFPSSLFS

SEQ ID NO: 862733 - protein, 2314 aa, Homo sapiens
ASLHGANMAHSCRWRFPARPGTTGGGGGGGRRGLGGAPRQRVPALLLPPGPPVGGGGPGAPPSPPAVAAAAAAAGSSGAGVPGGAAAASAASSSSASSSSSSSSSASSGPALLRVGPGFDAALQVSAAIGTNLRRFRAVFGESGGGGGSGEDEQFLGFGSDEEVRVRSPTRSPSVKTSPRKPRGRPRSGSDRNSAILSDPSVFSPLNKSETKSGDKIKKKDSKSIEKKRGRPPTFPGVKIKITHGKDISELPKGNKEDSLKKIKRTPSATFQQATKIKKLRAGKLSPLKSKFKTGKLQIGRKGVQIVRRRGRPPSTERIKTPSGLLINSELEKPQKVRKDKEGTPPLTKEDKTVVRQSPRRIKPVRIIPSSKRTDATIAKQLLQRAKKGAQKKIEKEAAQLQGRKVKTQVKNIRQFIMPVVSAISSRIIKTPRRFIEDEDYDPPIKIARLESTPNSRFSAPSCGSSEKSSAASQHSSQMSSDSSRSSSPSVDTSTDSQASEEIQVLPEERSDTPEVHPPLPISQSPENESNDRRSRRYSVSERSFGSRTTKKLSTLQSAPQQQTSSSPPPPLLTPPPPLQPASSISDHTPWLMPPTIPLASPFLPASTAPMQGKRKSILREPTFRWTSLKHSRSEPQYFSSAKYAKEGLIRKPIFDNFRPPPLTPEDVGFASGFSASGTAASARLFSPLHSGTRFDMHKRSPLLRAPRFTPSEAHSRIFESVTLPSNRTSAGTSSSGVSNRKRKRKVFSPIRSEPRSPSHSMRTRSGRLSSSELSPLTPPSSVSSSLSISVSPLATSALNPTFTFPSHSLTQSGESAEKNQRPRKQTSAPAEPFSSSSPTPLFPWFTPGSQTERGRNKDKAPEELSKDRDADKSVEKDKSRERDREREKENKRESRKEKRKKGSEIQSSSALYPVGRVSKEKVVGEDVATSSSAKKATGRKKSSSHDSGTDITSVTLGDTTAVKTKILIKKGRGNLEKTNLDLGPTAPSLEKEKTLCLSTPSSSTVKHSTSSIGSMLAQADKLPMTDKRVASLLKKAKAQLCKIEKSKSLKQTDQPKAQGQESDSSETSVRGPRIKHVCRRAAVALGRKRAVFPDDMPTLSALPWEEREKILSSMGNDDKSSIAGSEDAEPLAPPIKPIKPVTRNKAPQEPPVKKGRRSRRCGQCPGCQVPEDCGVCTNCLDKPKFGGRNIKKQCCKMRKCQNLQWMPSKAYLQKQAKAVKKKEKKSKTSEKKDSKESSVVKNVVDSSQKPTPSAREDPAPKKSSSEPPPRKPVEEKSEEGNVSAPGPESKQATTPASRKSSKQVSQPAVVIPPQPPTTGPPRKEVPKTTPSEPKKKQPPPPESGPEQSKQKKVAPRPSIPVKQKPKEKEKPPPVNKQENAGTLNILSTLSNGNSSKQKIPADGVHRIRVDFKEDCEAENVWEMGGLGILTSVPITPRVVCFLCASSGHVETYSNEVHCVEEILKEMTHSWPPPLTAIHTPSTAEPSKFPFPTKDSQHVSSVTQNQKQYDTSSKTHSNSQQGTSSMLEDDLQLSDSEDSDSEQTPEKPPSSSAPPSAPQSLPEPVASAHSSSAESESTSDSDSSSDSESESSSSDSEENEPLETPAPEPEPPTTNKWQLDNWLTKVSSQLRHQRAPGAQSPHGGTQRVRAAATVPRVRSILNPKILPLKAPAKPPRPPEAPHPGKRSCQKSPAQQEPPQRQTVGTKQPKKPVKASARAGSRTSLQGEREPGLLPYGSRDQTSKDKPKVKTKGRPRAAASNEPKPAVPPSSEKKKHKSSLPAPSKALSGPEPAKDNVEDRTPEHFALVPLTESQGPPHSGSSSRTSGCRQAVVVQEDSRKDRLPLPLRDTKLLSPLRDTPPPQSLMVKITLDLLSRIPQPPGKGSRQRKAEDKQPPAGKKHSSEKRSSDSSSKLAKKRKGEAERDCDNKKIRLEKEIKSQSSSSSSSHKESSKTKPSRPSSQSSKKEMLPPPPVSSSSQKPAKPALKRSRREADTCGQDPPKSASSTKSNHKDSSIPKQRRVEGKGSRSSSEHKGSSGDTANPFPVPSLPNGNSKPGKPQVKFDKQQADLHMREEKKMKQKAELMTDRVGKAFKYLEAVLSFIECGIATESESQSSKSAYSVYSETVDLIKFIMSLKSFSDATAPTQEKIFAVLCMRCQSILNMAMFRCKKDIAIKYSRTLNKHFESSSKVAQAPSPCIARSTGTPSPLSPMPSPASSVGSQSSAGSVGSSGVAATISTPVTIQNMTSSYVTITSHVLTAFDLWEQAEALTRKNKEFFARLSTNVCTLALNSSLVDLVHYTRQGFQQLQELTKTP

SEQ ID NO: 862734 - protein, 1610 aa, Homo sapiens
ASLHGANMAHSCRWRFPARPGTTGGGGGGGRRGLGGAPRQRVPALLLPPGPPVGGGGPGAPPSPPAVAAAAAAAGSSGAGVPGGAAAASAASSSSASSSSSSSSSASSGPALLRVGPGFDAALQVSAAIGTNLRRFRAVFGESGGGGGSGEDEQFLGFGSDEEVRVRSPTRSPSVKTSPRKPRGRPRSGSDRNSAILSDPSVFSPLNKSETKSGDKIKKKDSKSIEKKRGRPPTFPGVKIKITHGKDISELPKGNKEDSLKKIKRTPSATFQQATKIKKLRAGKLSPLKSKFKTGKLQIGRKGVQIVRRRGRPPSTERIKTPSGLLINSELEKPQKVRKDKEGTPPLTKEDKTVVRQSPRRIKPVRIIPSSKRTDATIAKQLLQRAKKGAQKKIEKEAAQLQGRKVKTQVKNIRQFIMPVVSAISSRIIKTPRRFIEDEDYDPPIKIARLESTPNSRFSAPSCGSSEKSSAASQHSSQMSSDSSRSSSPSVDTSTDSQASEEIQVLPEERSDTPEVHPPLPISQSPENESNDRRSRRYSVSERSFGSRTTKKLSTLQSAPQQQTSSSPPPPLLTPPPPLQPASSISDHTPWLMPPTIPLASPFLPASTAPMQGKRKSILREPTFRWTSLKHSRSEPQYFSSAKYAKEGLIRKPIFDNFRPPPLTPEDVGFASGFSASGTAASARLFSPLHSGTRFDMHKRSPLLRAPRFTPSEAHSRIFESVTLPSNRTSAGTSSSGVSNRKRKRKVFSPIRSEPRSPSHSMRTRSGRLSSSELSPLTPPSSVSSSLSISVSPLATSALNPTFTFPSHSLTQSGESAEKNQRPRKQTSAPAEPFSSSSPTPLFPWFTPGSQTERGRNKDKAPEELSKDRDADKSVEKDKSRERDREREKENKRESRKEKRKKGSEIQSSSALYPVGRVSKEKVVGEDVATSSSAKKATGRKKSSSHDSGTDITSVTLGDTTAVKTKILIKKGRGNLEKTNLDLGPTAPSLEKEKTLCLSTPSSSTVKHSTSSIGSMLAQADKLPMTDKRVASLLKKAKAQLCKIEKSKSLKQTDQPKAQGQESDSSETSVRGPRIKHVCRRAAVALGRKRAVFPDDMPTLSALPWEEREKILSSMGNDDKSSIAGSEDAEPLAPPIKPIKPVTRNKAPQEPPVKKGRRSRRCGQCPGCQVPEDCGVCTNCLDKPKFGGRNIKKQCCKMRKCQNLQWMPSKAYLQKQAKAVKKKEKKSKTSEKKDSKESSVVKNVVDSSQKPTPSAREDPAPKKSSSEPPPRKPVEEKSEEGNVSAPGPESKQATTPASRKSSKQVSQPAVVIPPQPPTTGPPRKEVPKTTPSEPKKKQPPPPESGPEQSKQKKVAPRPSIPVKQKPKEKEKPPPVNKQENAGTLNILSTLSNGNSSKQKIPADGVHRIRVDFKEDCEAENVWEMGGLGILTSVPITPRVVCFLCASSGHVEKPGMVPPPPGEESQTVILPPGWQSYLSPQGRRYYVNTTTNETTWERPSSSPGIPASPGSHRSSLPPTVNGYHASGTPAHPPETAHMSVRKSTGDSQNLGSSSPSKKQKQGKHHHNKLCDVPSPRHDAGTAAAETNRRSWSGGLFGFRPRGRDIPFFTLF

SEQ ID NO: 862735 - protein, 1459 aa, Homo sapiens
ASLHGANMAHSCRWRFPARPGTTGGGGGGGRRGLGGAPRQRVPALLLPPGPPVGGGGPGAPPSPPAVAAAAAAAGSSGAGVPGGAAAASAASSSSASSSSSSSSSASSGPALLRVGPGFDAALQVSAAIGTNLRRFRAVFGESGGGGGSGEDEQFLGFGSDEEVRVRSPTRSPSVKTSPRKPRGRPRSGSDRNSAILSDPSVFSPLNKSETKSGDKIKKKDSKSIEKKRGRPPTFPGVKIKITHGKDISELPKGNKEDSLKKIKRTPSATFQQATKIKKLRAGKLSPLKSKFKTGKLQIGRKGVQIVRRRGRPPSTERIKTPSGLLINSELEKPQKVRKDKEGTPPLTKEDKTVVRQSPRRIKPVRIIPSSKRTDATIAKQLLQRAKKGAQKKIEKEAAQLQGRKVKTQVKNIRQFIMPVVSAISSRIIKTPRRFIEDEDYDPPIKIARLESTPNSRFSAPSCGSSEKSSAASQHSSQMSSDSSRSSSPSVDTSTDSQASEEIQVLPEERSDTPEVHPPLPISQSPENESNDRRSRRYSVSERSFGSRTTKKLSTLQSAPQQQTSSSPPPPLLTPPPPLQPASSISDHTPWLMPPTIPLASPFLPASTAPMQGKRKSILREPTFRWTSLKHSRSEPQYFSSAKYAKEGLIRKPIFDNFRPPPLTPEDVGFASGFSASGTAASARLFSPLHSGTRFDMHKRSPLLRAPRFTPSEAHSRIFESVTLPSNRTSAGTSSSGVSNRKRKRKVFSPIRSEPRSPSHSMRTRSGRLSSSELSPLTPPSSVSSSLSISVSPLATSALNPTFTFPSHSLTQSGESAEKNQRPRKQTSAPAEPFSSSSPTPLFPWFTPGSQTERGRNKDKAPEELSKDRDADKSVEKDKSRERDREREKENKRESRKEKRKKGSEIQSSSALYPVGRVSKEKVVGEDVATSSSAKKATGRKKSSSHDSGTDITSVTLGDTTAVKTKILIKKGRGNLEKTNLDLGPTAPSLEKEKTLCLSTPSSSTVKHSTSSIGSMLAQADKLPMTDKRVASLLKKAKAQLCKIEKSKSLKQTDQPKAQGQESDSSETSVRGPRIKHVCRRAAVALGRKRAVFPDDMPTLSALPWEEREKILSSMGNDDKSSIAGSEDAEPLAPPIKPIKPVTRNKAPQEPPVKKGRRSRRCGQCPGCQVPEDCGVCTNCLDKPKFGGRNIKKQCCKMRKCQNLQWMPSKAYLQKQAKAVKKKEKKSKTSEKKDSKESSVVKNVVDSSQKPTPSAREDPAPKKSSSEPPPRKPVEEKSEEGNVSAPGPESKQATTPASRKSSKQVSQPAVVIPPQPPTTGPPRKEVPKTTPSEPKKKQPPPPESGPEQSKQKKVAPRPSIPVKQKPKEKEKPPPVNKQENAGTLNILSTLSNGNSSKQKIPADGVHRIRVDFKFVYCQVCCEPFHKFCLEENERPLEDQVVACLDSGPGAETFPSSLFS

SEQ ID NO: 862736 - protein, 1581 aa, Homo sapiens
ASLHGANMAHSCRWRFPARPGTTGGGGGGGRRGLGGAPRQRVPALLLPPGPPVGGGGPGAPPSPPAVAAAAAAAGSSGAGVPGGAAAASAASSSSASSSSSSSSSASSGPALLRVGPGFDAALQVSAAIGTNLRRFRAVFGESGGGGGSGEDEQFLGFGSDEEVRVRSPTRSPSVKTSPRKPRGRPRSGSDRNSAILSDPSVFSPLNKSETKSGDKIKKKDSKSIEKKRGRPPTFPGVKIKITHGKDISELPKGNKEDSLKKIKRTPSATFQQATKIKKLRAGKLSPLKSKFKTGKLQIGRKGVQIVRRRGRPPSTERIKTPSGLLINSELEKPQKVRKDKEGTPPLTKEDKTVVRQSPRRIKPVRIIPSSKRTDATIAKQLLQRAKKGAQKKIEKEAAQLQGRKVKTQVKNIRQFIMPVVSAISSRIIKTPRRFIEDEDYDPPIKIARLESTPNSRFSAPSCGSSEKSSAASQHSSQMSSDSSRSSSPSVDTSTDSQASEEIQVLPEERSDTPEVHPPLPISQSPENESNDRRSRRYSVSERSFGSRTTKKLSTLQSAPQQQTSSSPPPPLLTPPPPLQPASSISDHTPWLMPPTIPLASPFLPASTAPMQGKRKSILREPTFRWTSLKHSRSEPQYFSSAKYAKEGLIRKPIFDNFRPPPLTPEDVGFASGFSASGTAASARLFSPLHSGTRFDMHKRSPLLRAPRFTPSEAHSRIFESVTLPSNRTSAGTSSSGVSNRKRKRKVFSPIRSEPRSPSHSMRTRSGRLSSSELSPLTPPSSVSSSLSISVSPLATSALNPTFTFPSHSLTQSGESAEKNQRPRKQTSAPAEPFSSSSPTPLFPWFTPGSQTERGRNKDKAPEELSKDRDADKSVEKDKSRERDREREKENKRESRKEKRKKGSEIQSSSALYPVGRVSKEKVVGEDVATSSSAKKATGRKKSSSHDSGTDITSVTLGDTTAVKTKILIKKGRGNLEKTNLDLGPTAPSLEKEKTLCLSTPSSSTVKHSTSSIGSMLAQADKLPMTDKRVASLLKKAKAQLCKIEKSKSLKQTDQPKAQGQESDSSETSVRGPRIKHVCRRAAVALGRKRAVFPDDMPTLSALPWEEREKILSSMGNDDKSSIAGSEDAEPLAPPIKPIKPVTRNKAPQEPPVKKGRRSRRCGQCPGCQVPEDCGVCTNCLDKPKFGGRNIKKQCCKMRKCQNLQWMPSKAYLQKQAKAVKKKEKKSKTSEKKDSKESSVVKNVVDSSQKPTPSAREDPAPKKSSSEPPPRKPVEEKSEEGNVSAPGPESKQATTPASRKSSKQVSQPAVVIPPQPPTTGPPRKEVPKTTPSEPKKKQPPPPESGPEQSKQKKVAPRPSIPVKQKPKEKEKPPPVNKQENAGTLNILSTLSNGNSSKQKIPADGVHRIRVDFKEDCEAENVWEMGGLGILTSVPITPRVVCFLCASSGHVEKPGMVPPPPGEESQTVILPPGWQSYLSPQGRRYYVNTTTNETTWERPSSSPGIPASPGSHRSSLPPTVNGYHASGTPAHPPETAHMSVRKSTGDSQNLGSSSPSKKQKQGVVACLDSGPGAETFPSSLFS

SEQ ID NO: 862737 - protein, 1497 aa, Homo sapiens
ASLHGANMAHSCRWRFPARPGTTGGGGGGGRRGLGGAPRQRVPALLLPPGPPVGGGGPGAPPSPPAVAAAAAAAGSSGAGVPGGAAAASAASSSSASSSSSSSSSASSGPALLRVGPGFDAALQVSAAIGTNLRRFRAVFGESGGGGGSGEDEQFLGFGSDEEVRVRSPTRSPSVKTSPRKPRGRPRSGSDRNSAILSDPSVFSPLNKSETKSGDKIKKKDSKSIEKKRGRPPTFPGVKIKITHGKDISELPKGNKEDSLKKIKRTPSATFQQATKIKKLRAGKLSPLKSKFKTGKLQIGRKGVQIVRRRGRPPSTERIKTPSGLLINSELEKPQKVRKDKEGTPPLTKEDKTVVRQSPRRIKPVRIIPSSKRTDATIAKQLLQRAKKGAQKKIEKEAAQLQGRKVKTQVKNIRQFIMPVVSAISSRIIKTPRRFIEDEDYDPPIKIARLESTPNSRFSAPSCGSSEKSSAASQHSSQMSSDSSRSSSPSVDTSTDSQASEEIQVLPEERSDTPEVHPPLPISQSPENESNDRRSRRYSVSERSFGSRTTKKLSTLQSAPQQQTSSSPPPPLLTPPPPLQPASSISDHTPWLMPPTIPLASPFLPASTAPMQGKRKSILREPTFRWTSLKHSRSEPQYFSSAKYAKEGLIRKPIFDNFRPPPLTPEDVGFASGFSASGTAASARLFSPLHSGTRFDMHKRSPLLRAPRFTPSEAHSRIFESVTLPSNRTSAGTSSSGVSNRKRKRKVFSPIRSEPRSPSHSMRTRSGRLSSSELSPLTPPSSVSSSLSISVSPLATSALNPTFTFPSHSLTQSGESAEKNQRPRKQTSAPAEPFSSSSPTPLFPWFTPGSQTERGRNKDKAPEELSKDRDADKSVEKDKSRERDREREKENKRESRKEKRKKGSEIQSSSALYPVGRVSKEKVVGEDVATSSSAKKATGRKKSSSHDSGTDITSVTLGDTTAVKTKILIKKGRGNLEKTNLDLGPTAPSLEKEKTLCLSTPSSSTVKHSTSSIGSMLAQADKLPMTDKRVASLLKKAKAQLCKIEKSKSLKQTDQPKAQGQESDSSETSVRGPRIKHVCRRAAVALGRKRAVFPDDMPTLSALPWEEREKILSSMGNDDKSSIAGSEDAEPLAPPIKPIKPVTRNKAPQEPPVKKGRRSRRCGQCPGCQVPEDCGVCTNCLDKPKFGGRNIKKQCCKMRKCQNLQWMPSKAYLQKQAKAVKKKEKKSKTSEKKDSKESSVVKNVVDSSQKPTPSAREDPAPKKSSSEPPPRKPVEEKSEEGNVSAPGPESKQATTPASRKSSKQVSQPAVVIPPQPPTTGPPRKEVPKTTPSEPKKKQPPPPESGPEQSKQKKVAPRPSIPVKQKPKEKEKPPPVNKQENAGTLNILSTLSNGNSSKQKIPADGVHRIRVDFKEDCEAENVWEMGGLGILTSVPITPRVVCFLCASSGHVEFVYCQVCCEPFHKFCLEENERPLEDQVVACLDSGPGAETFPSSLFS

SEQ ID NO: 862738 - protein, 1514 aa, Homo sapiens
ASLHGANMAHSCRWRFPARPGTTGGGGGGGRRGLGGAPRQRVPALLLPPGPPVGGGGPGAPPSPPAVAAAAAAAGSSGAGVPGGAAAASAASSSSASSSSSSSSSASSGPALLRVGPGFDAALQVSAAIGTNLRRFRAVFGESGGGGGSGEDEQFLGFGSDEEVRVRSPTRSPSVKTSPRKPRGRPRSGSDRNSAILSDPSVFSPLNKSETKSGDKIKKKDSKSIEKKRGRPPTFPGVKIKITHGKDISELPKGNKEDSLKKIKRTPSATFQQATKIKKLRAGKLSPLKSKFKTGKLQIGRKGVQIVRRRGRPPSTERIKTPSGLLINSELEKPQKVRKDKEGTPPLTKEDKTVVRQSPRRIKPVRIIPSSKRTDATIAKQLLQRAKKGAQKKIEKEAAQLQGRKVKTQVKNIRQFIMPVVSAISSRIIKTPRRFIEDEDYDPPIKIARLESTPNSRFSAPSCGSSEKSSAASQHSSQMSSDSSRSSSPSVDTSTDSQASEEIQVLPEERSDTPEVHPPLPISQSPENESNDRRSRRYSVSERSFGSRTTKKLSTLQSAPQQQTSSSPPPPLLTPPPPLQPASSISDHTPWLMPPTIPLASPFLPASTAPMQGKRKSILREPTFRWTSLKHSRSEPQYFSSAKYAKEGLIRKPIFDNFRPPPLTPEDVGFASGFSASGTAASARLFSPLHSGTRFDMHKRSPLLRAPRFTPSEAHSRIFESVTLPSNRTSAGTSSSGVSNRKRKRKVFSPIRSEPRSPSHSMRTRSGRLSSSELSPLTPPSSVSSSLSISVSPLATSALNPTFTFPSHSLTQSGESAEKNQRPRKQTSAPAEPFSSSSPTPLFPWFTPGSQTERGRNKDKAPEELSKDRDADKSVEKDKSRERDREREKENKRESRKEKRKKGSEIQSSSALYPVGRVSKEKVVGEDVATSSSAKKATGRKKSSSHDSGTDITSVTLGDTTAVKTKILIKKGRGNLEKTNLDLGPTAPSLEKEKTLCLSTPSSSTVKHSTSSIGSMLAQADKLPMTDKRVASLLKKAKAQLCKIEKSKSLKQTDQPKAQGQESDSSETSVRGPRIKHVCRRAAVALGRKRAVFPDDMPTLSALPWEEREKILSSMGNDDKSSIAGSEDAEPLAPPIKPIKPVTRNKAPQEPPVKKGRRSRRCGQCPGCQVPEDCGVCTNCLDKPKFGGRNIKKQCCKMRKCQNLQWMPSKAYLQKQAKAVKKKEKKSKTSEKKDSKESSVVKNVVDSSQKPTPSAREDPAPKKSSSEPPPRKPVEEKSEEGNVSAPGPESKQATTPASRKSSKQVSQPAVVIPPQPPTTGPPRKEVPKTTPSEPKKKQPPPPESGPEQSKQKKVAPRPSIPVKQKPKEKEKPPPVNKQENAGTLNILSTLSNGNSSKQKIPADGVHRIRVDFKFVYCQVCCEPFHKFCLEENERPLEDQLENWCCRRCKFCHVCGRQHQATKQLLECNKCRNSYHPECLGPNYPTKPTKKKKVWVVACLDSGPGAETFPSSLFS

SEQ ID NO: 862739 - protein, 1458 aa, Homo sapiens
ASLHGANMAHSCRWRFPARPGTTGGGGGGGRRGLGGAPRQRVPALLLPPGPPVGGGGPGAPPSPPAVAAAAAAAGSSGAGVPGGAAAASAASSSSASSSSSSSSSASSGPALLRVGPGFDAALQVSAAIGTNLRRFRAVFGESGGGGGSGEDEQFLGFGSDEEVRVRSPTRSPSVKTSPRKPRGRPRSGSDRNSAILSDPSVFSPLNKSETKSGDKIKKKDSKSIEKKRGRPPTFPGVKIKITHGKDISELPKGNKEDSLKKIKRTPSATFQQATKIKKLRAGKLSPLKSKFKTGKLQIGRKGVQIVRRRGRPPSTERIKTPSGLLINSELEKPQKVRKDKEGTPPLTKEDKTVVRQSPRRIKPVRIIPSSKRTDATIAKQLLQRAKKGAQKKIEKEAAQLQGRKVKTQVKNIRQFIMPVVSAISSRIIKTPRRFIEDEDYDPPIKIARLESTPNSRFSAPSCGSSEKSSAASQHSSQMSSDSSRSSSPSVDTSTDSQASEEIQVLPEERSDTPEVHPPLPISQSPENESNDRRSRRYSVSERSFGSRTTKKLSTLQSAPQQQTSSSPPPPLLTPPPPLQPASSISDHTPWLMPPTIPLASPFLPASTAPMQGKRKSILREPTFRWTSLKHSRSEPQYFSSAKYAKEGLIRKPIFDNFRPPPLTPEDVGFASGFSASGTAASARLFSPLHSGTRFDMHKRSPLLRAPRFTPSEAHSRIFESVTLPSNRTSAGTSSSGVSNRKRKRKVFSPIRSEPRSPSHSMRTRSGRLSSSELSPLTPPSSVSSSLSISVSPLATSALNPTFTFPSHSLTQSGESAEKNQRPRKQTSAPAEPFSSSSPTPLFPWFTPGSQTERGRNKDKAPEELSKDRDADKSVEKDKSRERDREREKENKRESRKEKRKKGSEIQSSSALYPVGRVSKEKVVGEDVATSSSAKKATGRKKSSSHDSGTDITSVTLGDTTAVKTKILIKKGRGNLEKTNLDLGPTAPSLEKEKTLCLSTPSSSTVKHSTSSIGSMLAQADKLPMTDKRVASLLKKAKAQLCKIEKSKSLKQTDQPKAQGQESDSSETSVRGPRIKHVCRRAAVALGRKRAVFPDDMPTLSALPWEEREKILSSMGNDDKSSIAGSEDAEPLAPPIKPIKPVTRNKAPQEPPVKKGRRSRRCGQCPGCQVPEDCGVCTNCLDKPKFGGRNIKKQCCKMRKCQNLQWMPSKAYLQKQAKAVKKKEKKSKTSEKKDSKESSVVKNVVDSSQKPTPSAREDPAPKKSSSEPPPRKPVEEKSEEGNVSAPGPESKQATTPASRKSSKQVSQPAVVIPPQPPTTGPPRKEVPKTTPSEPKKKQPPPPESGPEQSKQKKVAPRPSIPVKQKPKEKEKPPPVNKQENAGTLNILSTLSNGNSSKQKIPADGVHRIRVDFKEDCEAENVWEMGGLGILTSVPITPRGGGLFGFRPRGRDIPFFTLF

SEQ ID NO: 862740 - protein, 1434 aa, Homo sapiens
ASLHGANMAHSCRWRFPARPGTTGGGGGGGRRGLGGAPRQRVPALLLPPGPPVGGGGPGAPPSPPAVAAAAAAAGSSGAGVPGGAAAASAASSSSASSSSSSSSSASSGPALLRVGPGFDAALQVSAAIGTNLRRFRAVFGESGGGGGSGEDEQFLGFGSDEEVRVRSPTRSPSVKTSPRKPRGRPRSGSDRNSAILSDPSVFSPLNKSETKSGDKIKKKDSKSIEKKRGRPPTFPGVKIKITHGKDISELPKGNKEDSLKKIKRTPSATFQQATKIKKLRAGKLSPLKSKFKTGKLQIGRKGVQIVRRRGRPPSTERIKTPSGLLINSELEKPQKVRKDKEGTPPLTKEDKTVVRQSPRRIKPVRIIPSSKRTDATIAKQLLQRAKKGAQKKIEKEAAQLQGRKVKTQVKNIRQFIMPVVSAISSRIIKTPRRFIEDEDYDPPIKIARLESTPNSRFSAPSCGSSEKSSAASQHSSQMSSDSSRSSSPSVDTSTDSQASEEIQVLPEERSDTPEVHPPLPISQSPENESNDRRSRRYSVSERSFGSRTTKKLSTLQSAPQQQTSSSPPPPLLTPPPPLQPASSISDHTPWLMPPTIPLASPFLPASTAPMQGKRKSILREPTFRWTSLKHSRSEPQYFSSAKYAKEGLIRKPIFDNFRPPPLTPEDVGFASGFSASGTAASARLFSPLHSGTRFDMHKRSPLLRAPRFTPSEAHSRIFESVTLPSNRTSAGTSSSGVSNRKRKRKVFSPIRSEPRSPSHSMRTRSGRLSSSELSPLTPPSSVSSSLSISVSPLATSALNPTFTFPSHSLTQSGESAEKNQRPRKQTSAPAEPFSSSSPTPLFPWFTPGSQTERGRNKDKAPEELSKDRDADKSVEKDKSRERDREREKENKRESRKEKRKKGSEIQSSSALYPVGRVSKEKVVGEDVATSSSAKKATGRKKSSSHDSGTDITSVTLGDTTAVKTKILIKKGRGNLEKTNLDLGPTAPSLEKEKTLCLSTPSSSTVKHSTSSIGSMLAQADKLPMTDKRVASLLKKAKAQLCKIEKSKSLKQTDQPKAQGQESDSSETSVRGPRIKHVCRRAAVALGRKRAVFPDDMPTLSALPWEEREKILSSMGNDDKSSIAGSEDAEPLAPPIKPIKPVTRNKAPQEPPVKKGRRSRRCGQCPGCQVPEDCGVCTNCLDKPKFGGRNIKKQCCKMRKCQNLQWMPSKAYLQKQAKAVKKKEKKSKTSEKKDSKESSVVKNVVDSSQKPTPSAREDPAPKKSSSEPPPRKPVEEKSEEGNVSAPGPESKQATTPASRKSSKQVSQPAVVIPPQPPTTGPPRKEVPKTTPSEPKKKQPPPPESGPEQSKQKKVAPRPSIPVKQKPKEKLVKKKEKKSKTSEKKDSKESSVVKNVVDSSQKPTPSAREDPARSWSGGLFGFRPRGRDIPFFTLF

SEQ ID NO: 862741 - protein, 1438 aa, Homo sapiens
ASLHGANMAHSCRWRFPARPGTTGGGGGGGRRGLGGAPRQRVPALLLPPGPPVGGGGPGAPPSPPAVAAAAAAAGSSGAGVPGGAAAASAASSSSASSSSSSSSSASSGPALLRVGPGFDAALQVSAAIGTNLRRFRAVFGESGGGGGSGEDEQFLGFGSDEEVRVRSPTRSPSVKTSPRKPRGRPRSGSDRNSAILSDPSVFSPLNKSETKSGDKIKKKDSKSIEKKRGRPPTFPGVKIKITHGKDISELPKGNKEDSLKKIKRTPSATFQQATKIKKLRAGKLSPLKSKFKTGKLQIGRKGVQIVRRRGRPPSTERIKTPSGLLINSELEKPQKVRKDKEGTPPLTKEDKTVVRQSPRRIKPVRIIPSSKRTDATIAKQLLQRAKKGAQKKIEKEAAQLQGRKVKTQVKNIRQFIMPVVSAISSRIIKTPRRFIEDEDYDPPIKIARLESTPNSRFSAPSCGSSEKSSAASQHSSQMSSDSSRSSSPSVDTSTDSQASEEIQVLPEERSDTPEVHPPLPISQSPENESNDRRSRRYSVSERSFGSRTTKKLSTLQSAPQQQTSSSPPPPLLTPPPPLQPASSISDHTPWLMPPTIPLASPFLPASTAPMQGKRKSILREPTFRWTSLKHSRSEPQYFSSAKYAKEGLIRKPIFDNFRPPPLTPEDVGFASGFSASGTAASARLFSPLHSGTRFDMHKRSPLLRAPRFTPSEAHSRIFESVTLPSNRTSAGTSSSGVSNRKRKRKVFSPIRSEPRSPSHSMRTRSGRLSSSELSPLTPPSSVSSSLSISVSPLATSALNPTFTFPSHSLTQSGESAEKNQRPRKQTSAPAEPFSSSSPTPLFPWFTPGSQTERGRNKDKAPEELSKDRDADKSVEKDKSRERDREREKENKRESRKEKRKKGSEIQSSSALYPVGRVSKEKVVGEDVATSSSAKKATGRKKSSSHDSGTDITSVTLGDTTAVKTKILIKKGRGNLEKTNLDLGPTAPSLEKEKTLCLSTPSSSTVKHSTSSIGSMLAQADKLPMTDKRVASLLKKAKAQLCKIEKSKSLKQTDQPKAQGQESDSSETSVRGPRIKHVCRRAAVALGRKRAVFPDDMPTLSALPWEEREKILSSMGNDDKSSIAGSEDAEPLAPPIKPIKPVTRNKAPQEPPVKKGRRSRRCGQCPGCQVPEDCGVCTNCLDKPKFGGRNIKKQCCKMRKCQNLQWMPSKAYLQKQAKAVKKKEKKSKTSEKKDSKESSVVKNVVDSSQKPTPSAREDPAPKKSSSEPPPRKPVEEKSEEGNVSAPGPESKQATTPASRKSSKQVSQPAVVIPPQPPTTGPPRKEVPKTTPSEPKKKQPPPPESGPEQSKQKKVAPRPSIPVKQKPKEKEKPPPVNKQENAGTLNILSTLSNGNSSKQKIPADGVHRIRVDFKNIDKQYVGFATLPNQVHRKSVKKGF

SEQ ID NO: 862742 - protein, 1364 aa, Homo sapiens
ASLHGANMAHSCRWRFPARPGTTGGGGGGGRRGLGGAPRQRVPALLLPPGPPVGGGGPGAPPSPPAVAAAAAAAGSSGAGVPGGAAAASAASSSSASSSSSSSSSASSGPALLRVGPGFDAALQVSAAIGTNLRRFRAVFGESGGGGGSGEDEQFLGFGSDEEVRVRSPTRSPSVKTSPRKPRGRPRSGSDRNSAILSDPSVFSPLNKSETKSGDKIKKKDSKSIEKKRGRPPTFPGVKIKITHGKDISELPKGNKEDSLKKIKRTPSATFQQATKIKKLRAGKLSPLKSKFKTGKLQIGRKGVQIVRRRGRPPSTERIKTPSGLLINSELEKPQKVRKDKEGTPPLTKEDKTVVRQSPRRIKPVRIIPSSKRTDATIAKQLLQRAKKGAQKKIEKEAAQLQGRKVKTQVKNIRQFIMPVVSAISSRIIKTPRRFIEDEDYDPPIKIARLESTPNSRFSAPSCGSSEKSSAASQHSSQMSSDSSRSSSPSVDTSTDSQASEEIQVLPEERSDTPEVHPPLPISQSPENESNDRRSRRYSVSERSFGSRTTKKLSTLQSAPQQQTSSSPPPPLLTPPPPLQPASSISDHTPWLMPPTIPLASPFLPASTAPMQGKRKSILREPTFRWTSLKHSRSEPQYFSSAKYAKEGLIRKPIFDNFRPPPLTPEDVGFASGFSASGTAASARLFSPLHSGTRFDMHKRSPLLRAPRFTPSEAHSRIFESVTLPSNRTSAGTSSSGVSNRKRKRKVFSPIRSEPRSPSHSMRTRSGRLSSSELSPLTPPSSVSSSLSISVSPLATSALNPTFTFPSHSLTQSGESAEKNQRPRKQTSAPAEPFSSSSPTPLFPWFTPGSQTERGRNKDKAPEELSKDRDADKSVEKDKSRERDREREKENKRESRKEKRKKGSEIQSSSALYPVGRVSKEKVVGEDVATSSSAKKATGRKKSSSHDSGTDITSVTLGDTTAVKTKILIKKGRGNLEKTNLDLGPTAPSLEKEKTLCLSTPSSSTVKHSTSSIGSMLAQADKLPMTDKRVASLLKKAKAQLCKIEKSKSLKQTDQPKAQGQESDSSETSVRGPRIKHVCRRAAVALGRKRAVFPDDMPTLSALPWEEREKILSSMGNDDKSSIAGSEDAEPLAPPIKPIKPVTRNKAPQEPPVKKGRRSRRCGQCPGCQVPEDCGVCTNCLDKPKFGGRNIKKQCCKMRKCQNLQWMPSKAYLQKQAKAVKKKEKKSKTSEKKDSKESSVVKNVVDSSQKPTPSAREDPAPKKSSSEPPPRKPVEEKSEEGNVSAPGPESKQATTPASRKSSKQVSQPAVVIPPQPPTTGPPRKEVPKTTPSEPKKKQPPPPESGGGLFGFRPRGRDIPFFTLF

SEQ ID NO: 862743 - protein, 107 aa, Homo sapiens
PHQQERILPQRKAVVSLLHESPSRKRVKKGMSRPLGLNPNRPPLQLPGSQASRSPSQQWSSRLSHLLQDRQEKKFPKPLLVSPRKSSLHHQNQVSEEGKKELLNHKY

SEQ ID NO: 862744 - protein, 105 aa, Homo sapiens
FVYCQVCCEPFHKFCLEENERPLEDQLENWCCRRCKFCHVCGRQHQATKVQNLVIELQLGLCISGFCIPGLNQPWIECIWEKMSSCLCTLCEQTFSCHYFLNNTV

SEQ ID NO: 862745 - protein, 2317 aa, Homo sapiens
ASLHGANMAHSCRWRFPARPGTTGGGGGGGRRGLGGAPRQRVPALLLPPGPPVGGGGPGAPPSPPAVAAAAAAAGSSGAGVPGGAAAASAASSSSASSSSSSSSSASSGPALLRVGPGFDAALQVSAAIGTNLRRFRAVFGESGGGGGSGELTTQIPCSWRTKGHIHDKKTEPFRLLAWSWCLNDEQFLGFGSDEEVRVRSPTRSPSVKTSPRKPRGRPRSGSDRNSAILSDPSVFSPLNKSETKSGDKIKKKDSKSIEKKRGRPPTFPGVKIKITHGKDISELPKGNKEDSLKKIKRTPSATFQQATKIKKLRAGKLSPLKSKFKTGKLQIGRKGVQIVRRRGRPPSTERIKTPSGLLINSELEKPQKVRKDKEGTPPLTKEDKTVVRQSPRRIKPVRIIPSSKRTDATIAKQLLQRAKKGAQKKIEKEAAQLQGRKVKTQVKNIRQFIMPVVSAISSRIIKTPRRFIEDEDYDPPIKIARLESTPNSRFSAPSCGSSEKSSAASQHSSQMSSDSSRSSSPSVDTSTDSQASEEIQVLPEERSDTPEVHPPLPISQSPENESNDRRSRRYSVSERSFGSRTTKKLSTLQSAPQQQTSSSPPPPLLTPPPPLQPASSISDHTPWLMPPTIPLGLCSNNPLTSPFLPASTAPMQGKRKSILREPTFRWTSLKHSRSEPQYFSSAKYAKEGLIRKPIFDNFRPPPLTPEDVGFASGFSASGTAASARLFSPLHSGTRFDMHKRSPLLRAPRFTPSEAHSRIFESVTLPSNRTSAGTSSSGVSNRKRKRKVFSPIRSEPRSPSHSMRTRSGRLSSSELSPLTPPSSVSSSLSISVSPLATSALNPTFTFPSHSLTQSGESAEKNQRPRKQTSAPAEPFSSSSPTPLFPWFTPGSQTERGRNKDKAPEELSKDRDADKSVEKDKSRERDREREKENKRESRKEKRKKGSEIQSSSALYPVGRVSKEKVVGEDVATSSSAKKATGRKKSSSHDSGTDITSVTLGDTTAVKTKILIKKGRGNLEKTNLDLGPTAPSLEKEKTLCLSTPSSSTVKHSTSSIGSMLAQADKLPMTDKRVASLLKKAKAQLCKIEKSKSLKQTDQPKAQGQESDSSETSVRGPRIKHVCRRAAVALGRKRAVFPDDMPTLSALPWEEREKILSSMGNDDKSSIAGSEDAEPLAPPIKPIKPVTRNKAPQEPPVKKGRRSRRCGQCPGCQVPEDCGVCTNCLDKPKFGGRNIKKQCCKMRKCQNLQWMPSKAYLQKQAKAVKKKEKKSKTSEKKDSKESSVVKNVVDSSQKPTPSAREDPAPKKSSSEPPPRKPVEEKSEEGNVSAPGPESKQATTPASRKSSKQVSQPAVVIPPQPPTTGPPRKEVPKTTPSEPKKKQPPPPESGPEQSKQKKVAPRPSIPVKQKPKEKEKPPPVNKQENAGTLNILSTLSNGNSSKQKIPADGVHRIRVDFKTYSNEVHCVEEILKEMTHSWPPPLTAIHTPSTAEPSKFPFPTKDSQHVSSVTQNQKQYDTSSKTHSNSQQGTSSMLEDDLQLSDSEDSDSEQTPEKPPSSSAPPSAPQSLPEPVASAHSSSAESESTSDSDSSSDSESESSSSDSEENEPLETPAPEPEPPTTNKWQLDNWLTKVSSQLRHQRAPGAQSPHGGTQRVRAAATVPRVRSILNPKILPLKAPAKPPRPPEAPHPGKRSCQKSPAQQEPPQRQTVGTKQPKKPVKASARAGSRTSLQGEREPGLLPYGSRDQTSKDKPKVKTKGRPRAAASNEPKPAVPPSSEKKKHKSSLPAPSKALSGPEPAKDNVEDRTPEHFALVPLTESQGPPHSGSSSRTSGCRQAVVVQEDSRKDRLPLPLRDTKLLSPLRDTPPPQSLMVKITLDLLSRIPQPPGKGSRQRKAEDKQPPAGKKHSSEKRSSDSSSKLAKKRKGEAERDCDNKKIRLEKEIKSQSSSSSSSHKESSKTKPSRPSSQSSKKEMLPPPPVSSSSQKPAKPALKRSRREADTCGQDPPKSASSTKSNHKDSSIPKQRRVEGKGSRSSSEHKGSSGDTANPFPVPSLPNGNSKPGKPQVKFDKQQADLHMREEKKMKQKAELMTDRVGKAFKYLEAVLSFIECGIATESESQSSKSAYSVYSETVDLIKFIMSLKSFSDATAPTQEKIFAVLCMRCQSILNMAMFRCKKDIAIKYSRTLNKHFESSSKVAQAPSPCIARSTGTPSPLSPMPSPASSVGSQSSAGSVGSSGVAATISTPVTIQNMTSSYVTITSHVLTAFDLWEQAEALTRKNKEFFARLSTNVCTLALNSSLVDLVHYTRQGFQQLQELTKTP

SEQ ID NO: 862746 - protein, 164 aa, Homo sapiens
MAHSCRWRFPARPGTTGGGGGGGRRGLGGAPRQRVPALLLPPGPPVGGGGPGAPPSPPAVAAAAAAAGSSGAGVPGGAAAASAASSSSASSSSSSSSSASSGPALLRVGPGFDAALQVSAAIGTNLRRFRAVFGESGGGGGSGEVPQLKRDEETLETVLRRLKR

SEQ ID NO: 862747 - protein, 3976 aa, Homo sapiens; identical to SEQ ID NO: 862722

SEQ ID NO: 862748 - protein, 3976 aa, Homo sapiens; identical to SEQ ID NO: 862722

SEQ ID NO: 862749 - protein, 3976 aa, Homo sapiens; identical to SEQ ID NO: 862722

SEQ ID NO: 862750 - protein, 3976 aa, Homo sapiens; identical to SEQ ID NO: 862722

SEQ ID NO: 862751 - protein, 3998 aa, Homo sapiens
ASLHGANMAHSCRWRFPARPGTTGGGGGGGRRGLGGAPRQRVPALLLPPGPPVGGGGPGAPPSPPAVAAAAAAAGSSGAGVPGGAAAASAASSSSASSSSSSSSSASSGPALLRVGPGFDAALQVSAAIGTNLRRFRAVFGESGGGGGSGEDEQFLGFGSDEEVRVRSPTRSPSVKTSPRKPRGRPRSGSDRNSAILSDPSVFSPLNKSETKSGDKIKKKDSKSIEKKRGRPPTFPGVKIKITHGKDISELPKGNKEDSLKKIKRTPSATFQQATKIKKLRAGKLSPLKSKFKTGKLQIGRKGVQIVRRRGRPPSTERIKTPSGLLINSELEKPQKVRKDKEGTPPLTKEDKTVVRQSPRRIKPVRIIPSSKRTDATIAKQLLQRAKKGAQKKIEKEAAQLQGRKVKTQVKNIRQFIMPVVSAISSRIIKTPRRFIEDEDYDPPIKIARLESTPNSRFSAPSCGSSEKSSAASQHSSQMSSDSSRSRIVDSVPPSQHSSQMSSDSSRSSSPSVDTSTDSQASEEIQVLPEERSDTPEVHPPLPISQSPENESNDRRSRRYSVSERSFGSRTTKKLSTLQSAPQQQTSSSPPPPLLTPPPPLQPASSISDHTPWLMPPTIPLASPFLPASTAPMQGKRKSILREPTFRWTSLKHSRSEPQYFSSAKYAKEGLIRKPIFDNFRPPPLTPEDVGFASGFSASGTAASARLFSPLHSGTRFDMHKRSPLLRAPRFTPSEAHSRIFESVTLPSNRTSAGTSSSGVSNRKRKRKVFSPIRSEPRSPSHSMRTRSGRLSSSELSPLTPPSSVSSSLSISVSPLATSALNPTFTFPSHSLTQSGESAEKNQRPRKQTSAPAEPFSSSSPTPLFPWFTPGSQTERGRNKDKAPEELSKDRDADKSVEKDKSRERDREREKENKRESRKEKRKKGSEIQSSSALYPVGRVSKEKVVGEDVATSSSAKKATGRKKSSSHDSGTDITSVTLGDTTAVKTKILIKKGRGNLEKTNLDLGPTAPSLEKEKTLCLSTPSSSTVKHSTSSIGSMLAQADKLPMTDKRVASLLKKAKAQLCKIEKSKSLKQTDQPKAQGQESDSSETSVRGPRIKHVCRRAAVALGRKRAVFPDDMPTLSALPWEEREKILSSMGNDDKSSIAGSEDAEPLAPPIKPIKPVTRNKAPQEPPVKKGRRSRRCGQCPGCQVPEDCGVCTNCLDKPKFGGRNIKKQCCKMRKCQNLQWMPSKAYLQKQAKAVKKKEKKSKTSEKKDSKESSVVKNVVDSSQKPTPSAREDPAPKKSSSEPPPRKPVEEKSEEGNVSAPGPESKQATTPASRKSSKQVSQPAVVIPPQPPTTGPPRKEVPKTTPSEPKKKQPPPPESGPEQSKQKKVAPRPSIPVKQKPKEKEKPPPVNKQENAGTLNILSTLSNGNSSKQKIPADGVHRIRVDFKEDCEAENVWEMGGLGILTSVPITPRVVCFLCASSGHVEFVYCQVCCEPFHKFCLEENERPLEDQLENWCCRRCKFCHVCGRQHQATKQLLECNKCRNSYHPECLGPNYPTKPTKKKKVWICTKCVRCKSCGSTTPGKGWDAQWSHDFSLCHDCAKLFAKGNFCPLCDKCYDDDDYESKMMQCGKCDRWVHSKCENLSDEMYEILSNLPESVAYTCVNCTERHPAEWRLALEKELQISLKQVLTALLNSRTTSHLLRYRQAAKPPDLNPETEESIPSRSSPEGPDPPVLTEVSKQDDQQPLDLEGVKRKMDQGNYTSVLEFSDDIVKIIQAAINSDGGQPEIKKANSMVKSFFIRQMERVFPWFSVKKSRFWEPNKVSSNSGMLPNAVLPPSLDHNYAQWQEREENSHTEQPPLMKKIIPAPKPKGPGEPDSPTPLHPPTPPILSTDRSREDSPELNPPPGIEDNRQCALCLTYGDDSANDAGRLLYIGQNEWTHVNCALWSAEVFEDDDGSLKNVHMAVIRGKQLRCEFCQKPGATVGCCLTSCTSNYHFMCSRAKNCVFLDDKKVYCQRHRDLIKGEVVPENGFEVFRRVFVDFEGISLRRKFLNGLEPENIHMMIGSMTIDCLGILNDLSDCEDKLFPIGYQCSRVYWSTTDARKRCVYTCKIVECRPPVVEPDINSTVEHDENRTIAHSPTSFTESSSKESQNTAEIISPPSPDRPPHSQTSGSCYYHVISKVPRIRTPSYSPTQRSPGCRPLPSAGSPTPTTHEIVTVGDPLLSSGLRSIGSRRHSTSSLSPQRSKLRIMSPMRTGNTYSRNNVSSVSTTGTATDLESSAKVVDHVLGPLNSSTSLGQNTSTSSNLQRTVVTVGNKNSHLDGSSSSEMKQSSASDLVSKSSSLKGEKTKVLSSKSSEGSAHNVAYPGIPKLAPQVHNTTSRELNVSKIGSFAEPSSVSFSSKEALSFPHLHLRGQRNDRDQHTDSTQSANSSPDEDTEVKTLKLSGMSNRSSIINEHMGSSSRDRRQKGKKSCKETFKEKHSSKSFLEPGQVTTGEEGNLKPEFMDEVLTPEYMGQRPCNNVSSDKIGDKGLSMPGVPKAPPMQVEGSAKELQAPRKRTVKVTLTPLKMENESQSKNALKESSPASPLQIESTSPTEPISASENPGDGPVAQPSPNNTSCQDSQSNNYQNLPVQDRNLMLPDGPKPQEDGSFKRRYPRRSARARSNMFFGLTPLYGVRSYGEEDIPFYSSSTGKKRGKRSAEGQVDGADDLSTSDEDDLYYYNFTRTVISSGGEERLASHNLFREEEQCDLPKISQLDGVDDGTESDTSVTATTRKSSQIPKRNGKENGTENLKIDRPEDAGEKEHVTKSSVGHKNEPKMDNCHSVSRVKTQGQDSLEAQLSSLESSRRVHTSTPSDKNLLDTYNTELLKSDSDNNNSDDCGNILPSDIMDFVLKNTPSMQALGESPESSSSELLNLGEGLGLDSNREKDMGLFEVFSQQLPTTEPVDSSVSSSISAEEQFELPLELPSDLSVLTTRSPTVPSQNPSRLAVISDSGEKRVTITEKSVASSESDPALLSPGVDPTPEGHMTPDHFIQGHMDADHISSPPCGSVEQGHGNNQDLTRNSSTPGLQVPVSPTVPIQNQKYVPNSTDSPGPSQISNAAVQTTPPHLKPATEKLIVVNQNMQPLYVLQTLPNGVTQKIQLTSSVSSTPSVMETNTSVLGPMGGGLTLTTGLNPSLPTSQSLFPSASKGLLPMSHHQHLHSFPAATQSSFPPNISNPPSGLLIGVQPPPDPQLLVSESSQRTDLSTTVATPSSGLKKRPISRLQTRKNKKLAPSSTPSNIAPSDVVSNMTLINFTPSQLPNHPSLLDLGSLNTSSHRTVPNIIKRSKSSIMYFEPAPLLPQSVGGTAATAAGTSTISQDTSHLTSGSVSGLASSSSVLNVVSMQTTTTPTSSASVPGHVTLTNPRLLGTPDIGSISNLLIKASQQSLGIQDQPVALPPSSGMFPQLGTSQTPSTAAITAASSICVLPSTQTTGITAASPSGEADEHYQLQHVNQLLASKTGIHSSQRDLDSASGPQVSNFTQTVDAPNSMGLEQNKALSSAVQASPTSPGGSPSSPSSGQRSASPSVPGPTKPKPKTKRFQLPLDKGNGKKHKVSHLRTSSSEAHIPDQETTSLTSGTGTPGAEAEQQDTASVEQSSQKECGQPAGQVAVLPEVQVTQNPANEQESAEPKTVEEEESNFSSPLMLWLQQEQKRKESITEKKPKKGLVFEISSDDGFQICAESIEDAWKSLTDKVQEARSNARLKQLSFAGVNGLRMLGILHDAVVFLIEQLSGAKHCRNYKFRFHKPEEANEPPLNPHGSARAEVHLRKSAFDMFNFLASKHRQPPEYNPNDEEEEEVQLKSARRATSMDLPMPMRFRHLKKTSKEAVGVYRSPIHGRGLFCKRNIDAGEMVIEYAGNVIRSIQTDKREKYYDSKGIGCYMFRIDDSEVVDATMHGNAARFINHSCEPNCYSRVINIDGQKHIVIFAMRKIYRGEELTYDYKFPIEDASNKLPCNCGAKKCRKFLN

SEQ ID NO: 862752 - protein, 3938 aa, Homo sapiens
ASLHGANMAHSCRWRFPARPGTTGGGGGGGRRGLGGAPRQRVPALLLPPGPPVGGGGPGAPPSPPAVAAAAAAAGSSGAGVPGGAAAASAASSSSASSSSSSSSSASSGPALLRVGPGFDAALQVSAAIGTNLRRFRAVFGESGGGGGSGEDEQFLGFGSDEEVRVRSPTRSPSVKTSPRKPRGRPRSGSDRNSAILSDPSVFSPLNKSETKSGDKIKKKDSKSIEKKRGRPPTFPGVKIKITHGKDISELPKGNKEDSLKKIKRTPSATFQQATKIKKLRAGKLSPLKSKFKTGKLQIGRKGVQIVRRRGRPPSTERIKTPSGLLINSELEKPQKVRKDKEGTPPLTKEDKTVVRQSPRRIKPVRIIPSSKRTDATIAKQLLQRAKKGAQKKIEKEAAQLQGRKVKTQVKNIRQFIMPVVSAISSRIIKTPRRFIEDEDYDPPIKIARLESTPNSRFSAPSCGSSEKSSAASQHSSQMSSDSSRSSSPSVDTSTDSQASEEIQVLPEERSDTPEVHPPLPISQSPENESNDRRSRRYSVSERSFGSRTTKKLSTLQSAPQQQTSSSPPPPLLTPPPPLQPASSISDHTPWLMPPTIPLASPFLPASTAPMQGKRKSILREPTFRWTSLKHSRSEPQYFSSAKYAKEGLIRKPIFDNFRPPPLTPEDVGFASGFSASGTAASARLFSPLHSGTRFDMHKRSPLLRAPRFTPSEAHSRIFESVTLPSNRTSAGTSSSGVSNRKRKRKVFSPIRSEPRSPSHSMRTRSGRLSSSELSPLTPPSSVSSSLSISVSPLATSALNPTFTFPSHSLTQSGESAEKNQRPRKQTSAPAEPFSSSSPTPLFPWFTPGSQTERGRNKDKAPEELSKDRDADKSVEKDKSRERDREREKENKRESRKEKRKKGSEIQSSSALYPVGRVSKEKVVGEDVATSSSAKKATGRKKSSSHDSGTDITSVTLGDTTAVKTKILIKKGRGNLEKTNLDLGPTAPSLEKEKTLCLSTPSSSTVKHSTSSIGSMLAQADKLPMTDKRVASLLKKAKAQLCKIEKSKSLKQTDQPKAQGQESDSSETSVRGPRIKHVCRRAAVALGRKRAVFPDDMPTLSALPWEEREKILSSMGNDDKSSIAGSEDAEPLAPPIKPIKPVTRNKAPQEPPVKKGRRSRRCGQCPGCQVPEDCGVCTNCLDKPKFGGRNIKKQCCKMRKCQNLQWMPSKAYLQKQAKAVKKKEKKSKTSEKKDSKESSVVKNVVDSSQKPTPSAREDPAPKKSSSEPPPRKPVEEKSEEGNVSAPGPESKQATTPASRKSSKQVSQPAVVIPPQPPTTGPPRKEVPKTTPSEPKKKQPPPPESGPEQSKQKKVAPRPSIPVKQKPKEKEKPPPVNKQENAGTLNILSTLSNGNSSKQKIPADGVHRIRVDFKFVYCQVCCEPFHKFCLEENERPLEDQLENWCCRRCKFCHVCGRQHQATKQLLECNKCRNSYHPECLGPNYPTKPTKKKKVWICTKCVRCKSCGSTTPGKGWDAQWSHDFSLCHDCAKLFAKGNFCPLCDKCYDDDDYESKMMQCGKCDRWVHSKCENLSDEMYEILSNLPESVAYTCVNCTERHPAEWRLALEKELQISLKQVLTALLNSRTTSHLLRYRQAAKPPDLNPETEESIPSRSSPEGPDPPVLTEVSKQDDQQPLDLEGVKRKMDQGNYTSVLEFSDDIVKIIQAAINSDGGQPEIKKANSMVKSFFIRQMERVFPWFSVKKSRFWEPNKVSSNSGMLPNAVLPPSLDHNYAQWQEREENSHTEQPPLMKKIIPAPKPKGPGEPDSPTPLHPPTPPILSTDRSREDSPELNPPPGIEDNRQCALCLTYGDDSANDAGRLLYIGQNEWTHVNCALWSAEVFEDDDGSLKNVHMAVIRGKQLRCEFCQKPGATVGCCLTSCTSNYHFMCSRAKNCVFLDDKKVYCQRHRDLIKGEVVPENGFEVFRRVFVDFEGISLRRKFLNGLEPENIHMMIGSMTIDCLGILNDLSDCEDKLFPIGYQCSRVYWSTTDARKRCVYTCKIVECRPPVVEPDINSTVEHDENRTIAHSPTSFTESSSKESQNTAEIISPPSPDRPPHSQTSGSCYYHVISKVPRIRTPSYSPTQRSPGCRPLPSAGSPTPTTHEIVTVGDPLLSSGLRSIGSRRHSTSSLSPQRSKLRIMSPMRTGNTYSRNNVSSVSTTGTATDLESSAKVVDHVLGPLNSSTSLGQNTSTSSNLQRTVVTVGNKNSHLDGSSSSEMKQSSASDLVSKSSSLKGEKTKVLSSKSSEGSAHNVAYPGIPKLAPQVHNTTSRELNVSKIGSFAEPSSVSFSSKEALSFPHLHLRGQRNDRDQHTDSTQSANSSPDEDTEVKTLKLSGMSNRSSIINEHMGSSSRDRRQKGKKSCKETFKEKHSSKSFLEPGQVTTGEEGNLKPEFMDEVLTPEYMGQRPCNNVSSDKIGDKGLSMPGVPKAPPMQVEGSAKELQAPRKRTVKVTLTPLKMENESQSKNALKESSPASPLQIESTSPTEPISASENPGDGPVAQPSPNNTSCQDSQSNNYQNLPVQDRNLMLPDGPKPQEDGSFKRRYPRRSARARSNMFFGLTPLYGVRSYGEEDIPFYSSSTGKKRGKRSAEGQVDGADDLSTSDEDDLYYYNFTRTVISSGGEERLASHNLFREEEQCDLPKISQLDGVDDGTESDTSVTATTRKSSQIPKRNGKENGTENLKIDRPEDAGEKEHVTKSSVGHKNEPKMDNCHSVSRVKTQGQDSLEAQLSSLESSRRVHTSTPSDKNLLDTYNTELLKSDSDNNNSDDCGNILPSDIMDFVLKNTPSMQALGESPESSSSELLNLGEGLGLDSNREKDMGLFEVFSQQLPTTEPVDSSVSSSISAEEQFELPLELPSDLSVLTTRSPTVPSQNPSRLAVISDSGEKRVTITEKSVASSESDPALLSPGVDPTPEGHMTPDHFIQGHMDADHISSPPCGSVEQGHGNNQDLTRNSSTPGLQVPVSPTVPIQNQKYVPNSTDSPGPSQISNAAVQTTPPHLKPATEKLIVVNQNMQPLYVLQTLPNGVTQKIQLTSSVSSTPSVMETNTSVLGPMGGGLTLTTGLNPSLPTSQSLFPSASKGLLPMSHHQHLHSFPAATQSSFPPNISNPPSGLLIGVQPPPDPQLLVSESSQRTDLSTTVATPSSGLKKRPISRLQTRKNKKLAPSSTPSNIAPSDVVSNMTLINFTPSQLPNHPSLLDLGSLNTSSHRTVPNIIKRSKSSIMYFEPAPLLPQSVGGTAATAAGTSTISQDTSHLTSGSVSGLASSSSVLNVVSMQTTTTPTSSASVPGHVTLTNPRLLGTPDIGSISNLLIKASQQSLGIQDQPVALPPSSGMFPQLGTSQTPSTAAITAASSICVLPSTQTTGITAASPSGEADEHYQLQHVNQLLASKTGIHSSQRDLDSASGPQVSNFTQTVDAPNSMGLEQNKALSSAVQASPTSPGGSPSSPSSGQRSASPSVPGPTKPKPKTKRFQLPLDKGNGKKHKVSHLRTSSSEAHIPDQETTSLTSGTGTPGAEAEQQDTASVEQSSQKECGQPAGQVAVLPEVQVTQNPANEQESAEPKTVEEEESNFSSPLMLWLQQEQKRKESITEKKPKKGLVFEISSDDGFQICAESIEDAWKSLTDKVQEARSNARLKQLSFAGVNGLRMLGILHDAVVFLIEQLSGAKHCRNYKFRFHKPEEANEPPLNPHGSARAEVHLRKSAFDMFNFLASKHRQPPEYNPNDEEEEEVQLKSARRATSMDLPMPMRFRHLKKTSKEAVGVYRSPIHGRGLFCKRNIDAGEMVIEYAGNVIRSIQTDKREKYYDSKGIGCYMFRIDDSEVVDATMHGNAARFINHSCEPNCYSRVINIDGQKHIVIFAMRKIYRGEELTYDYKFPIEDASNKLPCNCGAKKCRKFLN

SEQ ID NO: 862753 - protein, 3851 aa, Homo sapiens
ASLHGANMAHSCRWRFPARPGTTGGGGGGGRRGLGGAPRQRVPALLLPPGPPVGGGGPGAPPSPPAVAAAAAAAGSSGAGVPGGAAAASAASSSSASSSSSSSSSASSGPALLRVGPGFDAALQVSAAIGTNLRRFRAVFGESGGGGGSGEDEQFLGFGSDEEVRVRSPTRSPSVKTSPRKPRGRPRSGSDRNSAILSDPSVFSPLNKSETKSGDKIKKKDSKSIEKKRGRPPTFPGVKIKITHGKDISELPKGNKEDSLKKIKRTPSATFQQATKIKKLRAGKLSPLKSKFKTGKLQIGRKGVQIVRRRGRPPSTERIKTPSGLLINSELEKPQKVRKDKEGTPPLTKEDKTVVRQSPRRIKPVRIIPSSKRTDATIAKQLLQRAKKGAQKKIEKEAAQLQGRKVKTQVKNIRQFIMPVVSAISSRIIKTPRRFIEDEDYDPPIKIARLESTPNSRFSAPSCGSSEKSSAASQHSSQMSSDSSRSSSPSVDTSTDSQASEEIQVLPEERSDTPEVHPPLPISQSPENESNDRRSRRYSVSERSFGSRTTKKLSTLQSAPQQQTSSSPPPPLLTPPPPLQPASSISDHTPWLMPPTIPLASPFLPASTAPMQGKRKSILREPTFRWTSLKHSRSEPQYFSSAKYAKEGLIRKPIFDNFRPPPLTPEDVGFASGFSASGTAASARLFSPLHSGTRFDMHKRSPLLRAPRFTPSEAHSRIFESVTLPSNRTSAGTSSSGVSNRKRKRKVFSPIRSEPRSPSHSMRTRSGRLSSSELSPLTPPSSVSSSLSISVSPLATSALNPTFTFPSHSLTQSGESAEKNQRPRKQTSAPAEPFSSSSPTPLFPWFTPGSQTERGRNKDKAPEELSKDRDADKSVEKDKSRERDREREKENKRESRKEKRKKGSEIQSSSALYPVGRVSKEKVVGEDVATSSSAKKATGRKKSSSHDSGTDITSVTLGDTTAVKTKILIKKGRGNLEKTNLDLGPTAPSLEKEKTLCLSTPSSSTVKHSTSSIGSMLAQADKLPMTDKRVASLLKKAKAQLCKIEKSKSLKQTDQPKAQGQESDSSETSVRGPRIKHVCRRAAVALGRKRAVFPDDMPTLSALPWEEREKILSSMGNDDKSSIAGSEDAEPLAPPIKPIKPVTRNKAPQEPPVKKGRRSRRCGQCPGCQVPEDCGVCTNCLDKPKFGGRNIKKQCCKMRKCQNLQWMPSKAYLQKQAKAVKKKEKKSKTSEKKDSKESSVVKNVVDSSQKPTPSAREDPAPKKSSSEPPPRKPVEEKSEEGNVSAPGPESKQATTPASRKSSKQVSQPAVVIPPQPPTTGPPRKEVPKTTPSEPKKKQPPPPESGPEQSKQKKVAPRPSIPVKQKPKEKEKPPPVNKQENAGTLNILSTLSNGNSSKQKIPADGVHRIRVDFKEDCEAENVWEMGGLGILTSVPITPRVVCFLCASSGHVEFVYCQVCCEPFHKFCLEENERPLEDQLENWCCRRCKFCHVCGRQHQATKQLLECNKCRNSYHPECLGPNYPTKPTKKKKVWICTKCVRCKSCGSTTPGKGWDAQWSHDFSLCHDCAKLFAKGNFCPLCDKCYDDDDYESKMMQCGKCDRWVHSKCENLSDEMYEILSNLPESVAYTCVNCTERHPAEWRLALEKELQISLKQVLTALLNSRTTSHLLRYRQAAKPPDLNPETEESIPSRSSPEGPDPPVLTEVSKQDDQQPLDLEGVKRKMDQGNYTSVLEFSDDIVKIIQAAINSDGGQPEIKKANSMVKSFFIRQMERVFPWFSVKKSRFWEPNKVSSNSGMLPNAVLPPSLDHNYAQWQEREENSHTEQPPLMKKIIPAPKPKGPGEPDSPTPLHPPTPPILSTDRSREDSPELNPPPGIEDNRQCALCLTYGDDSANDAGRLLYIGQNEWTHVNCALWSAEVFEDDDGSLKNVHMAVIRGKQLRCEFCQKPGATVGCCLTSCTSNYHFMCSRAKNCVFLDDKKVYCQRHRDLIKGEVVPENGFEVFRRVFVDFEGISLRRKFLNGLEPENIHMMIGSMTIDCLGILNDLSDCEDKLFPIGYQCSRVYWSTTDARKRCVYTCKIVECRPPVVEPDINSTVEHDENRTIAHSPTSFTESSSKESQNTAEIISPPSPDRPPHSQTSGSCYYHVISKVPRIRTPSYSPTQRSPGCRPLPSAGSPTPTTHEIVTVGDPLLSSGLRSIGSRRHSTSSLSPQRSKLRIMSPMRTGNTYSRNNVSSVSTTGTATDLESSAKVVDHVLGPLNSSTSLGQNTSTSSNLQRTVVTVGNKNSHLDGSSSSEMKQSSASDLVSKSSSLKGEKTKVLSSKSSEGSAHNVAYPGIPKLAPQVHNTTSRELNVSKIGSFAEPSSVSFSSKEALSFPHLHLRGQRNDRDQHTDSTQSANSSPDEDTEVKTLKLSGMSNRSSIINEHMGSSSRDRRQKGKKSCKETFKEKHSSKSFLEPGQVTTGEEGNLKPEFMDEVLTPEYMGQRPCNNVSSDKIGDKGLSMPGVPKAPPMQVEGSAKELQAPRKRTVKVTLTPLKMENESQSKNALKESSPASPLQIESTSPTEPISASENPGDGPVAQPSPNNTSCQDSQSNNYQNLPVQDRNLMLPDGPKPQEDGSFKRRYPRRSARARSNMFFGLTPLYGVRSYGEEDIPFYSSSTGKKRGKRSAEGQVDGADDLSTSDEDDLYYYNFTRTVISSGGEERLASHNLFREEEQCDLPKISQLDGVDDGTESDTSVTATTRKSSQIPKRNGKENGTENLKIDRPEDAGEKEHVTKSSVGHKNEPKMDNCHSVSRVKTQGQDSLEAQLSSLESSRRVHTSTPSDKNLLDTYNTELLKSDSDNNNSDDCGNILPSDIMDFVLKNTPSMQALGESPESSSSELLNLGEGLGLDSNREKDMGLFEVFSQQLPTTEPVDSSVSSSISAEEQFELPLELPSDLSVLTTRSPTVPSQNPSRLAVISDSGEKRVTITEKSVASSESDPALLSPGVDPTPEGHMTPDHFIQGHMDADHISSPPCGSVEQGHGNNQDLTRNSSTPGLQVPVSPTVPIQNQKYVPNSTDSPGPSQISNAAVQTTPPHLKPATEKLIVVNQNMQPLYVLQTLPNGVTQKIQLTSSVSSTPSVMETNTSVLGPMGGGLTLTTGLNPSLPTSQSLFPSASKGLLPMSHHQHLHSFPAATQSSFPPNISNPPSGLLIGVQPPPDPQLLVSESSQRTDLSTTVATPSSGLKKRPISRLQTRKNKKLAPSSTPSNIAPSDVVSNMTLINFTPSQLPNHPSLLDLGSLNTSSHRTVPNIIKRSKSSIMYFEPAPLLPQSVGGTAATAAGTSTISQDTSHLTSGSVSGLASSSSVLNVVSMQTTTTPTSSASVPGHVTLTNPRLLGTPDIGSISNLLIKASQQSLGIQDQPVALPPSSGMFPQLGTSQTPSTAAITAASSICVLPSTQTTGITAASPSGEADEHYQLQHVNQLLASKTGIHSSQRDLDSASGPQVSNFTQTVDAPNSMGLEQNKALSSAVQASPTSPGGSPSSPSSGQRSASPSVPGPTKPKPKTKRFQLPLDKGNGKKHKVSHLRTSSSEAHIPDQETTSLTSGTGTPGAEAEQQDTASVEQSSQKECGQPAGQVAVLPEVQVTQNPANEQESAEPKTVEEEESNFSSPLMLWLQQEQKRKESITEKKPKKGLVFEISSDDGFQICAESIEDAWKSLTDKVQEARSNARLKQLSFAGVNGLRMLGILHDAVVFLIEQLSGAKHCRNYKFRFHKPEEANEPPLNPHGSARAEVHLRKSAFDMFNFLASKHRQPPEYNPNDEEEEEVQLKSARRATSMDLPMPMRFRHLKKTSKEAVGVYRPPANAVSTM

SEQ ID NO: 862754 - protein, 1343 aa, Homo sapiens
MFFGLTPLYGVRSYGEEDIPFYSSSTGKKRGKRSAEGQVDGADDLSTSDEDDLYYYNFTRTVISSGGEERLASHNLFREEEQCDLPKISQLDGVDDGTESDTSVTATTRKSSQIPKRNGKENGTENLKIDRPEDAGEKEHVTKSSVGHKNEPKMDNCHSVSRVKTQGQDSLEAQLSSLESSRRVHTSTPSDKNLLDTYNTELLKSDSDNNNSDDCGNILPSDIMDFVLKNTPSMQALGESPESSSSELLNLGEGLGLDSNREKDMGLFEVFSQQLPTTEPVDSSVSSSISAEEQFELPLELPSDLSVLTTRSPTVPSQNPSRLAVISDSGEKRVTITEKSVASSESDPALLSPGVDPTPEGHMTPDHFIQGHMDADHISSPPCGSVEQGHGNNQDLTRNSSTPGLQVPVSPTVPIQNQKYVPNSTDSPGPSQISNAAVQTTPPHLKPATEKLIVVNQNMQPLYVLQTLPNGVTQKIQLTSSVSSTPSVMETNTSVLGPMGGGLTLTTGLNPSLPTSQSLFPSASKGLLPMSHHQHLHSFPAATQSSFPPNISNPPSGLLIGVQPPPDPQLLVSESSQRTDLSTTVATPSSGLKKRPISRLQTRKNKKLAPSSTPSNIAPSDVVSNMTLINFTPSQLPNHPSLLDLGSLNTSSHRTVPNIIKRSKSSIMYFEPAPLLPQSVGGTAATAAGTSTISQDTSHLTSGSVSGLASSSSVLNVVSMQTTTTPTSSASVPGHVTLTNPRLLGTPDIGSISNLLIKASQQSLGIQDQPVALPPSSGMFPQLGTSQTPSTAAITAASSICVLPSTQTTGITAASPSGEADEHYQLQHVNQLLASKTGIHSSQRDLDSASGPQVSNFTQTVDAPNSMGLEQNKALSSAVQASPTSPGGSPSSPSSGQRSASPSVPGPTKPKPKTKRFQLPLDKGNGKKHKVSHLRTSSSEAHIPDQETTSLTSGTGTPGAEAEQQDTASVEQSSQKECGQPAGQVAVLPEVQVTQNPANEQESAEPKTVEEEESNFSSPLMLWLQQEQKRKESITEKKPKKGLVFEISSDDGFQICAESIEDAWKSLTDKVQEARSNARLKQLSFAGVNGLRMLGILHDAVVFLIEQLSGAKHCRNYKFRFHKPEEANEPPLNPHGSARAEVHLRKSAFDMFNFLASKHRQPPEYNPNDEEEEEVQLKSARRATSMDLPMPMRFRHLKKTSKEAVGVYRSPIHGRGLFCKRNIDAGEMVIEYAGNVIRSIQTDKREKYYDSKGIGCYMFRIDDSEVVDATMHGNAARFINHSCEPNCYSRVINIDGQKHIVIFAMRKIYRGEELTYDYKFPIEDASNKLPCNCGAKKCRKFLN

SEQ ID NO: 862755 - protein, 1714 aa, Homo sapiens
ASLHGANMAHSCRWRFPARPGTTGGGGGGGRRGLGGAPRQRVPALLLPPGPPVGGGGPGAPPSPPAVAAAAAAAGSSGAGVPGGAAAASAASSSSASSSSSSSSSASSGPALLRVGPGFDAALQVSAAIGTNLRRFRAVFGESGGGGGSGEDEQFLGFGSDEEVRVRSPTRSPSVKTSPRKPRGRPRSGSDRNSAILSDPSVFSPLNKSETKSGDKIKKKDSKSIEKKRGRPPTFPGVKIKITHGKDISELPKGNKEDSLKKIKRTPSATFQQATKIKKLRAGKLSPLKSKFKTGKLQIGRKGVQIVRRRGRPPSTERIKTPSGLLINSELEKPQKVRKDKEGTPPLTKEDKTVVRQSPRRIKPVRIIPSSKRTDATIAKQLLQRAKKGAQKKIEKEAAQLQGRKVKTQVKNIRQFIMPVVSAISSRIIKTPRRFIEDEDYDPPIKIARLESTPNSRFSAPSCGSSEKSSAASQHSSQMSSDSSRSSSPSVDTSTDSQASEEIQVLPEERSDTPEVHPPLPISQSPENESNDRRSRRYSVSERSFGSRTTKKLSTLQSAPQQQTSSSPPPPLLTPPPPLQPASSISDHTPWLMPPTIPLASPFLPASTAPMQGKRKSILREPTFRWTSLKHSRSEPQYFSSAKYAKEGLIRKPIFDNFRPPPLTPEDVGFASGFSASGTAASARLFSPLHSGTRFDMHKRSPLLRAPRFTPSEAHSRIFESVTLPSNRTSAGTSSSGVSNRKRKRKVFSPIRSEPRSPSHSMRTRSGRLSSSELSPLTPPSSVSSSLSISVSPLATSALNPTFTFPSHSLTQSGESAEKNQRPRKQTSAPAEPFSSSSPTPLFPWFTPGSQTERGRNKDKAPEELSKDRDADKSVEKDKSRERDREREKENKRESRKEKRKKGSEIQSSSALYPVGRVSKEKVVGEDVATSSSAKKATGRKKSSSHDSGTDITSVTLGDTTAVKTKILIKKGRGNLEKTNLDLGPTAPSLEKEKTLCLSTPSSSTVKHSTSSIGSMLAQADKLPMTDKRVASLLKKAKAQLCKIEKSKSLKQTDQPKAQGQESDSSETSVRGPRIKHVCRRAAVALGRKRAVFPDDMPTLSALPWEEREKILSSMGNDDKSSIAGSEDAEPLAPPIKPIKPVTRNKAPQEPPVKKGRRSRRCGQCPGCQVPEDCGVCTNCLDKPKFGGRNIKKQCCKMRKCQNLQWMPSKAYLQKQAKAVKKKEKKSKTSEKKDSKESSVVKNVVDSSQKPTPSAREDPAPKKSSSEPPPRKPVEEKSEEGNVSAPGPESKQATTPASRKSSKQVSQPAVVIPPQPPTTGPPRKEVPKTTPSEPKKKQPPPPESGPEQSKQKKVAPRPSIPVKQKPKEKEKPPPVNKQENAGTLNILSTLSNGNSSKQKIPADGVHRIRVDFKEDCEAENVWEMGGLGILTSVPITPRVVCFLCASSGHVEFVYCQVCCEPFHKFCLEENERPLEDQLENWCCRRCKFCHVCGRQHQATKQLLECNKCRNSYHPECLGPNYPTKPTKKKKVWICTKCVRCKSCGSTTPGKGWDAQWSHDFSLCHDCAKLFAKGNFCPLCDKCYDDDDYESKMMQCGKCDRWVHSKCENLSDEMYEILSNLPESVAYTCVNCTERHPAEWRLALEKELQISLKQVLTALLNSRTTSHLLRYRQAAKPPDLNPETEESIPSRSSPEGGGLFGFRPRGRDIPFFTLF

SEQ ID NO: 862756 - protein, 1552 aa, Homo sapiens
ASLHGANMAHSCRWRFPARPGTTGGGGGGGRRGLGGAPRQRVPALLLPPGPPVGGGGPGAPPSPPAVAAAAAAAGSSGAGVPGGAAAASAASSSSASSSSSSSSSASSGPALLRVGPGFDAALQVSAAIGTNLRRFRAVFGESGGGGGSGEDEQFLGFGSDEEVRVRSPTRSPSVKTSPRKPRGRPRSGSDRNSAILSDPSVFSPLNKSETKSGDKIKKKDSKSIEKKRGRPPTFPGVKIKITHGKDISELPKGNKEDSLKKIKRTPSATFQQATKIKKLRAGKLSPLKSKFKTGKLQIGRKGVQIVRRRGRPPSTERIKTPSGLLINSELEKPQKVRKDKEGTPPLTKEDKTVVRQSPRRIKPVRIIPSSKRTDATIAKQLLQRAKKGAQKKIEKEAAQLQGRKVKTQVKNIRQFIMPVVSAISSRIIKTPRRFIEDEDYDPPIKIARLESTPNSRFSAPSCGSSEKSSAASQHSSQMSSDSSRSSSPSVDTSTDSQASEEIQVLPEERSDTPEVHPPLPISQSPENESNDRRSRRYSVSERSFGSRTTKKLSTLQSAPQQQTSSSPPPPLLTPPPPLQPASSISDHTPWLMPPTIPLASPFLPASTAPMQGKRKSILREPTFRWTSLKHSRSEPQYFSSAKYAKEGLIRKPIFDNFRPPPLTPEDVGFASGFSASGTAASARLFSPLHSGTRFDMHKRSPLLRAPRFTPSEAHSRIFESVTLPSNRTSAGTSSSGVSNRKRKRKVFSPIRSEPRSPSHSMRTRSGRLSSSELSPLTPPSSVSSSLSISVSPLATSALNPTFTFPSHSLTQSGESAEKNQRPRKQTSAPAEPFSSSSPTPLFPWFTPGSQTERGRNKDKAPEELSKDRDADKSVEKDKSRERDREREKENKRESRKEKRKKGSEIQSSSALYPVGRVSKEKVVGEDVATSSSAKKATGRKKSSSHDSGTDITSVTLGDTTAVKTKILIKKGRGNLEKTNLDLGPTAPSLEKEKTLCLSTPSSSTVKHSTSSIGSMLAQADKLPMTDKRVASLLKKAKAQLCKIEKSKSLKQTDQPKAQGQESDSSETSVRGPRIKHVCRRAAVALGRKRAVFPDDMPTLSALPWEEREKILSSMGNDDKSSIAGSEDAEPLAPPIKPIKPVTRNKAPQEPPVKKGRRSRRCGQCPGCQVPEDCGVCTNCLDKPKFGGRNIKKQCCKMRKCQNLQWMPSKAYLQKQAKAVKKKEKKSKTSEKKDSKESSVVKNVVDSSQKPTPSAREDPAPKKSSSEPPPRKPVEEKSEEGNVSAPGPESKQATTPASRKSSKQVSQPAVVIPPQPPTTGPPRKEVPKTTPSEPKKKQPPPPESGPEQSKQKKVAPRPSIPVKQKPKEKEKPPPVNKQENAGTLNILSTLSNGNSSKQKIPADGVHRIRVDFKLENAGGDLKDGHHHYEGAVVILDAGAQYGKVIDRRVRELFVQSEIFPLETPAFAIKEQGFRAIIISGGPNSVYAEDAPWFDPAIFTIGKPVLGICYGMQMMNKVFGGTVHKKSDRGRWSVVACLDSGPGAETFPSSLFS

SEQ ID NO: 862757 - protein, 1510 aa, Homo sapiens
ASLHGANMAHSCRWRFPARPGTTGGGGGGGRRGLGGAPRQRVPALLLPPGPPVGGGGPGAPPSPPAVAAAAAAAGSSGAGVPGGAAAASAASSSSASSSSSSSSSASSGPALLRVGPGFDAALQVSAAIGTNLRRFRAVFGESGGGGGSGEDEQFLGFGSDEEVRVRSPTRSPSVKTSPRKPRGRPRSGSDRNSAILSDPSVFSPLNKSETKSGDKIKKKDSKSIEKKRGRPPTFPGVKIKITHGKDISELPKGNKEDSLKKIKRTPSATFQQATKIKKLRAGKLSPLKSKFKTGKLQIGRKGVQIVRRRGRPPSTERIKTPSGLLINSELEKPQKVRKDKEGTPPLTKEDKTVVRQSPRRIKPVRIIPSSKRTDATIAKQLLQRAKKGAQKKIEKEAAQLQGRKVKTQVKNIRQFIMPVVSAISSRIIKTPRRFIEDEDYDPPIKIARLESTPNSRFSAPSCGSSEKSSAASQHSSQMSSDSSRSSSPSVDTSTDSQASEEIQVLPEERSDTPEVHPPLPISQSPENESNDRRSRRYSVSERSFGSRTTKKLSTLQSAPQQQTSSSPPPPLLTPPPPLQPASSISDHTPWLMPPTIPLASPFLPASTAPMQGKRKSILREPTFRWTSLKHSRSEPQYFSSAKYAKEGLIRKPIFDNFRPPPLTPEDVGFASGFSASGTAASARLFSPLHSGTRFDMHKRSPLLRAPRFTPSEAHSRIFESVTLPSNRTSAGTSSSGVSNRKRKRKVFSPIRSEPRSPSHSMRTRSGRLSSSELSPLTPPSSVSSSLSISVSPLATSALNPTFTFPSHSLTQSGESAEKNQRPRKQTSAPAEPFSSSSPTPLFPWFTPGSQTERGRNKDKAPEELSKDRDADKSVEKDKSRERDREREKENKRESRKEKRKKGSEIQSSSALYPVGRVSKEKVVGEDVATSSSAKKATGRKKSSSHDSGTDITSVTLGDTTAVKTKILIKKGRGNLEKTNLDLGPTAPSLEKEKTLCLSTPSSSTVKHSTSSIGSMLAQADKLPMTDKRVASLLKKAKAQLCKIEKSKSLKQTDQPKAQGQESDSSETSVRGPRIKHVCRRAAVALGRKRAVFPDDMPTLSALPWEEREKILSSMGNDDKSSIAGSEDAEPLAPPIKPIKPVTRNKAPQEPPVKKGRRSRRCGQCPGCQVPEDCGVCTNCLDKPKFGGRNIKKQCCKMRKCQNLQWMPSKAYLQKQAKAVKKKEKKSKTSEKKDSKESSVVKNVVDSSQKPTPSAREDPAPKKSSSEPPPRKPVEEKSEEGNVSAPGPESKQATTPASRKSSKQVSQPAVVIPPQPPTTGPPRKEVPKTTPSEPKKKQPPPPESGPEQSKQKKVAPRPSIPVKQKPKEKEKPPPVNKQENAGTLNILSTLSNGNSSKQKIPADGVHRIRVDFKTYTSTSNNSISGSLKRLEDTTARFTNANFQEVSAHTSSGKDVSETRGSEGKGKKSSAHSSGQRGRKPGGGRNPGTKLEWWPVWIQAQGPRHSLLHSF

SEQ ID NO: 862758 - protein, 1423 aa, Homo sapiens
ASLHGANMAHSCRWRFPARPGTTGGGGGGGRRGLGGAPRQRVPALLLPPGPPVGGGGPGAPPSPPAVAAAAAAAGSSGAGVPGGAAAASAASSSSASSSSSSSSSASSGPALLRVGPGFDAALQVSAAIGTNLRRFRAVFGESGGGGGSGEDEQFLGFGSDEEVRVRSPTRSPSVKTSPRKPRGRPRSGSDRNSAILSDPSVFSPLNKSETKSGDKIKKKDSKSIEKKRGRPPTFPGVKIKITHGKDISELPKGNKEDSLKKIKRTPSATFQQATKIKKLRAGKLSPLKSKFKTGKLQIGRKGVQIVRRRGRPPSTERIKTPSGLLINSELEKPQKVRKDKEGTPPLTKEDKTVVRQSPRRIKPVRIIPSSKRTDATIAKQLLQRAKKGAQKKIEKEAAQLQGRKVKTQVKNIRQFIMPVVSAISSRIIKTPRRFIEDEDYDPPIKIARLESTPNSRFSAPSCGSSEKSSAASQHSSQMSSDSSRSSSPSVDTSTDSQASEEIQVLPEERSDTPEVHPPLPISQSPENESNDRRSRRYSVSERSFGSRTTKKLSTLQSAPQQQTSSSPPPPLLTPPPPLQPASSISDHTPWLMPPTIPLASPFLPASTAPMQGKRKSILREPTFRWTSLKHSRSEPQYFSSAKYAKEGLIRKPIFDNFRPPPLTPEDVGFASGFSASGTAASARLFSPLHSGTRFDMHKRSPLLRAPRFTPSEAHSRIFESVTLPSNRTSAGTSSSGVSNRKRKRKVFSPIRSEPRSPSHSMRTRSGRLSSSELSPLTPPSSVSSSLSISVSPLATSALNPTFTFPSHSLTQSGESAEKNQRPRKQTSAPAEPFSSSSPTPLFPWFTPGSQTERGRNKDKAPEELSKDRDADKSVEKDKSRERDREREKENKRESRKEKRKKGSEIQSSSALYPVGRVSKEKVVGEDVATSSSAKKATGRKKSSSHDSGTDITSVTLGDTTAVKTKILIKKGRGNLEKTNLDLGPTAPSLEKEKTLCLSTPSSSTVKHSTSSIGSMLAQADKLPMTDKRVASLLKKAKAQLCKIEKSKSLKQTDQPKAQGQESDSSETSVRGPRIKHVCRRAAVALGRKRAVFPDDMPTLSALPWEEREKILSSMGNDDKSSIAGSEDAEPLAPPIKPIKPVTRNKAPQEPPVKKGRRSRRCGQCPGCQVPEDCGVCTNCLDKPKFGGRNIKKQCCKMRKCQNLQWMPSKAYLQKQAKAVKKKEKKSKTSEKKDSKESSVVKNVVDSSQKPTPSAREDPAPKKSSSEPPPRKPVEEKSEEGNVSAPGPESKQATTPASRKSSKQVSQPAVVIPPQPPTTGPPRKEVPKTTPSEPKKKQPPPPESGPEQSKQKKVAPRPSIPVKQKPKEKEKPPPVNKQENAGTLNILSTLSNGNSSKQKIPADGVHRIRVDFKVKVFSDHKVY

SEQ ID NO: 862759 - protein, 1633 aa, Homo sapiens
ASLHGANMAHSCRWRFPARPGTTGGGGGGGRRGLGGAPRQRVPALLLPPGPPVGGGGPGAPPSPPAVAAAAAAAGSSGAGVPGGAAAASAASSSSASSSSSSSSSASSGPALLRVGPGFDAALQVSAAIGTNLRRFRAVFGESGGGGGSGEDEQFLGFGSDEEVRVRSPTRSPSVKTSPRKPRGRPRSGSDRNSAILSDPSVFSPLNKSETKSGDKIKKKDSKSIEKKRGRPPTFPGVKIKITHGKDISELPKGNKEDSLKKIKRTPSATFQQATKIKKLRAGKLSPLKSKFKTGKLQIGRKGVQIVRRRGRPPSTERIKTPSGLLINSELEKPQKVRKDKEGTPPLTKEDKTVVRQSPRRIKPVRIIPSSKRTDATIAKQLLQRAKKGAQKKIEKEAAQLQGRKVKTQVKNIRQFIMPVVSAISSRIIKTPRRFIEDEDYDPPIKIARLESTPNSRFSAPSCGSSEKSSAASQHSSQMSSDSSRSSSPSVDTSTDSQASEEIQVLPEERSDTPEVHPPLPISQSPENESNDRRSRRYSVSERSFGSRTTKKLSTLQSAPQQQTSSSPPPPLLTPPPPLQPASSISDHTPWLMPPTIPLASPFLPASTAPMQGKRKSILREPTFRWTSLKHSRSEPQYFSSAKYAKEGLIRKPIFDNFRPPPLTPEDVGFASGFSASGTAASARLFSPLHSGTRFDMHKRSPLLRAPRFTPSEAHSRIFESVTLPSNRTSAGTSSSGVSNRKRKRKVFSPIRSEPRSPSHSMRTRSGRLSSSELSPLTPPSSVSSSLSISVSPLATSALNPTFTFPSHSLTQSGESAEKNQRPRKQTSAPAEPFSSSSPTPLFPWFTPGSQTERGRNKDKAPEELSKDRDADKSVEKDKSRERDREREKENKRESRKEKRKKGSEIQSSSALYPVGRVSKEKVVGEDVATSSSAKKATGRKKSSSHDSGTDITSVTLGDTTAVKTKILIKKGRGNLEKTNLDLGPTAPSLEKEKTLCLSTPSSSTVKHSTSSIGSMLAQADKLPMTDKRVASLLKKAKAQLCKIEKSKSLKQTDQPKAQGQESDSSETSVRGPRIKHVCRRAAVALGRKRAVFPDDMPTLSALPWEEREKILSSMGNDDKSSIAGSEDAEPLAPPIKPIKPVTRNKAPQEPPVKKGRRSRRCGQCPGCQVPEDCGVCTNCLDKPKFGGRNIKKQCCKMRKCQNLQWMPSKAYLQKQAKAVKKKEKKSKTSEKKDSKESSVVKNVVDSSQKPTPSAREDPAPKKSSSEPPPRKPVEEKSEEGNVSAPGPESKQATTPASRKSSKQVSQPAVVIPPQPPTTGPPRKEVPKTTPSEPKKKQPPPPESGPEQSKQKKVAPRPSIPVKQKPKEKEKPPPVNKQENAGTLNILSTLSNGNSSKQKIPADGVHRIRVDFKEDCEAENVWEMGGLGILTSVPITPRVVCFLCASSGHVEFVYCQVCCEPFHKFCLEENERPLEDQLENWCCRRCKFCHVCGRQHQATKQLLECNKCRNSYHPECLGPNYPTKPTKKKKVWICTKCVRCKSCGSTTPGKGWDAQWSHDFSLCHDCAKLFAKGNFCPLCDKCYDDDDYESKMMQCGKCDRWVHSKCENLSGTEGWSLFISVFFFLGTTTFISL

SEQ ID NO: 862760 - protein, 1433 aa, Homo sapiens
ASLHGANMAHSCRWRFPARPGTTGGGGGGGRRGLGGAPRQRVPALLLPPGPPVGGGGPGAPPSPPAVAAAAAAAGSSGAGVPGGAAAASAASSSSASSSSSSSSSASSGPALLRVGPGFDAALQVSAAIGTNLRRFRAVFGESGGGGGSGEDEQFLGFGSDEEVRVRSPTRSPSVKTSPRKPRGRPRSGSDRNSAILSDPSVFSPLNKSETKSGDKIKKKDSKSIEKKRGRPPTFPGVKIKITHGKDISELPKGNKEDSLKKIKRTPSATFQQATKIKKLRAGKLSPLKSKFKTGKLQIGRKGVQIVRRRGRPPSTERIKTPSGLLINSELEKPQKVRKDKEGTPPLTKEDKTVVRQSPRRIKPVRIIPSSKRTDATIAKQLLQRAKKGAQKKIEKEAAQLQGRKVKTQVKNIRQFIMPVVSAISSRIIKTPRRFIEDEDYDPPIKIARLESTPNSRFSAPSCGSSEKSSAASQHSSQMSSDSSRSSSPSVDTSTDSQASEEIQVLPEERSDTPEVHPPLPISQSPENESNDRRSRRYSVSERSFGSRTTKKLSTLQSAPQQQTSSSPPPPLLTPPPPLQPASSISDHTPWLMPPTIPLASPFLPASTAPMQGKRKSILREPTFRWTSLKHSRSEPQYFSSAKYAKEGLIRKPIFDNFRPPPLTPEDVGFASGFSASGTAASARLFSPLHSGTRFDMHKRSPLLRAPRFTPSEAHSRIFESVTLPSNRTSAGTSSSGVSNRKRKRKVFSPIRSEPRSPSHSMRTRSGRLSSSELSPLTPPSSVSSSLSISVSPLATSALNPTFTFPSHSLTQSGESAEKNQRPRKQTSAPAEPFSSSSPTPLFPWFTPGSQTERGRNKDKAPEELSKDRDADKSVEKDKSRERDREREKENKRESRKEKRKKGSEIQSSSALYPVGRVSKEKVVGEDVATSSSAKKATGRKKSSSHDSGTDITSVTLGDTTAVKTKILIKKGRGNLEKTNLDLGPTAPSLEKEKTLCLSTPSSSTVKHSTSSIGSMLAQADKLPMTDKRVASLLKKAKAQLCKIEKSKSLKQTDQPKAQGQESDSSETSVRGPRIKHVCRRAAVALGRKRAVFPDDMPTLSALPWEEREKILSSMGNDDKSSIAGSEDAEPLAPPIKPIKPVTRNKAPQEPPVKKGRRSRRCGQCPGCQVPEDCGVCTNCLDKPKFGGRNIKKQCCKMRKCQNLQWMPSKAYLQKQAKAVKKKEKKSKTSEKKDSKESSVVKNVVDSSQKPTPSAREDPAPKKSSSEPPPRKPVEEKSEEGNVSAPGPESKQATTPASRKSSKQVSQPAVVIPPQPPTTGPPRKEVPKTTPSEPKKKQPPPPESGPEQSKQKKVAPRPSIPVKQKPKEKEKPPPVNKQENAGTLNILSTLSNGNSSKQKIPADGVHRIRVDFKVVACLDSGPGAETFPSSLFS

SEQ ID NO: 862761 - protein, 1423 aa, Homo sapiens; identical to SEQ ID NO: 862758

SEQ ID NO: 862762 - protein, 171 aa, Homo sapiens
MAHSCRWRFPARPGTTGGGGGGGRRGLGGAPRQRVPALLLPPGPPVGGGGPGAPPSPPAVAAAAAAAGSSGAGVPGGAAAASAASSSSASSSSSSSSSASSGPALLRVGPGFDAALQVSAAIGTNLRRFRAVFGESGGGGGSGEDEQFLGFGSDEEVRVRSPTRSPSGTAN

SEQ ID NO: 862763 - protein, 71 aa, Homo sapiens
MSSDSSRSSSPSVDTSTDSQASEEIQVLPEERSDTPEVHPPLPISQSPENESNDRRSRRYSVSERSFGSRT

SEQ ID NO: 862764 - protein, 255 aa, Homo sapiens
MKALLALPLLLLLSTPPCAPQVSGIRGDALERFCLQQPLDCDDIYAQGYQSDGVYLIYPSGPSVPVPVFCDMTTEGGKWTVFQKRFNGSVSFFRGWNDYKLGFGRADGEYWLGLQNMHLLTLKQKYELRVDLEDFENNTAYAKYADFSISPNAVSAEEDGYTLFVAGFEDGGAGDSLSYHSGQKFSTFDRDQDLFVQNCAALSSGAFWFRSCHFANLNGFYLGGSHLSYANGINWAQWKGFYYSLKRTEMKIRRA

SEQ ID NO: 862765 - protein, 263 aa, Homo sapiens [sequence omitted]

SEQ ID NO: 862766 - protein, 255 aa, Homo sapiens; identical to SEQ ID NO: 862764

SEQ ID NO: 862767 - protein, 255 aa, Homo sapiens; identical to SEQ ID NO: 862764

SEQ ID NO: 862768 - protein, 255 aa, Homo sapiens; identical to SEQ ID NO: 862764

SEQ ID NO: 862769 - protein, 255 aa, Homo sapiens; identical to SEQ ID NO: 862764

SEQ ID NO: 862770 - protein, 175 aa, Homo sapiens
MSHGAGLVRTTCSSGSALGPGAGAAQPSASPLEGLLDLSYPRTHAALLKVAQMVTLLIAFICVRSSLWTNYSAYSYFEVVTICDLIMILAFYLVHLFRFYRVLTCISWPLSELLHYLIGTLLLLIASIVAASKSYNQSGLVAGAIFGFMATFLCMASIWLSYKISCVTQSTDAAV

SEQ ID NO: 862771 - protein, 175 aa, Homo sapiens; identical to SEQ ID NO: 862770

SEQ ID NO: 862772 - protein, 175 aa, Homo sapiens; identical to SEQ ID NO: 862770

SEQ ID NO: 862773 - protein, 142 aa, Homo sapiens
MSHGAGLVRTTCSSGSALGPGAGAAQPSASPLEGLLDLSYPRTHAALLKVAQMVTLLIAFICVRSSLWTNYSAYSYFEVVTICDLIMILAFYLVHLFRFYRVLTCISWPLSIFGFMATFLCMASIWLSYKISCVTQSTDAAV

SEQ ID NO: 862774 - protein, 151 aa, Homo sapiens
MSHGAGLVRTTCSSGSALGPGAGAAQPSASPLEGLLDLSYPRTHAALLKVAQMVTLLIAFICVRSSLWTNYSAYSYFEVVTICDLIMILAFYLVHLFRFYRVLTCISWPLSELLHYLIGTLLLLIASIVAASKSYNQSGLVAGADNQSPLA

SEQ ID NO: 862775 - protein, 175 aa, Homo sapiens; identical to SEQ ID NO: 862770

SEQ ID NO: 862776 - protein, 132 aa, Homo sapiens
PRPPQVLGLQVTLLIAFICVRSSLWTNYSAYSYFEVVTICDLIMILAFYLVHLFRFYRVLTCISWPLSELLHYLIGTLLLLIASIVAASKSYNQSGLVAGAIFGFMATFLCMASIWLSYKISCVTQSTDAAV

SEQ ID NO: 862777 - protein, 207 aa, Homo sapiens
MSHGAGLVRTTCSSGSALGPGAGAAQPSASPLEGLLDLSYPRTHAALLKVAQMVTLLIAFICVRSSLWTNYSAYSYFEVVTICDLIMILAFYLVHLFRFYRVLTCISWPLSMQPSDEATTPRPLRSFAERRTCTPGEASGPVFLCQSPVRLVGTRKGLHPLPALPGSQLPELLSQPETLPPAFRGEHPSHSGKGKQPPGKCFLPSCF

SEQ ID NO: 862778 - protein, 1101 aa, Homo sapiens
MEQPGAAASGAGGGSEEPGGGRSNKRSAGNRAANEEETKNKPKLNIQIKTLADDVRDRITSFRKSTVKKEKPLIQHPIDSQVAMSEFPAAQPLYDERSLNLSEKEVLDLFEKMMEDMNLNEEKKAPLRNKDFTTKREMVVQYISATAKSGGLKNSKHECTLSSQEYVHELRSGISDEKLLNCLESLRVSLTSNPVSWVNNFGHEGLGLLLDELEKLLDKKQQENIDKKNQYKLIQCLKAFMNNKFGLQRILGDERSLLLLARAIDPKQPNMMTEIVKILSAICIVGEENILDKLLGAITTAAERNNRERFSPIVEGLENQEALQLQVACMQFINALVTSPYELDFRIHLRNEFLRSGLKTMLPDLKEKENDELDIQLKVFDENKEDDLTELSHRLNDIRAEMDDMNEVYHLLYNMLKDTAAENYFLSILQHFLLIRNDYYIRPQYYKIIEECVSQIVLHCSGMDPDFKYRQRLDIDLTHLIDSCVNKAKVEESEQKAAEFSKKFDEEFTARQEAQAELQKRDEKIKELEAEIQQLRTQAQVLSSSSGIPGPPAAPPLPGVGPPPPPPAPPLPGGAPLPPPPPPLPGMMGIPPPPPPPLLFGGPPPPPPLGGVPPPPGISLNLPYGMKQKKMYKPEVSMKRINWSKIEPTELSENCFWLRVKEDKFENPDLFAKLALNFATQIKVQKNAEALEEKKTGPTKKKVKELRILDPKTAQNLSIFLGSYRMPYEDIRNVILEVNEDMLSEALIQNLVKHLPEQKILNELAELKNEYDDLCEPEQFGVVMSSVKMLQPRLSSILFKLTFEEHINNIKPSIIAVTLACEELKKSESFNRLLELVLLVGNYMNSGSRNAQSLGFKINFLCKIRDTKSADQKTTLLHFIADICEEKYRDILKFPEELEHVESASKVSAQILKSNLASMEQQIVHLERDIKKFPQAENQHDKFVEKMTSFTKTAREQYEKLSTMHNNMMKLYENLGEYFIFDSKTVSIEEFFGDLNNFRTLFLEAVRENNKRREMEEKTRRAKLAKEKAEQEKLERQKKKKQLIDINKEGDETGVMDNLLEALQSGAAFRDRRKRIPRNPDNRRVPLERSRSRHNGAISSK

SEQ ID NO: 862779 - protein, 856 aa, Homo sapiens [sequence omitted]

SEQ ID NO: 862780 - protein, 709 aa, Homo sapiens
MSFRKPLLAHQSLPFGPKFMSVSCVKDIHPILTLPKVSTHYINPKSKISFKYHRFKSSKAYQFRSSKSGMSETLGMVFPEAKSSSSENQGNRKVNLLSNYNGGNRHRITVTDISVSKRREWKLEWSLLSQSFSKSSQANFCSISRPGSNPLSQGSTLWACSSSFLDYGLGLCLCAYGLHFFLCSHTWASASVPAALLSGWCFLYLEGWHMFAAEKFYQRVSYLENSGSLTIFFHFFLSLSLLGPVGSVSDGRTFSKILWVFYVCHIDSHIQKRGSSQIFPEQPHLYSWLLLKQSNKIHKLMPNLFSTSQRLSRHTLGLIYRAHFSNSESPNFSIFFVFFYNHSDCEFAQNLPSHQILIPFVHLYSYFLFKKKFFLMYVEMRSHSVTQAAVSGANIAPCNLKLPGSRDPPASAFQVAGSTGACHHAWLIFCIFLRDLILLCCPGCSRTPSLKQSTHLGLLKCRITGEATMPSLFCQCICFLSYFTISTKKKLSYISNTRLENFLSYTSKFIIYSTFHTTVVDNLDRYNFLPLYDKDSLSSIFQIKSSFPSKPSLEMPLTFILLPSGKGNLVFSITATKILLVSTHYPIPKPFSHFKTFVTEVPNPSQFHNLHEIPMAAVTNYPLAQWLKTIEIYYLVVLEAKSPKLRGGRAERLLETLRETLFPCLPVSCGCHHSLVCDCISLSSVFTSLPLCIYNLPLPLSYKDTCDGT

SEQ ID NO: 862781 - protein, 163 aa, Homo sapiens
MEQPGAAASGAGGGSEEPGGGRSNKRSAGNRAANEEETKNKPKLNIQIKTLADDVRDRITSFRKSTVKKEKPLIQHPIDSQVAMSEFPAAQPLYDERSLNLSEKEVLDLFEKMMEDMNLNEEKKAPLRNKDFTTKREMVVQYISATAKSIVGSKVGWAEKQQT

SEQ ID NO: 862782 - protein, 709 aa, Homo sapiens
MSFRKPLLAHQSLPFGPKFMSVSCVKDIHPILTLPKVSTHYINPKSKISFKYHRFKSSKAYQFRSSKSGMSETLGMVFPEAKSSSSENQCNRKVNLLSNYNGGNRHRITVTDISVSKRREWKLEWSLLSQSFSKSSQANFCSISRPGSNPLSQGSTLWACSSSFLDYGLGLCLCAYGLHFFLCSHTWASASVPAALLSGWCFLYLEGWHMFAAEKFYQRVSYLENSGSLTIFFHFFLSLSLLGPVGSVSDGRTFSKILWVFYVCHIDSHIQKRGSSQIFPEQPHLYSWLLLKQSNKSSKLMPNLFSTSQRLSRHTLGLIYRAHFSNSESPNFSIFFFFFTIIQIVNSGSELPSHQILIPFVHLYSYFLFKKKFFLMYVEMRSHSVTQAAVSGANIAPCNLKLPGSRDPPASAFQVAGSTGACHHAWLIFAFFCRDLILLCCPGCSRTPSLKQSTHLGLLKCRITGEATMPSLFCQCICFLSYFTISTKKKLSYISNTRLENFLSYTSKFIIYSTFHTTVVDNLDRYNFLPLYDKDSLSSIFQIKSSFPSKPSLEMPLTFILLPSGKGNLVFSITATKILLVSTHYPIPKPFSHFKTFVTEVPNPSQFHNLHEIPMAAVTNYPLAQWLKTIEIYYLVVLEAKSPKLRGWQAERLLETLRETLFPCLPVSCGCHHSLVCDCISLSSVFTSLPLCIYNLPLPLSYKDTCDGT

SEQ ID NO: 862783 - protein, 930 aa, Homo sapiens
MEYERRGGRGDRTGRYGATDRSQDDGGENRSRDHDYRDMDYRSYPREYGSQEGKHDYDDSSEEQSAEDSYEASPGSETQRRRRRRHRHSPTGPPGFPRDGDYRDQDYRTEQGEEEEEEEDEEEEEKASNIVMLRMLPQAATEDDIRGQLQSHGVQAREVRLMRNKSSGQSRGFAFVEFSHLQDATRWMEANQHSLNILGQKVSMHYSDPKPKINEDWLCNKCGVQNFKRREKCFKCGVPKSEAEQKLPLGTRLDQQTLPLGGRELSQGLLPLPQPYQAQGVLASQALSQGSEPSSENANDTIILRNLNPHSTMDSILGALAPYAVLSSSNVRVIKDKQTQLNRGFAFIQLSTIVEAAQLLQILQALHPPLTIDGKTINVEFAKGSKRDMASNEGSRISAASVASTAIAAAQWAISQASQGGEGTWATSEEPPVDYSYYQQDEGYGNSQGTESSLYAHGYLKGTKGPGITGTKGDPTGAGPEASLEPGADSVSMQAFSRAQPGAAPGIYQQSAEASSSQGTAANSQSYTIMSPAVLKSELQSPTHPSSALPPATSPTAQESYSQYPVPDVSTYQYDETSGYYYDPQTGLYYDPNSQYYYNAQSQQYLYWDGERRTYVPALEQSADGHKETGAPSKEGKEKKEKHKTKTAQQIAKDMERWARSLNKQKENFKNSFQPISSLRDDERRESATADAGYAILEKKGALAERQHTSMDLPKLASDDRPSPPRGLVAAYSGESDSEEEQERGGPEREEKLTDWQKLACLLCRRQFPSKEALIRHQQLSGLHKQNLEIHRRAHLSENELEALEKNDMEQMKYRDRAAERREKYGIPEPPEPKRRKYGGISTASVDFEQPTRDGLGSDNIGSRMLQAMGWKEGSGLGRKKQGIVTPIEAQTRVRGSGLGARGSSYGVTSTESYKETLHKTMVTRFNEAQ

SEQ ID NO: 862784 - protein, 930 aa, Homo sapiens; identical to SEQ ID NO: 862783

SEQ ID NO: 862785 - protein, 920 aa, Homo sapiens
MKDVVVVVTGLAAMEPLTARRMMVGRTAAETTTTGTWTTVHILASMAARRASMTMTTHLRSRVRRIPTRPPRAPRLSVGGGGGTGFPRDGDYRDQDYRTEQGEEEEEEEDEEEEEKASNIVMLRMLPQAATEDDIRGQLQSHGVQAREVRLMRNKSSGQSRGFAFVEFSHLQDATRWMEANQHSLNILGQKVSMHYSDPKPKINEDWLCNKCGVQNFKRREKCFKCGVPKSEAEQKLPLGTRLDQQTLPLGGRELSQGLLPLPQPYQAQGVLASQALSQGSEPSSENANDTIILRNLNPHSTMDSILGALAPYAVLSSSNVRVIKDKQTQLNRGFAFIQLSTIVEAAQLLQILQALHPPLTIDGKTINVEFAKGSKRDMASNEGSRISAASVASTAIAAAQWAISQASQGGEGTWATSEEPPVDYSYYQQDEGYGNSQGTESSLYAHGYLKGTKGPGITGTKGDPTGAGPEASLEPGADSVSMQAFSRAQPGAAPGIYQQSAEASSSQGTAANSQSYTIMSPAVLKSELQSPTHPSSALPPATSPTAQESYSQYPVPDVSTYQYDETSGYYYDPQTGLYYDPNSQYYYNAQSQQYLYWDGERRTYVPALEQSADGHKETGAPSKEGKEKKEKHKTKTAQQIAKDMERWARSLNKQKENFKNSFQPISSLRDDERRESATADAGYAILEKKGALAERQHTSMDLPKLASDDRPSPPRGLVAAYSGESDSEEEQERGGPEREEKLTDWQKLACLLCRRQFPSKEALIRHQQLSGLHKQNLEIHRRAHLSENELEALEKNDMEQMKYRDRAAERREKYGIPEPPEPKRRKYGGISTASVDFEQPTRDGLGSDNIGSRMLQAMGWKEGSGLGRKKQGIVTPIEAQTRVRGSGLGARGSSYGVTSTESYKETLHKTMVTRFNEAQ

SEQ ID NO: 862786 - protein, 930 aa, Homo sapiens; identical to SEQ ID NO: 862783

SEQ ID NO: 862787 - protein, 987 aa, Homo sapiens
MEYERRGGRGDRTGRYGATDRSQDDGGENRSRDHDYRDMDYRSYPREYGSQEGKHDYDDSSEEQSAEDSYEASPGSETQRRRRRRHRHSPTGPPGFPRDGDYRDQDYRTEQGEEEEEEEDEEEEEKASNIVMLRMLPQAATEDDIRGQLQSHGVQAREVRLMRNKSSGQSRGFAFVEFSHLQDATRWMEANQHSLNILGQKVSMHYSDPKPKINEDWLCNKCGVQNFKRREKCFKCGVPKSEAEQKLPLGTRLDQQTLPLGGRELSQGLLPLPQPYQAQGVLASQALSQGSEPSSENANDTIILRNLNPHSTMDSILGALAPYAVLSSSNVRVIKDKQTQLNRGFAFIQLSTIVEAAQLLQILQALHPPLTIDGKTINVEFAKGSKRDMASNEGSRISAASVASTAIAAAQWAISQASQGGEGTWATSEEPPVDYSYYQQDEGYGNSQGTESSLYAHGYLKGTKGPGITGTKGDPTGAGPEASLEPGADSVSMQAFSRAQPGAAPGIYQQSAEASSSQGTAANSQSYTIMSPAVLKSELQSPTHPSSALPPATSPTAQESYSQYPVPDVSTYQYDETSGYYYDPQTGLYYDPNSQYYYNAQSQQYLYWDGERRTYVPALEQSADGHKETGAPSKEGKEKKEKHKTKTAQQIAKDMERWARSLNKQKENFKNSFQPISSLRDDERRESATADAGYAILEKKVCWGHPPAPCPQSCPSFGPSVESLNFCVPPPQGALAERQHTSMDLPKLASDDRPVSAQGREEAGALIWPGLTAHPHPLQSPPRGLVAAYSGESDSEEEQERGGPEREEKLTDWQKLACLLCRRQFPSKEALIRHQQLSGLHKQNLEIHRRAHLSENELEALEKNDMEQMKYRDRAAERREKYGIPEPPEPKRRKYGGISTASVDFEQPTRDGLGSDNIGSRMLQAMGWKEGSGLGRKKQGIVTPIEAQTRVRGSGLGARGSSYGVTSTESYKETLHKTMVTRFNEAQ

SEQ ID NO: 862788 - protein, 855 aa, Homo sapiens
MEYERRGGRGDRTGRYGATDRSQDDGGENRSRDHDYRDMDYRSYPREYGSQEGKHDYDDSSEEQSAEDSYEASPGSETQRRRRRRHRHSPTGPPGFPRDGDYRDQDYRTEQGEEEEEEEDEEEEEKASNIVMLRMLPQAATEDDIRGQLQSHGVQAREVRLMRNKSSGQSRGFAFVEFSHLQDATRWMEANQHSLNILGQKVSMHYSDPKPKINEDWLCNKCGVQNFKRREKCFKCGVPKSEAEQKLPLGTRLDQQTLPLGGRELSQGLLPLPQPYQAQGVLASQALSQGSEPSSENANDTIILRNLNPHSTMDSILGALAPYAVLSSSNVRVIKDKQTQLNRGFAFIQLSTIVEAAQLLQILQALHPPLTIDGKTINVEFAKGSKRDMASNEGSRISAASVASTAIAAAQWAISQASQGGEGTWATSEEPPVDYSYYQQDEGYGNSQGTESSLYAHGYLKGTKGPGITGTKGDPTGAGPEASLEPGADSVSMQAFSRAQPGAAPGIYQQSAEASSSQGTAANSQSYTIMSPAVLKSELQSPTHPSSALPPATSPTAQESYSQYPVPDVSTYQYDETSGYYYDPQTGLYYDPNSQYYYNAQSQQYLYWDGERRTYVPALEQSADGHKETGAPSKEGKEKKEKHKTKTAQQIAKDMERWARSLNKQKENFKNSFQPISSLRDDERRESATADAGYAILEKKGALAERQHTSMDLPKLASDDRPSPPRGLVAAYSGESDSEEEQERGGPEREEKLTDWQKLACLLCRRQFPSKEALIRHQQLSGLHKQNLEIHRRAHLSENELEALEKQGIVTPIEAQTRVRGSGLGARGSSYGVTSTESYKETLHKTMVTRFNEAQ

SEQ ID NO: 862789 - protein, 429 aa, Homo sapiens
GTRPGYCSLRLIVGRCQGTAANSQSYTIMSPAVLKSELQSPTHPSSALPPATSPTAQESYSQYPVPDVSTYQYDETSGYYYDPQTGLYYDPNSQYYYNAQSQQYLYWDGERRTYVPALEQSADGHKETGAPSKEGKEKKEKHKTKTAQQIAKDMERWARSLNKQKENFKNSFQPISSLRDDERRESATADAGYAILEKKGALAERQHTSMDLPKLASDDRPSPPRGLVAAYSGESDSEEEQERGGPEREEKLTDWQKLACLLCRRQFPSKEALIRHQQLSGLHKQNLEIHRRAHLSENELEALEKNDMEQMKYRDRAAERREKYGIPEPPEPKRRKYGGISTASVDFEQPTRDGLGSDNIGSRMLQAMGWKEGSGLGRKKQGIVTPIEAQTRVRGSGLGARGSSYGVTSTESYKETLHKTMVTRFNEAQ

SEQ ID NO: 862790 - protein, 683 aa, Homo sapiens
MEYERRGGRGDRTGRYGATDRSQDDGGENRSRDHDYRDMDYRSYPREYGSQEGKHDYDDSSEEQSAEDSYEASPGSETQRRRRRRHRHSPTGPPGFPRDGDYRDQDYRTEQGEEEEEEEDEEEEEKASNIVMLRMLPQAATEDDIRGQLQSHGVQAREVRLMRNKSSGQSRGFAFVEFSHLQDATRWMEANQHSLNILGQKVSMHYSDPKPKINEDWLCNKCGVQNFKRREKCFKCGVPKSEAEQKLPLGTRLDQQTLPLGGRELSQGLLPLPQPYQAQGVLASQALSQGSEPSSENANDTIILRNLNPHSTMDSILGALAPYAVLSSSNVRVIKDKQTQLNRGFAFIQLSTIVEAAQLLQILQALHPPLTIDGKTINVEFAKGSKRDMASNEGSRISAASVASTAIAAAQWAISQASQGGEGTWATSEEPPVDYSYYQQDEGYGNSQGTESSLYAHGYLKGTKGPGITGTKGDPTGAGPEASLEPGADSVSMQAFSRAQPGAAPGIYQQSAEASSSQGTAANSQSYTIMSPAVLKSELQSPTHPSSALPPATSPTAQESYSQYPVPDVSTYQYDETSGYYYDPQTGLYYDPNSQYYYNAQSQQYLYWDGERRTYVPALEQSADGHKETGAPSKQGIVTPIEAQTRVRGSGLGARGSSYGVTSTESYKETLHKTMVTRFNEAQ

SEQ ID NO: 862791 - protein, 492 aa, Homo sapiens
MEYERRGGRGDRTGRYGATDRSQDDGGENRSRDHDYRDMDYRSYPREYGSQEGKHDYDDSSEEQSAEDSYEASPGSETQRRRRRRHRHSPTGPPGFPRDGDYRDQDYRTEQGEEEEEEEDEEEEEKASNIVMLRMLPQAATEDDIRGQLQSHGVQAREVRLMRNKSSGQSRGFAFVEFSHLQDATRWMEANQHSLNILGQKVSMHYSDPKPKINEDWLCNKCGVQNFKRREKCFKCGVPKSEAEQKLPLGTRLDQQTLPLGGRELSQGLLPLPQPYQAQGVLASQALSQGSEPSSENANDTIILRNLNPHSTMDSILGALAPYAVLSSSNVRVIKDKQTQLNRGFAFIQLSTIVEAAQLLQILQALHPPLTIDGKTINVEFAKGSKRDMASNEGSRISAASVASTAIAAAQWAISQASQGGEGTWATSEEPPVDYSYYQQDEGYGNSQGTESSLYAHGYLKDRVLDGWDGALLLSASPLPSQRGLDQIKLRW

SEQ ID NO: 862792 - protein, 157 aa, Homo sapiens
QSPRGGSTAAYPQPLCEWLGQVRGSGARGRGGRPTTHAVHRPCRDFEQPTRDGLGSDNIGSRMLQAMGWKEGSGLGRKKQGIVTPIEAESQAVLSHPPAPLTASPTSLTEPASLTQAQTRVRGSGLGARGSSYGVTSTESYKETLHKTMVTRFNEAQ

SEQ ID NO: 862793 - protein, 69 aa, Homo sapiens
MGSGQVASGTASPAGSLHKVFPHIPSSLLLPQYYYNAQSQQYLYWDGERRTYVPALEQSADGHKETGAP

SEQ ID NO: 862794 - protein, 853 aa, Homo sapiens
MEYERRGGRGDRTGRYGATDRSQDDGGENRSRDHDYRDMDYRSYPREYGSQEGKHDYDDSSEEQSAEIRGQLQSHGVQAREVRLMRNKSSGQSRGFAFVEFSHLQDATRWMEANQHSLNILGQKVSMHYSDPKPKINEDWLCNKCGVQNFKRREKCFKCGVPKSEAEQKLPLGTRLDQQTLPLGGRELSQGLLPLPQPYQAQGVLASQALSQGSEPSSENANDTIILRNLNPHSTMDSILGALAPYAVLSSSNVRVIKDKQTQLNRGFAFIQLSTIVEAAQLLQILQALHPPLTIDGKTINVEFAKGSKRDMASNEGSRISAASVASTAIAAAQWAISQASQGGEGTWATSEEPPVDYSYYQQDEGYGNSQGTESSLYAHGYLKGTKGPGITGTKGDPTGAGPEASLEPGADSVSMQAFSRAQPGAAPGIYQQSAEASSSQGTAANSQSYTIMSPAVLKSELQSPTHPSSALPPATSPTAQESYSQYPVPDVSTYQYDETSGYYYDPQTGLYYDPNSQYYYNAQSQQYLYWDGERRTYVPALEQSADGHKETGAPSKEGKEKKEKHKTKTAQQIAKDMERWARSLNKQKENFKNSFQPISSLRDDERRESATADAGYAILEKKGALAERQHTSMDLPKLASDDRPSPPRGLVAAYSGESDSEEEQERGGPEREEKLTDWQKLACLLCRRQFPSKEALIRHQQLSGLHKQNLEIHRRAHLSENELEALEKNDMEQMKYRDRAAERREKYGIPEPPEPKRRKYGGISTASVDFEQPTRDGLGSDNIGSRMLQAMGWKEGSGLGRKKQGIVTPIEAQTRVRGSGLGARGSSYGVTSTESYKETLHKTMVTRFNEAQ

SEQ ID NO: 862795 - protein, 930 aa, Homo sapiens; identical to SEQ ID NO: 862783

SEQ ID NO: 862796 - protein, 729 aa, Homo sapiens
PGIYQQSAEASSSQALLYNEVWRQNFKRREKCFKCGVPKSEAEQKLPLGTRLDQQTLPLGGRELSQGLLPLPQPYQAQGVLASQALSQGSEPSSENANDTIILRNLNPHSTMDSILGALAPYAVLSSSNVRVIKDKQTQLNRGFAFIQLSTIVEAAQLLQILQALHPPLTIDGKTINVEFAKGSKRDMASNEGSRISAASVASTAIAAAQWAISQASQGGEGTWATSEEPPVDYSYYQQDEGYGNSQGTESSLYAHGYLKGTKGPGITGTKGDPTGAGPEASLEPGADSVSMQAFSRAQPGAAPGIYQQSAEASSSQGTAANSQSYTIMSPAVLKSELQSPTHPSSALPPATSPTAQESYSQYPVPDVSTYQYDETSGYYYDPQTGLYYDPNSQYYYNAQSQQYLYWDGERRTYVPALEQSADGHKETGAPSKEGKEKKEKHKTKTAQQIAKDMERWARSLNKQKENFKNSFQPISSLRDDERRESATADAGYAILEKKGALAERQHTSMDLPKLASDDRPSPPRGLVAAYSGESDSEEEQERGGPEREEKLTDWQKLACLLCRRQFPSKEALIRHQQLSGLHKQNLEIHRRAHLSENELEALEKNDMEQMKYRDRAAERREKYGIPEPPEPKRRKYGGISTASVDFEQPTRDGLGSDNIGSRMLQAMGWKEGSGLGRKKQGIVTPIEAQTRVRGSGLGARGSSYGVTSTESYKETLHKTMVTRFNEAQ

SEQ ID NO: 862797 - protein, 438 aa, Homo sapiens [sequence omitted]

SEQ ID NO: 862798 - protein, 917 aa, Homo sapiens
MEYERRGGRGDRTGRYGATDRSQDDGGENRSRDHDYRDMDYRSYPREYGSQEGKHDYDDSSEEQSAEDSYEASPGSETQRRRRRRHRHSPTGPPGFPRDGDYRDQDYRTEQGEEEEEEEDEEEEEKASNIVMLRMLPQAATEDDIRGQLQSHGVQAREVRLMRNKSSGQSRGFAFVEFSHLQDATRWMEANQHSLNILGQKVSMHYSDPKPKINEDWLCNKCGVQNFKRREKCFKCGVPKSEAEQKLPLGTRLDQQTLPLGGRELSQGLLPLPQPYQAQGVLASQALSQGSEPSSENANDTIILRNLNPHSTMDSILGALAPYAVLSSSNVRVIKDKQTQLNRGFAFIQLSTIVEAAQLLQILQALHPPLTIDGKTINVEFAKGSKRDMASNEGSRISAASVASTAIAAAQWAISQASQGGEGTWATSEEPPVDYSYYQQDEGYGNSQGTESSLYAHGYLKGTKGPGITGTKGDPTGAGPEASLEPGADSVSMQAFSRAQPGAAPGIYQQSAEASSSQGTAANSQSYTIMSPAVLKSELQSPTHPSSALPPATSPTAQESYSQYPVPDVSTYQYDETSGYYYDPQTGLYYDPNSQYYYNAQSQQYLYWDGERRTYVPALEQSADGHKETGAPSKEGKEKKEKHKTKTAQQIAKDMERWARSLNKQKENFKNSFQPISSLRDDERRESATADAGYAILEKKGALAERQHTSMDLPKLASDDRPSPPRGLVAAYSGESDSEEEQERGGPEREEKLTDWQKLACLLCRRQFPSKEALIRHQQLSGLHKQNLEIHRRAHLSENELEALEKNDMEQMKYRDRAAERREKYGIPEPKKKKYSKSTTYVNFEKKKQKKKISNQQMSKKSSLDPKNQGILTPFEAQTRVRGPRLGARGSSYGVTSTESYKETLHKTMVTRFNEAQ

SEQ ID NO: 862799 - protein, 172 aa, Homo sapiens
MKDVVVVVTGLAAMEPLTARRMMVGRTAAETTTTGTWTTVHILASMAARRASMTMTTHLRSRVRRIPTRPPRAPRLSVGGGGGTGFPRDGDYRDQDYRTEQGEEEEEEEDEEEEEKASNIVMLRMLPQAATEDDIRGQLQSHGVQAREVRLMRNKSSALPQHPGPEGVDALQ

SEQ ID NO: 862800 - protein, 291 aa, Homo sapiens
MEYERRGGRGDRTGRYGATDRSQDDGGENRSRDHDYRDMDYRSYPREYGSQEGKHDYDDSSEEQSAEDSYEASPGSETQRRRRRRHRHSPTGPPGFPRDGDYRDQDYRTEQGEEEEEEEDEEEEEKASNIVMLRMLPQAATEDDIRGQLQSHGVQAREVRLMRNKSSGQSRGFAFVEFSHLQDATRWMEANQHSLNILGQKVSMHYSDPKPKINEDWLCNKCGVPPKVGRVPGPPPRSRRSTTATTNRMRAMATARAQSLPSMPMATSRAPRALASLEPKGIPLEQVPRPP

SEQ ID NO: 862801 - protein, 76 aa, Homo sapiens
MHSTENNIRRFRRHLPPLPRGFPSWGTAGSLGDLFIQVWRVQWEIPAPSDGLACASQCGVQNFKRREKCFKCGVPK

SEQ ID NO: 862802 - protein, 105 aa, Homo sapiens
MVLGSSLGTPQPPGASGGVCNRVIPPPSCPPYPQGKGSLSPSPSDWMCLYPLMPQSLSEHPHSPPVGGGCSSTHPDLTVQGASPAIPPPILYPPFLGPHHCGRRG

SEQ ID NO: 862803 - protein, 434 aa, Homo sapiens
RSRRRWQGEVEAVERQRQQRVPGLRQQRGRRRAEAEVTKAAAAAAVSLTVAETKAAAADGERPGPGPLLVGCGRAAVGPARLPPPAAPPPAPPPGRRRGPGPARTQTAAAAAAGGVGGGGGAMGGLASGGDVEPGLPVEVRGSNGAFYKGFVKDVHEDSVTIFFENNWQSERQIPFGDVRLPPPADYNKEITEGDEVEVYSRANEQEPCGWWLARVRMMKGDFYVIEYAACDATYNEIVTLERLRPVNPNPLATKGSFFKVTMAVPEDLREACSNENVHKEFKKALGANCIFLNITNSELFILSTTEAPVKRASLLGDMHFRSLRTKLLLMSRNEEATKHLETSKQLAAAFQEEFTVREDLMGLAIGTHGANIQQARKVPGVTAIELGEETCTFRIYGETPEACRQARSYLEFSEDSVQVPRNLVGELVVCIYS

SEQ ID NO: 862804 - protein, 332 aa, Homo sapiens [sequence omitted]

SEQ ID NO: 862805 - protein, 333 aa, Homo sapiens
TTPQFKSARGRENISNAQALLEYHLSYLQEVEQLRLERLQIDEQLRQIGLGFRPPGSGRGSGGSDKAGYSTDESSSSSLHATRTYGGSYGGRGRGRRTGGPAYGPSSDVSTASETESEKREEPNRAGPGDRDPPTRGEESRRRPTGGRGRGPPPAPRPTSRYNSSSISSVLKDPDSNPYSLLDTSEPEPPVDSEPGEPPPASARRRRSRRRRTDEDRTVMDGGLESDGPNMTENGLEDESRPQRRNRSRRRRNRGNRTDGSISGDRQPVTVADYISRAESQSRQRPPLERTKPSEDSLSGQKGDSVSKLPKGPSENGELSAPLELGSMVNGVS

SEQ ID NO: 862806 - protein, 531 aa, Homo sapiens
RSRRRWQGEVEAVERQRQQRVPGLRQQRGRRRAEAEVTKAAAAAAVSLTVAETKAAAADGERPGPGPLLVGCGRAAVGPARLPPPAAPPPAPPPGRRRGPGPARTQTAAAAAAGGVGGGGGAMGGLASGGDVEPGLPVEVRGSNGAFYKGFVKDVHEDSVTIFFENNWQSERQIPFGDVRLPPPADYNKEITEGDEVEVYSRANEQEPCGWWLARVRMMKGDFYVIEYAACDATYNEIVTLERLRPVNPNPLATKGSFFKVTMAVPEDLREACSNENVHKEFKKALGANCIFLNITNSELFILSTTEAPVKRASLLGDMHFRSLRTKLLLMSRNEEATKHLETSKQLAAAFQEEFTVREDLMGLAIGTHGANIQQARKVPGVTAIELGEETCTFRIYGETPEACRQARSYLEFSEDSVQVPRNLVGKVIGKNGKVIQEIVDKSGVVRVRVEGDNDKKNPREEGMVPFIFVGTRENISNAQALLEYHLSYLQEVEQLRLERLQIDEQLRQIGLGFRPPGSGRGSGGSDKAGR

SEQ ID NO: 862807 - protein, 114 aa, Homo sapiens [sequence omitted]

SEQ ID NO: 862808 - protein, 137 aa, Homo sapiens
SELRSRHCTPAWATERDAISKKKQKVPDLSTQVLVVRGLQSGSSFLLISHSFPYLSYAKGRVPGTVRFYHHDSYSDFSFQTSKQLAAAFQEEFTVREDLMGLAIGTHGANIQQARKVPGVTAIELGEETCTFRIYGE

SEQ ID NO: 862809 - protein, 795 aa, Homo sapiens
RSRRRWQGEVEAVERQRQQRVPGLRQQRGRRRAEAEVTKAAAAAAVSLTVAETKAAAADGERPGPGPLLVGCGRAAVGPARLPPPAAPPPAPPPGRRRGPGPARTQTAAAAAAGGVGGGGGAMGGLASGGDVEPGLPVEVRGSNGAFYKGFVKDVHEDSVTIFFENNWQSERQIPFGDVRLPPPADYNKEITEGDEVEVYSRANEQEPCGWWLARVRMMKGDFYVIEYAACDATYNEIVTLERLRPVNPNPLATKGSFFKVTMAVPEDLREACSNENVHKEFKKALGANCIFLNITNSELFILSTTEAPVKRASLLGDMHFRSLRTKLLLMSRNEEATKHLETSKQLAAAFQEEFTVREDLMGLAIGTHGANIQQARKVPGVTAIELGEETCTFRIYGETPEACRQARSYLEFSEDSVQVPRNLVGKVIGKNGKVIQEIVDKSGVVRVRVEGDNDKKNPREEGMVPFIFVGTRENISNAQALLEYHLSYLQEVEQLRLERLQIDEQLRQIGLGFRPPGSGRGSGGSDKAGYSTDESSSSSLHATRTYGGSYGGRGRGRRTGGPAYGPSSDVSTASETESEKREEPNRAGPGDRDPPTRGEESRRRPTGGRGRGPPPAPRPTSRYNSSSISSVLKDPDSNPYSLLDTSEPEPPVDSEPGEPPPASARRRRSRRRRTDEDRTVMDGGLESDGPNMTENGLEDESRPQRRNRSRRRRNRGNRTDGSISGDRQPVTVADYISRAESQSRQRPPLERTKPSEDSLSGQKGDSVSKLPKGPSENGELSAPLELGSMVNGVS

SEQ ID NO: 862810 - protein, 572 aa, Homo sapiens
STLEDPHGADDYNEIVTLERLRPVNPNPLATKGSFFKVTMAVPEDLREACSNENVHKEFKKALGANCIFLNITNSELFILSTTEAPVKRASLLGDMHFRSLRTKLLLMSRNEEATKHLETSKQLAAAFQEEFTVREDLMGLAIGTHGANIQQARKVPGVTAIELGEETCTFRIYGETPEACRQARSYLEFSEDSVQVPRNLVGKVIGKNGKVIQEIVDKSGVVRVRVEGDNDKKNPREEGMVPFIFVGTRENISNAQALLEYHLSYLQEVEQLRLERLQIDEQLRQIGLGFRPPGSGRGSGGSDKAGYSTDESSSSSLHATRTYGGSYGGRGRGRRTGGPAYGPSSDVSTASETESEKREEPNRAGPGDRDPPTRGEESRRRPTGGRGRGPPPAPRPTSRYNSSSISSVLKDPDSNPYSLLDTSEPEPPVDSEPGEPPPASARRRRSRRRRTDEDRTVMDGGLESDGPNMTENGLEDESRPQRRNRSRRRRNRGNRTDGSISGDRQPVTVADYISRAESQSRQRPPLERTKPSEDSLSGQKGDSVSKLPKGPSENGELSAPLELGSMVNGVS

SEQ ID NO: 862811 - protein, 775 aa, Homo sapiens
RSRRRWQGEVEAVERQRQQRVPGLRQQRGRRRAEAEVTKAAAAAAVSLTVAETKAAAADGERPGPGPLLVGCGRAAVGPARLPPPAAPPPAPPPGRRRGPGPARTQTAAAAAAGGVGGGGGAMGGLASGGDVEPGLPVEVRGSNGAFYKGFVKDVHEDSVTIFFENNWQSERQIPFGDVRLPPPADYNKEITEGDEVEVYSRANEQEPCGWWLARVRMMKGDFYVIEYAACDATYNEIVTLERLRPVNPNPLATKGSFFKVTMAVPEDLREACSNENVHKEFKKALGANCIFLNITNSELFILSTTEAPVKRASLLGDMHFRSLRTKLLLMSRNEEATKHLETSKQLAAAFQEEFTVREDLMGLAIGTHGANIQQARKVPGVTAIELGEETCTFRIYGETPEACRQARSYLEFSEDSVQVPRNLVGKVIGKNGKVIQEIVDKSGVVRVRVEGDNDKKNPREEGMVPFIFVGTRENISNAQALLEYHLSYLQEVEQLRLERLQIDEQLRQIGLGFRPPGSGRGSGGSDKAGYSTDESSSSSLHATRTYGGSYGGRGRGRRTGGPAYGPSSDVSTASETESEKREEPNRAGPGDRDPPTRGEESRRRPTGGRGRGPPPAPRPTSRYNSSSISSVLKDPDSNPYSLLDTSEPEPPVDSEPGEPPPASARRRRSRRRRTDEDRTVMDGGLESDGPNMTENGLEDESRPQRRNRSRRRRNRGNRTDGSISGDRQPVTVADYISRAESQSRQRPPLERTKPSEDSLSGQKRQLCLMEFRPV

SEQ ID NO: 862812 - protein, 434 aa, Homo sapiens; identical to SEQ ID NO: 862803

SEQ ID NO: 862813 - protein, 434 aa, Homo sapiens; identical to SEQ ID NO: 862803

SEQ ID NO: 862814 - protein, 791 aa, Homo sapiens
AGMACREGAGSRRARSNGCRLPRRGRRRGGRRRTVGPGPIHCRGRRALGPRVFRVMEALIPVINKLQDVFNTVGADIIQLPQIVVVGTQSSGKSSVLESLVGRDLLPRGTGIVTRRPLILQLVHVSQEDKRKTTGEENGVEAEEWGKFLHTKNKLYTDFDEIRQEIENETERISGNNKGVSPEPIHLKIFSPNVVNLTLVDLPGMTKVPVGDQPKDIELQIRELILRFISNPNSIILAVTAANTDMATSEALKISREVDPDGRRTLAVITKLDLMDAGTDAMDVLMGRVIPVKLGIIGVVNRSQLDINNKKSVTDSIRDEYAFLQKKYPSLANRNGTKYLARTLNRLLMHHIRDCLPELKTRINVLAAQYQSLLNSYGEPVDDKSATLLQLITKFATEYCNTIEGTAKYIETSELCGGARICYIFHETFGRTLESVDPLGGLNTIDILTAIRNATGPRPALFVPEVSFELLVKRQIKRLEEPSLRCVELVHEEMQRIIQHCSNYSTQELLRFPKLHDAIVEVVTCLLRKRLPVTNEMVHNLVAIELAYINTKHPDFADACGLMNNNIEEQRRNRLARELPSAVSRDKSSKVPSALAPASQEPSPAASAEADGKLIQDSRRETKNVASGGGGVGDGVQEPTTGNWRGMLKTSKAEELLAEEKSKPIPIMPASPQKGHAVNLLDVPVPVARKLSAREQRDCEVIERLIKSYFLIVRKNIQDSVPKAVMHFLVNHVKDTLQSELVGQLYKSSLLDDLLTESEDMAQRRKEAADMLKALQGASQIIAEIRETHLW

SEQ ID NO: 862815 - protein, 791 aa, Homo sapiens; identical to SEQ ID NO: 862814

SEQ ID NO: 862816 - protein, 791 aa, Homo sapiens; identical to SEQ ID NO: 862814

SEQ ID NO: 862817 - protein, 791 aa, Homo sapiens; identical to SEQ ID NO: 862814

SEQ ID NO: 862818 - protein, 791 aa, Homo sapiens; identical to SEQ ID NO: 862814

SEQ ID NO: 862819 - protein, 791 aa, Homo sapiens; identical to SEQ ID NO: 862814

SEQ ID NO: 862820 - protein, 763 aa, Homo sapiens
MACREGAGSRRARSNGCRLPRRGRRRGGRRRTVGPGPIHCRGRRALGPRVFRVMEALIPVINKLQDVFNTVGADIIQLPQIVVVGTQSSGKSSVLESLVGRDLLPRGTGIVTRRPLILQLVHVSQEDKRKTTGEENGVEAEEWGKFLHTKNKLYTDFDEIRQEIENETERISGNNKGVSPEPIHLKIFSPNVVNLTLVDLPGMTKVPVGDQPKDIELQIRELILRFISNPNSIILAVTAANTDMATSEALKISREVDPDGRRTLAVITKLDLMDAGTDAMDVLMGRVIPVKLGIIGVVNRSQLDINNKKSVTDSIRDEYAFLQKKYPSLANRNGTKYLARTLNRLLMHHIRDCLPELKTRINVLAAQYQSLLNSYGEPVDDKSATLLQLITKFATEYCNTIEGTAKYIETSELCGGARICYIFHETFGRTLESVDPLGGLNTIDILTAIRNATGPRPALFVPEVSFELLVKRQIKRLEEPSLRCVELVHEEMQRIIQHCSNYSTQELLRFPKLHDAIVEVVTCLLRKRLPVTNEMVHNLVAIELAYINTKHPDFADACGLMNNNIEEQRRNRLARELPSAVSRDKLIQDSRRETKNVASGGGGVGDGVQEPTTGNWRGMLKTSKAEELLAEEKSKPIPIMPASPQKGHAVNLLDVPVPVARKLSAREQRDCEVIERLIKSYFLIVRKNIQDSVPKAVMHFLVNHVKDTLQSELVGQLYKSSLLDDLLTESEDMAQRRKEAADMLKALQGASQIIAEIRETHLW

SEQ ID NO: 862821 - protein, 791 aa, Homo sapiens; identical to SEQ ID NO: 862814

SEQ ID NO: 862822 - protein, 690 aa, Homo sapiens
AGMACREGAGSRRARSNGCRLPRRGRRRGGRRRTVGPGPIHCRGRRALGPRVFRVMEALIPVINKLQDVFNTVGADIIQLPQIVVVGTQSSGKSSVLESLVGRDLLPRGTGIVTRRPLILQLVHVSQEDKRKTTGEENGVEAEEWGKFLHTKNKLYTDFDEIRQEIENETERISGNNKGVSPEPIHLKIFSPNVVNLTLVDLPGMTKVPVGDQPKDIELQIRELILRFISNPNSIILAVTAANTDMATSEALKISREVDPDGRRTLAVITKLDLMDAGTDAMDVLMGRVIPVKLGIIGVVNRSQLDINNKKSVTDSIRDEYAFLQKKYPSLANRNGTKYLARTLNRLLMHHIRDCLPELKTRINVLAAQYQSLLNSYGEPVDDKSATLLQLITKFATEYCNTIEGTAKYIETSELCGGARICYIFHETFGRTLESVDPLGGLNTIDILTAIRNATGPRPALFVPEVSFELLVKRQIKRLEEPSLRCVELVHEEMQRIIQHCSNYSTQELLRFPKLHDAIVEVVTCLLRKRLPVTNEMVHNLVAIELAYINTKHPDFADACGLMNNNIEEQRRNRLARELPSAVSRDKSSKVPSALAPASQEPSPAASAEADGKLIQDSRRETKNVASGGGGVGDGVQEPTTGNWRGMLKTSKAEELLAEEKSKPIPIMPASPQKGHAVNLLDVVSHDNLV

SEQ ID NO: 862823 - protein, 811 aa, Homo sapiens
AGMACREGAGSRRARSNGCRLPRRGRRRGGRRRTVGPGPIHCRGRRALGPRVFRVMEALIPVINKLQDVFNTVGADIIQLPQIVVVGTQSSGKSSVLESLVGRDLLPRGTGIVTRRPLILQLVHVSQEDKRKTTGEENGVEAEEWGKFLHTKNKLYTDFDEIRQEIENETERISGNNKGVSPEPIHLKIFSPNVVNLTLVDLPGMTKDTTLYRFISSLTGHSFSVSFAVSSHLPNVYTVPVGDQPKDIELQIRELILRFISNPNSIILAVTAANTDMATSEALKISREVDPDGRRTLAVITKLDLMDAGTDAMDVLMGRVIPVKLGIIGVVNRSQLDINNKKSVTDSIRDEYAFLQKKYPSLANRNGTKYLARTLNRLLMHHIRDCLPELKTRINVLAAQYQSLLNSYGEPVDDKSATLLQLITKFATEYCNTIEGTAKYIETSELCGGARICYIFHETFGRTLESVDPLGGLNTIDILTAIRNATGPRPALFVPEVSFELLVKRQIKRLEEPSLRCVELVHEEMQRIIQHCSNYSTQELLRFPKLHDAIVEVVTCLLRKRLPVTNEMVHNLVAIELAYINTKHPDFADACGLMNNNIEEQRRNRLARELPSAVSRDKSSKVPSALAPASQEPSPAASAEADGKVASGGGGVGDGVQEPTTGNWRGMLKTSKAEELLAEEKSKPIPIMPASPQKGHAVNLLDVPVPVARKLSAREQRDCEVIERLIKSYFLIVRKNIQDSVPKAVMHFLVNHVKDTLQSELVGQLYKSSLLDDLLTESEDMAQRRKEAADMLKALQGASQIIAEIRETHLW

SEQ ID NO: 862824 - protein, 743 aa, Homo sapiens
AGMACREGAGSRRARSNGCRLPRRGRRRGGRRRTVGPGPIHCRGRRALGPRVFRVMEALIPVINKLQDVFNTVGADIIQLPQIVVVGTQSSGKSSVLESLVGRDLLPRGTGIVTRRPLILQLVHVSQEDKRKTTGEENGVEAEEWGKFLHTKNKLYTDFDEIRQEIENETERISGNNKGVSPEPIHLKIFSPNVVNLTLVDLPGMTKVPVGDQPKDIELQIRELILRFISNPNSIILAVTAANTDMATSEALKISREVDPDGRRTLAVITKLDLMDAGTDAMDVLMGRVIPVKLGIIGVVNRSQLDINNKKSVTDSIRDEYAFLQKKYPSLANRNGTKYLARTLNRLLMHHIRDCLPELKTRINVLAAQYQSLLNSYGEPVDDKSATLLQLITKFATEYCNTIEGTAKYIETSELCGGARICYIFHETFGRTLESVDPLGGLNTIDILTAIRNATGPRPALFVPEVSFELLVKRQIKRLEEPSLRCVELVHEEMQRIIQHCSNYSTQELLRFPKLHDAIVEVVTCLLRKRLPVTNEMVHNLVAIELAYINTKHPDFADACGLMNNNIEEQRRNRLARELPSAVSRDKVASGGGGVGDGVQEPTTGNWRGMLKTSKAEELLADSNYASQSTKRSCREPARCASSCCTKTIYCEVIERLIKSYFLIVRKNIQDSVPKAVMHFLVNHVKDTLQSELVGQLYKSSLLDDLLTESEDMAQRRKEAADMLKALQGASQIIAEIRETHLW

SEQ ID NO: 862825 - protein, 592 aa, Homo sapiens
AGMACREGAGSRRARSNGCRLPRRGRRRGGRRRTVGPGPIHCRGRRALGPRVFRVMEALIPVINKLQDVFNTVGADIIQLPQIVVVGTQSSGKSSVLESLVGRDLLPRGTGIVTRRPLILQLVHVSQEDKRKTTGEENGVEAEEWGKFLHTKNKLYTDFDEIRQEIENETERISGNNKGVSPEPIHLKIFSPNVVNLTLVDLPGMTKVPVGDQPKDIELQIRELILRFISNPNSIILAVTAANTDMATSEALKISREVDPDGRRTLAVITKLDLMDAGTDAMDVLMGRVIPVKLGIIGVVNRSQLDINNKKSVTDSIRDEYAFLQKKYPSLANRNGTKYLARTLNRLLMHHIRDCLPELKTRINVLAAQYQSLLNSYGEPVDDKSATLLQLITKFATEYCNTIEGTAKYIETSELCGGARICYIFHETFGRTLESVDPLGGLNTIDILTAIRNATGPRPALFVPEVSFELLVKRQIKRLEEPSLRCVELVHEEMQRIIQHCSNYSTQELLRFPKLHDAIVEVVTCLLRKRLPVTNEMVHNLVAIELAYINTKHPDFADACGLMNNNIEEQRRNRLARELPSAVSRDKVKKCF

SEQ ID NO: 862826 - protein, 791 aa, Homo sapiens; identical to SEQ ID NO: 862814

SEQ ID NO: 862827 - protein, 791 aa, Homo sapiens; identical to SEQ ID NO: 862814

SEQ ID NO: 862828 - protein, 752 aa, Homo sapiens
MACREGAGSRRARSNGCRLPRRGRRRGGRRRTVGPGPIHCRGRRALGPRVFRVMEALIPVINKLQDVFNTVGADIIQLPQIVVVGTQSSGKSSVLESLVGRDLLPRGTGIVTRRPLILQLVHVSQEDKRKTTGEENGVEAEEWGKFLHTKNKLYTDFDEIRQEIENETERISGNNKGVSPEPIHLKIFSPNVVNLTLVDLPGMTKVPVGDQPKDIELQIRELILRFISNPNSIILAVTAANTDMATSEALKISREVDPDGRRTLAVITKLDLMDAGTDAMDVLMGRVIPVKLGIIGVVNRSQLDINNKKSVTDSIRDEYAFLQKKYPSLANRNGTKYLARTLNRLLMHHIRDCLPELKTRINVLAAQYQSLLNSYGEPVDDKSATLLQLITKFATEYCNTIEGTAKYIETSELCGGARICYIFHETFGRTLESVDPLGGLNTIDILTAIRNATGPRPALFVPEVSFELLVKRQIKRLEEPSLRCVELVHEEMQRIIQHCSNYSTQELLRFPKLHDAIVEVVTCLLRKRLPVTNEMVHNLVAIELAYINTKHPDFADACGLMNNNIEEQRRNRLARELPSAVSRDKVASGGGGVGDGVQEPTTGNWRGMLKTSKAEELLAEEKSKPIPIMPASPQKGHAVNLLDVPVPVARKLSAREQRDCEVIERLIKSYFLIVRKNIQDSVPKAVMHFLVNHVKDTLQSELVGQLYKSSLLDDLLTESEDMAQRRKEAADMLKALQGASQIIAEIRETHLW

SEQ ID NO: 862829 - protein, 778 aa, Homo sapiens
MACREGAGSRRARSNGCRLPRRGRRRGGRRRTVGPGPIHCRGRRALGPRVFRVMEALIPVINKLQDVFNTVGADIIQLPQIVVVGTQSSGKSSVLESLVGRDLLPRGTGIVTRRPLILQLVHVSQEDKRKTTGEENGVEAEEWGKFLHTKNKLYTDFDEIRQEIENETERISGNNKGVSPEPIHLKIFSPNVVNLTLVDLPGMTKVPVGDQPKDIELQIRELILRFISNPNSIILAVTAANTDMATSEALKISREVDPDGRRTLAVITKLDLMDAGTDAMDVLMGRVIPVKLGIIGVVNRSQLDINNKKSVTDSIRDEYAFLQKKYPSLANRNGTKYLARTLNRLLMHHIRDCLPELKTRINVLAAQYQSLLNSYGEPVDDKSATLLQLITKFATEYCNTIEGTAKYIETSELCGGARICYIFHETFGRTLESVDPLGGLNTIDILTAIRNATGPRPALFVPEVSFELLVKRQIKRLEEPSLRCVELVHEEMQRIIQHCSNYSTQELLRFPKLHDAIVEVVTCLLRKRLPVTNEMVHNLVAIELAYINTKHPDFADACGLMNNNIEEQRRNRLARELPSAVSRDKSSKVPSALAPASQEPSPAASAEADGKVASGGGGVGDGVQEPTTGNWRGMLKTSKAEELLAEEKSKPIPIMPASPQKGHAVNLLDVPVPVARKLSAREQRDCEVIERLIKSYFLIVRKNIQDSVPKAVMHFLVNHVKDTLQSELVGQLYKSSLLDDLLTESEDMAQRRKEAADMLKALQGASQIIAEIRETHLW

SEQ ID NO: 862830 - protein, 791 aa, Homo sapiens; identical to SEQ ID NO: 862814

SEQ ID NO: 862831 - protein, 592 aa, Homo sapiens; identical to SEQ ID NO: 862825

SEQ ID NO: 862832 - protein, 793 aa, Homo sapiens
AGMACREGAGSRRARSNGCRLPRRGRRRGGRRRTVGPGPIHCRGRRALGPRVFRVMEALIPVINKLQDVFNTVGADIIQLPQIVVVGTQSSGKSSVLESLVGRDLLPRGTGIVTRRPLILQLVHVSQEDKRKTTGEENDPATWKNSRHLSKGVEAEEWGKFLHTKNKLYTDFDEIRQEIENETERISGNNKGVSPEPIHLKIFSPNVVNLTLVDLPGMTKVPVGDQPKDIELQIRELILRFISNPNSIILAVTAANTDMATSEALKISREVDPDGRRTLAVITKLDLMDAGTDAMDVLMGRVIPVKLGIIGVVNRSQLDINNKKSVTDSIRDEYAFLQKKYPSLANRNGTKYLARTLNRLLMHHIRDCLPELKTRINVLAAQYQSLLNSYGEPVDDKSATLLQLITKFATEYCNTIEGTAKYIETSELCGGARICYIFHETFGRTLESVDPLGGLNTIDILTAIRNATGPRPALFVPEVSFELLVKRQIKRLEEPSLRCVELVHEEMQRIIQHCSNYSTQELLRFPKLHDAIVEVVTCLLRKRLPVTNEMVHNLVAIELAYINTKHPDFADACGLMNNNIEEQRRNRLARELPSAVSRDKSSKVPSALAPASQEPSPAASAEADGKVASGGGGVGDGVQEPTTGNWRGMLKTSKAEELLAEEKSKPIPIMPASPQKGHAVNLLDVPVPVARKLSAREQRDCEVIERLIKSYFLIVRKNIQDSVPKAVMHFLVNHVKDTLQSELVGQLYKSSLLDDLLTESEDMAQRRKEAADMLKALQGASQIIAEIRETHLW

SEQ ID NO: 862833 - protein, 752 aa, Homo sapiens; identical to SEQ ID NO: 862828

SEQ ID NO: 862834 - protein, 761 aa, Homo sapiens
MACREGAGSRRARSNGCRLPRRGRRRGGRRRTVGPGPIHCRGRRALGPRVFRVMEALIPVINKLQDVFNTVGADIIQLPQIVVVGTQSSGKSSVLESLVGRDLLPRGTGIVTRRPLILQLVHVSQEDKRKTTGEENGVEAEEWGKFLHTKNKLYTDFDEIRQEIENETERISGNNKGVSPEPIHLKIFSPNVVNLTLVDLPGMTKVPVGDQPKDIELQIRELILRFISNPNSIILAVTAANTDMATSEALKISREVDPDGRRTLAVITKLDLMDAGTDAMDVLMGRVIPVKLGIIGVVNRSQLDINNKKSVTDSIRDEYAFLQKKYPSLANRNGTKYLARTLNRLLMHHIRDCLPELKTRINVLAAQYQSLLNSYGEPVDDKSATLLQLITKFATEYCNTIEGTAKYIETSELCGGARICYIFHETFGRTLESVDPLGGLNTIDILTAIRNATGPRPALFVPEVSFELLVKRQIKRLEEPSLRCVELVHEEMQRIIQHCSNYSTQELLRFPKLHDAIVEVVTCLLRKRLPVTNEMVHNLVAIELAYINTKHPDFADACGLMNNNIEEQRRNRLARELPSAVSRDKSSKVPSALAPASQEPSPAASAEADGKVASGGGGVGDGVQEPTTGNWRGMLKTSKAEELLAEEKSKPIPIMPASPQKGHAVNLLDVPVPVARKLSAREQRDCEVIERLIKSYFLIVRKNIQDSVPKAVMHFLVNHVKDTLQSELVGQLYKSSLLDDLLTESEDMAQRRKEAADMLKL

SEQ ID NO: 862835 - protein, 435 aa, Homo sapiens
AGMACREGAGSRRARSNGCRLPRRGRRRGGRRRTVGPGPIHCRGRRALGPRVFRVMEALIPVINKLQDVFNTVGADIIQLPQIVVVGTQSSGKSSVLESLVGRDLLPRGTGIVTRRPLILQLVHVSQEDKRKTTGEENGVEAEEWGKFLHTKNKLYTDFDEIRQEIENETERISGNNKGVSPEPIHLKIFSPNVVNLTLVDLPGMTKVPVGDQPKDIELQIRELILRFISNPNSIILAVTAANTDMATSEALKISREVDPDGRRTLAVITKLDLMDAGTDAMDVLMGRVIPVKLGIIGVVNRSQLDINNKKSVTDSIRDEYAFLQKKYPSLANRNGTKYLARTLNRLLMHHIRDCLPELKTRINVLAAQYQSLLNSYGEPVDDKSATLLQLITKFATEYCNTIEGTAKYIETSELCGGVEIDRPISTQVYFKRKA

SEQ ID NO: 862836 - protein, 194 aa, Homo sapiens
MEEKLKKTKIIFVVGGPGSGKGTQCEKIVQKYGYTHLSTGDLLRSEVSSGSARGKKLSEIMEKGQLVPLETVLDMLRDAMVAKVNTSKGFLIDGYPREVQQGEEFERRIGQPTLLLYVDAGPETMTQRLLKRGETSGRVDDNEETIKKRLETYYKATEPVIAFYEKRGIVRKVNAEGSVDSVFSQVCTHLDALK

SEQ ID NO: 862837 - protein, 243 aa, Homo sapiens
VAKPPLPGEAGDGPAQGLRGEGQGAQETRQDGTMGCCSSSDPRREDDLRAREKLKKTKIIFVVGGPGSGKGTQCEKIVQKYGYTHLSTGDLLRSEVSSGSARGKKLSEIMEKGQLVPLETVLDMLRDAMVAKVNTSKGFLIDGYPREVQQGEEFERRIGQPTLLLYVDAGPETMTQRLLKRGETSGRVDDNEETIKKRLETYYKATEPVIAFYEKRGIVRKVNAEGSVDSVFSQVCTHLDALK

SEQ ID NO: 862838 - protein, 194 aa, Homo sapiens; identical to SEQ ID NO: 862836

SEQ ID NO: 862839 - protein, 194 aa, Homo sapiens; identical to SEQ ID NO: 862836

SEQ ID NO: 862840 - protein, 234 aa, Homo sapiens
MEEKLKKTKIIFVVGGPGSGKGTQCEKIVQKYGYTHLSTGDLLRSEVSSGSARGKKLSEIMEKGQLVPLETVLDMLRDAMVAKVNTSKGFLIDGYPREVQQGEEFERRIGQPTLLLYVDAGPETMTQRLLKRGETSGRVDDNEETIKKRLETYYKATEPVIAFYEKRGIVRKVNAEGSVDSVFSICFFLFSCSTLSSSFLIFSSYSSLIRAFSLSSSTLWSSCIACVCFWISSS

SEQ ID NO: 862841 - protein, 194 aa, Homo sapiens; identical to SEQ ID NO: 862836

SEQ ID NO: 862842 - protein, 194 aa, Homo sapiens; identical to SEQ ID NO: 862836

SEQ ID NO: 862843 - protein, 138 aa, Homo sapiens
MRPQDHVFRLGAPSKAILSFFSSQWPVRCVFLHLEWRPGGSGDGGGVRSQARLAFPVPTSPCLCDHGQVTSPLRAPIPSRAKGDQTLPSRSSGSRRGGAPWYTRKNSHRSWEKSLSSECRRGEGKDIPGHRARGLSAP

SEQ ID NO: 862844 - protein, 455 aa, Homo sapiens
RVGPRTPEVVRRSLAAEGAGSRGLDCFRLARRSKMADISLDELIRKRGAAAKGRLNARPGVGGVRSRVGIQQGLLSQSTRTATFQQRFDARQKIGLSDARLKLGVKDAREKLLQKDARFRIKGKVQDAREMLNSRKQQTTVPQKPRQVADAREKISLKRSSPAAFINPPIGTVTPALKLTKTIQVPQQKAMAPLHPHPAGMRINVVNNHQAKQNLYDLDEDDDGIASVPTKQMKFAASGGFLHHMAGLSSSKLSMSKALPLTKVVQNDAYTAPALPSSIRTKALTNMSRTLVNKEEPPKELPAAEPVLSPLEGTKMTVNNLHPRVTEEDIVELFCVCGALKRARLVHPGVAEVVFVKKDDAITAYKKYNNRCLDGQPMKCNLHMNGNVITSDQPILLRLSDSPSMKKESELPRRVNSASSSNPPAEVDPDTILKALFKSSGASVTTQPTEFKIKL

SEQ ID NO: 862845 - protein, 421 aa, Homo sapiens
MADISLDELIRKRGAAAKGRLNARPGVGGVRSRVGIQQGLLSQSTRTATFQQRFDARQKIGLSDARLKLGVKDAREKLLQKDARFRIKGKVQDAREMLNSRKQQTTVPQKPRQVADAREKISLKRSSPAAFINPPIGTVTPALKLTKTIQVPQQKAMAPLHPHPAGMRINVVNNHQAKQNLYDLDEDDDGIASVPTKQMKFAASGGFLHHMAGLSSSKLSMSKALPLTKVVQNDAYTAPALPSSIRTKALTNMSRTLVNKEEPPKELPAAEPVLSPLEGTKMTVNNLHPRVTEEDIVELFCVCGALKRARLVHPGVAEVVFVKKDDAITAYKKYNNRCLDGQPMKCNLHMNGNVITSDQPILLRLSDSPSMKKESELPRRVNSASSSNPPAEVDPDTILKALFKSSGASVTTQPTEFKIKL

SEQ ID NO: 862846 - protein, 377 aa, Homo sapiens
RVGPRTPEVVRRSLAAEGAGSRGLDCFRLARRSKMADISLDELIRKRGAAAKGRLNARPGVGGVRSRVGIQQGLLSQSTRTATFQQRFDARQKIGLSDARLKLGVKDAREKLLQKDARFRIKGKVQDAREMLNSRKQQTTVPQKPRQVADAREKISLKRSSPAAFINPPIGTVTPALKLTKTIQVPQQKAMAPLHPHPAGMRINVVNNHQAKQNLYDLDEDDDGIASVPTKQMKFAASGGFLHHMAGLSSSKLSMSKALPLTKVVQNDAYTAPALPSSIRTKALTNMSRTLVNKEEPPKELPAAEPVLSPLEGTKMTVNNLHPRVTEEDIVELFCVCGALKRARLVHPGVAEVVFVKKDDAITAYKKYNNRCLDAAE

SEQ ID NO: 862847 - protein, 397 aa, Homo sapiens
RVGPRTPEVVRRSLAAEGAGSRGLDCFRLARRSKMADISLDELIRKRGAAAKGRLNARPGVGGVRSRVGIQQGLLSQSTRTATFQQRFDARQKIGLSDARLKLGVKDAREKLLQKDARFRIKGKVQDAREMLNSRKQQTTVPQKPRQVADAREKISLKRSSPAAFINPPIGTVTPALKLTKTIQVPQQKAMAPLHPHPAGMRINVVNNHQAKQNLYDLDEDDDGIASVPTKQMKFAASGGFLHHMAGLSSSKLSMSKALPLTKVVQNDAYTAPALPSSIRTKALTNMSRTLVNKEEPPKELPAAEPVLSPLEGTKMTVNNLHPRVTEEDIVELFCVCGALKRARLVHPGVAEVVFVKKDDAITAYKKYNNRCLDGQPMKCNLHMNGNVITSDQPILL

SEQ ID NO: 862848 - protein, 477 aa, Homo sapiens
RVGPRTPEVVRRSLAAEGAGSRGLDCFRLARRSKMADISLDELIRKRGAAAKGRLNARPGVGGVRSRVGIQQGLLSQSTRTATFQQRFDARQKIGLSDARLKLGVKDAREKLLQKDARFRIKGKVQDAREMLNSRKQQTTVPQKPRQVADAREKISLKRSSPAAFINPPIGTVTPALKLTKTIQVPQQKAMAPLHPHPAGMRINVVNNHQAKQNLYDLDEDDDGIASVPTKQMKFAASGGFLHHMGPGLSRIRLLKSAIKGTISLLRAGLSSSKLSMSKALPLTKVVQNDAYTAPALPSSIRTKALTNMSRTLVNKEEPPKELPAAEPVLSPLEGTKMTVNNLHPRVTEEDIVELFCVCGALKRARLVHPGVAEVVFVKKDDAITAYKKYNNRCLDGQPMKCNLHMNGNVITSDQPILLRLSDSPSMKKESELPRRVNSASSSNPPAEVDPDTILKALFKSSGASVTTQPTEFKIKL

SEQ ID NO: 862849 - protein, 108 aa, Homo sapiens
MPHPSSLSLLGVFAGRGLCCEPSRFSPRLALNHTLVLCSRQLSSGWAFERLSLPLCSAWVWSLFEWKRSVCSWLSISGLSCLQDSGQGCLEAYIQLPPRGTVCSHLCE

SEQ ID NO: 862850 - protein, 455 aa, Homo sapiens; identical to SEQ ID NO: 862844

SEQ ID NO: 862851 - protein, 455 aa, Homo sapiens; identical to SEQ ID NO: 862844

SEQ ID NO: 862852 - protein, 455 aa, Homo sapiens; identical to SEQ ID NO: 862844

SEQ ID NO: 862853 - protein, 455 aa, Homo sapiens; identical to SEQ ID NO: 862844

SEQ ID NO: 862854 - protein, 455 aa, Homo sapiens; identical to SEQ ID NO: 862844

SEQ ID NO: 862855 - protein, 414 aa, Homo sapiens
RVGPRTPEVVRRSLAAEGAGSRGLDCFRLARRSKMADISLDELIRKRGAAAKGRLNARPGVGGVRSRVGIQQGLLSQSTRTATFQQRFDARQKIGLSDARLKLGVKDAREKLLQKDARFRIKGKVQDAREMLNSRKQQTTVPQKPRQVADAREKISLKRSSPAAFINPPIGTVTPALKLTKTIQVPQQKAMAPLHPHPAGMRINVVNNHQAKQNLYDLDEDDDGIASVPTKQMKFAASGGFLHHMAGLSSSKLSMSKALPLTKVVQNDAYTAPALPSSIRTKALTNMSRTLVNKEEPPKELPAAEPVLSPLEGTKMTVNNLHPRVTEEDIVELFCVCGALKRARLVHPGVAEVVFVKKDDAITAYKKYNNRCLDGQPMKCNLHMNGNVITSDQPILLAATWPSGAGAIGDHLVH

SEQ ID NO: 862856 - protein, 115 aa, Homo sapiens
QSVVRSQNLDTLERSNRMNDLGNISRDSWAVYLKYVLGMGQDIKQSLDKFLILKYFLMVLRCIEPAISNYVFNEFLVVLIICHVWDLEPSSAVPFIGLELNHSFFDLEVKAMGRS

SEQ ID NO: 862857 - protein, 343 aa, Homo sapiens
RVGPRTPEVVRRSLAAEGAGSRGLDCFRLARRSKMADISLDELIRKRGAAAKGRLNARPGVGGVRSRVGIQQGLLSQSTRTATFQQRFDARQKIGLSDARLKLGVKDAREKLLQKDARFRIKGKVQDAREMLNSRKQQTTVPQKPRQVADAREKISLKRSSPAAFINPPIGTVTPALKLTKTIQVPQQKAMAPLHPHPAGMRINVVNNHQAKQNLYDLDEDDDGIASVPTKQMKFAASGGFLHHMAGLSSSKLSMSKALPLTKVVQNDAYTAPALPSSIRTKALTNMSRTLVNKEEPPKELPAAEPVLSPLEGTKMTVLLHFPCLYVTHLCLLCRRRGRGIKR

SEQ ID NO: 862858 - protein, 252 aa, Homo sapiens
RVGPRTPEVVRRSLAAEGAGSRGLDCFRLARRSKMADISLDELIRKRGAAAKGRLNARPGVGGVRSRVGIQQGLLSQSTRTATFQQRFDARQKIGLSDARLKLGVKDAREKLLQKDARFRIKGKVQDAREMLNSRKQQTTVPQKPRQVADAREKISLKRSSPAAFINPPIGTVTPALKLTKTIQVPQQKAMAPLHPHPAGMRINVVNNHQAKQNLYDLDEDDDGIASVPTKQMKFAASGGFLHHMGPGLSSN

SEQ ID NO: 862859 - protein, 196 aa, Homo sapiens
RVGPRTPEVVRRSLAAEGAGSRGLDCFRLARRSKMADISLDELIRKRGAAAKGRLNARPGVGGVRSRVGIQQGLLSQSTRTATFQQRFDARQKIGLSDARLKLGVKDAREKLLQKDARFRIKGKVQDAREMLNSRKQQTTVPQKPRQVADAREKISLKRSSPAAFINPPIGTVTPALKLTKTIQVSCGFCHEFPES

SEQ ID NO: 862860 - protein, 299 aa, Homo sapiens
QERCSECRHSGVNFSDAGQECQDHIPGPLALQKRGAAAKGRLNARPGVGGVRSRVGIQQGLLSQSTRTATFQQRFDARQKIGLSDARLKLGVKDAREKLLQKDARFRIKGKVQDAREMLNSRKQQTTVPQKPRQVADAREKISLKRSSPAAFINPPIGTVTPALKLTKTIQVPQQKAMAPLHPHPAGMRINVVNNHQAKQNLYDLDEDDDGIASVPTKQMKFAASGGFLHHMVWHFMFSYTACLIRQVGEVVLNRTCCFFCFETTSRSSPPGCWSAMAQSWLTATSVSWVQAIILPQPP

SEQ ID NO: 862861 - protein, 223 aa, Homo sapiens [sequence omitted]

SEQ ID NO: 862862 - protein, 442 aa, Homo sapiens
RVGPRTPEVVRRSLAAEGAGSRGLDCFRLARRSKMADISLDELIRKRGAAAKGRLNARPGVGGVRSRVGIQQGLLSQSTRTATFQQRFDARQKIGLSDARLKLGVKDAREKLLQKDARFRIKGKVQDAREMLNSRKQQTTVPQKPRQVADAREKISLKRSSPAAFINPPIGTVTPALKLTKTIQVPQQKAMAPLHPHPAGMRINVVNNHQAKQNLYDLDEDDDGIASVPTKQMKFAASGGFLHHMAGLSSSKLSMSKALPLTKVVQNDAYTAPALPSSIRTKALTNMSRTLVNKEEPPKELPAAEPVLSPLEGTKMTVNNLHPRVTEEDIVELFCVCGALKRARLVHPGVAEVVFVKKDDAITAYKKYNNRCLDGQPMKCNLHMNGNVITSDQPILLRLSDSPSMKKESELPRRVALFPQGKAYDQWAIGLETPDCGKGCQG

SEQ ID NO: 862863 - protein, 455 aa, Homo sapiens; identical to SEQ ID NO: 862844

SEQ ID NO: 862864 - protein, 455 aa, Homo sapiens; identical to SEQ ID NO: 862844

SEQ ID NO: 862865 - protein, 455 aa, Homo sapiens; identical to SEQ ID NO: 862844

SEQ ID NO: 862866 - protein, 455 aa, Homo sapiens; identical to SEQ ID NO: 862844

SEQ ID NO: 862867 - protein, 455 aa, Homo sapiens; identical to SEQ ID NO: 862844

SEQ ID NO: 862868 - protein, 378 aa, Homo sapiens
RVGPRTPEVVRRSLAAEGAGSRGLDCFRLARRSKMADISLDELIRKRGAAAKGRLNARPGVGGVRSRVGIQQGLLSQSTRTATFQQRFDARQKIGLSDARLKLGVKDAREKLLQKDARFRIKGKVQDAREMLNSRKQQTTVPQKPRQVADAREKISLKRSSPAAFINPPIGTVTPALKLTKTIQVPQQKAMAPLHPHPAGMRINVVNNHQAKQNLYDLDEDDDGIASVPTKQMKFAASGGFLHHMAGLSSSKLSMSKALPLTKVVQNDAYTAPALPSSIRTKALTNMSRTLVNKEEPPKELPAAEPVLSPLEGTKMTVNNLHPRVTEEDIVELFCVCGALKRARLVHPGVAEVLLHFPCLYVTHLCLLCRRRGRGIKR

SEQ ID NO: 862869 - protein, 252 aa, Homo sapiens; identical to SEQ ID NO: 862858

SEQ ID NO: 862870 - protein, 312 aa, Homo sapiens
RVGPRTPEVVRRSLAAEGAGSRGLDCFRLARRSKMADISLDELIRKRGAAAKGRLNARPGVGGVRSRVGIQQGLLSQSTRTATFQQRFDARQKIGLSDARLKLGVKDAREKLLQKDARFRIKGKVQDAREMLNSRKQQTTVPQKPRQVADAREKISLKRSSPAAFINPPIGTVTPALKLTKTIQVPQQKAMAPLHPHPAGMRINVVNNHQAKQNLYDLDEDDDGIASVPTKQMKFAASGGFLHHMVWHFMFSYTACLIRQVGEVVLNRTCCFFCFETTSRSSPPGCWSAMAQSWLTATSVSWVQAIILPQPP

SEQ ID NO: 862871 - protein, 319 aa, Homo sapiens
MFISGSVAGSSDSRVPADADININSIKDYKINSNPYFSLMVRVNSDGGKYPELSLEKLLDREEQRSHSLILTALDGGDPPRSATAHIEISVKDTNDNPPVFSRDEYRISLSENLPPGSPVLQVTATDQDEGVNAEINYYFRSTAQSTKHMFSLDEKTGMIKNNQSFDFEDVERYTMEVEAKDGGGLSTQCKVIIEILDENDNSPEIIITSLSDQILENSPPGMVVALFKTRDLDFGGNGEVRCNIETDIPFKIYFFFFPHLTVVLLAIGMFFTAWFFVYEVTSTKYTRDIYKELLISLVASLFMGFGVLFLLLWVGIYV

SEQ ID NO: 862872 - protein, 112 aa, Homo sapiens
EGQARWFTPVIPALWEAEASGSGGQKFKTSLAQQELEAMSRYTSPVNPAVFPHLTVVLLAIGMFFTAWFFVYEVTSTKYTRDIYKELLISLVASLFMGFGVLFLLLWVGIYV

SEQ ID NO: 862873 - protein, 77 aa, Homo sapiens
NRRTTSPSMPLAPEALPFPVVLGACSCRRVLPVAERRISLRGAKFFPHLTVVLLAIGMFFTAWFFVYPFTEQPEDQH

SEQ ID NO: 862874 - protein, 143 aa, Homo sapiens
HDPLVDGDRLSGMGRDTRHLCLFPCPSYGFEPNVTLSSELTWPKASICLWDVPPRSVDAGIPWLYIYILRSQTPVTWRGCWEVSWLKGGQDPGLKTCCRQSTKQATRNQLWWLILRGVCSIALAPGAQGCRERRRKEGPLVLF

SEQ ID NO: 862875 - protein, 91 aa, Homo sapiens
MWGEPGRPPDKKLLETQPTRGGGRGTPQEENVHRRSKRVHIETSRVKNAEGGGVPPKRKRPRGKRGLCVTTPQEAWHGTRRTQKHRGDEKP

SEQ ID NO: 862876 - protein, 102 aa, Homo sapiens
MSALHYSAGVETYYMPPWRPDSGQLQIEAVEGLEALGRLDVLGLAQHADVHCHLEVVLLLAHKGVVAHRKVEALVRIHAVGFTFISVQEKEQTQPKRSTRPA

SEQ ID NO: 862877 - protein, 233 aa, Homo sapiens
MATGQKLMRAVRVFEFGGPEVLKLRSDIAVPIPKDHQVLIKVHACGVNPVETYIRSGTYSRKPLLPYTPGSDVAGVIEAVGDNASAFKKGDRVFTSSTISGGYAEYALAADHTVYKLPEKLDFKQGAAIGIPYFTAYRALIHRVQLCTNSPLMCDSWILFTLVPSFWYLKDSGFGRSTFAWSYKSVPRLPLSGIVENYEELMNCPTRLCWSIKKFGQKFSNNCYGPSLLGLIV

SEQ ID NO: 862878 - protein, 329 aa, Homo sapiens
MATGQKLMRAVRVFEFGGPEVLKLRSDIAVPIPKDHQVLIKVHACGVNPVETYIRSGTYSRKPLLPYTPGSDVAGVIEAVGDNASAFKKGDRVFTSSTISGGYAEYALAADHTVYKLPEKLDFKQGAAIGIPYFTAYRALIHSACVKAGESVLVHGASGGVGLAACQIARAYGLKILGTAGTEEGQKIVLQNGAHEVFNHREVNYIDKIKKYVGEKGIDIIIEMLANVNLSKDLSLLSHGGRVIVVGSRGTIEINPRDTMAKESSIIGVTLFSSTKEEFQQYAAALQAGMEIGWLKPVIGSQYPLEKVAEAHENIIHGSGATGKMILLL

SEQ ID NO: 862879 - protein, 329 aa, Homo sapiens; identical to SEQ ID NO: 862878

SEQ ID NO: 862880 - protein, 295 aa, Homo sapiens
MATGQKLMRAVRVFEFGGPEVLKLRSDIAVPIPKDHQVLIKVHACGVNPVETYIRSGTYSRKPLLPYTPGSDVAGVIEAVGDNASAFKKGDRVFTSSTISGGYAEYALAADHTVYKLPEKLDFKQGAAIGIPYFTAYRALIHSACVKAGESVLVHGASGGVGLAACQIARAYGLKILGTAGTEEGQKIVLQNGAHEVFNHREVNYIDKIKVVGSRGTIEINPRDTMAKESSIIGVTLFSSTKEEFQQYAAALQAGMEIGWLKPVIGSQYPLEKVAEAHENIIHGSGATGKMILLL

SEQ ID NO: 862881 - protein, 311 aa, Homo sapiens
MATGQKLMRAVRVFEFGGPEVLKLRSDIAVPIPKDHQVLIKVHACGVNPVETYIRSGTYSSVGDNASAFKKGDRVFTSSTISGGYAEYALAADHTVYKLPEKLDFKQGAAIGIPYFTAYRALIHSACVKAGESVLVHGASGGVGLAACQIARAYGLKILGTAGTEEGQKIVLQNGAHEVFNHREVNYIDKIKKYVGEKGIDIIIEMLANVNLSKDLSLLSHGGRVIVVGSRGTIEINPRDTMAKESSIIGVTLFSSTKEEFQQYAAALQAGMEIGWLKPVIGSQYPLEKVAEAHENIIHGSGATGKMILLL

SEQ ID NO: 862882 - protein, 257 aa, Homo sapiens
MATGQKLMRAVRVFEFGGPEVLKLRSDIAVPIPKDHQVLIKVHACGVNPVETYIRSGTYSRKPLLPYTPGSDVAGVIEAVGDNASAFKVGLAACQIARAYGLKILGTAGTEEGQKIVLQNGAHEVFNHREVNYIDKIKKYVGEKGIDIIIEMLANVNLSKDLSLLSHGGRVIVVGSRGTIEINPRDTMAKESSIIGVTLFSSTKEEFQQYAAALQAGMEIGWLKPVIGSQYPLEKVAEAHENIIHGSGATGKMILLL

SEQ ID NO: 862883 - protein, 263 aa, Homo sapiens
MATGQKLMRAVRVFEFGGPEVLKLRSDIAVPIPKDHQVLIKVHACGVNPVETYIRSGTYSRKPLLPYTPGSDVAGVIEAVGDNASAFKKGDRVFTSSTISGGYAEYALAADHTVYKLPEKLDFKQGAAIGIPYFTAYRALIHSACVKAGESVLVHGASGGVGLAACQIARAYGLKILGTAGTEEGQKIVLQNGAHEVFNHREVNYIDKIKKYVGEKGIDIIIEMLANVNLSKDLSLLSHGGRVICWQCLDSGHCLDSGHCLDS

SEQ ID NO: 862884 - protein, 254 aa, Homo sapiens
MATGQKLMRAVRVFEFGGPEVLKLRSDIAVPIPKDHQVLIKVHACGVNPVETYIRSGTYSRKPLLPYTPGSDVAGVIEAVGDNASAFKKGDRVFTSSTISGGYAEYALAADHTVYKLPEKLDFKQGAAIGIPYFTAYRALIHSACVKAGESVLVHGASGGVGLAACQIARAYGLKILGTAGTEEGQKIVLQNGAHEVFNHREVNYIDKIKKYVGEKGIDIIIEMLANVNLSKDLSLLSHGGRVICWQQRNYELG

SEQ ID NO: 862885 - protein, 125 aa, Homo sapiens
MATGQKLMRAVRVFEFGGPEVLKLRSDIAVPIPKDHQVLIKVHACGVNPVETYIRSGTYSRKPLLPYTPGSDVAGVIEAVGDNASAFKKGDRVFTSSTISGGYAEYALAADHTVYKLPEKLEFMM

SEQ ID NO: 862886 - protein, 329 aa, Homo sapiens; identical to SEQ ID NO: 862878

SEQ ID NO: 862887 - protein, 114 aa, Homo sapiens
MATGQKLMRAVRVFEFGGPEVLKLRSDIAVPIPKDHQVLIKVHACGVNPVETYIRSGTYSRKPLLPYTPGSDVAGVIEAVGDNASAFKCLCESWRECSGSWGKWRSWISSMPNC

SEQ ID NO: 862888 - protein, 329 aa, Homo sapiens; identical to SEQ ID NO: 862878

SEQ ID NO: 862889 - protein, 329 aa, Homo sapiens; identical to SEQ ID NO: 862878

SEQ ID NO: 862890 - protein, 311 aa, Homo sapiens; identical to SEQ ID NO: 862881

SEQ ID NO: 862891 - protein, 96 aa, Homo sapiens
GAGGEKLISHVQKLHKLYHILVNTALPAEVRFAQTLRLPFPELLRCDPWVTDSGSALGSFMVASSLPGGSHIEASGGRKGPNFLFVLNLGNSSAFA

SEQ ID NO: 862892 - protein, 128 aa, Homo sapiens
MSGGRRKEEPPQPQLANGALKVSVWSKVLRSDAAWEDKDEFLDVIYWFRQIIAVVLGVIWGVLPLRGFLGIAGFCLINAGVLYLYFSNYLQIDEEEYGGTWELTKEGFMTSFAFVHGHLDHLLHCHPL

SEQ ID NO: 862893 - protein, 128 aa, Homo sapiens; identical to SEQ ID NO: 862892

SEQ ID NO: 862894 - protein, 120 aa, Homo sapiens
MSGGRRKEEPPQPQLANGALKVSVWSKVLRSDAAWEDKDEFLDVIYWFRQIIAVVLGVIWGVLPLRGFLGIAGFCLINAGVLYLYFSNYLQIDEEEYGGTWELTKEGFMTSFAFVHGMCS

SEQ ID NO: 862895 - protein, 128 aa, Homo sapiens; identical to SEQ ID NO: 862892

SEQ ID NO: 862896 - protein, 128 aa, Homo sapiens; identical to SEQ ID NO: 862892

SEQ ID NO: 862897 - protein, 128 aa, Homo sapiens; identical to SEQ ID NO: 862892

SEQ ID NO: 862898 - protein, 128 aa, Homo sapiens; identical to SEQ ID NO: 862892

SEQ ID NO: 862899 - protein, 120 aa, Homo sapiens; identical to SEQ ID NO: 862894

SEQ ID NO: 862900 - protein, 32 aa, Homo sapiens
MFGTCSLLLQFCLINAGVLYLYFSNYLQIDEE

SEQ ID NO: 862901 - protein, 123 aa, Homo sapiens
MSGGRRKEEPPQPQLANGALKVSVWSKVLRSDAAWEDKDEFLDVIYWFRQIIAVVLGVIWGVLPLRGFLGIAGKGHCCSGAVCVCDDYKQRSSPTVALLGLVHHSSGASQVIWIIFYTAIHYD

SEQ ID NO: 862902 - protein, 165 aa, Homo sapiens
MSGGRRKEEPPQPQLANGALKVSVWSKVLRSDAAWEDKDEFLDVIYWFRQIIAVVLGVIWGVLPLRGFLGIAGKGHCCSGAVCVCDDYKQRSSPTVALLGLVHHSSGASQFCLINAGVLYLYFSNYLQIDEEEYGGTWELTKEGFMTSFAFVHGHLDHLLHCHPL

SEQ ID NO: 862903 - protein, 128 aa, Homo sapiens; identical to SEQ ID NO: 862892

SEQ ID NO: 862904 - protein, 128 aa, Homo sapiens; identical to SEQ ID NO: 862892

SEQ ID NO: 862905 - protein, 128 aa, Homo sapiens; identical to SEQ ID NO: 862892

SEQ ID NO: 862906 - protein, 128 aa, Homo sapiens; identical to SEQ ID NO: 862892

SEQ ID NO: 862907 - protein, 104 aa, Homo sapiens
MPLKLEEAISFLGPTTRSPGTREKLSVPQILPPERLLAFYLVALLRARWVTSSCTGATRENSARVLALVVSVQTGTVLIRKYGLNMCRQCFRQYAKDIGFIKLD

SEQ ID NO: 862908 - protein, 80 aa, Homo sapiens
PTPPGTHLGRCEARLMEEALLRARWVTSSCTGATRENSARVLALVVSVQTGTVLIRKYGLNMCRQCFRQYAKDIGFIKLD

SEQ ID NO: 862909 - protein, 78 aa, Homo sapiens
DPELNFFPPPPRFYLVALLRARWVTSSCTGATRENSARVLALVVSVQTGTVLIRKYGLNMCRQCFRQYAKDIGFIKLD

SEQ ID NO: 862910 - protein, 77 aa, Homo sapiens
GTRRNGHYGRGFYLVALLRARWVTSSCTGATRENSARVLALVVSVQTGTVLIRKYGLNMCRQCFRQYAKDIGFIKLD

SEQ ID NO: 862911 - protein, 70 aa, Homo sapiens
LLPRCTAESRWSQQCTEPPRKFGQGSRSCRVWFNTRGNRAPGIPGEKLIGASKLIVCPAQGWFFPPGSKA

SEQ ID NO: 862912 - protein, 70 aa, Homo sapiens
MRRGNSEDRKRAQETQKKREHRGNAKDSRTEGKRTRGTKGKNQIATKARAAEKRKQNKSVESTKKNDSRY

SEQ ID NO: 862913 - protein, 78 aa, Homo sapiens; identical to SEQ ID NO: 862909

SEQ ID NO: 862914 - protein, 78 aa, Homo sapiens; identical to SEQ ID NO: 862909

SEQ ID NO: 862915 - protein, 98 aa, Homo sapiens
RIPRVSAVDALRVAGARRAAVSRGKAGVPLRYRERHLELSEWPRKPSEGAFPGADGLLVVLVAALRRHTWHVEGGLYMAVFDLAIPAEQIIFHGGETT

SEQ ID NO: 862916 - protein, 107 aa, Homo sapiens [sequence omitted]

SEQ ID NO: 862917 - protein, 98 aa, Homo sapiens; identical to SEQ ID NO: 862915

SEQ ID NO: 862918 - protein, 98 aa, Homo sapiens; identical to SEQ ID NO: 862915

SEQ ID NO: 862919 - protein, 98 aa, Homo sapiens; identical to SEQ ID NO: 862915

SEQ ID NO: 862920 - protein, 98 aa, Homo sapiens; identical to SEQ ID NO: 862915

SEQ ID NO: 862921 - protein, 98 aa, Homo sapiens; identical to SEQ ID NO: 862915

SEQ ID NO: 862922 - protein, 104 aa, Homo sapiens
MRGPASSFYLVALLRARWVTSSCTGATRENSARVLALVVSVQTGTVLIRKYGLNMCRQCFRQYAKDIGFIKVGVCRRTPCCLGREGCGGYFFRERQTDRSSLEW

SEQ ID NO: 862923 - protein, 112 aa, Homo sapiens
MRGPASSFYLVALLRARWVTSSCTGATRENSARVLALVVSVQTGTVLIRKYGLNMCRQCFRQYAKDIGFIKEIGSPSVAQVEVQWRCYGSLQPRTPPGLRRSSCLGVPSSWD

SEQ ID NO: 862924 - protein, 78 aa, Homo sapiens; identical to SEQ ID NO: 862909

SEQ ID NO: 862925 - protein, 77 aa, Homo sapiens; identical to SEQ ID NO: 862910

SEQ ID NO: 862926 - protein, 66 aa, Homo sapiens
PFLGALLRGRWVTSSCTGATRENSARVLALVVSVQTGTVLIRKYGLNMCRQCFRQYAKDIGFIKLD

SEQ ID NO: 862927 - protein, 73 aa, Homo sapiens
RGRGRVGFYLVALLRARWVTSSCTGATRENSARVLALVVSVQTGTVLIRKYGLNMCRQCFRQYAKDIGFIKLD

SEQ ID NO: 862928 - protein, 98 aa, Homo sapiens; identical to SEQ ID NO: 862915

SEQ ID NO: 862929 - protein, 77 aa, Homo sapiens; identical to SEQ ID NO: 862910

SEQ ID NO: 862930 - protein, 78 aa, Homo sapiens; identical to SEQ ID NO: 862909

SEQ ID NO: 862931 - protein, 78 aa, Homo sapiens; identical to SEQ ID NO: 862909

SEQ ID NO: 862932 - protein, 98 aa, Homo sapiens; identical to SEQ ID NO: 862915

SEQ ID NO: 862933 - protein, 98 aa, Homo sapiens; identical to SEQ ID NO: 862915

SEQ ID NO: 862934 - protein, 98 aa, Homo sapiens; identical to SEQ ID NO: 862915

SEQ ID NO: 862935 - protein, 98 aa, Homo sapiens; identical to SEQ ID NO: 862915

SEQ ID NO: 862936 - protein, 98 aa, Homo sapiens; identical to SEQ ID NO: 862915

SEQ ID NO: 862937 - protein, 66 aa, Homo sapiens; identical to SEQ ID NO: 862926

SEQ ID NO: 862938 - protein, 98 aa, Homo sapiens; identical to SEQ ID NO: 862915

SEQ ID NO: 862939 - protein, 152 aa, Homo sapiens
QCDKMLGGDALVTDLLVDFCGSRSGVEIPRTPQLYVAHEIGTIKTVTPPEDRDSESGVAGGQGTLQEPGFGEASEAISVSRNRQPIPLLMNKENSTKTSKVELTLASPYMKQEKEEEKEGFSESDFSDGNTSSNAESWRNPSSEHLKFFNSQ

SEQ ID NO: 862940 - protein, 130 aa, Homo sapiens
MAEYGTLLQDLTNNITLEDLEQLKSACKEDIPSEKSEEITTGSAWFSFLESHNKLDKDNLSYIEHIFEISRRPDLLTMVVDYRTRVLKISEEDELDTKLTRIPSAKKYKDIIRQPSEEEIIKLAPPPKKA

SEQ ID NO: 862941 - protein, 141 aa, Homo sapiens
NRRKRWWGEGVMAEYGTLLQDLTNNITLEDLEQLKSACKEDIPSEKSEEITTGSAWFSFLESHNKLDKDNLSYIEHIFEISRRPDLLTMVVDYRTRVLKISEEDELDTKLTRIPSAKKYKDIIRQPSEEEIIKLAPPPKKA

SEQ ID NO: 862942 - protein, 130 aa, Homo sapiens; identical to SEQ ID NO: 862940

SEQ ID NO: 862943 - protein, 130 aa, Homo sapiens; identical to SEQ ID NO: 862940

SEQ ID NO: 862944 - protein, 130 aa, Homo sapiens; identical to SEQ ID NO: 862940

SEQ ID NO: 862945 - protein, 66 aa, Homo sapiens
EEDNERLGTRLGVIGLRLRGRKRRRRRQKRRRRRRREPRRRFRTLLRNRGLRSARALSAQLQRRHG

SEQ ID NO: 862946 - protein, 130 aa, Homo sapiens; identical to SEQ ID NO: 862940

SEQ ID NO: 862947 - protein, 130 aa, Homo sapiens; identical to SEQ ID NO: 862940

SEQ ID NO: 862948 - protein, 130 aa, Homo sapiens; identical to SEQ ID NO: 862940

SEQ ID NO: 862949 - protein, 130 aa, Homo sapiens; identical to SEQ ID NO: 862940

SEQ ID NO: 862950 - protein, 130 aa, Homo sapiens; identical to SEQ ID NO: 862940

SEQ ID NO: 862951 - protein, 130 aa, Homo sapiens; identical to SEQ ID NO: 862940

SEQ ID NO: 862952 - protein, 169 aa, Homo sapiens
MSSGGGKRSAGADGSRESSGRCENRTQDARPDAHSSVVIMAEYGTLLQDLTNNITLEDLEQLKSACKEDIPSEKSEEITTGSAWFSFLESHNKLDKDNLSYIEHIFEISRRPDLLTMVVDYRTRVLKISEEDELDTKLTRIPSAKKYKDIIRQPSEEEIIKLAPPPKKA

SEQ ID NO: 862953 - protein, 108 aa, Homo sapiens
MAEYGTLLQDLTNNITLEDLEQLKSACKEDIPSEKNNLSYIEHIFEISRRPDLLTMVVDYRTRVLKISEEDELDTKLTRIPSAKKYKDIIRQPSEEEIIKLAPPPKKA

SEQ ID NO: 862954 - protein, 103 aa, Homo sapiens
MAEYGTLLQDLTNNITLEDLEQLKSACKEDIPSEKSEEITTGSAWFSFLESHNKLDKDNLSYIEHIFEISRRPDLLTMVVDYRTRVLKISHLVPLLKGMGVRG

SEQ ID NO: 862955 - protein, 130 aa, Homo sapiens; identical to SEQ ID NO: 862940

SEQ ID NO: 862956 - protein, 130 aa, Homo sapiens; identical to SEQ ID NO: 862940

SEQ ID NO: 862957 - protein, 130 aa, Homo sapiens; identical to SEQ ID NO: 862940

SEQ ID NO: 862958 - protein, 130 aa, Homo sapiens; identical to SEQ ID NO: 862940

SEQ ID NO: 862959 - protein, 66 aa, Homo sapiens; identical to SEQ ID NO: 862945

SEQ ID NO: 862960 - protein, 126 aa, Homo sapiens
MSIGVPIKVLHEAEGHIVTCETNTGEVYRGKLIEAEDNMNCQMSNITVTYRDGRVAQLEQVYIRGSKIRFLILPDMLKNAPMLKSMKNKNQGSGAGRGKAAILKAQVAARGRGRGMGRGNIFQKRR

SEQ ID NO: 862961 - protein, 78 aa, Homo sapiens
GPALDSLAGGREGSKHLHGNEANLLRLIRFRLWLRYCIVCFCPRGRETETICCRLDSPRDCLEHQLGSSHTILVGISQ

SEQ ID NO: 862962 - protein, 126 aa, Homo sapiens; identical to SEQ ID NO: 862960

SEQ ID NO: 862963 - protein, 126 aa, Homo sapiens; identical to SEQ ID NO: 862960

SEQ ID NO: 862964 - protein, 126 aa, Homo sapiens; identical to SEQ ID NO: 862960

SEQ ID NO: 862965 - protein, 126 aa, Homo sapiens; identical to SEQ ID NO: 862960

SEQ ID NO: 862966 - protein, 126 aa, Homo sapiens; identical to SEQ ID NO: 862960

SEQ ID NO: 862967 - protein, 126 aa, Homo sapiens; identical to SEQ ID NO: 862960

SEQ ID NO: 862968 - protein, 181 aa, Homo sapiens
MATEPEAAEPVVPSLVDRYFTRWYKPDVKGKFCEDHCILQHSNRICVITLAESHPVLQSGKTIKSISYQISTNCSRLQNKVSGKFKRGAQFLTELAPLCKIYCSDGEEYTVSSCVRGRLMEVNENILHKPSILQEKPSTEGYIAVVLPKFEESKSITEGLLTQKQYEEVMVKRINATTATS

SEQ ID NO: 862969 - protein, 156 aa, Homo sapiens
MGGKIIPSNHTGSTFSPCRICVITLAESHPVLQSGKTIKSISYQISTNCSRLQNKVSGKFKRGAQFLTELAPLCKIYCSDGEEYTVSSCVRGRLMEVNENILHKPSILQEKPSTEGYIAVVLPKFEESKSITEGLLTQKQYEEVMVKRINATTATS

SEQ ID NO: 862970 - protein, 115 aa, Homo sapiens
MATEPEAAEPVVPSLVDRYFTRWYKPDVKGKFCEDHCILQHSNRICVITLAESHPVLQSGKTIKSISYQISTNCSRLQNKVSGKFKRRIIYLEKVEDVIKRKMMPLSLGLHLPHS

SEQ ID NO: 862971 - protein, 224 aa, Homo sapiens
MSNPKAAVIGGGGGGGGTCGPESSARAHDTRCAPEEHAQSGLRGGSAGVPEGGGGGAGGRHGYRARSRGAGGAFARGSILHSLVQTGICVITLAESHPVLQSGKTIKSISYQISTNCSRLQNKVSGKFKRGAQFLTELAPLCKIYCSDGEEYTVSSCVRGRLMEVNENILHKPSILQEKPSTEGYIAVVLPKFEESKSITEGLLTQKQYEEVMVKRINATTATS

SEQ ID NO: 862972 - protein, 102 aa, Homo sapiens
MSKENFVRTTVYYSTLTGKQIGNFKLSKIFFSWYCSLVWSCGLGLNKCSLNKHALIIFYCVEDGIIIGVCLARMSIPVPGHSEHINLITQTSKWRTTSSAAT

SEQ ID NO: 862973 - protein, 572 aa, Homo sapiens
ASSLPPSVQQKILATATTSTSGMVEASQMPTVIYVSPVNTVKNVVTKNFQNIYPKPVTEIAKPVILNTTQIPKNVATETQLKGGQHSQAAPVKWIFQDNLQPFTPSLVPVKSSNNVASKILKTFVDRKNLGDNTINMPPLSTIDPSGTRSKNMPIKDNALVMFNGKVYLLAKKGTDVLPSQIDQQNSVSPDTPVRKDTLQTVSSSPVTEISREVVNIVLAKSKSSQMETKSLSNTQLASMANLRAEKNKVEKPSPSTTNPHMNQSSNYLKQSKTLFTNPIFPVGFSTGHNAPRKVTAVIYARKGSVLQSIEKISSSVDATTVTSQQCVFRDQEPKIHNEMASTSDKGAQGRNDKKDSQGRSNKALHLKSDAEFKKIFGLTKDLRVCLTRIPDHLTSGEGFDSFSSLVKSGTYKETEFMVKEGERKQQNFDKKRKAKTNKKMDHIKKRKTENAYNAIINGEANVTGSQLLSSILPTSDVSQHNILTSHSKTRQEKRTEMEYYTHEKQEKGTLNSNAAYEQSHFFNKNYTEDIFPVTPPELEETIRDEKIRRLKQVLREKEAALEEMRKKMHQK

SEQ ID NO: 862974 - protein, 233 aa, Homo sapiens
MASTSDKGAQGRNDKKDSQGRSNKALHLKSDAEFKKIFGLTKDLRVCLTRIPDHLTSGEGFDSFSSLVKSGTYKETEFMVKEGERKQQNFDKKRKAKTNKKMDHIKKRKTENAYNAIINGEANVTGSQLLSSILPTSDVSQHNILTSHSKTRQEKRTEMEYYTHEKQEKGTLNSNAAYEQSHFFNKNYTEDIFPVTPPELEETIRDEKIRRLKQVLREKEAALEEMRKKMHQK

SEQ ID NO: 862975 - protein, 233 aa, Homo sapiens; identical to SEQ ID NO: 862974

SEQ ID NO: 862976 - protein, 142 aa, Homo sapiens
MSNNLRRVFLKPAEENSGNASRCVSGCMYQVVQTIGSDGKNLLQLLPIPKSSGNLIPLVQSSVMSDALKGNTGKPVQVTFQTQISSSSTSASVQLPIFQPASSSNYFLTRTVDTSEKGRVTSVGTGNFSSSVSKVQSHGVKI

SEQ ID NO: 862977 - protein, 233 aa, Homo sapiens; identical to SEQ ID NO: 862974

SEQ ID NO: 862978 - protein, 635 aa, Homo sapiens
MSVGVSTSAPLSPTSGTSVGMSTFSIMDYVVFVLLLVLSLAIGLYHACRGWGRHTVGELLMADRKMGCLPVALSLLATFQSAVAILGVPSEIYRFGTQYWFLGCCYFLGLLIPAHIFIPVFYRLHLTSAYEYLELRFNKTVRVCGTVTFIFQMVIYMGVVLYAPSLALNAVTGFDLWLSVLALGIVCTVYTALGGLKAVIWTDVFQTLVMFLGQLAVIIVGSAKVGGLGRVWAVASQHGRISGFELDPDPFVRHTFWTLAFGGVFMMLSLYGVNQAQVQRYLSSRTEKAAVLSCYAVFPFQQVSLCVGCLIGLVMFAYYQEYPMSIQQAQAAPDQFVLYFVMDLLKGLPGLPGLFIACLFSGSLSTISSAFNSLATVTMEDLIRPWFPEFSEARAIMLSRGLAFGYGLLCLGMAYISSQMGPVLQAAISIFGMVGGPLLGLFCLGMFFPCANPPGAVVGLLAGLVMAFWIGIGSIVTSMGFSMPPSPSNGSSFSLPTNLTVATVTTLMPLTTFSKPTGLQRFYSLSYLWYSAHNSTTVIVVGLIVSLLTGRMRGRSLNPATIYPVLPKLLSLLPLSCQKRLHCRSYGQDHLDTGLFPEKPRNGVLGDSRDKEAMALDGTAYQGSSSTCILQETSL

SEQ ID NO: 862979 - protein, 752 aa, Homo sapiens
MSVGVSTSAPLSPTSGTSVGMSTFSIMDYVVFVLLLVLSLAIGLYHACRGWGRHTVGELLMADRKMGCLPVALSLLATFQSAVAILGVPSEIYRFGTQYWFLGCCYFLGLLIPAHIFIPVFYRLHLTSAYEYLELRFNKTVRVCGTVTFIFQMVIYMGVVLYAPSLALNAVTGFDLWLSVLALGIVCTVYTALGGLKAVIWTDVFQTLVMFLGQLAVIIVGSAKVGGLGRVWAVASQHGRISGFELDPDPFVRHTFWTLAFGGVFMMLSLYGVNQAQVQRYLSSRTEKAAVLSCYAVFPFQQVSLCVGCLIGLVMFAYYQEYPMSIQQAQAAPDQFVLYFVMDLLKGLPGLPGLFIACLFSGSLSTISSAFNSLATVTMEDLIRPWFPEFSEARAIMLSRGLGGVMLPHLFSLGLSKLHPDHCHQFAVKHPLYPGLSTCLMKHTTFPACMVVSISGHVLGRSLSHIGVRTWWEEAGACCNMPFVSRETEVVVWLGREPCFTPLLVLTHTFLFPLLSFPPAFGYGLLCLGMAYISSQMGPVLQAAISIFGMVGGPLLGLFCLGMFFPCANPPGAVVGLLAGLVMAFWIGIGSIVTSMGFSMPPSPSNGSSFSLPTNLTVATVTTLMPLTTFSKPTGLQRFYSLSYLWYSAHNSTTVIVVGLIVSLLTGRMRGRSLNPATIYPVLPKLLSLLPLSCQKRLHCRSYGQDHLDTGLFPEKPRNGVLGDSRDKEAMALDGTAYQGSSSTCILQETSL

SEQ ID NO: 862980 - protein, 635 aa, Homo sapiens; identical to SEQ ID NO: 862978

SEQ ID NO: 862981 - protein, 635 aa, Homo sapiens; identical to SEQ ID NO: 862978

SEQ ID NO: 862982 - protein, 635 aa, Homo sapiens; identical to SEQ ID NO: 862978

SEQ ID NO: 862983 - protein, 426 aa, Homo sapiens
MFLGQLAVIIVGSAKVGGLGRVWAVASQHGRISGFELDPDPFVRHTFWTLAFGGVFMMLSLYGVNQAQVQRYLSSRTEKAAVLSCYAVFPFQQVSLCVGCLIGLVMFAYYQEYPMSIQQAQAAPDQFVLYFVMDLLKGLPGLPGLFIACLFSGSLSTISSAFNSLATVTMEDLIRPWFPEFSEARAIMLSRGLAFGYGLLCLGMAYISSQMGPVLQAAISIFGMVGGPLLGLFCLGMFFPCANPPGAVVGLLAGLVMAFWIGIGSIVTSMGFSMPPSPSNGSSFSLPTNLTVATVTTLMPLTTFSKPTGLQRFYSLSYLWYSAHNSTTVIVVGLIVSLLTGRMRGRSLNPATIYPVLPKLLSLLPLSCQKRLHCRSYGQDHLDTGLFPEKPRNGVLGDSRDKEAMALDGTAYQGSSSTCILQETSL

SEQ ID NO: 862984 - protein, 635 aa, Homo sapiens; identical to SEQ ID NO: 862978

SEQ ID NO: 862985 - protein, 635 aa, Homo sapiens; identical to SEQ ID NO: 862978

SEQ ID NO: 862986 - protein, 155 aa, Homo sapiens
MSVGVSTSAPLSPTSGTSVGMSTFSIMDYVVFVLLLVLSLAIGLYHACRGWGRHTVGELLMADRKMGCLPVALSLLATFQSAVAILGVPSEIYRFGTQYWFLGCCYFLGLLIPAHIFIPVFYRLHLTSAYEYLELRFNKTVRVCGTVTFIFQMST

SEQ ID NO: 862987 - protein, 109 aa, Homo sapiens
MTNALSLWHDVMPYQGFSPGEPFSRDKNVASMLTVTGFDLWLSVLALGIVCTVYTALGGLKAVIWTDVFQTLVMFLGQLAVIIVGSAKVGGLGRVWAVASQHGRISGFE

SEQ ID NO: 862988 - protein, 477 aa, Homo sapiens
MSVGVSTSAPLSPTSGTSVGMSTFSIMDYVVFVLLLVLSLAIGLYHACRGWGRHTVGELLMADRKMGCLPVALSLLATFQSAVAILGVPSEIYRFGTQYWFLGCCYFLGLLIPAHIFIPVFYRLHLTSAYEYLELRFNKTVRVCGTVTFIFQMVIYMGVVLYAPSLALNAVTGFDLWLSVLALGIVCTVYTALGGLKAVIWTDVFQTLVMFLGQLAVIIVGSAKVGGLGRVWAVASQHGRISGFELDPDPFVRHTFWTLAFGGVFMMLSLYGVNQAQVQRYLSSRTEKAAVLSCYAVFPFQQVSLCVGCLIGLVMFAYYQEYPMSIQQAQAAPDQFVLYFVMDLLKGLPGLPGLFIACLFSGSLSTISSAFNSLATVTMEDLIRPWFPEFSEARAIMLSRGLGGVMLPHLFSLGLSKLHPDHCHQFAVKHPLYPGLSTCLMKHTTFPACMVVSISGHVLGRSLSHIGVRTWWEEAGA

SEQ ID NO: 862989 - protein, 635 aa, Homo sapiens; identical to SEQ ID NO: 862978

SEQ ID NO: 862990 - protein, 161 aa, Homo sapiens
PATIYPVLPKLLSLLPLSCQKRLHCRSYGQVVPAVQVTPPCPSPQMPLTLQVPFYPFSLPLPRVPLSGSAKPRLSHTAVSGSTHRTALAWWAEGSQGSEELSPSLGQSAPLPSPPCAPCCAMPSLFSPCSPSRTQPCWAPFWRGPFLCESCQAPVIRLHQF

SEQ ID NO: 862991 - protein, 260 aa, Homo sapiens
MEKCEAAAKDIRGETLNHHVNARHLDLASLKSIREFAAKIIEEEERVDILINNAGVMRCPHWTTEDGFEMQFGVNHLGHFLLTNLLLDKLKASAPSRIINLSSLAHVAGHIDFDDLNWQTRKYNTKAAYCQSKLAIVLFTKELSRRLQGSGVTVNALHPGVARTELGRHTGIHGSTFSSTTLGPIFWLLVKSPELAAQPSTYLAVAEELADVSGKYFDGLKQKAPAPEAEDEEVARRLWAESARLVGLEAPSVREQPLPR

SEQ ID NO: 862992 - protein, 295 aa, Homo sapiens
MAFSPCVSVSVFPSYKDTSHWIRAHPNDRILTWPLRHRPCFRHRPHSQVVGAQECFCWCIRLGSVLTGMSPPPPLSSEEERVDILINNAGVMRCPHWTTEDGFEMQFGVNHLGHFLLTNLLLDKLKASAPSRIINLSSLAHVAGHIDFDDLNWQTRKYNTKAAYCQSKLAIVLFTKELSRRLQGSGVTVNALHPGVARTELGRHTGIHGSTFSSTTLGPIFWLLVKSPELAAQPSTYLAVAEELADVSGKYFDGLKQKAPAPEAEDEEVARRLWAESARLVGLEAPSVREQPLPR

SEQ ID NO: 862993 - protein, 321 aa, Homo sapiens
AAPAPPLACGCVARSSSELPRRLVCSKLRADPGRLTPDACPRPGMSRYLLPLSALGTVAGAAVLLKDYVTGGACPSKATIPGKTVIVTGANTGIGKQTALELARRGGNIILACRDMEKCEAAAKDIRGETLNHHVNARHLDLASLKSIREFAAKIIEEEERVDILINNAGVMRCPHWTTEDGFEMQFGVNHLGHFLLTNLLLDKLKASAPSRIINLSSLAHVAGHIDFDDLNWQTRKYNTKAAYCQSKLAIVLFTKEAGQTHGHPWLHLLQHHTRAHLLAAGQEPRAGRPAQHIPGRGGGTGGCFRKVLRWTQTEGPGPRG

SEQ ID NO: 862994 - protein, 114 aa, Homo sapiens
AEDCLFIPGGLVCLDQMSFPAAVGQAAQPFGSSQLWCDCQRPAPRRGQDRAGQTHGHPWLHLLQHHTRAHLLAAGQEPRAGRPAQHIPGRGGGTGGCFRKVLRWTQTEGPGPRG

SEQ ID NO: 862995 - protein, 375 aa, Homo sapiens
AAPAPPLACGCVARSSSELPRRLVCSKLRADPGRLTPDACPRPGMSRYLLPLSALGTVAGAAVLLKDYVTGGACPSKATIPGKTVIVTGANTGIGKQTALELARRGGNIILACRDMEKCEAAAKDIRGETLNHHVNARHLDLASLKSIREFAAKIIEEEERVDILINNAGVMRCPHWTTEDGFEMQFGVNHLGHFLLTNLLLDKLKASAPSRIINLSSLAHVAGHIDFDDLNWQTRKYNTKAAYCQSKLAIVLFTKELSRRLQGSGVTVNALHPGVARTELGRHTGIHGSTFSSTTLGPIFWLLVKSPELAAQPSTYLAVAEELADVSGKYFDGLKQKAPAPEAEDEEVARRLWAESARLVGLEAPSVREQPLPR

SEQ ID NO: 862996 - protein, 375 aa, Homo sapiens; identical to SEQ ID NO: 862995

SEQ ID NO: 862997 - protein, 375 aa, Homo sapiens; identical to SEQ ID NO: 862995

SEQ ID NO: 862998 - protein, 375 aa, Homo sapiens; identical to SEQ ID NO: 862995

SEQ ID NO: 862999 - protein, 206 aa, Homo sapiens
AAPAPPLACGCVARSSSELPRRLVCSKLRADPGRLTPDACPRPGMSRYLLPLSALGTVAGAAVLLKDYVTGGACPSKATIPGKTVIVTGANTGIGKQTALELARRGGNIILACRDMEKCEAAAKDIRGETLNHHVNARHLDLASLKSIREFAAKIIEEEERVDILINNAGVMRCPHFLSILMVVQTADSQTCSFKRKKKEENVPES

SEQ ID NO: 863000 - protein, 260 aa, Homo sapiens; identical to SEQ ID NO: 862991

SEQ ID NO: 863001 - protein, 375 aa, Homo sapiens; identical to SEQ ID NO: 862995

SEQ ID NO: 863002 - protein, 357 aa, Homo sapiens
AAPAPPLACGCVARSSSELPRRLVCSKLRADPGRLTPDACPRPGMSRYLLPLSALGTVAGAAVLLKDYVTGGACPSKATIPGKTVIVTGANTGIGKQTALELARRGGNIILACRDMEKCEAAAKDIRGETLNHHVNARHLDLASLKSIREFAAKIIEEEERVDILINNAGVMRCPHWTTEDGFEMQFGVNHLGHFLLTNLLLDKLKASAPSRIINLSSLAHVAGHIDFDDLNWQTRKYNTKAAYCQSKLAIVLFTKELSRRLQGSGVTVNALHPGVARTELGRHTGIHGSTFSSTTLGESPPSLGSPRGALHPCFLSPGPRTLPQRPSLRPHACSSPTSSEAQSTGPFPPLTWPASL

SEQ ID NO: 863003 - protein, 152 aa, Homo sapiens
MGFECRKQPGARKPHSWVWAATASQVRLDPSLSLLFLSSPGSGVTVNALHPGVARTELGRHTGIHGSTFSSTTLGPIFWLLVKSPELAAQPSTYLAVAEELADVSGKYFDGLKQKAPAPEAEDEEVARRLWAESARLVGLEAPSVREQPLPR

SEQ ID NO: 863004 - protein, 375 aa, Homo sapiens; identical to SEQ ID NO: 862995

SEQ ID NO: 863005 - protein, 68 aa, Homo sapiens
AEDCLFIPGGLVCLDQMSFPAAVGQAAQPFGSSQLWCDCQRPAPRRGQDRAGQTHGHPWLHLLQHHTR

SEQ ID NO: 863006 - protein, 149 aa, Homo sapiens
MRDVGKMMAGRFLDINTLIVLILTTPGLIFIFEMKSCSVAQAGVQWHDLHSLQLPPPRFKRFSCLQVAGITGPIFWLLVKSPELAAQPSTYLAVAEELADVSGKYFDGLKQKAPAPEAEDEEVARRLWAESARLVGLEAPSVREQPLPR

SEQ ID NO: 863007 - protein, 100 aa, Homo sapiens
LPKCWDFRCESKVTFFIILNPGHFLLTNLLLDKLKASAPSRIINLSSLAHVAGHIDFDDLNWQTRKYNTKAAYCQSKLAIVLFTKELSRRLQGTGALGSA

SEQ ID NO: 863008 - protein, 169 aa, Homo sapiens
MLLVDDRALPDFKGIQTSDPNAVVMGLAPEHFHYQILNQAFRLLLDGAPLIAIHKARYYKRKDGLALGPGPFVTALEYATDTKATVVGKPEKTFFLEALRGTGCEPEEAVMIGDDCRDDVGGAQDVGMLGILVKTGKYRASDEEKINPPPYLTCESFPHAVDHILQHLL

SEQ ID NO: 863009 - protein, 259 aa, Homo sapiens
MAACRALKAVLVDLSGTLHIEDAAVPGAQEALKRLRGASVIIRFVTNTTKESKQDLLERLRKLEFDISEDEIFTSLTAARSLLERKQVRPMLLVDDRALPDFKGIQTSDPNAVVMGLAPEHFHYQILNQAFRLLLDGAPLIAIHKARYYKRKDGLALGPGPFVTALEYATDTKATVVGKPEKTFFLEALRGTGCEPEEAVMIGDDCRDDVGGAQDVGMLGILVKTGKYRASDEEKINPPPYLTCESFPHAVDHILQHLL

SEQ ID NO: 863010 - protein, 259 aa, Homo sapiens; identical to SEQ ID NO: 863009

SEQ ID NO: 863011 - protein, 169 aa, Homo sapiens; identical to SEQ ID NO: 863008

SEQ ID NO: 863012 - protein, 250 aa, Homo sapiens
MAACRALKAVLVDLSGTLHIEDAAVPGAQEALKRFVTNTTKESKQDLLERLRKLEFDISEDEIFTSLTAARSLLERKQVRPMLLVDDRALPDFKGIQTSDPNAVVMGLAPEHFHYQILNQAFRLLLDGAPLIAIHKARYYKRKDGLALGPGPFVTALEYATDTKATVVGKPEKTFFLEALRGTGCEPEEAVMIGDDCRDDVGGAQDVGMLGILVKTGKYRASDEEKINPPPYLTCESFPHAVDHILQHLL

SEQ ID NO: 863013 - protein, 259 aa, Homo sapiens; identical to SEQ ID NO: 863009

SEQ ID NO: 863014 - protein, 231 aa, Homo sapiens
MSAKSRTIGIIGAPFSKGQPRGGVEEGPTVLRKAGLLEKLKEQECDVKDYGDLPFADIPNDSPFQIVKNPRSVGKASEQLAGKVAEVKKNGRISLVLGGDHSLAIGSISGHARVHPDLGVIWVDAHTDINTPLTTTSGNLHGQPVSFLLKELKGKIPDVPGFSWVTPCISAKDIVYIGLRDVDPGEHYILKTLGIKYFSMTEVDRLGIWQGDGRNTQLSTRKKEKANSSKF

SEQ ID NO: 863015 - protein, 205 aa, Homo sapiens
MSAKSRTIGIIGAPFSKGQPRGGVEEGPTVLRKAGLLEKLKEQECDVKDYGDLPFADIPNDSPFQIVKNPRSVGKASEQLAGKVAEVKKNGRISLVLGGDHSLAIGSISGHARVHPDLGVIWVDAHTDINTPLTTTSGNLHGQPVSFLLKELKGKIPDVPGFSWVTPCISAKDIVYIGLRDVDPGEHRLGIWQGDGRNTQLSTRK

SEQ ID NO: 863016 - protein, 213 aa, Homo sapiens
MSAKSRTIGIIGAPFSKGQPRGGVEEGPTVLRKAGLLEKLKEQECDVKDYGDLPFADIPNDSPFQIVKNPRSVGISLVLGGDHSLAIGSISGHARVHPDLGVIWVDAHTDINTPLTTTSGNLHGQPVSFLLKELKGKIPDVPGFSWVTPCISAKDIVYIGLRDVDPGEHYILKTLGIKYFSMTEVDRLGIWQGDGRNTQLSTRKKEKANSSKF

SEQ ID NO: 863017 - protein, 111 aa, Homo sapiens
MEETLSYLLGRKKRPIHLSFDVDGLDPSFTPATGTPVVGGLTYREGLYITEEIYKTGLLSGLDIMEVNPSLGKTPEEVTRTVNTAVAITLACFGLAREGNHKPIDYLNPPK

SEQ ID NO: 863018 - protein, 239 aa, Homo sapiens
MGLPSQDLQTFQVFPLLILVNICLFYTIEIILHRLIYNLLFNLVTQNFLILECDVKDYGDLPFADIPNDSPFQIVKNPRSVGKASEQLAGKVAEVKKNGRISLVLGGDHSLAIGSISGHARVHPDLGVIWVDAHTDINTPLTTTSGNLHGQPVSFLLKELKGKIPDVPGFSWVTPCISAKDIVYIGLRDVDPGEHYILKTLGIKYFSMTEVDRLGIWQGDGRNTQLSTRKKEKANSSKF

SEQ ID NO: 863019 - protein, 214 aa, Homo sapiens
MSAKSRTIGIIGAPFSKGQPRGGVEEGPTVLRKAGLLEKLKEQECDVKDYGDLPFADIPNDSPFQIVKNPRSVGKASEQLAGKVAEVKKNGRISLVLGGDHSLAIGSISGHARVHPDLGVIWVDAHTDINTPLTTTSGNLHGQPVSFLLKELKGKIPDVPGFSWVTPCISAKDIVYIGLRDVDPGEHRLGIWQGDGRNTQLSTRKKEKANSSKF

SEQ ID NO: 863020 - protein, 291 aa, Homo sapiens
MSAKSRTIGIIGAPFSKGQPRGGVEEGPTVLRKAGLLEKLKEQECDVKDYGDLPFADIPNDSPFQIVKNPRSVGKASEQLAGKVAEVKKNGRISLVLGGDHSLAIGSISGHARVHPDLGVIWVDAHTDINTPLTTTSGNLHGQPVSFLLKELKGKIPDVPGFSWVTPCISAKDIVYIGLRDVDPGEHYILKTLGIKYFSMTEVDRLGIWQGDGRNTQLSTRKTSYWHTSRGRSDIQRRSLHHRRNLQNRATLRIRYNGSEPIPGEDTRRSNSNSEHSSCNNLGLFRTCSGG

SEQ ID NO: 863021 - protein, 273 aa, Homo sapiens
MSAKSRTIGIIGAPFSKGQPRGGVEEGPTVLRKAGLLEKLKEQECDVKDYGDLPFADIPNDSPFQIVKNPRSVGISLVLGGDHSLAIGSISGHARVHPDLGVIWVDAHTDINTPLTTTSGNLHGQPVSFLLKELKGKIPDVPGFSWVTPCISAKDIVYIGLRDVDPGEHYILKTLGIKYFSMTEVDRLGIWQGDGRNTQLSTRKTSYWHTSRGRSDIQRRSLHHRRNLQNRATLRIRYNGSEPIPGEDTRRSNSNSEHSSCNNLGLFRTCSGG

SEQ ID NO: 863022 - protein, 164 aa, Homo sapiens
MSAKSRTIGIIGAPFSKGQPRGGVEEGPTVLRKAGLLEKLKEQECDVKDYGDLPFADIPNDSPFQIVKNPRSVGKASEQLAGKVAEVKKNGRISLVLGGDHSLAIGSISGHARVHPDLGVIWVDAHTDINTPLTTTSGNLHGQPVSFLLKELKGKLPRILCILA

SEQ ID NO: 863023 - protein, 104 aa, Homo sapiens
MSAKSRTIGIIGAPFSKGQPRGGVEEGPTVLRKAGLLEKLKEQECDVKDYGDLPFADIPNDSPFQIVKNPRSVGKASEQLAGKVAEVKKNGRISLVLGGDHRSC

SEQ ID NO: 863024 - protein, 104 aa, Homo sapiens; identical to SEQ ID NO: 863023

SEQ ID NO: 863025 - protein, 104 aa, Homo sapiens; identical to SEQ ID NO: 863023

SEQ ID NO: 863026 - protein, 94 aa, Homo sapiens
EVLYFLIVQPRGGVEEGPTVLRKAGLLEKLKEQECDVKDYGDLPFADIPNDSPFQIVKNPRSVGKASEQLAGKVAEVKKNGRISLVLGGDHRSC

SEQ ID NO: 863027 - protein, 318 aa, Homo sapiens
MSAKSRTIGIIGAPFSKGQPRGGVEEGPTVLRKAGLLEKLKEQECDVKDYGDLPFADIPNDSPFQIVKNPRSVGKASEQLAGKVAEVKKNGRISLVLGGDHSLAIGSISGHARVHPDLGVIWVDAHTDINTPLTTTSGNLHGQPVSFLLKELKGKIPDVPGFSWVTPCISAKDIVYIGLRDVDPGEQLTFLKTLGPLNYFSNDLTVDQTQDLGQGDWAENTPGNLTLRERTRKKGPISLLKGFRNGFDPAPVEAPLLFPNSPSVRCGHHPQVSWRKRRLDTIHTYAIGSSFAYHQRIAKFLSTPTPARYLPPSGRPNF

SEQ ID NO: 863028 - protein, 225 aa, Homo sapiens
MSAKSRTIGIIGAPFSKGQPRGGVEEGPTVLRKAGLLEKLKEQECDVKDYGDLPFADIPNDSPFQIVKNPRSVGKASEQLAGKVAEVKKNGRISLVLGGDHSLAIGSISGHARVHPDLGVIWVDAHTDINTPLTTTSGNLHGQPVSFLLKELKGKIPDVPGFSWVTPCISAKDIVYIGLRDVDPGEHYILKTLGIKYFSMTEVDNSNSEHSSCNNLGLFRTCSGG

SEQ ID NO: 863029 - protein, 103 aa, Homo sapiens
MSAKSRTIGIIGAPFSKGQPRGGVEEGPTVLRKAGLLEKLKEQECDVKDYGDLPFADIPNDSPFQIVKNPRSVGKASEQLAGKVASPFFGIARCHLDLEASGG

SEQ ID NO: 863030 - protein, 111 aa, Homo sapiens; identical to SEQ ID NO: 863017

SEQ ID NO: 863031 - protein, 226 aa, Homo sapiens
LTLLSRLEYSGTIMAHYSLNLPSSGDPLASASRVAGTTECDVKDYGDLPFADIPNDSPFQIVKNPRSVGKASEQLAGKVAEVKKNGRISLVLGGDHSLAIGSISGHARVHPDLGVIWVDAHTDINTPLTTTSGNLHGQPVSFLLKELKGKIPDVPGFSWVTPCISAKDIVYIGLRDVDPGEHYILKTLGIKYFSMTEVDRLGIWQGDGRNTQLSTRKKEKANSSKF

SEQ ID NO: 863032 - protein, 146 aa, Homo sapiens
MSAKSRTIGIIGAPFSKGQPRGGVEEGPTVLRKAGLLEKLKEQECDVKDYGDLPFADIPNDSPFQIVKNPRSVGISLVLGGDHSLAIGSISGHARVHPDLGVIWVDAHTDINTPLTTTSGNLHGQPVSFLLKELKGKLPRILCILA

SEQ ID NO: 863033 - protein, 186 aa, Homo sapiens
MSAKSRTIGIIGAPFSKGQPRGGVEEGPTVLRKAGLLEKLKEQECDVKDYGDLPFADIPNDSPFQIVKNPRSVGISLVLGGDHSLAIGSISGHARVHPDLGVIWVDAHTDINTPLTTTSGNLHGQPVSFLLKELKGKIPDVPGFSWVTPCISAKDIVYIGLRDVDPGEQVSLFLDVICLHFCPFVC

SEQ ID NO: 863034 - protein, 111 aa, Homo sapiens; identical to SEQ ID NO: 863017

SEQ ID NO: 863035 - protein, 133 aa, Homo sapiens
MSAKSRTIGIIGAPFSKGQPRGGVEEGPTVLRKAGLLEKLKEQECDVKDYGDLPFADIPNDSPFQIVKNPRSVGKASEQLAGKVAEVKKNGRISLVLGGDHSLAIGSISGHARVHPDLGVIWVDAHTDINTTF

SEQ ID NO: 863036 - protein, 291 aa, Homo sapiens; identical to SEQ ID NO: 863020

SEQ ID NO: 863037 - protein, 147 aa, Homo sapiens
MSAKSRTIGIIGAPFSKGQPRGGVEEGPTVLRKAGLLEKLKEQECDVKDYGDLPFADIPNDSPFQIVKNPRSVGISLVLGGDHSLAIGSISGHARVHPDLGVIWVDAHTDINTPLTTTSGNLHGQPVSFLLKELKGKGKRLVGTLVQ

SEQ ID NO: 863038 - protein, 104 aa, Homo sapiens; identical to SEQ ID NO: 863023

SEQ ID NO: 863039 - protein, 108 aa, Homo sapiens
SESVKSKQFSPSGYLSDTEESNMICQTMKCQRYQTPYLSEETTYLEPGKISVNCGHPSRHKADRLKSDFKKLSSTLPSSVCQQPSRKLIVPLSSQQDSGFDSPFVNLD

SEQ ID NO: 863040 - protein, 1873 aa, Homo sapiens
MEANDHFNFTGLPPAPAASGLKPSPSSGEGLYTNGSPMNFPQQGKSLNGDVNVNGLSTVSHTTTSGILNSAPHSSSTSHLHHPSVAYDCLWNYSQYPSANPGSNLKDPPLLSQFSGGQYPLNGILGGSRQPSSPSHNTNLRAGSQEFWANGTQSPMGLNFDSQELYDSFPDQNFEEVGSGIHPDEAAEKEMTSVVAENGTGLVGSLELEEEQPELKMCGYNGSVPSVESLHQEVSVLVPDPTVSCLDDPSHLPDQLEDTPILSEDSLEPFNSLAPEPVSGGLYGIDDTELMGAEDKLPLEDSPVISALDCPSLNNATAFSLLADDSQTSTSIFASPTSPPVLGESVLQDNSFDLNNGSDAEQEEMETQSSDFPPSLTQPAPDQSSTIQLHPATSPAVSPTTSPAVSLVVSPAASPEISPEVCPAASTVVSPAVFSVVSPASSAVLPAVSLEVPLTASVTSPKASPVTSPAAAFPTASPANKDVSSFLETTADVEEITGEGLTASGSGDVMRRRIATPEEVRLPLQHGWRREVRIKKGSHRWQGETWYYGPCGKRMKQFPEVIKYLSRNVVHSVRREHFSFSPRMPVGDFFEERDTPEGLQWVQLSAEEIPSRIQAITGKRGRPRNTEKAKTKEVPKVKRGRGRPPKVKITELLNKTDNRPLKKLEAQETLNEEDKAKIAKSKKKMRQKVQRGECQTTIQGQARNKRKQETKSLKQKEAKKKSKAEKEKGKTKQEKLKEKVKREKKEKVKMKEKEEVTKAKPACKADKTLATQRRLEERQRQQMILEEMKKPTEDMCLTDHQPLPDFSRVPGLTLPSGAFSDCLTIVEFLHSFGKVLGFDPAKDVPSLGVLQEGLLCQGDSLGEVQDLLVRLLKAALHDPGFPSYCQSLKILGEKVSEIPLTRDNVSEILRCFLMAYGVEPALCDRLRTQPFQAQPPQQKAAVLAFLVHELNGSTLIINEIDKTLESMSSYRKNKWIVEGRLRRLKTVLAKRTGRSEVEMEGPEECLGRRRSSRIMEETSGMEEEEEEESIAAVPGRRGRRDGEVDATASSIPELERQIEKLSKRQLFFRKKLLHSSQMLRAVSLGQDRYRRRYWVLPYLAGIFVEGTEGNLVPEEVIKKETDSLKVAAHASLNPALFSMKMELAGSNTTASSPARARGRPRKTKPGSMQPRHLKSPVRGQDSEQPQAQLQPEAQLHAPAQPQPQLQLQLQSHKGFLEQEGSPLSLGQSQHDLSQSAFLSWLSQTQSHSSLLSSSVLTPDSSPGKLDPAPSQPPEEPEPDEAESSPDPQALWFNISAQMPCNAAPTPPPAVSEDQPTPSPQQLASSKPMNRPSAANPCSPVQFSSTPLAGLAPKRRAGDPGEMPQSPTGLGQPKRRGRPPSKFFKQMEQRYLTQLTAQPVPPEMCSGWWWIRDPEMLDAMLKALHPRGIREKALHKHLNKHRDFLQEVCLRPSADPIFEPRQLPAFQEGIMSWSPKEKTYETDLAVLQWVEELEQRVIMSDLQIRGWTCPSPDSTREDLAYCEHLSDSQEDITWRGRGREGLAPQRKTTNPLDLAVMRLAALEQNVERRYLREPLWPTHEVVLEKALLSTPNGAPEGTTTEISYEITPRIRVWRQTLERCRSAAQVCLCLGQLERSIAWEKSVNKVTCLVCRKGDNDEFLLLCDGCDRGCHIYCHRPKMEAVPEGDWFCTVCLAQQVEGEFTQKPGFPKRGQKRKSGYSLNFSEGDGRRRRVLLRGRESPAAGPRYSEEGLSPSKRRRLSMRNHHSDLTFCEIILMEMESHDAAWPFLEPVNPRLVSGYRRIIKNPMDFSTMRERLLRGGYTSSEEFAADALLVFDNCQTFNEDDSEVGKAGHIMRRFFESRWEEFYQGKQANL

SEQ ID NO: 863041 - protein, 243 aa, Homo sapiens
AAPVLCCGCSDPDKWVLPYLAGIFVEGTEGNLVPEEVIKKETDSLKVAAHASLNPALFSMKMELAGSNTTASSPARARGRPRKTKPGSMQPRHLKSPVRGQDSEQPQAQLQPEAQLHAPAQPQPQLQLQLQSHKGFLEQEGSPLSLGQSQHDLSQSAFLSWLSQTQSHSSLLSSSVLTPDSSPGKLDPAPSQPPEEPEPDEAESSPDPQALWFNISAQMPCNAAPTPPCVLGTTILPQSASQP

SEQ ID NO: 863042 - protein, 115 aa, Homo sapiens
SQCYYFEFVLVKLLAYISVTDLFFLSLPGLNGDVNVNGLSTVSHTTTSGILNSAPHSSSTSHLHHPSVAYDCLWNYSQYPSANPGSNLKDPPLLSQFSGGQYPLNGHYNAWDPLD

SEQ ID NO: 863043 - protein, 1933 aa, Homo sapiens
VLAPGARPCEPLVPRGETSPEPGWTPLPQEMEANDHFNFTGLPPAPAASGLKPSPSSGEGLYTNGSPMNFPQQGKSLNGDVNVNGLSTVSHTTTSGILNSAPHSSSTSHLHHPSVAYDCLWNYSQYPSANPGSNLKDPPLLSQFSGGQYPLNGILGGSRQPSSPSHNTNLRAGSQEFWANGTQSPMGLNFDSQELYDSFPDQNFEVMPNGPPSFFTSPQTSPMLGSSIQTFAPSQEVGSGIHPDEAAEKEMTSVVAENGTGLVGSLELEEEQPELKMCGYNGSVPSVESLHQEVSVLVPDPTVSCLDDPSHLPDQLEDTPILSEDSLEPFNSLAPEPVSGGLYGIDDTELMGAEDKLPLEDSPVISALDCPSLNNATAFSLLADDSQTSTSIFASPTSPPVLGESVLQDNSFDLNNGSDAEQEEMETQSSDFPPSLTQPAPDQSSTIQLHPATSPAVSPTTSPAVSLVVSPAASPEISPEVCPAASTVVSPAVFSVVSPASSAVLPAVSLEVPLTASVTSPKASPVTSPAAAFPTASPANKDVSSFLETTADVEEITGEGLTASGSGDVMRRRIATPEEVRLPLQHGWRREVRIKKGSHRWQGETWYYGPCGKRMKQFPEVIKYLSRNVVHSVRREHFSFSPRMPVGDFFEERDTPEGLQWVQLSAEEIPSRIQAITGKRGRPRNTEKAKTKEVPKVKRGRGRPPKVKITELLNKTDNRPLKKLEAQETLNEEDKAKIAKSKKKMRQKVQRGECQTTIQGQARNKRKQETKSLKQKEAKKKSKAEKEKGKTKQEKLKEKVKREKKEKVKMKEKEEVTKAKPACKADKTLATQRRLEERQRQQMILEEMKKPTEDMCLTDHQPLPDFSRVPGLTLPSGAFSDCLTIVEFLHSFGKVLGFDPAKDVPSLGVLQEGLLCQGDSLGEVQDLLVRLLKAALHDPGFPSYCQSLKILGEKVSEIPLTRDNVSEILRCFLMAYGVEPALCDRLRTQPFQAQPPQQKAAVLAFLVHELNGSTLIINEIDKTLESMSSYRKNKWIVEGRLRRLKTVLAKRTGRSEVEMEGPEECLGRRRSSRIMEETSGMEEEEEEESIAAVPGRRGRRDGEVDATASSIPELERQIEKLSKRQLFFRKKLLHSSQMLRAVSLGQDRYRRRYWVLPYLAGIFVEGTEGNLVPEEVIKKETDSLKVAAHASLNPALFSMKMELAGSNTTASSPARARGRPRKTKPGSMQPRHLKSPVRGQDSEQPQAQLQPEAQLHAPAQPQPQLQLQLQSHKGFLEQEGSPLSLGQSQHDLSQSAFLSWLSQTQSHSSLLSSSVLTPDSSPGKLDPAPSQPPEEPEPDEAESSPDPQALWFNISAQMPCNAAPTPPPAVSEDQPTPSPQQLASSKPMNRPSAANPCSPVQFSSTPLAGLAPKRRAGDPGEMPQSPTGLGQPKRRGRPPSKFFKQMEQRYLTQLTAQPVPPEMCSGWWWIRDPEMLDAMLKALHPRGIREKALHKHLNKHRDFLQEVCLRPSADPIFEPRQLPAFQEGIMSWSPKEKTYETDLAVLQWVEELEQRVIMSDLQIRGWTCPSPDSTREDLAYCEHLSDSQEDITWRGRGREGLAPQRKTTNPLDLAVMRLAALEQNVERRYLREPLWPTHEVVLEKALLSTPNGAPEGTTTEISYEITPRIRVWRQTLERCRSAAQVCLCLGQLERSIAWEKSVNKVTCLVCRKGDNDEFLLLCDGCDRGCHIYCHRPKMEAVPEGDWFCTVCLAQQVEGEFTQKPGFPKRGQKRKSGYSLNFSEGDGRRRRVLLRGRESPAAGPRYSEEGLSPSKRRRLSMRNHHSDLTFCEIILMEMESHDAAWPFLEPVNPRLVSGYRRIIKNPMDFSTMRERLLRGGYTSSEEFAADALLVFDNCQTFNEDDSEVGKAGHIMRRFFESRWEEFYQGKQANL

SEQ ID NO: 863044 - protein, 1937 aa, Homo sapiens
MDGESFLSGDQGPADVARKVVIQAGPGCTEGTEEMEANDHFNFTGLPPAPAASGLKPSPSSGEGLYTNGSPMNFPQQGKSLNGDVNVNGLSTVSHTTTSGILNSAPHSSSTSHLHHPSVAYDCLWNYSQYPSANPGSNLKDPPLLSQFSGGQYPLNGILGGSRQPSSPSHNTNLRAGSQEFWANGTQSPMGLNFDSQELYDSFPDQNFEVMPNGPPSFFTSPQTSPMLGSSIQTFAPSQEVGSGIHPDEAAEKEMTSVVAENGTGLVGSLELEEEQPELKMCGYNGSVPSVESLHQEVSVLVPDPTVSCLDDPSHLPDQLEDTPILSEDSLEPFNSLAPEPVSGGLYGIDDTELMGAEDKLPLEDSPVISALDCPSLNNATAFSLLADDSQTSTSIFASPTSPPVLGESVLQDNSFDLNNGSDAEQEEMETQSSDFPPSLTQPAPDQSSTIQLHPATSPAVSPTTSPAVSLVVSPAASPEISPEVCPAASTVVSPAVFSVVSPASSAVLPAVSLEVPLTASVTSPKASPVTSPAAAFPTASPANKDVSSFLETTADVEEITGEGLTASGSGDVMRRRIATPEEVRLPLQHGWRREVRIKKGSHRWQGETWYYGPCGKRMKQFPEVIKYLSRNVVHSVRREHFSFSPRMPVGDFFEERDTPEGLQWVQLSAEEIPSRIQAITGKRGRPRNTEKAKTKEVPKVKRGRGRPPKVKITELLNKTDNRPLKKLEAQETLNEEDKAKIAKSKKKMRQKVQRGECQTTIQGQARNKRKQETKSLKQKEAKKKSKAEKEKGKTKQEKLKEKVKREKKEKVKMKEKEEVTKAKPACKADKTLATQRRLEERQRQQMILEEMKKPTEDMCLTDHQPLPDFSRVPGLTLPSGAFSDCLTIVEFLHSFGKVLGFDPAKDVPSLGVLQEGLLCQGDSLGEVQDLLVRLLKAALHDPGFPSYCQSLKILGEKVSEIPLTRDNVSEILRCFLMAYGVEPALCDRLRTQPFQAQPPQQKAAVLAFLVHELNGSTLIINEIDKTLESMSSYRKNKWIVEGRLRRLKTVLAKRTGRSEVEMEGPEECLGRRRSSRIMEETSGMEEEEEEESIAAVPGRRGRRDGEVDATASSIPELERQIEKLSKRQLFFRKKLLHSSQMLRAVSLGQDRYRRRYWVLPYLAGIFVEGTEGNLVPEEVIKKETDSLKVAAHASLNPALFSMKMELAGSNTTASSPARARGRPRKTKPGSMQPRHLKSPVRGQDSEQPQAQLQPEAQLHAPAQPQPQLQLQLQSHKGFLEQEGSPLSLGQSQHDLSQSAFLSWLSQTQSHSSLLSSSVLTPDSSPGKLDPAPSQPPEEPEPDEAESSPDPQALWFNISAQMPCNAAPTPPPAVSEDQPTPSPQQLASSKPMNRPSAANPCSPVQFSSTPLAGLAPKRRAGDPGEMPQSPTGLGQPKRRGRPPSKFFKQMEQRYLTQLTAQPVPPEMCSGWWWIRDPEMLDAMLKALHPRGIREKALHKHLNKHRDFLQEVCLRPSADPIFEPRQLPAFQEGIMSWSPKEKTYETDLAVLQWVEELEQRVIMSDLQIRGWTCPSPDSTREDLAYCEHLSDSQEDITWRGRGREGLAPQRKTTNPLDLAVMRLAALEQNVERRYLREPLWPTHEVVLEKALLSTPNGAPEGTTTEISYEITPRIRVWRQTLERCRSAAQVCLCLGQLERSIAWEKSVNKVTCLVCRKGDNDEFLLLCDGCDRGCHIYCHRPKMEAVPEGDWFCTVCLAQQVEGEFTQKPGFPKRGQKRKSGYSLNFSEGDGRRRRVLLRGRESPAAGPRYSEEGLSPSKRRRLSMRNHHSDLTFCEIILMEMESHDAAWPFLEPVNPRLVSGYRRIIKNPMDFSTMRERLLRGGYTSSEEFAADALLVFDNCQTFNEDDSEVGKAGHIMRRFFESRWEEFYQGKQANL

SEQ ID NO: 863045 - protein, 1903 aa, Homo sapiens
VLAPGARPCEPLVPRGETSPEPGWTPLPQEMEANDHFNFTGLPPAPAASGLKPSPSSGEGLYTNGSPMNFPQQGKSLNGDVNVNGLSTVSHTTTSGILNSAPHSSSTSHLHHPSVAYDCLWNYSQYPSANPGSNLKDPPLLSQFSGGQYPLNGILGGSRQPSSPSHNTNLRAGSQEFWANGTQSPMGLNFDSQELYDSFPDQNFEVMPNGPPSFFTSPQTSPMLGSSIQTFAPSQEVGSGIHPDEAAEKEMTSVVAENGTGLVGSLELEEEQPELKMCGYNGSVPSVESLHQEVSVLVPDPTVSCLDDPSHLPDQLEDTPILSEDSLEPFNSLAPEPVSGGLYGIDDTELMGAEDKLPLEDSPVISALDCPSLNNATAFSLLADDSQTSTSIFASPTSPPVLGESVLQDNSFDLNNGSDAEQEEMETQSSDFPPSLTQPAPDQSSTIQLHPATSPAVSPTTSPAVSLVVSPAASPEIFSLEVPLTASVTSPKASPVTSPAAAFPTASPANKDVSSFLETTADVEEITGEGLTASGSGDVMRRRIATPEEVRLPLQHGWRREVRIKKGSHRWQGETWYYGPCGKRMKQFPEVIKYLSRNVVHSVRREHFSFSPRMPVGDFFEERDTPEGLQWVQLSAEEIPSRIQAITGKRGRPRNTEKAKTKEVPKVKRGRGRPPKVKITELLNKTDNRPLKKLEAQETLNEEDKAKIAKSKKKMRQKVQRGECQTTIQGQARNKRKQETKSLKQKEAKKKSKAEKEKGKTKQEKLKEKVKREKKEKVKMKEKEEVTKAKPACKADKTLATQRRLEERQRQQMILEEMKKPTEDMCLTDHQPLPDFSRVPGLTLPSGAFSDCLTIVEFLHSFGKVLGFDPAKDVPSLGVLQEGLLCQGDSLGEVQDLLVRLLKAALHDPGFPSYCQSLKILGEKVSEIPLTRDNVSEILRCFLMAYGVEPALCDRLRTQPFQAQPPQQKAAVLAFLVHELNGSTLIINEIDKTLESMSSYRKNKWIVEGRLRRLKTVLAKRTGRSEVEMEGPEECLGRRRSSRIMEETSGMEEEEEEESIAAVPGRRGRRDGEVDATASSIPELERQIEKLSKRQLFFRKKLLHSSQMLRAVSLGQDRYRRRYWVLPYLAGIFVEGTEGNLVPEEVIKKETDSLKVAAHASLNPALFSMKMELAGSNTTASSPARARGRPRKTKPGSMQPRHLKSPVRGQDSEQPQAQLQPEAQLHAPAQPQPQLQLQLQSHKGFLEQEGSPLSLGQSQHDLSQSAFLSWLSQTQSHSSLLSSSVLTPDSSPGKLDPAPSQPPEEPEPDEAESSPDPQALWFNISAQMPCNAAPTPPPAVSEDQPTPSPQQLASSKPMNRPSAANPCSPVQFSSTPLAGLAPKRRAGDPGEMPQSPTGLGQPKRRGRPPSKFFKQMEQRYLTQLTAQPVPPEMCSGWWWIRDPEMLDAMLKALHPRGIREKALHKHLNKHRDFLQEVCLRPSADPIFEPRQLPAFQEGIMSWSPKEKTYETDLAVLQWVEELEQRVIMSDLQIRGWTCPSPDSTREDLAYCEHLSDSQEDITWRGRGREGLAPQRKTTNPLDLAVMRLAALEQNVERRYLREPLWPTHEVVLEKALLSTPNGAPEGTTTEISYEITPRIRVWRQTLERCRSAAQVCLCLGQLERSIAWEKSVNKVTCLVCRKGDNDEFLLLCDGCDRGCHIYCHRPKMEAVPEGDWFCTVCLAQQVEGEFTQKPGFPKRGQKRKSGYSLNFSEGDGRRRRVLLRGRESPAAGPRYSEEGLSPSKRRRLSMRNHHSDLTFCEIILMEMESHDAAWPFLEPVNPRLVSGYRRIIKNPMDFSTMRERLLRGGYTSSEEFAADALLVFDNCQTFNEDDSEVGKAGHIMRRFFESRWEEFYQGKQANL

SEQ ID NO: 863046 - protein, 1933 aa, Homo sapiens; identical to SEQ ID NO: 863043

SEQ ID NO: 863047 - protein, 1565 aa, Homo sapiens
SRACTHDIGHEVTLAIFYYQHYYISGSFNLSTCPGESVLQDNSFDLNNGSDAEQEEMETQSSDFPPSLTQPAPDQSSTIQLHPATSPAVSPTTSPAVSLVVSPAASPEISPEVCPAASTVVSPAVFSVVSPASSAVLPAVSLEVPLTASVTSPKASPVTSPAAAFPTASPANKDVSSFLETTADVEEITGEGLTASGSGDVMRRRIATPEEVRLPLQHGWRREVRIKKGSHRWQGETWYYGPCGKRMKQFPEVIKYLSRNVVHSVRREHFSFSPRMPVGDFFEERDTPEGLQWVQLSAEEIPSRIQAITGKRGRPRNTEKAKTKEVPKVKRGRGRPPKVKITELLNKTDNRPLKKLEAQETLNEEDKAKIAKSKKKMRQKVQRGECQTTIQGQARNKRKQETKSLKQKEAKKKSKAEKEKGKTKQEKLKEKVKREKKEKVKMKEKEEVTKAKPACKADKTLATQRRLEERQRQQMILEEMKKPTEDMCLTDHQPLPDFSRVPGLTLPSGAFSDCLTIVEFLHSFGKVLGFDPAKDVPSLGVLQEGLLCQGDSLGEVQDLLVRLLKAALHDPGFPSYCQSLKILGEKVSEIPLTRDNVSEILRCFLMAYGVEPALCDRLRTQPFQAQPPQQKAAVLAFLVHELNGSTLIINEIDKTLESMSSYRKNKWIVEGRLRRLKTVLAKRTGRSEVEMEGPEECLGRRRSSRIMEETSGMEEEEEEESIAAVPGRRGRRDGEVDATASSIPELERQIEKLSKRQLFFRKKLLHSSQMLRAVSLGQDRYRRRYWVLPYLAGIFVEGTEGNLVPEEVIKKETDSLKVAAHASLNPALFSMKMELAGSNTTASSPARARGRPRKTKPGSMQPRHLKSPVRGQDSEQPQAQLQPEAQLHAPAQPQPQLQLQLQSHKGFLEQEGSPLSLGQSQHDLSQSAFLSWLSQTQSHSSLLSSSVLTPDSSPGKLDPAPSQPPEEPEPDEAESSPDPQALWFNISAQMPCNAAPTPPPAVSEDQPTPSPQQLASSKPMNRPSAANPCSPVQFSSTPLAGLAPKRRAGDPGEMPQSPTGLGQPKRRGRPPSKFFKQMEQRYLTQLTAQPVPPEMCSGWWWIRDPEMLDAMLKALHPRGIREKALHKHLNKHRDFLQEVCLRPSADPIFEPRQLPAFQEGIMSWSPKEKTYETDLAVLQWVEELEQRVIMSDLQIRGWTCPSPDSTREDLAYCEHLSDSQEDITWRGRGREGLAPQRKTTNPLDLAVMRLAALEQNVERRYLREPLWPTHEVVLEKALLSTPNGAPEGTTTEISYEITPRIRVWRQTLERCRSAAQVCLCLGQLERSIAWEKSVNKVTCLVCRKGDNDEFLLLCDGCDRGCHIYCHRPKMEAVPEGDWFCTVCLAQQVEGEFTQKPGFPKRGQKRKSGYSLNFSEGDGRRRRVLLRGRESPAAGPRYSEEGLSPSKRRRLSMRNHHSDLTFCEIILMEMESHDAAWPFLEPVNPRLVSGYRRIIKNPMDFSTMRERLLRGGYTSSEEFAADALLVFDNCQTFNEDDSEVGKAGHIMRRFFESRWEEFYQGKQANL

SEQ ID NO: 863048 - protein, 1296 aa, Homo sapiens
FYLLLLFPLTFSFSFLLVFPFSFSALDFFLASFCFKLVVSCFRLFLACPWIVVWHSLPKVKRGRGRPPKVKITELLNKTDNRPLKKLEAQETLNEEDKAKIAKSKKKMRQKVQRGECQTTIQGQARNKRKQETKSLKQKEAKKKSKAEKEKGKTKQEKLKEKVKREKKEKVKMKEKEEVTKAKPACKADKTLATQRRLEERQRQQMILEEMKKPTEDMCLTDHQPLPDFSRVPGLTLPSGAFSDCLTIVEFLHSFGKVLGFDPAKDVPSLGVLQEGLLCQGDSLGEVQDLLVRLLKAALHDPGFPSYCQSLKILGEKVSEIPLTRDNVSEILRCFLMAYGVEPALCDRLRTQPFQAQPPQQKAAVLAFLVHELNGSTLIINEIDKTLESMSSYRKNKWIVEGRLRRLKTVLAKRTGRSEVEMEGPEECLGRRRSSRIMEETSGMEEEEEEESIAAVPGRRGRRDGEVDATASSIPELERQIEKLSKRQLFFRKKLLHSSQMLRAVSLGQDRYRRRYWVLPYLAGIFVEGTEGNLVPEEVIKKETDSLKVAAHASLNPALFSMKMELAGSNTTASSPARARGRPRKTKPGSMQPRHLKSPVRGQDSEQPQAQLQPEAQLHAPAQPQPQLQLQLQSHKGFLEQEGSPLSLGQSQHDLSQSAFLSWLSQTQSHSSLLSSSVLTPDSSPGKLDPAPSQPPEEPEPDEAESSPDPQALWFNISAQMPCNAAPTPPPAVSEDQPTPSPQQLASSKPMNRPSAANPCSPVQFSSTPLAGLAPKRRAGDPGEMPQSPTGLGQPKRRGRPPSKFFKQMEQRYLTQLTAQPVPPEMCSGWWWIRDPEMLDAMLKALHPRGIREKALHKHLNKHRDFLQEVCLRPSADPIFEPRQLPAFQEGIMSWSPKEKTYETDLAVLQWVEELEQRVIMSDLQIRGWTCPSPDSTREDLAYCEHLSDSQEDITWRGRGREGLAPQRKTTNPLDLAVMRLAALEQNVERRYLREPLWPTHEVVLEKALLSTPNGAPEGTTTEISYEITPRIRVWRQTLERCRSAAQVCLCLGQLERSIAWEKSVNKVTCLVCRKGDNDEFLLLCDGCDRGCHIYCHRPKMEAVPEGDWFCTVCLAQQVEGEFTQKPGFPKRGQKRKSGYSLNFSEGDGRRRRVLLRGRESPAAGPRYSEEGLSPSKRRRLSMRNHHSDLTFCEIILMEMESHDAAWPFLEPVNPRLVSGYRRIIKNPMDFSTMRERLLRGGYTSSEEFAADALLVFDNCQTFNEDDSEVGKAGHIMRRFFESRWEEFYQGKQANL

SEQ ID NO: 863049 - protein, 1884 aa, Homo sapiens
VLAPGARPCEPLVPRGETSPEPGWTPLPQEMEANDHFNFTGLPPAPAASGLKPSPSSGEGLYTNGSPMNFPQQGKSLNGDVNVNGLSTVSHTTTSGILNSAPHSSSTSHLHHPSVAYDCLWNYSQYPSANPGSNLKDPPLLSQFSGGQYPLNGILGGSRQPSSPSHNTNLRAGSQEFWANGTQSPMGLNFDSQELYDSFPDQNFEVMPNGPPSFFTSPQTSPMLGSSIQTFAPSQEVGSGIHPDEAAEKEMTSVVAENGTGLVGSLELEEEQPELKMCGYNGSVPSVESLHQEVSVLVPDPTVSCLDDPSHLPDQLEDTPILSEDSLEPFNSLAPEPVSGGLYGIDDTELMGAEDKLPLEDSPVISALDCPSLNNATAFSLLADDSQTSTSIFASPTSPPVLGESVLQDNSFDLNNGSDAEQEEMETQSSDFPPSLTQPAPDQSSTIQLHPATSPAVSPTTSPAVSLVVSPAASPEISPEVCPAASTVVSPAVFSVVSPASSAVLPAVSLEVPLTASVTSPKASPVTSPAAAFPTASPANKDVSSFLETTADVEEITGEGLTASGSGDVMRRRIATPEEVRLPLQHGWRREVRIKKGSHRWQGETWYYGPCGKRMKQFPEVIKYLSRNVVHSVRREHFSFSPRMPVGDFFEERDTPEGLQWVQLSAEEIPSRIQAITGKRGRPRNTEKAKTKEVPKVKRGRGRPPKVKITELLNKTDNRPLKKLEAQETLNEEDKAKIAKSKKKMRQKVQRGECQTTIQGQARNKRKQETKSLKQKEAKKKSKAEKEKGKTKQEKLKEKVKREKKEKVKMKEKEEVTKAKPACKADKTLATQRRLEERQRQQMILEEMKKPTEDMCLTDHQPLPDFSRVPGLTLPSGAFSDCLTIVEFLHSFGKVLGFDPAKDVPSLGVLQEGLLCQGDSLGEVQDLLVRLLKAALHDPGFPSYCQSLKILGEKVSEIPLTRDNVSEILRCFLMAYGVEPALCDRLRTQPFQAQPPQQKAAVLAFLVHELNGSTLIINEIDKTLESMSSYRKNKWIVEGRLRRLKTVLAKRTGRSEVEMEGPEECLGRRRSSRIMEETSGMEEEEEEESIAAVPGRRGRRDGEVDATASSIPELERQIEKLSKRQLFFRKKLLHSSQMLRAVSLGQDRYRRRYWVLPYLAGIFVEGTEGNLVPEEVIKKETDSLKVAAHASLNPALFSMKMELAGSNTTASSPARARGRPRKTKPGSMQPRHLKSPVRGQDSEQPQAQLQPEAQLHAPAQPQPQLQLQLQSHKGFLEQEGSPLSLGQSQHDLSQSAFLSWLSQTQSHSSLLSSSVLTPDSSPGKLDPAPSQPPEEPEPDEAESSPDPQALWFNISAQMPCNAAPTPPPAVSEDQPTPSPQQLASSKPMNRPSAANPCSPVQFSSTPLAGLAPKRRAGDPGEMPQSPTGLGQPKRRGRPPSKFFKQMEQRYLTQLTAQPVPPEMCSGWWWIRDPEMLDAMLKALHPRGIREKALHKHLNKHRDFLQEVCLRPSADPIFEPRQLPAFQEGIMSWSPKEKTYETDLAVLQWVEELEQRVIMSDLQIRGWTCPSPDSTREDLAYCEHLSDSQEDITWRGRGREGLAPQRKTTNPLDLAVMRLAALEQNVERRYLREPLWPTHEVVLEKALLSTPNGAPEGTTTEISYEITPRIRVWRQTLERCRSAAQVCLCLGQLERSIAWEKSVNKVQVEGEFTQKPGFPKRGQKRKSGYSLNFSEGDGRRRRVLLRGRESPAAGPRYSEEGLSPSKRRRLSMRNHHSDLTFCEIILMEMESHDAAWPFLEPVNPRLVSGYRRIIKNPMDFSTMRERLLRGGYTSSEEFAADALLVFDNCQTFNEDDSEVGKAGHIMRRFFESRWEEFYQGKQANL

SEQ ID NO: 863050 - protein, 668 aa, Homo sapiens
CINALGAYHMVTAGGANSLVIEPAHDLSQSAFLSWLSQTQSHSSLLSSSVLTPDSSPGKLDPAPSQPPEEPEPDEAESSPDPQALWFNISAQMPCNAAPTPPPAVSEDQPTPSPQQLASSKPMNRPSAANPCSPVQFSSTPLAGLAPKRRAGDPGEMPQSPTGLGQPKRRGRPPSKFFKQMEQRYLTQLTAQPVPPEMCSGWWWIRDPEMLDAMLKALHPRGIREKALHKHLNKHRDFLQEVCLRPSADPIFEPRQLPAFQEGIMSWSPKEKTYETDLAVLQWVEELEQRVIMSDLQIRGWTCPSPDSTREDLAYCEHLSDSQEDITWRGRGREGLAPQRKTTNPLDLAVMRLAALEQNVERRYLREPLWPTHEVVLEKALLSTPNGAPEGTTTEISYEITPRIRVWRQTLERCRSAAQVCLCLGQLERSIAWEKSVNKVTCLVCRKGDNDEFLLLCDGCDRGCHIYCHRPKMEAVPEGDWFCTVCLAQQVEGEFTQKPGFPKRGQKRKSGYSLNFSEGDGRRRRVLLRGRESPAAGPRYSEEGLSPSKRRRLSMRNHHSDLTFCEIILMEMESHDAAWPFLEPVNPRLVSGYRRIIKNPMDFSTMRERLLRGGYTSSEEFAADALLVFDNCQTFNEDDSEVGKAGHIMRRFFESRWEEFYQGKQANL

SEQ ID NO: 863051 - protein, 79 aa, Homo sapiens [sequence omitted]

SEQ ID NO: 863052 - protein, 1191 aa, Homo sapiens
VLAPGARPCEPLVPRGETSPEPGWTPLPQEMEANDHFNFTGLPPAPAASGLKPSPSSGEGLYTNGSPMNFPQQGKSLNGDVNVNGLSTVSHTTTSGILNSAPHSSSTSHLHHPSVAYDCLWNYSQYPSANPGSNLKDPPLLSQFSGGQYPLNGILGGSRQPSSPSHNTNLRAGSQEFWANGTQSPMGLNFDSQELYDSFPDQNFEVMPNGPPSFFTSPQTSPMLGSSIQTFAPSQEVGSGIHPDEAAEKEMTSVVAENGTGLVGSLELEEEQPELKMCGYNGSVPSVESLHQEVSVLVPDPTVSCLDDPSHLPDQLEDTPILSEDSLEPFNSLAPEPVSGGLYGIDDTELMGAEDKLPLEDSPVISALDCPSLNNATAFSLLADDSQTSTSIFASPTSPPVLGESVLQDNSFDLNNGSDAEQEEMETQSSDFPPSLTQPAPDQSSTIQLHPATSPAVSPTTSPAVSLVVSPAASPEISPEVCPAASTVVSPAVFSVVSPASSAVLPAVSLEVPLTASVTSPKASPVTSPAAAFPTASPANKDVSSFLETTADVEEITGEGLTASGSGDVMRRRIATPEEVRLPLQHGWRREVRIKKGSHRWQGETWYYGPCGKRMKQFPEVIKYLSRNVVHSVRREHFSFSPRMPVGDFFEERDTPEGLQWVQLSAEEIPSRIQAITGKRGRPRNTEKAKTKEVPKVKRGRGRPPKVKITELLNKTDNRPLKKLEAQETLNEEDKAKIAKSKKKMRQKVQRGECQTTIQGQARNKRKQETKSLKQKEAKKKSKAEKEKGKTKQEKLKEKVKREKKEKVKMKEKEEVTKAKPACKADKTLATQRRLEERQRQQMILEEMKKPTEDMCLTDHQPLPDFSRVPGLTLPSGAFSDCLTIVEFLHSFGKVLGFDPAKDVPSLGVLQEGLLCQGDSLGEVQDLLVRLLKAALHDPGFPSYCQSLKILGEKVSEIPLTRDNVSEILRCFLMAYGVEPALCDRLRTQPFQAQPPQQKAAVLAFLVHELNGSTLIINEIDKTLESMSSYRKNKWIVEGRLRRLKTVLAKRTGRSEVEMEGPEECLGRRRSSRIMEETSGMEEEEEEESIAAVPGRRGRRDGEVDATASSIPELERQIEKLSKRQLFFRKKLLHSSQMLRAVSLGQDRYRRRYWVLPYLAGIFVEGTEGNLGLRKKKEKTKQEKLKEKVKR

SEQ ID NO: 863053 - protein, 958 aa, Homo sapiens
VLAPGARPCEPLVPRGETSPEPGWTPLPQEMEANDHFNFTGLPPAPAASGLKPSPSSGEGLYTNGSPMNFPQQGKSLNGDVNVNGLSTVSHTTTSGILNSAPHSSSTSHLHHPSVAYDCLWNYSQYPSANPGSNLKDPPLLSQFSGGQYPLNGILGGSRQPSSPSHNTNLRAGSQEFWANGTQSPMGLNFDSQELYDSFPDQNFEVMPNGPPSFFTSPQTSPMLGSSIQTFAPSQEVGSGIHPDEAAEKEMTSVVAENGTGLVGSLELEEEQPELKMCGYNGSVPSVESLHQEVSVLVPDPTVSCLDDPSHLPDQLEDTPILSEDSLEPFNSLAPEPVSGGLYGIDDTELMGAEDKLPLEDSPVISALDCPSLNNATAFSLLADDSQTSTSIFASPTSPPVLGESVLQDNSFDLNNGSDAEQEEMETQSSDFPPSLTQPAPDQSSTIQLHPATSPAVSPTTSPAVSLVVSPAASPEISPEVCPAASTVVSPAVFSVVSPASSAVLPAVSLEVPLTASVTSPKASPVTSPAAAFPTASPANKDVSSFLETTADVEEITGEGLTASGSGDVMRRRIATPEEVRLPLQHGWRREVRIKKGSHRWQGETWYYGPCGKRMKQFPEVIKYLSRNVVHSVRREHFSFSPRMPVGDFFEERDTPEGLQWVQLSAEEIPSRIQAITGKRGRPRNTEKAKTKEVPKVKRGRGRPPKVKITELLNKTDNRPLKKLEAQETLNEEDKAKIAKSKKKMRQKVQRGECQTTIQGQARNKRKQETKSLKQKEAKKKSKAEKEKGKTKQEKLKEKVKREKKEKVKMKEKEEVTKAKPACKADKTLATQRRLEERQRQQMILEEMKKPTEDMCLTDHQPLPDFSRVPGLTLPSGAFSDCLTIVEFLHSFGKVLGFDPAKDVPSLGVLQEGLLCQGDSLGEVQDLLVRLLKAALHDPGFPSYCQVSASPSQSNQDK

SEQ ID NO: 863054 - protein, 469 aa, Homo sapiens
VLAPGARPCEPLVPRGETSPEPGWTPLPQEMEANDHFNFTGLPPAPAASGLKPSPSSGEGLYTNGSPMNFPQQGKSLNGDVNVNGLSTVSHTTTSGILNSAPHSSSTSHLHHPSVAYDCLWNYSQYPSANPGSNLKDPPLLSQFSGGQYPLNGILGGSRQPSSPSHNTNLRAGSQEFWANGTQSPMGLNFDSQELYDSFPDQNFEVMPNGPPSFFTSPQTSPMLGSSIQTFAPSQEVGSGIHPDEAAEKEMTSVVAENGTGLVGSLELEEEQPELKMCGYNGSVPSVESLHQEVSVLVPDPTVSCLDDPSHLPDQLEDTPILSEDSLEPFNSLAPEPVSGGLYGIDDTELMGAEDKLPLEDSPVISALDCPSLNNATAFSLLADDSQTSTSIFASPTSPPVLGESVLQEDTTYRALIVMRSERCTGTMISRSTQASDCPTILNPAMLSDSVMLVIQGTVRQILQICFPF

SEQ ID NO: 863055 - protein, 110 aa, Homo sapiens
IWVLGWNSFFSCSPFTLEPPFPFFVLPLHPIPYSPAVRLTRLWRVCPATGKTSGLLKAGSGGRDQTESRASERREVGRVKHSQGFGLKCDALAPSLGLGPYQGPGWFRVK

SEQ ID NO: 863056 - protein, 210 aa, Homo sapiens
MEIEEEWDEATKSLVRAHIKFDTPLELPVRADRHLEIRFRAQKNHCSIDIVVNVQEEVLVVDNITQGNRLAAWEAWQGEMDKGGGAGKTVMKDSLKTVLSQTGGSVLSVGQVEGEFTQKPGFPKRGQKRKSGYSLNFSEGDGRRRRVLLRGRESPAAGPRYSEEGLSPSKRRRLSMRNHHSDLTFCEIILMDLSALWQPACGYELDSYLS

SEQ ID NO: 863057 - protein, 1919 aa, Homo sapiens
HANQPVNQKDPGRTEALGGTAEEQMILEEMKNADRGYVSDDHQLLPDFSRVPGADIAQQGKSLNGDVNVNGLSTVSHTTTSGILNSAPHSSSTSHLHHPSVAYDCLWNYSQYPSANPGSNLKDPPLLSQFSGGQYPLNGILGGSRQPSSPSHNTNLRAGSQEFWANGTQSPMGLNFDSQELYDSFPDQNFEVMPNGPPSFFTSPQTSPMLGSSIQTFAPSQEVGSGIHPDEAAEKEMTSVVAENGTGLVGSLELEEEQPELKMCGYNGSVPSVESLHQEVSVLVPDPTVSCLDDPSHLPDQLEDTPILSEDSLEPFNSLAPEPVSGGLYGIDDTELMGAEDKLPLEDSPVISALDCPSLNNATAFSLLADDSQTSTSIFASPTSPPVLGESVLQDNSFDLNNGSDAEQEEMETQSSDFPPSLTQPAPDQSSTIQLHPATSPAVSPTTSPAVSLVVSPAASPEISPEVCPAASTVVSPAVFSVVSPASSAVLPAVSLEVPLTASVTSPKASPVTSPAAAFPTASPANKDVSSFLETTADVEEITGEGLTASGSGDVMRRRIATPEEVRLPLQHGWRREVRIKKGSHRWQGETWYYGPCGKRMKQFPEVIKYLSRNVVHSVRREHFSFSPRMPVGDFFEERDTPEGLQWVQLSAEEIPSRIQAITGKRGRPRNTEKAKTKEVPKVKRGRGRPPKVKITELLNKTDNRPLKKLEAQETLNEEDKAKIAKSKKKMRQKVQRGECQTTIQGQARNKRKQETKSLKQKEAKKKSKAEKEKGKTKQEKLKEKVKREKKEKVKMKEKEEVTKAKPACKADKTLATQRRLEERQRQQMILEEMKKPTEDMCLTDHQPLPDFSRVPGLTLPSGAFSDCLTIVEFLHSFGKVLGFDPAKDVPSLGVLQEGLLCQGDSLGEVQDLLVRLLKAALHDPGFPSYCQSLKILGEKVSEIPLTRDNVSEILRCFLMAYGVEPALCDRLRTQPFQAQPPQQKAAVLAFLVHELNGSTLIINEIDKTLESMSSYRKNKWIVEGRLRRLKTVLAKRTGRSEVEMEGPEECLGRRRSSRIMEETSGMEEEEEEESIAAVPGRRGRRDGEVDATASSIPELERQIEKLSKRQLFFRKKLLHSSQMLRAVSLGQDRYRRRYWVLPYLAGIFVEGTEGNLVPEEVIKKETDSLKVAAHASLNPALFSMKMELAGSNTTASSPARARGRPRKTKPGSMQPRHLKSPVRGQDSEQPQAQLQPEAQLHAPAQPQPQLQLQLQSHKGFLEQEGSPLSLGQSQHDLSQSAFLSWLSQTQSHSSLLSSSVLTPDSSPGKLDPAPSQPPEEPEPDEAESSPDPQALWFNISAQMPCNAAPTPPPAVSEDQPTPSPQQLASSKPMNRPSAANPCSPVQFSSTPLAGLAPKRRAGDPGEMPQSPTGLGQPKRRGRPPSKFFKQMEQRYLTQLTAQPVPPEMCSGWWWIRDPEMLDAMLKALHPRGIREKALHKHLNKHRDFLQEVCLRPSADPIFEPRQLPAFQEGIMSWSPKEKTYETDLAVLQWVEELEQRVIMSDLQIRGWTCPSPDSTREDLAYCEHLSDSQEDITWRGRGREGLAPQRKTTNPLDLAVMRLAALEQNVERRYLREPLWPTHEVVLEKALLSTPNGAPEGTTTEISYEITPRIRVWRQTLERCRSAAQVCLCLGQLERSIAWEKSVNKVTCLVCRKGDNDEFLLLCDGCDRGCHIYCHRPKMEAVPEGDWFCTVCLAQQVEGEFTQKPGFPKRGQKRKSGYSLNFSEGDGRRRRVLLRGRESPAAGPRYSEEGLSPSKRRRLSMRNHHSDLTFCEIILMEMESHDAAWPFLEPVNPRLVSGYRRIIKNPMDFSTMRERLLRGGYTSSEEFAADALLVFDNCQTFNEDDSEVGKAGHIMRRFFESRWEEFYQGKQANL

SEQ ID NO: 863058 - protein, 1657 aa, Homo sapiens
MCGYNGSVPSVESLHQEVSVLVPDPTVSCLDDPSHLPDQLEDTPILSEDSLEPFNSLAPEPVSGGLYGIDDTELMGAEDKLPLEDSPVISALDCPSLNNATAFSLLADDSQTSTSIFASPTSPPVLGESVLQDNSFDLNNGSDAEQEEMETQSSDFPPSLTQPAPDQSSTIQLHPATSPAVSPTTSPAVSLVVSPAASPEISPEVCPAASTVVSPAVFSVVSPASSAVLPAVSLEVPLTASVTSPKASPVTSPAAAFPTASPANKDVSSFLETTADVEEITGEGLTASGSGDVMRRRIATPEEVRLPLQHGWRREVRIKKGSHRWQGETWYYGPCGKRMKQFPEVIKYLSRNVVHSVRREHFSFSPRMPVGDFFEERDTPEGLQWVQLSAEEIPSRIQAITGKRGRPRNTEKAKTKEVPKVKRGRGRPPKVKITELLNKTDNRPLKKLEAQETLNEEDKAKIAKSKKKMRQKVQRGECQTTIQGQARNKRKQETKSLKQKEAKKKSKAEKEKGKTKQEKLKEKVKREKKEKVKMKEKEEVTKAKPACKADKTLATQRRLEERQRQQMILEEMKKPTEDMCLTDHQPLPDFSRVPGLTLPSGAFSDCLTIVEFLHSFGKVLGFDPAKDVPSLGVLQEGLLCQGDSLGEVQDLLVRLLKAALHDPGFPSYCQSLKILGEKVSEIPLTRDNVSEILRCFLMAYGVEPALCDRLRTQPFQAQPPQQKAAVLAFLVHELNGSTLIINEIDKTLESMSSYRKNKWIVEGRLRRLKTVLAKRTGRSEVEMEGPEECLGRRRSSRIMEETSGMEEEEEEESIAAVPGRRGRRDGEVDATASSIPELERQIEKLSKRQLFFRKKLLHSSQMLRAVSLGQDRYRRRYWVLPYLAGIFVEGTEGNLVPEEVIKKETDSLKVAAHASLNPALFSMKMELAGSNTTASSPARARGRPRKTKPGSMQPRHLKSPVRGQDSEQPQAQLQPEAQLHAPAQPQPQLQLQLQSHKGFLEQEGSPLSLGQSQHDLSQSAFLSWLSQTQSHSSLLSSSVLTPDSSPGKLDPAPSQPPEEPEPDEAESSPDPQALWFNISAQMPCNAAPTPPPAVSEDQPTPSPQQLASSKPMNRPSAANPCSPVQFSSTPLAGLAPKRRAGDPGEMPQSPTGLGQPKRRGRPPSKFFKQMEQRYLTQLTAQPVPPEMCSGWWWIRDPEMLDAMLKALHPRGIREKALHKHLNKHRDFLQEVCLRPSADPIFEPRQLPAFQEGIMSWSPKEKTYETDLAVLQWVEELEQRVIMSDLQIRGWTCPSPDSTREDLAYCEHLSDSQEDITWRGRGREGLAPQRKTTNPLDLAVMRLAALEQNVERRYLREPLWPTHEVVLEKALLSTPNGAPEGTTTEISYEITPRIRVWRQTLERCRSAAQVCLCLGQLERSIAWEKSVNKVTCLVCRKGDNDEFLLLCDGCDRGCHIYCHRPKMEAVPEGDWFCTVCLAQQVEGEFTQKPGFPKRGQKRKSGYSLNFSEGDGRRRRVLLRGRESPAAGPRYSEEGLSPSKRRRLSMRNHHSDLTFCEIILMEMESHDAAWPFLEPVNPRLVSGYRRIIKNPMDFSTMRERLLRGGYTSSEEFAADALLVFDNCQTFNEDDSEVGKAGHIMRRFFESRWEEFYQGKQANL

SEQ ID NO: 863059 - protein, 1933 aa, Homo sapiens; identical to SEQ ID NO: 863043

SEQ ID NO: 863060 - protein, 1933 aa, Homo sapiens; identical to SEQ ID NO: 863043

SEQ ID NO: 863061 - protein, 959 aa, Homo sapiens
QVAGITGPCHHTWLIFVFLVETGFHHVGQAGLELLTSGDPPVLASQSAGITGVSHHTWPSLNLSPSISRLKTVLAKRTGRSEVEMEGPEECLGRRRSSRIMEETSGMEEEEEEESIAAVPGRRGRRDGEVDATASSIPELERQIEKLSKRQLFFRKKLLHSSQMLRAVSLGQDRYRRRYWVLPYLAGIFVEGTEGNLVPEEVIKKETDSLKVAAHASLNPALFSMKMELAGSNTTASSPARARGRPRKTKPGSMQPRHLKSPVRGQDSEQPQAQLQPEAQLHAPAQPQPQLQLQLQSHKGFLEQEGSPLSLGQSQHDLSQSAFLSWLSQTQSHSSLLSSSVLTPDSSPGKLDPAPSQPPEEPEPDEAESSPDPQALWFNISAQMPCNAAPTPPPAVSEDQPTPSPQQLASSKPMNRPSAANPCSPVQFSSTPLAGLAPKRRAGDPGEMPQSPTGLGQPKRRGRPPSKFFKQMEQRYLTQLTAQPVPPEMCSGWWWIRDPEMLDAMLKALHPRGIREKALHKHLNKHRDFLQEVCLRPSADPIFEPRQLPAFQEGIMSWSPKEKTYETDLAVLQWVEELEQRVIMSDLQIRGWTCPSPDSTREDLAYCEHLSDSQEDITWRGRGREGLAPQRKTTNPLDLAVMRLAALEQNVERRYLREPLWPTHEVVLEKALLSTPNGAPEGTTTEISYEITPRIRVWRQTLERCRSAAQVCLCLGQLERSIAWEKSVNKVTCLVCRKGDNDEFLLLCDGCDRGCHIYCHRPKMEAVPEGDWFCTVCLAQQVEGEFTQKPGFPKRGQKRKSGYSLNFSEGDGRRRRVLLRGRESPAAGPRYSEEGLSPSKRRRLSMRNHHSDLTFCEIILMEMESHDAAWPFLEPVNPRLVSGYRRIIKNPMDFSTMRERLLRGGYTSSEEFAADALLVFDNCQTFNEDDSEVGKAGHIMRRFFESRWEEFYQGKQANL

SEQ ID NO: 863062 - protein, 793 aa, Homo sapiens
ETTMDAALQIAAEWVLPYLAGIFVEGTEGNLVPEEVIKKETDSLKVAAHASLNPALFSMKMELAGSNTTASSPARARGRPRKTKPGSMQPRHLKSPVRGQDSEQPQAQLQPEAQLHAPAQPQPQLQLQLQSHKGFLEQEGSPLSLGQSQHDLSQSAFLSWLSQTQSHSSLLSSSVLTPDSSPGKLDPAPSQPPEEPEPDEAESSPDPQALWFNISAQMPCNAAPTPPPAVSEDQPTPSPQQLASSKPMNRPSAANPCSPVQFSSTPLAGLAPKRRAGDPGEMPQSPTGLGQPKRRGRPPSKFFKQMEQRYLTQLTAQPVPPEMCSGWWWIRDPEMLDAMLKALHPRGIREKALHKHLNKHRDFLQEVCLRPSADPIFEPRQLPAFQEGIMSWSPKEKTYETDLAVLQWVEELEQRVIMSDLQIRGWTCPSPDSTREDLAYCEHLSDSQEDITWRGRGREGLAPQRKTTNPLDLAVMRLAALEQNVERRYLREPLWPTHEVVLEKALLSTPNGAPEGTTTEISYEITPRIRVWRQTLERCRSAAQVCLCLGQLERSIAWEKSVNKVTCLVCRKGDNDEFLLLCDGCDRGCHIYCHRPKMEAVPEGDWFCTVCLAQQVEGEFTQKPGFPKRGQKRKSGYSLNFSEGDGRRRRVLLRGRESPAAGPRYSEEGLSPSKRRRLSMRNHHSDLTFCEIILMEMESHDAAWPFLEPVNPRLVSGYRRIIKNPMDFSTMRERLLRGGYTSSEEFAADALLVFDNCQTFNEDDSEVGKAGHIMRRFFESRWEEFYQGKQANL

SEQ ID NO: 863063 - protein, 1661 aa, Homo sapiens
VLAPGARPCEPLVPRGETSPEPGWTPLPQEMEANDHFNFTGLPPAPAASGLKPSPSSGEGLYTNGSPMNFPQQGKSLNGDVNVNGLSTVSHTTTSGILNSAPHSSSTSHLHHPSVAYDCLWNYSQYPSANPGSNLKDPPLLSQFSGGQYPLNGILGGSRQPSSPSHNTNLRAGSQEFWANGTQSPMGLNFDSQELYDSFPDQNFEVMPNGPPSFFTSPQTSPMLGSSIQTFAPSQEVGSGIHPDEAAEKEMTSVVAENGTGLVGSLELEEEQPELKMCGYNGSVPSVESLHQEVSVLVPDPTVSCLDDPSHLPDQLEDTPILSEDSLEPFNSLAPEPVSGGLYGIDDTELMGAEDKLPLEDSPVISALDCPSLNNATAFSLLADDSQTSTSIFASPTSPPVLGESVLQDNSFDLNNGSDAEQEEMETQSSDFPPSLTQPAPDQSSTIQLHPATSPAVSPTTSPAVSLVVSPAASPEISPEVCPAASTVVSPAVFSVVSPASSAVLPAVSLEVPLTASVTSPKASPVTSPAAAFPTASPANKDVSSFLETTADVEEITGEGLTASGSGDVMRRRIATPEEVRLPLQHGWRREVRIKKGSHRWQGETWYYGPCGKRMKQFPEVIKYLSRNVVHSVRREHFSFSPRMPVGDFFEERDTPEGLQWVQLSAEEIPSRIQAITGKRGRPRNTEKAKTKEVPKVKRGRGRPPKVKITELLNKTDNRPLKKLEAQETLNEEDKAKIAKSKKKMRQKVQRGECQTTIQGQARNKRKQETKSLKQKEAKKKSKAEKEKGKTKQEKLKEKVKREKKEKVKMKEKEEVTKAKPACKADKTLATQRRLEERQRQQMILEEMKKPTEDMCLTDHQPLPDFSRVPGLTLPSGAFSDCLTIVEFLHSFGKVLGFDPAKDVPSLGVLQEGLLCQGDSLGEVQDLLVRLLKAALHDPGFPSYCQSLKILGEKVSEIPLTRDNVSEILRCFLMAYGVEPALCDRLRTQPFQAQPPQQKAAVLAFLVHELNGSTLIINEIDKTLESMSSYRKNKWIVEGRLRRLKTVLAKRTGRSEVEMEGPEECLGRRRSSRIMEETSGMEEEEEEESIAAVPGRRGRRDGEVDATASSIPELERQIEKLSKRQLFFRKKLLHSSQMLRAVSLGQDRYRRRYWVLPYLAGIFVEGTEGNLVPEEVIKKETDSLKVAAHASLNPALFSMKMELAGSNTTASSPARARGRPRKTKPGSMQPRHLKSPVRGQDSEQPQAQLQPEAQLHAPAQPQPQLQLQLQSHKGFLEQEGSPLSLGQSQHDLSQSAFLSWLSQTQSHSSLLSSSVLTPDSSPGKLDPAPSQPPEEPEPDEAESSPDPQALWFNISAQMPCNAAPTPPPAVSEDQPTPSPQQLASSKPMNRPSAANPCSPVQFSSTPLAGLAPKRRAGDPGEMPQSPTGLGQPKRRGRPPSKFFKQMEQRYLTQLTAQPVPPEMCSGWWWIRDPEMLDAMLKALHPRGIREKALHKHLNKHRDFLQEVCLRPSADPIFEPRQLPAFQEGIMSWSPKEKTYETDLAVLQWVEELEQRVIMSDLQIRGWTCPSPDSTREDLAYCEHLSDSQEDITWRGRGREGLAPQRKTTNPLDLAVMRLAALEQNVERRYLREPLWPTHEVVLEKALLSTPNGAPEGTTTEM

SEQ ID NO: 863064 - protein, 1127 aa, Homo sapiens
VLAPGARPCEPLVPRGETSPEPGWTPLPQEMEANDHFNFTGLPPAPAASGLKPSPSSGEGLYTNGSPMNFPQQGKSLNGDVNVNGLSTVSHTTTSGILNSAPHSSSTSHLHHPSVAYDCLWNYSQYPSANPGSNLKDPPLLSQFSGGQYPLNGILGGSRQPSSPSHNTNLRAGSQEFWANGTQSPMGLNFDSQELYDSFPDQNFEVMPNGPPSFFTSPQTSPMLGSSIQTFAPSQEVGSGIHPDEAAEKEMTSVVAENGTGLVGSLELEEEQPELKMCGYNGSVPSVESLHQEVSVLVPDPTVSCLDDPSHLPDQLEDTPILSEDSLEPFNSLAPEPVSGGLYGIDDTELMGAEDKLPLEDSPVISALDCPSLNNATAFSLLADDSQTSTSIFASPTSPPVLGESVLQDNSFDLNNGSDAEQEEMETQSSDFPPSLTQPAPDQSSTIQLHPATSPAVSPTTSPAVSLVVSPAASPEISPEVCPAASTVVSPAVFSVVSPASSAVLPAVSLEVPLTASVTSPKASPVTSPAAAFPTASPANKDVSSFLETTADVEEITGEGLTASGSGDVMRRRIATPEEVRLPLQHGWRREVRIKKGSHRWQGETWYYGPCGKRMKQFPEVIKYLSRNVVHSVRREHFSFSPRMPVGDFFEERDTPEGLQWVQLSAEEIPSRIQAITGKRGRPRNTEKAKTKEVPKVKRGRGRPPKVKITELLNKTDNRPLKKLEAQETLNEEDKAKIAKSKKKMRQKVQRGECQTTIQGQARNKRKQETKSLKQKEAKKKSKAEKEKGKTKQEKLKEKVKREKKEKVKMKEKEEVTKAKPACKADKTLATQRRLEERQRQQMILEEMKKPTEDMCLTDHQPLPDFSRVPGLTLPSGAFSDCLTIVEFLHSFGKVLGFDPAKDVPSLGVLQEGLLCQGDSLGEVQDLLVRLLKAALHDPGFPSYCQSLKILGEKVSEIPLTRDNVSEILRCFLMAYGVEPALCDRLRTQPFQAQPPQQKAAVLAFLVHELNGSTLIINEIDKTLESMSSYRKNKWIVEGRLRRLKTVLAKRTGRSEVEMEGPEECLGRRRSSRIMEETSGMEEEEEEESIAAVPGRRGRRDGEVDATASSIPELERQIEKLSKVLCF

SEQ ID NO: 863065 - protein, 587 aa, Homo sapiens
VLAPGARPCEPLVPRGETSPEPGWTPLPQEMEANDHFNFTGLPPAPAASGLKPSPSSGEGLYTNGSPMNFPQQGKSLNGDVNVNGLSTVSHTTTSGILNSAPHSSSTSHLHHPSVAYDCLWNYSQYPSANPGSNLKDPPLLSQFSGGQYPLNGILGGSRQPSSPSHNTNLRAGSQEFWANGTQSPMGLNFDSQELYDSFPDQNFEVMPNGPPSFFTSPQTSPMLGSSIQTFAPSQEVGSGIHPDEAAEKEMTSVVAENGTGLVGSLELEEEQPELKMCGYNGSVPSVESLHQEVSVLVPDPTVSCLDDPSHLPDQLEDTPILSEDSLEPFNSLAPEPVSGGLYGIDDTELMGAEDKLPLEDSPVISALDCPSLNNATAFSLLADDSQTSTSIFASPTSPPVLGESVLQDNSFDLNNGSDAEQEEMETQSSDFPPSLTQPAPDQSSTIQLHPATSPAVSPTTSPAVSLVVSPAASPEISPEVCPAASTVVSPAVFSVVSPASSAVLPAVSLEVPLTASVTSPKASPVTSPAAAFPTASPANKDVSSFLETTADVEEITGEGLTASGSGDVMRRRIATPEEVRLPLQHG

SEQ ID NO: 863066 - protein, 77 aa, Homo sapiens
MNSPLSLWKCVYSSSFSLSTQRQLFFRKKLLHSSQMLRAVSLGQDRYRRRYWVLPYLAGIFVEGTEGNLGRCACGSV

SEQ ID NO: 863067 - protein, 627 aa, Homo sapiens
QQLGGRVGPAAGGSGARVGGRPAARQGEHAPGLRKGDRILEVEYRGYPPPHPPRASMPLHVLRYPFIPHSRSVPSMLLTSGSPARKMADEDGEGIHPSAPHRNGGGGGGGGSGLHCAGNGGGGGGGPRVVRIVKSESGYGFNVRGQVSEGGQLRSINGELYAPLQHVSAVLPGGAADRAGVRKGDRILEVNHVNVEGATHKQVVDLIRAGEKELILTVLSVPPHEADNLDPSDDSLGQSFYDYTEKQAVPISVPRYKHVEQNGEKFVVYNVYMAGRQLCSKRYREFAILHQNLKREFANFTFPRLPGKWPFSLSEQQLDARRRGLEEYLEKVCSIRVIGESDIMQEFLSESDENYNGVSDVELRVALPDGTTVTVRVKKNSTTDQVYQAIAAKVGMDSTTVNYFALFEVISHSFVRKLAPNEFPHKLYIQNYTSAVPGTCLTIRKWLFTTEEEILLNDNDLAVTYFFHQAVDDVKKGYIKAEEKSYQLQKLYEQRKMVMYLNMLRTCEGYNEIIFPHCACDSRRKGHVITAISITHFKLHACTEEGQLENQVIAFEWDEMQRWDTDEEGMAFCFEYARGEKKPRWVKIFTPYFNYMHECFERVFCELKWRKENIFQMARSQQRDVAT

SEQ ID NO: 863068 - protein, 532 aa, Homo sapiens
QQLGGRVGPAAGGSGARVGGRPAARQGEHAPGGLGGVGGGGTARLLARWRTRTGKGFIPQPLTGTEVAAAAGGLGSTAPGTAAGEAAARGSCASSSPSPATASTCGAKNHVNVEGATHKQVVDLIRAGEKELILTVLSVPPHEADNLDPSDDSLGQSFYDYTEKQAVPISVPRYKHVEQNGEKFVVYNVYMAGRQLCSKRYREFAILHQNLKREFANFTFPRLPGKWPFSLSEQQLDARRRGLEEYLEKVCSIRVIGESDIMQEFLSESDENYNGVSDVELRVALPDGTTVTVRVKKNSTTDQVYQAIAAKVGMDSTTVNYFALFEVISHSFVRKLAPNEFPHKLYIQNYTSAVPGTCLTIRKWLFTTEEEILLNDNDLAVTYFFHQAVDDVKKGYIKAEEKSYQLQKLYEQRKMVMYLNMLRTCEGYNEIIFPHCACDSRRKGHVITAISITHFKLHACTEEGQLENQVIAFEWDEMQRWDTDEEGMAFCFEYARGEKKPRWVKIFTPYFNYMHECFERVFCELKWRKEEY

SEQ ID NO: 863069 - protein, 532 aa, Homo sapiens; identical to SEQ ID NO: 863068

SEQ ID NO: 863070 - protein, 206 aa, Homo sapiens
MFLQIIVRPLFLSFFLSFFLSFVLSFFRSFFLSFFLFLSFAFLLSSLFCNLLLQIIVRPLFFPLPSFLFFCFFFFFFPESCSVAQVGVQWHDLGSCTLCLLGSSDSPASASQVAGITGIHHHAPLIFCIFGRAGFHHDGQVGFELLTSSNLPTSASQSARITGVSHCAWPTFLSFLLILLCWQPFAPAWYGIKEDSLSSLTFSKSR

SEQ ID NO: 863071 - protein, 532 aa, Homo sapiens; identical to SEQ ID NO: 863068

SEQ ID NO: 863072 - protein, 699 aa, Homo sapiens
AAALDADTWTAAPRLPALAAPAARAMPSYTVTVATGSQWFAGTDDYIYLSLVGSAGCSEKHLLDKPFYNDFERGAVDSYDVTVDEELGEIQLVRIEKRKYWLNDDWYLKYITLKTPHGDYIEFPCYRWITGDVEVVLRDGRAKLARDDQIHILKQHRRKELETRQKQYRWMEWNPGFPLSIDAKCHKDLPRDIQFDSEKGVDFVLNYSKAMENLFINRFMHMFQSSWNDFADFEKIFVKISNTISERVMNHWQEDLMFGYQFLNGCNPVLIRRCTELPEKLPVTTEMVECSLERQLSLEQEVQQGNIFIVDFELLDGIDANKTDPCTLQFLAAPICLLYKNLANKIVPIAIQLNQIPGDENPIFLPSDAKYDWLLAKIWVRSSDFHVHQTITHLLRTHLVSEVFGIAMYRQLPAVHPIFKLLVAHVRFTIAINTKAREQLICECGLFDKANATGGGGHVQMVQRAMKDLTYASLCFPEAIKARGMESKEDIPYYFYRDDGLLVWEAIRTFTAEVVDIYYEGDQVVEEDPELQDFVNDVYVYGMRGRKSSGFPKSVKSREQLSEYLTVVIFTASAQHAAVNFGQYDWCSWIPNAPPTMRAPPPTAKGVVTIEQIVDTLPDRGRSCWHLGAVWALSQFQENELFLGMYPEEHFIEKPVKEAMARFRKNLEAIVSVIAERNKKKQLPYYYLSPDRIPNSVAI

SEQ ID NO: 863073 - protein, 676 aa, Homo sapiens
AAALDADTWTAAPRLPALAAPAARAMPSYTVTVATGSQWFAGTDDYIYLSLVGSAGCSEKHLLDKPFYNDFERGAVDSYDVTVDEELGEIQLVRIEKRKYWLNDDWYLKYITLKTPHGDYIEFPCYRWITGDVEVVLRDGRAKLARDDQIHILKQHRRKELETRQKQYRWMEWNPGFPLSIDAKCHKDLPRDIQFDSEKGVDFVLNYSKAMENLFINRFMHMFQSSWNDFADFEKIFVKISNTISERVMNHWQEDLMFGYQFLNGCNPVLIRRCTELPEKLPVTTEMVECSLERQLSLEQEVQQGNIFIVDFELLDGIDANKTDPCTLQFLAAPICLLYKNLANKIVPIAIQLNQIPGDENPIFLPSDAKYDWLLAKIWVRSSDFHVHQTITHLLRTHLVSEVFGIAMYRQLPAVHPIFKLLVAHVRFTIAINTKAREQLICECGLFDKANATGGGGHVQMVQRAMKDLTYASLCFPEAIKARGMESKEDIPYYFYRDDGLLVWEAIRTCAPAGRWSWGRSRDPCLTTWGGPGPSTASAEWGRGGGVPASVRGLPPGTAPQTWLGRPPRLRPLSQVHGRGGRHLLRGRPGGGGGPGAAGLRERCLRVRHAGPQVLRLPQVGQEPGAAVGVPDRGDLHRLRPARRGQLRPVRLVLLDPQCAPNHASPATDCQGRGDH

SEQ ID NO: 863074 - protein, 640 aa, Homo sapiens
MAQETTHGLIACSPSQVDSYDVTVDEELGEIQLVRIEKRKYWLNDDWYLKYITLKTPHGDYIEFPCYRWITGDVEVVLRDGRAKLARDDQIHILKQHRRKELETRQKQYRWMEWNPGFPLSIDAKCHKDLPRDIQFDSEKGVDFVLNYSKAMENLFINRFMHMFQSSWNDFADFEKIFVKISNTISERVMNHWQEDLMFGYQFLNGCNPVLIRRCTELPEKLPVTTEMVECSLERQLSLEQEVQQGNIFIVDFELLDGIDANKTDPCTLQFLAAPICLLYKNLANKIVPIAIQLNQIPGDENPIFLPSDAKYDWLLAKIWVRSSDFHVHQTITHLLRTHLVSEVFGIAMYRQLPAVHPIFKLLVAHVRFTIAINTKAREQLICECGLFDKANATGGGGHVQMVQRAMKDLTYASLCFPEAIKARGMESKEDIPYYFYRDDGLLVWEAIRTFTAEVVDIYYEGDQVVEEDPELQDFVNDVYVYGMRGRKSSGFPKSVKSREQLSEYLTVVIFTASAQHAAVNFGQYDWCSWIPNAPPTMRAPPPTAKGVVTIEQIVDTLPDRGRSCWHLGAVWALSQFQENELFLGMYPEEHFIEKPVKEAMARFRKNLEAIVSVIAERNKKKQLPYYYLSPDRIPNSVAI

SEQ ID NO: 863075 - protein, 652 aa, Homo sapiens
MPTMVTTGDGEQKHLLDKPFYNDFERGAVDSYDVTVDEELGEIQLVRIEKRKYWLNDDWYLKYITLKTPHGDYIEFPCYRWITGDVEVVLRDGRAKLARDDQIHILKQHRRKELETRQKQYRWMEWNPGFPLSIDAKCHKDLPRDIQFDSEKGVDFVLNYSKAMENLFINRFMHMFQSSWNDFADFEKIFVKISNTISERVMNHWQEDLMFGYQFLNGCNPVLIRRCTELPEKLPVTTEMVECSLERQLSLEQEVQQGNIFIVDFELLDGIDANKTDPCTLQFLAAPICLLYKNLANKIVPIAIQLNQIPGDENPIFLPSDAKYDWLLAKIWVRSSDFHVHQTITHLLRTHLVSEVFGIAMYRQLPAVHPIFKLLVAHVRFTIAINTKAREQLICECGLFDKANATGGGGHVQMVQRAMKDLTYASLCFPEAIKARGMESKEDIPYYFYRDDGLLVWEAIRTFTAEVVDIYYEGDQVVEEDPELQDFVNDVYVYGMRGRKSSGFPKSVKSREQLSEYLTVVIFTASAQHAAVNFGQYDWCSWIPNAPPTMRAPPPTAKGVVTIEQIVDTLPDRGRSCWHLGAVWALSQFQENELFLGMYPEEHFIEKPVKEAMARFRKNLEAIVSVIAERNKKKQLPYYYLSPDRIPNSVAI

SEQ ID NO: 863076 - protein, 795 aa, Homo sapiens
AAALDADTWTAAPRLPALAAPAARAMPSYTVTVATGSQWFAGTDDYIYLSLVGSAGCSEKHLLDKPFYNDFERGAVDSYDVTVDEELGEIQLVRIEKRKYWLNDDWYLKYITLKTPHGDYIEFPCYRWITGDVEVVLRDGRAKLARDDQIHILKQHRRKELETRQKQYRWMEWNPGFPLSIDAKCHKDLPRDIQFDSEKGVDFVLNYSKAMENLFINRFMHMFQSSWNDFADFEKIFVKISNTISERVMNHWQEDLMFGYQFLNGCNPVLIRRCTELPEKLPVTTEMVECSLERQLSLEQEVQQGNIFIVDFELLDGIDANKTDPCTLQFLAAPICLLYKNLANKIVPIAIQLNQIPGDENPIFLPSDAKYDWLLAKIWVRSSDFHVHQTITHLLRTHLVSEVFGIAMYRQLPAVHPIFKLLVAHVRFTIAINTKAREQLICECGLFDKANATGGGGHVQMVQRAMKDLTYASLCFPEAIKARGMESKEDIPYYFYRDDGLLVWEAIRTFTAEVVDIYYEGDQVVEEDPELQDFVNDVYVYGMRGRKSSGFPKSVKSREQLSEYLTVVIFTASAQHAAVNFGQVGRAGPAGQGSLLKAAASSPAPVLHAYCTLGQPRGLARDLQDGFCPLSQGLLAAGKEDGRTAGPAGVGGHGEDGAQGAAGQQGFGGAHACWRSSPQYDWCSWIPNAPPTMRAPPPTAKGVVTIEQIVDTLPDRGRSCWHLGAVWALSQFQENELFLGMYPEEHFIEKPVKEAMARFRKNLEAIVSVIAERNKKKQLPYYYLSPDRIPNSVAI

SEQ ID NO: 863077 - protein, 170 aa, Homo sapiens
RLVPAAGPMIVYGMRGRKSSGFPKSVKSREQLSEYLTVVIFTASAQHAAVNFGQYDWCSWIPNAPPTMRAPPPTAKGVVTIEQIVDTLPDRGRSCWHLGAVWALSQFQENELFLGMYPEEHFIEKPVKEAMARFRKNLEAIVSVIAERNKKKQLPYYYLSPDRIPNSVAI

SEQ ID NO: 863078 - protein, 473 aa, Homo sapiens
AAALDADTWTAAPRLPALAAPAARAMPSYTVTVATGSQWFAGTDDYIYLSLVGSAGCSEKHLLDKPFYNDFERGAVDSYDVTVDEELGEIQLVRIEKRKYWLNDDWYLKYITLKTPHGDYIEFPCYRWITGDVEVVLRDGRAKLARDDQIHILKQHRRKELETRQKQYRWMEWNPGFPLSIDAKCHKDLPRDIQFDSEKGVDFVLNYSKAMENLFINRFMHMFQSSWNDFADFEKIFVKISNTISERVMNHWQEDLMFGYQFLNGCNPVLIRRCTELPEKLPVTTEMVECSLERQLSLEQEVQQGNIFIVDFELLDGIDANKTDPCTLQFLAAPICLLYKNLANKIVPIAIQLNQIPGDENPIFLPSDAKYDWLLAKIWVRSSDFHVHQTITHLLRTHLVSEVFGIAMYRQLPAVHPIFKLLVAHVRFTIAINTKAREQLICECGLFDKVGALLPYLLPGRAQPGRLHSLSEI

SEQ ID NO: 863079 - protein, 315 aa, Homo sapiens
AAALDADTWTAAPRLPALAAPAARAMPSYTVTVATGSQWFAGTDDYIYLSLVGSAGCSEKHLLDKPFYNDFERGAVDSYDVTVDEELGEIQLVRIEKRKYWLNDDWYLKYITLKTPHGDYIEFPCYRWITGDVEVVLRDGRAKLARDDQIHILKQHRRKELETRQKQYRWMEWNPGFPLSIDAKCHKDLPRDIQFDSEKGVDFVLNYSKAMENLFINRFMHMFQSSWNDFADFEKIFVKISNTISERVMNHWQEDLMFGYQFLNGCNPVLIRRCTELPEKLPVTTEMVECSLERQLSLEQEVQPDFWSYLTHRNL

SEQ ID NO: 863080 - protein, 329 aa, Homo sapiens
AAALDADTWTAAPRLPALAAPAARAMPSYTVTVATGSQWFAGTDDYIYLSLVGSAGCSEKHLLDKPFYNDFERGAVDSYDVTVDEELGEIQLVRIEKRKYWLNDDWYLKYITLKTPHGDYIEFPCYRWITGDVEVVLRDGRAKLARDDQIHILKQHRRKELETRQKQYRWMEWNPGFPLSIDAKCHKDLPRDIQFDSEKGVDFVLNYSKAMENLFINRFMHMFQSSWNDFADFEKIFVKISNTISERVMNHWQEDLMFGYQFLNGCNPVLIRRCTELPEKLPVTTEMVECSLERQLSLEQEVQSSRFQTPQMPNELLPFLHLTPNCHNL

SEQ ID NO: 863081 - protein, 699 aa, Homo sapiens; identical to SEQ ID NO: 863072

SEQ ID NO: 863082 - protein, 699 aa, Homo sapiens; identical to SEQ ID NO: 863072

SEQ ID NO: 863083 - protein, 701 aa, Homo sapiens
LWRWVRVVAVSWLCPAAAECLGHRIHGVLLVFELRFLDDILTAQRDDYIYLSLVGSAGCSEKHLLDKPFYNDFERGAVDSYDVTVDEELGEIQLVRIEKRKYWLNDDWYLKYITLKTPHGDYIEFPCYRWITGDVEVVLRDGRAKLARDDQIHILKQHRRKELETRQKQYRWMEWNPGFPLSIDAKCHKDLPRDIQFDSEKGVDFVLNYSKAMENLFINRFMHMFQSSWNDFADFEKIFVKISNTISERVMNHWQEDLMFGYQFLNGCNPVLIRRCTELPEKLPVTTEMVECSLERQLSLEQEVQQGNIFIVDFELLDGIDANKTDPCTLQFLAAPICLLYKNLANKIVPIAIQLNQIPGDENPIFLPSDAKYDWLLAKIWVRSSDFHVHQTITHLLRTHLVSEVFGIAMYRQLPAVHPIFKLLVAHVRFTIAINTKAREQLICECGLFDKANATGGGGHVQMVQRAMKDLTYASLCFPEAIKARGMESKEDIPYYFYRDDGLLVWEAIRTFTAEVVDIYYEGDQVVEEDPELQDFVNDVYVYGMRGRKSSGFPKSVKSREQLSEYLTVVIFTASAQHAAVNFGQYDWCSWIPNAPPTMRAPPPTAKGVVTIEQIVDTLPDRGRSCWHLGAVWALSQFQENELFLGMYPEEHFIEKPVKEAMARFRKNLEAIVSVIAERNKKKQLPYYYLSPDRIPNSVAI

SEQ ID NO: 863084 - protein, 723 aa, Homo sapiens
AAALDADTWTAAPRLPALAAPAARAMPSYTVTVATGSQWFAGTDDYIYLSLVGSAGCSEKHLLDKPFYNDFERGAVDSYDVTVDEELGEIQLVRIEKRKYWLNDDWYLKYITLKTPHGDYIEFPCYRWITGDVEVVLRDGRAKLARDDQIHILKQHRRKELETRQKQYRWMEWNPGFPLSIDAKCHKDLPRDIQFDSEKGVDFVLNYSKAMENLFINRFMHMFQSSWNDFADFEKIFVKISNTISERVMNHWQEDLMFGYQFLNGCNPVLIRRCTELPEKLPVTTEMVECSLERQLSLEQEVQQGNIFIVDFELLDGIDANKTDPCTLQFLAAPICLLYKNLANKIVPIAIQLNQIPGDENPIFLPSDAKYDWLLAKIWVRSSDFHVHQTITHLLRTHLVSEVFGIAMYRQLPAVHPIFKLLVAHVRFTIAINTKAREQLICECGLFDKANATGGGGHVQMVQRAMKDLTYASLCFPEAIKARGMESKEDIPYYFYRDDGLLVWEAIRTFTAEVVDIYYEGDQVVEEDPELQDFVNDVYVYGMRGRKSSGFPKSVKSREQLSEYLTVVIFTASAQHAAVNFGQYDWCSWIPNAPPTMRAPPPTAKGVVTIEQIVDTLPDRGRSCWHLGAVWALSQFQENEVKLGRAGHSPGHPRLSGSSASGLCDSGPKAHLEQRNPDFQGWKGPEGCSRHQVPRPQPGQSSGCAGQESTQPRLCSLSPEGRV

SEQ ID NO: 863085 - protein, 527 aa, Homo sapiens
AAALDADTWTAAPRLPALAAPAARAMPSYTVTVATGSQWFAGTDDYIYLSLVGSAGCSEKHLLDKPFYNDFERGAVDSYDVTVDEELGEIQLVRIEKRKYWLNDDWYLKYITLKTPHGDYIEFPCYRWITGDVEVVLRDGRAKLARDDQIHILKQHRRKELETRQKQYRWMEWNPGFPLSIDAKCHKDLPRDIQFDSEKGVDFVLNYSKAMENLFINRFMHMFQSSWNDFADFEKIFVKISNTISERVMNHWQEDLMFGYQFLNGCNPVLIRRCTELPEKLPVTTEMVECSLERQLSLEQEVQQGNIFIVDFELLDGIDANKTDPCTLQFLAAPICLLYKNLANKIVPIAIQLNQIPGDENPIFLPSDAKYDWLLAKIWVRSSDFHVHQTITHLLRTHLVSEVFGIAMYRQLPAVHPIFKLLVAHVRFTIAINTKAREQLICECGLFDKANATGGGGHVQMVQRAMKDLTYASLCFPEAIKARGMESKEDIPYYFYRDDGLLVWEAIRTFTAEVVDIYYEGDLPRAW

SEQ ID NO: 863086 - protein, 134 aa, Homo sapiens
GAGESGAGAQRAAVNFGQYDWCSWIPNAPPTMRAPPPTAKGVVTIEQIVDTLPDRGRSCWHLGAVWALSQFQENELFLGMYPEEHFIEKPVKEAMARFRKNLEAIVSVIAERNKKKQLPYYYLSPDRIPNSVAI

SEQ ID NO: 863087 - protein, 329 aa, Homo sapiens
AAALDADTWTAAPRLPALAAPAARAMPSYTVTVATGSQWFAGTDDYIYLSLVGSAGCSEKHLLDKPFYNDFERGAVDSYDVTVDEELGEIQLVRIEKRKYWLNDDWYLKYITLKTPHGDYIEFPCYRWITGDVEVVLRDGRAKLARDDQIHILKQHRRKELETRQKQYRWMEWNPGFPLSIDAKCHKDLPRDIQFDSEKGVDFVLNYSKAMENLFINRFMHMFQSSWNDFADFEKIFVKISNTISERVMNHWQEDLMFGYQFLNGCNPVLIRRCTELPEKLPVTTEMVECSLERQLSLEQEVQVGVDGLGKWPRSQSVRWKPVPPGQCS

SEQ ID NO: 863088 - protein, 134 aa, Homo sapiens
SYPELPQPVNTFHVNQSALESEERSTHSELRWVAGKGEGCPEVITLSPGLIFGPSAEPDLDTSLCLLQQGNIFIVDFELLDGIDANKTDPCTLQFLAAPICLLYKNLANKIVPIAIQVGCWGAHLSEQLSPLRS

SEQ ID NO: 863089 - protein, 106 aa, Homo sapiens
MFAPAVMRAFRKNKTLGYGVPMLLLIVGGSFGLREFSQIRYDAVKSKMDPELEKKLKENKISLESEYEKIKDSKFDDWKNIRGPRPWEDPDLLQGRNPESLKTKTT

SEQ ID NO: 863090 - protein, 106 aa, Homo sapiens; identical to SEQ ID NO: 863089

SEQ ID NO: 863091 - protein, 78 aa, Homo sapiens
LLASVGRILSAPPLLGGTEMDPELEKKLKENKISLESEYEKIKDSKFDDWKNIRGPRPWEDPDLLQGRNPESLKTKTT

SEQ ID NO: 863092 - protein, 75 aa, Homo sapiens
KYAHDDRSQRIYLPTFMDPELEKKLKENKISLESEYEKIKDSKFDDWKNIRGPRPWEDPDLLQGRNPESLKTKTT

SEQ ID NO: 863093 - protein, 106 aa, Homo sapiens; identical to SEQ ID NO: 863089

SEQ ID NO: 863094 - protein, 77 aa, Homo sapiens
TAYKEKYEDESKPFRYTWMDPELEKKLKENKISLESEYEKIKDSKFDDWKNIRGPRPWEDPDLLQGRNPESLKTKTT

SEQ ID NO: 863095 - protein, 233 aa, Homo sapiens
MKGYQSLVFNFFFLKLSAENESTPIQQLLEHFLRQLQRKDPHGFFAFPVTDAIAPGYSMIIKHPMDFGTMKDKIVANEYKSVTEFKADFKLMCDNAMTYNRPDTVYYKLAKKILHAGFKMMSKQAALLGNEDTAVEEPVPEVVPVQVETAKKSKKPSREVISCMFEPEGNACSLTDSTAEEHVLALVEHAADEARDRINRFLPGGKVVLCGHRERVPRGPRLSVCLSFWVGAV

SEQ ID NO: 863096 - protein, 649 aa, Homo sapiens
PPRPVSGAAQRARQPRRSERGRPARARGRWRPRSDRVPAVPSPRLGPAAGAAMGKKHKKHKAEWRSSYEDYADKPLEKPLKLVLKVGGSEVTELSGSGHDSSYYDDRSDHERERHKEKKKKKKKKSEKEKHLDDEERRKRKEEKKRKREREHCDTEGEADDFDPGKKVEVEPPPDRPVRACRTQPAENESTPIQQLLEHFLRQLQRKDPHGFFAFPVTDAIAPGYSMIIKHPMDFGTMKDKIVANEYKSVTEFKADFKLMCDNAMTYNRPDTVYYKLAKKILHAGFKMMSKQAALLGNEDTAVEEPVPEVVPVQVETAKKSKKPSREVISCMFEPEGNACSLTDSTAEEHVLALVEHAADEARDRINRFLPGGKMGYLKRNGDGSLLYSVVNTAEPDADEEETHPVDLSSLSSKLLPGFTTLGFKDERRNKVTFLSSATTALSMQNNSVFGDLKSDEMELLYSAYGDETGVQCALSLQEFVKDAGSYSKKVVDDLLDQITGGDHSRTLFQLKQRRNVPMKPPDEAKVGDTLGDSSSSVLEFMSMKSYPDVSVDISMLSSLGKVKKELDPDDSHLNLDETTKLLQDLHEAQAERGGSRPSSNLSSLSNASERDQHHLGSPSRLSVGEQPDVTHDPYEFLQSPEPAASAKT

SEQ ID NO: 863097 - protein, 410 aa, Homo sapiens
MLRALHARKPSVFPASGPSLAIPSNKADFKLMCDNAMTYNRPDTVYYKLAKKILHAGFKMMSKQAALLGNEDTAVEEPVPEVVPVQVETAKKSKKPSREVISCMFEPEGNACSLTDSTAEEHVLALVEHAADEARDRINRFLPGGKETSRPSVFSGNRAQAVCSLRLPSSPDKRSRAMQMGYLKRNGDGSLLYSVVNTAEPDADEEETHPVDLSSLSSKLLPGFTTLGFKDERRNKVTFLSSATTALSMQNNSVFGDLKSDEMELLYSAYGDETGVQCALSLQEFVKDAGSYSKKVVDDLLDQITGGDHSRTLFQLKQRRNVPMKPPDEAKVGDTLGDSSSSVLEFMSMKSYPDVSVDISMLSSLVSFRACHLSRDAVLKSDRNLVSYYHGVCFVNLQISVLKLMLVSCA

SEQ ID NO: 863098 - protein, 871 aa, Homo sapiens
PPRPVSGAAQRARQPRRSERGRPARARGRWRPRSDRVPAVPSPRLGPAAGAAMGKKHKKHKAEWRSSYEDYADKPLEKPLKLVLKVGGSEVTELSGSGHDSSYYDDRSDHERERHKEKKKKKKKKSEKEKHLDDEERRKRKEEKKRKREREHCDTEGEADDFDPGKKVEVEPPPDRPVRACRTQPAENESTPIQQLLEHFLRQLQRKDPHGFFAFPVTDAIAPGYSMIIKHPMDFGTMKDKIVANEYKSVTEFKADFKLMCDNAMTYNRPDTVYYKLAKKILHAGFKMMSKERLLALKRSMSFMQDMDFSQQAALLGNEDTAVEEPVPEVVPVQVETAKKSKKPSREVISCMFEPEGNACSLTDSTAEEHVLALVEHAADEARDRINRFLPGGKVVLCGHRERVPRGPRLSVCLSFWVGAVSSSTATGIQRSAWGPDGRSGSDTHKAGLFSRGPGASGRAAAGVSCIVEATVVTDLISLMEALLQANPFSWSEMLTSVSLSLGVDVRHRPCYSSGGAGVGSDRWSIMATDCVHVAPATDGLCGGGAHSADHALLSGRRRSRPSVFSGNRAQAVCSLRLPSSPDKRSRAMQVTLILQMGYLKRNGDGSLLYSVVNTAEPDADEEETHPVDLSSLSSKLLPGFTTLGFKDERRNKVTFLSSATTALSMQNNSVFGDLKSDEMELLYSAYGDETGVQCALSLQEFVKDAGSYSKKVVDDLLDQITGGDHSRTLFQLKQRRNVPMKPPDEAKVGDTLGDSSSSVLEFMSMKSYPDVSVDISMLSSLGKVKKELDPDDSHLNLDETTKLLQDLHEAQAERGGSRPSSNLSSLSNASERDQHHLGSPSRLSVGEQPDVTHDPYEFLQSPEPAASAKT

SEQ ID NO: 863099 - protein, 665 aa, Homo sapiens
PPRPVSGAAQRARQPRRSERGRPARARGRWRPRSDRVPAVPSPRLGPAAGAAMGKKHKKHKAEWRSSYEDYADKPLEKPLKLVLKVGGSEVTELSGSGHDSSYYDDRSDHERERHKEKKKKKKKKSEKEKHLDDEERRKRKEEKKRKREREHCDTEGEADDFDPGKKVEVEPPPDRPVRACRTQPAENESTPIQQLLEHFLRQLQRKDPHGFFAFPVTDAIAPGYSMIIKHPMDFGTMKDKIVANEYKSVTEFKADFKLMCDNAMTYNRPDTVYYKLAKKILHAGFKMMSKQAALLGNEDTAVEEPVPEVVPVQVETAKKSKKPSREVISCMFEPEGNACSLTDSTAEEHVLALVEHAADEARDRINRFLPGGKMGYLKRNGDGSLLYSVVNTAEPDADEEETHPVDLSSLSSKLLPGFTTLGFKDERRNKVTFLSSATTALSMQNNSVFGDLKSDEMELLYSAYGDETGVQCALSLQEFVKDAGSYSKKVVDDLLDQITGGDHSRTLFQLKQVSPGDRDCVLTTPSALRRNVPMKPPDEAKVGDTLGDSSSSVLEFMSMKSYPDVSVDISMLSSLGKVKKELDPDDSHLNLDETTKLLQDLHEAQAERGGSRPSSNLSSLSNASERDQHHLGSPSRLSVGEQPDVTHDPYEFLQSPEPAASAKT

SEQ ID NO: 863100 - protein, 649 aa, Homo sapiens; identical to SEQ ID NO: 863096

SEQ ID NO: 863101 - protein, 649 aa, Homo sapiens; identical to SEQ ID NO: 863096

SEQ ID NO: 863102 - protein, 649 aa, Homo sapiens; identical to SEQ ID NO: 863096

SEQ ID NO: 863103 - protein, 605 aa, Homo sapiens
PPRPVSGAAQRARQPRRSERGRPARARGRWRPRSDRVPAVPSPRLGPAAGAAMGKKHKKHKAEWRSSYEDYADKPLEKPLKLVLKVGGSEVTELSGSGHDSSYYDDRSDHERERHKEKKKKKKKKSEKEKHLDDEERRKRKEEKKRKREREHCDTEGEADDFDPGKKVEVEPPPDRPVRACRTQPAENESTPIQQLLEHFLRQLQRKDPHGFFAFPVTDAIAPGYSMIIKHPMDFGTMKDKIVANEYKSVTEFKADFKLMCDNAMTYNRPDTVYYKLAKKILHAGFKMMSKQAALLGNEDTAVEEPVPEVVPVQVETAKKSKKPSREVISCMFEPEGNACSLTDSTAEEHVLALVEHAADEARDRINRFLPGGKMGYLKRNGDGSLLYSVVNTAEPDADEEETHPVDLSSLSSKLLPGFTTLGFKDERRNKVTFLSSATTALSMQNNSVFGDLKSDEMELLYSAYGDETGVQCALSLQEFVKDAGSYSKKVVDDLLDQITGGDHSRTLFQLKQRRNVPMKPPDEAKVGDTLGDSSSSVLEFMSMKSYPDVSVDISMLSSLVSFRACHLSRDAVLKSDRNLVSYYHGVCFVNLQISVLKLMLVSCA

SEQ ID NO: 863104 - protein, 187 aa, Homo sapiens
PPRPVSGAAQRARQPRRSERGRPARARGRWRPRSDRVPAVPSPRLGPAAGAAMGKKHKKHKAEWRSSYEDYADKPLEKPLKLVLKVGGSEVTELSGSGHDSSYYDDRSDHERERHKEKKKKKKKKSEKEKHLDDEERRKRKEEKKRKREREHCDTEGEADDFDPGKKVEGVVSSFLRPYSPRQPRQL

SEQ ID NO: 863105 - protein, 130 aa, Homo sapiens
MHMGWDVKNAEVGAFQRCLLLFACACWEVAVLCVACVLRGCGLRGSRVGRSWSAWLTCWEVAVVCMACVLGGCSLCGPCVGRLWSAWLVCWEVVVHVACMLGSCCGLRGLCVGRLWFVWLVCWEVAVCVA

SEQ ID NO: 863106 - protein, 501 aa, Homo sapiens
MKGYQSLVFNFFFLKLSAENESTPIQQLLEHFLRQLQRKDPHGFFAFPVTDAIAPGYSMIIKHPMDFGTMKDKIVANEYKSVTEFKADFKLMCDNAMTYNRPDTVYYKLAKKILHAGFKMMSKERLLALKRSMSFMQDMDFSQQAALLGNEDTAVEEPVPEVVPVQVETAKKSKKPSREVISCMFEPEGNACSLTDSTAEEHVLALVEHAADEARDRINRFLPGGKMGYLKRNGDGSLLYSVVNTAEPDADEEETHPVDLSSLSSKLLPGFTTLGFKDERRNKVTFLSSATTALSMQNNSVFGDLKSDEMELLYSAYGDETGVQCALSLQEFVKDAGSYSKKVVDDLLDQITGGDHSRTLFQLKQRRNVPMKPPDEAKVGDTLGDSSSSVLEFMSMKSYPDVSVDISMLSSLGKVKKELDPDDSHLNLDETTKLLQDLHEAQAERGGSRPSSNLSSLSNASERDQHHLGSPSRLSVGEQPDVTHDPYEFLQSPEPAASAKT

SEQ ID NO: 863107 - protein, 481 aa, Homo sapiens
MKGYQSLVFNFFFLKLSAENESTPIQQLLEHFLRQLQRKDPHGFFAFPVTDAIAPGYSMIIKHPMDFGTMKDKIVANEYKSVTEFKADFKLMCDNAMTYNRPDTVYYKLAKKILHAGFKMMSKQAALLGNEDTAVEEPVPEVVPVQVETAKKSKKPSREVISCMFEPEGNACSLTDSTAEEHVLALVEHAADEARDRINRFLPGGKMGYLKRNGDGSLLYSVVNTAEPDADEEETHPVDLSSLSSKLLPGFTTLGFKDERRNKVTFLSSATTALSMQNNSVFGDLKSDEMELLYSAYGDETGVQCALSLQEFVKDAGSYSKKVVDDLLDQITGGDHSRTLFQLKQRRNVPMKPPDEAKVGDTLGDSSSSVLEFMSMKSYPDVSVDISMLSSLGKVKKELDPDDSHLNLDETTKLLQDLHEAQAERGGSRPSSNLSSLSNASERDQHHLGSPSRLSVGEQPDVTHDPYEFLQSPEPAASAKT

SEQ ID NO: 863108 - protein, 669 aa, Homo sapiens
PPRPVSGAAQRARQPRRSERGRPARARGRWRPRSDRVPAVPSPRLGPAAGAAMGKKHKKHKAEWRSSYEDYADKPLEKPLKLVLKVGGSEVTELSGSGHDSSYYDDRSDHERERHKEKKKKKKKKSEKEKHLDDEERRKRKEEKKRKREREHCDTEGEADDFDPGKKVEVEPPPDRPVRACRTQPAENESTPIQQLLEHFLRQLQRKDPHGFFAFPVTDAIAPGYSMIIKHPMDFGTMKDKIVANEYKSVTEFKADFKLMCDNAMTYNRPDTVYYKLAKKILHAGFKMMSKERLLALKRSMSFMQDMDFSQQAALLGNEDTAVEEPVPEVVPVQVETAKKSKKPSREVISCMFEPEGNACSLTDSTAEEHVLALVEHAADEARDRINRFLPGGKMGYLKRNGDGSLLYSVVNTAEPDADEEETHPVDLSSLSSKLLPGFTTLGFKDERRNKVTFLSSATTALSMQNNSVFGDLKSDEMELLYSAYGDETGVQCALSLQEFVKDAGSYSKKVVDDLLDQITGGDHSRTLFQLKQRRNVPMKPPDEAKVGDTLGDSSSSVLEFMSMKSYPDVSVDISMLSSLGKVKKELDPDDSHLNLDETTKLLQDLHEAQAERGGSRPSSNLSSLSNASERDQHHLGSPSRLSVGEQPDVTHDPYEFLQSPEPAASAKT

SEQ ID NO: 863109 - protein, 275 aa, Homo sapiens
MGYLKRNGDGSLLYSVVNTAEPDADEEETHPVDLSSLSSKLLPGFTTLGFKDERRNKVTFLSSATTALSMQNNSVFGDLKSDEMELLYSAYGDETGVQCALSLQEFVKDAGSYSKKVVDDLLDQITGGDHSRTLFQLKQRRNVPMKPPDEAKVGDTLGDSSSSVLEFMSMKSYPDVSVDISMLSSLGKVKKELDPDDSHLNLDETTKLLQDLHEAQAERGGSRPSSNLSSLSNASERDQHHLGSPSRLSVGEQPDVTHDPYEFLQSPEPAASAKT

SEQ ID NO: 863110 - protein, 137 aa, Homo sapiens
RGSHSIRDLQEFVKDAGSYSKKVVDDLLDQITGGDHSRTLFQLKQRRNVPMKPPDEAKVGDTLGDSSSSVLEFMSMKSYPDVSVDISMLSSLVSFRACHLSRDAVLKSDRNLVSYYHGVCFVNLQISVLKLMLVSCA

SEQ ID NO: 863111 - protein, 421 aa, Homo sapiens
PPRPVSGAAQRARQPRRSERGRPARARGRWRPRSDRVPAVPSPRLGPAAGAAMGKKHKKHKAEWRSSYEDYADKPLEKPLKLVLKVGGSEVTELSGSGHDSSYYDDRSDHERERHKEKKKKKKKKSEKEKHLDDEERRKRKEEKKRKREREHCDTEGEADDFDPGKKVEVEPPPDRPVRACRTQPAENESTPIQQLLEHFLRQLQRKDPHGFFAFPVTDAIAPGYSMIIKHPMDFGTMKDKIVANEYKSVTEFKADFKLMCDNAMTYNRPDTVYYKLAKKILHAGFKMMSKERLLALKRSMSFMQDMDFSQQAALLGNEDTAVEEPVPEVVPVQVETAKKSKKPSREVISCMFEPEGNACSLTDSTAEEHVLALVEHAADEARDRINRFLPGGKVVLCGHRERVPRGPRLSVCLSFWVGAV

SEQ ID NO: 863112 - protein, 711 aa, Homo sapiens
RTSQKLLSLTKVSSPAGPTEDNDLSRKAVAQAPGRRYTGKRKSACTPASDHCEPLLPTSSLSIVNRSKEEVTSHKYQHEKLFIQVKGKKSRHQKEDSLSWSNSAYLSLDDDAFTAPFHRDGMLSLKQLLSFLSITDFQLPDEDFGPLKLEKVKSCSEKPVEPFESKMFGERHLKEGSCIFPEELSPKRMDTEMEDLEEDLIVLPGKSHPKRPNSQSQHTKTGLSSSILLYTPLNTVAPDDNDRPTTDMCSPAFPILGTTPAFGPQGSYEKASTEVAGRTCCTPQLAHLKDSVCLASDTKQFDSSGSPAKPHTTLQVSGRQGQPTCDCDSVPPGTPPPIESFTFKENQLCRNTCQELHKHSVEQTETAELPASDSINPGNLQLVSELKNPSGSCSVDVSAMFWERAGCKEPCIITACEDVVSLWKALDAWQWEKLYTWHFAEVPVLQIVPVPDVYNLVCVALGNLEIREIRALFCSSDDESEKQVLLKSGNIKAVLGLTKRRLVSSSGTLSDQQVEVMTFAEDGGGKENQFLMPPEETILTFAEVQGMQEALLGTTIMNNIVIWNLKTGQLLKKMHIDDSYQASVCHKAYSEMGLLFIVLSHPCAKESESLRSPVFQLIVINPKTTLSVGVMLYCLPPGQAGRFLEGDVKDHCAAAILTSGTIAIWDLLLGQCTALLPPVSDQHWSFVKWSGTDSHLLAGQKDGNIFVYHYS

SEQ ID NO: 863113 - protein, 71 aa, Homo sapiens
SADRALRVRSRAPHSFLGRLPGPGQLGPGVGRPGVGDGCSFRSVACPMDEPPGKPLSCEGEGTRDTWTING

SEQ ID NO: 863114 - protein, 312 aa, Homo sapiens
MFWERAGCKEPCIITACEDVVSLWKALDAWQWEKLYTWHFAEVPVLQIVPVPDVYNLVCVALGNLEIREIRALFCSSDDESEKQVLLKSGNIKAVLGLTKRRLVSSSGTLSDQQVEVMTFAEDGGGKENQFLMPPEETILTFAEVQGMQEALLGTTIMNNIVIWNLKTGQLLKKMHIDDSYQASVCHKAYSEMGLLFIVLSHPCAKESESLRSPVFQLIVINPKTTLSVGVMLYCLPPGQAGRFLEGDVKDHCAAAILTSGTIAIWDLLLGQCTALLPPVSDQHWSFVKWSGTDSHLLAGQKDGNIFVYHYS

SEQ ID NO: 863115 - protein, 711 aa, Homo sapiens; identical to SEQ ID NO: 863112

SEQ ID NO: 863116 - protein, 323 aa, Homo sapiens
MDEPPGKPLSCEEKKLKEKLAFLKREYSKTLARLQRAQRAEKIKHSIKKTVEEQDCLSQQDLSPQLKHSEPKNKICVYDKLHIKTHLDEETGEKTSITLDVGPESFNPGDGPGGLPIQRTDDTQEHFPHRVSDPSGEQKQKLPSRRKKQQKRTFISQERDCVFGTDSLRLSGKRLKEQEEISSKNPARSPVTEIRTHLLSLKSELPDSPEPVTEINEDSVLIPPTAQPEKGVDTFLRRPNFTRATTVPLQTLSDSGSSQHLEHIPPKGSSELTTHDLKNIRFTSPVSLEAQGKKMTVSTDNLLVNKAISKSGQLPTSSNLEAN

SEQ ID NO: 863117 - protein, 596 aa, Homo sapiens
RTSQKLLSLTKVSSPAGPTEDNDLSRKAVAQAPGRRYTGKRKSACTPASDHCEPLLPTSSLSIVNRSKEEVTSHKYQHEKLFIQVKGKKSRHQKEDSLSWSNSAYLSLDDDAFTAPFHRDGMLSLKQLLSFLSITDFQLPDEDFGPLKLEKVKSCSEKPVEPFESKMFGERHLKEGSCIFPEELSPKRMDTEMEDLEEDLIVLPGKSHPKRPNSQSQHTKTGLSSSILLYTPLNTVAPDDNDRPTTDMCSPAFPILGTTPAFGPQGSYEKASTEVAGRTCCTPQLAHLKDSVCLASDTKQFDSSGSPAKPHTTLQVSGRQGQPTCDCDSVPPGTPPPIESFTFKENQLCRNTCQELHKHSVEQTETAELPASDSINPGNLQLVSELKNPSGSCSVDVSAMFWERAGCKEPCIITACEDVVSLWKALDAWQWEKLYTWHFAEVPVLQIVPVPDVYNLVCVALGNLEIREIRALFCSSDDESEKQVLLKSGNIKAVLGLTKRRLVSSSGTLSDQQVEVMTFAEDGGGKENQFLMPPEETILTFAEVQGMQEALLGTTIMNNIVIWNLKTGQLLKKMHIDDSYQASVCHKAYSEMVPGR

SEQ ID NO: 863118 - protein, 1972 aa, Homo sapiens
MGQTKSTSSGGGNRKCNQEQSKNQPLDARVDKIKDKKPRKKAMESSSNSDSDSGTSSDTSSEGISSSDSDDLEEDEEEEDQSIEESEDDDSDSESEAQHKSNNQVLLHGISDPKADGQKATEKAQEKRIHQPLPLASESQTHSFQSQQKQPQVLSQQLPFIFQSSQAKEESVNKHTSVIQSTGLVSNVKPLSLVNQAKKETYMKLIVPSPDVLKAGNKNTSEESSLLTSELRSKREQYKQAFPSQLKKQESSKSLKKVIAALSNPKATSSSPAHPKQTLENNHPNPFLTNALLGNHQPNGVIQSVIQEAPLALTTKTKMQSKINENIAAASSTPFSSPVNLSTSGRRTPGNQTPVMPSASPILHSQGKEKAVSNNVNPVKTQHHSHPAKSLVEQFRGTDSDIPSSKDSEDSNEDEEEDDEEEDEEDDEDDESDDSQSESDSNSESDTEGSEEEDDDDKDQDESDSDTEGEKTSMKLNKTTSSVKSPSMSLTGHSTPRNLHIAKAPGSAPAALCSESQSPAFLGTSSSTLTSSPHSGTSKRRRVTDERELRIPLEYGWQRETRIRNFGGRLQGEVAYYAPCGKKLRQYPEVIKYLSRNGIMDISRDNFSFSAKIRVGDFYEARDGPQGMQWCLLKEEDVIPRIRAMEGRRGRPPNPDRQRAREESRMRRRKGRPPNVGNAEFLDNADAKLLRKLQAQEIARQAAQIKLLRKLQKQEQARVAKEAKKQQAIMAAEEKRKQKEQIKIMKQQEKIKRIQQIRMEKELRAQQILEAKKKKKEEAANAKLLEAEKRIKEKEMRRQQAVLLKHQERERRRQHMMLMKAMEARKKAEEKERLKQEKRDEKRLNKERKLEQRRLELEMAKELKKPNEDMCLADQKPLPELPRIPGLVLSGSTFSDCLMVVQFLRNFGKVLGFDVNIDVPNLSVLQEGLLNIGDSMGEVQDLLVRLLSAAVCDPGLITGYKAKTALGEHLLNVGVNRDNVSEILQIFMEAHCGQTELTESLKTKAFQAHTPAQKASVLAFLINELACSKSVVSEIDKNIDYMSNLRRDKWVVEGKLRKLRIIHAKKTGKRDTSGGIDLGEEQHPLGTPTPGRKRRRKGGDSDYDDDDDDDSDDQGDEDDEDEEDKEDKKGKKTDICEDEDEGDQAASVEELEKQIEKLSKQQSQYRRKLFDASHSLRSVMFGQDRYRRRYWILPQCGGIFVEGMESGEGLEEIAKEREKLKKAESVQIKEEMFETSGDSLNCSNTDHCEQKEDLKEKDNTNLFLQKPGSFSKLSKLLEVAKMPPESEVMTPKPNAGANGCTLSYQNSGKHSLGSVQSTATQSNVEKADSNNLFNTGSSGPGKFYSPLPNDQLLKTLTEKNRQWFSLLPRTPCDDTSLTHADMSTASLVTPQSQPPSKSPSPTPAPLGSSAQNPVGLNPFALSPLQVKGGVSMMGLQFCGWPTGVVTSNIPFTSSVPSLGSGLGLSEGNGNSFLTSNVASSKSESPVPQNEKATSAQPAAVEVAKPVDFPSPKPIPEEMQFGWWRIIDPEDLKALLKVLHLRGIREKALQKQIQKHLDYITQACLKNKDVAIIELNENEENQVTRDIVENWSVEEQAMEMDLSVLQQVEDLERRVASASLQVKGWMCPEPASEREDLVYFEHKSFTKLCKEHDGEFTGEDESSAHALERKSDNPLDIAVTRLADLERNIERRIEEDIAPGLRVWRRALSEARSAAQVALCIQQLQKSIAWEKSIMKVYCQICRKGDNEELLLLCDGCDKGCHTYCHRPKITTIPDGDWFCPACIAKASGQTLKIKKLHVKGKKTNESKKGKKVTLTGDTEDEDSASTSSSLKRGNKDLKKRKMEENTSINLSKQESFTSVKKPKRDDSKDLALCSMILTEMETHEDAWPFLLPVNLKLVPGYKKVIKKPMDFSTIREKLSSGQYPNLETFALDVRLVFDNCETFNEDDSDIGRAGHNMRKYFEKKWTDTFKVS

SEQ ID NO: 863119 - protein, 2070 aa, Homo sapiens
MESGERLPSSAASSTTPTSSSTPSVASVVSKGGLSTGVASLSSTINPCAEWWRTTDAHTRTGATFFPPLLGIPPLFAPPAQNHDSSSFHSRTSGKSNRNGPEKGVNGSINGSNTSSVIGINTSVLSTTASSSMGQTKSTSSGGGNRKCNQEQSKNQPLDARVDKIKDKKPRKKAMESSSNSDSDSGTSSDTSSEGISSSDSDDLEEDEEEEDQSIEESEDDDSDSESEAQHKSNNQVLLHGISDPKADGQKATEKAQEKRIHQPLPLASESQTHSFQSQQKQPQVLSQQLPFIFQSSQAKEESVNKHTSVIQSTGLVSNVKPLSLVNQAKKETYMKLIVPSPDVLKAGNKNTSEESSLLTSELRSKREQYKQAFPSQLKKQESSKSLKKVIAALSNPKATSSSPAHPKQTLENNHPNPFLTNALLGNHQPNGVIQSVIQEAPLALTTKTKMQSKINENIAAASSTPFSSPVNLSTSGRRTPGNQTPVMPSASPILHSQGKEKAVSNNVNPVKTQHHSHPAKSLVEQFRGTDSDIPSSKDSEDSNEDEEEDDEEEDEEDDEDDESDDSQSESDSNSESDTEGSEEEDDDDKDQDESDSDTEGEKTSMKLNKTTSSVKSPSMSLTGHSTPRNLHIAKAPGSAPAALCSESQSPAFLGTSSSTLTSSPHSGTSKRRRVTDERELRIPLEYGWQRETRIRNFGGRLQGEVAYYAPCGKKLRQYPEVIKGMQWCLLKEEDVIPRIRAMEGRRGRPPNPDRQRAREESRMRRRKGRPPNVGNAEFLDNADAKLLRKLQAQEIARQAAQIKLLRKLQKQEQARVAKEAKKQQAIMAAEEKRKQKEQIKIMKQQEKIKRIQQIRMEKELRAQQILEAKKKKKEEAANAKLLEAEKRIKEKEMRRQQAVLLKHQERERRRQHMMLMKAMEARKKAEEKERLKQEKRDEKRLNKERKLEQRRLELEMAKELKKPNEDMCLADQKPLPELPRIPGLVLSGSTFSDCLMVVQFLRNFGKVLGFDVNIDVPNLSVLQEGLLNIGDSMGEVQDLLVRLLSAAVCDPGLITGYKAKTALGEHLLNVGVNRDNVSEILQIFMEAHCGQTELTESLKTKAFQAHTPAQKASVLAFLINELACSKSVVSEIDKNIDYMSNLRRDKWVVEGKLRKLRIIHAKKTGKRDTSGGIDLGEEQHPLGTPTPGRKRRRKGGDSDYDDDDDDDSDDQGDEDDEDEEDKEDKKGKKTDICEDEDEGDQAASVEELEKQIEKLSKQQSQYRRKLFDASHSLRSVMFGQDRYRRRYWILPQCGGIFVEGMESGEGLEEIAKEREKLKKAESVQIKEEMFETSGDSLNCSNTDHCEQKEDLKEKDNTNLFLQKPGSFSKLSKLLEVAKMPPESEVMTPKPNAGANGCTLSYQNSGKHSLGSVQSTATQSNVEKADSNNLFNTGSSGPGKFYSPLPNDQLLKTLTEKNRQWFSLLPRTPCDDTSLTHADMSTASLVTPQSQPPSKSPSPTPAPLGSSAQNPVGLNPFALSPLQVKGGVSMMGLQFCGWPTGVVTSNIPFTSSVPSLGSGLGLSEGNGNSFLTSNVASSKSESPVPQNEKATSAQPAAVEVAKPVDFPSPKPIPEEMQFGWWRIIDPEDLKALLKVLHLRGIREKALQKQIQKHLDYITQACLKNKDVAIIELNENEENQVTRDIVENWSVEEQAMEMDLSVLQQVEDLERRVASASLQVKGWMCPEPASEREDLVYFEHKSFTKLCKEHDGEFTGEDESSAHALERKSDNPLDIAVTRLADLERNIERRIEEDIAPGLRVWRRALSEARSAAQVALCIQQLQKSIAWEKSIMKVYCQICRKGDNEELLLLCDGCDKGCHTYCHRPKITTIPDGDWFCPACIAKASGQTLKIKKLHVKGKKTNESKKGKKVTLTGDTEDEDSASTSSSLKRGNKDLKKRKMEENTSINLSKQESFTSVKKPKRDDSKDLALCSMILTEMETHEDAWPFLLPVNLKLVPGYKKVIKKPMDFSTIREKLSSGQYPNLETFALDVRLVFDNCETFNEDDSDIGRAGHNMRKYFEKKWTDTFKVS

SEQ ID NO: 863120 - protein, 2070 aa, Homo sapiens; identical to SEQ ID NO: 863119

SEQ ID NO: 863121 - protein, 1496 aa, Homo sapiens
FFYFPESDSNSESDTEGSEEEDDDDKDQDESDSDTEGEKTSMKLNKTTSSVKSPSMSLTGTSKRRRVTDERELRIPLEYGWQRETRIRNFGGRLQGEVAYYAPCGKKLRQYPEVIKYLSRNGIMDISRDNFSFSAKIRVGDFYEARDGPQGMQWCLLKEEDVIPRIRAMEGRRGRPPNPDRQRAREESRMRRRKGRPPNVGNAEFLDNADAKLLRKLQAQEIARQAAQIKLLRKLQKQEQARVAKEAKKQQAIMAAEEKRKQKEQIKIMKQQEKIKRIQQIRMEKELRAQQILEAKKKKKEEAANAKLLEAEKRIKEKEMRRQQAVLLKHQERERRRQHMMLMKAMEARKKAEEKERLKQEKRDEKRLNKERKLEQRRLELEMAKELKKPNEDMCLADQKPLPELPRIPGLVLSGSTFSDCLMVVQFLRNFGKVLGFDVNIDVPNLSVLQEGLLNIGDSMGEVQDLLVRLLSAAVCDPGLITGYKAKTALGEHLLNVGVNRDNVSEILQIFMEAHCGQTELTESLKTKAFQAHTPAQKASVLAFLINELACSKSVVSEIDKNIDYMSNLRRDKWVVEGKLRKLRIIHAKKTGKRDTSGGIDLGEEQHPLGTPTPGRKRRRKGGDSDYDDDDDDDSDDQGDEDDEDEEDKEDKKGKKTDICEDEDEGDQAASVEELEKQIEKLSKQQSQYRRKLFDASHSLRSVMFGQDRYRRRYWILPQCGGIFVEGMESGEGLEEIAKEREKLKKAESVQIKEEMFETSGDSLNCSNTDHCEQKEDLKEKDNTNLFLQKPGSFSKLSKLLEVAKMPPESEVMTPKPNAGANGCTLSYQNSGKHSLGSVQSTATQSNVEKADSNNLFNTGSSGPGKFYSPLPNDQLLKTLTEKNRQWFSLLPRTPCDDTSLTHADMSTASLVTPQSQPPSKSPSPTPAPLGSSAQNPVGLNPFALSPLQVKGGVSMMGLQFCGWPTGVVTSNIPFTSSVPSLGSGLGLSEGNGNSFLTSNVASSKSESPVPQNEKATSAQPAAVEVAKPVDFPSPKPIPEEMQFGWWRIIDPEDLKALLKVLHLRGIREKALQKQIQKHLDYITQACLKNKDVAIIELNENEENQVTRDIVENWSVEEQAMEMDLSVLQQVEDLERRVASASLQVKGWMCPEPASEREDLVYFEHKSFTKLCKEHDGEFTGEDESSAHALERKSDNPLDIAVTRLADLERNIERRIEEDIAPGLRVWRRALSEARSAAQVALCIQQLQKSIAWEKSIMKVYCQICRKGDNEELLLLCDGCDKGCHTYCHRPKITTIPDGDWFCPACIAKASGQTLKIKKLHVKGKKTNESKKGKKVTLTGDTEDEDSASTSSSLKRGNKDLKKRKMEENTSINLSKQESFTSVKKPKRDDSKDLALCSMILTEMETHEDAWPFLLPVNLKLVPGYKKVIKKPMDFSTIREKLSSGQYPNLETFALDVRLVFDNCETFNEDDSDIGRAGHNMRKYFEKKWTDTFKVS

SEQ ID NO: 863122 - protein, 2078 aa, Homo sapiens
MESGERLPSSAASSTTPTSSSTPSVASVVSKGGLSTGVASLSSTINPCGHLFRTAGDQPFNLSTVSSAFPMVSHPVFGLHSASSGHSEFGGLGTLGTPTALAAHPQLASFPAEWWRTTDAHTRTGATFFPPLLGIPPLFAPPAQNHDSSSFHSRTSGKSNRNGPEKGVNGSINGSNTSSVIGINTSVLSTTASSSMGQTKSTSSGGGNRKCNQEQSKNQPLDARVDKIKDKKPRKKAMESSSNSDSDSGTSSDTSSEGISSSDSDDLEEDEEEEDQSIEESEDDDSDSESEAQHKSNNQVLLHGISDPKADGQKATEKAQEKRIHQPLPLASESQTHSFQSQQKQPQVLSQQLPFIFQSSQAKEESVNKHTSVIQSTGLVSNVKPLSLVNQAKKETYMKLIVPSPDVLKAGNKNTSEESSLLTSELRSKREQYKQAFPSQLKKQESSKSLKKVIAALSNPKATSSSPAHPKQTLENNHPNPFLTNALLGNHQPNGVIQSVIQEAPLALTTKTKMQSKINENIAAASSTPFSSPVNLSTSGRRTPGNQTPVMPSASPILHSQGKEKAVSNNVNPVKTQHHSHPAKSLVEQFRGTDSDIPSSKDSEDSNEDEEEDDEEEDEEDDEDDESDDSQSGTSKRRRVTDERELRIPLEYGWQRETRIRNFGGRLQGEVAYYAPCGKKLRQYPEVIKYLSRNGIMDISRDNFSFSAKIRVGDFYEARDGPQGMQWCLLKEEDVIPRIRAMEGRRGRPPNPDRQRAREESRMRRRKGRPPNVGNAEFLDNADAKLLRKLQAQEIARQAAQIKLLRKLQKQEQARVAKEAKKQQAIMAAEEKRKQKEQIKIMKQQEKIKRIQQIRMEKELRAQQILEAKKKKKEEAANAKLLEAEKRIKEKEMRRQQAVLLKHQELERHRLDMERERRRQHMMLMKAMEARKKAEEKERLKQEKRDEKRLNKERKLEQRRLELEMAKELKKPNEDMCLADQKPLPELPRIPGLVLSGSTFSDCLMVVQFLRNFGKVLGFDVNIDVPNLSVLQEGLLNIGDSMGEVQDLLVRLLSAAVCDPGLITGYKAKTALGEHLLNVGVNRDNVSEILQIFMEAHCGQTELTESLKTKAFQAHTPAQKASVLAFLINELACSKSVVSEIDKNIDYMSNLRRDKWVVEGKLRKLRIIHAKKTGKRDTSGGIDLGEEQHPLGTPTPGRKRRRKGGDSDYDDDDDDDSDDQGDEDDEDEEDKEDKKGKKTDICEDEDEGDQAASVEELEKQIEKLSKQQSQYRRKLFDASHSLRSVMFGQDRYRRRYWILPQCGGIFVEGMESGEGLEEIAKEREKLKKAESVQIKEEMFETSGDSLNCSNTDHCEQKEDLKEKDNTNLFLQKPGSFSKLSKLLEVAKMPPESEVMTPKPNAGANGCTLSYQNSGKHSLGSVQSTATQSNVEKADSNNLFNTGSSGPGKFYSPLPNDQLLKTLTEKNRQWFSLLPRTPCDDTSLTHADMSTASLVTPQSQPPSKSPSPTPAPLGSSAQNPVGLNPFALSPLQVKGGVSMMGLQFCGWPTGVVTSNIPFTSSVPSLGSGLGLSEGNGNSFLTSNVASSKSESPVPQNEKATSAQPAAVEVAKPVDFPSPKPIPEEMQFGWWRIIDPEDLKALLKVLHLRGIREKALQKQIQKHLDYITQACLKNKDVAIIELNENEENQVTRDIVENWSVEEQAMEMDLSVLQQVEDLERRVASASLQVKGWMCPEPASEREDLVYFEHKSFTKLCKEHDGEFTGEDESSAHALERKSDNPLDIAVTRLADLERNIERRIEEDIAPGLRVWRRALSEARSAAQVALCIQQLQKSIAWEKSIMKVYCQICRKGDNEELLLLCDGCDKGCHTYCHRPKITTIPDGDWFCPACIAKASGQTLKIKKLHVKGKKTNESKKGKKVTLTGDTEDEDSASTSSSLKRGNKDLKKRKMEENTSINLSKQESFTSVKKPKRDDSKDLALCSMILTEMETHEDAWPFLLPVNLKLVPGYKKVIKKPMDFSTIREKLSSGQYPNLETFALDVRLVFDNCETFNEDDSDIGRAGHNMRKYFEKKWTDTFKVS

SEQ ID NO: 863123 - protein, 2086 aa, Homo sapiens
MESGERLPSSAASSTTPTSSSTPSVASVVSKGGLSTGVASLSSTINPCGHLFRTAGDQPFNLSTVSSAFPMVSHPVFGLHSASSGHSEFGGLGTLGTPTALAAHPQLASFPAEWWRTTDAHTRTGATFFPPLLGIPPLFAPPAQNHDSSSFHSRTSGKSNRNGPEKGVNGSINGSNTSSVIGINTSVLSTTASSSMGQTKSTSSGGGNRKCNQEQSKNQPLDARVDKIKDKKPRKKAMESSSNSDSDSGTSSDTSSEGISSSDSDDLEEDEEEEDQSIEESEDDDSDSESEAQHKSNNQVLLHGISDPKADGQKATEKAQEKRIHQPLPLASESQTHSFQSQQKQPQVLSQQLPFIFQSSQAKEESVNKHTSVIQSTGLVSNVKPLSLVNQAKKETYMKLIVPSPDVLKAGNKNTSEESSLLTSELRSKREQYKQAFPSQLKKQESSKSLKKVIAALSNPKATSSSPAHPKQTLENNHPNPFLTNALLGNHQPNGVIQSVIQEAPLALTTKTKMQSKINENIAAASSTPFSSPVNLSTSGRRTPGNQTPVMPSASPILHSQGKEKAVSNNVNPVKTQHHSHPAKSLVEQFRGTDSDIPSSKDSEDSNEDEEEDDEEEDEEDDEDDESDDSQSGTSKRRRVTDERELRIPLEYGWQRETRIRNFGGRLQGEVAYYAPCGKKLRQYPEVIKYLSRNGIMDISRDNFSFSAKIRVGDFYEARDGPQGMQWCLLKEEDVIPRIRAMEGRRGRPPNPDRQRAREESRMRRRKGRPPNVGNAEFLDNADAKLLRKLQAQEIARQAAQIKLLRKLQKQEQARVAKEAKKQQAIMAAEEKRKQKEQIKIMKQQEKIKRIQQIRMEKELRAQQILEAKKKKKEEAANAKLLEAEKRIKEKEMRRQQAVLLKHQERERRRQHMMLMKAMEARKKAEEKERLKQEKRDEKRLNKERKLEQRRLELEMAKELKKPNEDMCLADQKPLPELPRIPGLVLSGSTFSDCLMVVQFLRNFGKVLGFDVNIDVPNLSVLQEGLLNIGDSMGEVQDLLVRLLSAAVCDPGLITGYKAKTALGEHLLNVGVNRDNVSEILQIFMEAHCGQTELTESLKTKAFQAHTPAQKASVLAFLINELACSKSVVSEIDKNIDYMSNLRRDKWVVEGKLRKLRIIHAKKTGKRDTSGGIDLGEEQHPLGTPTPGRKRRRKGGDSDYDDDDDDDSDDQGDEDDEDEEDKEDKKGKKTDICEDEDEGDQAASVEELEKQIEKLSKQQSQYRRKLFDASHSLRSVMFGQDRYRRRYWILPQCGGIFVEGMESGEGLEEIAKEREKLKKAESVQIKEEMFETSGDSLNCSNTDHCEQKEDLKEKDNTNLFLQKPGSFSKLSKLLEVAKMPPESEVMTPKPNAGANGCTLSYQNSGKHSLGSVQSTATQSNVEKADSNNLFNTGSSGPGKFYSPLPNDQLLKTLTEKNRQWFSLLPRTPCDDTSLTHADMSTASLVTPQSQPPSKSPSPTPAPLGSSAQNPVGLNPFALSPLQVKGGVSMMGLQFCGWPTGVVTSNIPFTSSVPSLGSGLGLSEGNGNSFLTSNVASSKSESPVPQNEKATSAQPAAVEVAKPVDFPSPKPIPEEMQFGWWRIIDPEDLKALLKVLHLRGIREKALQKQIQKHLDYITQACLKNKDVAIIELNENEENQVTRDIVENWSVEEQAMEMDLSVLQQVEDLERRVASASLQVKGWMCPEPASEREDLVYFEHKSFTKLCKEHDGEFTGEDESSAHALERKSDNPLDIAVTRLADLERNIERRYLKSPLSTTIQIKLDNVGTVTVPAPAPSVSGDGDGIEEDIAPGLRVWRRALSEARSAAQVALCIQQLQKSIAWELLLLCDGCDKGCHTYCHRPKITTIPDGDWFCPACIAKASGQTLKIKKLHVKGKKTNESKKGKKVTLTGDTEDEDSASTSSSLKRGNKDLKKRKMEENTSINLSKQESFTSVKKPKRDDSKDLALCSMILTEMETHEDAWPFLLPVNLKLVPGYKKVIKKPMDFSTIREKLSSGQYPNLETFALDVRLVFDNCETFNEDDSDIGRAGHNMRKYFEKKWTDTFKVS

SEQ ID NO: 863124 - protein, 1823 aa, Homo sapiens
MESGERLPSSAASSTTPTSSSTPSVASVVSKGGLSTGVASLSSTINPCGHLFRTAGDQPFNLSTVSSAFPMVSHPVFGLHSASSGHSEFGGLGTLGTPTALAAHPQLASFPAEWWRTTDAHTRTGATFFPPLLGIPPLFAPPAQNHDSSSFHSRTSGKSNRNGPEKGVNGSINGSNTSSVIGINTSVLSTTASSSMGQTKSTSSGGGNRKCNQEQSKNQPLDARVDKIKDKKPRKKAMESSSNSDSDSGTSSDTSSEGISSSDSDDLEEDEEEEDQSIEESEDDDSDSESEAQHKSNNQVLLHGISDPKADGQKATEKAQEKRIHQPLPLASESQTHSFQSQQKQPQVLSQQLPFIFQSSQAKEESVNKHTSVIQSTGLVSNVKPLSLVNQAKKETYMKLIVPSPDVLKAGNKNTSEESSLLTSELRSKREQYKQAFPSQLKKQESSKSLKKVIAALSNPKATSSSPAHPKQTLENNHPNPFLTNALLGNHQPNGVIQSVIQEAPLALTTKTKMQSKINENIAAASSTPFSSPVNLSTSGRRTPGNQTPVMPSASPILHSQGKEKAVSNNVNPVKTQHHSHPAKSLVEQFRGTDSDIPSSKDSEDSNEDEEEDDEEEDEEDDEDDESDDSQSGTSKRRRVTDERELRIPLEYGWQRETRIRNFGGRLQGEVAYYAPCGKKLRQYPEVIKYLSRNGIMDISRDNFSFSAKIRVGDFYEARDGPQGMQWCLLKEEDVIPRIRAMEGRRGRPPNPDRQRAREESRMRRRKGRPPNVGNAEFLDNADAKLLRKLQAQEIARQAAQIKLLRKLQKQEQARVAKEAKKQQAIMAAEEKRKQKEQIKIMKQQEKIKRIQQIRMEKELRAQQILEAKKKKKEEAANAKLLEAEKRIKEKEMRRQQAVLLKHQERERRRQHMMLMKAMEARKKAEEKERLKQEKRDEKRLNKERKLEQRRLELEMAKELKKPNEDMCLADQKPLPELPRIPGLVLSGSTFSDCLMVVQFLRNFGKVLGFDVNIDVPNLSVLQEGLLNIGDSMGEVQDLLVRLLSAAVCDPGLITGYKAKTALGEHLLNVGVNRDNVSEILQIFMEAHCGQTELTESLKTKAFQAHTPAQKASVLAFLINELACSKSVVSEIDKNIDYMSNLRRDKWVVEGKLRKLRIIHAKKTGKRDTSGGIDLGEEQHPLGTPTPGRKRRRKGGDSDYDDDDDDDSDDQGDEDDEDEEDKEDKKGKKTDICEDEDEGDQAASVEELEKQIEKLSKQQSQYRRKLFDASHSLRSVMFGQDRYRRRYWILPQCGGIFVEGMESGEGLEEIAKEREKLKKAESVQIKEEMFETSGDSLNCSNTDHCEQKEDLKEKDNTNLFLQKPGSFSKLSKLLEVAKMPPESEVMTPKPNAGANGCTLSYQNSGKHSLGSVQSTATQSNVEKADSNNLFNTGSSGPGKFYSPLPNDQLLKTLTEKNRQWFSLLPRTPCDDTSLTHADMSTASLVTPQSQPPSKSPSPTPAPLGSSAQNPVGLNPFALSPLQVKGGVSMMGLQFCGWPTGVVTSNIPFTSSVPSLGSGLGLSEGNGNSFLTSNVASSKSESPVPQNEKATSAQPAAVEVAKPVDFPSPKPIPEEMQFGWWRIIDPEDLKALLKVLHLRGIREKALQKQIQKHLDYITQACLKNKDVAIIELNENEENQVTRDIVENWSVEEQAMEMDLSVLQQVEDLERRVASASLQVKGWMCPEPASEREDLVYFEHKSFTKLCKEHDGEFTGEDESSAHALERKSDNPLDIAVTRLADLERNIERRYLKSPLSTTIQIKLDNVGTVTVPAPAPSVSGDGDG

SEQ ID NO: 863125 - protein, 1153 aa, Homo sapiens
MGVTEMPPENLASQRKLLVQYKRGKKVAAYFTLEDIEIMAFKKLSCFYFICISFYFQPLPELPRIPGLVLSGSTFSDCLMVVQFLRNFGKVLGFDVNIDVPNLSVLQEGLLNIGDSMGEVQDLLVRLLSAAVCDPGLITGYKAKTALGEHLLNVGVNRDNVSEILQIFMEAHCGQTELTESLKTKAFQAHTPAQKASVLAFLINELACSKSVVSEIDKNIDYMSNLRRDKWVVEGKLRKLRIIHAKKTGKRDTSGGIDLGEEQHPLGTPTPGRKRRRKGGDSDYDDDDDDDSDDQGDEDDEDEEDKEDKKGKKTDICEDEDEGDQAASVEELEKQIEKLSKQQSQYRRKLFDASHSLRSVMFGQDRYRRRYWILPQCGGIFVEGMESGEGLEEIAKEREKLKKAESVQIKEEMFETSGDSLNCSNTDHCEQKEDLKEKDNTNLFLQKPGSFSKLSKLLEVAKMPPESEVMTPKPNAGANGCTLSYQNSGKHSLGSVQSTATQSNVEKADSNNLFNTGSSGPGKFYSPLPNDQLLKTLTEKNRQWFSLLPRTPCDDTSLTHADMSTASLVTPQSQPPSKSPSPTPAPLGSSAQNPVGLNPFALSPLQVKGGVSMMGLQFCGWPTGVVTSNIPFTSSVPSLGSGLGLSEGNGNSFLTSNVASSKSESPVPQNEKATSAQPAAVEVAKPVDFPSPKPIPEEMQFGWWRIIDPEDLKALLKVLHLRGIREKALQKQIQKHLDYITQACLKNKDVAIIELNENEENQVTRDIVENWSVEEQAMEMDLSVLQQVEDLERRVASASLQVKGWMCPEPASEREDLVYFEHKSFTKLCKEHDGEFTGEDESSAHALERKSDNPLDIAVTRLADLERNIERRIEEDIAPGLRVWRRALSEARSAAQVALCIQQLQKSIAWEKSIMKVYCQICRKGDNEELLLLCDGCDKGCHTYCHRPKITTIPDGDWFCPACIAKASGQTLKIKKLHVKGKKTNESKKGKKVTLTGDTEDEDSASTSSSLKRGNKDLKKRKMEENTSINLSKQESFTSVKKPKRDDSKDLALCSMILTEMETHEDAWPFLLPVNLKLVPGYKKVIKKPMDFSTIREKLSSGQYPNLETFALDVRLVFDNCETFNEDDSDIGRAGHNMRKYFEKKWTDTFKVS

SEQ ID NO: 863126 - protein, 1177 aa, Homo sapiens
MRRQQAVLLKHQERERRRQHMMLMKAMEARKKAEEKERLKQEKRDEKRLNKERKLEQRRLELEMAKELKKPNEDMCLADQKPLPELPRIPGLVLSGSTFSDCLMVVQFLRNFGKVLGFDVNIDVPNLSVLQEGLLNIGDSMGEVQDLLVRLLSAAVCDPGLITGYKAKTALGEHLLNVGVNRDNVSEILQIFMEAHCGQTELTESLKTKAFQAHTPAQKASVLAFLINELACSKSVVSEIDKNIDYMSNLRRDKWVVEGKLRKLRIIHAKKTGKRDTSGGIDLGEEQHPLGTPTPGRKRRRKGGDSDYDDDDDDDSDDQGDEDDEDEEDKEDKKGKKTDICEDEDEGDQAASVEELEKQIEKLSKQQSQYRRKLFDASHSLRSVMFGQDRYRRRYWILPQCGGIFVEGMESGEGLEEIAKEREKLKKAESVQIKEEMFETSGDSLNCSNTDHCEQKEDLKEKDNTNLFLQKPGSFSKLSKLLEVAKMPPESEVMTPKPNAGANGCTLSYQNSGKHSLGSVQSTATQSNVEKADSNNLFNTGSSGPGKFYSPLPNDQLLKTLTEKNRQWFSLLPRTPCDDTSLTHADMSTASLVTPQSQPPSKSPSPTPAPLGSSAQNPVGLNPFALSPLQVKGGVSMMGLQFCGWPTGVVTSNIPFTSSVPSLGSGLGLSEGNGNSFLTSNVASSKSESPVPQNEKATSAQPAAVEVAKPVDFPSPKPIPEEMQFGWWRIIDPEDLKALLKVLHLRGIREKALQKQIQKHLDYITQACLKNKDVAIIELNENEENQVTRDIVENWSVEEQAMEMDLSVLQQVEDLERRVASASLQVKGWMCPEPASEREDLVYFEHKSFTKLCKEHDGEFTGEDESSAHALERKSDNPLDIAVTRLADLERNIERRIEEDIAPGLRVWRRALSEARSAAQVALCIQQLQKSIAWEKSIMKVYCQICRKGDNEELLLLCDGCDKGCHTYCHRPKITTIPDGDWFCPACIAKASGQTLKIKKLHVKGKKTNESKKGKKVTLTGDTEDEDSASTSSSLKRGNKDLKKRKMEENTSINLSKQESFTSVKKPKRDDSKDLALCSMILTEMETHEDAWPFLLPVNLKLVPGYKKVIKKPMDFSTIREKLSSGQYPNLETFALDVRLVFDNCETFNEDDSDIGRAGHNMRKYFEKKWTDTFKVS

SEQ ID NO: 863127 - protein, 1823 aa, Homo sapiens; identical to SEQ ID NO: 863124

SEQ ID NO: 863128 - protein, 1801 aa, Homo sapiens
MESGERLPSSAASSTTPTSSSTPSVASVVSKGGLSTGVASLSSTINPCGHLFRTAGDQPFNLSTVSSAFPMVSHPVFGLHSASSGHSEFGGLGTLGTPTALAAHPQLASFPAEWWRTTDAHTRTGATFFPPLLGIPPLFAPPAQNHDSSSFHSRTSGKSNRNGPEKGVNGSINGSNTSSVIGINTSVLSTTASSSMGQTKSTSSGGGNRKCNQEQSKNQPLDARVDKIKDKKPRKKAMESSSNSDSDSGTSSDTSSEGISSSDSDDLEEDEEEEDQSIEESEDDDSDSESEAQHKSNNQVLLHGISDPKADGQKATEKAQEKRIHQPLPLASESQTHSFQSQQKQPQVLSQQLPFIFQSSQAKEESVNKHTSVIQSTGLVSNVKPLSLVNQAKKETYMKLIVPSPDVLKAGNKNTSEESSLLTSELRSKREQYKQAFPSQLKKQESSKSLKKVIAALSNPKATSSSPAHPKQTLENNHPNPFLTNALLGNHQPNGVIQSVIQEAPLALTTKTKMQSKINENIAAASSTPFSSPVNLSTSGRRTPGNQTPVMPSASPILHSQGKEKAVSNNVNPVKTQHHSHPAKSLVEQFRGTDSDIPSSKDSEDSNEDEEEDDEEEDEEDDEDDESDDSQSGTSKRRRVTDERELRIPLEYGWQRETRIRNFGGRLQGEVAYYAPCGKKLRQYPEVIKYLSRNGIMDISRDNFSFSAKIRVGDFYEARDGPQGMQWCLLKEEDVIPRIRAMEGRRGRPPNPDRQRAREESRMRRRKGRPPNVGNAEFLDNADAKLLRKLQAQEIARQAAQIKLLRKLQKQEQARVAKEAKKQQAIMAAEEKRKQKEQIKIMKQQEKIKRIQQIRMEKELRAQQILEAKKKKKEEAANAKLLEAEKRIKEKEMRRQQAVLLKHQERERRRQHMMLMKAMEARKKAEEKERLKQEKRDEKRLNKERKLEQRRLELEMAKELKKPNEDMCLADQKPLPELPRIPGLVLSGSTFSDCLMVVQFLRNFGKVLGFDVNIDVPNLSVLQEGLLNIGDSMGEVQDLLVRLLSAAVCDPGLITGYKAKTALGEHLLNVGVNRDNVSEILQIFMEAHCGQTELTESLKTKAFQAHTPAQKASVLAFLINELACSKSVVSEIDKNIDYMSNLRRDKWVVEGKLRKLRIIHAKKTGKRDTSGGIDLGEEQHPLGTPTPGRKRRRKGGDSDYDDDDDDDSDDQGDEDDEDEEDKEDKKGKKTDICEDEDEGDQAASVEELEKQIEKLSKQQSQYRRKLFDASHSLRSVMFGQDRYRRRYWILPQCGGIFVEGMESGEGLEEIAKEREKLKKAESVQIKEEMFETSGDSLNCSNTDHCEQKEDLKEKDNTNLFLQKPGSFSKLSKLLEVAKMPPESEVMTPKPNAGANGCTLSYQNSGKHSLGSVQSTATQSNVEKADSNNLFNTGSSGPGKFYSPLPNDQLLKTLTEKNRQWFSLLPRTPCDDTSLTHADMSTASLVTPQSQPPSKSPSPTPAPLGSSAQNPVGLNPFALSPLQVKGGVSMMGLQFCGWPTGVVTSNIPFTSSVPSLGSGLGLSEGNGNSFLTSNVASSKSESPVPQNEKATSAQPAAVEVAKPVDFPSPKPIPEEMQFGWWRIIDPEDLKALLKVLHLRGIREKALQKQIQKHLDYITQACLKNKDVAIIELNENEENQVTRDIVENWSVEEQAMEMDLSVLQQVEDLERRVASASLQVKGWMCPEPASEREDLVYFEHKSFTKLCKEHDGEFTGEDESSAHALERKSDNPLDIAVTRLADLERNIERRYLKSPLSTTIQIK

SEQ ID NO: 863129 - protein, 2069 aa, Homo sapiens
MESGERLPSSAASSTTPTSSSTPSVASVVSKGGLSTGVASLSSTINPCGHLFRTAGDQPFNLSTVSSAFPMVSHPVFGLHSASSGHSEFGGLGTLGTPTALAAHPQLASFPAEWWRTTDAHTRTGATFFPPLLGIPPLFAPPAQNHDSSSFHSRTSGKSNRNGPEKGVNGSINGSNTSSVIGINTSVLSTTASSSMGQTKSTSSGGGNRKCNQEQSKNQPLDARVDKIKDKKPRKKAMESSSNSDSDSGTSSDTSSEGISSSDSDDLEEDEEEEDQSIEESEDDDSDSESEAQHKSNNQVLLHGISDPKADGQKATEKAQEKRIHQPLPLASESQTHSFQSQQKQPQVLSQQLPFIFQSSQAKEESVNKHTSVIQSTGLVSNVKPLSLVNQAKKETYMKLIVPSPDVLKAGNKNTSEESSLLTSELRSKREQYKQAFPSQLKKQESSKSLKKVIAALSNPKATSSSPAHPKQTLENNHPNPFLTNALLGNHQPNGVIQSVIQEAPLALTTKTKMQSKINENIAAASSTPFSSPVNLSTSGRRTPGNQTPVMPSASPILHSQGKEKAVSNNVNPVKTQHHSHPAKSLVEQFRGTDSDIPSSKDSEDSNEDEEEDDEEEDEEDDEDDESDDSQSGTSKRRRVTDERELRIPLEYGWQRETRIRNFGGRLQGEVAYYAPCGKKLRQYPEVIKYLSRNGIMDISRDNFSFSAKIRVGDFYEARDGPQGMQWCLLKEEDVIPRIRAMEGRRGRPPNPDRQRAREESRMRRRKGRPPNVGNAEFLDNADAKLLRKLQAQEIARQAAQIKLLRKLQKQEQARVAKEAKKQQAIMAAEEKRKQKEQIKIMKQQEKIKRIQQIRMEKELRAQQILEAKKKKKEEAANAKLLEAEKRIKEKEMRRQQAVLLKHQERERRRQHMMLMKAMEARKKAEEKERLKQEKRDEKRLNKERKLEQRRLELEMAKELKKPNEDMCLADQKPLPELPRIPGLVLSGSTFSDCLMVVQFLRNFGKVLGFDVNIDVPNLSVLQEGLLNIGDSMGEVQDLLVRLLSAAVCDPGLITGYKAKTALGEHLLNVGVNRDNVSEILQIFMEAHCGQTELTESLKTKAFQAHTPAQKASVLAFLINELACSKSVVSEIDKNIDYMSNLRRDKWVVEGKLRKLRIIHAKKTGKRDTSGGIDLGEEQHPLGTPTPGRKRRRKGGDSDYDDDDDDDSDDQGDEDDEDEEDKEDKKGKKTDICEDEDEGDQAASVEELEKQIEKLSKQQSQYRRKLFDASHSLRSVMFGQDRYRRRYWILPQCGGIFVEGMESGEGLEEIAKEREKLKKAESVQIKEEMFETSGDSLNCSNTDHCEQKEDLKEKDNTNLFLQKPGSFSKLSKLLEVAKMPPESEVMTPKPNAGANGCTLSYQNSGKHSLGSVQSTATQSNVEKADSNNLFNTGSSGPGKFYSPLPNDQLLKTLTEKNRQWFSLLPRTPCDDTSLTHADMSTASLVTPQSQPPSKSPSPTPAPLGSSAQNPVGLNPFALSPLQVKGGVSMMGLQFCGWPTGVVTSNIPFTSSVPSLGSGLGLSEGNGNSFLTSNVASSKSESPVPQNEKATSAQPAAVEVAKPVDFPSPKPIPEEMQFGWWRIIDPEDLKALLKVLHLRGIREKALQKQIQKHLDYITQACLKNKDVAIIELNENEENQVTRDIVENWSVEEQAMEMDLSVLQQVEDLERRVASASLQVKGWMCPEPASEREDLVYFEHKSFTKLCKEHDGEFTGEDESSAHALERKSDNPLDIAVTRLADLERNIERRIEEDIAPGLRVWRRALSEARSAAQVALCIQQLQKSIAWEKSIMKVYCQICRKGDNEELLLLCDGCDKGCHTYCHRPKITTIPDGDWFCPACIAKASGQTLKIKKLHVKGKKTNESKKGKKVTLTGDTEDEDSASTSSSLKRGNKDLKKRKMEENTSINLSKQESFTSVKKPKRDDSKDLALCSMILTEMETHEDAWPFLLPVNLKLVPGYKKVIKKPMDFSTIREKLSSGQYPNLETFALDVRLVFDNCETFNEDDSDIGRAGHNMRKYFEKKWTDTFKVS

SEQ ID NO: 863130 - protein, 2133 aa, Homo sapiens
MESGERLPSSAASSTTPTSSSTPSVASVVSKGGLSTGVASLSSTINPCGHLFRTAGDQPFNLSTVSSAFPMVSHPVFGLHSASSGHSEFGGLGTLGTPTALAAHPQLASFPAEWWRTTDAHTRTGATFFPPLLGIPPLFAPPAQNHDSSSFHSRTSGKSNRNGPEKGVNGSINGSNTSSVIGINTSVLSTTASSSMGQTKSTSSGGGNRKCNQEQSKNQPLDARVDKIKDKKPRKKAMESSSNSDSDSGTSSDTSSEGISSSDSDDLEEDEEEEDQSIEESEDDDSDSESEAQHKSNNQVLLHGISDPKADGQKATEKAQEKRIHQPLPLASESQTHSFQSQQKQPQVLSQQLPFIFQSSQAKEESVNKHTSVIQSTGLVSNVKPLSLVNQAKKETYMKLIVPSPDVLKAGNKNTSEESSLLTSELRSKREQYKQAFPSQLKKQESSKSLKKVIAALSNPKATSSSPAHPKQTLENNHPNPFLTNALLGNHQPNGVIQSVIQEAPLALTTKTKMQSKINENIAAASSTPFSSPVNLSTSGRRTPGNQTPVMPSASPILHSQGKEKAVSNNVNPVKTQHHSHPAKSLVEQFRGTDSDIPSSKDSEDSNEDEEEDDEEEDEEDDEDDESDDSQSESDSNSESDTEGSEEEDDDDKDQDESDSDTEGEKTSMKLNKTTSSVKSPSMSLTGHSTPRNLHIAKAPGSAPAALCSESQSPAFLGTSSSTLTSSPHSGTSKRRRVTDERELRIPLEYGWQRETRIRNFGGRLQGEVAYYAPCGKKLRQYPEVIKGMQWCLLKEEDVIPRIRAMEGRRGRPPNPDRQRAREESRMRRRKGRPPNVGNAEFLDNADAKLLRKLQAQEIARQAAQIKLLRKLQKQEQARVAKEAKKQQAIMAAEEKRKQKEQIKIMKQQEKIKRIQQIRMEKELRAQQILEAKKKKKEEAANAKLLEAEKRIKEKEMRRQQAVLLKHQERERRRQHMMLMKAMEARKKAEEKERLKQEKRDEKRLNKERKLEQRRLELEMAKELKKPNEDMCLADQKPLPELPRIPGLVLSGSTFSDCLMVVQFLRNFGKVLGFDVNIDVPNLSVLQEGLLNIGDSMGEVQDLLVRLLSAAVCDPGLITGYKAKTALGEHLLNVGVNRDNVSEILQIFMEAHCGQTELTESLKTKAFQAHTPAQKASVLAFLINELACSKSVVSEIDKNIDYMSNLRRDKWVVEGKLRKLRIIHAKKTGKRDTSGGIDLGEEQHPLGTPTPGRKRRRKGGDSDYDDDDDDDSDDQGDEDDEDEEDKEDKKGKKTDICEDEDEGDQAASVEELEKQIEKLSKQQSQYRRKLFDASHSLRSVMFGQDRYRRRYWILPQCGGIFVEGMESGEGLEEIAKEREKLKKAESVQIKEEMFETSGDSLNCSNTDHCEQKEDLKEKDNTNLFLQKPGSFSKLSKLLEVAKMPPESEVMTPKPNAGANGCTLSYQNSGKHSLGSVQSTATQSNVEKADSNNLFNTGSSGPGKFYSPLPNDQLLKTLTEKNRQWFSLLPRTPCDDTSLTHADMSTASLVTPQSQPPSKSPSPTPAPLGSSAQNPVGLNPFALSPLQVKGGVSMMGLQFCGWPTGVVTSNIPFTSSVPSLGSGLGLSEGNGNSFLTSNVASSKSESPVPQNEKATSAQPAAVEVAKPVDFPSPKPIPEEMQFGWWRIIDPEDLKALLKVLHLRGIREKALQKQIQKHLDYITQACLKNKDVAIIELNENEENQVTRDIVENWSVEEQAMEMDLSVLQQVEDLERRVASASLQVKGWMCPEPASEREDLVYFEHKSFTKLCKEHDGEFTGEDESSAHALERKSDNPLDIAVTRLADLERNIERRIEEDIAPGLRVWRRALSEARSAAQVALCIQQLQKSIAWEKSIMKVYCQICRKGDNEELLLLCDGCDKGCHTYCHRPKITTIPDGDWFCPACIAKASGQTLKIKKLHVKGKKTNESKKGKKVTLTGDTEDEDSASTSSSLKRGNKDLKKRKMEENTSINLSKQESFTSVKKPKRDDSKDLALCSMILTEMETHEDAWPFLLPVNLKLVPGYKKVIKKPMDFSTIREKLSSGQYPNLETFALDVRLVFDNCETFNEDDSDIGRAGHNMRKYFEKKWTDTFKVS

SEQ ID NO: 863131 - protein, 2069 aa, Homo sapiens; identical to SEQ ID NO: 863129

SEQ ID NO: 863132 - protein, 2154 aa, Homo sapiens
MESGERLPSSAASSTTPTSSSTPSVASVVSKGGLSTGVASLSSTINPCGHLFRTAGDQPFNLSTVSSAFPMVSHPVFGLHSASSGHSEFGGLGTLGTPTALAAHPQLASFPAEWWRTTDAHTRTGATFFPPLLGIPPLFAPPAQNHDSSSFHSRTSGKSNRNGPEKGVNGSINGSNTSSVIGINTSVLSTTASSSMGQTKSTSSGGGNRKCNQEQSKNQPLDARVDKIKDKKPRKKAMESSSNSDSDSGTSSDTSSEGISSSDSDDLEEDEEEEDQSIEESEDDDSDSESEAQHKSNNQVLLHGISDPKADGQKATEKAQEKRIHQPLPLASESQTHSFQSQQKQPQVLSQQLPFIFQSSQAKEESVNKHTSVIQSTGLVSNVKPLSLVNQAKKETYMKLIVPSPDVLKAGNKNTSEESSLLTSELRSKREQYKQAFPSQLKKQESSKSLKKVIAALSNPKATSSSPAHPKQTLENNHPNPFLTNALLGNHQPNGVIQSVIQEAPLALTTKTKMQSKINENIAAASSTPFSSPVNLSTSGRRTPGNQTPVMPSASPILHSQGKEKAVSNNVNPVKTQHHSHPAKSLVEQFRGTDSDIPSSKDSEDSNEDEEEDDEEEDEEDDEDDESDDSQSESDSNSESDTEGSEEEDDDDKDQDESDSDTEGEKTSMKLNKTTSSVKSPSMSLTGHSTPRNLHIAKAPGSAPAALCSESQSPAFLGTSKRRRVTDERELRIPLEYGWQRETRIRNFGGRLQGEVAYYAPCGKKLRQYPEVIKYLSRNGIMDISRDNFSFSAKIRVGDFYEARDGPQGMQWCLLKEEDVIPRIRAMEGRRGRPPNPDRQRAREESRMRRRKGRPPNVGNAEFLDNADAKLLRKLQAQEIARQAAQIKLLRKLQKQEQARVAKEAKKQQAIMAAEEKRKQKEQIKIMKQQEKIKRIQQIRMEKELRAQQILEAKKKKKEEAANAKLLEAEKRIKEKEMRRQQAVLLKHQERERRRQHMMLMKAMEARKKAEEKERLKQEKRDEKRLNKERKLEQRRLELEMAKELKKPNEDMCLADQKPLPELPRIPGLVLSGSTFSDCLMVVQFLRNFGKVLGFDVNIDVPNLSVLQEGLLNIGDSMGEVQDLLVRLLSAAVCDPGLITGYKAKTALGEHLLNVGVNRDNVSEILQIFMEAHCGQTELTESLKTKAFQAHTPAQKASVLAFLINELACSKSVVSEIDKNIDYMSNLRRDKWVVEGKLRKLRIIHAKKTGKRDTSGGIDLGEEQHPLGTPTPGRKRRRKGGDSDYDDDDDDDSDDQGDEDDEDEEDKEDKKGKKTDICEDEDEGDQAASVEELEKQIEKLSKQQSQYRRKLFDASHSLRSVMFGQDRYRRRYWILPQCGGIFVEGMESGEGLEEIAKEREKLKKAESVQIKEEMFETSGDSLNCSNTDHCEQKEDLKEKDNTNLFLQKPGSFSKLSKLLEVAKMPPESEVMTPKPNAGANGCTLSYQNSGKHSLGSVQSTATQSNVEKADSNNLFNTGSSGPGKFYSPLPNDQLLKTLTEKNRQWFSLLPRTPCDDTSLTHADMSTASLVTPQSQPPSKSPSPTPAPLGSSAQNPVGLNPFALSPLQVKGGVSMMGLQFCGWPTGVVTSNIPFTSSVPSLGSGLGLSEGNGNSFLTSNVASSKSESPVPQNEKATSAQPAAVEVAKPVDFPSPKPIPEEMQFGWWRIIDPEDLKALLKVLHLRGIREKALQKQIQKHLDYITQACLKNKDVAIIELNENEENQVTRDIVENWSVEEQAMEMDLSVLQQVEDLERRVASASLQVKGWMCPEPASEREDLVYFEHKSFTKLCKEHDGEFTGEDESSAHALERKSDNPLDIAVTRLADLERNIERRIEEDIAPGLRVWRRALSEARSAAQVALCIQQLQKSIAWEKSIMKVYCQICRKGDNEELLLLCDGCDKGCHTYCHRPKITTIPDGDWFCPACIAKASGQTLKIKKLHVKGKKTNESKKGKKVTLTGDTEDEDSASTSSSLKRGNKDLKKRKMEENTSINLSKQESFTSVKKPKRDDSKDLALCSMILTEMETHEDAWPFLLPVNLKLVPGYKKVIKKPMDFSTIREKLSSGQYPNLETFALDVRLVFDNCETFNEDDSDIGRAGHNMRKYFEKKWTDTFKVS

SEQ ID NO: 863133 - protein, 1255 aa, Homo sapiens
VVLILYYYMSLDKDIYEKLNEKEEIKIMKQQEKIKRIQQIRMEKELRAQQILEAKKKKKEEAANAKLLEAEKRIKEKEMRRQQAVLLKHQERERRRQHMMLMKAMEARKKAEEKERLKQEKRDEKRLNKERKLEQRRLELEMAKELKKPNEDMCLADQKPLPELPRIPGLVLSGSTFSDCLMVVQFLRNFGKVLGFDVNIDVPNLSVLQEGLLNIGDSMGEVQDLLVRLLSAAVCDPGLITGYKAKTALGEHLLNVGVNRDNVSEILQIFMEAHCGQTELTESLKTKAFQAHTPAQKASVLAFLINELACSKSVVSEIDKNIDYMSNLRRDKWVVEGKLRKLRIIHAKKTGKRDTSGGIDLGEEQHPLGTPTPGRKRRRKGGDSDYDDDDDDDSDDQGDEDDEDEEDKEDKKGKKTDICEDEDEGDQAASVEELEKQIEKLSKQQSQYRRKLFDASHSLRSVMFGQDRYRRRYWILPQCGGIFVEGMESGEGLEEIAKEREKLKKAESVQIKEEMFETSGDSLNCSNTDHCEQKEDLKEKDNTNLFLQKPGSFSKLSKLLEVAKMPPESEVMTPKPNAGANGCTLSYQNSGKHSLGSVQSTATQSNVEKADSNNLFNTGSSGPGKFYSPLPNDQLLKTLTEKNRQWFSLLPRTPCDDTSLTHADMSTASLVTPQSQPPSKSPSPTPAPLGSSAQNPVGLNPFALSPLQVKGGVSMMGLQFCGWPTGVVTSNIPFTSSVPSLGSGLGLSEGNGNSFLTSNVASSKSESPVPQNEKATSAQPAAVEVAKPVDFPSPKPIPEEMQFGWWRIIDPEDLKALLKVLHLRGIREKALQKQIQKHLDYITQACLKNKDVAIIELNENEENQVTRDIVENWSVEEQAMEMDLSVLQQVEDLERRVASASLQVKGWMCPEPASEREDLVYFEHKSFTKLCKEHDGEFTGEDESSAHALERKSDNPLDIAVTRLADLERNIERRIEEDIAPGLRVWRRALSEARSAAQVALCIQQLQKSIAWEKSIMKVYCQICRKGDNEELLLLCDGCDKGCHTYCHRPKITTIPDGDWFCPACIAKASGQTLKIKKLHVKGKKTNESKKGKKVTLTGDTEDEDSASTSSSLKRGNKDLKKRKMEENTSINLSKQESFTSVKKPKRDDSKDLALCSMILTEMETHEDAWPFLLPVNLKLVPGYKKVIKKPMDFSTIREKLSSGQYPNLETFALDVRLVFDNCETFNEDDSDIGRAGHNMRKYFEKKWTDTFKVS

SEQ ID NO: 863134 - protein, 2045 aa, Homo sapiens
MESGERLPSSAASSTTPTSSSTPSVASVVSKGGLSTGVASLSSTINPCGHLFRTAGDQPFNLSTVSSAFPMVSHPVFGLHSASSGHSEFGGLGTLGTPTALAAHPQLASFPAEWWRTTDAHTRTGATFFPPLLGIPPLFAPPAQNHDSSSFHSRTSGKSNRNGPEKGVNGSINGSNTSSVIGINTSVLSTTASSSMGQTKSTSSGGGNRKCNQEQSKNQPLDARVDKIKDKKPRKKAMESSSNSDSDSGTSSDTSSEGISSSDSDDLEEDEEEEDQSIEESEDDDSDSESEAQHKSNNQVLLHGISDPKADGQKATEKAQEKRIHQPLPLASESQTHSFQSQQKQPQVLSQQLPFIFQSSQAKEESVNKHTSVIQSTGLVSNVKPLSLVNQAKKETYMKLIVPSPDVLKAGNKNTSEESSLLTSELRSKREQYKQAFPSQLKKQESSKSLKKVIAALSNPKATSSSPAHPKQTLENNHPNPFLTNALLGNHQPNGVIQSVIQEAPLALTTKTKMQSKINENIAAASSTPFSSPVNLSTSGRRTPGNQTPVMPSASPILHSQGKEKAVSNNVNPVKTQHHSHPAKSLVEQFRGTDSDIPSSKDSEDSNEDEEEDDEEEDEEDDEDDESDDSQSGTSKRRRVTDERELRIPLEYGWQRETRIRNFGGRLQGEVAYYAPCGKKLRQYPEVIKYLSRNGIMDISRDNFSFSAKIRVGDFYEARDGPQGMQWCLLKEEDVIPRIRAMEGRRGRPPNPDRQRAREESRMRRRKGRPPNVGNAEFLDNADAKLLRKLQAQEIARQAAQIKLLRKLQKQEQARVAKEAKKQQAIMAAEEKRKQKEQIKIMKQQEKIKRIQQIRMEKELRAQQILEAKKKKKEEAANAKLLEAEKRIKEKEMRRQQAVLLKHQERERRRQHMMLMKAMEARKKAEEKERLKQEKRDEKRLNKERKLEQRRLELEMAKELKKPNEDMCLADQKPLPELPRIPGLVLSGSTFSDCLMVVQFLRNFGKVLGFDVNIDVPNLSVLQEGLLNIGDSMGEVQDLLVRLLSAAVCDPGLITGYKIFMEAHCGQTELTESLKTKAFQAHTPAQKASVLAFLINELACSKSVVSEIDKNIDYMSNLRRDKWVVEGKLRKLRIIHAKKTGKRDTSGGIDLGEEQHPLGTPTPGRKRRRKGGDSDYDDDDDDDSDDQGDEDDEDEEDKEDKKGKKTDICEDEDEGDQAASVEELEKQIEKLSKQQSQYRRKLFDASHSLRSVMFGQDRYRRRYWILPQCGGIFVEGMESGEGLEEIAKEREKLKKAESVQIKEEMFETSGDSLNCSNTDHCEQKEDLKEKDNTNLFLQKPGSFSKLSKLLEVAKMPPESEVMTPKPNAGANGCTLSYQNSGKHSLGSVQSTATQSNVEKADSNNLFNTGSSGPGKFYSPLPNDQLLKTLTEKNRQWFSLLPRTPCDDTSLTHADMSTASLVTPQSQPPSKSPSPTPAPLGSSAQNPVGLNPFALSPLQVKGGVSMMGLQFCGWPTGVVTSNIPFTSSVPSLGSGLGLSEGNGNSFLTSNVASSKSESPVPQNEKATSAQPAAVEVAKPVDFPSPKPIPEEMQFGWWRIIDPEDLKALLKVLHLRGIREKALQKQIQKHLDYITQACLKNKDVAIIELNENEENQVTRDIVENWSVEEQAMEMDLSVLQQVEDLERRVASASLQVKGWMCPEPASEREDLVYFEHKSFTKLCKEHDGEFTGEDESSAHALERKSDNPLDIAVTRLADLERNIERRIEEDIAPGLRVWRRALSEARSAAQVALCIQQLQKSIAWEKSIMKVYCQICRKGDNEELLLLCDGCDKGCHTYCHRPKITTIPDGDWFCPACIAKASGQTLKIKKLHVKGKKTNESKKGKKVTLTGDTEDEDSASTSSSLKRGNKDLKKRKMEENTSINLSKQESFTSVKKPKRDDSKDLALCSMILTEMETHEDAWPFLLPVNLKLVPGYKKVIKKPMDFSTIREKLSSGQYPNLETFALDVRLVFDNCETFNEDDSDIGRAGHNMRKYFEKKWTDTFKVS

SEQ ID NO: 863135 - protein, 2086 aa, Homo sapiens; identical to SEQ ID NO: 863123

SEQ ID NO: 863136 - protein, 1074 aa, Homo sapiens
MVVQFLRNFGKVLGFDVNIDVPNLSVLQEGLLNIGDSMGEVQDLLVRLLSAAVCDPGLITGYKAKTALGEHLLNVGVNRDNVSEILQIFMEAHCGQTELTESLKTKAFQAHTPAQKASVLAFLINELACSKSVVSEIDKNIDYMSNLRRDKWVVEGKLRKLRIIHAKKTGKRDTSGGIDLGEEQHPLGTPTPGRKRRRKGGDSDYDDDDDDDSDDQGDEDDEDEEDKEDKKGKKTDICEDEDEGDQAASVEELEKQIEKLSKQQSQYRRKLFDASHSLRSVMFGQDRYRRRYWILPQCGGIFVEGMESGEGLEEIAKEREKLKKAESVQIKEEMFETSGDSLNCSNTDHCEQKEDLKEKDNTNLFLQKPGSFSKLSKLLEVAKMPPESEVMTPKPNAGANGCTLSYQNSGKHSLGSVQSTATQSNVEKADSNNLFNTGSSGPGKFYSPLPNDQLLKTLTEKNRQWFSLLPRTPCDDTSLTHADMSTASLVTPQSQPPSKSPSPTPAPLGSSAQNPVGLNPFALSPLQVKGGVSMMGLQFCGWPTGVVTSNIPFTSSVPSLGSGLGLSEGNGNSFLTSNVASSKSESPVPQNEKATSAQPAAVEVAKPVDFPSPKPIPEEMQFGWWRIIDPEDLKALLKVLHLRGIREKALQKQIQKHLDYITQACLKNKDVAIIELNENEENQVTRDIVENWSVEEQAMEMDLSVLQQVEDLERRVASASLQVKGWMCPEPASEREDLVYFEHKSFTKLCKEHDGEFTGEDESSAHALERKSDNPLDIAVTRLADLERNIERRIEEDIAPGLRVWRRALSEARSAAQVALCIQQLQKSIAWEKSIMKVYCQICRKGDNEELLLLCDGCDKGCHTYCHRPKITTIPDGDWFCPACIAKASGQTLKIKKLHVKGKKTNESKKGKKVTLTGDTEDEDSASTSSSLKRGNKDLKKRKMEENTSINLSKQESFTSVKKPKRDDSKDLALCSMILTEMETHEDAWPFLLPVNLKLVPGYKKVIKKPMDFSTIREKLSSGQYPNLETFALDVRLVFDNCETFNEDDSDIGRAGHNMRKYFEKKWTDTFKVS

SEQ ID NO: 863137 - protein, 2114 aa, Homo sapiens
MESGERLPSSAASSTTPTSSSTPSVASVVSKGGLSTGVASLSSTINPCGHLFRTAGDQPFNLSTVSSAFPMVSHPVFGLHSASSGHSEFGGLGTLGTPTALAAHPQLASFPAEWWRTTDAHTRTGATFFPPLLGIPPLFAPPAQNHDSSSFHSRTSGKSNRNGPEKGVNGSINGSNTSSVIGINTSVLSTTASSSMGQTKSTSSGGGNRKCNQEQSKNQPLDARVDKIKDKKPRKKAMESSSNSDSDSGTSSDTSSEGISSSDSDDLEEDEEEEDQSIEESEDDDSDSESEAQHKSNNQVLLHGISDPKADGQKATEKAQEKRIHQPLPLASESQTHSFQSQQKQPQVLSQQLPFIFQSSQAKEESVNKHTSVIQSTGLVSNVKPLSLVNQAKKETYMKLIVPSPDVLKAGNKNTSEESSLLTSELRSKREQYKQAFPSQLKKQESSKSLKKVIAALSNPKATSSSPAHPKQTLENNHPNPFLTNALLGNHQPNGVIQSVIQEAPLALTTKTKMQSKINENIAAASSTPFSSPVNLSTSGRRTPGNQTPVMPSASPILHSQGKEKAVSNNVNPVKTQHHSHPAKSLVEQFRGTDSDIPSSKDSEDSNEDEEEDDEEEDEEDDEDDESDDSQSGTSKRRRVTDERELRIPLEYGWQRETRIRNFGGRLQGEVAYYAPCGKKLRQYPEVIKYLSRNGIMDISRDNFSFSAKIRVGDFYEARDGPQGMQWCLLKEEDVIPRIRAMEGRRGRPPNPDRQRAREESRMRRRKGRPPNVGNAEFLDNADAKLLRKLQAQEIARQAAQIKLLRKLQKQEQARVAKEAKKQQAIMAAEEKRKQKEQIKIMKQQEKIKRIQQIRMEKELRAQQILEAKKKKKEEAANAKLLEAEKRIKEKEMRRQQAVLLKHQERERRRQHMMLMKAMEARKKAEEKERLKQEKRDEKRLNKERKLEQRRLELEMAKELKKPNEDMCLADQKPLPELPRIPGLVLSGSTFSDCLMVVQFLRNFGKVLGFDVNIDVPNLSVLQEGLLNIGDSMGEVQDLLVRLLSAAVCDPGLITGYKAKTALGEHLLNVGVNRDNVSEILQIFMEAHCGQTELTESLKTKAFQAHTPAQKASVLAFLINELACSKSVVSEIDKNIDYMSNLRRDKWVVEGKLRKLRIIHAKKTGKRDTSGGIDLGEEQHPLGTPTPGRKRRRKGGDSDYDDDDDDDSDDQGDEDDEDEEDKEDKKGKKTDICEDEDEGDQAASVEELEKQIEKLSKQQSQYRRKLFDASHSLRSVMFGQDRYRRRYWILPQCGGIFVEGMESGEGLEEIAKEREKLKKAESVQIKEEMFETSGDSLNCSNTDHCEQKEDLKEKDNTNLFLQKPGSFSKLSKLLEVAKMPPESEVMTPKPNAGANGCTLSYQNSGKHSLGSVQSTATQSNVEKADSNNLFNTGSSGPGKFYSPLPNDQLLKTLTEKNRQWFSLLPRTPCDDTSLTHADMSTASLVTPQSQPPSKSPSPTPAPLGSSAQNPVGLNPFALSPLQVKGGVSMMGLQFCGWPTGVVTSNIPFTSSVPSLGSGLGLSEGNGNSFLTSNVASSKSESPVPQNEKATSAQPAAVEVAKPVDFPSPKPIPEEMQFGWWRIIDPEDLKALLKVLHLRGIREKALQKQIQKHLDYITQACLKNKDVAIIELNENEENQVTRDIVENWSVEEQAMEMDLSVLQQVEDLERRVASASLQVKGWMCPEPASEREDLVYFEHKSFTKLCKEHDGEFTGEDESSAHALERKSDNPLDIAVTRLADLERNIERRYLKSPLSTTIQIKLDNVGTVTVPAPAPSVSGDGDGIEEDIAPGLRVWRRALSEARSAAQVALCIQQLQKSIAWELLLLCDGCDKGCHTYCHRPKITTIPDGDWFCPACIAKASGQTLKIKKLHVKGKKTNESKKGKKVTLTGDTEDEDSASTSSSLKRGNKDLKKRKMEENTSINLSKQESFTSVKKPKRDDSKDLALCSMILTEMETHEDAWPFLLPVNLKLVPGYKKVIKKPMDFSTIREKLSSGQYPNLETFALDVRLVFDNCETFNEDDSDIGRAGHNMRKYFEKKWTDTFKPLCYEDALAAQPYGAANSYHQLTSPVPEAS

SEQ ID NO: 863138 - protein, 1256 aa, Homo sapiens
MESGERLPSSAASSTTPTSSSTPSVASVVSKGGLSTGVASLSSTINPCGHLFRTAGDQPFNLSTVSSAFPMVSHPVFGLHSASSGHSEFGGLGTLGTPTALAAHPQLASFPAEWWRTTDAHTRTGATFFPPLLGIPPLFAPPAQNHDSSSFHSRTSGKSNRNGPEKGVNGSINGSNTSSVIGINTSVLSTTASSSMGQTKSTSSGGGNRKCNQEQSKNQPLDARVDKIKDKKPRKKAMESSSNSDSDSGTSSDTSSEGISSSDSDDLEEDEEEEDQSIEESEDDDSDSESEAQHKSNNQVLLHGISDPKADGQKATEKAQEKRIHQPLPLASESQTHSFQSQQKQPQVLSQQLPFIFQSSQAKEESVNKHTSVIQSTGLVSNVKPLSLVNQAKKETYMKLIVPSPDVLKAGNKNTSEESSLLTSELRSKREQYKQAFPSQLKKQESSKSLKKVIAALSNPKATSSSPAHPKQTLENNHPNPFLTNALLGNHQPNGVIQSVIQEAPLALTTKTKMQSKINENIAAASSTPFSSPVNLSTSGRRTPGNQTPVMPSASPILHSQGKEKAVSNNVNPVKTQHHSHPAKSLVEQFRGTDSDIPSSKDSEDSNEDEEEDDEEEDEEDDEDDESDDSQSGTSKRRRVTDERELRIPLEYGWQRETRIRNFGGRLQGEVAYYAPCGKKLRQYPEVIKYLSRNGIMDISRDNFSFSAKIRVGDFYEARDGPQGMQWCLLKEEDVIPRIRAMEGRRGRPPNPDRQRAREESRMRRRKGRPPNVGNAEFLDNADAKLLRKLQAQEIARQAAQIKLLRKLQKQEQARVAKEAKKQQAIMAAEEKRKQKEQIKIMKQQEKIKRIQQIRMEKELRAQQILEAKKKKKEEAANAKLLEAEKRIKEKEMRRQQAVLLKHQERERRRQHMMLMKAMEARKKAEEKERLKQEKRDEKRLNKERKLEQRRLELEMAKELKKPNEDMCLADQKPLPELPRIPGLVLSGSTFSDCLMVVQFLRNFGKVLGFDVNIDVPNLSVLQEGLLNIGDSMGEVQDLLVRLLSAAVCDPGLITGYKAKTALGEHLLNVGVNRDNVSEILQIFMEAHCGQTELTESLKTKAFQAHTPAQKASVLAFLINELACSKSVVSEIDKNIDYMSNLRRDKWVVEGKLRKLRIIHAKKTGKRDTSGGIDLGEEQHPLGTPTPGRKRRRKGGDSDYDDDDDDDSDDQGDEDDEDEEDKEDKKGKKTDICEDEDEGDQAAVLRHSGSSRVTSA

SEQ ID NO: 863139 - protein, 393 aa, Homo sapiens
MLRRLLERPCTLALLVGSQLAVMMYLSLGGFRSLSALFGRDQGPTFDYSHPRDVYSNLSHLPGAPGGPPAPQGLPYCPERSPLLVGPVSVSFSPVPSLAEIVERNPRVEPGGRYRPAGCEPRSRTAIIVPHRAREHHLRLLLYHLHPFLQRQQLAYGIYVIHQAGNGTFNRAKLLNVGVREALRDEEWDCLFLHDVDLLPENDHNLYVCDPRGPRHVAVAMNKFGYSLPYPQYFGGVSALTPDQYLKMNGFPNEYWGWGGEDDDIATRVRLAGMKISRPPTSVGHYKMVKHRGDKGNEENPHRFDLLVRTQNSWTQDGMNSLTYQLLARELGPLYTNITADIGTDPRGPRAPSGPRYPPGSSQAFRQEMLQRRPPARPGPLSTANHTALRGSH

SEQ ID NO: 863140 - protein, 393 aa, Homo sapiens; identical to SEQ ID NO: 863139

SEQ ID NO: 863141 - protein, 393 aa, Homo sapiens; identical to SEQ ID NO: 863139

SEQ ID NO: 863142 - protein, 393 aa, Homo sapiens; identical to SEQ ID NO: 863139

SEQ ID NO: 863143 - protein, 393 aa, Homo sapiens; identical to SEQ ID NO: 863139

SEQ ID NO: 863144 - protein, 393 aa, Homo sapiens; identical to SEQ ID NO: 863139

SEQ ID NO: 863145 - protein, 310 aa, Homo sapiens
MLRRLLERPCTLALLVGSQLAVMMYLSLGGFRSLSALFGRDQGPTFDYSHPRDVYSNLSHLPGAPGGPPAPQGLPYCPERSPLLVGPVSVSFSPVPSLAEIVERNPRVEPGGRYRPAGCEPRSRTAIIVPHRAREHHLRLLLYHLHPFLQRQQLAYGIYVIHQAGNGTFNRAKLLNVGVREALRDEEWDCLFLHDVDLLPENDHNLYVCDPRGPRHVAVAMNKFGYSLPYPQYFGGVSALTPDQYLKMNGFPNEYWGWGGEDDDIATRVRLAGMKISRPPTSVGHYKMVKHRGDKGNEENPHRIPGRKMG

SEQ ID NO: 863146 - protein, 400 aa, Homo sapiens
MYEAVVIGETPPPQRPLPRWRQRCLPGCWGGGDDRQQKTSWSQIRCWSAGWSLSLPSVTFPILDNASHLCPPGGPPAPQGLPYCPERSPLLVGPVSVSFSPVPSLAEIVERNPRVEPGGRYRPAGCEPRSRTAIIVPHRAREHHLRLLLYHLHPFLQRQQLAYGIYVIHQAGNGTFNRAKLLNVGVREALRDEEWDCLFLHDVDLLPENDHNLYVCDPRGPRHVAVAMNKFGYSLPYPQYFGGVSALTPDQYLKMNGFPNEYWGWGGEDDDIATRVRLAGMKISRPPTSVGHYKMVKHRGDKGNEENPHRFDLLVRTQNSWTQDGMNSLTYQLLARELGPLYTNITADIGTDPRGPRAPSGPRYPPGSSQAFRQEMLQRRPPARPGPLSTANHTALRGSH

SEQ ID NO: 863147 - protein, 173 aa, Homo sapiens
MNKFGYSLPYPQYFGGVSALTPDQYLKMNGFPNEYWGWGGEDDDIATRVRLAGMKISRPPTSVGHYKMVKHRGDKGNEENPHRFDLLVRTQNSWTQDGMNSLTYQLLARELGPLYTNITADIGTDPRGPRAPSGPRYPPGSSQAFRQEMLQRRPPARPGPLSTANHTALRGSH

SEQ ID NO: 863148 - protein, 148 aa, Homo sapiens
MLRRLLERPCTLALLVGSQLAVMMYLSLGGFRSLSALFGRDQGPTFDYSHPRDVYSNLSHLPGAPGGPPAPQGLPYCPERSPLLVGPVSVSFSPVPSLAEIVERNPRVEPGGRCCSTTCTPSCSASSLLMASMSSTRLEMEHLTGQNC

SEQ ID NO: 863149 - protein, 304 aa, Homo sapiens
MEFVLVLREFVLVLREFVLVLRELYRPAGCEPRSRTAIIVPHRAREHHLRLLLYHLHPFLQRQQLAYGIYVIHQAGNGTFNRAKLLNVGVREALRDEEWDCLFLHDVDLLPENDHNLYVCDPRGPRHVAVAMNKFGYSLPYPQYFGGVSALTPDQYLKMNGFPNEYWGWGGEDDDIATRVRLAGMKISRPPTSVGHYKMVKHRGDKGNEENPHRFDLLVRTQNSWTQDGMNSLTYQLLARELGPLYTNITADIGTDPRGPRAPSGPRYPPGSSQAFRQEMLQRRPPARPGPLSTANHTALRGSH

SEQ ID NO: 863150 - protein, 219 aa, Homo sapiens
SRGSHKAALRDEEWDCLFLHDVDLLPENDHNLYVCDPRGPRHVAVAMNKFGYSLPYPQYFGGVSALTPDQYLKMNGFPNEYWGWGGEDDDIATRVRLAGMKISRPPTSVGHYKMVKHRGDKGNEENPHRFDLLVRTQNSWTQDGMNSLTYQLLARELGPLYTNITADIGTDPRGPRAPSGPRYPPGSSQAFRQEMLQRRPPARPGPLSTANHTALRGSH

SEQ ID NO: 863151 - protein, 312 aa, Homo sapiens
MLRRLLERPCTLALLVGSQLAVMMYLSLGGFRSLSALFGRDQGPTFDYSHPRDVYSNLSHLPGAPGGPPAPQGLPYCPERSPLLVGPVSVSFSPVPSLAEIVERNPRVEPGGRYRPAGCEPRSRTAIIVPHRAREHHLRLLLYHLHPFLQRQQLAYGIYVIHQAGNGTFNRAKLLNVGVREALRDEEWDCLFLHDVDLLPENDHNLYVCDPRGPRHVAVAMNKFGYSLPYPQYFGGVSALTPDQYLKMNGFPNEYWGWGGEDDDIATRVRLAGMKISRPPTSVGHYKMVKHRGDKGNEENPHRLTPGSVPEF

SEQ ID NO: 863152 - protein, 82 aa, Homo sapiens
GYYEAVVIGETPPPQRPLPRWRQRCLPGCWGGGDDRQQKTSWSQIRCWSAGWSLSLPSVTFPILDNASHLCPPGTPWSPHDP

SEQ ID NO: 863153 - protein, 52 aa, Homo sapiens
GCVPRRLGVCKDLSLPSLPYPQYFGGVSALTPDQYLKMNGFPNEYWGWGGED

SEQ ID NO: 863154 - protein, 393 aa, Homo sapiens; identical to SEQ ID NO: 863139

SEQ ID NO: 863155 - protein, 393 aa, Homo sapiens; identical to SEQ ID NO: 863139

SEQ ID NO: 863156 - protein, 393 aa, Homo sapiens; identical to SEQ ID NO: 863139

SEQ ID NO: 863157 - protein, 393 aa, Homo sapiens; identical to SEQ ID NO: 863139

SEQ ID NO: 863158 - protein, 303 aa, Homo sapiens
MLRRLLERPCTLALLVGSQLAVMMYLSLGGFRSLSALFGRDQGPTFDYSHPRDVYSNLSHLPGAPGGPPAPQGLPYCPERSPLLVGPVSVSFSPVPSLAEIVERNPRVEPGGRYRPAGCEPRSRTAIIVPHRAREHHLRLLLYHLHPFLQRQQLAYGIYVIHQAGNGTFNRAKLLNVGVREALRDEEWDCLFLHDVDLLPENDHNLYVCDPRGPRHVAVAMNKFGYSLPYPQYFGGVSALTPDQYLKMNGFPNEYWGWGGEDDDIATRVRLAGMKISRPPTSVGHYKMVKHRGDKGNEENPHR

SEQ ID NO: 863159 - protein, 349 aa, Homo sapiens
LWRWYAPELRDSNLSHLPGAPGGPPAPQGLPYCPERSPLLVGPVSVSFSPVPSLAEIVERNPRVEPGGRYRPAGCEPRSRTAIIVPHRAREHHLRLLLYHLHPFLQRQQLAYGIYVIHQAGNGTFNRAKLLNVGVREALRDEEWDCLFLHDVDLLPENDHNLYVCDPRGPRHVAVAMNKFGYSLPYPQYFGGVSALTPDQYLKMNGFPNEYWGWGGEDDDIATRVRLAGMKISRPPTSVGHYKMVKHRGDKGNEENPHRFDLLVRTQNSWTQDGMNSLTYQLLARELGPLYTNITADIGTDPRGPRAPSGPRYPPGSSQAFRQEMLQRRPPARPGPLSTANHTALRGSH

SEQ ID NO: 863160 - protein, 327 aa, Homo sapiens
MVYVELGVNSDEAEHLSLLGPVSVSFSPVPSLAEIVERNPRVEPGGRYRPAGCEPRSRTAIIVPHRAREHHLRLLLYHLHPFLQRQQLAYGIYVIHQAGNGTFNRAKLLNVGVREALRDEEWDCLFLHDVDLLPENDHNLYVCDPRGPRHVAVAMNKFGYSLPYPQYFGGVSALTPDQYLKMNGFPNEYWGWGGEDDDIATRVRLAGMKISRPPTSVGHYKMVKHRGDKGNEENPHRFDLLVRTQNSWTQDGMNSLTYQLLARELGPLYTNITADIGTDPRGPRAPSGPRYPPGSSQAFRQEMLQRRPPARPGPLSTANHTALRGSH

SEQ ID NO: 863161 - protein, 393 aa, Homo sapiens; identical to SEQ ID NO: 863139

SEQ ID NO: 863162 - protein, 120 aa, Homo sapiens
MKISRPPTSVGHYKMVKHRGDKGNEENPHRFDLLVRTQNSWTQDGMNSLTYQLLARELGPLYTNITADIGTDPRGPRAPSGPRYPPGSSQAFRQEMLQRRPPARPGPLSTANHTALRGSH

SEQ ID NO: 863163 - protein, 82 aa, Homo sapiens; identical to SEQ ID NO: 863152

SEQ ID NO: 863164 - protein, 187 aa, Homo sapiens
MEENEVESSSDAAPGPGRPEEPSESGLGVGTSEAVSADSSDAAAAPGQAEADDSGVGQSSDRGSRSQEEVSESSSSADPLPNSYLPDSSSVSHGPVAGVTGGPPALVHSSALPDPNMLVSDCTASSSDLGSAIDKIIESTIGPDLIQNCITVTSAEDGGAETTRYLILQGPDDGAPLTSPMASSQEL

SEQ ID NO: 863165 - protein, 1342 aa, Homo sapiens
MEENEVESSSDAAPGPGRPEEPSESGLGVGTSEAVSADSSDAAAAPGQAEADDSGVGQSSDRGSRSQEEVSESSSSADPLPNSYLPDSSSVSHGPVAGVTGGPPALVHSSALPDPNMLVSDCTASSSDLGSAIDKIIESTIGPDLIQNCITVTSAEDGGAETTRYLILQGPDDGAPMTSPMSSSTLAHSLAAIEALADGPTSTSTCLEAQGGPSSPVQLPPASGAEEPDLQSLEAMMEVVVVQQFKCKMCQYRSSTKATLLRHMRERHFRPVAAAAAAAGKKGRLRKWSTSTKSQEEEGPEEEDDDDIVDAGAIDDLEEDSDYNPAEDEPRGRQLRLQRPTPSTPRPRRRPGRPRKLPRLEISDLPDGVEGEPLVSSQSGQSPPEPQDPEAPSSSGPGHLVAMGKVSRTPVEAGVSQSDAENAAPSCPDEHDTLPRRRGRPSRRFLGKKYRKYYYKSPKPLLRPFLCRICGSRFLSHEDLRFHVNSHEAGDPQLFKCLQCSYRSRRWSSLKEHMFNHVGSKPYKCDECSYTSVYRKDVIRHAAVHSRDRKKRPDPTPKLSSFPCPVCGRVYPMQKRLTQHMKTHSTEKPHMCDKCGKSFKKRYTFKMHLLTHIQAVANRRFKCEFCEFVCEDKKALLNHQLSHVSDKPFKCSFCPYRTFREDFLLSHVAVKHTGAKPFACEYCHFSTRHKKNLRLHVRCRHASSFEEWGRRHPEEPPSRRRPFFSLQQIEELKQQHSAAPGPPPSSPGPPEIPPEATTFQSSEAPSLLCSDTLGGATIIYQQGAEESTAMATQTALDLLLNMSAQRELGGTALQVAVVKSEDVEAGLASPGGQPSPEGATPQVVTLHVAEPGGGAAAESQLGPPDLPQITLAPGPFGGTGYSVITAPPMEEGTSAPGTPYSEEPAGEAAQAVVVSDTLKEAGTHYIMATDGTQLHHIELTADGSISFPSPDALASGAKWPLLQCGGLPRDGPEPPSPAKTHCVGDSQSSASSPPATSKALGLAVPPSPPSAATAASKKFSCKICAEAFPGRAEMESHKRAHAGPGAFKCPDCPFSARQWPEVRAHMAQHSSLRPHQCSQCSFASKNKKDLRRHMLTHTKEKPFACHLCGQRFNRNGHLKFHIQRLHSPDGRKSGTPTARAPTQTPTQTIILNSDDETLATLHTALQSSHGVLGPERLQQALSQEHIIVAQEQTVTNQEEAAYIQEITTADGQTVQHLVTSDNQVQYIISQDGVQHLLPQEYVVVPEGHHIQVQEGQITHIQYEQGAPFLQESQIQYVPVSPGQQLVTQAQLEAAAHSAVTAVADAAMAQAQGLFGTDETVPEHIQQLQHQGIEYDVITLADD

SEQ ID NO: 863166 - protein, 1079 aa, Homo sapiens
MEENEVESSSDAAPGPGRPEEPSESGLGVGTSEAVSADSSDAAAAPGQAEADDSGEDSDYNPAEDEPRGRQLRLQRPTPSTPRPRRRPGRPRKLPRLEISDLPDGVEGEPLVSSQSGQSPPEPQDPEAPSSSGPGHLVAMGKVSRTPVEAGVSQSDAENAAPSCPDEHDTLPRRRGRPSRRFLGKKYRKYYYKSPKPLLRPFLCRICGSRFLSHEDLRFHVNSHEAGDPQLFKCLQCSYRSRRWSSLKEHMFNHVGSKPYKCDECSYTSVYRKDVIRHAAVHSRDRKKRPDPTPKLSSFPCPVCGRVYPMQKRLTQHMKTHSTEKPHMCDKCGKSFKKRYTFKMHLLTHIQAVANRRFKCEFCEFVCEDKKALLNHQLSHVSDKPFKCSFCPYRTFREDFLLSHVAVKHTGAKPFACEYCHFSTRHKKNLRLHVRCRHASSFEEWGRRHPEEPPSRRRPFFSLQQIEELKQQHSAAPGPPPSSPGPPEIPPEATTFQSSEAPSLLCSDTLGGATIIYQQGAEESTAMATQTALDLLLNMSAQRELGGTALQVAVVKSEDVEAGLASPGGQPSPEGATPQVVTLHVAEPGGGAAAESQLGPPDLPQITLAPGPFGGTGYSVITAPPMEEGTSAPGTPYSEEPAGEAAQAVVVSDTLKEAGTHYIMATDGTQLHHIELTADGSISFPSPDALASGAKWPLLQCGGLPRDGPEPPSPAKTHCVGDSQSSASSPPATSKALGLAVPPSPPSAATAASKKFSCKICAEAFPGRAEMESHKRAHAGPGAFKCPDCPFSARQWPEVRAHMAQHSSLRPHQCSQCSFASKNKKDLRRHMLTHTKEKPFACHLCGQRFNRNGHLKFHIQRLHSPDGRKSGTPTARAPTQTPTQTIILNSDDETLATLHTALQSSHGVLGPERLQQALSQEHIIVAQEQTVTNQEEAAYIQEITTADGQTVQHLVTSDNQVQYIISQDGVQHLLPQEYVVVPEGHHIQVQEGQITHIQYEQGAPFLQESQIQYVPVSPGQQLVTQAQLEAAAHSAVTAVADAAMAQAQGLFGTDETVPEHIQQLQHQGIEYDVITLADD

SEQ ID NO: 863167 - protein, 979 aa, Homo sapiens
MSVAGVEGEPLVSSQSGQSPPEPQDPEAPSSSGPGHLVAMGKVSRTPVEAGVSQSDAENAAPSCPDEHDTLPRRRGRPSRRFLGKKYRKYYYKSPKPLLRPFLCRICGSRFLSHEDLRFHVNSHEAGDPQLFKCLQCSYRSRRWSSLKEHMFNHVGSKPYKCDECSYTSVYRKDVIRHAAVHSRDRKKRPDPTPKLSSFPCPVCGRVYPMQKRLTQHMKTHSTEKPHMCDKCGKSFKKRYTFKMHLLTHIQAVANRRFKCEFCEFVCEDKKALLNHQLSHVSDKPFKCSFCPYRTFREDFLLSHVAVKHTGAKPFACEYCHFSTRHKKNLRLHVRCRHASSFEEWGRRHPEEPPSRRRPFFSLQQIEELKQQHSAAPGPPPSSPGPPEIPPEATTFQSSEAPSLLCSDTLGGATIIYQQGAEESTAMATQTALDLLLNMSAQRELGGTALQVAVVKSEDVEAGLASPGGQPSPEGATPQVVTLHVAEPGGGAAAESQLGPPDLPQITLAPGPFGGTGYSVITAPPMEEGTSAPGTPYSEEPAGEAAQAVVVSDTLKEAGTHYIMATDGTQLHHIELTADGSISFPSPDALASGAKWPLLQCGGLPRDGPEPPSPAKTHCVGDSQSSASSPPATSKALGLAVPPSPPSAATAASKKFSCKICAEAFPGRAEMESHKRAHAGPGAFKCPDCPFSARQWPEVRAHMAQHSSLRPHQCSQCSFASKNKKDLRRHMLTHTKEKPFACHLCGQRFNRNGHLKFHIQRLHSPDGRKSGTPTARAPTQTPTQTIILNSDDETLATLHTALQSSHGVLGPERLQQALSQEHIIVAQEQTVTNQEEAAYIQEITTADGQTVQHLVTSDNQVQYIISQDGVQHLLPQEYVVVPEGHHIQVQEGQITHIQYEQGAPFLQESQIQYVPVSPGQQLVTQAQLEAAAHSAVTAVADAAMAQAQGLFGTDETVPEHIQQLQHQGIEYDVITLADD

SEQ ID NO: 863168 - protein, 1418 aa, Homo sapiens
MEENEVESSSDAAPGPGRPEEPSESGLGVGTSEAVSADSSDAAAAPGQAEADDSGVGQSSDRGSRSQEEVSESSSSADPLPNSYLPDSSSVSHGPVAGVTGGPPALVHSSALPDPNMLVSDCTASSSDLGSAIDKIIESTIGPDLIQNCITVTSAEDGGAETTRYLILQGPDDGAPMTSPMSSSTLAHSLAAIEALADGPTSTSTCLEAQGGPSSPVQLPPASGAEEPDLQSLEAMMEVVVVQQFKCKMCQYRSSTKATLLRHMRERHFRPVAAAAAAAGKKGRLRKWSTSTKSQEEEGPEEEDDDDIVDAGAIDDLEEDSDYNPAEDEPRGRQLRLQRPTPSTPRPRRRPGRPRKLPRLEISDLPDGVEGEPLVSSQSGQSPPEPQDPEAPSSSGPGHLVAMGKVSRTPVEAGVSQSDAENAAPSCPDEHDTLPRRRGRPSRRFLGKKYRKYYYKSPKPLLRPFLCRICGSRFLSHEDLRFHVNSHEAGDPQLFKCLQCSYRSRRWSSLKEHMFNHVGSKPYKCDECSYTSVYRKDVIRHAAVHSRDRKKRPDPTPKLSSFPCPVCGRVYPMQKRLTQHMKTHSTEKPHMCDKCGKSFKKRYTFKMHLLTHIQAVANRRFKCEFCEFVCEDKKALLNHQLSHVSDKPFKCSFCPYRTFREDFLLSHVAVKHTGAKPFACEYCHFSTRHKKNLRLHVRCRHASSFEEWGRRHPEEPPSRRRPFFSLQQIEELKQQHSAAPGPPPSSPGPPEIPPEATTFQSSEAPSLLCSDTLGGATIIYQQGELCRRIGALEGRTSELGRGRSCWWGLEDGEGVVLGASFLALCQAEVPPHPGAEESTAMATQTALDLLLNMSAQRELGGTALQVAVVKSEDVEAGLASPGGQPSPEGATPQVVTLHVAEPGGGAAAESQLGPPDLPQITLAPGPFGGTGYSVITAPPMEEGTSAPGTPYSEEPAGEAAQAVVVSDTLKEAGTHYIMATDGTQLHHIEVRLGDANHSPTSLPFSVPHAPCLSQLTADGSISFPSPDALASGAKWPLLQCGGLPRDGPEPPSPAKTHCVGDSQSSASSPPATSKALGLAVPPSPPSAATAASKKFSCKICAEAFPGRAEMESHKRAHAGPGAFKCPDCPFSARQWPEVRAHMAQHSSLRPHQCSQCSFASKNKKDLRRHMLTHTKEKPFACHLCGQRFNRNGHLKFHIQRLHSPDGRKSGTPTARAPTQTPTQTIILNSDDETLATLHTALQSSHGVLGPERLQQALSQEHIIVAQEQTVTNQEEAAYIQEITTADGQTVQHLVTSDNQVQYIISQDGVQHLLPQEYVVVPEGHHIQVQEGQITHIQYEQGAPFLQESQIQYVPVSPGQQLVTQAQLEAAAHSAVTAVADAAMAQAQGLFGTDETVPEHIQQLQHQGIEYDVITLADD

SEQ ID NO: 863169 - protein, 613 aa, Homo sapiens
MEENEVESSSDAAPGPGRPEEPSESGLGVGTSEAVSADSSDAAAAPGQAEADDSGVGQSSDRGSRSQEEVSESSSSADPLPNSYLPDSSSVSHGPVAGVTGGPPALVHSSALPDPNMLVSDCTASSSDLGSAIDKIIESTIGPDLIQNCITVTSAEDGGAETTRYLILQGPDDGAPMTSPMSSSTLAHSLAAIEALADGPTSTSTCLEAQGGPSSPVQLPPASGAEEPDLQSLEAMMEVVVVQQFKCKMCQYRSSTKATLLRHMRERHFRPVAAAAAAAGKKGRLRKWSTSTKSQEEEGPEEEDDDDIVDAGAIDDLEEDSDYNPAEDEPRGRQLRLQRPTPSTPRPRRRPGRPRKLPRLEISDLPDGVEGEPLVSSQSGQSPPEPQDPEAPSSSGPGHLVAMGKVSRTPVEAGVSQSDAENAAPSCPDEHDTLPRRRGRPSRRFLGKKYRKYYYKSPKPLLRPFLCRICGSRFLSHEDLRFHVNSHEAGDPQLFKCLQCSYRSRRWSSLKEHMFNHVGSKPYKCDECSYTSVYRKDVIRHAAVHSRDRSVWGWEGPGQERPGWVGKWRPGITMVPTYRAPALSQPHLLHTTGMSRKAVHPSSFGLEQDSTRP

SEQ ID NO: 863170 - protein, 708 aa, Homo sapiens
MEENEVESSSDAAPGPGRPEEPSESGLGVGTSEAVSADSSDAAAAPGQAEADDSGVGQSSDRGSRSQEEVSESSSSADPLPNSYLPDSSSVSHGPVAGVTGGPPALVHSSALPDPNMLVSDCTASSSDLGSAIDKIIESTIGPDLIQNCITVTSAEDGGAETTRYLILQGPDDGAPMTSPMSSSTLAHSLAAIEALADGPTSTSTCLEAQGGPSSPVQLPPASGAEEPDLQSLEAMMEVVVVQQFKCKMCQYRSSTKATLLRHMRERHFRPVAAAAAAAGKKGRLRKWSTSTKSQEEEGPEEEDDDDIVDAGAIDDLEEDSDYNPAEDEPRGRQLRLQRPTPSTPRPRRRPGRPRKLPRLEISDLPDGVEGEPLVSSQSGQSPPEPQDPEAPSSSGPGHLVAMGKVSRTPVEAGVSQSDAENAAPSCPDEHDTLPRRRGRPSRRFLGKKYRKYYYKSPKPLLRPFLCRICGSRFLSHEDLRFHVNSHEAGDPQLFKCLQCSYRSRRWSSLKEHMFNHVGSKPYKCDECSYTSVYRKDVIRHAAVHSRDRKKRPDPTPKLSSFPCPVCGRVYPMQKRLTQHMKTHSTEKPHMCDKCGKSFKKRYTFKMHLLTHIQAVANRRFKCEFCEFVCEDKKALLNHQLSHVSDKPFKCSFCPYRTFREDFLLSHVAVKHTGAKPFACGSRFLSHEDLRFHVNSHEAGDPQLYQCR

SEQ ID NO: 863171 - protein, 233 aa, Homo sapiens
MEENEVESSSDAAPGPGRPEEPSESGLGVGTSEAVSADSSDAAAAPGQAEADDSGVGQSSDRGSRSQEEVSESSSSADPLPNSYLPDSSSVSHGPVAGVTGGPPALVHSSALPDPNMLVSDCTASSSDLGSAIDKIIESTIGPDLIQNCITVTSAEDGGAETTRYLILQGPDDGAPMTSPMSSSTLAHSLAPWAPARTCWVPQPAGRLWERNLFLFGWTHWPVSLNKGTGVQS

SEQ ID NO: 863172 - protein, 821 aa, Homo sapiens
MQKRLTQHMKTHSTEKPHMCDKCGKSFKKRYTFKMHLLTHIQAVANRRFKCEFCEFVCEDKKALLNHQLSHVSDKPFKCSFCPYRTFREDFLLSHVAVKHTGAKPFACEYCHFSTRHKKNLRLHVRCRHASSFEEWGRRHPEEPPSRRRPFFSLQQIEELKQQHSAAPGPPPSSPGPPEIPPEATTFQSSEAPSLLCSDTLGGATIIYQQGELCRRIGALEGRTSELGRGRSCWWGLEDGEGVVLGASFLALCQAEVPPHPGAEESTAMATQTALDLLLNMSAQRELGGTALQVAVVKSEDVEAGLASPGGQPSPEGATPQVVTLHVAEPGGGAAAESQLGPPDLPQITLAPGPFGGTGYSVITAPPMEEGTSAPGTPYSEEPAGEAAQAVVVSDTLKEAGTHYIMATDGTQLHHIELTADGSISFPSPDALASGAKWPLLQCGGLPRDGPEPPSPAKTHCVGDSQSSASSPPATSKALGLAVPPSPPSAATAASKKFSCKICAEAFPGRAEMESHKRAHAGPGAFKCPDCPFSARQWPEVRAHMAQHSSLRPHQCSQCSFASKNKKDLRRHMLTHTKEKPFACHLCGQRFNRNGHLKFHIQRLHSPDGRKSGTPTARAPTQTPTQTIILNSDDETLATLHTALQSSHGVLGPERLQQALSQEHIIVAQEQTVTNQEEAAYIQEITTADGQTVQHLVTSDNQVQYIISQDGVQHLLPQEYVVVPEGHHIQVQEGQITHIQYEQGAPFLQESQIQYVPVSPGQQLVTQAQLEAAAHSAVTAVADAAMAQAQGLFGTDETVPEHIQQLQHQGIEYDVITLADD

SEQ ID NO: 863173 - protein, 128 aa, Homo sapiens
RHARPPHQQVQYIISQDGVQHLLPQEYVVVPEGHHIQVQEGQITHIQYEQGAPFLQESQIQYVPVSPGQQLVTQAQLEAAAHSAVTAVADAAMAQAQGLFGTDETVPEHIQQLQHQGIEYDVITLADD

SEQ ID NO: 863174 - protein, 279 aa, Homo sapiens
MSVAGVEGEPLVSSQSGQSPPEPQDPEAPSSSGPGHLVAMGKVSRTPVEAGVSQSDAENAAPSCPDEHDTLPRRRGRPSRRFLGKKYRKYVEQRRGWGMHVVKPPTPPDLSATLSSCRYYYKSPKPLLRPFLCRICGSRFLSHEDLRFHVNSHEAGDPQLFKCLQCSYRSRRWSSLKEHMFNHVGSKPYKCDECSYTSVYRKDVIRHAAVHSRDRSVWGWEGPGQERPGWVGKWRPGITMVPTYRAPALSQPHLLHTTGMSRKAVHPSSFGLEQDSTRP

SEQ ID NO: 863175 - protein, 1342 aa, Homo sapiens; identical to SEQ ID NO: 863165

SEQ ID NO: 863176 - protein, 1342 aa, Homo sapiens; identical to SEQ ID NO: 863165

SEQ ID NO: 863177 - protein, 1393 aa, Homo sapiens
MEENEVESSSDAAPGPGRPEEPSESGLGVGTSEAVSADSSDAAAAPGQAEADDSGVGQSSDRGSRSQEEVSESSSSADPLPNSYLPDSSSVSHGPVAGVTGGPPALVHSSALPDPNMLVSDCTASSSDLGSAIDKIIESTIGPDLIQNCITVTSAEDGGAETTRYLILQGPDDGAPMTSPMSSSTLAHSLAAIEALADGPTSTSTCLEAQGGPSSPVQLPPASGAEEPDLQSLEAMMEVVVVQQFKCKMCQYRSSTKATLLRHMRERHFRPVAAAAAAAGKKGRLRKWSTSTKSQEEEGPEEEDDDDIVDAGAIDDLEEDSDYNPAEDEPRGRQLRLQRPTPSTPRPRRRPGRPRKLPRLEISDLPDGVEGEPLVSSQSGQSPPEPQDPEAPSSSGPGHLVAMGKVSRTPVEAGVSQSDAENAAPSCPDEHDTLPRRRGRPSRRFLGKKYRKYYYKSPKPLLRPFLCRICGSRFLSHEDLRFHVNSHEAGDPQLFKCLQCSYRSRRWSSLKEHMFNHVGSKPYKCDECSYTSVYRKDVIRHAAVHSRDRKKRPDPTPKLSSFPCPVCGRVYPMQKRLTQHMKTHSTEKPHMCDKCGKSFKKRYTFKMHLLTHIQAVANRRFKCEFCEFVCEDKKALLNHQLSHVSDKPFKCSFCPYRTFREDFLLSHVAVKHTGAKPFACEYCHFSTRHKKNLRLHVRCRHASSFEEWGRRHPEEPPSRRRPFFSLQQIEELKQQHSAAPGPPPSSPGPPEIPPEATTFQSSEAPSLLCSDTLGGATIIYQQGELCRRIGALEGRTSELGRGRSCWWGLEDGEGVVLGASFLALCQAEVPPHPGAEESTAMATQTALDLLLNMSAQRELGGTALQVAVVKSEDVEAGLASPGGQPSPEGATPQVVTLHVAEPGGGAAAESQLGPPDLPQITLAPGPFGGTGYSVITAPPMEEGTSAPGTPYSEEPAGEAAQAVVVSDTLKEAGTHYIMATDGTQLHHIELTADGSISFPSPDALASGAKWPLLQCGGLPRDGPEPPSPAKTHCVGDSQSSASSPPATSKALGLAVPPSPPSAATAASKKFSCKICAEAFPGRAEMESHKRAHAGPGAFKCPDCPFSARQWPEVRAHMAQHSSLRPHQCSQCSFASKNKKDLRRHMLTHTKEKPFACHLCGQRFNRNGHLKFHIQRLHSPDGRKSGTPTARAPTQTPTQTIILNSDDETLATLHTALQSSHGVLGPERLQQALSQEHIIVAQEQTVTNQEEAAYIQEITTADGQTVQHLVTSDNQVQYIISQDGVQHLLPQEYVVVPEGHHIQVQEGQITHIQYEQGAPFLQESQIQYVPVSPGQQLVTQAQLEAAAHSAVTAVADAAMAQAQGLFGTDETVPEHIQQLQHQGIEYDVITLADD

SEQ ID NO: 863178 - protein, 1313 aa, Homo sapiens
MEENEVESSSDAAPGPGRPEEPSESGLGVGTSEAVSADSSDAAAAPGQAEADDSGVGQSSDRGSRSQEEVSESSSSADPLPNSYLPDSSSVSHGPVAGVTGGPPALVHSSALPDPNMLVSDCTASSSDLGSAIDKIIESTIGPDLIQNCITVTSAEDGGAETTRYLILQGPDDGAPMTSPMSSSTLAHSLAAIEALADGPTSTSTCLEAQGGPSSPVQLPPASGAEEPDLQSLEAMMEVVVVQQFKCKMCQYRSSTKATLLRHMRERHFRPVAAAAAAAGKKGRLRKWSTSTKSQEEEGPEEEDDDDIVDAGAIDDLEEDSDYNPAEDEPRGRQLRLQRPTPSTPRPRRRPGRPRKLPRLEISDLPDGVEGEPLVSSQSGQSPPEPQDPEAPSSSGPGHLVAMGKVSRTPVEAGVSQSDAENAAPSCPDEHDTLPRRRGRPSRRFLGKKYRKYYYKSPKPLLRPFLCRICGSRFLSHEDLRFHVNSHEAGDPQLFKCLQCSYRSRRWSSLKEHMFNHVGSKPYKCDECSYTSVYRKDVIRHAAVHSRDRKKRPDPTPKLSSFPCPVCGRVYPMQKRLTQHMKTHSTEKPHMCDKCGKSFKKRYTFKMHLLTHIQAVANRRFKCEFCEFVCEDKKALLNHQLSHVSDKPFKCSFCPYRTFREDFLLSHVAVKHTGAKPFACEYCHFSTRHKKNLRLHVRCRHASSFEEWGRRHPEEPPSRRRPFFSLQQIEELKQQHSAAPGPPPSSPGPPEIPPEATTFQSSEAPSLLCSDTLGGATIIYQQGELCRRIGALEGRTSELGRGRSCWWGLEDGEGVVLGASFLALCQAEVPPHPGAEESTAMATQTALDLLLNMSAQRELGGTALQVAVVKSEDVEAGLASPGGQPSPEGATPQVVTLHVAEPGGGAAAESQLGPPDLPQITLAPGPFGGTGYSVITAPPMEEGTSAPGTPYSEEPAGEAAQAVVVSDTLKEAGTHYIMATDGTQLHHIELTADGSISFPSPDALASGAKWPLLQCGGLPRDGPEPPSPAKTHCVGDSQSSASSPPATSKALGLAVPPSPPSAATAASKKFSCKICAEAFPGRAEMESHKRAHAGPGAFKCPDCPFSARQWPEVRAHMAQHSSLRPHQCSQCSFASKNKKDLRRHMLTHTKEKPFACHLCGQRFNRNGHLKFHIQRLHSPDGRKSGTPTARAPTQTPTQTIILNSDDETLATLHTALQSSHGVLGPERLQQALSQEHIIVAQEQTVTNQEEAAYIQEITTADGQTVQHLVTSDNQVQYIISQDGVQHLLPQEYVVVPEGHHIQVGQTWDEGAVW

SEQ ID NO: 863179 - protein, 172 aa, Homo sapiens
MEENEVESSSDAAPGPGRPEEPSESGLGVGTSEAVSADSSDAAAAPGQAEADDSGVGQSSDRGSRSQEEVSESSSSADPLPNSYLPDSSSVSHGPVAGVTGGPPALVHSSALPDPNMLVSDCTASSSDLGSAIDKIIESTIGPDLIQSESGRGAPQGFSCSVRQPAVPTLAV

SEQ ID NO: 863180 - protein, 120 aa, Homo sapiens
MEENEVESSSDAAPGPGRPEEPSESGLGVGTSEAVSADSSDAAAAPGQAEADDSGVGQSSDRGSRSQVWTRLDGVGGGKDREQQCLTAKRKQGLFVANTWCFWFTVSQAPSQTPKMDFLI

SEQ ID NO: 863181 - protein, 288 aa, Homo sapiens [sequence omitted]

SEQ ID NO: 863182 - protein, 76 aa, Homo sapiens
SSSWGIAGFPGPQVSILSSLPSCTPVQSRGPGPRAATAGTEPGTHHRCPGTDSDQSGKSQDWGPSGQRQAGVGVEK

SEQ ID NO: 863183 - protein, 443 aa, Homo sapiens
MDFPCLWLGLLLPLVAALDFNYHRQEGMEAFLKTVAQNYSSVTHLHSIGKSVKGRNLWVLVVGRFPKEHRIGIPEFKYVANMHGDETVGRELLLHLIDYLVTSDGKDPEITNLINSTRIHIMPSMNPDGFEAVKKPDCYYSIGRENYNQYDLNRNFPDAFEYNNVSRQPETVAVMKWLKTETFVLSANLHGGALVASYPFDNGVQATGALYSRSLTPDDDVFQYLAHTYASRNPNMKKGDECKNKMNFPNGVTNGYSWYPLQGGMQDYNYIWAQCFEITLELSCCKYPREEKLPSFWNNNKASLIEYIKQVHLGVKGQVFDQNGNPLPNVIVEVQDRKHICPYRTNKYGEYYLLLLPGSYIINVTVPGHDPHITKVIIPEKSQNFSALKKDILLPFQGQLDSIPVSNPSCPMIPLYRNLPDHSAATKPSLFLFLVSLLHIFFK

SEQ ID NO: 863184 - protein, 468 aa, Homo sapiens
AFLPSAYGTGPFLEWGSYDLQSNKNMDFPCLWLGLLLPLVAALDFNYHRQEGMEAFLKTVAQNYSSVTHLHSIGKSVKGRNLWVLVVGRFPKEHRIGIPEFKYVANMHGDETVGRELLLHLIDYLVTSDGKDPEITNLINSTRIHIMPSMNPDGFEAVKKPDCYYSIGRENYNQYDLNRNFPDAFEYNNVSRQPETVAVMKWLKTETFVLSANLHGGALVASYPFDNGVQATGALYSRSLTPDDDVFQYLAHTYASRNPNMKKGDECKNKMNFPNGVTNGYSWYPLQGGMQDYNYIWAQCFEITLELSCCKYPREEKLPSFWNNNKASLIEYIKQVHLGVKGQVFDQNGNPLPNVIVEVQDRKHICPYRTNKYGEYYLLLLPGSYIINVTVPGHDPHITKVIIPEKSQNFSALKKDILLPFQGQLDSIPVSNPSCPMIPLYRNLPDHSAATKPSLFLFLVSLLHIFFK

SEQ ID NO: 863185 - protein, 468 aa, Homo sapiens; identical to SEQ ID NO: 863184

SEQ ID NO: 863186 - protein, 443 aa, Homo sapiens; identical to SEQ ID NO: 863183

SEQ ID NO: 863187 - protein, 443 aa, Homo sapiens; identical to SEQ ID NO: 863183

SEQ ID NO: 863188 - protein, 127 aa, Homo sapiens
MDLKPSKSLTVTTASEGKEGLVYLYLKTTQHKGSRQAPVGLGKRRCVMVRALRAGVMSLMCQSSRHIRAASGLQEEMQIRLLCPGAHLASPSSFATPSLSPASSPLGLLPGSTRCFLTSAFYTHRFP

SEQ ID NO: 863189 - protein, 48 aa, Homo sapiens
MTTPEITNLINSTRIHIMPSMNPDGFEAVKKPDCYYSIGRENYNQGGE

SEQ ID NO: 863190 - protein, 443 aa, Homo sapiens; identical to SEQ ID NO: 863183

SEQ ID NO: 863191 - protein, 468 aa, Homo sapiens; identical to SEQ ID NO: 863184

SEQ ID NO: 863192 - protein, 443 aa, Homo sapiens; identical to SEQ ID NO: 863183

SEQ ID NO: 863193 - protein, 315 aa, Homo sapiens
MDFPCLWLGLLLPLVAALDFNYHRQEGMEAFLKTVAQNYSSVTHLHSIGKSVKGRNLWVLVVGRFPKEHRIGIPEFKYVANMHGDETVGRELLLHLIDYLVTSDGKDPEITNLINSTRIHIMPSMNPDGFEAVKKPDCYYSIGRENYNQYDLNRNFPDAFEYNNVSRQPETVAVMKWLKTETFVLSANLHGGALVASYPFDNGVQATGALYSRSLTPDDDVFQYLAHTYASRNPNMKKGDECKNKMNFPNGVTNGYSWYPLQGGMQDYNYIWAQCFEITLELSCCKYPREEKLPSFWNNNKASLIEYIKQVHLGL

SEQ ID NO: 863194 - protein, 865 aa, Homo sapiens
RPHPCRPPRPSRVPEPSGMEPWKQCAQWLIHCKVLPTNHRVTWDSAQVFDLAQTLRDGVLLCQLLNNLRAHSINLKEINLRPQMSQFLCLKNIRTFLTACCETFGMRKSELFEAFDLFDVRDFGKVIETLSRLSRTPIALATGIRPFPTEESINDEDIYKGLPDLIDETLVEDEEDLYDCVYGEDEGGEVYEDLMKAEEAHQPKCPENDIRSCCLAEIKQTEEKYTETLESIEKYFMAPLKRFLTAAEFDSVFINIPELVKLHRNLMQEIHDSIVNKNDQNLYQVFINYKERLVIYGQYCSGVESAISSLDYISKTKEDVKLKLEECSKRANNGKFTLRDLLVVPMQRVLKYHLLLQELVKHTTDPTEKANLKLALDAMKDLAQYVNEVKRDNETLREIKQFQLSIENLNQPVLLFGRPQGDGEIRITTLDKHTKQERHIFLFDLAVIVCKRKGDNYEMKEIIDLQQYKIANNPTTDKENKKWSYGFYLIHTQGQNGLEFYCKTKDLKKKWLEQFEMALSNIRPDYADSNFHDFKMHTFTRVTSCKVCQMLLRGTFYQGYLCFKCGARAHKECLGRVDNCGRVNSGEQGTLKLPEKRTNGLRRTPKQVDPGLPKMQVIRNYSGTPPPALHEGPPLQLQAGDTVELLKGDAHSLFWQGRNLASGEVGFFPSDAVKPCPCVPKPVDYSCQPWYAGAMERLQAETELINRVNSTYLVRHRTKESGEYAISIKYNNEAKHIKILTRDGFFHIAENRKFKSLMELVEYYKHHSLKEGFRTLDTTLQFPYKEPEHSAGQRGNRAGNSLLSPKVLGIAIARYDFCARDMRELSLLKGDVVKIYTKMSANGWWRGEVNGRVGWFPSTYVEEDE

SEQ ID NO: 863195 - protein, 67 aa, Homo sapiens
SGALLKMALHSMRKARERWSFIRALHKGSAAAPALQVTKDGPSLRGFPSREVLLIPLPSIYFSPPAS

SEQ ID NO: 863196 - protein, 366 aa, Homo sapiens
SGALLKMALHSMRKARERWSFIRALHKGSAAAPALQKDSKKRVFSGIQPTGILHLGNYLGAIESWVRLQDEYDSVLYSIVDLHSITVPQDPAVLRQSILDMTAVLLACGINPEKSILFQQSQVSEHTQLSWILSCMVRLPRLQHLHQWKAKTTKQKHDGTVGLLTYPVLQAADILLYKSTHVPVGEDQVQHMELVQDLAQGFNKKYGEFFPVPESILTSMKKVKSLRDPSAKMSKSDPDKLATVRITDSPEEIVQKFRKAVTDFTSEVTYDPAGRAGVSNIVAVHAAVTGLSVEEVVRRSAGMNTARYKLAVADAVIEKFAPIKREIEKLKLDKDHLEKVLQIGSAKAKELAYTVCQEVKKLVGFL

SEQ ID NO: 863197 - protein, 366 aa, Homo sapiens; identical to SEQ ID NO: 863196

SEQ ID NO: 863198 - protein, 261 aa, Homo sapiens
SGALLKMALHSMRKARERWSFIRALHKGSAAAPALQKDSKKRVFSGIQPTGILHLGNYLGAIESWVRLQDEYDSVLYSIVDLHSITVPQDPAVLRQSILDMTAVLLACGINPEKSILFQQSQVSEHTQLSWILSCMVRLPRLQHLHQWKAKTTKQKHDGTVGLLTYPVLQAADILLYKSTHVPVGEDQVQHMELVQDLAQGFNKKYGEFFPVPESILTSMKKVKSLRDPSAKMSKSDPDKLATVRITDSPEEIVQKFRKML

SEQ ID NO: 863199 - protein, 376 aa, Homo sapiens
SGALLKMALHSMRKARERWSFIRALHKGSAAAPALQKDSKKRVFSGIQPTGILHLGNYLGAIESWVRLQDEYDSVLYSIVDLHSITVPQDPAVLRQSILDMTAVLLACGINPEKSILFQQSQVSEHTQLSWILSCMVRLPRLQHLHQWKAKTTKQKHDGTVGLLTYPVLQAADILLYKSTHVPVGEDQVQHMELVQDLAQGFNKKYGEFFPVPESILSMCVLVFLTYASMKKVKSLRDPSAKMSKSDPDKLATVRITDSPEEIVQKFRKAVTDFTSEVTYDPAGRAGVSNIVAVHAAVTGLSVEEVVRRSAGMNTARYKLAVADAVIEKFAPIKREIEKLKLDKDHLEKVLQIGSAKAKELAYTVCQEVKKLVGFL

SEQ ID NO: 863200 - protein, 379 aa, Homo sapiens
RPHPCRPPRPSRVPEPSGMEPWKQCAQWLIHCKVLPTNHRVTWDSAQVFDLAQTLRDGVLLCQLLNNLRAHSINLKEINLRPQMSQFLCLKNIRTFLTACCETFGMRKSELFEAFDLFDVRDFGKVSEHTQLSWILSCMVRLPRLQHLHQWKAKTTKQKHDGTVGLLTYPVLQAADILLYKSTHVPVGEDQVQHMELVQDLAQGFNKKYGEFFPVPESILSMCVLVFFNLASMKKVKSLRDPSAKMSKSDPDKLATVRITDSPEEIVQKFRKAVTDFTSEVTYDPAGRAGVSNIVAVHAAVTGLSVEEVVRRSAGMNTARYKLAVADAVIEKFAPIKREIEKLKLDKDHLEKVLQIGSAKAKELAYTVCQEVKKLVGFL

SEQ ID NO: 863201 - protein, 175 aa, Homo sapiens [sequence omitted]

SEQ ID NO: 863202 - protein, 366 aa, Homo sapiens; identical to SEQ ID NO: 863196

SEQ ID NO: 863203 - protein, 753 aa, Homo sapiens
MQLPDCPCRAHLPVIETLSRLSRTPIALATGIRPFPTEESINDEDIYKGLPDLIDETLVEDEEDLYDCVYGEDEGGEVYEDLMKAEEAHQPKCPENDIRSCCLAEIKQTEEKYTETLESIEKYFMAPLKRFLTAAEFDSVFINIPELVKLHRNLMQEIHDSIVNKNDQNLYQVFINYKERLVIYGQYCSGVESAISSLDYISKTKEDVKLKLEECSKRANNGKFTLRDLLVVPMQRVLKYHLLLQELVKHTTDPTEKANLKLALDAMKDLAQYVNEVKRDNETLREIKQFQLSIENLNQPVLLFGRPQGDGEIRITTLDKHTKQERHIFLFDLAVIVCKRKGDNYEMKEIIDLQQYKIANNPTTDKENKKWSYGFYLIHTQGQNGLEFYCKTKDLKKKWLEQFEMALSNIRPDYADSNFHDFKMHTFTRVTSCKVCQMLLRGTFYQGYLCFKCGARAHKECLGRVDNCGRVNSGEQGTLKLPEKRTNGLRRTPKQVDPGLPKMQVIRNYSGTPPPALHEGPPLQLQAGDTVELLKGDAHSLFWQGRNLASGEVGFFPSDAVKPCPCVPKPVDYSCQPWYAGAMERLQAETELINRVNSTYLVRHRTKESGEYAISIKYNNEAKHIKILTRDGFFHIAENRKFKSLMELVEYYKHHSLKEGFRTLDTTLQFPYKEPEHSAGQRGNRAGNSLLSPKVLGIAIARYDFCARDMRELSLLKGDVVKIYTKMSANGWWRGEVNGRVGWFPSTYVEEDE

SEQ ID NO: 863204 - protein, 312 aa, Homo sapiens
TKQWCFTTLQRKLRLLTKQNNFTLTMPIFTFLSEQGTLKLPEKRTNGLRRTPKQVDPGLPKMQVIRNYSGTPPPALHEGPPLQLQAGDTVELLKGDAHSLFWQGRNLASGEVGFFPSDAVKPCPCVPKPVDYSCQPWYAGAMERLQAETELINRVNSTYLVRHRTKESGEYAISIKYNNEAKHIKILTRDGFFHIAENRKFKSLMELVEYYKHHSLKEGFRTLDTTLQFPYKEPEHSAGQRGNRAGNSLLSPKVLGIAIARYDFCARDMRELSLLKGDVVKIYTKMSANGWWRGEVNGRVGWFPSTYVEEDE

SEQ ID NO: 863205 - protein, 331 aa, Homo sapiens
MKDSKKRVFSGIQPTGILHLGNYLGAIESWVRLQDEYDSVLYSIVDLHSITVPQDPAVLRQSILDMTAVLLACGINPEKSILFQQSQVSEHTQLSWILSCMVRLPRLQHLHQWKAKTTKQKHDGTVGLLTYPVLQAADILLYKSTHVPVGEDQVQHMELVQDLAQGFNKKYGEFFPVPESILTSMKKVKSLRDPSAKMSKSDPDKLATVRITDSPEEIVQKFRKAVTDFTSEVTYDPAGRAGVSNIVAVHAAVTGLSVEEVVRRSAGMNTARYKLAVADAVIEKFAPIKREIEKLKLDKDHLEKVLQIGSAKAKELAYTVCQEVKKLVGFL

SEQ ID NO: 863206 - protein, 319 aa, Homo sapiens
SGALLKMALHSMRKARERWSFIRALHKGSAAAPALQKDSKKRVFSGIQPTGILHLGNYLGAIESWVSEHTQLSWILSCMVRLPRLQHLHQWKAKTTKQKHDGTVGLLTYPVLQAADILLYKSTHVPVGEDQVQHMELVQDLAQGFNKKYGEFFPVPESILSMCVLVFFNLASMKKVKSLRDPSAKMSKSDPDKLATVRITDSPEEIVQKFRKAVTDFTSEVTYDPAGRAGVSNIVAVHAAVTGLSVEEVVRRSAGMNTARYKLAVADAVIEKFAPIKREIEKLKLDKDHLEKVLQIGSAKAKELAYTVCQEVKKLVGFL

SEQ ID NO: 863207 - protein, 753 aa, Homo sapiens; identical to SEQ ID NO: 863203

SEQ ID NO: 863208 - protein, 220 aa, Homo sapiens
GPRKPAKARPPSRGRTMVDQLRERTTMADPLRERTELLLADYLGYCAREPGTPEPAPSTPEAAVLRSAAARLRQIHRSFFSAYLGYPGNRFELVALMADSVLSDSPGPTWGRVVTLVTFAGTLLERGPLVTARWKKWGFQPRLKEQEGDVARDCQRLVALLSSRLMGQHRAWLQAQGGWDGFCHFFRTPFPLAFWRKQLVQAFLSCLLTTAFIYLWTRLL

SEQ ID NO: 863209 - protein, 299 aa, Homo sapiens
MVDKKLVVVFGGTGAQGGSVARTLLEDGTFKVRVVTRNPRKKAAKELRLQGAEVVQGDQDDQVIMELALNGAYATFIVTNYWESCSQEQEVKQGKLLADLARRLGLHYVVYSGLENIKKLTAGRLAAAHFDGKGEVEEYFRDIGVPMTSVRLPCYFENLLSHFLPQKAPDGKSYLLSLPTGDVPMDGMSVSDLGPVVLSLLKMPEKYVGQNIGLSTCRHTAEEYAALLTKHTRKVVHDAKMTPEDYEKLGFPGARDLANMFRFYALRPDRDIELTLRLNPKALTLDQWLEQHKGDFNLL

SEQ ID NO: 863210 - protein, 210 aa, Homo sapiens
RTRGSTHASADALGRGRVGQNIKKLTAGRLAAAHFDGKGEVEEYFRDIGVPMTSVRLPCYFENLLSHFLPQKAPDGKSYLLSLPTGDVPMDGMSVSDLGPVVLSLLKMPEKYVGQNIGLSTCRHTAEEYAALLTKHTRKVVHDAKVGLPPQMTPEDYEKLGFPGARDLANMFRFYALRPDRDIELTLRLNPKALTLDQWLEQHKGDFNLL

SEQ ID NO: 863211 - protein, 348 aa, Homo sapiens
VSWYGRKHFDGVSADTSGLAAAARGPPTLGFRERRSARSLDRIRPILVLMVDKKLVVVFGGTGAQGGSVARTLLEDGTFKVRVVTRNPRKKAAKELRLQGAEVVQGDQDDQVIMELALNGAYATFIVTNYWESCSQEQEVKQGKLLADLARRLGLHYVVYSGLENIKKLTAGRLAAAHFDGKGEVEEYFRDIGVPMTSVRLPCYFENLLSHFLPQKAPDGKSYLLSLPTGDVPMDGMSVSDLGPVVLSLLKMPEKYVGQNIGLSTCRHTAEEYAALLTKHTRKVVHDAKMTPEDYEKLGFPGARDLANMFRFYALRPDRDIELTLRLNPKALTLDQWLEQHKGDFNLL

SEQ ID NO: 863212 - protein, 235 aa, Homo sapiens
MELALNGAYATFIVTNYWESCSQEQEVKQGKLLADLARRLGLHYVVYSGLENIKKLTAGRLAAAHFDGKGEVEEYFRDIGVPMTSVRLPCYFENLLSHFLPQKAPDGKSYLLSLPTGDVPMDGMSVSDLGPVVLSLLKMPEKYVGQNIGLSTCRHTAEEYAALLTKHTRKVVHDAKMTPEDYEKLGFPGARDLANMFRFYALRPDRDIELTLRLNPKALTLDQWLEQHKGDFNLL

SEQ ID NO: 863213 - protein, 330 aa, Homo sapiens
MVDKKLVVVFGGTEIWFHHVAQAGLKLLSSRDLRASASQSVWITGAQGGSVARTLLEDGTFKVRVVTRNPRKKAAKELRLQGAEVVQGDQDDQVIMELALNGAYATFIVTNYWESCSQEQEVKQGKLLADLARRLGLHYVVYSGLENIKKLTAGRLAAAHFDGKGEVEEYFRDIGVPMTSVRLPCYFENLLSHFLPQKAPDGKSYLLSLPTGDVPMDGMSVSDLGPVVLSLLKMPEKYVGQNIGLSTCRHTAEEYAALLTKHTRKVVHDAKMTPEDYEKLGFPGARDLANMFRFYALRPDRDIELTLRLNPKALTLDQWLEQHKGDFNLL

SEQ ID NO: 863214 - protein, 344 aa, Homo sapiens
MVDKKLVVVFGGTEIWFHHVAQAGLKLLSSRDLRASASQSVWITGMSPWAQLQRAKSKGAQGGSVARTLLEDGTFKVRVVTRNPRKKAAKELRLQGAEVVQGDQDDQVIMELALNGAYATFIVTNYWESCSQEQEVKQGKLLADLARRLGLHYVVYSGLENIKKLTAGRLAAAHFDGKGEVEEYFRDIGVPMTSVRLPCYFENLLSHFLPQKAPDGKSYLLSLPTGDVPMDGMSVSDLGPVVLSLLKMPEKYVGQNIGLSTCRHTAEEYAALLTKHTRKVVHDAKMTPEDYEKLGFPGARDLANMFRFYALRPDRDIELTLRLNPKALTLDQWLEQHKGDFNLL

SEQ ID NO: 863215 - protein, 327 aa, Homo sapiens
MVDKKLVVVFGGTGAQGGSVARTLLEDGTFKVRVVTRNPRKKAAKELRLQGAEVVQGDQDDQVIMELALNGAYATFIVTNYWESCSQEQEVKQGKLLADLARRLGLHYVVYSGLENIKKLTAGRLAAAHFDGKGEVEEYFRDIGVPMTSVRLPCYFENLLSHFLPQKAPDGKSYLLSLPTGDVPMDGMSVSDLGPVVLSLLKMPEKYVGQNIGLSTCRHTAEEYAALLTKHTRKVVHDAKMTPEDYEKLGFPGARDLANMFRFYALRPDRDIELTLRLNPAEEYAALLTKHTRKVAHDAKMTPEDYEKLGFPGARDLANMFRFYALR

SEQ ID NO: 863216 - protein, 251 aa, Homo sapiens
MVDKKLVVVFGGTGAQGGSVARTLLEDGTFKVRVVTRNPRKKAAKELRLQGAEVVQGDQDDQVIMELALNGAYATFIVTNYWESCSQEQEVKQGKLLADLARRLGLHYVVYSGLENIKKLTAGRLAAAHFDGKGEVEEYFRDIGVPMTSVRLPCYFENLLSHFLPQKAPDGKSYLLSLPTGDVPMDGMSVSDLGPVVLSLLKMPEKYVGQNIGLSTCRHTAEEYAALLTKHTRKVVHDAKELTGHRVKFLA

SEQ ID NO: 863217 - protein, 274 aa, Homo sapiens [sequence omitted]

SEQ ID NO: 863218 - protein, 78 aa, Homo sapiens
RYRQRTPRPCARKVVHDAKMTPEDYEKLGFPGARDLANMFRFYALRPDRDIELTLRLNPKALTLDQWLEQHKGDFNLL

SEQ ID NO: 863219 - protein, 151 aa, Homo sapiens
SAGITGMSHSIWPRTIFKLIYNVRQLRRAAVSELSALQKFSNDLVRRTWVRDRDNSGSGCSRSGDPSPSGLPAPPPPGALEDAGHDRLLCFQMTPEDYEKLGFPGARDLANMFRFYALRPDRDIELTLRLNPKALTLDQWLEQHKGDFNLL

SEQ ID NO: 863220 - protein, 299 aa, Homo sapiens; identical to SEQ ID NO: 863209

SEQ ID NO: 863221 - protein, 335 aa, Homo sapiens
MGVSFVAPGGNPGPTPNSTPPITPRSLDRIRPILVLMVDKKLVVVFGGTGAQGGSVARTLLEDGTFKVRVVTRNPRKKAAKELRLQGAEVVQGDQDDQVIMELALNGAYATFIVTNYWESCSQEQEVKQGKLLADLARRLGLHYVVYSGLENIKKLTAGRLAAAHFDGKGEVEEYFRDIGVPMTSVRLPCYFENLLSHFLPQKAPDGKSYLLSLPTGDVPMDGMSVSDLGPVVLSLLKMPEKYVGQNIGLSTCRHTAEEYAALLTKHTRKVVHDAKMTPEDYEKLGFPGARDLANMFRFYALRPDRDIELTLRLNPKALTLDQWLEQHKGDFNLL

SEQ ID NO: 863222 - protein, 235 aa, Homo sapiens; identical to SEQ ID NO: 863212

SEQ ID NO: 863223 - protein, 236 aa, Homo sapiens
MRIVVEKVSWMLLAVVEHSLRGFALQWDFQGKLLADLARRLGLHYVVYSGLENIKKLTAGRLAAAHFDGKGEVEEYFRDIGVPMTSVRLPCYFENLLSHFLPQKAPDGKSYLLSLPTGDVPMDGMSVSDLGPVVLSLLKMPEKYVGQNIGLSTCRHTAEEYAALLTKHTRKVVHDAKMTPEDYEKLGFPGARDLANMFRFYALRPDRDIELTLRLNPKALTLDQWLEQHKGDFNLL

SEQ ID NO: 863224 - protein, 274 aa, Homo sapiens [sequence omitted]

SEQ ID NO: 863225 - protein, 115 aa, Homo sapiens [sequence omitted]

SEQ ID NO: 863226 - protein, 108 aa, Homo sapiens
MILQRLFRFSSVIRSAVSVHLRRNIGVTAVAFNKELDPIQKLFVDKIREYKSKRQTSGGPVDASSEYQQELERELFKLKQMFGNADMNTFPTFKFEDPKFEVIEKPQA

SEQ ID NO: 863227 - protein, 245 aa, Homo sapiens
MGVTAPGTSGNKTQRRPRGGPCGGKGPGTRPAREGPRSPPPRRPHSPTPESALSPPPALQSRLRTAAARAPRAASLRVRPAAPATRSVRSQGPSRGIGAEKPQPPSRLPGTFGSRTTTPGRVRKTTAQGNGGSRGISMILQRLFRFSSVIRSAVSVHLRRNIGVTAVAFNKELDPIQKLFVDKIREYKSKRQTSGGPVDASSEYQQELERELFKLKQMFGNADMNTFPTFKFEDPKFEVIEKPQA

SEQ ID NO: 863228 - protein, 108 aa, Homo sapiens; identical to SEQ ID NO: 863226

SEQ ID NO: 863229 - protein, 116 aa, Homo sapiens
MHCDGGISMILQRLFRFSSVIRSAVSVHLRRNIGVTAVAFNKELDPIQKLFVDKIREYKSKRQTSGGPVDASSEYQQELERELFKLKQMFGNADMNTFPTFKFEDPKFEVIEKPQA

SEQ ID NO: 863230 - protein, 245 aa, Homo sapiens; identical to SEQ ID NO: 863227

SEQ ID NO: 863231 - protein, 116 aa, Homo sapiens; identical to SEQ ID NO: 863229

SEQ ID NO: 863232 - protein, 108 aa, Homo sapiens; identical to SEQ ID NO: 863226

SEQ ID NO: 863233 - protein, 108 aa, Homo sapiens; identical to SEQ ID NO: 863226

SEQ ID NO: 863234 - protein, 108 aa, Homo sapiens; identical to SEQ ID NO: 863226

SEQ ID NO: 863235 - protein, 119 aa, Homo sapiens
MILQRLFRFSSVIRSAVSVHLRRNIGVTAVAFNKELDPIQKLFVDKIREYKSKRQTSGGPVDASSEYQQELERELFKLKQMFGNADMNTFPTFKFEEHFSQHLRSWQPSRDDDILILSS

SEQ ID NO: 863236 - protein, 108 aa, Homo sapiens; identical to SEQ ID NO: 863226

SEQ ID NO: 863237 - protein, 108 aa, Homo sapiens; identical to SEQ ID NO: 863226

SEQ ID NO: 863238 - protein, 109 aa, Homo sapiens [sequence omitted]

SEQ ID NO: 863239 - protein, 109 aa, Homo sapiens [sequence omitted]

SEQ ID NO: 863240 - protein, 172 aa, Homo sapiens
MGVTAPGTSGNKTQRRPRGGPCGGKGPGTRPAREGPRSPPPRRPHSPTPESALSPPPALQSRLRTAAARAPRAASLRVRPAAPATRSVRSQGPSRGIGAEKPQPPSRLPGTFGSRTTTPGRVRKTTAQGNGGSRGTRKHNAPIRFVLHSLTFPAPLYTSITLTNRTLTRRGA

SEQ ID NO: 863241 - protein, 116 aa, Homo sapiens; identical to SEQ ID NO: 863229

SEQ ID NO: 863242 - protein, 108 aa, Homo sapiens; identical to SEQ ID NO: 863226

SEQ ID NO: 863243 - protein, 108 aa, Homo sapiens; identical to SEQ ID NO: 863226

SEQ ID NO: 863244 - protein, 108 aa, Homo sapiens; identical to SEQ ID NO: 863226

SEQ ID NO: 863245 - protein, 108 aa, Homo sapiens; identical to SEQ ID NO: 863226

SEQ ID NO: 863246 - protein, 122 aa, Homo sapiens
MILQRLFRFSSVIRSAVSVHLRRNIGVTAVAFNKELDPIQKLFVDKIREYKSKRQTSGGPVDASSEYQQELERELFKLKQMFGNADMNTFPTFKFEDPKFEVIDYPHQSNLQNTPHTPAQAP

SEQ ID NO: 863247 - protein, 125 aa, Homo sapiens
DLVCGTLKGLFCLRGEVLAPSAPDSFPDMSGIGESSIGDIIFSSTRACRRRCVRAIQKLFVDKIREYKSKRQTSGGPVDASSEYQQELERELFKLKQMFGNADMNTFPTFKFEDPKFEVIEKPQA

SEQ ID NO: 863248 - protein, 109 aa, Homo sapiens [sequence omitted]

SEQ ID NO: 863249 - protein, 119 aa, Homo sapiens; identical to SEQ ID NO: 863235

SEQ ID NO: 863250 - protein, 172 aa, Homo sapiens; identical to SEQ ID NO: 863240

SEQ ID NO: 863251 - protein, 172 aa, Homo sapiens; identical to SEQ ID NO: 863240

SEQ ID NO: 863252 - protein, 205 aa, Homo sapiens
MGVTAPGTSGNKTQRRPRGGPCGGKGPGTRPAREGPRSPPPRRPHSPTPESALSPPPALQSRLRTAAARAPRAASLRVRPAAPATRSVRSQGPSRGIGAEKPQPPSRLPGTFGSRTTTPGRVRGSSGSPLSFGQPSQSICGGTLVLQQWHLIRNLILYRNSLWTRLENTNLSDRHLEDLLMLVQSISKSWRGSFLSSSKCLVMQT

SEQ ID NO: 863253 - protein, 1043 aa, Homo sapiens
MPLLEGSVGVEDLVLLEPLVEESLLKNLQLRYENKEIYTYIGNVVISVNPYQQLPIYGPEFIAKYQDYTFYELKPHIYALANVAYQSLRDRDRDQCILITGESGSGKTEASKLVMSYVAAVCGKGEQVNSVKEQLLQSNPVLEAFGNAKTIRNNNSSRFGKYMDIEFDFKGSPLGGVITNYLLEKSRLVKQLKGERNFHIFYQLLAGADEQLLKALKLERDTTGYAYLNHEVSRVDGMDDASSFRAVQSAMAVIGFSEEEIRQVLEVTSMVLKLGNVLVADEFQASGIPASGIRDGRGVREIGEMVGLNSEEVERALCSRTMETAKEKVVTALNVMQAQYARDALAKNIYSRLFDWIVNRINESIKVGIGEKKKVMGVLDIYGFEILEDNSFEQFVINYCNEKLQQVFIEMTLKEEQEEYKREGIPWTKVDYFDNGIICKLIEHNQRGILAMLDEECLRPGVVSDSTFLAKLNQLFSKHGHYESKVTQNAQRQYDHTMGLSCFRICHYAGKVTYNVTSFIDKNNDLLFRDLLQAMWKAQHPLLRSLFPEGNPKQASLKRPPTAGAQFKSSVAILMKNLYSKSPNYIRCIKPNEHQQRGQFSSDLVATQARYLGLLENVRVRRAGYAHRQGYGPFLERYRLLSRSTWPHWNGGDREGVEKVLGELSMSSGELAFGKTKIFIRSPKTLFYLEEQRRLRLQQLATLIQKIYRGWRCRTHYQLMRKSQILISSWFRGNMQKKCYGKIKASVLLIQAFVRGWKARKNYRKYFRSEAALTLADFIYKSMVQKFLLGLKNNLPSTNVLDKTWPAAPYKCLSTANQELQQLFYQWKCKRFRDQLSPKQVEILREKLCASELFKGKKASYPQSVPIPFCGDYIGLQGNPKLQKLKGGEEGPVLMAEAVKKVNRGNGKTSSRILLLTKGHVILTDTKKSQAKIVIGLDNVAGVSVTSLKDGLFSLHLSEMSSVGSKGDFLLVSEHVIELLTKMYRAVLDATQRQLTVTVTEKFSVRFKENSVAVKVVQGPAGGDNSKLRYKKKGSHCLEVTVQ

SEQ ID NO: 863254 - protein, 1020 aa, Homo sapiens
MPLLEGSVGVEDLVLLEPLVEESLLKNLQLRYENKEIYTYIGNVVISVNPYQQLPIYGPEFIAKYQDYTFYELKPHIYALANVAYQSLRDRDRDQCILITGESGSGKTEASKLVMSYVAAVCGKGEQVNSVKEQLLQSNPVLEAFGNAKTIRNNNSSRFGKYMDIEFDFKGSPLGGVITNYLLEKSRLVKQLKGERNFHIFYQLLAGADEQLLKALKLERDTTGYAYLNHEVSRVDGMDDASSFRAVQSAMAVIGFSEEEIRQVLEVTSMVLKLGNVLVADEFQASGIPASGIRDGRGVREIGEMVGLNSEEVERALCSRTMETAKEKVVTALNVMQAQYARDALAKNIYSRLFDWIVNRINESIKVGIGEKKKVMGVLDIYGFEILEDNSFEQFVINYCNEKLQQVFIEMTLKEEQEEYKREGIPWTKVDYFDNGIICKLIEHNQRGILAMLDEECLRPGVVSDSTFLAKLNQLFSKHGHYESKVTQNAQRQYDHTMGLSCFRICHYAGKVTYNVTSFIDKNNDLLFRDLLQAMWKAQHPLLRSLFPEGNPKQASLKRPPTAGAQFKSSVAILMKNLYSKSPNYIRCIKPNEHQQRGQFSSDLVATQARYLGLLENVRVRRAGYAHRQGYGPFLERYRLLSRSTWPHWNGGDREGVEKVLGELSMSSGELAFGKTKIFIRSPKTLFYLEEQRRLRLQQLATLIQKIYRGWRCRTHYQLMRKSQILISSWFRGNMARKNYRKYFRSEAALTLADFIYKSMVQKFLLGLKNNLPSTNVLDKTWPAAPYKCLSTANQELQQLFYQWKCKRFRDQLSPKQVEILREKLCASELFKGKKASYPQSVPIPFCGDYIGLQGNPKLQKLKGGEEGPVLMAEAVKKVNRGNGKTSSRILLLTKGHVILTDTKKSQAKIVIGLDNVAGVSVTSLKDGLFSLHLSEMSSVGSKGDFLLVSEHVIELLTKMYRAVLDATQRQLTVTVTEKFSVRFKENSVAVKVVQGPAGGDNSKLRYKKKGSHCLEVTVQ

SEQ ID NO: 863255 - protein, 1043 aa, Homo sapiens; identical to SEQ ID NO: 863253

SEQ ID NO: 863256 - protein, 841 aa, Homo sapiens
MPLLEGSVGVEDLVLLEPLVEESLLKNLQLRYENKEIYTYIGNVVISVNPYQQLPIYGPEFIAKYQDYTFYELKPHIYALANVAYQSLRDRDRDQCILITGESGSGKTEASKLVMSYVAAVCGKGEQVNSVKEQLLQSNPVLEAFGNAKTIRNNNSSRFGKYMDIEFDFKGSPLGGVITNYLLEKSRLVKQLKGERNFHIFYQLLAGADEQLLKALKLERDTTGYAYLNHEVSRVDGMDDASSFRAVQSAMAVIGFSEEEIRQVLEVTSMVLKLGNVLVADEFQASGIPASGIRDGRGVREIGEMVGLNSEEVERALCSRTMETAKEKVVTALNVMQAQYARDALAKNIYSRLFDWIVNRINESIKVGIGEKKKVMGVLDIYGFEILEDNSFEQFVINYCNEKLQQVFIEMTLKEEQEEYKREGIPWTKVDYFDNGIICKLIEHNQRGILAMLDEECLRPGVVSDSTFLAKLNQLFSKHGHYESKVTQNAQRQYDHTMGLSCFRICHYAGKVTYNVTSFIDKNNDLLFRDLLQAMWKAQHPLLRSLFPEGNPKQASLKRPPTAGAQFKSSVAILMKNLYSKSPNYIRCIKPNEHQQRGQFSSDLVATQARYLGLLENVRVRRAGYAHRQGYGPFLERYRLLSRSTWPHWNGGDREGVEKVLGELSMSSGELAFGKTKIFIRSPKTLFYLEEQRRLRLQQLATLIQKIYRGWRCRTHYQLMRKSQILISSWFRGNMARKNYRKYFRSEAALTLADFIYKSMVQKFLLGLKNNLPSTNVLDKTWPAAPYKCLSTANQELQQLFYQWKCKRFRDQLSPKQVEILREKLCASELFKGKKASYPQR

SEQ ID NO: 863257 - protein, 137 aa, Homo sapiens
SPAAAQTSFISKTLSTKTPSAAQNPMMTNASATQATLTAQKFTTAKVAFTQSPSAARKSTNVHSPVTNGLKSTQRFPSAHITATRSTPVSRTTKHFHETTPNKGSGTTSGTTRLLSGHTCFTLTGLLGTLVTMGLLT

SEQ ID NO: 863258 - protein, 381 aa, Homo sapiens
MTVARPSVPAALPLLGELPRLLLLVLLCLPAVWGDCGLPPDVPNAQPALEGRTSFPEDTVITYKCEESFVKIPGEKDSVICLKGSQWSDIEEFCNRSCEVPTRLNSASLKQPYITQNYFPVGTVVEYECRPGYRREPSLSPKLTCLQNLKWSTAVEFCKKKSCPNPGEIRNGQIDVPGGILFGATISFSCNTGYKLFGSTSSFCLISGSSVQWSDPLPECREIYCPAPPQIDNGIIQGERDHYGYRQSVTYACNKGFTMIGEHSIYCTVNNDEGEWSGPPPECRGKSLTSKVPPTVQKPTTVNVPTTEVSPTSQKTTTKTTTPNAQATRSTPVSRTTKHFHETTPNKGSGTTSGTTRLLSGHTCFTLTGLLGTLVTMGLLT

SEQ ID NO: 863259 - protein, 381 aa, Homo sapiens; identical to SEQ ID NO: 863258

SEQ ID NO: 863260 - protein, 381 aa, Homo sapiens; identical to SEQ ID NO: 863258

SEQ ID NO: 863261 - protein, 400 aa, Homo sapiens
MTVARPSVPAALPLLGELPRLLLLVLLCLPAVWGDCGLPPDVPNAQPALEGRTSFPEDTVITYKCEESFVKIPGEKDSVICLKGSQWSDIEEFCNRSCEVPTRLNSASLKQPYITQNYFPVGTVVEYECRPGYRREPSLSPKLTCLQNLKWSTAVEFCKKKSCPNPGEIRNGQIDVPGGILFGATISFSCNTGYKLFGSTSSFCLISGSSVQWSDPLPECREIYCPAPPQIDNGIIQGERDHYGYRQSVTYACNKGFTMIGEHSIYCTVNNDEGEWSGPPPECRGKSLTSKVPPTVQKPTTVNVPTTEVSPTSQKTTTKTTTPNAQATRSTPVSRTTKHFHETTPNKGSGTTSGQLTLFRAHVFHVDRFAWDASNHGLADLAKEELRRKYTQVYRLFLVS

SEQ ID NO: 863262 - protein, 399 aa, Homo sapiens
MTVARPSVPAALPLLGELPRLLLLVLLCLPAVWESSRVEHTMLQTCMSSLSGDCGLPPDVPNAQPALEGRTSFPEDTVITYKCEESFVKIPGEKDSVICLKGSQWSDIEEFCNRSCEVPTRLNSASLKQPYITQNYFPVGTVVEYECRPGYRREPSLSPKLTCLQNLKWSTAVEFCKKKSCPNPGEIRNGQIDVPGGILFGATISFSCNTGYKLFGSTSSFCLISGSSVQWSDPLPECREIYCPAPPQIDNGIIQGERDHYGYRQSVTYACNKGFTMIGEHSIYCTVNNDEGEWSGPPPECRGKSLTSKVPPTVQKPTTVNVPTTEVSPTSQKTTTKTTTPNAQATRSTPVSRTTKHFHETTPNKGSGTTSGTTRLLSGHTCFTLTGLLGTLVTMGLLT

SEQ ID NO: 863263 - protein, 381 aa, Homo sapiens; identical to SEQ ID NO: 863258

SEQ ID NO: 863264 - protein, 381 aa, Homo sapiens; identical to SEQ ID NO: 863258

SEQ ID NO: 863265 - protein, 363 aa, Homo sapiens
MTVARPSVPAALPLLGELPRLLLLVLLCLPAVWGDCGLPPDVPNAQPALEGRTSFPEDTVITYKCEESFVKIPGEKDSVICLKGSQWSDIEEFCNRSCEVPTRLNSASLKQPYITQNYFPVGTVVEYECRPGYRREPSLSPKLTCLQNLKWSTAVEFCKSGILFGATISFSCNTGYKLFGSTSSFCLISGSSVQWSDPLPECREIYCPAPPQIDNGIIQGERDHYGYRQSVTYACNKGFTMIGEHSIYCTVNNDEGEWSGPPPECRGKSLTSKVPPTVQKPTTVNVPTTEVSPTSQKTTTKTTTPNAQATRSTPVSRTTKHFHETTPNKGSGTTSGTTRLLSGHTCFTLTGLLGTLVTMGLLT

SEQ ID NO: 863266 - protein, 394 aa, Homo sapiens
MTVARPSVPAALPLLGELPRLLLLVLLCLPAVWGDCGLPPDVPNAQPALEGRTSFPEDTVITYKCEESFVKIPGEKDSVICLKGSQWSDIEEFCNRSCEVPTRLNSASLKQPYITQNYFPVGTVVEYECRPGYRREPSLSPKLTCLQNLKWSTAVEFCKKKSCPNPGEIRNGQIDVPGGILFGATISFSCNTGYKLFGSTSSFCLISGSSVQWSDPLPECREIYCPAPPQIDNGIIQGERDHYGYRQSVTYACNKGFTMIGEHSIYCTVNNDEGEWSGPPPECRGKSLTSKVPPTVQKPTTVNVPTTEVSPTSQKTTTKTTTPNAQATRSTPVSRTTKHFHETTPNKGSGTTSGQLTLFRFTEYGSNVLWWKYELDQDCRIKWSLIYCSQGFSY

SEQ ID NO: 863267 - protein, 137 aa, Homo sapiens; identical to SEQ ID NO: 863257

SEQ ID NO: 863268 - protein, 233 aa, Homo sapiens
MTVARPSVPAALPLLGELPRLLLLVLLCLPAVWGDCGLPPDVPNAQPALEGRTSFPEDTVITYKCEESFVKIPGEKDSVICLKGSQWSDIEEFCNRSCEVPTRLNSASLKQPYITQNYFPVGTVVEYECRPGYRREPSLSPKLTCLQNLKWSTAVEFCKKKSCPNPGEIRNGQIDVPGGILFGATISFSCNTGYKLFGSTSSFCLISGSSVQWSDPLPECRGPRQEYKWRSLA

SEQ ID NO: 863269 - protein, 444 aa, Homo sapiens
MTVARPSVPAALPLLGELPRLLLLVLLCLPAVWGDCGLPPDVPNAQPALEGRTSFPEDTVITYKCEESFVKIPGEKDSVICLKGSQWSDIEEFCNRSCEVPTRLNSASLKQPYITQNYFPVGTVVEYECRPGYRREPSLSPKLTCLQNLKWSTAVEFCKKKSCPNPGEIRNGQIDVPGGILFGATISFSCNTGYKLFGSTSSFCLISGSSVQWSDPLPECREIYCPAPPQIDNGIIQGERDHYGYRQSVTYACNKGFTMIGEHSIYCTVNNDEGEWSGPPPECRGKSLTSKVPPTVQKPTTVNVPTTEVSPTSQKTTTKTTTPNAQATRSTPVSRTTKHFHETTPNKGSGTTSGTTRLLSGSRPVTQAGMRWCDRSSLQSRTPGFKRSFHFSLPSSWYYRCVPRHPAKFLKFIFCRDRIFLCCPGWFQTPGRKRFFRPPKTLRL

SEQ ID NO: 863270 - protein, 381 aa, Homo sapiens; identical to SEQ ID NO: 863258

SEQ ID NO: 863271 - protein, 440 aa, Homo sapiens
MTVARPSVPAALPLLGELPRLLLLVLLCLPAVWGDCGLPPDVPNAQPALEGRTSFPEDTVITYKCEESFVKIPGEKDSVICLKGSQWSDIEEFCNRSCEVPTRLNSASLKQPYITQNYFPVGTVVEYECRPGYRREPSLSPKLTCLQNLKWSTAVEFCKKKSCPNPGEIRNGQIDVPGGILFGATISFSCNTGYKLFGSTSSFCLISGSSVQWSDPLPECREIYCPAPPQIDNGIIQGERDHYGYRQSVTYACNKGFTMIGEHSIYCTVNNDEGEWSGPPPECRGKSLTSKVPPTVQKPTTVNVPTTEVSPTSQKTTTKTTTPNAQATRSTPVSRTTKHFHETTPNKGSGTTSGTTRLLSGSRPVTQAGMRWCDRSSLQSRTPGFKRSFHFSLPSSWYYRAHVFHVDRFAWDASNHGLADLAKEELRRKYTQVYRLFLVS

SEQ ID NO: 863272 - protein, 377 aa, Homo sapiens
MTVARPSVPAALPLLGELPRLLLLVLLCLPAVWGDCGLPPDVPNAQPALEGRTSFPEDTVITYKCEESFVKIPGEKDSVICLKGSQWSDIEEFCNRSCEVPTRLNSASLKQPYITQNYFPVGTVVEYECRPGYRREPSLSPKLTCLQNLKWSTAVEFCKKKSCPNPGEIRNGQIDVPGGILFGATISFSCNTGYKLFGSTSSFCLISGSSVQWSDPLPECREIYCPAPPQIDNGIIQGERDHYGYRQSVTYACNKGFTMIGEHSIYCTVNNDEGEWSGPPPECRGKSLTSKVPPTVQKPTTVNVPTTEVSPTSQKTTTKTTTPNAQATRSTPVSRTTKHFHETTPNKGSGTTSGTTRLLSGFSPWKRRRPEASSQTS

SEQ ID NO: 863273 - protein, 410 aa, Homo sapiens
MGGQTADRSPLSTESSRVEHTMLQTCMSSLSGVAFQGGLCLENSNCEDTLIVISFSSAFVSLGDCGLPPDVPNAQPALEGRTSFPEDTVITYKCEESFVKIPGEKDSVICLKGSQWSDIEEFCNRSCEVPTRLNSASLKQPYITQNYFPVGTVVEYECRPGYRREPSLSPKLTCLQNLKWSTAVEFCKKKSCPNPGEIRNGQIDVPGGILFGATISFSCNTGYKLFGSTSSFCLISGSSVQWSDPLPECREIYCPAPPQIDNGIIQGERDHYGYRQSVTYACNKGFTMIGEHSIYCTVNNDEGEWSGPPPECRGKSLTSKVPPTVQKPTTVNVPTTEVSPTSQKTTTKTTTPNAQATRSTPVSRTTKHFHETTPNKGSGTTSGTTRLLSGHTCFTLTGLLGTLVTMGLLT

SEQ ID NO: 863274 - protein, 318 aa, Homo sapiens
MTVARPSVPAALPLLGELPRLLLLVLLCLPAVWGDCGLPPDVPNAQPALEGRTSFPEDTVITYKCEESFVKIPGEKDSVICLKGSQWSDIEEFCNRSCEVPTRLNSASLKQPYITQNYFPVGTVVEYECRPGYRREPSLSPKLTCLQNLKWSTAVEFCKKKSCPNPGEIRNGQIDVPGGILFGATISFSCNTGYKLFGSTSSFCLISGSSVQWSDPLPECRGKSLTSKVPPTVQKPTTVNVPTTEVSPTSQKTTTKTTTPNAQATRSTPVSRTTKHFHETTPNKGSGTTSGTTRLLSGHTCFTLTGLLGTLVTMGLLT

SEQ ID NO: 863275 - protein, 378 aa, Homo sapiens
MTVARPSVPAALPLLGELPRLLLLVLLCLPAVWGDCGLPPDVPNAQPALEGRTSFPEDTVITYKCEESFVKIPGEKDSVICLKGSQWSDIEEFCNRSCEVPTRLNSASLKQPYITQNYFPVGTVVEYECRPGYRREPSLSPKLTCLQNLKWSTAVEFCKKKSCPNPGEIRNGQIDVPGGILFGATISFSCNTGYKLFGSTSSFCLISGSSVQWSDPLPECREIYCPAPPQIDNGIIQGERDHYGYRQSVTYACNKGFTMIGEHSIYCTVNNDEGEWSGPPPECRGKSLTSKVPPTVQKPTTVNVPTTEVSPTSQKTTTKTTTPNAQDNTGWLIPNCDSARWGKAGQCPREHPSLHLTTCYPHAGGDISYAQPFPTAHT

SEQ ID NO: 863276 - protein, 275 aa, Homo sapiens
MTVARPSVPAALPLLGELPRLLLLVLLCLPAVWGDCGLPPDVPNAQPALEGRTSFPEDTVITYKCEESFVKIPGEKDSVICLKGSQWSDIEEFCNRSCEVPTRLNSASLKQPYITQNYFPVGTVVEYECRPGYRREPSLSPKLTCLQNLKWSTAVEFCKKKSCPNPGEIRNGQIDVPGGILFGATISFSCNTGYKLFGSTSSFCLISGSSVQWSDPLPECREIYCPAPPQIDNGIIPTACSADRALTLHCVCYFRDLHNVTSPSLGEQLEALYCQ

SEQ ID NO: 863277 - protein, 166 aa, Homo sapiens
TGGASAGLRVGAHHVLVLQLTERLRDAENESMAKIAELEKQLSQARKELETLRERFSESTAMGASRRPPEPEKAPPAAPTRPSALELKVEELEEKGLIRILRGPGDAVSIEILPVAVATPSGGDAPTPGVPTGSPSPDLAPAAEPAPGAAPPPPPPLPGLPSPQEA

SEQ ID NO: 863278 - protein, 492 aa, Homo sapiens
SSSTPSAHHCPQTPVPGVKAKKPIQTKFRMPLLNWVALKPSQITGTVFTELNDEKVLQELDMSDFEEQFKTKSQGPSLDLSALKSKAAQKAPSKATLIEANRAKNLAITLRKGNLGAERICQAIEAYDLQALGLDFLELLMRFLPTEYERSLITRFEREQRPMEELSEEDRFMLCFSRIPRLPERMTTLTFLGNFPDTAQLLMPQLNAIIAASMSIKSSDKLRQILEIVLAFGNYMNSSKRGAAYGFRLQSLDALLEMKSTDRKQTLLHYLVKVIAEKYPQLTGFHSDLHFLDKAGSVSLDSVLADVRSLQRGLELTQREFVRQDDCMVLKEFLRANSPTMDKLLADSKTAQEAFESVVEYFGENPKTTSPGLFFSLFSRFIKAYKKAEQEVEQWKKEAAAQEAGADTPGKGEPPAPKSPPKARRPQMDLISELKRRQQKEPLIYESDRDGAIEDIITDLRNQPYIRADTGRRSARRRPPGPPLQVTSDLSL

SEQ ID NO: 863279 - protein, 589 aa, Homo sapiens
PPPPGTDGPVPPPPPPPPPPPGGPPDALGRRDSELGPGVKAKKPIQTKFRMPLLNWVALKPSQITGTVFTELNDEKVLQELDMSDFEEQFKTKSQGPSLDLSALKSKAAQKAPSKATLIEANRAKNLAITLRKGNLGAERICQAIEAYDLQALGLDFLELLMRFLPTEYERSLITRFEREQRPMEELSEEDRFMLCFSRIPRLPERMTTLTFLGNFPDTAQLLMPVWAERAGRCDLGGDGQEATPSLGCGREPGSTSASRWRRLQLILPPPSHPQQLNAIIAASMSIKSSDKLRQILEIVLAFGNYMNSSKRGAAYGFRLQSLDAVRRGPWLGDWGWGLAGGLWLTMGPVQLLEMKSTDRKQTLLHYLVKVIAEKYPQLTGFHSDLHFLDKAGSVSLDSVLADVRSLQRGLELTQREFVRQDDCMVLKEFLRANSPTMDKLLADSKTAQEAFESVVEYFGENPKTTSPGLFFSLFSRFIKAYKKAEQEVEQWKKEAAAQEAGADTPGKGEPPAPKSPPKARRPQMDLISELKRRQQKEPLIYESDRDGAIEDIITDLRNQPYIRADTGRRSARRRPPGPPLQVTSDLSL

SEQ ID NO: 863280 - protein, 648 aa, Homo sapiens
SSSTPSAHHCPQTPVPGVKAKKPIQTKFRMPLLNWVALKPSQITGTVFTELNDEKVLQELDMSDFEEQFKTKSQGPSLDLSALKSKAAQKAPSKATLIEANRAKNLAITLRKGNLGAERICQAIEAWCPCPGFVGSPAPLLGWGCQADPSKRASMVSSFIRLHTNPGPGNCPHFKVEKTQSMPKLGCPTSSLPLCLAVSTQAVGFTAGRPPLTYDGDPGCPVSQFLWIPSSQFLWIPTSCSLKLLANRNTEIHLFNQGRGSPAPRDWWVWMMPNLPSPPSHRYDLQALGLDFLELLMRFLPTEYERSLITRFEREQRPMEELSEEDRFMLCFSRIPRLPERMTTLTFLGNFPDTAQLLMPQLNAIIAASMSIKSSDKLRQILEIVLAFGNYMNSSKRGAAYGFRLQSLDALLEMKSTDRKQTLLHYLVKVIAEKYPQLTGFHSDLHFLDKAGSVSLDSVLADVRSLQRGLELTQREFVRQDDCMVLKEFLRANSPTMDKLLADSKTAQEAFESVVEYFGENPKTTSPGLFFSLFSRFIKAYKKAEQEVEQWKKEAAAQEAGADTPGKGEPPAPKSPPKARRPQMDLISELKRRQQKEPLIYESDRDGAIEDIITDLRNQPYIRADTGRRSARRRPPGPPLQVTSDLSL

SEQ ID NO: 863281 - protein, 235 aa, Homo sapiens [sequence omitted]

SEQ ID NO: 863282 - protein, 479 aa, Homo sapiens
PPPPGTDGPVPPPPPPPPPPPGGPPDALGRRDSELGPGVKAKKPIQTKFRMPLLNWVALKPSQITGTVFTELNDEKVLQELDMSDFEEQFKTKSQGPSLDLSALKSKAAQKAPSKATLIEANRAKNLAITLRKGNLGAERICQAIEAYDLQALGLDFLELLMRFLPTEYERSLITRFEREQRPMEELSEEDRFMLCFSRIPRLPERMTTLTFLGNFPDTAQLLMPQLNAIIAASMSIKSSDKLRQILEIVLAFGNYMNSSKRGAAYGFRLQSLDALLEMKSTDRKQTLLHYLVKVIAEKYPQLTGFHSDLHFLDKAGSVSLDSVLADVRSLQRGLELTQREFVRQDDCMVLKEFLRANSPTMDKLLADSKTAQKAEQEVEQWKKEAAAQEAGADTPGKGEPPAPKSPPKARRPQMDLISELKRRQQKEPLIYESDRDGAIEDIITDLRNQPYIRADTGRRSARRRPPGPPLQVTSDLSL

SEQ ID NO: 863283 - protein, 533 aa, Homo sapiens
PPPPGTDGPVPPPPPPPPPPPGGPPDALGRRDSELGPGVKAKKPIQTKFRMPLLNWVALKPSQITGTVFTELNDEKVLQELDMSDFEEQFKTKSQGPSLDLSALKSKAAQKAPSKATLIEANRAKNLAITLRKGNLGAERICQAIEAYDLQALGLDFLELLMRFLPTEYERSLITRFEREQRPMEELSEEDRFMLCFSRIPRLPERMTTLTFLGNFPDTAQLLMPQLNAIIAASMSIKSSDKLRQILEIVLAFGNYMNSSKRGAAYGFRLQSLDALLEMKSTDRKQTLLHYLVKVIAEKYPQLTGFHSDLHFLDKAGSVSLDSVLADVRSLQRGLELTQREFVRQDDCMVLKEFLRANSPTMDKLLADSKTAQKAEQEVEQWKKEAAAQEAGADTPGKGEPPAPKSPPKARRPQMDLISELKRRQQKEPLIYESDRDGAIEDIITGKGLARPWSYPQSVLLCFLLTQCAILWGTGCHTASCYLFCFSFLFPFSTPLHLPHPHSVIKTVPFTARTGKRTSRLLCEASLGEEMPL

SEQ ID NO: 863284 - protein, 455 aa, Homo sapiens
PPPPGTDGPVPPPPPPPPPPPGGPPDALGRRDSELGPGVKAKKPIQTKFRMPLLNWVALKPSQITGTVFTELNDEKVLQELDMSDFEEQFKTKSQGPSLDLSALKSKAAQKAPSKATLIEANRAKNLAITLRKGNLGAERICQAIEAYDLQALGLDFLELLMRFLPTEYERSLITRFEREQRPMEELSEEDRFMLCFSRIPRLPERMTTLTFLGNFPDTAQLLMPQLNAIIAASMSIKSSDKLRQILEIVLAFGNYMNSSKRGAAYGFRLQSLDALLEMKSTDRKQTLLHYLVKVIAEKYPQLTGFHSDLHFLDKAGSVSLDSVLADVRSLQRGLELTQREFVRQDDCMVLKEFLRANSPTMDKLLADSKTAQEAFESVVEYFGENPKTTSPGLFFSLFSRFIKAYKKAEQEVEQWKKEAAAQEAGADTPGKGEPPAPKVGNCSWAWYWAAGMHG

SEQ ID NO: 863285 - protein, 423 aa, Homo sapiens
PPPPGTDGPVPPPPPPPPPPPGGPPDALGRRDSELGPGVKAKKPIQTKFRMPLLNWVALKPSQITGTVFTELNDEKVLQELDMSDFEEQFKTKSQGPSLDLSALKSKAAQKAPSKATLIEANRAKNLAITLRKGNLGAERICQAIEAYDLQALGLDFLELLMRFLPTEYERSLITRFEREQRPMEELSEEDRFMLCFSRIPRLPERMTTLTFLGNFPDTAQLLMPQLNAIIAASMSIKSSDKLRQILEIVLAFGNYMNSSKRGAAYGFRLQSLDALLEMKSTDRKQTLLHYLVKVIAEKYPQLTGFHSDLHFLDKAGSVSLDSVLADVRSLQRGLELTQREFVRQDDCMVLKEFLRANSPTMDKLLADSKTAQEAFESVVEYFGENPKTTSPGLFFSLFSRFIKAYKVFGSGAGWEPCRALKP

SEQ ID NO: 863286 - protein, 389 aa, Homo sapiens
PPPPGTDGPVPPPPPPPPPPPGGPPDALGRRDSELGPGVKAKKPIQTKFRMPLLNWVALKPSQITGTVFTELNDEKVLQELDMSDFEEQFKTKSQGPSLDLSALKSKAAQKAPSKATLIEANRAKNLAITLRKGNLGAERICQAIEAYDLQALGLDFLELLMRFLPTEYERSLITRFEREQRPMEELSEEDRFMLCFSRIPRLPERMTTLTFLGNFPDTAQLLMPQLNAIIAASMSIKSSDKLRQILEIVLAFGNYMNSSKRGAAYGFRLQSLDALLEMKSTDRKQTLLHYLVKVIAEKYPQLTGFHSDLHFLDKAGSVSLDSVLADVRSLQRGLELTQREFVRQDDCMVLKEFLRANSPTMDKLLADSKTAQVRQGWPHLEVGHVGAL

SEQ ID NO: 863287 - protein, 116 aa, Homo sapiens [sequence omitted]

SEQ ID NO: 863288 - protein, 450 aa, Homo sapiens
PPPPGTDGPVPPPPPPPPPPPGGPPDALGRRDSELGPGVKAKKPIQTKFRMPLLNWVALKPSQITGTVFTELNDEKVLQELDMSDFEEQFKTKSQGPSLDLSALKSKAAQKAPSKATLIEANRAKNLAITLRKGNLGAERICQAIEAYDLQALGLDFLELLMRFLPTEYERSLITRFEREQRPMEELSEEDRFMLCFSRIPRLPERMTTLTFLGNFPDTAQLLMPVWAERAGRCDLGGDGQEATPSLGCGREPGSTSASRWRRLQLILPPPSHPQQLNAIIAASMSIKSSDKLRQILEIVLAFGNYMNSSKRGAAYGFRLQSLDALLEMKSTDRKQTLLHYLVKVIAEKYPQLTGFHSDLHFLDKAGSVSLDSVLADVRSLQRGLELTQREFVRQDDCMVLKEFLRANSPTMDKLLADSKTAQEAFESVVEYFGENPKGSFETIAGGPSQ

SEQ ID NO: 863289 - protein, 337 aa, Homo sapiens
LTPAHSRKALRNSRIVSQKDDVHVCIMCLRAIMNYQSGFSLVMNHPACVNEIALSLNNKNPRTKALVLELLAAVCLVRGGHDIILAAFDNFKEVCGEQHRFEKLMEYFRNEDSNIDFMVACMQFINIVVHSVENMNFRVFLQYEFTHLGLDLYLERLRLTESDKLQVQIQAYLDNIFDVGALLEDTETKNAVLEHMEELQEQVALLTERLRDAENESMAKIAELEKQLSQARKELETLRERFSESTAMGASRRPPEPEKAPPAAPTRPSALELKVEELEEKGLIRILRGPGDAVSIEILPVAVATPSGGDAPTPGVPTGSPSPDLAPTDPMPTGSSR

SEQ ID NO: 863290 - protein, 352 aa, Homo sapiens
LTPAHSRKALRNSRIVSQKDDVHVCIMCLRAIMNYQSGFSLVMNHPACVNEIALSLNNKNPRTKALVLELLAAVCLVRGGHDIILAAFDNFKEVCGEQHRFEKLMEYFRNEDSNIDFMVACMQFINIVVHSVENMNFRVFLQYEFTHLGLDLYLERLRLTESDKLQVQIQAYLDNIFDVGALLEDTETKNAVLEHMEELQEQVALLTERLRDAENESMAKIAELEKQLSQARKELETLRERFSESTAMGASRRPPEPEKAPPAAPTRPSALELKVEELEEKGLIRILRGPGDAVSIEILPVAVATPSGGDAPTPGVPTGSPSPDLAPAAEPAPGAAPPPPPPLPGLPSPQEA

SEQ ID NO: 863291 - protein, 142 aa, Homo sapiens
MEELQEQVALLTERLRDAENESMAKIAELEKQLSQARKELETLRERFSESTAMGASRRPPEPEKAPPAAPTRPSALELKVEELEEKGLIRILRGPGDAVSIEILPVAVATPSGGDAPTPGVPTGSPSPDLAPTDPMPTGSSR

SEQ ID NO: 863292 - protein, 513 aa, Homo sapiens
PPPPGTDGPVPPPPPPPPPPPGGPPDALGRRDSELGPGVKAKKPIQTKFRMPLLNWVALKPSQITGTVFTELNDEKVLQELDMSDFEEQFKTKSQGPSLDLSALKSKAAQKAPSKATLIEANRAKNLAITLRKGNLGAERICQAIEAYDLQALGLDFLELLMRFLPTEYERSLITRFEREQRPMEELSEEDRFMLCFSRIPRLPERMTTLTFLGNFPDTAQLLMPQLNAIIAASMSIKSSDKLRQILEIVLAFGNYMNSSKRGAAYGFRLQSLDALLEMKSTDRKQTLLHYLVKVIAEKYPQLTGFHSDLHFLDKAGSVSLDSVLADVRSLQRGLELTQREFVRQDDCMVLKEFLRANSPTMDKLLADSKTAQEAFESVVEYFGENPKTTSPGLFFSLFSRFIKAYKKAEQEVEQWKKEAAAQEAGADTPGKGEPPAPKSPPKARRPQMDLISELKRRQQKEPLIYESDRDGAIEDIITDLRNQPYIRADTGRRSARRRPPGPPLQVTSDLSL

SEQ ID NO: 863293 - protein, 450 aa, Homo sapiens
PDPSPTQLRLLTLYLQELDMSDFEEQFKTKSQGPSLDLSALKSKAAQKAPSKATLIEANRAKNLAITLRKGNLGAERICQAIEAYDLQALGLDFLELLMRFLPTEYERSLITRFEREQRPMEELSEEDRFMLCFSRIPRLPERMTTLTFLGNFPDTAQLLMPQLNAIIAASMSIKSSDKLRQILEIVLAFGNYMNSSKRGAAYGFRLQSLDALLEMKSTDRKQTLLHYLVKVIAEKYPQLTGFHSDLHFLDKAGSVSLDSVLADVRSLQRGLELTQREFVRQDDCMVLKEFLRANSPTMDKLLADSKTAQEAFESVVEYFGENPKTTSPGLFFSLFSRFIKAYKKAEQEVEQWKKEAAAQEAGADTPGKGEPPAPKSPPKARRPQMDLISELKRRQQKEPLIYESDRDGAIEDIITDLRNQPYIRADTGRRSARRRPPGPPLQVTSDLSL

SEQ ID NO: 863294 - protein, 539 aa, Homo sapiens
PPPPGTDGPVPPPPPPPPPPPGGPPDALGRRDSELGPGVKAKKPIQTKFRMPLLNWVALKPSQITGTVFTELNDEKVLQELDMSDFEEQFKTKSQGPSLDLSALKSKAAQKAPSKATLIEANRAKNLAITLRKGNLGAERICQAIEAYDLQALGLDFLELLMRFLPTEYERSLITRFEREQRPMEELSEEDRFMLCFSRIPRLPERMTTLTFLGNFPDTAQLLMPQLNAIIAASMSIKSSDKLRQILEIVLAFGNYMNSSKRGAAYGFRLQSLDAVRRGPWLGDWGWGLAGGLWLTMGLVQLLEMKSTDRKQTLLHYLVKVIAEKYPQLTGFHSDLHFLDKAGSVSLDSVLADVRSLQRGLELTQREFVRQDDCMVLKEFLRANSPTMDKLLADSKTAQEAFESVVEYFGENPKTTSPGLFFSLFSRFIKAYKKAEQEVEQWKKEAAAQEAGADTPGKGEPPAPKSPPKARRPQMDLISELKRRQQKEPLIYESDRDGAIEDIITDLRNQPYIRADTGRRSARRRPPGPPLQVTSDLSL

SEQ ID NO: 863295 - protein, 275 aa, Homo sapiens
VYDSDLSLMIVVCFRLMYMNSSKRGAAYGFRLQSLDALLEMKSTDRKQTLLHYLVKVIAEKYPQLTGFHSDLHFLDKAGSVSLDSVLADVRSLQRGLELTQREFVRQDDCMVLKEFLRANSPTMDKLLADSKTAQEAFESVVEYFGENPKTTSPGLFFSLFSRFIKAYKKAEQEVEQWKKEAAAQEAGADTPGKGEPPAPKSPPKARRPQMDLISELKRRQQKEPLIYESDRDGAIEDIITDLRNQPYIRADTGRRSARRRPPGPPLQVTSDLSL

SEQ ID NO: 863296 - protein, 567 aa, Homo sapiens
PPPPGTDGPVPPPPPPPPPPPGGPPDALGRRDSELGPGVKAKKPIQTKFRMPLLNWVALKPSQITGTVFTELNDEKVLQELDMSDFEEQFKTKSQGPSLDLSALKSKAAQKAPSKATLIEANRAKNLAITLRKGNLGAERICQAIEAYDLQALGLDFLELLMRFLPTEYERSLITRFEREQRPMEELSEEDRFMLCFSRIPRLPERMTTLTFLGNFPDTAQLLMPQLNAIIAASMSIKSSDKLRQILEIVLAFGNYMNSSKRGAAYGFRLQSLDALLEMKSTDRKQTLLHYLVKVIAEKYPQLTGFHSDLHFLDKAGSVSLDSVLADVRSLQRGLELTQREFVRQDDCMVLKEFLRANSPTMDKLLADSKTAQEAFESVVEYFGENPKTTSPGLFFSLFSRFIKAYKKAEQEVEQWKKEAAAQEAGADTPGKGEPPAPKSPPKARRPQMDLISELKRRQQKEPLIYESDRDGAIEDIITGKGLARPWSYPQSVLLCFLLTQCAILWGTGCHTASCYLFCFSFLFPFSTPLHLPHPHSVIKTVPFTARTGKRTSRLLCEASLGEEMPL

SEQ ID NO: 863297 - protein, 509 aa, Homo sapiens
PPPPGTDGPVPPPPPPPPPPPGGPPDALGRRDSELGPGVKAKKPIQTKFRMPLLNWVALKPSQITGTVFTELNDEKVLQELDMSDFEEQFKTKSQGPSLDLSALKSKAAQKAPSKATLIEANRAKNLAITLRKGNLGAERICQAIEAYDLQALGLDFLELLMRFLPTEYERSLITRFEREQRPMEELSEEDRFMLCFSRIPRLPERMTTLTFLGNFPDTAQLLMPQLNAIIAASMSIKSSDKLRQILEIVLAFGNYMNSSKRGAAYGFRLQSLDALLEMKSTDRKQTLLHYLVKVIAEKYPQLTGFHSDLHFLDKAGSVSLDSVLADVRSLQRGLELTQREFVRQDDCMVLKEFLRANSPTMDKLLADSKTAQEAFESVVEYFGENPKTTSPGLFFSLFSRFIKAYKKAEQEVEQWKKEAAAQEAGADTPGKGEPPAPKSPPKARRPQMDLISELKRRQQKEPLIYESDRDGAIEDIITVIKTVPFTARTGKRTSRLLCEASLGEEMPL

SEQ ID NO: 863298 - protein, 165 aa, Homo sapiens [sequence omitted]

SEQ ID NO: 863299 - protein, 156 aa, Homo sapiens
QAVRGLSWGADRLCPQEAFESVVEYFGENPKTTSPGLFFSLFSRFIKAYKKAEQEVEQWKKEAAAQEAGADTPGKGEPPAPKSPPKARRPQMDLISELKRRQQKEPLIYESDRDGAIEDIITDLRNQPYIRADTGRRSARRRPPGPPLQVTSDLSL

SEQ ID NO: 863300 - protein, 111 aa, Homo sapiens
MGPLKTSSQICGTSPTSAQTQAAAVPVGVPRAPHCRSPPTSRCSRYFCRWILQGCGAVDRLRLKEGGPQLGWPGSPSSAVARLKRAGASSSWPQRAASPAPSPKCCLQHPP

SEQ ID NO: 863301 - protein, 335 aa, Homo sapiens
PPPPGTDGPVPPPPPPPPPPPGGPPDALGRRDSELGPGVKAKKPIQTKFRMPLLNWVALKPSQITGTVFTELNDEKVLQELDMSDFEEQFKTKSQGPSLDLSALKSKAAQKAPSKATLIEANRAKNLAITLRKGNLGAERICQAIEAYDLQALGLDFLELLMRFLPTEYERSLITRFEREQRPMEELSEEDRFMLCFSRIPRLPERMTTLTFLGNFPDTAQLLMPQLNAIIAASMSIKSSDKLRQILEIVLAFGNYMNSSKRGAAYGFRLQSLDALLEMKSTDRKQTLLHYLVKVIAEKYPQLTGFHSDLHFLDKAGSGRRHTDPWVWGGAVGWG

SEQ ID NO: 863302 - protein, 262 aa, Homo sapiens
PPPPGTDGPVPPPPPPPPPPPGGPPDALGRRDSELGPGVKAKKPIQTKFRMPLLNWVALKPSQITGTVFTELNDEKVLQELDMSDFEEQFKTKSQGPSLDLSALKSKAAQKAPSKATLIEANRAKNLAITLRKGNLGAERICQAIEAYDLQALGLDFLELLMRFLPTEYERSLITRFEREQRPMEELSEEDRFMLCFSRIPRLPERMTTLTFLGNFPDTAQLLMPQLNAIIAASMSIKSSDKLRQILEVRGQEVGPTLACSG

SEQ ID NO: 863303 - protein, 357 aa, Homo sapiens
LTPAHSRKALRNSRIVSQKDDVHVCIMCLRAIMNYQSGFSLVMNHPACVNEIALSLNNKNPRTKALVLELLAAVCLVRGGHDIILAAFDNFKEVCGEQHRFEKLMEYFRNEDSNIDFMVACMQFINIVVHSVENMNFRVFLQYEFTHLGLDLYLERLRLTESDKLQVQIQAYLDNIFDVGALLEDTETKNAVLEHMEELQEQVALLTERLRDAENESMAKIAELEKQLSQARKELETLRERFSESTAMGASRRPPEPEKAPPAAPTRPSALELKVEELEEKGLIRILRGPGDAVSIEILPVAVATPSGGDAPTPGVPTGSPSPGAQELQAGGDAGQGLEGSPGASVAGRVGRGRFGL

SEQ ID NO: 863304 - protein, 163 aa, Homo sapiens
SSSTPSAHHCPQTPVPGVKAKKPIQTKFRMPLLNWVALKPSQITGTVFTELNDEKVLQELDMSDFEEQFKTKSQGPSLDLSALKSKAAQKAPSKATLIEANRAKNLAITLRKGNLGAERICQAIEAYDLQALGLDFLELLMRFLPTEYERSLITLKPPPNSHT

SEQ ID NO: 863305 - protein, 299 aa, Homo sapiens
LTPAHSRKALRNSRIVSQKDDVHVCIMCLRAIMNYQSGFSLVMNHPACVNEIALSLNNKNPRTKALVLELLAAVCLVRGGHDIILAAFDNFKEVCGEQHRFEKLMEYFRNEDSNIDFMVACMQFINIVVHSVENMNFRVFLQYEFTHLGLDLYLERLRLTESDKLQVQIQAYLDNIFDVGALLEDTETKNAVLEHMEELQEQVALLTERLRDAENESMAKIAELEKQLSQARKELETLRERFSESTAMGASRRPPEPEKAPPAAPTRPSALELKVEELEEKGLIRKPQPRGPSMDLIFI

SEQ ID NO: 863306 - protein, 74 aa, Homo sapiens
SSSTPSAHHCPQTPVPGVKAKKPIQTKFRMPLLNWVALKPSQITGTVFTELNDEKVLQVSGPAWLPMWAPEEEG

SEQ ID NO: 863307 - protein, 152 aa, Homo sapiens
MANLERTFIAIKPDGVQRGLVGEIIKRFEQKGFRLVAMKFLRASEEHLKQHYIDLKDRPFFPGLVKYMNSGPVVAMVWEGLNVVKTGRVMLGETNPADSKPGTIRGDFCIQVGRNIIHGSDSVKSAEKEISLWFKPEELVDYKSCAHDWVYE

SEQ ID NO: 863308 - protein, 94 aa, Homo sapiens
IRSVMYLSILYPTPHKPRVWEGLNVVKTGRVMLGETNPADSKPGTIRGDFCIQVGRNIIHGSDSVKSAEKEISLWFKPEELVDYKSCAHDWVYE

SEQ ID NO: 863309 - protein, 152 aa, Homo sapiens; identical to SEQ ID NO: 863307

SEQ ID NO: 863310 - protein, 152 aa, Homo sapiens; identical to SEQ ID NO: 863307

SEQ ID NO: 863311 - protein, 152 aa, Homo sapiens; identical to SEQ ID NO: 863307

SEQ ID NO: 863312 - protein, 152 aa, Homo sapiens; identical to SEQ ID NO: 863307

SEQ ID NO: 863313 - protein, 152 aa, Homo sapiens; identical to SEQ ID NO: 863307

SEQ ID NO: 863314 - protein, 152 aa, Homo sapiens; identical to SEQ ID NO: 863307

SEQ ID NO: 863315 - protein, 202 aa, Homo sapiens
KWALRQRICAEAFRACKCCEPRGSRARFGCWRLQPEFKPKQLEGTMANCERTFIAIKPDGVQRGLVGEIIKRFEQKGFRLVGLKFMQMKFLRASEEHLKQHYIDLKDRPFFPGLVKYMNSGPVVAMVWEGLNVVKTGRVMLGETNPADSKPGTIRGDFCIQVGRNIIHGSDSVKSAEKEISLWFKPEELVDYKSCAHDWVYE

SEQ ID NO: 863316 - protein, 152 aa, Homo sapiens; identical to SEQ ID NO: 863307

SEQ ID NO: 863317 - protein, 152 aa, Homo sapiens; identical to SEQ ID NO: 863307

SEQ ID NO: 863318 - protein, 152 aa, Homo sapiens; identical to SEQ ID NO: 863307

SEQ ID NO: 863319 - protein, 258 aa, Homo sapiens
KWALRQRICAEAFRACKCCEPRGSRARFGCWRLQPEFKPKQLEGTMANCERTFIAIKPDGVQRGLVGEIIKRFEQKGFRLVGLKFMQASEDLLKEHYVDLKDRPFFAGLVKYMHSGPVVAMVWEGLNVVKTGRVMLGETNPADSKPGTIRGDFCIQVGRTMANLERTFIAIKPDGVQRGLVGEIIKRFEQKGFRLVAMKFLRASEEHLKQHYIDGLGGAERGEDRPSDAWGDQSSRFKARHHSWGLLHSGWQEHHSWQ

SEQ ID NO: 863320 - protein, 94 aa, Homo sapiens
AAAYYYYYYYFKFAAASTVWEGLNVVKTGRVMLGETNPADSKPGTIRGDFCIQVGRNIIHGSDSVKSAEKEISLWFKPEELVDYKSCAHDWVYE

SEQ ID NO: 863321 - protein, 216 aa, Homo sapiens
KWALRQRICAEAFRACKCCEPRGSRARFGCWRLQPEFKPKQLEGTMANCERTFIAIKPDGVQRGLVGEIIKRFEQKGFRLVGLKFMQVWEGLNVVKTGRVMLGETNPADSKPGTIRGDFCIQVGRTMANLERTFIAIKPDGVQRGLVGEIIKRFEQKGFRLVAMKFLRASEEHLKQHYIDLKDRPFFPGLVKYMNSGPVVAMVWEGELNVGERQAE

SEQ ID NO: 863322 - protein, 242 aa, Homo sapiens
KWALRQRICAEAFRACKCCEPRGSRARFGCWRLQPEFKPKQLEGTMANCERTFIAIKPDGVQRGLVGEIIKRFEQKGFRLVGLKFMQASEDLLKEHYVDLKDRPFFAGLVKYMHSGPVVAMVWEGLNVVKTGRVMLGETNPADSKPGTIRGDFCIQVGRTMANLERTFIAIKPDGVQRGLVGEIIKRFEQKGFRLVAMKFLRASEEHLKQHYIDLKDRPFFPGLVKYMNSGPVVAMEHHSWQ

SEQ ID NO: 863323 - protein, 175 aa, Homo sapiens
MLSRGAPNYRTPPFFVKKEGAIRGGGVNNQPRTRGRGNKPARVEGHTLACGVNSVGRGETPPSRGRGAHQVAGTPPHPKKESKYRERTAEATQLTKNVGARCYSVRVSHNTRGPLILVSSRSRSQNKLVLHQPEMRNYGTQSFFPPCAARLVNVAGPSTKSQNQDSLPDNSYGKE

SEQ ID NO: 863324 - protein, 175 aa, Homo sapiens; identical to SEQ ID NO: 863323

SEQ ID NO: 863325 - protein, 233 aa, Homo sapiens
KWALRQRICAEAFRACKCCEPRGSRARFGCWRLQPEFKPKQLEGTMANCERTFIAIKPDGVQRGLVGEIIKRFEQKGFRLVGLKFMQASEDLLKEHYVDLKDRPFFAGLVKYMHSGPVVAMVWEGLNVVKTGRVMLGETNPADSKPGTIRGDFCIQVGRTMANLERTFIAIKPDGVQRGLVGEIIKRFEQKGFRLVAMKFLRASEEHLKQHYIDLTYNSKVKCFTFGEVFDYH

SEQ ID NO: 863326 - protein, 152 aa, Homo sapiens; identical to SEQ ID NO: 863307

SEQ ID NO: 863327 - protein, 150 aa, Homo sapiens
MANLERTFIAIKPDGVQRGLVGEIIKRFEQKGFRLVAMKFLRASEEHLKQHYIDLKDRPFFPGLVKYMNSGPVVAMVWEGLNVVKTGRVMLGETNPADSKPGTIRGDFCIQVGRNIIHGSDSVKSAEKEISLWFKPEELVDYKSCAHTGL

SEQ ID NO: 863328 - protein, 152 aa, Homo sapiens; identical to SEQ ID NO: 863307

SEQ ID NO: 863329 - protein, 152 aa, Homo sapiens; identical to SEQ ID NO: 863307

SEQ ID NO: 863330 - protein, 312 aa, Homo sapiens
KWALRQRICAEAFRACKCCEPRGSRARFGCWRLQPEFKPKQLEGTMANCERTFIAIKPDGVQRGLVGEIIKRFEQKGFRLVGLKFMQASEDLLKEHYVDLKDRPFFAGLVKYMHSGPVVAMVWEGLNVVKTGRVMLGETNPADSKPGTIRGDFCIQVGRTMANLERTFIAIKPDGVQRGLVGEIIKRFEQKGFRLVAMKFLRASEEHLKQHYIDLKDRPFFPGLVKYMNSGPVVAMVWEGLNVVKTGRVMLGETNPADSKPGTIRGDFCIQVGRNIIHGSDSVKSAEKEISLWFKPEELVDYKSCAHDWVYE

SEQ ID NO: 863331 - protein, 152 aa, Homo sapiens; identical to SEQ ID NO: 863307

SEQ ID NO: 863332 - protein, 152 aa, Homo sapiens; identical to SEQ ID NO: 863307

SEQ ID NO: 863333 - protein, 152 aa, Homo sapiens; identical to SEQ ID NO: 863307

SEQ ID NO: 863334 - protein, 152 aa, Homo sapiens; identical to SEQ ID NO: 863307

SEQ ID NO: 863335 - protein, 299 aa, Homo sapiens
KWALRQRICAEAFRACKCCEPRGSRARFGCWRLQPEFKPKQLEGTMANCERTFIAIKPDGVQRGLVGEIIKRFEQKGFRLVGLKFMQASEDLLKEHYVDLKDRPFFAGLVKYMHSGPVVAMVWEGLNVVKTGRVMLGETNPADSKPGTIRGDFCIQVGRTMANLERTFIAIKPDGVQRGLVGEIIKRFEQKGFRLVAMKFLRASEEHLKQHYIDLKDRPFFPGVWEGLNVVKTGRVMLGETNPADSKPGTIRGDFCIQVGRNIIHGSDSVKSAEKEISLWFKPEELVDYKSCAHDWVYE

SEQ ID NO: 863336 - protein, 152 aa, Homo sapiens; identical to SEQ ID NO: 863307

SEQ ID NO: 863337 - protein, 85 aa, Homo sapiens
IKKTKTPPFSLRRADLVKTGRVMLGETNPADSKPGTIRGDFCIQVGRNIIHGSDSVKSAEKEISLWFKPEELVDYKSCAHDWVYE

SEQ ID NO: 863338 - protein, 175 aa, Homo sapiens; identical to SEQ ID NO: 863323

SEQ ID NO: 863339 - protein, 237 aa, Homo sapiens
KWALRQRICAEAFRACKCCEPRGSRARFGCWRLQPEFKPKQLEGTMANCERTFIAIKPDGVQRGLVGEIIKRFEQKGFRLVGLKFMQASEDLLKEHYVDLKDRPFFAGLVKYMHSGPVVAMVWEGLNVVKTGRVMLGETNPADSKPGTIRGDFCIQVGRTMANLERTFIAIKPDGVQRGLVGEIIKRFEQKGFRLVAMKFLRASEEHLKQHYIDLKDRPFFPGLVKYMNSGPVVAME

SEQ ID NO: 863340 - protein, 175 aa, Homo sapiens; identical to SEQ ID NO: 863323

SEQ ID NO: 863341 - protein, 100 aa, Homo sapiens
WTQPKAEDPWPTKLIFELSPPSPALTCDPRPFGAPLTQLARSRTQTMFPVKVKVEKSELEMAKARNQLDAVLQCLLEKSHMDRERLDEEAGKTPSDTHNK

SEQ ID NO: 863342 - protein, 232 aa, Homo sapiens
MAKARNQLDAVLQCLLEKSHMDRERLDEEAGKTPSDTHNKDCSIAATGKRPSARFPHQRRKKRREMDDGLAEGGPQRSNTYVIKLFDRSVDLAQFSENTPLYPICRAWMRNSPSVRERECSPSSPLPPLPEDEEGSEVTNSKSRDVYKLPPPTPPGPPGDACRSRIPSPLQPEMQGTPDDEPSEPEPSPSTLIYRNMQRWKRIRQRWKEASHRNQLRYSESMKILREMYERQ

SEQ ID NO: 863343 - protein, 167 aa, Homo sapiens
MDDGLAEGGPQRSNTYVIKLFDRSVDLAQFSENTPLYPICRAWMRNSPSVRERECSPSSPLPPLPEDEEGSEVTNSKSRDVYKLPPPTPPGPPGDACRSRIPSPLQPEMQGTPDDEPSEPEPSPSTLIYRNMQRWKRIRQRWKEASHRNQLRYSESMKILREMYERQ

SEQ ID NO: 863344 - protein, 167 aa, Homo sapiens; identical to SEQ ID NO: 863343

SEQ ID NO: 863345 - protein, 167 aa, Homo sapiens; identical to SEQ ID NO: 863343

SEQ ID NO: 863346 - protein, 230 aa, Homo sapiens
NEAVNRARVPVGVLLEKSHVQERLDEEAGKTPSDTHNKDCSIAATGKRPSARFPHQRRKKRREMDDGLAEGGPQRSNTYVIKLFDRSVDLAQFSENTPLYPICRAWMRNSPSVRERECSPSSPLPPLPEDEEGSEVTNSKSRDVYKLPPPTPPGPPGDACRSRIPSPLQPEMQGTPDDEPSEPEPSPSTLIYRNMQRWKRIRQRWKEASHRNQLRYSESMKILREMYERQ

SEQ ID NO: 863347 - protein, 124 aa, Homo sapiens
MRNSPSVRERECSPSSPLPPLPEDEEGSEVTNSKSRDVYKLPPPTPPGPPGDACRSRIPSPLQPEMQGTPDDEPSEPEPSPSTLIYRNMQRWKRIRQRWKEASHRNQLRYSESMKILREMYERQ

SEQ ID NO: 863348 - protein, 129 aa, Homo sapiens
MNLERVSNEEKLNLCRKYYLGGFAFLPFLWLVNIFWFFREAFLVPAYTEQSQIKGYVWRSAVGFLFWVIVLTSWITIFQIYRLHILGPCLFSQDRLLKAEEPVLGAPSQTPKTCFHVPRSLLTSPNKGP

SEQ ID NO: 863349 - protein, 224 aa, Homo sapiens
WTQPKAEDPWPTKLIFELSPPSPALTCDPRPFGAPLTQLARSRTQTMFPVKVKVEKSELEMAKARNQLDAVLQCLLEKSHMDRERLDEEAGKTPSDTHNKDCSIAATGKRPSARFPHQRRKKRREMDDGLAEGGPQRSNTYVIKLFDRSVDLAQFSENTPLYPICRAWMRNSPSVRERECSPSSPLPPLPEDEEVGWVVGPSPAAWCQGSGWIGSKDPAPKLVG

SEQ ID NO: 863350 - protein, 141 aa, Homo sapiens
MDDGLAEGGPQRSNTYVIKLFDRSVDLAQFSENTPLYPICRAWMRNSPSVRERECSPSSPLPPLPEDEEGSEVTNSKSRDVYKLPPPTPPGPPGDACRSRIPSPLQPEMQGTPDDEPSEPEPSPSTLIYRNMQRWKRIRQR

SEQ ID NO: 863351 - protein, 163 aa, Homo sapiens
MAKARNQLDAVLQCLLEKSHMDRERLDEEAGKTPSDTHNKDCSIAATGKRPSARFPHQRRKKRREMDDGLAEGGPQRSNTYVIKLFDRSVDLAQFSENTPLYPICRAWMRNSPSVRERECSPSPLSPSPHPPHSSIATCSAGNASARGGRRPLIGTSFVTQKA

SEQ ID NO: 863352 - protein, 292 aa, Homo sapiens
WTQPKAEDPWPTKLIFELSPPSPALTCDPRPFGAPLTQLARSRTQTMFPVKVKVEKSELEMAKARNQLDAVLQCLLEKSHMDRERLDEEAGKTPSDTHNKDCSIAATGKRPSARFPHQRRKKRREMDDGLAEGGPQRSNTYVIKLFDRSVDLAQFSENTPLYPICRAWMRNSPSVRERECSPSSPLPPLPEDEEGSEVTNSKSRDVYKLPPPTPPGPPGDACRSRIPSPLQPEMQGTPDDEPSEPEPSPSTLIYRNMQRWKRIRQRWKEASHRNQLRYSESMKILREMYERQ

SEQ ID NO: 863353 - protein, 46 aa, Homo sapiens
MCQKVAPVSPTFCDHTGEKPAGGPHKGGAEKVLKRRYRVSTTHSEH

SEQ ID NO: 863354 - protein, 162 aa, Homo sapiens
MRTTTAPTNRTLSPNRQTPARHTQNRGRGIIHHHKNKNHPPGVTQPPAPLTEHHTYTRAAPPRRRPHNKGGAHTTSQGRAPTTGSGRPQHKKHNTRRRRGGRENNHDSHQHRPQTPCTNHRRNDGTTQTTTTRDHMHRQPDHQHDQHRELQQPPRVAHDKQK

SEQ ID NO: 863355 - protein, 147 aa, Homo sapiens
MDDGLAEGGPQRSNTYVIKLFDRSVDLAQFSENTPLYPICRAWMRNSPSGSEVTNSKSRDVYKLPPPTPPGPPGDACRSRIPSPLQPEMQGTPDDEPSEPEPSPSTLIYRNMQRWKRIRQRWKEASHRNQLRYSESMKILREMYERQ

SEQ ID NO: 863356 - protein, 134 aa, Homo sapiens
MDDGLAEGGPQRSNTYVIKLFDRSVDLAQFSENTPLYPICRAWMRNSPSVRERECSPSSPLPPLPEDEEHPEMPADPASHLHCSLRCRAPLTMSPLSPSPHPPHSSIATCSAGNASARGGRRPLIGTSFVTQKA

SEQ ID NO: 863357 - protein, 980 aa, Homo sapiens
MALAVLRVLEPFPTETPPLAVLLPPGGPWPAAELGLVLALRPAGESPAGPALLVAALEGPDAGTEEQGPGPPQLLVSRALLRLLALGSGAWVRARAVRRPPALGWALLGTSLGPGLGPRVGPLLVRRGETLPVPGPRVLETRPALQGLLGPGTRLAVTELRGRARLCPESGDSSRPPPPPVVSSFAVSGTVRRLQGVLGGTGDSLGVSRSCLRGLGLFQGEWVWVAQARESSNTSQPHLARVQVLEPRWDLSDRLGPGSGPLGEPLADGLALVPATLAFNLGCDPLEMGELRIQRYLEGSIAPEDKGSCSLLPGPPFARELHIEIVSSPHYSTNGNYDGVLYRHFQIPRVVQEGDVLCVPTIGQVEILEGSPEKLPRWREMFFKVKKTVGEAPDGPASAYLADTTHTSLYMVGSTLSPVPWLPSEESTLWSSLSPPGLEALVSELCAVLKPRLQPGGALLTGTSSVLLRGPPGCGKTTVVAAACSHLGLHLLKVPCSSLCAESSGAVETKLQAIFSRARRCRPAVLLLTAVDLLGRDRDGLGEDARVMAVLRHLLLNEDPLNSCPPLMVVATTSRAQDLPADVQTAFPHELEVPALSEGQRLSILRALTAHLPLGQEVNLAQLARRCAGFVVGDLYALLTHSSRAACTRIKNSGLAGGLTEEDEGELCAAGFPLLAEDFGQALEQLQTAHSQAVGAPKIPSVSWHDVGGLQEVKKEILETIQLPLEHPELLSLGLRRSGLLLHGPPGTGKTLLAKAVATECSLTFLSVKGPELINMYVGQSEENVREVFARARAAAPCIIFFDELDSLAPSRGRSGDSGGVMDRVVSQLLAELDGLHSTQDVFVIGATNRPDLLDPALLRPGRFDKLVFVGANEDRASQLRVLSAITRKFKLEPSVSLVNVLDCCPPQLTGADLYSLCSDAMTAALKRRVHDLEEGLEQGSSALMLTMEDLLQAAARLQPSVSEQELLRYKRIQRKFAAC

SEQ ID NO: 863358 - protein, 952 aa, Homo sapiens
MALAVLRVLEPFPTETPPLAVLLPPGGPWPAAELGLVLALRPAGESPAGPALLVAALEGPDAGTEEQGPGPPQLLVSRALLRLLALGSGAWVRARAVRRPPALGWALLGTSLGPGLGPRVGPLLVRRGETLPVPGPRVLETRPALQGLLGPGTRLAVTELRGRARLCPESGDSSRPPPPPVVSSFAVSGTVRRLQGVLGGTGDSLGVSRSCLRGLGLFQGEWVWVAQARESSNTSQPHLARVQVLEPRWDLSDRLGPGSGPLGEPLADGLALVPATLAFNLGCDPLEMGELRIQRYLEGSIAPEDKGSCSLLPGPPFARELHIEIVSSPHYSTNGNYDGVLYRHFQIPRWREMFFKVKKTVGEAPDGPASAYLADTTHTSLYMVGSTLSPVPWLPSEESTLWSSLSPPGLEALVSELCAVLKPRLQPGGALLTGTSSVLLRGPPGCGKTTVVAAACSHLGLHLLKVPCSSLCAESSGAVETKLQAIFSRARRCRPAVLLLTAVDLLGRDRDGLGEDARVMAVLRHLLLNEDPLNSCPPLMVVATTSRAQDLPADVQTAFPHELEVPALSEGQRLSILRALTAHLPLGQEVNLAQLARRCAGFVVGDLYALLTHSSRAACTRIKNSGLAGGLTEEDEGELCAAGFPLLAEDFGQALEQLQTAHSQAVGAPKIPSVSWHDVGGLQEVKKEILETIQLPLEHPELLSLGLRRSGLLLHGPPGTGKTLLAKAVATECSLTFLSVKGPELINMYVGQSEENVREVFARARAAAPCIIFFDELDSLAPSRGRSGDSGGVMDRVVSQLLAELDGLHSTQDVFVIGATNRPDLLDPALLRPGRFDKLVFVGANEDRASQLRVLSAITRKFKLEPSVSLVNVLDCCPPQLTGADLYSLCSDAMTAALKRRVHDLEEGLEQGSSALMLTMEDLLQAAARLQPSVSEQELLRYKRIQRKFAAC

SEQ ID NO: 863359 - protein, 1065 aa, Homo sapiens
MALAVLRVLEPFPTETPPLAVLLPPGGPWPAAELGLVLALRPAGESPAGPALLVAALEGPDAGTEEQGPGPPQLLVSRALLRLLALGSGAWVRARAVRRPPALGWALLGTSLGPGLGPRVGPLLVRRGETLPVPGPRVLETRPALQGLLGPGTRLAVTELRGRARLCPESGDSSRPPPPPVVSSFAVSGTVRRLQGVLGGTGDSLGVSRSCLRGLGLFQGEWVWVAQARESSNTSQPHLARVQVLEPRWDLSDRLGPGSGPLGEPLADGLALVPATLAFNLGCDPLEMGELRIQRYLEGSIAPEDKGSCSLLPGPPFARELHIEIVSSPHYSTNGNYDGVLYRHFQIPRVVQEGDVLCVPTIGQVEILEGSPEKLPRWREMFFKVKKTVGEAPDGPASAYLADTTHTSLYMVGSTLSPVPWLPSEESTLWSSLSPPGLEALVSELCAVLKPRLQPGGALLTGTSSVLLRGPPGCGKTTVVAAACSHLGLHLLKVPCSSLCAESSGAVETKLQAIFSRARRCRPAVLLLTAVDLLGRDRDGLGEDARVMAVLRHLLLNEDPLNSCPPLMVVATTSRAQDLPADVQTAFPHELEVPALSEGQRLSILRALTAHLPLGQEVNLAQLARRCAGFVVGDLYALLTHSSRAACTRIKNSGLAGGLTEEDEGELCAAGFPLLAEDFGQALEQLQTAHSQAVGAPKIPSVSWHDVGGLQEVKKEILETIQLPLEHPELLSLGLRRSGLLLHGPPGTGKTLLAKAVATECSLTFLSVKGPELINMYVGQSEENVREGERAGRGRASHASQTPMAPKPPPTPRLLMIIPNPPFYKSGSCPAGSSTWDASAVLSGPSFPPCSHLTSTPHKPSFALLWAPLSSSVFARARAAAPCIIFFDELDSLAPSRGRSGDSGGVMDRVVSQLLAELDGLHSTQDVFVIGATNRPDLLDPALLRPGRFDKLVFVGANEDRASQLRVLSAITRKFKLEPSVSLVNVLDCCPPQLTGADLYSLCSDAMTAALKRRVHDLEEGLEQGSSALMLTMEDLLQAAARLQPSVSEQELLRYKRIQRKFAAC

SEQ ID NO: 863360 - protein, 1106 aa, Homo sapiens
MALAVLRVLEPFPTETPPLAVLLPPGGPWPAAELGLVLALRPAGESPAGPALLVAALEGPDAGTEEQGPGPPQLLVSRALLRLLALGSGAWVRARAVRRPPALGWALLGTSLGPGLGPRVGPLLVRRGETLPVPGPRVLETRPALQGLLGPGTRLAVTELRGRARLCPESGDSSRPPPPPVVSSFAVSGTVRRLQGVLGGTGDSLGVSRSCLRGLGLFQGEWVWVAQARESSNTSQPHLARVQVLEPRWDLSDRLGPGSGPLGEPLADGLALVPATLAFNLGCDPLEMGELRIQRYLEGSIAPEDKGSCSLLPGPPFARELHIEIVSSPHYSTNGNYDGVLYRHFQIPRVVQEGDVLCVPTIGQVEILEGSPEKLPRWREMFFKVKKTVGEAPDGPASAYLADTTHTSLYMVGSTLSPVPWLPSEESTLWSSLSPPGLEALVSELCAVLKPRLQPGGALLTGTSSVLLRGPPGCGKTTVVAAACSHLGLHLLKVRVSGEVEPQLLPLPSSCSPSLLLPLPSLLCLLTGPSTSAQWVRHIPMMLSYGEVLSRRRELQDIGGQSREWDEGKKEVGLGQGTFPVPALQRKRWPTSSTSSSPDSPALVMLSPVLTDPLGSPPQVPCSSLCAESSGAVETKLQAIFSRARRCRPAVLLLTAVDLLGRDRDGLGEDARVMAVLRHLLLNEDPLNSCPPLMVVATTSRAQDLPADVQTAFPHELEVPALSEGQRLSILRALTAHLPLGQEVNLAQLARRCAGFVVGDLYALLTHSSRAACTRIKNSGLAGGLTEEDEGELCAAGFPLLAEDFGQALEQLQTAHSQAVGAPKIPSVSWHDVGGLQEVKKEILETIQLPLEHPELLSLGLRRSGLLLHGPPGTGKTLLAKAVATECSLTFLSVKGPELINMYVGQSEENVREVFARARAAAPCIIFFDELDSLAPSRGRSGDSGGVMDRVVSQLLAELDGLHSTQDVFVIGATNRPDLLDPALLRPGRFDKLVFVGANEDRASQLRVLSAITRKFKLEPSVSLVNVLDCCPPQLTGADLYSLCSDAMTAALKRRVHDLEEGLEQGSSALMLTMEDLLQAAARLQPSVSEQELLRYKRIQRKFAAC

SEQ ID NO: 863361 - protein, 980 aa, Homo sapiens; identical to SEQ ID NO: 863357

SEQ ID NO: 863362 - protein, 654 aa, Homo sapiens
MALAVLRVLEPFPTETPPLAVLLPPGGPWPAAELGLVLALRPAGESPAGPALLVAALEGPDAGTEEQGPGPPQLLVSRALLRLLALGSGAWVRARAVRRPPALGWALLGTSLGPGLGPRVGPLLVRRGETLPVPGPRVLETRPALQGLLGPGTRLAVTELRGRARLCPESGDSSRPPPPPVVSSFAVSGTVRRLQGVLGGTGDSLGVSRSCLRGLGLFQGEWVWVAQARESSNTSQPHLARVQVLEPRWDLSDRLGPGSGPLGEPLADGLALVPATLAFNLGCDPLEMGELRIQRYLEGSIAPEDKGSCSLLPGPPFARELHIEIVSSPHYSTNGNYDGVLYRHFQIPRVVQEGDVLCVPTIGQVEILEGSPEKLPRWREMFFKVKKTVGEAPDGPASAYLADTTHTSLYMVGSTLSPVPWLPSEESTLWSSLSPPGLEALVSELCAVLKPRLQPGGALLTGTSSVLLRGPPGCGKTTVVAAACSHLGLHLLKVPCSSLCAESSGAVETKLQAIFSRARRCRPAVLLLTAVDLLGRDRDGLGEDARVMAVLRHLLLNEDPLNSCPPLMVVATTSRAQDLPADVQTAFPHELEVPALSEGQRLSILRALTAHLPLGQEVNLAQLARRCAVSIKGEYWPSLGGPWLLLQELSPVAL

SEQ ID NO: 863363 - protein, 97 aa, Homo sapiens
KATRPLLSVSQFPGSFPGITSVLQGWLWRKNLQQGHLFLRLPFPLGNSLAILHFTALALKDTTPHTSGPGVDADPHLSATTMSLNTIQTSHNVEVLL

SEQ ID NO: 863364 - protein, 980 aa, Homo sapiens; identical to SEQ ID NO: 863357

SEQ ID NO: 863365 - protein, 912 aa, Homo sapiens
MALAVLRVLEPFPTETPPLAVLLPPGGPWPAAELGLVLALRPAGESPAGPALLVAALEGPDAGTEEQGPGPPQLLVSRALLRLLALGSGAWVRARAVRRPPALGWALLGTSLGPGLGPRVGPLLVRRGETLPVPGPRVLETRPALQGLLGPGTRLAVTELRGRARLCPESGDSSRPPPPPVVSSFAVSGTVRRLQGVLGGTGDSLGVSRSCLRGLGLFQGEWVWVAQARESSNTSQPHLARVQVLEPRWDLSDRLGPGSGPLGEPLADGLALVPATLAFNLGCDPLEMGELRIQRYLEGSIAPEDKGSCSLLPGPPFARELHIEIVSSPHYSTNGNYDGVLYRHFQIPRVVQEGDVLCVPTIGQVEILEGSPEKLPRWREMFFKVKKTVGEAPDGPASAYLADTTHTSLYMVGSTLSPVPWLPSEESTLWSSLSPPGLEALVSELCAVLKPRLQPGGALLTGTSSVLLRGPPGCGKTTVVAAACSHLGLHLLKVPCSSLCAESSGAVETKLQAIFSRARRCRPAVLLLTAVDLLGRDRDGLGEDARVMAVLRHLLLNEDPLNSCPPLMVVATTSRAQDLPADVQTAFPHELEVPALSEGQRLSILRALTAHLPLGQEVNLAQLARRCAGFVVGDLYALLTHSSRAACTRIKNSGLAGGLTEEDEGELCAAGFPLLAEDFGQALEQLQTAHSQAVGAPKIPSVSWHDNMYVGQSEENVREVFARARAAAPCIIFFDELDSLAPSRGRSGDSGGVMDRVVSQLLAELDGLHSTQDVFVIGATNRPDLLDPALLRPGRFDKLVFVGANEDRASQLRVLSAITRKFKLEPSVSLVNVLDCCPPQLTGADLYSLCSDAMTAALKRRVHDLEEGLEQGSSALMLTMEDLLQAAARLQPSVSEQELLRYKRIQRKFAAC

SEQ ID NO: 863366 - protein, 262 aa, Homo sapiens
MAPKPPPTPRLLMIIPNPPFYKSGSCPAGSSTWDASAVIVRPQFPSLLSPNFNPPQAELCPPVGPSLSSVFARARAAAPCIIFFDELDSLAPSRGRSGDSGGVMDRVVSQLLAELDGLHSTQDVFVIGATNRPDLLDPALLRPGRFDKLVFVGANEDRASQLRVLSAITRKFKLEPSVSLVNVLDCCPPQLTGADLYSLCSDAMTAALKRRVHDLEEGLEQGSSALMLTMEDLLQAAARLQPSVSEQELLRYKRIQRKFAAC

SEQ ID NO: 863367 - protein, 980 aa, Homo sapiens; identical to SEQ ID NO: 863357

SEQ ID NO: 863368 - protein, 1462 aa, Homo sapiens
MALYYDHQIEAPDAAGSPSFISWHPVHPFLAVAYISTTSTGSVDIYLEQGECVPDTHVERPFRVASLCWHPTRLVLAVGWETGEVTVFNKQDKEQHTMPLTHTADITVLRWSPSGNCLLSGDRLGVLLLWRLDQRGRVQGTPLLKHEYGKHLTHCIFRLPPPGEDLVQLAKAAVSGDEKALDMFNWKKSSSGSLLKMGSHEGLLFFVSLMDGTVHYVDEKGKTTQVVSADSTIQMLFYMEKREALVVVTENLRLSLYTVPPEGKAEEVMKVKLSGKTGRRADIALIEGSLLVMAVGEAALRFWDIERGENYILSPDEKFGFEKGENMNCVCYCKVKGLLAAGTDRGRVAMWRKVPDFLGSPGAEGKDRWALQTPTELQGNITQIQWGSRKNLLAVNSVISVAILSERAMSSHFHQQVAAMQVSPSLLNVCFLSTGVAHSLRTDMHISGVFATKDAVAVWNGRQVAIFELSGAAIRSAGTFLCETPVLAMHEENVYTVESNRVQVRTWQGTVKQLLLFSETEGNPCFLDICGNFLVVGTDLAHFKSFDLSRREAKAHCSCRSLAELVPGVGGIASLRCSSSGSTISILPSKADNSPDSKICFYDVEMDTVTVFDFKTGQIDRRETLSFNEQETNKSHLFVDEGLKNYVPVNHFWDQSEPRLFVCEAVQETPRSQPQSANGQPQDGRAGPAADVLILSFFISEEHGFLLHESFPRPATSHSLLGMEVPYYYFTRKPEEADREDEVEPGCHHIPQMVSRRPLRDFVGLEDCDKATRDAMLHFSFFVTIGDMDEAFKSIKLIKSEAVWENMARMCVKTQRLDVAKVCLGNMGHARGARALREAEQEPELEARVAVLATQLGMLEDAEQLYRKCKRHDLLNKFYQAAGRWQEALQVAEHHDRVHLRSTYHRYAGHLEASADCSRALSYYEKSDTHRFEVPRMLSEDLPSLELYVNKMKDKTLWRWWAQYLESQGEMDAALHYYELARDHFSLVRIHCFQGNVQKAAQIANETGNLAASYHLARQYESQEEVGQAVHFYTRAQAFKNAIRLCKENGLDDQLMNLALLSSPEDMIEAARYYEEKGVQMDRAVMLYHKAGHFSKALELAFATQQFVALQLIAEDLDETSDPALLARCSDFFIEHSQYERAVELLLAARKYQEALQLCLGQNMSITEEMAEKMTVAKDSSDLPEESRRELLEQIADCCMRQGSYHLATKKYTQAGNKLKAMRALLKSGDTEKITFFASVSRQKEIYIMAANYLQSLDWRKEPEIMKNIIGFYTKGRALDLLAGFYDACAQVEIDEYQNYDKAHGALTEAYKCLAKAKAKSPLDQETRLAQLQSRMALVKRFIQARRTYTEDPKESIKQCELLLEEPDLDSTIRIGDVYGFLVEHYVRKEEYQTAYRFLEEMRRRLPLANMSYYVSPQAVDAVHRGLGLPLPRTVPEQVRHNSMEDARELDEEVVEEADDDP

SEQ ID NO: 863369 - protein, 824 aa, Homo sapiens
SCPRGEARDAGCGTDPSSRLLLLSLVAPGAWRLVLSDYCLPWGLHTPQPSSCPQDHRYPQDHRNHKPPPARVFQACPRHGNAALKRGADITGLLGRGETRVPGGSKFTQTCRARDLYLEDLGARDLYLEGLGARDLYLEDLGARDLYLEDLEARSFLGGKKGEAVWENMARMCVKTQRLDVAKVCLGNMGHARGARALREAEQEPELEARVAVLATQLGMLEDAEQLYRKCKRHDLLNKFYQAAGRWQEALQVAEHHDRVHLRSTYHRYAGHLEASADCSRALSYYEKSDTHRFEVPRMLSEDLPSLELYVNKMKDKTLWRWWAQYLESQGEMDAALHYYELARDHFSLVRIHCFQGNVQKAAQIANETGNLAASYHLARQYESQEEVGQAVHFYTRAQAFKNAIRLCKENGLDDQLMNLALLSSPEDMIEAARYYEEKGVQMDRAVMLYHKAGHFSKALELAFATQQFVALQLIAEDLDETSDPALLARCSDFFIEHSQYERAVELLLAARKYQEALQLCLGQNMSITEEMAEKMTVAKDSSDLPEESRRELLEQIADCCMRQGSYHLATKKYTQAGNKLKAMRALLKSGDTEKITFFASVSRQKEIYIMAANYLQSLDWRKEPEIMKNIIGFYTKGRALDLLAGFYDACAQVEIDEYQNYDKAHGALTEAYKCLAKAKAKSPLDQETRLAQLQSRMALVKRFIQARRTYTEDPKESIKQCELLLEEPDLDSTIRIGDVYGFLVEHYVRKEEYQTAYRFLEEMRRRLPLANMSYYVSPQAVDAVHRGLGLPLPRTVPEQVRHNSMEDARELDEEVVEEADDDP

SEQ ID NO: 863370 - protein, 599 aa, Homo sapiens
KGVQMDRAVMLYHKAGHFSKALELAFATQQFVALQLIAEDLDETSDPALLARCSDFFIEHSQYERAVELLLAVHGGRTSLRTDMHISGVFATKDAVAVWNGRQVAIFELSGAAIRSAGTFLCETPVLAMHEENVYTVESNRVQVRTWQGTVKQLLLFSETEGNPCFLDICGNFLVVGTDLAHFKSFDLSRREAKAHCSCRSLAELVPGVGGIASLRCSSSGSTISILPSKADNSPDSKICFYDVEMDTVTVFDFKTGQLGVLLLWRLDQRGRVQGTPLLKHEYGKHLTHCIFRLPPPGEDLVQLAKAAVSGDEKALDMFNWKKSSSGSLLKMGSHEGLLFFVSLMDGTVHYVDEKGKTTQVVSADSTIQMLFYMEKREALVVVTENLRLSLYTVPPEGKAEEVMKVKLSGKTGRRADIALIEGSLLVMAVGEAALRFWDIERGENYILSPDEKFGFEKGENMNCVCYCKVKGLLAAGTDRGRVAMWRKVPDSHCHAPSPSRSATTAWRTPGSWTRRWWKRQMTTPEGPGPQDQRAAAERHLLEFFRQLWQSQHFCWEKTCLCWNTRQSWARTQRPGPAEGVTRLHLALSHLPLGARQLH

SEQ ID NO: 863371 - protein, 125 aa, Homo sapiens
MALYYDHQIEAPDAAGSPSFISWHPVHPFLAVAYISTTSTGSVDIYLEQGECVPDTHVERPFRVASLCWHPTRLVLAVGWETGEVTVFNKQDKEQHTMPLTHTADITVLRWSPTLSTLVAPIALG

SEQ ID NO: 863372 - protein, 1102 aa, Homo sapiens
KGVQMDRAVMLYHKAGHFSKALELAFATQQFVALQLIAEDLDETSDPALLARCSDFFIEHSQYERAVELLLLSTGVAHSLRTDMHISGVFATKDAVAVWNGRQVAIFELSGAAIRSAGTFLCETPVLAMHEENVYTVESNRVQVRTWQGTVKQLLLFSETEGNPCFLDICGNFLVVGTDLAHFKSFDLSRREAKAHCSCRSLAELVPGVGGIASLRCSSSGSTISILPSKADNSPDSKICFYDVEMDTVTVFDFKTGQIDRRETLSFNEQETNKSHLFVDEGLKNYVPVNHFWDQSEPRLFVCEAVQETPRSQPQSANGQPQDGRAGPAADVLILSFFISEEHGFLLHESFPRPATSHSLLGMEVPYYYFTRKPEEADREDEVEPGCHHIPQMVSRRPLRDFVGLEDCDKATRDAMLHFSFFVTIGDMDEAFKSIKLIKSEAVWENMARMCVKTQRLDVAKVCLGNMGHARGARALREAEQEPELEARVAVLATQLGMLEDAEQLYRKCKRHDLLNKFYQAAGRWQEALQVAEHHDRVHLRSTYHRYAGHLEASADCSRALSYYEKSDTHRFEVPRMLSEDLPSLELYVNKMKDKTLWRWWAQYLESQGEMDAALHYYELARDHFSLVRIHCFQGNVQKAAQIANETGNLAASYHLARQYESQEEVGQAVHFYTRAQAFKNAIRLCKENGLDDQLMNLALLSSPEDMIEAARYYEEKGVQMDRAVMLYHKAGHFSKALELAFATQQFVALQLIAEDLDETSDPALLARCSDFFIEHSQYERAVELLLAARKYQEALQLCLGQNMSITEEMAEKMTVAKDSSDLPEESRRELLEQIADCCMRQGSYHLATKKYTQAGNKLKAMRALLKSGDTEKITFFASVSRQKEIYIMAANYLQSLDWRKEPEIMKNIIGFYTKGRALDLLAGFYDACAQVEIDEYQNYDKAHGALTEAYKCLAKAKAKSPLDQETRLAQLQSRMALVKRFIQARRTYTEDPKESIKQCELLLEEPDLDSTIRIGDVYGFLVEHYVRKEEYQTAYRFLEEMRRRLPLANMSYYVSPQAVDAVHRGLGLPLPRTVPEQVRHNSMEDARELDEEVVEEADDDP

SEQ ID NO: 863373 - protein, 1419 aa, Homo sapiens
MALYYDHQIEAPDAAGSPSFISWHPVHPFLAVAYISTTSTGSVDIYLEQGECVPDTHVERPFRVASLCWHPTRLVLAVGWETGEVTVFNKQDKEQHTMPLTHTADITVLRWSPSGNCLLSGDRLGVLLLWRLDQRGRVQGTPLLKHEYGKHLTHCIFRLPPPGEDLVQLAKAAVSGDEKALDMFNWKKSSSGSLLKMGSHEGLLFFVSLMDGTVHYVDEKGKTTQVVSADSTIQMLFYMEKREALVVVTENLRLSLYTVPPEGKAEEVMKVKLSGKTGRRADIALIEGSLLVMAVGEAALRFWDIERGENYILSPDEKFGFEKGENMNCVCYCKVKGLLAAGTDRGRVAMWRKVPDFLGSPGAEGKDRWALQTPTELQGNITQIQWGSRKNLLAVNSVISVAILSERAMSSHFHQQVAAMQVSPSLLNVCFLSTGVAHSLRTDMHISGVFATKDAVAVWNGRQVAIFELSGAAIRSAGTFLCETPVLAMHEENVYTVESNRVQVRTWQGTVKQLLLFSETEGNPCFLDICGNFLVVGTDLAHFKSFDLSRREAKAHCSCRSLAELVPGVGGIASLRCSSSGSTISILPSKADNSPDSKICFYDVEMDTVTVFDFKTGQIDRRETLSFNEQETNKSHLFVDEGLKNYVPVNHFWDQSEPRLFVCEAVQETPRSQPQSANGQPQDGRAGPAADVLILSFFISEEHGFLLHESFPRPATSHSLLGMEVPYYYFTRKPEEADREDEVEPGCHHIPQMVSRRPLRDFVGLEDCDKATRDAMLHFSFFVTIGDMDEAFKSIKLIKSEAVWENMARMCVKTQRLDVAKVCLGNMGHARGARALREAEQEPELEARVAVLATQLGMLEDAEQLYRKCKRHDLLNKFYQAAGRWQEALQVAEHHDRVHLRSTYHRYAGHLEASADCSRALSYYEKSDTHRFEVPRMLSEDLPSLELYVNKMKDKTLWRWWAQYLESQGEMDAALHYYELARDHFSLVRIHCFQGNVQKAAQIANETGNLAASYHLARQYESQEEVGQAVHFYTRAQAFKNAIRLCKENGLDDQLMNLALLSSPEDMIEAARYYEEKGVQMDRAVMLYHKAGHFSKALELAFATQQFVALQLIAEDLDETSDPALLARCSDFFIEHSQYERAVELLLAARKYQEALQLCLGQNMSITEEMAEKMTVAKDSSDLPEESRRELLEQIADCCMRQGSYHLATKKYTQAGNKLKAMRALLKSGDTEKITFFASVSRQKEIYIMAANYLQSLDWRKEPEIMKNIIGFYTKGRALDLLAGFYDACAQVEIDEYQNYDKAHGALTEAYKCLAKAKAKSPLDQETRLAQLQSRMALVKRFIQARRTYTEDPKESIKQCELLLEEPDLDSTIRIGDVYGFLVEHYVRKEEYQTVRPECCSLAASRHTRLLKRRLNGSN

SEQ ID NO: 863374 - protein, 1017 aa, Homo sapiens
MALYYDHQIEAPDAAGSPSFISWHPVHPFLAVAYISTTSTGSVDIYLEQGECVPDTHVERPFRVASLCWHPTRLVLAVGWETGEVTVFNKQDKEQHTMPLTHTADITVLRWSPSGNCLLSGDRLGVLLLWRLDQRGRVQGTPLLKHEYGKHLTHCIFRLPPPGEDLVQLAKAAVSGDEKALDMFNWKKSSSGSLLKMGSHEGLLFFVSLMDGTVHYVDEKGKTTQVVSADSTIQMLFYMEKREALVVVTENLRLSLYTVPPEGKAEEVMKVKLSGKTGRRADIALIEGSLLVMAVGEAALRFWDIERGENYILSPDEKFGFEKGENMNCVCYCKVKGLLAAGTDRGRVAMWRKVPDFLGSPGAEGKDRWALQTPTELQGNITQIQWGSRKNLLAVNSVISVAILSERAMSSHFHQQVAAMQVSPSLLNVCFLSTGVAHSLRTDMHISGVFATKDAVAVWNGRQVAIFELSGAAIRSAGTFLCETPVLAMHEENVYTVESNRVQVRTWQGTVKQLLLFSETEGNPCFLDICGNFLVVGTDLAHFKSFDLSRREAKAHCSCRSLAELVPGVGGIASLRCSSSGSTISILPSKADNSPDSKICFYDVEMDTVTVFDFKTGQIDRRETLSFNEQETNKSHLFVDEGLKNYVPVNHFWDQSEPRLFVCEAVQETPRSQPQSANGQPQDGRAGPAADVLILSFFISEEHGFLLHESFPRPATSHSLLGMEVPYYYFTRKPEEADREDEVEPGCHHIPQMVSRRPLRDFVGLEDCDKATRDAMLHFSFFVTIGDMDEAFKSIKLIKSEAVWENMARMCVKTQRLDVAKVCLGNMGHARGARALREAEQEPELEARVAVLATQLGMLEDAEQLYRKCKRHDLLNKFYQAAGRWQEALQVAEHHDRVHLRSTYHRYAGHLEASADCSRALSYYEKSDTHRFEVPRMLSEDLPSLELYVNKMKDKTPWAVLGPDLGSLGASFRVRQAAAASPGAPTWSRARSKAGRNSRDMKQCGGHNVSRQMNTRA

SEQ ID NO: 863375 - protein, 800 aa, Homo sapiens [sequence omitted]

SEQ ID NO: 863376 - protein, 96 aa, Homo sapiens
TVHYVDEKGKTTQVVSADSTIQMLFYMEKREALVVVTENLRLSLYTVPPEGKAEEVMKVSGSGLGGSRWGSWARFSLASLTALSLLDSKTEKKPIN

SEQ ID NO: 863377 - protein, 185 aa, Homo sapiens
LLVNICLSAEGFLPHKGAKSRGRGLGEGFSFTYELTNTWVLCHLARRSRQRRRGGAWVPPHPSDGVQETPARLCGAGGLRQGHPGRHAPLQLLCHHRRHGRSLQIHQAHQKVRIPTTGMLGDSACSRLFPFSLFAFLVRLLKYLTPHDCVMVYFMVFPLDEMLPSLQMPRGKLSASLVLGASRAV

SEQ ID NO: 863378 - protein, 1221 aa, Homo sapiens
MALYYDHQIEAPDAAGSPSFISWHPVHPFLAVAYISTTSTGSVDIYLEQGECVPDTHVERPFRVASLCWHPTRLVLAVGWETGEVTVFNKQDKEQHTMPLTHTADITVLRWSPSGNCLLSGDRLGVLLLWRLDQRGRVQGTPLLKHEYGKHLTHCIFRLPPPGEDLVQLAKAAVSGDEKALDMFNWKKSSSGSLLKMGSHEGLLFFVSLMDGTVHYVDEKGKTTQVVSADSTIQMLFYMEKREALVVVTENLRLSLYTVPPEGKAEEVMKVKLSGKTGRRADIALIEGSLLVMAVGEAALRFWDIERGENYILSPDEKFGFEKGENMNCVCYCKVKGLLAAGTDRGRVAMWRKVPDFLGSPGAEGKDRWALQTPTELQGNITQIQWGSRKNLLAVNSVISVAILSERAMSSHFHQQVAAMQVSPSLLNVCFLSTGVAHSLRTDMHISGVFATKDAVAVWNGRQVAIFELSGAAIRSAGTFLCETPVLAMHEENVYTVESNRVQVRTWQGTVKQLLLFSETEGNPCFLDICGNFLVVGTDLAHFKSFDLSRREAKAHCSCRSLAELVPGVGGIASLRCSSSGSTISILPSKADNSPDSKICFYDVEMDTVTVFDFKTGQIDRRETLSFNEQETNKSHLFVDEGLKNYVPVNHFWDQSEPRLFVCEAVQETPRSQPQSANGQPQDGRAGPAADVLILSFFISEEHGFLLHESFPRPATSHSLLGMEVPYYYFTRKPEEADREDEVEPGCHHIPQMVSRRPLRDFVGLEDCDKATRDAMLHFSFFVTIGDMDEAFKSIKLIKSEAVWENMARMCVKTQRLDVAKVCLGNMGHARGARALREAEQEPELEARVAVLATQLGMLEDAEQLYRKCKRHDLLNKFYQAAGRWQEALQVAEHHDRVHLRSTYHRYAGHYQEALQLCLGQNMSITEEMAEKMTVAKDSSDLPEESRRELLEQIADCCMRQGSYHLATKKYTQAGNKLKAMRALLKSGDTEKITFFASVSRQKEIYIMAANYLQSLDWRKEPEIMKNIIGFYTKGRALDLLAGFYDACAQVEIDEYQNYDKAHGALTEAYKCLAKAKAKSPLDQETRLAQLQSRMALVKRFIQARRTYTEDPKESIKQCELLLEEPDLDSTIRIGDVYGFLVEHYVRKEEYQTAYRFLEEMRRRLPLANMSYYVSPQAVDAVHRGLGLPLPRTVPEQVRHNSMEDARELDEEVVEEADDDP

SEQ ID NO: 863379 - protein, 618 aa, Homo sapiens
MARMCVKTQRLDVAKEDAEQLYRKCKRHDLLNKFYQAAGRWQEALQVAEHHDRVHLRSTYHRYAGHLEASADCSRALSYYEKSDTHRFEVPRMLSEDLPSLELYVNKMKDKTLWRWWAQYLESQGEMDAALHYYELARDHFSLVRIHCFQGNVQKAAQIANETGNLAASYHLARQYESQEEVGQAVHFYTRAQAFKNAIRLCKENGLDDQLMNLALLSSPEDMIEAARYYEEKGVQMDRAVMLYHKAGHFSKALELAFATQQFVALQLIAEDLDETSDPALLARCSDFFIEHSQYERAVELLLAARKYQEALQLCLGQNMSITEEMAEKMTVAKDSSDLPEESRRELLEQIADCCMRQGSYHLATKKYTQAGNKLKAMRALLKSGDTEKITFFASVSRQKEIYIMAANYLQSLDWRKEPEIMKNIIGFYTKGRALDLLAGFYDACAQVEIDEYQNYDKAHGALTEAYKCLAKAKAKSPLDQETRLAQLQSRMALVKRFIQARRTYTEDPKESIKQCELLLEEPDLDSTIRIGDVYGFLVEHYVRKEEYQTAYRFLEEMRRRLPLANMSYYVSPQAVDAVHRGLGLPLPRTVPEQVRHNSMEDARELDEEVVEEADDDP

SEQ ID NO: 863380 - protein, 1062 aa, Homo sapiens [sequence omitted]

SEQ ID NO: 863381 - protein, 740 aa, Homo sapiens
MALYYDHQIEAPDAAGSPSFISWHPVHPFLAVAYISTTSTGSVDIYLEQGECVPDTHVERPFRVASLCWHPTRLVLAVGWETGEVTVFNKQDKEQHTMPLTHTADITVLRWSPSGNCLLSGDRLGVLLLWRLDQRGRVQGTPLLKHEYGKHLTHCIFRLPPPGEDLVQLAKAAVSGDEKALDMFNWKKSSSGSLLKMGSHEGLLFFVSLMDGTVHYVDEKGKTTQVVSADSTIQMLFYMEKREALVVVTENLRLSLYTVPPEGKAEEVMKVKLSGKTGRRADIALIEGSLLVMAVGEAALRFWDIERGENYILSPDEKFGFEKGENMNCVCYCKVKGLLAAGTDRGRVAMWRKVPDFLGSPGAEGKDRWALQTPTELQGNITQIQWGSRKNLLAVNSVISVAILSERAMSSHFHQQVAAMQVSPSLLNVCFLSTGVAHSLRTDMHISGVFATKDAVAVWNGRQVAIFELSGAAIRSAGTFLCETPVLAMHEENVYTVESNRVQVRTWQGTVKQLLLFSETEGNPCFLDICGNFLVVGTDLAHFKSFDLSRREAKAHCSCRSLAELVPGVGGIASLRCSSSGSTISILPSKADNSPDSKICFYDVEMDTVTVFDFKTGQIDRRETLSFNEQETNKSHLFVDEGLKNYVPVNHFWDQSEPRLFVCEAVQETPRSQPQSANGQPQDGRAGPAADVLILSFFISEEHGFLLHESFPRPATSHSLLGMEVPYYYFTRKVRSHDIR

SEQ ID NO: 863382 - protein, 516 aa, Homo sapiens
MGDPSKQDILTIFKRLRSVPTNKVCFDCGAKNPSWASITYGVFLCIDCSGSHRSLGVHLSFIRSTELDSNWSWFQLRCMQVGGNASASSFFHQHGCSTNDTNAKYNSRAAQLYREKIKSLASQATRKHGTDLWLDSCVVPPLSPPPKEEDFFASHVSPEVSDTAWASAIAEPSSLTSRPVETTLENNEGGQEQGPSVEGLNVPTKATLEVSSIIKKKPNQAKKGLGAKKGSLGAQKLANTCFNEIEKQAQAADKMKEQEDLAKVVSKEESIVSSLRLAYKDLEIQMKKDEKMNISGKKNVDSDRLGMGFGNCRSVISHSVTSDMQTIEQESPIMAKPRKKYNDDSDDSYFTSSSRYFDEPVELRSSSFSSWDDSSDSYWKKETSKDTETVLKTTGYSDRPTARRKPDYEPVENTDEAQKKFGNVKAISSDMYFGRQSQADYETRARLERLSASSSISSADLFEEPRKQPAGNYSLSSVLPNAPDMAQFKQGVRSVAGKLSVFANGVVTSIQDRYGS

SEQ ID NO: 863383 - protein, 516 aa, Homo sapiens; identical to SEQ ID NO: 863382

SEQ ID NO: 863384 - protein, 516 aa, Homo sapiens; identical to SEQ ID NO: 863382

SEQ ID NO: 863385 - protein, 438 aa, Homo sapiens [sequence omitted]

SEQ ID NO: 863386 - protein, 528 aa, Homo sapiens
MGDPSKQDILTIFKRLRSVPTNKVCFDCGAKNPSWASITYGVFLCIDCSGSHRSLGVHLSFIRSTELDSNWSWFQLRCMQVGGNASASSFFHQHGCSTNDTNAKYNSRAAQLYREKIKSLASQATRKHGTDLWLDSCVVPPLSPPPKEEDFFASHVSPEVSDTAWASAIAEPSSLTSRPVETTLENNEGGQEQGPSVEGLNVPTKATLEVSSIIKKKPNQAKKGLGAKKGSLGAQKLANTCFNEIEKQAQAADKMKEQEDLAKVVSKEESIVSSLRLAYKDLEIQMKKDEKMNISGKKNVDSDRLGMGFGNCRSVISHSVTSDMQTIEQESPIMAKPRKKYNDDSDDSYFTSSSRYFDEPVELRSSSFSSWDDSSDSYWKKETSKDTETVLKTTGYSDRPTARRKPDYEPVENTDEAQKKFGNVKAISSDMYFGRQSQADYETRARLERLSASSSISSADLFEEPRKQPAGNYSLSSVLPNAPDMAQFKQGVRSVAGKLSVFANGVVTSIQVKELRHRRLGHFCKMTS

SEQ ID NO: 863387 - protein, 262 aa, Homo sapiens [sequence omitted]

SEQ ID NO: 863388 - protein, 208 aa, Homo sapiens
MRNCRSVISHSVTSDMQTIEQESPIMAKPRKKYNDDSDDSYFTSSSRYFDEPVELRSSSFSSWDDSSDSYWKKETSKDTETVLKTTGYSDRPTARRKPDYEPVENTDEAQKKFGNVKAISSDMYFGRQSQADYETRARLERLSASSSISSADLFEEPRKQPAGNYSLSSVLPNAPDMAQFKQGVRSVAGKLSVFANGVVTSIQDRYGS

SEQ ID NO: 863389 - protein, 528 aa, Homo sapiens
MGDPSKQDILTIFKRLRSVPTNKVCFDCGAKNPSWASITYGVFLCIDCSGSHRSLGVHLSFIRSTELDSNWSWFQLRCMQVGGNASASSFFHQHGCSTNDTNAKYNSRAAQLYREKIKSLASQATRKHGTDLWLDSCVVPPLSPPPKEEDFFASHVSPEVSDTAWASAIAEPSSLTSRPVETTLENNEGGQEQGPSVEGLNVPTKATLEVSSIIKKKPNQAKKGLGAKKGSLGAQKLANTCFNEIEKQAQAADKMKEQEDLAKVVSKEESIVSSLRLAYKDLEIQMKKDEKMNISGKKNVDSDRLGMGFGNCRSVISHSVTSDMQTIEQESPIMAKPRKKYNDDSDDSYFTSSSRYFDEPVELRSSSFSSWDDSSDSYWKKETSKDTETVLKTTGYSDRPTARRKPDYEPVENTDEAQKKFGNVKAISSDMYFGRQSQADYETRARLERLSASSSISSADLFEEPRKQPAGNYSLSSVLPNAPDMAQFKQGVRSVAGKLSVFANGVVTSIQVSGMGQCSLAMTVGSAV

SEQ ID NO: 863390 - protein, 104 aa, Homo sapiens
MRIPKRSGCECECFPVISVSRSFLSHPPLASLCISLLYFLGTFDFNTEGLETSAPPAPEPGGFMWGRRRGLHVTHGLRAARISGCWMGLQKQHSPHTLPSKDQK

SEQ ID NO: 863391 - protein, 196 aa, Homo sapiens
MGDPSKQDILTIFKRLRSVPTNKVCFDCGAKNPSWASITYGVFLCIDCSGSHRSLGVHLSFIRSTELDSNWSWFQLRCMQVGGNASASSFFHQHGCSTNDTNAKYNSRAAQLYREKIKSLASQATRKHGTDLWLDSCVVPPLSPPPKEEDFFASHVSPEVSDTAWASAIAEPSSLTSRPVETTLENNEGGVLRTVM

SEQ ID NO: 863392 - protein, 141 aa, Homo sapiens
MGDPSKQDILTIFKRLRSVPTNKVCFDCGAKNPSWASITYGVFLCIDCSGSHRSLGVHLSFIRSTELDSNWSWFQLRCMQVGGNASASSFFHQHGCSTNDTNAKYNSRAAQLYREKIKSLASQATRKHGTDVSHWRLDCFL

SEQ ID NO: 863393 - protein, 516 aa, Homo sapiens; identical to SEQ ID NO: 863382

SEQ ID NO: 863394 - protein, 516 aa, Homo sapiens; identical to SEQ ID NO: 863382

SEQ ID NO: 863395 - protein, 516 aa, Homo sapiens; identical to SEQ ID NO: 863382

SEQ ID NO: 863396 - protein, 504 aa, Homo sapiens
MGDPSKQDILTIFKRLRSVPTNKVCFDCGAKNPSWASITYGVFLCIDCSGSHRSLGVHLSFIRSTELDSNWSWFQLRCMQVGGNASASSFFHQHGCSTNDTNAKYNSRAAQLYREKIKSLWLDSCVVPPLSPPPKEEDFFASHVSPEVSDTAWASAIAEPSSLTSRPVETTLENNEGGQEQGPSVEGLNVPTKATLEVSSIIKKKPNQAKKGLGAKKGSLGAQKLANTCFNEIEKQAQAADKMKEQEDLAKVVSKEESIVSSLRLAYKDLEIQMKKDEKMNISGKKNVDSDRLGMGFGNCRSVISHSVTSDMQTIEQESPIMAKPRKKYNDDSDDSYFTSSSRYFDEPVELRSSSFSSWDDSSDSYWKKETSKDTETVLKTTGYSDRPTARRKPDYEPVENTDEAQKKFGNVKAISSDMYFGRQSQADYETRARLERLSASSSISSADLFEEPRKQPAGNYSLSSVLPNAPDMAQFKQGVRSVAGKLSVFANGVVTSIQDRYGS

SEQ ID NO: 863397 - protein, 453 aa, Homo sapiens
MGDPSKQDILTIFKRLRSVPTNKVCFDCGAKNPSWASITYGVFLCIDCSGSHRSLGVHLSFIRSTELDSNWSWFQLRCMQVGGNASASSFFHQHGCSTNDTNAKYNSRAAQLYREKIKSLASQATRKHGTDLWLDSCVVPPLSPPPKEEDFFASHVSPEVSDTAWASAIAEPSSLTSRPVETTLENNEGGQEQGPSVEGLNVPTKATLEVSSIIKKKPNQAKKGLGAKKGSLGAQKLANTCFNEIEKQAQAADKMKEQEDLAKVVSKEESIVSSLRLAYKDLEIQMKKDEKMNISGKKNVDSDRLGMGFGNCRSVISHSVTSDMQTIEQESPIMAKPRKKYNDDSDDSYFTSSSRYFDEPVELRSSSFSSWDDSSDSYWKKETSKDTETVLKTTGYSDRPTARRKPDYEPVENTDEAQKKFGNVKAISSDMYFGRQSQADYETRARLERYPLS

SEQ ID NO: 863398 - protein, 271 aa, Homo sapiens
MGDPSKQDILTIFKRLRSVPTNKVCFDCGAKNPSWASITYGVFLCIDCSGSHRSLGVHLSFIRSTELDSNWSWFQLRCMQVGGNASASSFFHQHGCSTNDTNAKYNSRAAQLYREKIKSLASQATRKHGTDLWLDSCVVPPLSPPPKEEDFFASHVSPEVSDTAWASAIAEPSSLTSRPVETTLENNEGGQEQGPSVEGLNVPTKATLEVSSIIKKKPNQAKKGLGAKKGSLGAQKLANTCFNEIEKQAQAADKMKEQEDLAKVVSKEESM

SEQ ID NO: 863399 - protein, 422 aa, Homo sapiens
SPLQLRLRLQRTRLLRLLLRSVAVRRVHPSQQSPGERGGQSARTSPRGTMPNDEAFSKPSTPSEAPHAPGVPPQGRAGGFGKASGALVGAASGSSAGGSSRGGGSGSGASDLGAGSKKSPRLPKCARCRNHGYASPLKGHKRFCMWRDCQCKKCNLIAERQRVMAAQVALRRQQAQEEELGISHPIPLPSAAELLVKRENNGSNPCLMTECSGTSQPPPASVPTTAASEGRMVIQDIPAVTSRGHVENTPDLVSDSTYYSSFYQPSLFPYYNNLYNCPQYSMALAADSASGEVGNPLGGSPVKNSLRGLPGPYVPGQTGNQWQMKNMENRHAMSSQYRMHSYYPPPSYLGQSVPQFFTFEDAPSYPEARASVFSPPSSQDSGLVSLSSSSPISNKSTKAVLECEPASEPSSFTVTPVIEEDE

SEQ ID NO: 863400 - protein, 68 aa, Homo sapiens
GEVGKYEEEKGEQPKGYVFSPPSSQDSGLVSLSSSSPISNKSTKAVLECEPASEPSSFTVTPVIEEDE

SEQ ID NO: 863401 - protein, 2028 aa, Homo sapiens
MCTMDNFAEGDFTVADYALLEDCPHVDDCVFAAEFMSNDYVRVTQLYCDGVGVQYKDYIQSERNLEFDICSIWCSKPISVLQDYCDAIKINIFWPLLFQHQNSSVISRLHPCVDANNSRASEINLKKLQHLELMEDIVDLAKKVANDSFLIGGLLRIGCKIENKILAMEEALNWIKYAGDVTILTKLGSIDNCWPMLSIFFTEYKYHITKIVMEDCNLLEELKTQSCMDCIEEGELMKMKGNEEFSKERFDIAIIYYTRAIEYRPENYLLYGNRALCFLRTGQFRNALGDGKRATILKNTWPKGHYRYCDALSMLGEYDWALQANIKAQKLCKNDPEGIKDLIQQHVKLQKQIEDLQGRTANKDPIKAFYENRAYTPRSLSAPIFTTSLNFVEKERDFRKINHEMANGGNQNLKVADEALKVDDCDCHPEFSPPSSQPPKHKGKQKSRNNESEKFSSSSPLTLPADLKNILEKQFSKSSRAAHQDFANIMKMLRSLIQDGYMALLEQRCRSAAQAFTELLNGLDPQKIKQLNLAMINYVLVVYGLAISLLGIGQPEELSEAENQFKRIIEHYPSEGLDCLAYCGIGKVYLKKNRFLEALNHFEKARTLIYRLPGVLTWPTSNVIIEESQPQKIKMLLEKFVEECKFPPVPDAICCYQKCHGYSKIQIYITDPDFKGFIRISCCQYCKIEFHMNCWKKLKTTTFNDKIDKDFLQGICLTPDCEGVISKIIIFSSGGEVKCEFEHKVIKEKVPPRPILKQKCSSLEKLRLKEDKKLKRKIQKKEAKKLAQERMEEDLRESNPPKNEEQKETVDNVQRCQFLDDRILQCIKQYADKIKSGIQNTAMLLKELLSWKVLSTEDYTTCFSSRNFLNEAVDYVIRHLIQENNRVKTRIFLHVLSELKEVEPKLAAWIQKLNSFGLDATGTFFSRYGASLKLLDFSIMTFLWNEKYGHKLDSIEGKQLDYFSEPASLKEARCLIWLLEEHRDKFPALHSALDEFFDIMDSRCTVLRKQDSGEAPFSSTKVKNKSKKKKPKDSKPMLVGSGTTSVTSNNEIITSSEDHSNRNSDSAGPFAVPDHLRQDVEEFEALYDQHSNEYVVRNKKLWDMNPKQKCSTLYDYFSQFLEEHGPLDMSNKMFSAEYEFFPEETRQILEKAGGLKPFLLGCPRFVVIDNCIALKKVASRLKKKRKKKNIKTKVEEISKAGEYVRVKLQLNPAAREFKPDVKSKPVSDSSSAPAFENVKPKPVSANSPKPACEDVKAKPVSDNSSRQVSEDGQPKGVSSNSPKPGSEDANYKRVSCNSPKPVLEDVKPTYWAQSHLVTGYCTYLPFQRFDITQTPPAYINVLPGLPQYTSIYTPLASLSPEYQLPRSVPVVPSFVANDRADKNAAAYFEGHHLNAENVAGHQIASETQILEGSLGISVKSHCSTGDAHTVLSESNRNDEHCGNSNNKCEVIPESTSAVTNIPHVQMVAIQVSWNIIHQEVNTEPYNPFEERQGEISRIEKEHQVLQDQLQEVYENYEQIKLKGLEETRDLEEKLKRHLEENKISKTELDWFLQDLEREIKKWQQEKKEIQERLKSLKKKIKKVSNASEMYTQKNDGKEKEHELHLDQSLEISNTLTNEKMKIEEYIKKGKEDYEESHQRAVAAEVSVLENWKESEVYKLQIMESQAEAFLKKLGLISRDPAAYPDMESDIRSWELFLSNVTKEIEKAKSQFEEQIKAIKNGSRLSELSKVQISELSFPACNTVHPELLPESSGHDGQGLVTSASDVTGNHAALHRDPSVFSAGDSPGEAPSALLPGPPPGQPEATQLTGPKRAGQAALSERSPVADRKQPVPPGRAARSSQSPKKPFNSIIEHLSVVFPCYNSTELAGFIKKVRSKNKNSLSGLSIDEIVQRVTEHILDEQKKKKPNPGKDKRTYEPSSATPVTRSSQGSPSVVVAPSPKTKGQKAEDVPVRIALGASSCEICHEVFKSKNVRVLKCGHKYHKGCFKQWLKGQSACPACQGRDLLTEESPSGRGWPSQNQELPSCSSR

SEQ ID NO: 863402 - protein, 1790 aa, Homo sapiens
MKGNEEFSKERFDIAIIYYTRAIEYRPENYLLYGNRALCFLRTGQFRNALGDGKRATILKNTWPKGHYRYCDALSMLGEYDWALQANIKAQKLCKNDPEGIKDLIQQHVKLQKQIEDLQGRTANKDPIKAFYENRAYTPRSLSAPIFTTSLNFVEKERDFRKINHEMANGGNQNLKVADEALKVDDCDCHPEFSPPSSQPPKHKGKQKSRNNESEKFSSSSPLTLPADLKNILEKQFSKSSRAAHQDFANIMKMLRSLIQDGYMALLEQRCRSAAQAFTELLNGLDPQKIKQLNLAMINYVLVVYGLAISLLGIGQPEELSEAENQFKRIIEHYPSEGLDCLAYCGIGKVYLKKNRFLEALNHFEKARTLIYRLPGVLTWPTSNVIIEESQPQKIKMLLEKFVEECKFPPVPDAICCYQKCHGYSKIQIYITDPDFKGFIRISCCQYCKIEFHMNCWKKLKTTTFNDKIDKDFLQGICLTPDCEGVISKIIIFSSGGEVKCEFEHKVIKEKVPPRPILKQKCSSLEKLRLKEDKKLKRKIQKKEAKKLAQERMEEDLRESNPPKNEEQKETVDNVQRCQFLDDRILQCIKQYADKIKSGIQNTAMLLKELLSWKVLSTEDYTTCFSSRNFLNEAVDYVIRHLIQENNRVKTRIFLHVLSELKEVEPKLAAWIQKLNSFGLDATGTFFSRYGASLKLLDFSIMTFLWNEKYGHKLDSIEGKQLDYFSEPASLKEARCLIWLLEEHRDKFPALHSALDEFFDIMDSRCTVLRKQDSGEAPFSSTKVKNKSKKKKPKDSKPMLVGSGTTSVTSNNEIITSSEDHSNRNSDSAGPFAVPDHLRQDVEEFEALYDQHSNEYVVRNKKLWDMNPKQKCSTLYDYFSQFLEEHGPLDMSNKMFSAEYEFFPEETRQILEKAGGLKPFLLGCPRFVVIDNCIALKKVASRLKKKRKKKNIKTKVEEISKAGEYVRVKLQLNPAAREFKPDVKSKPVSDSSSAPAFENVKPKPVSANSPKPACEDVKAKPVSDNSSRQVSEDGQPKGVSSNSPKPGSEDANYKRVSCNSPKPVLEDVKPTYWAQSHLVTGYCTYLPFQRFDITQTPPAYINVLPGLPQYTSIYTPLASLSPEYQLPRSVPVVPSFVANDRADKNAAAYFEGHHLNAENVAGHQIASETQILEGSLGISVKSHCSTGDAHTVLSESNRNDEHCGNSNNKCEVIPESTSAVTNIPHVQMVAIQVSWNIIHQEVNTEPYNPFEERQGEISRIEKEHQVLQDQLQEVYENYEQIKLKGLEETRDLEEKLKRHLEENKISKTELDWFLQDLEREIKKWQQEKKEIQERLKSLKKKIKKVSNASEMYTQKNDGKEKEHELHLDQSLEISNTLTNEKMKIEEYIKKGKEDYEESHQRAVAAEVSVLENWKESEVYKLQIMESQAEAFLKKLGLISRDPAAYPDMESDIRSWELFLSNVTKEIEKAKSQFEEQIKAIKNGSRLSELSKVQISELSFPACNTVHPELLPESSGHDGQGLVTSASDVTGNHAALHRDPSVFSAGDSPGEAPSALLPGPPPGQPEATQLTGPKRAGQAALSERSPVADRKQPVPPGRAARSSQSPKKPFNSIIEHLSVVFPCYNSTELAGFIKKVRSKNKNSLSGLSIDEIVQRVTEHILDEQKKKKPNPGKDKRTYEPSSATPVTRSSQGSPSVVVAPSPKTKGQKAEDVPVRIALGASSCEICHEVFKSKNVRVLKCGHKYHKGCFKQWLKGQSACPACQGRDLLTEESPSGRGWPSQNQELPSCSSR

SEQ ID NO: 863403 - protein, 2025 aa, Homo sapiens
MDNFAEGDFTVADYALLEDCPHVDDCVFAAEFMSNDYVRVTQLYCDGVGVQYKDYIQSERNLEFDICSIWCSKPISVLQDYCDAIKINIFWPLLFQHQNSSVISRLHPCVDANNSRASEINLKKLQHLELMEDIVDLAKKVANDSFLIGGLLRIGCKIENKILAMEEALNWIKYAGDVTILTKLGSIDNCWPMLSIFFTEYKYHITKIVMEDCNLLEELKTQSCMDCIEEGELMKMKGNEEFSKERFDIAIIYYTRAIEYRPENYLLYGNRALCFLRTGQFRNALGDGKRATILKNTWPKGHYRYCDALSMLGEYDWALQANIKAQKLCKNDPEGIKDLIQQHVKLQKQIEDLQGRTANKDPIKAFYENRAYTPRSLSAPIFTTSLNFVEKERDFRKINHEMANGGNQNLKVADEALKVDDCDCHPEFSPPSSQPPKHKGKQKSRNNESEKFSSSSPLTLPADLKNILEKQFSKSSRAAHQDFANIMKMLRSLIQDGYMALLEQRCRSAAQAFTELLNGLDPQKIKQLNLAMINYVLVVYGLAISLLGIGQPEELSEAENQFKRIIEHYPSEGLDCLAYCGIGKVYLKKNRFLEALNHFEKARTLIYRLPGVLTWPTSNVIIEESQPQKIKMLLEKFVEECKFPPVPDAICCYQKCHGYSKIQIYITDPDFKGFIRISCCQYCKIEFHMNCWKKLKTTTFNDKIDKDFLQGICLTPDCEGVISKIIIFSSGGEVKCEFEHKVIKEKVPPRPILKQKCSSLEKLRLKEDKKLKRKIQKKEAKKLAQERMEEDLRESNPPKNEEQKETVDNVQRCQFLDDRILQCIKQYADKIKSGIQNTAMLLKELLSWKVLSTEDYTTCFSSRNFLNEAVDYVIRHLIQENNRVKTRIFLHVLSELKEVEPKLAAWIQKLNSFGLDATGTFFSRYGASLKLLDFSIMTFLWNEKYGHKLDSIEGKQLDYFSEPASLKEARCLIWLLEEHRDKFPALHSALDEFFDIMDSRCTVLRKQDSGEAPFSSTKVKNKSKKKKPKDSKPMLVGSGTTSVTSNNEIITSSEDHSNRNSDSAGPFAVPDHLRQDVEEFEALYDQHSNEYVVRNKKLWDMNPKQKCSTLYDYFSQFLEEHGPLDMSNKMFSAEYEFFPEETRQILEKAGGLKPFLLGCPRFVVIDNCIALKKVASRLKKKRKKKNIKTKVEEISKAGEYVRVKLQLNPAAREFKPDVKSKPVSDSSSAPAFENVKPKPVSANSPKPACEDVKAKPVSDNSSRQVSEDGQPKGVSSNSPKPGSEDANYKRVSCNSPKPVLEDVKPTYWAQSHLVTGYCTYLPFQRFDITQTPPAYINVLPGLPQYTSIYTPLASLSPEYQLPRSVPVVPSFVANDRADKNAAAYFEGHHLNAENVAGHQIASETQILEGSLGISVKSHCSTGDAHTVLSESNRNDEHCGNSNNKCEVIPESTSAVTNIPHVQMVAIQVSWNIIHQEVNTEPYNPFEERQGEISRIEKEHQVLQDQLQEVYENYEQIKLKGLEETRDLEEKLKRHLEENKISKTELDWFLQDLEREIKKWQQEKKEIQERLKSLKKKIKKVSNASEMYTQKNDGKEKEHELHLDQSLEISNTLTNEKMKIEEYIKKGKEDYEESHQRAVAAEVSVLENWKESEVYKLQIMESQAEAFLKKLGLISRDPAAYPDMESDIRSWELFLSNVTKEIEKAKSQFEEQIKAIKNGSRLSELSKVQISELSFPACNTVHPELLPESSGHDGQGLVTSASDVTGNHAALHRDPSVFSAGDSPGEAPSALLPGPPPGQPEATQLTGPKRAGQAALSERSPVADRKQPVPPGRAARSSQSPKKPFNSIIEHLSVVFPCYNSTELAGFIKKVRSKNKNSLSGLSIDEIVQRVTEHILDEQKKKKPNPGKDKRTYEPSSATPVTRSSQGSPSVVVAPSPKTKGQKAEDVPVRIALGASSCEICHEVFKSKNVRVLKCGHKYHKGCFKQWLKGQSACPACQGRDLLTEESPSGRGWPSQNQELPSCSSR

SEQ ID NO: 863404 - protein, 2069 aa, Homo sapiens
PDIFSLTKRTYHKNIFTQIALNQKTSIHNVKNEKLANLLTTLCTMDNFAEGDFTVADYALLEDCPHVDDCVFAAEFMSNDYVRVTQLYCDGVGVQYKDYIQSERNLEFDICSIWCSKPISVLQDYCDAIKINIFWPLLFQHQNSSVISRLHPCVDANNSRASEINLKKLQHLELMEDIVDLAKKVANDSFLIGGLLRIGCKIENKILAMEEALNWIKYAGDVTILTKLGSIDNCWPMLSIFFTEYKYHITKIVMEDCNLLEELKTQSCMDCIEEGELMKMKGNEEFSKERFDIAIIYYTRAIEYRPENYLLYGNRALCFLRTGQFRNALGDGKRATILKNTWPKGHYRYCDALSMLGEYDWALQANIKAQKLCKNDPEGIKDLIQQHVKLQKQIEDLQGRTANKDPIKAFYENRAYTPRSLSAPIFTTSLNFVEKERDFRKINHEMANGGNQNLKVADEALKVDDCDCHPEFSPPSSQPPKHKGKQKSRNNESEKFSSSSPLTLPADLKNILEKQFSKSSRAAHQDFANIMKMLRSLIQDGYMALLEQRCRSAAQAFTELLNGLDPQKIKQLNLAMINYVLVVYGLAISLLGIGQPEELSEAENQFKRIIEHYPSEGLDCLAYCGIGKVYLKKNRFLEALNHFEKARTLIYRLPGVLTWPTSNVIIEESQPQKIKMLLEKFVEECKFPPVPDAICCYQKCHGYSKIQIYITDPDFKGFIRISCCQYCKIEFHMNCWKKLKTTTFNDKIDKDFLQGICLTPDCEGVISKIIIFSSGGEVKCEFEHKVIKEKVPPRPILKQKCSSLEKLRLKEDKKLKRKIQKKEAKKLAQERMEEDLRESNPPKNEEQKETVDNVQRCQFLDDRILQCIKQYADKIKSGIQNTAMLLKELLSWKVLSTEDYTTCFSSRNFLNEAVDYVIRHLIQENNRVKTRIFLHVLSELKEVEPKLAAWIQKLNSFGLDATGTFFSRYGASLKLLDFSIMTFLWNEKYGHKLDSIEGKQLDYFSEPASLKEARCLIWLLEEHRDKFPALHSALDEFFDIMDSRCTVLRKQDSGEAPFSSTKVKNKSKKKKPKDSKPMLVGSGTTSVTSNNEIITSSEDHSNRNSDSAGPFAVPDHLRQDVEEFEALYDQHSNEYVVRNKKLWDMNPKQKCSTLYDYFSQFLEEHGPLDMSNKMFSAEYEFFPEETRQILEKAGGLKPFLLGCPRFVVIDNCIALKKVASRLKKKRKKKNIKTKVEEISKAGEYVRVKLQLNPAAREFKPDVKSKPVSDSSSAPAFENVKPKPVSANSPKPACEDVKAKPVSDNSSRQVSEDGQPKGVSSNSPKPGSEDANYKRVSCNSPKPVLEDVKPTYWAQSHLVTGYCTYLPFQRFDITQTPPAYINVLPGLPQYTSIYTPLASLSPEYQLPRSVPVVPSFVANDRADKNAAAYFEGHHLNAENVAGHQIASETQILEGSLGISVKSHCSTGDAHTVLSESNRNDEHCGNSNNKCEVIPESTSAVTNIPHVQMVAIQVSWNIIHQEVNTEPYNPFEERQGEISRIEKEHQVLQDQLQEVYENYEQIKLKGLEETRDLEEKLKRHLEENKISKTELDWFLQDLEREIKKWQQEKKEIQERLKSLKKKIKKVSNASEMYTQKNDGKEKEHELHLDQSLEISNTLTNEKMKIEEYIKKGKEDYEESHQRAVAAEVSVLENWKESEVYKLQIMESQAEAFLKKLGLISRDPAAYPDMESDIRSWELFLSNVTKEIEKAKSQFEEQIKAIKNGSRLSELSKVQISELSFPACNTVHPELLPESSGHDGQGLVTSASDVTGNHAALHRDPSVFSAGDSPGEAPSALLPGPPPGQPEATQLTGPKRAGQAALSERSPVADRKQPVPPGRAARSSQSPKKPFNSIIEHLSVVFPCYNSTELAGFIKKVRSKNKNSLSGLSIDEIVQRVTEHILDEQKKKKPNPGKDKRTYEPSSATPVTRSSQGSPSVVVAPSPKTKGQKAEDVPVRIALGASSCEICHEVFKSKNVRVLKCGHKYHKGCFKQWLKGQSACPACQGRDLLTEESPSGRGWPSQNQELPSCSSR

SEQ ID NO: 863405 - protein, 1914 aa, Homo sapiens
MYNSRASEINLKKLQHLELMEDIVDLAKKVANDSFLIGGLLRIGCKIENKILAMEEALNWIKYAGDVTILTKLGSIDNCWPMLSIFFTEYKYHITKIVMEDCNLLEELKTQSCMDCIEEGELMKMKGNEEFSKERFDIAIIYYTRAIEYRPENYLLYGNRALCFLRTGQFRNALGDGKRATILKNTWPKGHYRYCDALSMLGEYDWALQANIKAQKLCKNDPEGIKDLIQQHVKLQKQIEDLQGRTANKDPIKAFYENRAYTPRSLSAPIFTTSLNFVEKERDFRKINHEMANGGNQNLKVADEALKVDDCDCHPEFSPPSSQPPKHKGKQKSRNNESEKFSSSSPLTLPADLKNILEKQFSKSSRAAHQDFANIMKMLRSLIQDGYMALLEQRCRSAAQAFTELLNGLDPQKIKQLNLAMINYVLVVYGLAISLLGIGQPEELSEAENQFKRIIEHYPSEGLDCLAYCGIGKVYLKKNRFLEALNHFEKARTLIYRLPGVLTWPTSNVIIEESQPQKIKMLLEKFVEECKFPPVPDAICCYQKCHGYSKIQIYITDPDFKGFIRISCCQYCKIEFHMNCWKKLKTTTFNDKIDKDFLQGICLTPDCEGVISKIIIFSSGGEVKCEFEHKVIKEKVPPRPILKQKCSSLEKLRLKEDKKLKRKIQKKEAKKLAQERMEEDLRESNPPKNEEQKETVDNVQRCQFLDDRILQCIKQYADKIKSGIQNTAMLLKELLSWKVLSTEDYTTCFSSRNFLNEAVDYVIRHLIQENNRVKTRIFLHVLSELKEVEPKLAAWIQKLNSFGLDATGTFFSRYGASLKLLDFSIMTFLWNEKYGHKLDSIEGKQLDYFSEPASLKEARCLIWLLEEHRDKFPALHSALDEFFDIMDSRCTVLRKQDSGEAPFSSTKVKNKSKKKKPKDSKPMLVGSGTTSVTSNNEIITSSEDHSNRNSDSAGPFAVPDHLRQDVEEFEALYDQHSNEYVVRNKKLWDMNPKQKCSTLYDYFSQFLEEHGPLDMSNKMFSAEYEFFPEETRQILEKAGGLKPFLLGCPRFVVIDNCIALKKVASRLKKKRKKKNIKTKVEEISKAGEYVRVKLQLNPAAREFKPDVKSKPVSDSSSAPAFENVKPKPVSANSPKPACEDVKAKPVSDNSSRQVSEDGQPKGVSSNSPKPGSEDANYKRVSCNSPKPVLEDVKPTYWAQSHLVTGYCTYLPFQRFDITQTPPAYINVLPGLPQYTSIYTPLASLSPEYQLPRSVPVVPSFVANDRADKNAAAYFEGHHLNAENVAGHQIASETQILEGSLGISVKSHCSTGDAHTVLSESNRNDEHCGNSNNKCEVIPESTSAVTNIPHVQMVAIQVSWNIIHQEVNTEPYNPFEERQGEISRIEKEHQVLQDQLQEVYENYEQIKLKGLEETRDLEEKLKRHLEENKISKTELDWFLQDLEREIKKWQQEKKEIQERLKSLKKKIKKVSNASEMYTQKNDGKEKEHELHLDQSLEISNTLTNEKMKIEEYIKKGKEDYEESHQRAVAAEVSVLENWKESEVYKLQIMESQAEAFLKKLGLISRDPAAYPDMESDIRSWELFLSNVTKEIEKAKSQFEEQIKAIKNGSRLSELSKVQISELSFPACNTVHPELLPESSGHDGQGLVTSASDVTGNHAALHRDPSVFSAGDSPGEAPSALLPGPPPGQPEATQLTGPKRAGQAALSERSPVADRKQPVPPGRAARSSQSPKKPFNSIIEHLSVVFPCYNSTELAGFIKKVRSKNKNSLSGLSIDEIVQRVTEHILDEQKKKKPNPGKDKRTYEPSSATPVTRSSQGSPSVVVAPSPKTKGQKAEDVPVRIALGASSCEICHEVFKSKNVRVLKCGHKYHKGCFKQWLKGQSACPACQGRDLLTEESPSGRGWPSQNQELPSCSSR

SEQ ID NO: 863406 - protein, 1715 aa, Homo sapiens
MLGEYDWALQANIKAQKLCKNDPEGIKDLIQQHVKLQKQIEDLQGRTANKDPIKAFYENRAYTPRSLSAPIFTTSLNFVEKERDFRKINHEMANGGNQNLKVADEALKVDDCDCHPEFSPPSSQPPKHKGKQKSRNNESEKFSSSSPLTLPADLKNILEKQFSKSSRAAHQDFANIMKMLRSLIQDGYMALLEQRCRSAAQAFTELLNGLDPQKIKQLNLAMINYVLVVYGLAISLLGIGQPEELSEAENQFKRIIEHYPSEGLDCLAYCGIGKVYLKKNRFLEALNHFEKARTLIYRLPGVLTWPTSNVIIEESQPQKIKMLLEKFVEECKFPPVPDAICCYQKCHGYSKIQIYITDPDFKGFIRISCCQYCKIEFHMNCWKKLKTTTFNDKIDKDFLQGICLTPDCEGVISKIIIFSSGGEVKCEFEHKVIKEKVPPRPILKQKCSSLEKLRLKEDKKLKRKIQKKEAKKLAQERMEEDLRESNPPKNEEQKETVDNVQRCQFLDDRILQCIKQYADKIKSGIQNTAMLLKELLSWKVLSTEDYTTCFSSRNFLNEAVDYVIRHLIQENNRVKTRIFLHVLSELKEVEPKLAAWIQKLNSFGLDATGTFFSRYGASLKLLDFSIMTFLWNEKYGHKLDSIEGKQLDYFSEPASLKEARCLIWLLEEHRDKFPALHSALDEFFDIMDSRCTVLRKQDSGEAPFSSTKVKNKSKKKKPKDSKPMLVGSGTTSVTSNNEIITSSEDHSNRNSDSAGPFAVPDHLRQDVEEFEALYDQHSNEYVVRNKKLWDMNPKQKCSTLYDYFSQFLEEHGPLDMSNKMFSAEYEFFPEETRQILEKAGGLKPFLLGCPRFVVIDNCIALKKVASRLKKKRKKKNIKTKVEEISKAGEYVRVKLQLNPAAREFKPDVKSKPVSDSSSAPAFENVKPKPVSANSPKPACEDVKAKPVSDNSSRQVSEDGQPKGVSSNSPKPGSEDANYKRVSCNSPKPVLEDVKPTYWAQSHLVTGYCTYLPFQRFDITQTPPAYINVLPGLPQYTSIYTPLASLSPEYQLPRSVPVVPSFVANDRADKNAAAYFEGHHLNAENVAGHQIASETQILEGSLGISVKSHCSTGDAHTVLSESNRNDEHCGNSNNKCEVIPESTSAVTNIPHVQMVAIQVSWNIIHQEVNTEPYNPFEERQGEISRIEKEHQVLQDQLQEVYENYEQIKLKGLEETRDLEEKLKRHLEENKISKTELDWFLQDLEREIKKWQQEKKEIQERLKSLKKKIKKVSNASEMYTQKNDGKEKEHELHLDQSLEISNTLTNEKMKIEEYIKKGKEDYEESHQRAVAAEVSVLENWKESEVYKLQIMESQAEAFLKKLGLISRDPAAYPDMESDIRSWELFLSNVTKEIEKAKSQFEEQIKAIKNGSRLSELSKVQISELSFPACNTVHPELLPESSGHDGQGLVTSASDVTGNHAALHRDPSVFSAGDSPGEAPSALLPGPPPGQPEATQLTGPKRAGQAALSERSPVADRKQPVPPGRAARSSQSPKKPFNSIIEHLSVVFPCYNSTELAGFIKKVRSKNKNSLSGLSIDEIVQRVTEHILDEQKKKKPNPGKDKRTYEPSSATPVTRSSQGSPSVVVAPSPKTKGQKAEDVPVRIALGASSCEICHEVFKSKNVRVLKCGHKYHKGCFKQWLKGQSACPACQGRDLLTEESPSGRGWPSQNQELPSCSSR

SEQ ID NO: 863407 - protein, 1681 aa, Homo sapiens
YVCVCVMTFIGRTANKDPIKAFYENRAYTPRSLSAPIFTTSLNFVEKERDFRKINHEMANGGNQNLKVADEALKVDDCDCHPEFSPPSSQPPKHKGKQKSRNNESEKFSSSSPLTLPADLKNILEKQFSKSSRAAHQDFANIMKMLRSLIQDGYMALLEQRCRSAAQAFTELLNGLDPQKIKQLNLAMINYVLVVYGLAISLLGIGQPEELSEAENQFKRIIEHYPSEGLDCLAYCGIGKVYLKKNRFLEALNHFEKARTLIYRLPGVLTWPTSNVIIEESQPQKIKMLLEKFVEECKFPPVPDAICCYQKCHGYSKIQIYITDPDFKGFIRISCCQYCKIEFHMNCWKKLKTTTFNDKIDKDFLQGICLTPDCEGVISKIIIFSSGGEVKCEFEHKVIKEKVPPRPILKQKCSSLEKLRLKEDKKLKRKIQKKEAKKLAQERMEEDLRESNPPKNEEQKETVDNVQRCQFLDDRILQCIKQYADKIKSGIQNTAMLLKELLSWKVLSTEDYTTCFSSRNFLNEAVDYVIRHLIQENNRVKTRIFLHVLSELKEVEPKLAAWIQKLNSFGLDATGTFFSRYGASLKLLDFSIMTFLWNEKYGHKLDSIEGKQLDYFSEPASLKEARCLIWLLEEHRDKFPALHSALDEFFDIMDSRCTVLRKQDSGEAPFSSTKVKNKSKKKKPKDSKPMLVGSGTTSVTSNNEIITSSEDHSNRNSDSAGPFAVPDHLRQDVEEFEALYDQHSNEYVVRNKKLWDMNPKQKCSTLYDYFSQFLEEHGPLDMSNKMFSAEYEFFPEETRQILEKAGGLKPFLLGCPRFVVIDNCIALKKVASRLKKKRKKKNIKTKVEEISKAGEYVRVKLQLNPAAREFKPDVKSKPVSDSSSAPAFENVKPKPVSANSPKPACEDVKAKPVSDNSSRQVSEDGQPKGVSSNSPKPGSEDANYKRVSCNSPKPVLEDVKPTYWAQSHLVTGYCTYLPFQRFDITQTPPAYINVLPGLPQYTSIYTPLASLSPEYQLPRSVPVVPSFVANDRADKNAAAYFEGHHLNAENVAGHQIASETQILEGSLGISVKSHCSTGDAHTVLSESNRNDEHCGNSNNKCEVIPESTSAVTNIPHVQMVAIQVSWNIIHQEVNTEPYNPFEERQGEISRIEKEHQVLQDQLQEVYENYEQIKLKGLEETRDLEEKLKRHLEENKISKTELDWFLQDLEREIKKWQQEKKEIQERLKSLKKKIKKVSNASEMYTQKNDGKEKEHELHLDQSLEISNTLTNEKMKIEEYIKKGKEDYEESHQRAVAAEVSVLENWKESEVYKLQIMESQAEAFLKKLGLISRDPAAYPDMESDIRSWELFLSNVTKEIEKAKSQFEEQIKAIKNGSRLSELSKVQISELSFPACNTVHPELLPESSGHDGQGLVTSASDVTGNHAALHRDPSVFSAGDSPGEAPSALLPGPPPGQPEATQLTGPKRAGQAALSERSPVADRKQPVPPGRAARSSQSPKKPFNSIIEHLSVVFPCYNSTELAGFIKKVRSKNKNSLSGLSIDEIVQRVTEHILDEQKKKKPNPGKDKRTYEPSSATPVTRSSQGSPSVVVAPSPKTKGQKAEDVPVRIALGASSCEICHEVFKSKNVRVLKCGHKYHKGCFKQWLKGQSACPACQGRDLLTEESPSGRGWPSQNQELPSCSSR

SEQ ID NO: 863408 - protein, 1494 aa, Homo sapiens
MINYVLVVYGLAISLLGIGQPEELSEAENQFKRIIEHYPSEGLDCLAYCGIGKVYLKKNRFLEALNHFEKARTLIYRLPGVLTWPTSNVIIEESQPQKIKMLLEKFVEECKFPPVPDAICCYQKCHGYSKIQIYITDPDFKGFIRISCCQYCKIEFHMNCWKKLKTTTFNDKIDKDFLQGICLTPDCEGVISKIIIFSSGGEVKCEFEHKVIKEKVPPRPILKQKCSSLEKLRLKEDKKLKRKIQKKEAKKLAQERMEEDLRESNPPKNEEQKETVDNVQRCQFLDDRILQCIKQYADKIKSGIQNTAMLLKELLSWKVLSTEDYTTCFSSRNFLNEAVDYVIRHLIQENNRVKTRIFLHVLSELKEVEPKLAAWIQKLNSFGLDATGTFFSRYGASLKLLDFSIMTFLWNEKYGHKLDSIEGKQLDYFSEPASLKEARCLIWLLEEHRDKFPALHSALDEFFDIMDSRCTVLRKQDSGEAPFSSTKVKNKSKKKKPKDSKPMLVGSGTTSVTSNNEIITSSEDHSNRNSDSAGPFAVPDHLRQDVEEFEALYDQHSNEYVVRNKKLWDMNPKQKCSTLYDYFSQFLEEHGPLDMSNKMFSAEYEFFPEETRQILEKAGGLKPFLLGCPRFVVIDNCIALKKVASRLKKKRKKKNIKTKVEEISKAGEYVRVKLQLNPAAREFKPDVKSKPVSDSSSAPAFENVKPKPVSANSPKPACEDVKAKPVSDNSSRQVSEDGQPKGVSSNSPKPGSEDANYKRVSCNSPKPVLEDVKPTYWAQSHLVTGYCTYLPFQRFDITQTPPAYINVLPGLPQYTSIYTPLASLSPEYQLPRSVPVVPSFVANDRADKNAAAYFEGHHLNAENVAGHQIASETQILEGSLGISVKSHCSTGDAHTVLSESNRNDEHCGNSNNKCEVIPESTSAVTNIPHVQMVAIQVSWNIIHQEVNTEPYNPFEERQGEISRIEKEHQVLQDQLQEVYENYEQIKLKGLEETRDLEEKLKRHLEENKISKTELDWFLQDLEREIKKWQQEKKEIQERLKSLKKKIKKVSNASEMYTQKNDGKEKEHELHLDQSLEISNTLTNEKMKIEEYIKKGKEDYEESHQRAVAAEVSVLENWKESEVYKLQIMESQAEAFLKKLGLISRDPAAYPDMESDIRSWELFLSNVTKEIEKAKSQFEEQIKAIKNGSRLSELSKVQISELSFPACNTVHPELLPESSGHDGQGLVTSASDVTGNHAALHRDPSVFSAGDSPGEAPSALLPGPPPGQPEATQLTGPKRAGQAALSERSPVADRKQPVPPGRAARSSQSPKKPFNSIIEHLSVVFPCYNSTELAGFIKKVRSKNKNSLSGLSIDEIVQRVTEHILDEQKKKKPNPGKDKRTYEPSSATPVTRSSQGSPSVVVAPSPKTKGQKAEDVPVRIALGASSCEICHEVFKSKNVRVLKCGHKYHKGCFKQWLKGQSACPACQGRDLLTEESPSGRGWPSQNQELPSCSSR

SEQ ID NO: 863409 - protein, 1394 aa, Homo sapiens
MLLEKFVEECKFPPVPDAICCYQKCHGYSKIQIYITDPDFKGFIRISCCQYCKIEFHMNCWKKLKTTTFNDKIDKDFLQGICLTPDCEGVISKIIIFSSGGEVKCEFEHKVIKEKVPPRPILKQKCSSLEKLRLKEDKKLKRKIQKKEAKKLAQERMEEDLRESNPPKNEEQKETVDNVQRCQFLDDRILQCIKQYADKIKSGIQNTAMLLKELLSWKVLSTEDYTTCFSSRNFLNEAVDYVIRHLIQENNRVKTRIFLHVLSELKEVEPKLAAWIQKLNSFGLDATGTFFSRYGASLKLLDFSIMTFLWNEKYGHKLDSIEGKQLDYFSEPASLKEARCLIWLLEEHRDKFPALHSALDEFFDIMDSRCTVLRKQDSGEAPFSSTKVKNKSKKKKPKDSKPMLVGSGTTSVTSNNEIITSSEDHSNRNSDSAGPFAVPDHLRQDVEEFEALYDQHSNEYVVRNKKLWDMNPKQKCSTLYDYFSQFLEEHGPLDMSNKMFSAEYEFFPEETRQILEKAGGLKPFLLGCPRFVVIDNCIALKKVASRLKKKRKKKNIKTKVEEISKAGEYVRVKLQLNPAAREFKPDVKSKPVSDSSSAPAFENVKPKPVSANSPKPACEDVKAKPVSDNSSRQVSEDGQPKGVSSNSPKPGSEDANYKRVSCNSPKPVLEDVKPTYWAQSHLVTGYCTYLPFQRFDITQTPPAYINVLPGLPQYTSIYTPLASLSPEYQLPRSVPVVPSFVANDRADKNAAAYFEGHHLNAENVAGHQIASETQILEGSLGISVKSHCSTGDAHTVLSESNRNDEHCGNSNNKCEVIPESTSAVTNIPHVQMVAIQVSWNIIHQEVNTEPYNPFEERQGEISRIEKEHQVLQDQLQEVYENYEQIKLKGLEETRDLEEKLKRHLEENKISKTELDWFLQDLEREIKKWQQEKKEIQERLKSLKKKIKKVSNASEMYTQKNDGKEKEHELHLDQSLEISNTLTNEKMKIEEYIKKGKEDYEESHQRAVAAEVSVLENWKESEVYKLQIMESQAEAFLKKLGLISRDPAAYPDMESDIRSWELFLSNVTKEIEKAKSQFEEQIKAIKNGSRLSELSKVQISELSFPACNTVHPELLPESSGHDGQGLVTSASDVTGNHAALHRDPSVFSAGDSPGEAPSALLPGPPPGQPEATQLTGPKRAGQAALSERSPVADRKQPVPPGRAARSSQSPKKPFNSIIEHLSVVFPCYNSTELAGFIKKVRSKNKNSLSGLSIDEIVQRVTEHILDEQKKKKPNPGKDKRTYEPSSATPVTRSSQGSPSVVVAPSPKTKGQKAEDVPVRIALGASSCEICHEVFKSKNVRVLKCGHKYHKGCFKQWLKGQSACPACQGRDLLTEESPSGRGWPSQNQELPSCSSR

SEQ ID NO: 863410 - protein, 1273 aa, Homo sapiens
MYNSRASEINLKKLQHLELMEDIVDLAKKVANDSFLIGGLLRIGCKIENKILAMEEALNWIKYAGDVTILTKLGSIDNCWPMLSIFFTEYKYHITKIVMEDCNLLEELKTQSCMDCIEEGELMKMKGNEEFSKERFDIAIIYYTRAIEYRPENYLLYGNRALCFLRTGQFRNALGDGKRATILKNTWPKGHYRYCDALSMLGEYDWALQANIKAQKLCKNDPEGIKDLIQQHVKLQKQIEDLQGRTANKDPIKAFYENRAYTPRSLSAPIFTTSLNFVEKERDFRKINHEMANGGNQNLKVADEALKVDDCDCHPEFSPPSSQPPKHKGKQKSRNNESEKFSSSSPLTLPADLKNILEKQFSKSSRAAHQDFANIMKMLRSLIQDGYMALLEQRCRSAAQAFTELLNGLDPQKIKQLNLAMINYVLVVYGLAISLLGIGQPEELSEAENQFKRIIEHYPSEGLDCLAYCGIGKVYLKKNRFLEALNHFEKARTLIYRLPGVLTWPTSNVIIEESQPQKIKMLLEKFVEECKFPPVPDAICCYQKCHGYSKIQIYITDPDFKGFIRISCCQYCKIEFHMNCWKKLKTTTFNDKIDKDFLQGICLTPDCEGVISKIIIFSSGGEVKCEFEHKVIKEKVPPRPILKQKCSSLEKLRLKEDKKLKRKIQKKEAKKLAQERMEEDLRESNPPKNEEQKETVDNVQRCQFLDDRILQCIKQYADKIKSGIQNTAMLLKELLSWKVLSTEDYTTCFSSRNFLNEAVDYVIRHLIQENNRVKTRIFLHVLSELKEVEPKLAAWIQKLNSFGLDATGTFFSRYGASLKLLDFSIMTFLWNEKYGHKLDSIEGKQLDYFSEPASLKEARCLIWLLEEHRDKFPALHSALDEFFDIMDSRCTVLRKQDSGEAPFSSTKVKNKSKKKKPKDSKPMLVGSGTTSVTSNNEIITSSEDHSNRNSDSAGPFAVPDHLRQDVEEFEALYDQHSNEYVVRNKKLWDMNPKQKCSTLYDYFSQFLEEHGPLDMSNKMFSAEYEFFPEETRQILEKAGGLKPFLLGCPRFVVIDNCIALKKVASRLKKKRKKKNIKTKVEEISKAGEYVRVKLQLNPAAREFKPDVKSKPVSDSSSAPAFENVKPKPVSANSPKPACEDVKAKPVSDNSSRQVSEDGQPKGVSSNSPKPGSEDANYKRVSCNSPKPVLEDVKPTYWAQSHLVTGYCTYLPFQRFDITQTPPAYINVLPGLPQYTSIYTPLASLSPEYQLPRSVPVVPSFVANDRADWSPDCL

SEQ ID NO: 863411 - protein, 992 aa, Homo sapiens
MLVGSGTTSVTSNNEIITSSEDHSNRNSDSAGPFAVPDHLRQDVEEFEALYDQHSNEYVVRNKKLWDMNPKQKCSTLYDYFSQFLEEHGPLDMSNKMFSAEYEFFPEETRQILEKAGGLKPFLLGCPRFVVIDNCIALKKVASRLKKKRKKKNIKTKVEEISKAGEYVRVKLQLNPAAREFKPDVKSKPVSDSSSAPAFENVKPKPVSANSPKPACEDVKAKPVSDNSSRQVSEDGQPKGVSSNSPKPGSEDANYKRVSCNSPKPVLEDVKPTYWAQSHLVTGYCTYLPFQRFDITQTPPAYINVLPGLPQYTSIYTPLASLSPEYQLPRSVPVVPSFVANDRADKNAAAYFEGHHLNAENVAGHQIASETQILEGSLGISVKSHCSTGDAHTVLSESNRNDEHCGNSNNKCEVIPESTSAVTNIPHVQMVAIQVSWNIIHQEVNTEPYNPFEERQGEISRIEKEHQVLQDQLQEVYENYEQIKLKGLEETRDLEEKLKRHLEENKISKTELDWFLQDLEREIKKWQQEKKEIQERLKSLKKKIKKVSNASEMYTQKNDGKEKEHELHLDQSLEISNTLTNEKMKIEEYIKKGKEDYEESHQRAVAAEVSVLENWKESEVYKLQIMESQAEAFLKKLGLISRDPAAYPDMESDIRSWELFLSNVTKEIEKAKSQFEEQIKAIKNGSRLSELSKVQISELSFPACNTVHPELLPESSGHDGQGLVTSASDVTGNHAALHRDPSVFSAGDSPGEAPSALLPGPPPGQPEATQLTGPKRAGQAALSERSPVADRKQPVPPGRAARSSQSPKKPFNSIIEHLSVVFPCYNSTELAGFIKKVRSKNKNSLSGLSIDEIVQRVTEHILDEQKKKKPNPGKDKRTYEPSSATPVTRSSQGSPSVVVAPSPKTKGQKAEDVPVRIALGASSCEICHEVFKSKNVRVLKCGHKYHKGCFKQWLKGQSACPACQGRDLLTEESPSGRGWPSQNQELPSCSSR

SEQ ID NO: 863412 - protein, 1916 aa, Homo sapiens
MYNSRASEINLKKLQHLELMEDIVDLAKKVANDSFLIGGLLRIGCKIENKILAMEEALNWIKYAGDVTILTKLGSIDNCWPMLSIFFTEYKYHITKIVMEDCNLLEELKTQSCMDCIEEGELMKMKGNEEFSKERFDIAIIYYTRAIEYRPENYLLYGNRALCFLRTGQFRNALGDGKRATILKNTWPKGHYRYCDALSMLGEYDWALQANIKAQKLCKNDPEGIKDLIQQHVKLQKQIEDLQGRTANKDPIKAFYENRAYTPRSLSAPIFTTSLNFVEKERDFRKINHEMANGGNQNLKVADEALKVDDCDCHPEFSPPSSQPPKHKGKQKSRNNESEKFSSSSPLTLPADLKNILEKQFSKSSRAAHQDFANIMKMLRSLIQDGYMALLEQRCRSAAQAFTELLNGLDPQKIKQLNLAMINYVLVVYGLAISLLGIGQPEELSEAENQFKRIIEHYPSEGLDCLAYCGIGKVYLKKNRFLEALNHFEKARTLIYRLPGVLTWPTSNVIIEESQPQKIKMLLEKFVEECKFPPVPDAICCYQKCHGYSKIQIYITDPDFKGFIRISCCQYCKIEFHMNCWKKLKTTTFNDKIDKDFLQGICLTPDCEGVISKIIIFSSGGEVKCEFEHKVIKEKVPPRPILKQKCSSLEKLRLKEDKKLKRKIQKKEAKKLAQERMEEDLRESNPPKNEEQKETVDNVQRCQFLDDRILQCIKQYADKIKSGIQNTAMLLKELLSWKVLSTEDYTTCFSSRNFLNEAVDYVIRHLIQENNRVKTRIFLHVLSELKEVEPKLAAWIQKLNSFGLDATGTFFSRYGASLKLLDFSIMTFLWNEKYGHKLDSIEGKQLDYFSEPASLKEARCLIWLLEEHRDKFPALHSALDEFFDIMDSRCTVLRKQDSGEAPFSSTKVKNKSKKKKPKDSKPMLVGSGTTSVTSNNEIITSSEDHSNRNSDSAGPFAVPDHLRQDVEEFEALYDQHSNEYVVRNKKLWDMNPKQKCSTLYDYFSQFLEEHGPLDMSNKMFSAEYEFFPEETRQILEKAGGLKPFLLGCPRFVVIDNCIALKKVASRLKKKRKKKNIKTKVEEISKAGEYVRVKLQLNPAAREFKPDVKSKPVSDSSSAPAFENVKPKPVSANSPKPACEDVKAKPVSDNSSRQVSEDGQPKGVSSNSPKPGSEDANYKRVSCNSPKPVLEDVKPTYWAQSHLVTGYCTYLPFQRFDITQTPPAYINVLPGLPQYTSIYTPLASLSPEYQLPRSVPVVPSFVANDRADKNAAAYFEGHHLNAENVAGHQIASETQILEGSLGISVKSHCSTGDAHTVLSESNRNDEHCGNSNNKCEVIPESTSAVTNIPHVQMVAIQVSWNIIHQEVNTEPYNPFEERQGEISRIEKEHQVLQDQLQEVYENYEQIKLKGLEETRDLEEKLKRHLEENKISKTELDWFLQDLEREIKKWQQEKKEIQERLKSLKKKIKKVSNASEMYTQKNDGKEKEHELHLDQSLEISNTLTNEKMKIEEYIKKGKEDYEESHQRAVAAEVSVLENWKESEVYKLQIMESQAEAFLKKLGLISRDPAAYPDMESDIRSWELFLSNVTKEIEKAKSQFEEQIKAIKNGSRLSELSKVQISELSFPACNTVHPELLPESSGHDGQGLVTSASDVTGNHAALHRDPSVFSAGDSPGEAPSALLPGPPPGQPEATQLTGPKRAGQAALSERSPVADRKQPVPPGRAARSSQSPKKPFNSIIEHLSVVFPCYNSTELAGFIKKVRSKNKNSLSGLSIDEIVQRVTEHILDEQKKKKPNPGKDKRTYEPSSATPVTRSSQGSPSVVVAPSPKTKGQKAEDVPVRIALGASSCEICHEVFKSKNVRVLKCGHKYHKGCFKQWLKGQSACPACQGRDLLTEESPSGRGWPSQNQELPSCSSSID

SEQ ID NO: 863413 - protein, 406 aa, Homo sapiens
ARVGTSSCRDYEESHQRAVAAEVSVLENWKESEVYKLQIMESQAEAFLKKLGLISRDPAAYPDMESDIRSWELFLSNVTKEIEKAKSQFEEQIKAIKNGSRLSELSKVQISELSFPACNTVHPELLPESSGHDGQGLVTSASDVTGNHAALHRDPSVFSAGDSPGEAPSALLPGPPPGQPEATQLTGPKRAGQAALSERSPVADRKQPVPPGRAARSSQSPKKPFNSIIEHLSVVFPCYNSTELAGFIKKVRSKNKNSLSGLSIDEIVQRVTEHILDEQKKKKPNPGKDKRTYEPSSATPVTRSSQGSPSVVVAPSPKTKGQKAEDVPVRIALGASSCEICHEVFKSKNVRVLKCGHKYHKGCFKQWLKGQSACPACQGRDLLTEESPSGRGWPSQNQELPSCSSR

SEQ ID NO: 863414 - protein, 367 aa, Homo sapiens
MESQAEAFLKKLGLISRDPAAYPDMESDIRSWELFLSNVTKEIEKAKSQFEEQIKAIKNGSRLSELSKVQISELSFPACNTVHPELLPESSGHDGQGLVTSASDVTGNHAALHRDPSVFSAGDSPGEAPSALLPGPPPGQPEATQLTGPKRAGQAALSERSPVADRKQPVPPGRAARSSQSPKKPFNSIIEHLSVVFPCYNSTELAGFIKKVRSKNKNSLSGLSIDEIVQRVTEHILDEQKKKKPNPGKDKRTYEPSSATPVTRSSQGSPSVVVAPSPKTKGQKAEDVPVRIALGASSCEICHEVFKSKNVRVLKCGHKYHKGCFKQWLKGQSACPACQGRDLLTEESPSGRGWPSQNQELPSCSSR

SEQ ID NO: 863415 - protein, 47 aa, Homo sapiens
MKPALEVRRSDNRRRPEMYLHNLTGTYWPISLGVTIISFRITRIPSM

SEQ ID NO: 863416 - protein, 1750 aa, Homo sapiens
MYNSRASEINLKKLQHLELMEDIVDLAKKVANDSFLIGGLLRIGCKIENKILAMEEALNWIKYAGDVTILTKLGSIDNCWPMLSIFFTEYKYHITKIVMEDCNLLEELKTQSCMDCIEEGELMKMKGNEEFSKERFDIAIIYYTRAIEYRPENYLLYGNRALCFLRTGQFRNALGDGKRATILKNTWPKGHYRYCDALSMLGEYDWALQANIKAQKLCKNDPEGIKDLIQQHVKLQKQIEDLQGRTANKDPIKAFYENRAYTPRSLSAPIFTTSLNFVEKERDFRKINHEMANGGNQNLKVADEALKVDDCDCHPEFSPPSSQPPKHKGKQKSRNNESEKFSSSSPLTLPADLKNILEKQFSKSSRAAHQDFANIMKMLRSLIQDGYMALLEQRCRSAAQAFTELLNGLDPQKIKQLNLAMINYVLVVYGLAISLLGIGQPEELSEAENQFKRIIEHYPSEGLDCLAYCGIGKVYLKKNRFLEALNHFEKARTLIYRLPGVLTWPTSNVIIEESQPQKIKMLLEKFVEECKFPPVPDAICCYQKCHGYSKIQIYITDPDFKGFIRISCCQYCKIEFHMNCWKKLKTTTFNDKIDKDFLQGICLTPDCEGVISKIIIFSSGGEVKCEFEHKVIKEKVPPRPILKQKCSSLEKLRLKEDKKLKRKIQKKEAKKLAQERMEEDLRESNPPKNEEQKETVDNVQRCQFLDDRILQCIKQYADKIKSGIQNTAMLLKELLSWKVLSTEDYTTCFSSRNFLNEAVDYVIRHLIQENNRVKTRIFLHVLSELKEVEPKLAAWIQKLNSFGLDATGTFFSRYGASLKLLDFSIMTFLWNEKYGHKLDSIEGKQLDYFSEPASLKEARCLIWLLEEHRDKFPALHSALDEFFDIMDSRCTVLRKQDSGEAPFSSTKVKNKSKKKKPKDSKPMLVGSGTTSVTSNNEIITSSEDHSNRNSDSAGPFAVPDHLRQDVEEFEALYDQHSNEYVVRNKKLWDMNPKQKCSTLYDYFSQFLEEHGPLDMSNKMFSAEYEFFPEETRQILEKAGGLKPFLLGCPRFVVIDNCIALKKVASRLKKKRKKKNIKTKVEEISKAGEYVRVKLQLNPAAREFKPDVKSKPVSDSSSAPAFENVKPKPVSANSPKPACEDVKAKPVSDNSSRQVSEDGQPKGVSSNSPKPGSEDANYKRVSCNSPKPVLEDVKPTYWAQSHLVTGYCTYLPFQRFDITQTPPAYINVLPGLPQYTSIYTPLASLSPEYQLPRSVPVVPSFVANDRADKNAAAYFEGHHLNAENVAGHQIASETQILEGSLGISVKSHCSTGDAHTVLSESNRNDEHCGNSNNKCEVIPESTSAVTNIPHVQMVAIQVSWNIIHQEVNTEPYNPFEERQGEISRIEKEHQVLQDQLQEVYENYEQIKLKGLEETRDLEEKLKRHLEENKISKTELDWFLQDLEREIKKWQQEKKEIQERLKSLKKKIKKVSNASEMYTQKNDGKEKEHELHLDQSLEISNTLTNEKMKIEEYIKKGKEDYEESHQRAVAAEVSVLENWKESEVYKLQIMESQAEAFLKKLGLISRDPAAYPDMESDIRSWELFLSNVTKEIEKAKSQFEEQIKAIKNGSRLSELSKVQISELSFPACNTVHPELLPESSGHDGQGLVTSASDVTGNHAALHRDPSVFSAGDSPGEAPSALLPGPPPGQPEATQLTGPKRAGQAALSERSPVADRKQPVPPGRAARSSQSPKKPFNSIIEHLSVVFPCYNSH

SEQ ID NO: 863417 - protein, 1620 aa, Homo sapiens
MYNSRASEINLKKLQHLELMEDIVDLAKKVANDSFLIGGLLRIGCKIENKILAMEEALNWIKYAGDVTILTKLGSIDNCWPMLSIFFTEYKYHITKIVMEDCNLLEELKTQSCMDCIEEGELMKMKGNEEFSKERFDIAIIYYTRAIEYRPENYLLYGNRALCFLRTGQFRNALGDGKRATILKNTWPKGHYRYCDALSMLGEYDWALQANIKAQKLCKNDPEGIKDLIQQHVKLQKQIEDLQGRTANKDPIKAFYENRAYTPRSLSAPIFTTSLNFVEKERDFRKINHEMANGGNQNLKVADEALKVDDCDCHPEFSPPSSQPPKHKGKQKSRNNESEKFSSSSPLTLPADLKNILEKQFSKSSRAAHQDFANIMKMLRSLIQDGYMALLEQRCRSAAQAFTELLNGLDPQKIKQLNLAMINYVLVVYGLAISLLGIGQPEELSEAENQFKRIIEHYPSEGLDCLAYCGIGKVYLKKNRFLEALNHFEKARTLIYRLPGVLTWPTSNVIIEESQPQKIKMLLEKFVEECKFPPVPDAICCYQKCHGYSKIQIYITDPDFKGFIRISCCQYCKIEFHMNCWKKLKTTTFNDKIDKDFLQGICLTPDCEGVISKIIIFSSGGEVKCEFEHKVIKEKVPPRPILKQKCSSLEKLRLKEDKKLKRKIQKKEAKKLAQERMEEDLRESNPPKNEEQKETVDNVQRCQFLDDRILQCIKQYADKIKSGIQNTAMLLKELLSWKVLSTEDYTTCFSSRNFLNEAVDYVIRHLIQENNRVKTRIFLHVLSELKEVEPKLAAWIQKLNSFGLDATGTFFSRYGASLKLLDFSIMTFLWNEKYGHKLDSIEGKQLDYFSEPASLKEARCLIWLLEEHRDKFPALHSALDEFFDIMDSRCTVLRKQDSGEAPFSSTKVKNKSKKKKPKDSKPMLVGSGTTSVTSNNEIITSSEDHSNRNSDSAGPFAVPDHLRQDVEEFEALYDQHSNEYVVRNKKLWDMNPKQKCSTLYDYFSQFLEEHGPLDMSNKMFSAEYEFFPEETRQILEKAGGLKPFLLGCPRFVVIDNCIALKKVASRLKKKRKKKNIKTKVEEISKAGEYVRVKLQLNPAAREFKPDVKSKPVSDSSSAPAFENVKPKPVSANSPKPACEDVKAKPVSDNSSRQVSEDGQPKGVSSNSPKPGSEDANYKRVSCNSPKPVLEDVKPTYWAQSHLVTGYCTYLPFQRFDITQTPPAYINVLPGLPQYTSIYTPLASLSPEYQLPRSVPVVPSFVANDRADKNAAAYFEGHHLNAENVAGHQIASETQILEGSLGISVKSHCSTGDAHTVLSESNRNDEHCGNSNNKCEVIPESTSAVTNIPHVQMVAIQVSWNIIHQEVNTEPYNPFEERQGEISRIEKEHQVLQDQLQEVYENYEQIKLKGLEETRDLEEKLKRHLEENKISKTELDWFLQDLEREIKKWQQEKKEIQERLKSLKKKIKKVSNASEMYTQKNDGKEKEHELHLDQSLEISNTLTNEKMKIEEYIKKGKEDYEESHQRAVAAEVSVLENWKESEVYKLQIMESQAEAFLKKLGLISRDPAAYPDMESDIRSWELFLSNVTKEIEKAKSQFEEQIKAIKNGSRLRWCGVPSSNV

SEQ ID NO: 863418 - protein, 811 aa, Homo sapiens
MYNSRASEINLKKLQHLELMEDIVDLAKKVANDSFLIGGLLRIGCKIENKILAMEEALNWIKYAGDVTILTKLGSIDNCWPMLSIFFTEYKYHITKIVMEDCNLLEELKTQSCMDCIEEGELMKMKGNEEFSKERFDIAIIYYTRAIEYRPENYLLYGNRALCFLRTGQFRNALGDGKRATILKNTWPKGHYRYCDALSMLGEYDWALQANIKAQKLCKNDPEGIKDLIQQHVKLQKQIEDLQGRTANKDPIKAFYENRAYTPRSLSAPIFTTSLNFVEKERDFRKINHEMANGGNQNLKVADEALKVDDCDCHPEFSPPSSQPPKHKGKQKSRNNESEKFSSSSPLTLPADLKNILEKQFSKSSRAAHQDFANIMKMLRSLIQDGYMALLEQRCRSAAQAFTELLNGLDPQKIKQLNLAMINYVLVVYGLAISLLGIGQPEELSEAENQFKRIIEHYPSEGLDCLAYCGIGKVYLKKNRFLEALNHFEKARTLIYRLPGVLTWPTSNVIIEESQPQKIKMLLEKFVEECKFPPVPDAICCYQKCHGYSKIQIYITDPDFKGFIRISCCQYCKIEFHMNCWKKLKTTTFNDKIDKDFLQGICLTPDCEGVISKIIIFSSGGEVKCEFEHKVIKEKVPPRPILKQKCSSLEKLRLKEDKKLKRKIQKKEAKKLAQERMEEDLRESNPPKNEEQKETVDNVQRCQFLDDRILQCIKQYADKIKSGIQNTAMLLKELLSWKVLSTEDYTTCFSSRNFLNEAVDYVIRHLIQENNRVKTRIFLHVLSELKEVEPKLAAWIQKLNSFGMSLYIPEQ

SEQ ID NO: 863419 - protein, 566 aa, Homo sapiens
MDNFAEGDFTVADYALLEDCPHVDDCVFAAEFMSNDYVRVTQLYCDGVGVQYKDYIQSERNLEFDICSIWCSKPISVLQDYCDAIKINIFWPLLFQHQNSSVISRLHPCVDANNSRASEINLKKLQHLELMEDIVDLAKKVANDSFLIGGLLRIGCKIENKILAMEEALNWIKYAGDVTILTKLGSIDNCWPMLSIFFTEYKYHITKIVMEDCNLLEELKTQSCMDCIEEGELMKMKGNEEFSKERFDIAIIYYTRAIEYRPENYLLYGNRALCFLRTGQFRNALGDGKRATILKNTWPKGHYRYCDALSMLGEYDWALQANIKAQKLCKNDPEGIKDLIQQHVKLQKQIEDLQGRTANKDPIKAFYENRAYTPRSLSAPIFTTSLNFVEKERDFRKINHEMANGGNQNLKVADEALKVDDCDCHPEFSPPSSQLYNVGNHKSRTTDSQTVTSSSPIELNQQMRRHLADTGVENLQSCHRIANIRNARSYSEATWLLADRCRSCTASEVARDTQNQESRTSAPGDAGLPDDTASTTPSATARGSAAHQSARRTHNNHRGLIAERPP

SEQ ID NO: 863420 - protein, 388 aa, Homo sapiens
MDNFAEGDFTVADYALLEDCPHVDDCVFAAEFMSNDYVRVTQLYCDGVGVQYKDYIQSERNLEFDICSIWCSKPISVLQDYCDAIKINIFWPLLFQHQNSSVISRLHPCVDANNSRASEINLKKLQHLELMEDIVDLAKKVANDSFLIGGLLRIGCKIENKILAMEEALNWIKYAGDVTILTKLGSIDNCWPMLSIFFTEYKYHITKIVMEDCNLLEELKTQSCMDCIEEGELMKMKGNEEFSKERFDIAIIYYTRAIEYRPENYLLYGNRALCFLRTGQFRNALGDGKRATILKNTWPKGHYRYCDALSMLGEYDWALQANIKAQKLCKNDPEGIKDLIQQHVKLQKQIEDLQGISPKILLVTVLIPFQTLEGGFLGLTEDHKSILR

SEQ ID NO: 863421 - protein, 1790 aa, Homo sapiens; identical to SEQ ID NO: 863402

SEQ ID NO: 863422 - protein, 2025 aa, Homo sapiens; identical to SEQ ID NO: 863403

SEQ ID NO: 863423 - protein, 1790 aa, Homo sapiens; identical to SEQ ID NO: 863402

SEQ ID NO: 863424 - protein, 1715 aa, Homo sapiens; identical to SEQ ID NO: 863406

SEQ ID NO: 863425 - protein, 1880 aa, Homo sapiens
MYNSRASEINLKKLQHLELMEDIVDLAKKVANDSFLIGGLLRIGCKIENKILAMEEALNWIKYAGDVTILTKLGSIDNCWPMLSIFFTEYKYHITKIVMEDCNLLEELKTQSCMDCIEEGELMKMKGNEEFSKERFDIAIIYYTRAIEYRPENYLLYGNRALCFLRTGQFRNALGDGKRATILKNTWPKGHYRYCDALSMLGEYDWALQANIKAQKLCKNDPEGIKDLIQQHVKLQKQIEDLQGRTANKDPIKAFYENRAYTPRSLSAPIFTTSLNFVEKERDFRKINHEMANGGNQNLKVADEALKVDDCDCHPEFSPPSSQPPKHKGKQKSRNNESEKFSSSSPLTLPADLKNILEKQFSKSSRAAHQDFANIMKMLRSLIQDGYMALLEQRCRSAAQAFTELLNGLDPQKIKQLNLAMINYVLVVYGLAISLLGIGQPEELSEAENQFKRIIEHYPSEGLDCLAYCGIGKVYLKKNRFLEALNHFEKARTLIYRLPGVLTWPTSNVIIEESQPQKIKMLLEKFVEECKFPPVPDAICCYQKCHGYSKIQIYITDPDFKDFLQGICLTPDCEGVISKIIIFSSGGEVKCEFEHKVIKEKVPPRPILKQKCSSLEKLRLKEDKKLKRKIQKKEAKKLAQERMEEDLRESNPPKNEEQKETVDNVQRCQFLDDRILQCIKQYADKIKSGIQNTAMLLKELLSWKVLSTEDYTTCFSSRNFLNEAVDYVIRHLIQENNRVKTRIFLHVLSELKEVEPKLAAWIQKLNSFGLDATGTFFSRYGASLKLLDFSIMTFLWNEKYGHKLDSIEGKQLDYFSEPASLKEARCLIWLLEEHRDKFPALHSALDEFFDIMDSRCTVLRKQDSGEAPFSSTKVKNKSKKKKPKDSKPMLVGSGTTSVTSNNEIITSSEDHSNRNSDSAGPFAVPDHLRQDVEEFEALYDQHSNEYVVRNKKLWDMNPKQKCSTLYDYFSQFLEEHGPLDMSNKMFSAEYEFFPEETRQILEKAGGLKPFLLGCPRFVVIDNCIALKKVASRLKKKRKKKNIKTKVEEISKAGEYVRVKLQLNPAAREFKPDVKSKPVSDSSSAPAFENVKPKPVSANSPKPACEDVKAKPVSDNSSRQVSEDGQPKGVSSNSPKPGSEDANYKRVSCNSPKPVLEDVKPTYWAQSHLVTGYCTYLPFQRFDITQTPPAYINVLPGLPQYTSIYTPLASLSPEYQLPRSVPVVPSFVANDRADKNAAAYFEGHHLNAENVAGHQIASETQILEGSLGISVKSHCSTGDAHTVLSESNRNDEHCGNSNNKCEVIPESTSAVTNIPHVQMVAIQVSWNIIHQEVNTEPYNPFEERQGEISRIEKEHQVLQDQLQEVYENYEQIKLKGLEETRDLEEKLKRHLEENKISKTELDWFLQDLEREIKKWQQEKKEIQERLKSLKKKIKKVSNASEMYTQKNDGKEKEHELHLDQSLEISNTLTNEKMKIEEYIKKGKEDYEESHQRAVAAEVSVLENWKESEVYKLQIMESQAEAFLKKLGLISRDPAAYPDMESDIRSWELFLSNVTKEIEKAKSQFEEQIKAIKNGSRLSELSKVQISELSFPACNTVHPELLPESSGHDGQGLVTSASDVTGNHAALHRDPSVFSAGDSPGEAPSALLPGPPPGQPEATQLTGPKRAGQAALSERSPVADRKQPVPPGRAARSSQSPKKPFNSIIEHLSVVFPCYNSTELAGFIKKVRSKNKNSLSGLSIDEIVQRVTEHILDEQKKKKPNPGKDKRTYEPSSATPVTRSSQGSPSVVVAPSPKTKGQKAEDVPVRIALGASSCEICHEVFKSKNVRVLKCGHKYHKGCFKQWLKGQSACPACQGRDLLTEESPSGRGWPSQNQELPSCSSR

SEQ ID NO: 863426 - protein, 1303 aa, Homo sapiens
MIKLTRIFYKEYVLPLTVKVSFLRLSSSAVVVKLNVNLEKLRLKEDKKLKRKIQKKEAKKLAQERMEEDLRESNPPKNEEQKETVDNVQRCQFLDDRILQCIKQYADKIKSGIQNTAMLLKELLSWKVLSTEDYTTCFSSRNFLNEAVDYVIRHLIQENNRVKTRIFLHVLSELKEVEPKLAAWIQKLNSFGLDATGTFFSRYGASLKLLDFSIMTFLWNEKYGHKLDSIEGKQLDYFSEPASLKEARCLIWLLEEHRDKFPALHSALDEFFDIMDSRCTVLRKQDSGEAPFSSTKVKNKSKKKKPKDSKPMLVGSGTTSVTSNNEIITSSEDHSNRNSDSAGPFAVPDHLRQDVEEFEALYDQHSNEYVVRNKKLWDMNPKQKCSTLYDYFSQFLEEHGPLDMSNKMFSAEYEFFPEETRQILEKAGGLKPFLLGCPRFVVIDNCIALKKVASRLKKKRKKKNIKTKVEEISKAGEYVRVKLQLNPAAREFKPDVKSKPVSDSSSAPAFENVKPKPVSANSPKPACEDVKAKPVSDNSSRQVSEDGQPKGVSSNSPKPGSEDANYKRVSCNSPKPVLEDVKPTYWAQSHLVTGYCTYLPFQRFDITQTPPAYINVLPGLPQYTSIYTPLASLSPEYQLPRSVPVVPSFVANDRADKNAAAYFEGHHLNAENVAGHQIASETQILEGSLGISVKSHCSTGDAHTVLSESNRNDEHCGNSNNKCEVIPESTSAVTNIPHVQMVAIQVSWNIIHQEVNTEPYNPFEERQGEISRIEKEHQVLQDQLQEVYENYEQIKLKGLEETRDLEEKLKRHLEENKISKTELDWFLQDLEREIKKWQQEKKEIQERLKSLKKKIKKVSNASEMYTQKNDGKEKEHELHLDQSLEISNTLTNEKMKIEEYIKKGKEDYEESHQRAVAAEVSVLENWKESEVYKLQIMESQAEAFLKKLGLISRDPAAYPDMESDIRSWELFLSNVTKEIEKAKSQFEEQIKAIKNGSRLSELSKVQISELSFPACNTVHPELLPESSGHDGQGLVTSASDVTGNHAALHRDPSVFSAGDSPGEAPSALLPGPPPGQPEATQLTGPKRAGQAALSERSPVADRKQPVPPGRAARSSQSPKKPFNSIIEHLSVVFPCYNSTELAGFIKKVRSKNKNSLSGLSIDEIVQRVTEHILDEQKKKKPNPGKDKRTYEPSSATPVTRSSQGSPSVVVAPSPKTKGQKAEDVPVRIALGASSCEICHEVFKSKNVRVLKCGHKYHKGCFKQWLKGQSACPACQGRDLLTEESPSGRGWPSQNQELPSCSSR

SEQ ID NO: 863427 - protein, 1932 aa, Homo sapiens
MYNSRASEINLKKLQHLELMEDIVDLAKKVANDSFLIGGLLRIGCKIENKILAMEEALNWIKYAGDVTILTKLGSIDNCWPMLSIFFTEYKYHITKIVMEDCNLLEELKTQSCMDCIEEGELMKMKGNEEFSKERFDIAIIYYTRAIEYRPENYLLYGNRALCFLRTGQFRNALGDGKRATILKNTWPKGHYRYCDALSMLGEYDWALQANIKAQKLCKNDPEGIKDLIQQHVKLQKQIEDLQGRTANKDPIKAFYENRAYTPRSLSAPIFTTSLNFVEKERDFRKINHEMANGGNQNLKVADEALKVDDCDCHPEFSPPSSQPPKHKGKQKSRNNESEKFSSSSPLTLPADLKNILEKQFSKSSRAAHQDFANIMKMLRSLIQDGYMALLEQRCRSAAQAFTELLNGLDPQKIKQLNLAMINYVLVVYGLAISLLGIGQPEELSEAENQFKRIIEHYPSEGLDCLAYCGIGKVYLKKNRFLEALNHFEKARTLIYRLPGVLTWPTSNVIIEESQPQKIKMLLEKFVEECKFPPVPDAICCYQKCHGYSKIQIYITDPDFKGFIRISCCQYCKIEFHMNCWKKLKTTTFNDKIDKDFLQGICLTPDCEGVISKIIIFSSGGEVKCEFEHKVIKEKVPPRPILKQKCSSLEKLRLKEDKKLKRKIQKKEAKKLAQERMEEDLRESNPPKNEEQKETVDNVQRCQFLDDRILQCIKQYADKIKSGIQNTAMLLKELLSWKVLSTEDYTTCFSSRNFLNEAVDYVIRHLIQENNRVKTRIFLHVLSELKEVEPKLAAWIQKLNSFGLDATGTFFSRYGASLKLLDFSIMTFLWNEKYGHKLDSIEGKQLDYFSEPASLKEARCLIWLLEEHRDKFPALHSALDEFFDIMDIFTASWERLHVTLTESINSRCTVLRKQDSGEAPFSSTKVKNKSKKKKPKDSKPMLVGSGTTSVTSNNEIITSSEDHSNRNSDSAGPFAVPDHLRQDVEEFEALYDQHSNEYVVRNKKLWDMNPKQKCSTLYDYFSQFLEEHGPLDMSNKMFSAEYEFFPEETRQILEKAGGLKPFLLGCPRFVVIDNCIALKKVASRLKKKRKKKNIKTKVEEISKAGEYVRVKLQLNPAAREFKPDVKSKPVSDSSSAPAFENVKPKPVSANSPKPACEDVKAKPVSDNSSRQVSEDGQPKGVSSNSPKPGSEDANYKRVSCNSPKPVLEDVKPTYWAQSHLVTGYCTYLPFQRFDITQTPPAYINVLPGLPQYTSIYTPLASLSPEYQLPRSVPVVPSFVANDRADKNAAAYFEGHHLNAENVAGHQIASETQILEGSLGISVKSHCSTGDAHTVLSESNRNDEHCGNSNNKCEVIPESTSAVTNIPHVQMVAIQVSWNIIHQEVNTEPYNPFEERQGEISRIEKEHQVLQDQLQEVYENYEQIKLKGLEETRDLEEKLKRHLEENKISKTELDWFLQDLEREIKKWQQEKKEIQERLKSLKKKIKKVSNASEMYTQKNDGKEKEHELHLDQSLEISNTLTNEKMKIEEYIKKGKEDYEESHQRAVAAEVSVLENWKESEVYKLQIMESQAEAFLKKLGLISRDPAAYPDMESDIRSWELFLSNVTKEIEKAKSQFEEQIKAIKNGSRLSELSKVQISELSFPACNTVHPELLPESSGHDGQGLVTSASDVTGNHAALHRDPSVFSAGDSPGEAPSALLPGPPPGQPEATQLTGPKRAGQAALSERSPVADRKQPVPPGRAARSSQSPKKPFNSIIEHLSVVFPCYNSTELAGFIKKVRSKNKNSLSGLSIDEIVQRVTEHILDEQKKKKPNPGKDKRTYEPSSATPVTRSSQGSPSVVVAPSPKTKGQKAEDVPVRIALGASSCEICHEVFKSKNVRVLKCGHKYHKGCFKQWLKGQSACPACQGRDLLTEESPSGRGWPSQNQELPSCSSR

SEQ ID NO: 863428 - protein, 1785 aa, Homo sapiens
STPPPAPSRRRLTWRAGGGGGGGGGCCCCCCPRPRLAGGGPGNALGDGKRATILKNTWPKGHYRYCDALSMLGEYDWALQANIKAQKLCKNDPEGIKDLIQQHVKLQKQIEDLQGRTANKDPIKAFYENRAYTPRSLSAPIFTTSLNFVEKERDFRKINHEMANGGNQNLKVADEALKVDDCDCHPEFSPPSSQPPKHKGKQKSRNNESEKFSSSSPLTLPADLKNILEKQFSKSSRAAHQDFANIMKMLRSLIQDGYMALLEQRCRSAAQAFTELLNGLDPQKIKQLNLAMINYVLVVYGLAISLLGIGQPEELSEAENQFKRIIEHYPSEGLDCLAYCGIGKVYLKKNRFLEALNHFEKARTLIYRLPGVLTWPTSNVIIEESQPQKIKMLLEKFVEECKFPPVPDAICCYQKCHGYSKIQIYITDPDFKGFIRISCCQYCKIEFHMNCWKKLKTTTFNDKIDKDFLQGICLTPDCEGVISKIIIFSSGGEVKCEFEHKVIKEKVPPRPILKQKCSSLEKLRLKEDKKLKRKIQKKEAKKLAQERMEEDLRESNPPKNEEQKETVDNVQRCQFLDDRILQCIKQYADKIKSGIQNTAMLLKELLSWKVLSTEDYTTCFSSRNFLNEAVDYVIRHLIQENNRVKTRIFLHVLSELKEVEPKLAAWIQKLNSFGLDATGTFFSRYGASLKLLDFSIMTFLWNEKYGHKLDSIEGKQLDYFSEPASLKEARCLIWLLEEHRDKFPALHSALDEFFDIMDSRCTVLRKQDSGEAPFSSTKVKNKSKKKKPKDSKPMLVGSGTTSVTSNNEIITSSEDHSNRNSDSAGPFAVPDHLRQDVEEFEALYDQHSNEYVVRNKKLWDMNPKQKCSTLYDYFSQFLEEHGPLDMSNKMFSAEYEFFPEETRQILEKAGGLKPFLLGCPRFVVIDNCIALKKVASRLKKKRKKKNIKTKVEEISKAGEYVRVKLQLNPAAREFKPDVKSKPVSDSSSAPAFENVKPKPVSANSPKPACEDVKAKPVSDNSSRQVSEDGQPKGVSSNSPKPGSEDANYKRVSCNSPKPVLEDVKPTYWAQSHLVTGYCTYLPFQRFDITQTPPAYINVLPGLPQYTSIYTPLASLSPEYQLPRSVPVVPSFVANDRADKNAAAYFEGHHLNAENVAGHQIASETQILEGSLGISVKSHCSTGDAHTVLSESNRNDEHCGNSNNKCEVIPESTSAVTNIPHVQMVAIQVSWNIIHQEVNTEPYNPFEERQGEISRIEKEHQVLQDQLQEVYENYEQIKLKGLEETRDLEEKLKRHLEENKISKTELDWFLQDLEREIKKWQQEKKEIQERLKSLKKKIKKVSNASEMYTQKNDGKEKEHELHLDQSLEISNTLTNEKMKIEEYIKKGKEDYEESHQRAVAAEVSVLENWKESEVYKLQIMESQAEAFLKKLGLISRDPAAYPDMESDIRSWELFLSNVTKEIEKAKSQFEEQIKAIKNGSRLSELSKVQISELSFPACNTVHPELLPESSGHDGQGLVTSASDVTGNHAALHRDPSVFSAGDSPGEAPSALLPGPPPGQPEATQLTGPKRAGQAALSERSPVADRKQPVPPGRAARSSQSPKKPFNSIIEHLSVVFPCYNSTELAGFIKKVRSKNKNSLSGLSIDEIVQRVTEHILDEQKKKKPNPGKDKRTYEPSSATPVTRSSQGSPSVVVAPSPKTKGQKAEDVPVRIALGASSCEICHEVFKSKNVRVLKCGHKYHKGCFKQWLKGQSACPACQGRDLLTEESPSGRGWPSQNQELPSCSSR

SEQ ID NO: 863429 - protein, 1715 aa, Homo sapiens; identical to SEQ ID NO: 863406

SEQ ID NO: 863430 - protein, 1539 aa, Homo sapiens
MKMLRSLIQDGYMALLEQRCRSAAQAFTELLNGLDPQKIKQLNLAMINYVLVVYGLAISLLGIGQPEELSEAENQFKRIIEHYPSEGLDCLAYCGIGKVYLKKNRFLEALNHFEKARTLIYRLPGVLTWPTSNVIIEESQPQKIKMLLEKFVEECKFPPVPDAICCYQKCHGYSKIQIYITDPDFKGFIRISCCQYCKIEFHMNCWKKLKTTTFNDKIDKDFLQGICLTPDCEGVISKIIIFSSGGEVKCEFEHKVIKEKVPPRPILKQKCSSLEKLRLKEDKKLKRKIQKKEAKKLAQERMEEDLRESNPPKNEEQKETVDNVQRCQFLDDRILQCIKQYADKIKSGIQNTAMLLKELLSWKVLSTEDYTTCFSSRNFLNEAVDYVIRHLIQENNRVKTRIFLHVLSELKEVEPKLAAWIQKLNSFGLDATGTFFSRYGASLKLLDFSIMTFLWNEKYGHKLDSIEGKQLDYFSEPASLKEARCLIWLLEEHRDKFPALHSALDEFFDIMDSRCTVLRKQDSGEAPFSSTKVKNKSKKKKPKDSKPMLVGSGTTSVTSNNEIITSSEDHSNRNSDSAGPFAVPDHLRQDVEEFEALYDQHSNEYVVRNKKLWDMNPKQKCSTLYDYFSQFLEEHGPLDMSNKMFSAEYEFFPEETRQILEKAGGLKPFLLGCPRFVVIDNCIALKKVASRLKKKRKKKNIKTKVEEISKAGEYVRVKLQLNPAAREFKPDVKSKPVSDSSSAPAFENVKPKPVSANSPKPACEDVKAKPVSDNSSRQVSEDGQPKGVSSNSPKPGSEDANYKRVSCNSPKPVLEDVKPTYWAQSHLVTGYCTYLPFQRFDITQTPPAYINVLPGLPQYTSIYTPLASLSPEYQLPRSVPVVPSFVANDRADKNAAAYFEGHHLNAENVAGHQIASETQILEGSLGISVKSHCSTGDAHTVLSESNRNDEHCGNSNNKCEVIPESTSAVTNIPHVQMVAIQVSWNIIHQEVNTEPYNPFEERQGEISRIEKEHQVLQDQLQEVYENYEQIKLKGLEETRDLEEKLKRHLEENKISKTELDWFLQDLEREIKKWQQEKKEIQERLKSLKKKIKKVSNASEMYTQKNDGKEKEHELHLDQSLEISNTLTNEKMKIEEYIKKGKEDYEESHQRAVAAEVSVLENWKESEVYKLQIMESQAEAFLKKLGLISRDPAAYPDMESDIRSWELFLSNVTKEIEKAKSQFEEQIKAIKNGSRLSELSKVQISELSFPACNTVHPELLPESSGHDGQGLVTSASDVTGNHAALHRDPSVFSAGDSPGEAPSALLPGPPPGQPEATQLTGPKRAGQAALSERSPVADRKQPVPPGRAARSSQSPKKPFNSIIEHLSVVFPCYNSTELAGFIKKVRSKNKNSLSGLSIDEIVQRVTEHILDEQKKKKPNPGKDKRTYEPSSATPVTRSSQGSPSVVVAPSPKTKGQKAEDVPVRIALGASSCEICHEVFKSKNVRVLKCGHKYHKGCFKQWLKGQSACPACQGRDLLTEESPSGRGWPSQNQELPSCSSR

SEQ ID NO: 863431 - protein, 1270 aa, Homo sapiens
MFISLEKLRLKEDKKLKRKIQKKEAKKLAQERMEEDLRESNPPKNEEQKETVDNVQRCQFLDDRILQCIKQYADKIKSGIQNTAMLLKELLSWKVLSTEDYTTCFSSRNFLNEAVDYVIRHLIQENNRVKTRIFLHVLSELKEVEPKLAAWIQKLNSFGLDATGTFFSRYGASLKLLDFSIMTFLWNEKYGHKLDSIEGKQLDYFSEPASLKEARCLIWLLEEHRDKFPALHSALDEFFDIMDSRCTVLRKQDSGEAPFSSTKVKNKSKKKKPKDSKPMLVGSGTTSVTSNNEIITSSEDHSNRNSDSAGPFAVPDHLRQDVEEFEALYDQHSNEYVVRNKKLWDMNPKQKCSTLYDYFSQFLEEHGPLDMSNKMFSAEYEFFPEETRQILEKAGGLKPFLLGCPRFVVIDNCIALKKVASRLKKKRKKKNIKTKVEEISKAGEYVRVKLQLNPAAREFKPDVKSKPVSDSSSAPAFENVKPKPVSANSPKPACEDVKAKPVSDNSSRQVSEDGQPKGVSSNSPKPGSEDANYKRVSCNSPKPVLEDVKPTYWAQSHLVTGYCTYLPFQRFDITQTPPAYINVLPGLPQYTSIYTPLASLSPEYQLPRSVPVVPSFVANDRADKNAAAYFEGHHLNAENVAGHQIASETQILEGSLGISVKSHCSTGDAHTVLSESNRNDEHCGNSNNKCEVIPESTSAVTNIPHVQMVAIQVSWNIIHQEVNTEPYNPFEERQGEISRIEKEHQVLQDQLQEVYENYEQIKLKGLEETRDLEEKLKRHLEENKISKTELDWFLQDLEREIKKWQQEKKEIQERLKSLKKKIKKVSNASEMYTQKNDGKEKEHELHLDQSLEISNTLTNEKMKIEEYIKKGKEDYEESHQRAVAAEVSVLENWKESEVYKLQIMESQAEAFLKKLGLISRDPAAYPDMESDIRSWELFLSNVTKEIEKAKSQFEEQIKAIKNGSRLSELSKVQISELSFPACNTVHPELLPESSGHDGQGLVTSASDVTGNHAALHRDPSVFSAGDSPGEAPSALLPGPPPGQPEATQLTGPKRAGQAALSERSPVADRKQPVPPGRAARSSQSPKKPFNSIIEHLSVVFPCYNSTELAGFIKKVRSKNKNSLSGLSIDEIVQRVTEHILDEQKKKKPNPGKDKRTYEPSSATPVTRSSQGSPSVVVAPSPKTKGQKAEDVPVRIALGASSCEICHEVFKSKNVRVLKCGHKYHKGCFKQWLKGQSACPACQGRDLLTEESPSGRGWPSQNQELPSCSSR

SEQ ID NO: 863432 - protein, 1914 aa, Homo sapiens; identical to SEQ ID NO: 863405

SEQ ID NO: 863433 - protein, 1914 aa, Homo sapiens; identical to SEQ ID NO: 863405

SEQ ID NO: 863434 - protein, 1914 aa, Homo sapiens; identical to SEQ ID NO: 863405

SEQ ID NO: 863435 - protein, 440 aa, Homo sapiens [sequence omitted]

SEQ ID NO: 863436 - protein, 343 aa, Homo sapiens
MESDIRSWELFLSNVTKEIEKAKSQFEEQIKAIKNGSRLSELSKVQISELSFPACNTVHPELLPESSGHDGQGLVTSASDVTGNHAALHRDPSVFSAGDSPGEAPSALLPGPPPGQPEATQLTGPKRAGQAALSERSPVADRKQPVPPGRAARSSQSPKKPFNSIIEHLSVVFPCYNSTELAGFIKKVRSKNKNSLSGLSIDEIVQRVTEHILDEQKKKKPNPGKDKRTYEPSSATPVTRSSQGSPSVVVAPSPKTKGQKAEDVPVRIALGASSCEICHEVFKSKNVRVLKCGHKYHKGCFKQWLKGQSACPACQGRDLLTEESPSGRGWPSQNQELPSCSSR

SEQ ID NO: 863437 - protein, 304 aa, Homo sapiens
MCHAAQETRPHVSTWELRVHPELLPESSGHDGQGLVTSASDVTGNHAALHRDPSVFSAGDSPGEAPSALLPGPPPGQPEATQLTGPKRAGQAALSERSPVADRKQPVPPGRAARSSQSPKKPFNSIIEHLSVVFPCYNSTELAGFIKKVRSKNKNSLSGLSIDEIVQRVTEHILDEQKKKKPNPGKDKRTYEPSSATPVTRSSQGSPSVVVAPSPKTKGQKAEDVPVRIALGASSCEICHEVFKSKNVRVLKCGHKYHKGCFKQWLKGQSACPACQGRDLLTEESPSGRGWPSQNQELPSCSSR

SEQ ID NO: 863438 - protein, 1509 aa, Homo sapiens
MYNSRASEINLKKLQHLELMEDIVDLAKKVANDSFLIGGLLRIGCKIENKILAMEEALNWIKYAGDVTILTKLGSIDNCWPMLSIFFTEYKYHITKIVMEDCNLLEELKTQSCMDCIEEGELMKMKGNEEFSKERFDIAIIYYTRAIEYRPENYLLYGNRALCFLRTGQFRNALGDGKRATILKNTWPKGHYRYCDALSMLGEYDWALQANIKAQKLCKNDPEGIKDLIQQHVKLQKQIEDLQGRTANKDPIKAFYENRAYTPRSLSAPIFTTSLNFVEKERDFRKINHEMANGGNQNLKVADEALKVDDCDCHPEFSPPSSQPPKHKGKQKSRNNESEKFSSSSPLTLPADLKNILEKQFSKSSRAAHQDFANIMKMLRSLIQDGYMALLEQRCRSAAQAFTELLNGLDPQKIKQLNLAMINYVLVVYGLAISLLGIGQPEELSEAENQFKRIIEHYPSEGLDCLAYCGIGKVYLKKNRFLEALNHFEKARTLIYRLPGVLTWPTSNVIIEESQPQKIKMLLEKFVEECKFPPVPDAICCYQKCHGYSKIQIYITDPDFKGFIRISCCQYCKIEFHMNCWKKLKTTTFNDKIDKDFLQGICLTPDCEGVISKIIIFSSGGEVKCEFEHKVIKEKVPPRPILKQKCSSLEKLRLKEDKKLKRKIQKKEAKKLAQERMEEDLRESNPPKNEEQKETVDNVQRCQFLDDRILQCIKQYADKIKSGIQNTAMLLKELLSWKVLSTEDYTTCFSSRNFLNEAVDYVIRHLIQENNRVKTRIFLHVLSELKEVEPKLAAWIQKLNSFGLDATGTFFSRYGASLKLLDFSIMTFLWNEKYGHKLDSIEGKQLDYFSEPASLKEARCLIWLLEEHRDKFPALHSALDEFFDIMDSRCTVLRKQDSGEAPFSSTKVKNKSKKKKPKDSKPMLVGSGTTSVTSNNEIITSSEDHSNRNSDSAGPFAVPDHLRQDVEEFEALYDQHSNEYVVRNKKLWDMNPKQKCSTLYDYFSQFLEEHGPLDMSNKMFSAEYEFFPEETRQILEKAGGLKPFLLGCPRFVVIDNCIALKKVASRLKKKRKKKNIKTKVEEISKAGEYVRVKLQLNPAAREFKPDVKSKPVSDSSSAPAFENVKPKPVSANSPKPACEDVKAKPVSDNSSRQVSEDGQPKGVSSNSPKPGSEDANYKRVSCNSPKPVLEDVKPTYWAQSHLVTGYCTYLPFQRFDITQTPPAYINVLPGLPQYTSIYTPLASLSPEYQLPRSVPVVPSFVANDRADKNAAAYFEGHHLNAENVAGHQIASETQILEGSLGISVKSHCSTGDAHTVLSESNRNDEHCGNSNNKCEVIPESTSAVTNIPHVQMVAIQVSWNIIHQEVNTEPYNPFEERQGEISRIEKEHQVLQDQLQEVYENYEQIKLKGLEETRDLEEKLKRHLEENKISKTELDWFLQDLEREIKKWQQEKKEIQERLKSLKKKIKKVSNASEMYTQKNDGKEKEHELHLDQSLEIRQIKLKFIFNIF

SEQ ID NO: 863439 - protein, 732 aa, Homo sapiens
MYNSRASEINLKKLQHLELMEDIVDLAKKVANDSFLIGGLLRIGCKIENKILAMEEALNWIKYAGDVTILTKLGSIDNCWPMLSIFFTEYKYHITKIVMEDCNLLEELKTQSCMDCIEEGELMKMKGNEEFSKERFDIAIIYYTRAIEYRPENYLLYGNRALCFLRTGQFRNALGDGKRATILKNTWPKGHYRYCDALSMLGEYDWALQANIKAQKLCKNDPEGIKDLIQQHVKLQKQIEDLQGRTANKDPIKAFYENRAYTPRSLSAPIFTTSLNFVEKERDFRKINHEMANGGNQNLKVADEALKVDDCDCHPEFSPPSSQPPKHKGKQKSRNNESEKFSSSSPLTLPADLKNILEKQFSKSSRAAHQDFANIMKMLRSLIQDGYMALLEQRCRSAAQAFTELLNGLDPQKIKQLNLAMINYVLVVYGLAISLLGIGQPEELSEAENQFKRIIEHYPSEGLDCLAYCGIGKVYLKKNRFLEALNHFEKARTLIYRLPGVLTWPTSNVIIEESQPQKIKMLLEKFVEECKFPPVPDAICCYQKCHGYSKIQIYITDPDFKDFLQGICLTPDCEGVISKIIIFSSGGEVKCEFEHKVIKEKVPPRPILKQKCSSLEKLRLKEDKKLKRKIQKKEAKKLAQERMEEDLRESNPPKNEEQKETVDNVQRCQFLDDRILQCIKQYADKIKSGIQNTAMLLKELLSWKLARDYHRFQANSYGGLFACSNSVTICGG

SEQ ID NO: 863440 - protein, 300 aa, Homo sapiens
MDNFAEGDFTVADYALLEDCPHVDDCVFAAEFMSNDYVRVTQLYCDGVGVQYKDYIQSERNLEFDICSIWCSKPISVLQDYCDAIKINIFWPLLFQHQNSSVISRLHPCVDANNSRASEINLKKLQHLELMEDIVDLAKKVANDSFLIGGLLRIGCKIENKILAMEEALNWIKYAGDVTILTKLGSIDNCWPMLSIFFTEYKYHITKIVMEDCNLLEELKTQSCMDCIEEGELMKMKGNEEFSKERFDIAIIYYTRAIEYRPENYLLYGNRALCFLRTGQFRTHSHGRKFGKYKSLKRRK

SEQ ID NO: 863441 - protein, 261 aa, Homo sapiens [sequence omitted]

SEQ ID NO: 863442 - protein, 102 aa, Homo sapiens
MKRQLVTNSFLHHLLIGQKRPRNAPRKPKKKKRKRKEEEEEEEEEEEEEEEEEEEEEEEEEEEKKKKKKRKKKKNAAVGCLQIGHESWQESLKTGPAAHVLP

SEQ ID NO: 863443 - protein, 533 aa, Homo sapiens
MKLWVSALLMAWFGVLSCVQAEFFTSIGHMTDLIYAEKELVQSLKEYILVEEAKLSKIKSWANKMEALTSKSAADAEGYLAHPVNAYKLVKRLNTDWPALEDLVLQDSAAGFIANLSVQRQFFPTDEDEIGAAKALMRLQDTYRLDPGTISRGELPGTKYQAMLSVDDCFGMGRSAYNEGDYYHTVLWMEQVLKQLDAGEEATTTKSQVLDYLSYAVFQLGDLHRALELTRRLLSLDPSHERAGGNLRYFEQLLEEEREKTLTNQTEAELATPEGIYERPVDYLPERDVYESLCRGEGVKLTPRRQKRLFCRYHHGNRAPQLLIAPFKEEDEWDSPHIVRYYDVMSDEEIERIKEIAKPKLARATVRDPKTGVLTVASYRVSKSSWLEEDDDPVVARVNRRMQHITGLTVKTAELLQVANYGVGGQYEPHFDFSRRPFDSGLKTEGNRLATFLNYMSDVEAGGATVFPDLGAAIWPKKGTAVFWYNLLRSGEGDYRTRHAACPVLVGCKWVSNKWFHERGQEFLRPCGSTEVD

SEQ ID NO: 863444 - protein, 535 aa, Homo sapiens
MKLWVSALLMAWFGVLSCVQAEFFTSIGHMTDLIYAEKELVQSLKEYILVEEAKLSKIKSWANKMEALTSKSAADAEGYLAHPVNAYKLVKRLNTDWPALEDLVLQDSAAGFIANLSVQRQFFPTDEDEIGAAKALMRLQDTYRLDPGTISRGELPGTKYQAMLSVDDCFGMGRSAYNEGDYYHTVLWMEQVLKQLDAGEEATTTKSQVLDYLSYAVFQLGDLHRALELTRRLLSLDPSHERAGGNLRYFEQLLEEEREKTLTNQTEAELATPEGIYERPVDYLPERDVYESLCRGEGVKLTPRRQKRLFCRYHHGNRAPQLLIAPFKEEDEWDSPHIVRYYDVMSDEEIERIKEIAKPKLARATVRDPKTGVLTVASYRVSKSSWLEEDDDPVVARVNRRMQHITGLTVKTAELLQVANYGVGGQYEPHFDFSRNDERDTFKHLGTGNRVATFLNYMSDVEAGGATVFPDLGAAIWPKKGTAVFWYNLLRSGEGDYRTRHAACPVLVGCKWVSNKWFHERGQEFLRPCGSTEVD

SEQ ID NO: 863445 - protein, 551 aa, Homo sapiens
ASCRIGTRASVQTLPSVTMKLWVSALLMAWFGVLSCVQAEFFTSIGHMTDLIYAEKELVQSLKEYILVEEAKLSKIKSWANKMEALTSKSAADAEGYLAHPVNAYKLVKRLNTDWPALEDLVLQDSAAGFIANLSVQRQFFPTDEDEIGAAKALMRLQDTYRLDPGTISRGELPGTKYQAMLSVDDCFGMGRSAYNEGDYYHTVLWMEQVLKQLDAGEEATTTKSQVLDYLSYAVFQLGDLHRALELTRRLLSLDPSHERAGGNLRYFEQLLEEEREKTLTNQTEAELATPEGIYERPVDYLPERDVYESLCRGEGVKLTPRRQKRLFCRYHHGNRAPQLLIAPFKEEDEWDSPHIVRYYDVMSDEEIERIKEIAKPKLARATVRDPKTGVLTVASYRVSKSSWLEEDDDPVVARVNRRMQHITGLTVKTAELLQVANYGVGGQYEPHFDFSRRPFDSGLKTEGNRLATFLNYMSDVEAGGATVFPDLGAAIWPKKGTAVFWYNLLRSGEGDYRTRHAACPVLVGCKWVSNKWFHERGQEFLRPCGSTEVD

SEQ ID NO: 863446 - protein, 533 aa, Homo sapiens; identical to SEQ ID NO: 863443

SEQ ID NO: 863447 - protein, 565 aa, Homo sapiens
MKRQLVTNSFLHHLLIGQKRPRNAPRTLPSVTMKLWVSALLMAWFGVLSCVQAEFFTSIGHMTDLIYAEKELVQSLKEYILVEEAKLSKIKSWANKMEALTSKSAADAEGYLAHPVNAYKLVKRLNTDWPALEDLVLQDSAAGFIANLSVQRQFFPTDEDEIGAAKALMRLQDTYRLDPGTISRGELPGTKYQAMLSVDDCFGMGRSAYNEGDYYHTVLWMEQVLKQLDAGEEATTTKSQVLDYLSYAVFQLGDLHRALELTRRLLSLDPSHERAGGNLRYFEQLLEEEREKTLTNQTEAELATPEGIYERPVDYLPERDVYESLCRGEGVKLTPRRQKRLFCRYHHGNRAPQLLIAPFKEEDEWDSPHIVRYYDVMSDEEIERIKEIAKPKLARATVRDPKTGVLTVASYRVSKSSWLEEDDDPVVARVNRRMQHITGLTVKTAELLQVANYGVGGQYEPHFDFSRRPFDSGLKTEGNRLATFLNYMSDVEAGGATVFPDLGAAIWPKKGTAVFWYNLLRSGEGDYRTRHAACPVLVGCKWVSNKWFHERGQEFLRPCGSTEVD

SEQ ID NO: 863448 - protein, 374 aa, Homo sapiens
VHLAFCWSLSRTPDCTRNNEGDYYHTVLWMEQVLKQLDAGEEATTTKSQVLDYLSYAVFQLGDLHRALELTRRLLSLDPSHERAGGNLRYFEQLLEEEREKTLTNQTEAELATPEGIYERPVDYLPERDVYESLCRGEGVKLTPRRQKRLFCRYHHGNRAPQLLIAPFKEEDEWDSPHIVRYYDVMSDEEIERIKEIAKPKLARATVRDPKTGVLTVASYRVSKSSWLEEDDDPVVARVNRRMQHITGLTVKTAELLQVANYGVGGQYEPHFDFSRRPFDSGLKTEGNRLATFLNYMSDVEAGGATVFPDLGAAIWPKKGTAVFWYNLLRSGEGDYRTRHAACPVLVGCKWVSNKWFHERGQEFLRPCGSTEVD

SEQ ID NO: 863449 - protein, 122 aa, Homo sapiens
MEQTPSSVTHAERRAIYIPCHVLCGSIALRALGRRVKLYVLYFQMSDVEAGGATVFPDLGAAIWPKKGTAVFWYNLLRSGEGDYRTRHAACPVLVGCKWVSNKWFHERGQEFLRPCGSTEVD

SEQ ID NO: 863450 - protein, 134 aa, Homo sapiens
GRSAYNEGDYYHTVLWMEQVLKQLDAGEEATTTKSQVLDYLSYAVFQLGDLHRALELTRRLLSLGKEILGEGKMGMESGRGTALCWHLPDPSPGTESVYPVTWPVTNALLTLGPVQLLTSSLPTSILALGLRSR

SEQ ID NO: 863451 - protein, 563 aa, Homo sapiens
GRRRRADRATPREVLETPGAASVQTLPSVTMKLWVSALLMAWFGVLSCVQAEFFTSIGHMTDLIYAEKELVQSLKEYILVEEAKLSKIKSWANKMEALTSKSAADAEGYLAHPVNAYKLVKRLNTDWPALEDLVLQDSAAGFIANLSVQRQFFPTDEDEIGAAKALMRLQDTYRLDPGTISRGELPGTKYQAMLSVDDCFGMGRSAYNEGDYYHTVLWMEQVLKQLDAGEEATTTKSQVLDYLSYAVFQLGDLHRALELTRRLLSLDPSHERAGGNLRYFEQLLEEEREKTLTNQTEAELATPEGIYERPVDYLPERDVYESLCRGEGVKLTPRRQKRLFCRYHHGNRAPQLLIAPFKEEDEWDSPHIVRYYDVMSDEEIERIKEIAKPKLARATVRDPKTGVLTVASYRVSKSSWLEEDDDPVVARVNRRMQHITGLTVKTAELLQVANYGVGGQYEPHFDFSRRPFDSGLKTEGNRLATFLNYMSDVEAGGATVFPDLGAAIWPKKGTAVFWYNLLRSGEGDYRTRHAACPVLVGCKWVSNKWFHERGQEFLRPCGSTEVD

SEQ ID NO: 863452 - protein, 563 aa, Homo sapiens; identical to SEQ ID NO: 863451

SEQ ID NO: 863453 - protein, 488 aa, Homo sapiens
MWVDALVFLFLWFHSWANKMEALTSKSAADAEGYLAHPVNAYKLVKRLNTDWPALEDLVLQDSAAGFIANLSVQRQFFPTDEDEIGAAKALMRLQDTYRLDPGTISRGELPGTKYQAMLSVDDCFGMGRSAYNEGDYYHTVLWMEQVLKQLDAGEEATTTKSQVLDYLSYAVFQLGDLHRALELTRRLLSLDPSHERAGGNLRYFEQLLEEEREKTLTNQTEAELATPEGIYERPVDYLPERDVYESLCRGEGVKLTPRRQKRLFCRYHHGNRAPQLLIAPFKEEDEWDSPHIVRYYDVMSDEEIERIKEIAKPKLARATVRDPKTGVLTVASYRVSKSSWLEEDDDPVVARVNRRMQHITGLTVKTAELLQVANYGVGGQYEPHFDFSRRPFDSGLKTEGNRLATFLNYMSDVEAGGATVFPDLGAAIWPKKGTAVFWYNLLRSGEGDYRTRHAACPVLVGCKWVSNKWFHERGQEFLRPCGSTEVD

SEQ ID NO: 863454 - protein, 598 aa, Homo sapiens
LERGSRYVAQWSRVLARKSEDGTSCTCFTLRACYIKDTFWKAGWCEDSVLQPLETSLLFTLPSVTMKLWVSALLMAWFGVLSCVQAEFFTSIGHMTDLIYAEKELVQSLKEYILVEEAKLSKIKSWANKMEALTSKSAADAEGYLAHPVNAYKLVKRLNTDWPALEDLVLQDSAAGFIANLSVQRQFFPTDEDEIGAAKALMRLQDTYRLDPGTISRGELPGTKYQAMLSVDDCFGMGRSAYNEGDYYHTVLWMEQVLKQLDAGEEATTTKSQVLDYLSYAVFQLGDLHRALELTRRLLSLDPSHERAGGNLRYFEQLLEEEREKTLTNQTEAELATPEGIYERPVDYLPERDVYESLCRGEGVKLTPRRQKRLFCRYHHGNRAPQLLIAPFKEEDEWDSPHIVRYYDVMSDEEIERIKEIAKPKLARATVRDPKTGVLTVASYRVSKSSWLEEDDDPVVARVNRRMQHITGLTVKTAELLQVANYGVGGQYEPHFDFSRRPFDSGLKTEGNRLATFLNYMSDVEAGGATVFPDLGAAIWPKKGTAVFWYNLLRSGEGDYRTRHAACPVLVGCKWVSNKWFHERGQEFLRPCGSTEVD

SEQ ID NO: 863455 - protein, 298 aa, Homo sapiens
MYPSHERAGGNLRYFEQLLEEEREKTLTNQTEAELATPEGIYERPVDYLPERDVYESLCRGEGVKLTPRRQKRLFCRYHHGNRAPQLLIAPFKEEDEWDSPHIVRYYDVMSDEEIERIKEIAKPKLARATVRDPKTGVLTVASYRVSKSSWLEEDDDPVVARVNRRMQHITGLTVKTAELLQVANYGVGGQYEPHFDFSRRPFDSGLKTEGNRLATFLNYMSDVEAGGATVFPDLGAAIWPKKGTAVFWYNLLRSGEGDYRTRHAACPVLVGCKWVSNKWFHERGQEFLRPCGSTEVD

SEQ ID NO: 863456 - protein, 509 aa, Homo sapiens
GRRRRADRATPREVLETPGAASVQTLPSVTMKLWVSALLMAWFGVLSCVQAEFFTSIGHMTDLIYAEKELVQSLKEYILVEEAKLSKIKSWANKMEALTSKSAADAEGYLAHPVNAYKLVKRLNTDWPALEDLVLQDSAAGFIANLSVQRQFFPTDEDEIGAAKALMRLQDTYRLDPGTISRGELPGTKYQAMLSVDDCFGMGRSAYNEGDYYHTVLWMEQVLKQLDAGEEATTTKSQVLDYLSYAVFQLGDLHRALELTRRLLSLDPSHERAGGNLRYFEQLLEEEREKTLTNQTEAELATPEGIYERPVDYLPERDVYESLCRGEGVKLTPRRQKRLFCRYHHGNRAPQLLIAPFKEEDEWDSPHIVRYYDVMSDEEIERIKEIAKPKLARATVRDPKTGVLTVASYRVSKSSWLEEDDDPVVARVNRRMQHITGLTVKTAELLQVANYGVGGQYEPHFDFSRRPFDSGLKTEGNRLATFLNYMSDVEAGGATVFPEVSTWGSSESG

SEQ ID NO: 863457 - protein, 326 aa, Homo sapiens
MVDYYEVLGVQRHASPEDIKKAYRKLALKWHPDKNPENKEEAERKFKQVAEAYEVLSDAKKRDIYDKYGKEGLNGGGGGGSHFDSPFEFGFTFRNPDDVFREFFGGRDPFSFDFFEDPFEDFFGNRRGPRGSRSRGTGSFFSAFSGFPSFGSGFSSFDTGFTSFGSLGHGGLTSFSSTSFGGSGMGNFKSISTSTKMVNGRKITTKRIVENGQERVEVEEDGQLKSLTINGVADDDALAEERMRRGQNALPAQPAGLRPPKPPRPASLLRHAPHCLSEEEGEQDRPRAPGPWDPLASAAGLKEGGKRKKQKQREESKKKKSTKGNH

SEQ ID NO: 863458 - protein, 241 aa, Homo sapiens
MVDYYEVLGVQRHASPEDIKKAYRKLALKWHPDKNPENKEEAERKFKQVAEAYEVLSDAKKRDIYDKYGKEGLNGGGGGGSHFDSPFEFGFTFRNPDDVFREFFGGRDPFSFDFFEDPFEDFFGNRRGPRGSRSRGTGSFFSAFSGFPSFGSGFSSFDTGFTSFGSLGHGGLTSFSSTSFGGSGMGNFKSISTSTKMVNGRKITTKRIVENGQERVEVEEDGQLKSLTINGKEQLLRLDNK

SEQ ID NO: 863459 - protein, 241 aa, Homo sapiens; identical to SEQ ID NO: 863458

SEQ ID NO: 863460 - protein, 241 aa, Homo sapiens; identical to SEQ ID NO: 863458

SEQ ID NO: 863461 - protein, 241 aa, Homo sapiens; identical to SEQ ID NO: 863458

SEQ ID NO: 863462 - protein, 218 aa, Homo sapiens
MVDYYEVLGVQRHASPEDIKKAYRKLALKWHPDKNPENKEEAERKFKQVAEAYEVLSDAKKRDIYDKYGKEGLNGGGGGGSHFDSPFEFGFTFRNPDDVFREFFGGRDPFSFDFFEDPFEDFFGNRRGPRGSRSRGTGSFFSAFSGFPSFGSGFSSFDTGFTSFGSLGHGGLTSFSSTSFGGSGMGNFKSISTSTKMVNGRKITTKRRWPVKVLNNKW

SEQ ID NO: 863463 - protein, 282 aa, Homo sapiens
MVDYYEVLGVQRHASPEDIKKAYRKLALKWHPDKNPENKEEAERKFKQVAEAYEVLSDAKKRDIYDKYGKEGLNGGGGGGSHFDSPFEFGFTFRNPDDVFREFFGGRDPFSFDFFGFTSFGSLGHGGLTSFSSTSFGGSGMGNFKSISTSTKMVNGRKITTKRIVENGQERVEVEEDGQLKSLTINGVADDDALAEERMRRGQNALPAQPAGLRPPKPPRPASLLRHAPHCLSEEEGEQDRPRAPGPWDPLASAAGLKEGGKRKKQKQREESKKKKSTKGNH

SEQ ID NO: 863464 - protein, 283 aa, Homo sapiens
MVDYYEVLGVQRHASPEDIKKAYRKLALKWHPDKNPENKEEAERKFKQVAEAYEVLSDAKKRDIYDKYGKEGLNGGGGGGSHFDSPFEFGFTFRNPDDVFREFFGGRDPFSFDFFEDPFEDFFGNRRGPRGSRSRGTGSFFSAFSGFPSFGSGFSSFDTGFTSFGSLGHGGLTSFSSTSFGGSGMGNFKSISTSTKMVNGRKITTKRIVENGQERVEVEEDGQLKSLTINGGGPTNDGLSEDAPSGEGQKTAQAKWTEIERQNKTGNTSGDQRSTGSADEGRK

SEQ ID NO: 863465 - protein, 136 aa, Homo sapiens
MYVVTEQPADEDPFEDFFGNRRGPRGSRSRGTGSFFSAFSGFPSFGSGFSSFDTGFTSFGSLGHGGLTSFSSTSFGGSGMGNFKSISTSTKMVNGRKITTKRIVENGQERVEVEEDGQLKSLTINGKEQLLRLDNK

SEQ ID NO: 863466 - protein, 187 aa, Homo sapiens
GSLIKLIPSSGRKERKESARSRRHHQRSSSWSCEEIRAVTLPPLRPATGRFCPRSTKMVNGRKITTKRIVENGQERVEVEEDGQLKSLTINGVADDDALAEERMRRGQNALPAQPAGLRPPKPPRPASLLRHAPHCLSEEEGEQDRPRAPGPWDPLASAAGLKEGGKRKKQKQREESKKKKSTKGNH

SEQ ID NO: 863467 - protein, 98 aa, Homo sapiens
GSLIKLIPSSGRKERKESARSRRHHQRSSSWSCEEIRAVTLPPLRPATGRFCPRSGTRALGPPRVRSRIERRWQEEEAEAERGVEEEEVDQRQSLDRT

SEQ ID NO: 863468 - protein, 241 aa, Homo sapiens; identical to SEQ ID NO: 863458

SEQ ID NO: 863469 - protein, 217 aa, Homo sapiens
MVDYYEVLGVQRHASPEDIKKAYRKLALKWHPDKNPENKEEAERKFKQVAEAYEVLSDAKKRDIYDKYGKEGLNGGGGGGSHFDSPFEFGFTFRNPDDVFREFFGGRDPFSFDFFEDPFEDFFGNRRGPRGSRSRGTGSFFSAFSGFPSFGSGFSSFDTGFTSFGSLGHGGLTSFSSTSFGGSGMGNFKSISTSTKMVNGRKITTKRGTVVFCILYF

SEQ ID NO: 863470 - protein, 241 aa, Homo sapiens; identical to SEQ ID NO: 863458

SEQ ID NO: 863471 - protein, 129 aa, Homo sapiens [sequence omitted]

SEQ ID NO: 863472 - protein, 226 aa, Homo sapiens
MVDYYEVLGVQRHASPEDIKKAYRKLALKWHPDKNPENKEEAETKKRDIYDKYGKEGLNGGGGGGSHFDSPFEFGFTFRNPDDVFREFFGGRDPFSFDFFEDPFEDFFGNRRGPRGSRSRGTGSFFSAFSGFPSFGSGFSSFDTGFTSFGSLGHGGLTSFSSTSFGGSGMGNFKSISTSTKMVNGRKITTKRIVENGQERVEVEEDGQLKSLTINGKEQLLRLDNK

SEQ ID NO: 863473 - protein, 142 aa, Homo sapiens [sequence omitted]

SEQ ID NO: 863474 - protein, 127 aa, Homo sapiens
MVDYYEVLGVQRHASPEDIKKAYRKLALKWHPDKNPENKEEAERKFKQVAEAYEVLSDAKKRDIYDKYGKEGLNGGGGGWKSLSLSIRIRLLMEEAGGSPQGIDGRQGPIDKLQLGDPIEGYAGEYV

SEQ ID NO: 863475 - protein, 119 aa, Homo sapiens
MNKYDYVLTGYTRDKSFLAMVVDIVQELKQQNPRLVYVCDPVLGDKWDGEGSMSKTPSQKTKEKSRNHLTHELCSNSSSCSPQTWTSDQVDGEQIHCDQSRSLEFRGGRNPKVILPVGF

SEQ ID NO: 863476 - protein, 381 aa, Homo sapiens
GAARNSRVRSRPLRSEGGVCADRVRRAPEPESQPRGAGAGARARAEPEPERAAETVPPPRPRAAAARPGMEEECRVLSIQSHVIRGYVGNRAATFPLQVLGFEIDAVNSVQFSNHTGYAHWKGQVLNSDELQELYEGLRLNNMNKYDYVLTGYTRDKSFLAMVVDIVQELKQQNPRLVYVCDPVLGDKWDGEGSMYVPEDLLPVYKEKVVPLADIITPNQFEAELLSGRKIHSQEEALRVMDMLHSMGPDTVVITSSDLPSPQGSNYLIVLGSQRRRNPAGSVVMERIRMDIRKVDAVFVGTGDLFAAMLLAWTHKHPNNLKVACEKTVSTLHHVLQRTIQCAKAQAGEGVRPSPMQLELRMVQSKRDIEDPEIVVQATVL

SEQ ID NO: 863477 - protein, 239 aa, Homo sapiens
MNKYDYVLTGYTRDKSFLAMVVDIVQELKQQNPRLVYVCDPVLGDKWDGEGSMYVPEDLLPVYKEKVVPLADIITPNQFEAELLSGRKIHSQEEALRVMDMLHSMGPDTVVITSSDLPSPQGSNYLIVLGSQRRRNPAGSVVMERIRMDIRKVDAVFVGTGDLFAAMLLAWTHKHPNNLKVACEKTVSTLHHVLQRTIQCAKAQAGEGVRPSPMQLELRMVQSKRDIEDPEIVVQATVL

SEQ ID NO: 863478 - protein, 272 aa, Homo sapiens
MGRSRPPGYAHWKGQVLNSDELQELYEGLRLNNMNKYDYVLTGYTRDKSFLAMVVDIVQELKQQNPRLVYVCDPVLGDKWDGEGSMYVPEDLLPVYKEKVVPLADIITPNQFEAELLSGRKIHSQEEALRVMDMLHSMGPDTVVITSSDLPSPQGSNYLIVLGSQRRRNPAGSVVMERIRMDIRKVDAVFVGTGDLFAAMLLAWTHKHPNNLKVACEKTVSTLHHVLQRTIQCAKAQAGEGVRPSPMQLELRMVQSKRDIEDPEIVVQATVL

SEQ ID NO: 863479 - protein, 439 aa, Homo sapiens
QAQGTPIARELPLIPCECSTDLLRLDHLHVWASELFSPAVFCQVLSEAATLPGQSISFTFLVPPGGAWEGATAVQRCQFQRHGPAQSAGFQLKDMCNSRRYLSLGSQAPVLDLGTPPPVHCRLLSLALSGTGSWMGRLWKRPDQLAMLMNEADFDGVLGFEIDAVNSVQFSNHTGYAHWKGQVLNSDELQELYEGLRLNNMNKYDYVLTGYTRDKSFLAMVVDIVQELKQQNPRLVYVCDPVLGDKWDGEGSMYVPEDLLPVYKEKVVPLADIITPNQFEAELLSGRKIHSQEEALRVMDMLHSMGPDTVVITSSDLPSPQGSNYLIVLGSQRRRNPAGSVVMERIRMDIRKVDAVFVGTGDLFAAMLLAWTHKHPNNLKVACEKTVSTLHHVLQRTIQCAKAQAGEGVRPSPMQLELRMVQSKRDIEDPEIVVQATVL

SEQ ID NO: 863480 - protein, 303 aa, Homo sapiens
VQIPFIHRGYRGQRGTFPLQVLGFEIDAVNSVQFSNHTGYAHWKGQVLNSDELQELYEGLRLNNMNKYDYVLTGYTRDKSFLAMVVDIVQELKQQNPRLVYVCDPVLGDKWDGEGSMYVPEDLLPVYKEKVVPLADIITPNQFEAELLSGRKIHSQEEALRVMDMLHSMGPDTVVITSSDLPSPQGSNYLIVLGSQRRRNPAGSVVMERIRMDIRKVDAVFVGTGDLFAAMLLAWTHKHPNNLKVACEKTVSTLHHVLQRTIQCAKAQAGEGVRPSPMQLELRMVQSKRDIEDPEIVVQATVL

SEQ ID NO: 863481 - protein, 272 aa, Homo sapiens
GSNAAVSGYAHWKGQVLNSDELQELYEGLRLNNMNKYDYVLTGYTRDKSFLAMVVDIVQELKQQNPRLVYVCDPVLGDKWDGEGSMYVPEDLLPVYKEKVVPLADIITPNQFEAELLSGRKIHSQEEALRVMDMLHSMGPDTVVITSSDLPSPQGSNYLIVLGSQRRRNPAGSVVMERIRMDIRKVDAVFVGTGDLFAAMLLAWTHKHPNNLKVACEKTVSTLHHVLQRTIQCAKAQAGEGVRPSPMQLELRMVQSKRDIEDPEIVVQATVL

SEQ ID NO: 863482 - protein, 254 aa, Homo sapiens
MTTCSQLIVVSLLFSEGDLDSPPKGYTRDKSFLAMVVDIVQELKQQNPRLVYVCDPVLGDKWDGEGSMYVPEDLLPVYKEKVVPLADIITPNQFEAELLSGRKIHSQEEALRVMDMLHSMGPDTVVITSSDLPSPQGSNYLIVLGSQRRRNPAGSVVMERIRMDIRKVDAVFVGTGDLFAAMLLAWTHKHPNNLKVACEKTVSTLHHVLQRTIQCAKAQAGEGVRPSPMQLELRMVQSKRDIEDPEIVVQATVL

SEQ ID NO: 863483 - protein, 199 aa, Homo sapiens
MYRLSSEDPRMQKYVPEDLLPVYKEKVVPLADIITPNQFEAELLSGRKIHSQEEALRVMDMLHSMGPDTVVITSSDLPSPQGSNYLIVLGSQRRRNPAGSVVMERIRMDIRKVDAVFVGTGDLFAAMLLAWTHKHPNNLKVACEKTVSTLHHVLQRTIQCAKAQAGEGVRPSPMQLELRMVQSKRDIEDPEIVVQATVL

SEQ ID NO: 863484 - protein, 355 aa, Homo sapiens
GAARNSRVRSRPLRSEGGVCADRVRRAPEPESQPRGAGAGARARAEPEPERAAETVPPPRPRAAAARPGMEEECRVLSIQSHVIRGYVGNRAATFPLQVLGFEIDAVNSVQFSNHTGYAHWKGQVLNSDELQELYEGLRLNNMNKYDYVLTGYTRDKSFLAMVVDIVQELKQQNPRLVYVCDPVLGDKWDGEGSMYVPEDLLPVYKEKVVPLADIITPNQFEAELLSGRKIHSQEEALRNYLIVLGSQRRRNPAGSVVMERIRMDIRKVDAVFVGTGDLFAAMLLAWTHKHPNNLKVACEKTVSTLHHVLQRTIQCAKAQAGEGVRPSPMQLELRMVQSKRDIEDPEIVVQATVL

SEQ ID NO: 863485 - protein, 351 aa, Homo sapiens
MGHKARLPAGTRVFHTSCVVGSLTPFRLGGGKADPPSACRAHLAQASPPRGCCSHFCPFPRPGPRSLRPYHKVRSFFHTVSWAWQSLHLVASIPSGPFERISWSSLSELPGLRALGRSLRSWRSAGGRVALSWLSECRARGDGTGALLLGLVVPAAGKGQLVEHKELRGWRRPGPGACRRTPARGQAGPGACRRTPARGQAGPDSLAGWDLTGAPGSLGRPRNRLFACAFSSVNGMSWTQDPSALPCWRRFLWALGPSHIPQWAGGHQEVQDHALCFDRKLGLRGAWGLCLRPGQVLDVSPSSWLLWLNYVPPNSHVAALTPAPQCGTGFGDGAPTEVSRLKEAIRALGGP

SEQ ID NO: 863486 - protein, 295 aa, Homo sapiens
GAARNSRVRSRPLRSEGGVCADRVRRAPEPESQPRGAGAGARARAEPEPERAAETVPPPRPRAAAARPGMEEECRVLSIQSHVIRGYVGNRAATFPLQVLGFEIDAVNSVQFSNHTGYAHWKGQVLNSDELQELYEGLRLNNMNKYDYVLTGYTRDKSFLAMVVDIVQELKQQNPRLVYVCDPVLGDKWDGEGSMYVPEDLLPVYKEKVVPLADIITPNQFEAELLSGRKIHSQEEALRWTPSLWALGTCLLPCSWRGHTSTPITSRWPVRRPCLPCTTFCRGPSSVQKPRPGKE

SEQ ID NO: 863487 - protein, 278 aa, Homo sapiens
GAARNSRVRSRPLRSEGGVCADRVRRAPEPESQPRGAGAGARARAEPEPERAAETVPPPRPRAAAARPGMEEECRVLSIQSHVIRGYVGNRAATFPLQVLGFEIDAVNSVQFSNHTGYAHWKGQVLNSDELQELYEGLRLNNMNKYDYVLTGYTRDKSFLAMVVDIVQELKQQNPRLVYVCDPVLGDKWDGEGSMYVPEDLLPVYKEKVVPLADIITPNQFEAELLSGRKIHSQEEALRPGHGAVRAPPLARDTQRVGVSVFVPVKTCNVCLRAMTET

SEQ ID NO: 863488 - protein, 81 aa, Homo sapiens
EQVAGTGHLLSPPGSPWWAVRSVACEKTVSTLHHVLQRTIQCAKAQAGEGVRPSPMQLELRMVQSKRDIEDPEIVVQATVL

SEQ ID NO: 863489 - protein, 351 aa, Homo sapiens; identical to SEQ ID NO: 863485

SEQ ID NO: 863490 - protein, 214 aa, Homo sapiens
GAARNSRVRSRPLRSEGGVCADRVRRAPEPESQPRGAGAGARARAEPEPERAAETVPPPRPRAAAARPGMEEECRVLSIQSHVIRGYVGNRAATFPLQVLGFEIDAVNSVQFSNHTGYAHWKGQVLNSDELQELYEGLRLNNMNKYDYVLTGYTRDKSFLAMVVDIVQELKQQNPRLVYVCDPVLGDKWDGEGSMYVPEDLLPVYKEKVAALEP

SEQ ID NO: 863491 - protein, 246 aa, Homo sapiens
GAARNSRVRSRPLRSEGGVCADRVRRAPEPESQPRGAGAGARARAEPEPERAAETVPPPRPRAAAARPGMEEECRVLSIQSHVIRGYVGNRAATFPLQVLGFEIDAVNSVQFSNHTGYAHWKGQVLNSDELQELYEGLRLNNMNKYDYVLTGYTRDKSFLAMVVDIVQELKQQNPRLVYVCDPVLGDKWDGEGSMYVPEDLLSGLQRTRYLELSRDSTGQGGKPLSVGWTWLDCYGPPTPVVIQVR

SEQ ID NO: 863492 - protein, 381 aa, Homo sapiens; identical to SEQ ID NO: 863476

SEQ ID NO: 863493 - protein, 239 aa, Homo sapiens; identical to SEQ ID NO: 863477

SEQ ID NO: 863494 - protein, 239 aa, Homo sapiens; identical to SEQ ID NO: 863477

SEQ ID NO: 863495 - protein, 239 aa, Homo sapiens; identical to SEQ ID NO: 863477

SEQ ID NO: 863496 - protein, 353 aa, Homo sapiens
GAARNSRVRSRPLRSEGGVCADRVRRAPEPESQPRGAGAGARARAEPEPERAAETVPPPRPRAAAARPGMEEECRVLSIQSHVIRGYVGNRAATFPLQVLGFEIDAVNSVQFSNHTGYAHWKGQVLNSDELQELYEGLRLNNMNKYDYVLTVCDPVLGDKWDGEGSMYVPEDLLPVYKEKVVPLADIITPNQFEAELLSGRKIHSQEEALRVMDMLHSMGPDTVVITSSDLPSPQGSNYLIVLGSQRRRNPAGSVVMERIRMDIRKVDAVFVGTGDLFAAMLLAWTHKHPNNLKVACEKTVSTLHHVLQRTIQCAKAQAGEGVRPSPMQLELRMVQSKRDIEDPEIVVQATVL

SEQ ID NO: 863497 - protein, 399 aa, Homo sapiens
GAARNSRVRSRPLRSEGGVCADRVRRAPEPESQPRGAGAGARARAEPEPERAAETVPPPRPRAAAARPGMEEECRVLSIQSHVIRGYVGNRAATFPLQVLGFEIDAVNSVQFSNHTGYAHWKGQVLNSDELQELYEGLRLNNMNKYDYVLTVIVVSLLFSEGDLDSPPKGYTRDKSFLAMVVDIVQELKQQNPRLVYVCDPVLGDKWDGEGSMYVPEDLLPVYKEKVVPLADIITPNQFEAELLSGRKIHSQEEALRVMDMLHSMGPDTVVITSSDLPSPQGSNYLIVLGSQRRRNPAGSVVMERIRMDIRKVDAVFVGTGDLFAAMLLAWTHKHPNNLKVACEKTVSTLHHVLQRTIQCAKAQAGEGVRPSPMQLELRMVQSKRDIEDPEIVVQATVL

SEQ ID NO: 863498 - protein, 212 aa, Homo sapiens
MNKYDYVLTGYTRDKSFLAMVVDIVQELKQQNPRLVYVCDPVLGDKWDGEGSMYVPEDLLPVYKEKVVPLADIITPNQFEADVVITSSDLPSPQGSNYLIVLGSQRRRNPAGSVVMERIRMDIRKVDAVFVGTGDLFAAMLLAWTHKHPNNLKVACEKTVSTLHHVLQRTIQCAKAQAGEGVRPSPMQLELRMVQSKRDIEDPEIVVQATVL

SEQ ID NO: 863499 - protein, 228 aa, Homo sapiens
MTTCSQLIVVSLLFSEGDLDSPPKGYTRDKSFLAMVVDIVQELKQQNPRLVYVCDPVLGDKWDGEGSMYVPEDLLPVYKEKVVPLADIITPNQFEAELLSGRKIHSQEEALRNYLIVLGSQRRRNPAGSVVMERIRMDIRKVDAVFVGTGDLFAAMLLAWTHKHPNNLKVACEKTVSTLHHVLQRTIQCAKAQAGEGVRPSPMQLELRMVQSKRDIEDPEIVVQATVL

SEQ ID NO: 863500 - protein, 128 aa, Homo sapiens
ARVGLPCAPRSMGYSRTTRRMRRRNPAGSVVMERIRMDIRKVDAVFVGTGDLFAAMLLAWTHKHPNNLKVACEKTVSTLHHVLQRTIQCAKAQAGEGVRPSPMQLELRMVQSKRDIEDPEIVVQATVL

SEQ ID NO: 863501 - protein, 230 aa, Homo sapiens
GAARNSRVRSRPLRSEGGVCADRVRRAPEPESQPRGAGAGARARAEPEPERAAETVPPPRPRAAAARPGMEEECRVLSIQSHVIRGYVGNRAATFPLQVLGFEIDAVNSVQFSNHTGYAHWKGQVLNSDELQELYEGLRLNNMNKYDYVLTGYTRDKSFLAWTHKHPNNLKVACEKTVSTLHHVLQRTIQCAKAQAGEGVRPSPMQLELRMVQSKRDIEDPEIVVQATVL

SEQ ID NO: 863502 - protein, 134 aa, Homo sapiens
MTTCSQLIVVSLLFSEGDLDSPPKGYTRDKSFLAMVVDIVQELKQQNPRLVYVCDPVLGDKWDGEGSMSKTPSQKTKEKSRNHLTHELCSNSSSCSPQTWTSDQVDGEQIHCDQSRSLEFRGGRNPKVILPVGF

SEQ ID NO: 863503 - protein, 234 aa, Homo sapiens
GAARNSRVRSRPLRSEGGVCADRVRRAPEPESQPRGAGAGARARAEPEPERAAETVPPPRPRAAAARPGMEEECRVLSIQSHVIRGYVGNRAATFPLQVLGFEIDAVNSVQFSNHTGYAHWKGQVLNSDELQELYVCDPVLGDKWDGEGSMYVPEDLLPVYKEKVVPLADIITPNQFEAELLSGRKIHSQEEALRPGHGAVRAPPLARDTQRVGVSVFVPVKTCNVCLRAMTET

SEQ ID NO: 863504 - protein, 120 aa, Homo sapiens
MGRLWKRPDQLAMLMNKLILMGCVKRRCQPRGSACSCSHLKAENSDFILGYVCQPQRINYLHTQKQWSRIFWQDFQDLCHRCLISVSSQSVRILKDLKYCKLSVYRGCGFGLVHLQSAHF

SEQ ID NO: 863505 - protein, 192 aa, Homo sapiens
MASNKTTLQKMGKKQNGKSKKVEEAEPEEFVVEKVLDRRVVNGKVEYFLKWKGFTDADNTWEPEENLDCPELIEAFLNSQKAGKEKDGTKRKSLSDSESDDSKSKKKRDAADKPRGFARGLDPERIIGATDSSGELMFLMKWKDSDEADLVLAKEANMKCPQIVIAFYEERLTWHSCPEDEAQYLINGKHGF

SEQ ID NO: 863506 - protein, 183 aa, Homo sapiens
MASNKTTLQKMGKKQNGKSKKVEEAEPEEFVVEKVLDRRVVNGKVEYFLKWKGFTDADNTWEPEENLDCPELIEAFLNSQKAGKEKDGTKRKSLSDSESDDSKSKKKRDAADKPRGFARGLDPERIIGATDSSGELMFLMKWKDSDEADLVLAKEANMKCPQIVIAFYEERLTWHSCPEDEAQ

SEQ ID NO: 863507 - protein, 183 aa, Homo sapiens; identical to SEQ ID NO: 863506

SEQ ID NO: 863508 - protein, 183 aa, Homo sapiens; identical to SEQ ID NO: 863506

SEQ ID NO: 863509 - protein, 183 aa, Homo sapiens; identical to SEQ ID NO: 863506

SEQ ID NO: 863510 - protein, 183 aa, Homo sapiens; identical to SEQ ID NO: 863506

SEQ ID NO: 863511 - protein, 183 aa, Homo sapiens; identical to SEQ ID NO: 863506

SEQ ID NO: 863512 - protein, 183 aa, Homo sapiens; identical to SEQ ID NO: 863506

SEQ ID NO: 863513 - protein, 183 aa, Homo sapiens; identical to SEQ ID NO: 863506

SEQ ID NO: 863514 - protein, 183 aa, Homo sapiens; identical to SEQ ID NO: 863506

SEQ ID NO: 863515 - protein, 183 aa, Homo sapiens; identical to SEQ ID NO: 863506

SEQ ID NO: 863516 - protein, 173 aa, Homo sapiens
MGKKQNGKSKKVEEAEPEEFVVEKVLDRRVVNGKVEYFLKWKGFTDADNTWEPEENLDCPELIEAFLNSQKAGKEKDGTKRKSLSDSESDDSKSKKKRDAADKPRGFARGLDPERIIGATDSSGELMFLMKWKDSDEADLVLAKEANMKCPQIVIAFYEERLTWHSCPEDEAQ

SEQ ID NO: 863517 - protein, 195 aa, Homo sapiens
MEHPMDKSYECGNREMGNTNQEMDKSKKVGRGGQQTARNSESVRVKYWIDEKWNWRRNGIFPVRGRDVADNTWEPEENLDCPELIEAFLNSQKAGKEKDGTKRKSLSDSESDDSKSKKKRDAADKPRGFARGLDPERIIGATDSSGELMFLMKWKDSDEADLVLAKEANMKCPQIVIAFYEERLTWHSCPEDEAQ

SEQ ID NO: 863518 - protein, 183 aa, Homo sapiens; identical to SEQ ID NO: 863506

SEQ ID NO: 863519 - protein, 183 aa, Homo sapiens; identical to SEQ ID NO: 863506

SEQ ID NO: 863520 - protein, 183 aa, Homo sapiens; identical to SEQ ID NO: 863506

SEQ ID NO: 863521 - protein, 77 aa, Homo sapiens
RRGGRRVRCGAVPLSPRAAAFVSPRGCADHEARAPGWGRAPALRHVWTPGFSGGGRERVFARGDSFFKVSRNGVEAS

SEQ ID NO: 863522 - protein, 105 aa, Homo sapiens
MGKKQNGKSKKVEEAEPEEFVVEKVLDRRVVNGKVEYFLKWKGFTDADNTWEPEENLDCPELIEAFLNSQKAGKEKDGTKRKSLSDSESDDSKSKKKRDAMRKRD

SEQ ID NO: 863523 - protein, 113 aa, Homo sapiens
MTKTNEVQGNSTKKEKYTRQQRGSRENDDVNKPPKGPPEAIDTPRKRGESAQQVANQPMADKESEKCPRNKEPRRDEIEQQQDEEKSYEESTTEPAERRDKKKQRRHNKHTEE

SEQ ID NO: 863524 - protein, 183 aa, Homo sapiens; identical to SEQ ID NO: 863506

SEQ ID NO: 863525 - protein, 183 aa, Homo sapiens; identical to SEQ ID NO: 863506

SEQ ID NO: 863526 - protein, 183 aa, Homo sapiens; identical to SEQ ID NO: 863506

SEQ ID NO: 863527 - protein, 183 aa, Homo sapiens; identical to SEQ ID NO: 863506

SEQ ID NO: 863528 - protein, 183 aa, Homo sapiens; identical to SEQ ID NO: 863506

SEQ ID NO: 863529 - protein, 183 aa, Homo sapiens; identical to SEQ ID NO: 863506

SEQ ID NO: 863530 - protein, 183 aa, Homo sapiens; identical to SEQ ID NO: 863506

SEQ ID NO: 863531 - protein, 183 aa, Homo sapiens; identical to SEQ ID NO: 863506

SEQ ID NO: 863532 - protein, 131 aa, Homo sapiens
MASNKTTLQKMGKKQNGKSKKVEEAEPEEFVVEKVLDRRVVNGKVEYFLKWKGFTDADNTWEPEENLDCPELIEAFLNSQKAGKEKDGTKRKSLSDSESDDSKSKKKRDANNWCHRQQWRIDVSHEMERFR

SEQ ID NO: 863533 - protein, 111 aa, Homo sapiens
MASNKTTLQKMGKKQNGKSKKVEEAEPEEFVVEKVLDRRVVNGKVEYFLKWKGFTDADNTWEPEENLDCPELIEAFLNSQKAGKEKDGTKRKSLSDSESDDSKSKKKRDAV

SEQ ID NO: 863534 - protein, 142 aa, Homo sapiens
MASNKTTLQKMGKKQNGKSKKVEEAEPEEFVVEKVLDRRVVNGKVEYFLKWKGFTDADNTWEPEENLDCPELIEAFLNSQKAGKEKDGTNKAAQDLVLAAGSWSTCGSAVGVSWGPSTSTLFLSTSRCILISMSLLAASWST

SEQ ID NO: 863535 - protein, 77 aa, Homo sapiens; identical to SEQ ID NO: 863521

SEQ ID NO: 863536 - protein, 577 aa, Homo sapiens
RRERERERTSLGGPKGKKKNGRNRGGKANNPPYLPPEAEDGNIEYKLKLVNPSQYRFEHLVTQMKWRLQEGRGEAVYQIGVEDNGLLVGLAEEEMRASLKTLHRMAEKVGADITVLREREVDYDSDMPRKITEVLVRKVPDNQQFLDLRVAVLGNVDSGKSTLLGVLTQGELDNGRGRARLNLFRHLHEIQSGRTSSISFEILGFNSKGEVVNYSDSRTAEEICESSSKMITFIDLAGHHKYLHTTIFGLTSYCPDCALLLVSANTGIAGTTREHLGLALALKVPFFIVVSKIDLCAKTTVERTVRQLERVLKQPGCHKVPMLVTSEDDAVTAAQQFAQSPNVTPIFTLSSVSGESLDLLKVFLNILPPLTNSKEQEELMQQLTEFQVDEIYTVPEVGTVVGGTLSSGICREGDQLVVGPTDDGCFLELRVCSIQRNRSACRVLRAGQAATLALGDFDRALLRKGMVMVSPEMNPTICSVFEAEIVLLFHATTFRRGFQVTVHVGNVRQTAVVEKIHAKDKLRTGEKAVVRFRFLKHPEYLKVGAKLLFREGVTKGIGHVTDVQAITAGEAQANMGF

SEQ ID NO: 863537 - protein, 210 aa, Homo sapiens
MITFIDLAGHHKYLHTTIFGLTSYCPDCALLLVSANTGIAGTTREHLGLALALKVPFFIVVSKIDLCAKTTVERTVRQLERVLKQPGCHKVPMLVTSEDDAVTAAQQFAQSPNVTPIFTLSSVSGESLDLLKVFLNILPPLTNSKEQEELMQQLTEFQVDEIYTVPEVGTVVGGTLSRLGFHYQKSWRTVVCWLWREETVLLPIGESPGP

SEQ ID NO: 863538 - protein, 429 aa, Homo sapiens
QGGGAREENTSFRSRDPREEGQRLDSQAEDGNIEYKLKLVNPSQYRFEHLVTQMKWRLQEGRGEAVYQIGVEDNGLLVGLAEEEMRASLKTLHRMAEKVGADITVLREREVDYDSDMPRKITEVLVRKVPDNQQFLDLRVAVLGNVDSGKSTLLGVLTQGELDNGRGRARLNLFRHLHEIQSGRTSSISFEILGFNSKGEVVNYSDSRTAEEICESSSKMITFIDLAGHHKYLHTTIFGLTSYCPDCALLLVSANTGIAGTTREHLGLALALKVPFFIVVSKIDLCAKTTVERTVRQLERVLKQPGCHKVPMLVTSEDDAVTAAQQFAQSPNVTPIFTLSSVSGESLDLLKVFLNILPPLTNSKEQEELMQQLTEFQVDEIYTVPEVGTVVGGTLSRLGFHYQKSWRTVVCWLWREETVLLPIGESPGP

SEQ ID NO: 863539 - protein, 277 aa, Homo sapiens
SGSKGGGDGGGGRGRGRAGGWRQRRMDSRVSELFGGCCRPGGGPAVGGTLKARGAGSSSGCGGPKGKKKNGRNRGGKANNPPYLPPEAEDGNIEYKLKLVNPSQYRFEHLVTQMKWRLQEGRGEAVYQIGVEDNGLLVGLAEEEMRASLKTLHRMAEKVGADITVLREREVDYDSDMPRKITEVLVRKVPDNQQFLDLRVAVLGNVDSGKSTLLGVLTQGELDNGRGRARLNLFRHLHEIQSGRTSSISFEILGFNSKGEVHGINGTQWGQTLRMGW

SEQ ID NO: 863540 - protein, 481 aa, Homo sapiens
SGSKGGGDGGGGRGRGRAGGWRQRRMDSRVSELFGGCCRPGGGPAVGGTLKARGAGSSSGCGGPKGKKKNGRNRGGKANNPPYLPPEAEDGNIEYKYRFEHLVTQMKWRLQEGRGEAVYQIGVEDNGLLVGLAEEEMRASLKTLHRMAEKVGADITVLREREVDYDSDMPRKITEVLVRKVPDNQQFLDLRVAVLGNVDSGKSTLLGVLTQGELDNGRGRARLNLFRHLHEIQSGRTSSISFEILGFNSKGEVVNYSDSRTAEEICESSSKMITFIDLAGHHKYLHTTIFGLTSYCPDCALLLVSANTGIAGTTREHLGLALALKVPFFIVVSKIDLCAKTTVERTVRQLERVLKQPGCHKVPMLVTSEDDAVTAAQQFAQSPNVTPIFTLSSVSGESLDLLKVFLNILPPLTNSKEQEELMQQLTEFQVDEIYTVPEVGTVVGGTLSRLGFHYQKSWRTVVCWLWREETVLLPIGESPGP

SEQ ID NO: 863541 - protein, 302 aa, Homo sapiens
RITHPSLRSPTAACPKPSHCHKSTIPNPLRDIPTVRSQKPGCHKVPMLVTSEDDAVTAAQQFAQSPNVTPIFTLSSVSGESLDLLKVFLNILPPLTNSKEQEELMQQLTEFQVDEIYTVPEVGTVVGGTLSSGICREGDQLVVGPTDDGCFLELRVCSIQRNRSACRVLRAGQAATLALGDFDRALLRKGMVMVSPEMNPTICSVFEAEIVLLFHATTFRRGFQVTVHVGNVRQTAVVEKIHAKDKLRTGEKAVVRFRFLKHPEYLKVGAKLLFREGVTKGIGHVTDVQAITAGEAQANMGF

SEQ ID NO: 863542 - protein, 108 aa, Homo sapiens
RVQEIEEFNSDQDVDVGYENSLLPTSKLPANRIKVGNVRQTAVVEKIHAKDKLRTGEKAVVRFRFLKHPEYLKVGAKLLFREGVTKGIGHVTDVQAITAGEAQANMGF

SEQ ID NO: 863543 - protein, 118 aa, Homo sapiens
VRKEGGLPQTGRELLDPNNGNKTPLRVGSGLIGLWRVESHGWQRMGQKALARGVTTYLLQDKLRTGEKAVVRFRFLKHPEYLKVGAKLLFREGVTKGIGHVTDVQAITAGEAQANMGF

SEQ ID NO: 863544 - protein, 627 aa, Homo sapiens
SGSKGGGDGGGGRGRGRAGGWRQRRMDSRVSELFGGCCRPGGGPAVGGTLKARGAGSSSGCGGPKGKKKNGRNRGGKANNPPYLPPEAEDGNIEYKLKLVNPSQYRFEHLVTQMKWRLQEGRGEAVYQIGVEDNGLLVGLAEEEMRASLKTLHRMAEKVGADITVLREREVDYDSDMPRKITEVLVRKVPDNQQFLDLRVAVLGNVDSGKSTLLGVLTQGELDNGRGRARLNLFRHLHEIQSGRTSSISFEILGFNSKGEVVNYSDSRTAEEICESSSKMITFIDLAGHHKYLHTTIFGLTSYCPDCALLLVSANTGIAGTTREHLGLALALKVPFFIVVSKIDLCAKTTVERTVRQLERVLKQPGCHKVPMLVTSEDDAVTAAQQFAQSPNVTPIFTLSSVSGESLDLLKVFLNILPPLTNSKEQEELMQQLTEFQVDEIYTVPEVGTVVGGTLSSGICREGDQLVVGPTDDGCFLELRVCSIQRNRSACRVLRAGQAATLALGDFDRALLRKGMVMVSPEMNPTICSVFEAEIVLLFHATTFRRGFQVTVHVGNVRQTAVVEKIHAKDKLRTGEKAVVRFRFLKHPEYLKVGAKLLFREGVTKGIGHVTDVQAITAGEAQANMGF

SEQ ID NO: 863545 - protein, 210 aa, Homo sapiens; identical to SEQ ID NO: 863537

SEQ ID NO: 863546 - protein, 210 aa, Homo sapiens; identical to SEQ ID NO: 863537

SEQ ID NO: 863547 - protein, 340 aa, Homo sapiens
MITFIDLAGHHKYLHTTIFGLTSYCPDCALLLVSANTGIAGTTREHLGLALALKVPFFIVVSKIDLCAKTTVERTVRQLERVLKQPGCHKVPMLVTSEDDAVTAAQQFAQSPNVTPIFTLSSVSGESLDLLKVFLNILPPLTNSKEQEELMQQLTEFQVDEIYTVPEVGTVVGGTLSSGICREGDQLVVGPTDDGCFLELRVCSIQRNRSACRVLRAGQAATLALGDFDRALLRKGMVMVSPEMNPTICSVFEAEIVLLFHATTFRRGFQVTVHVGNVRQTAVVEKIHAKDKLRTGEKAVVRFRFLKHPEYLKVQSSSIVTKYCGLFSVVQVSRILRPFT

SEQ ID NO: 863548 - protein, 116 aa, Homo sapiens
GRESLMLELPFLGLGSVPPQGMVMVSPEMNPTICSVFEAEIVLLFHATTFRRGFQVTVHVGNVRQTAVVEKIHAKVRGTWPSISPEVRKEGGLPQTGRELLDPTMGIKPHLGWVAA

SEQ ID NO: 863549 - protein, 283 aa, Homo sapiens
RGDIDFWEKQAEDGNIEYKLKLVNPSQYRFEHLVTQMKWRLQEGRGEAFTPIFTLSSVSGESLDLLKVFLNILPPLTNSKEQEELMQQLTEFQVDEIYTVPEVGTVVGGTLSSGICREGDQLVVGPTDDGCFLELRVCSIQRNRSACRVLRAGQAATLALGDFDRALLRKGMVMVSPEMNPTICSVFEAEIVLLFHATTFRRGFQVTVHVGNVRQTAVVEKIHAKDKLRTGEKAVVRFRFLKHPEYLKVGAKLLFREGVTKGIGHVTDVQAITAGEAQANMGF

SEQ ID NO: 863550 - protein, 577 aa, Homo sapiens; identical to SEQ ID NO: 863536

SEQ ID NO: 863551 - protein, 489 aa, Homo sapiens
SGSKGGGDGGGGRGRGRAGGWRQRRMDSRVSELFGGCCRPGGGPAVGGTLKARGAGSSSGCGGPKGKKKNGRNRGGKANNPPYLPPEAEDGNIEYKLKLVNPSQYRFEHLVTQMKWRLQEGRGEAVYQIGVEDNGLLVGLAEEEMRASLKTLHRMAEKVGADITVLREREVDYDSDMPRKITEVLVRKVPDNQQFLDLRVAVLGNVDSGKSTLLGVLTQGELDNGRGRARLNLFRHLHEIQSGRTSSISFEILGFNSKGEVVNYSDSRTAEEICESSSKMITFIDLAGHHKYLHTTIFGLTSYCPDCALLLVSANTGIAGTTREHLGLALALKVPFFIVVSKIDLCAKTTVERTVRQLERVLKQPGCHKVPMLVTSEDDAVTAAQQFAQSPNVTPIFTLSSVSGESLDLLKVFLNILPPLTNSKEQEELMQQLTEFQVDEIYTVPEVGTVVGGTLSRLGFHYQKSWRTVVCWLWREETVLLPIGESPGP

SEQ ID NO: 863552 - protein, 376 aa, Homo sapiens
MKWRLQEGRGEAVYQIGVEDNGLLVGLAEEEMRASLKTLHRMAEKVGADITVLREREVDYDSDMPRKITEVLVRKVPDNQQFLDLRVAVLGNVDSGKSTLLGVLTQGELDNGRGRARLNLFRHLHEIQSGRTSSISFEILGFNSKGEVVNYSDSRTAEEICESSSKMITFIDLAGHHKYLHTTIFGLTSYCPDCALLLVSANTGIAGTTREHLGLALALKVPFFIVVSKIDLCAKTTVERTVRQLERVLKQPGCHKVPMLVTSEDDAVTAAQQFAQSPNVTPIFTLSSVSGESLDLLKVFLNILPPLTNSKEQEELMQQLTEFQVDEIYTVPEVGTVVGGTLSRLGFHYQKSWRTVVCWLWREETVLLPIGESPGP

SEQ ID NO: 863553 - protein, 210 aa, Homo sapiens; identical to SEQ ID NO: 863537

SEQ ID NO: 863554 - protein, 83 aa, Homo sapiens
GDLEDPFDVVGNVRQTAVVEKIHAKDKLRTGEKAVVRFRFLKHPEYLKVGAKLLFREGVTKGIGHVTDVQAITAGEAQANMGF

SEQ ID NO: 863555 - protein, 125 aa, Homo sapiens
GSLRLGALRGGEQRISYPTSTSGQIELFNLLHSKLVKIVKRCISCPPIESMVGNVRQTAVVEKIHAKDKLRTGEKAVVRFRFLKHPEYLKVGAKLLFREGVTKGIGHVTDVQAITAGEAQANMGF

SEQ ID NO: 863556 - protein, 210 aa, Homo sapiens; identical to SEQ ID NO: 863537

SEQ ID NO: 863557 - protein, 210 aa, Homo sapiens; identical to SEQ ID NO: 863537

SEQ ID NO: 863558 - protein, 106 aa, Homo sapiens
PLTQSSVRGGERLEFLSLAIHPQFLDLRVAVLGNVDSGKSTLLGVLTQGELDNGRGRARLNLFRHLHEIQSGRTSSISFEILGFNSKGEVHGINGTQWGQTLRMGW

SEQ ID NO: 863559 - protein, 382 aa, Homo sapiens
MRSGGRGRPRLRLGERGLMEPLLPPKRRLLPRVRLLPLLLALAVGSAFYTIWSGWHRRTEELPLGRELRVPLIGSLPEARLRRVVGQLDPQRLWSTYLRPLLVVRTPGSPGNLQVRKFLEATLRSLTAGWHVELDPFTASTPLGPVDFGNVVATLDPRAARHLTLACHYDSKLFPPGSTPFVGATDSAVPCALLLELAQALDLELSRAKKQAAPVTLQLLFLDGEEALKEWGPKDSLYGSRHLAQLMESIPHSPGPTRIQAIELFMLLDLLGAPNPTFYSHFPRTVRWFHRLRSIEKRLHRLNLLQSHPQEVMYFQPGEPFGSVEDDHIPFLRRGVPVLHLISTPFPAVWHTPADTEVNLHPPTVHNLCRILAVFLAEYLGL

SEQ ID NO: 863560 - protein, 382 aa, Homo sapiens; identical to SEQ ID NO: 863559

SEQ ID NO: 863561 - protein, 75 aa, Homo sapiens
KVTWRLGLGSWVVVGCSGPDKVSSVTSGVPVLHLISTPFPAVWHTPADTEVNLHPPTVHNLCRILAVFLAEYLGL

SEQ ID NO: 863562 - protein, 288 aa, Homo sapiens
MRSGGRGRPRLRLGERGLMEPLLPPKRRLLPRVRLLPLLLALAVGSAFYTIWSGWHRRTEELPLGRELRVPLIGSLPEARLRRVVGQLDPQRLWSTYLRPLLVVRTPGSPGNLQVRKAAPVTLQLLFLDGEEALKEWGPKDSLYGSRHLAQLMESIPHSPGPTRIQAIELFMLLDLLGAPNPTFYSHFPRTVRWFHRLRSIEKRLHRLNLLQSHPQEVMYFQPGEPFGSVEDDHIPFLRRGVPVLHLISTPFPAVWHTPADTEVNLHPPTVHNLCRILAVFLAEYLGL

SEQ ID NO: 863563 - protein, 117 aa, Homo sapiens [sequence omitted]

SEQ ID NO: 863564 - protein, 1209 aa, Homo sapiens
MPRGEAPGPGRRGAKDEALGEESGERWSPEFHLQRKLADSSHSEQQDRNRVSEELIMVVQEMKKYFPSERRNKPSTLDALNYALRCVHSVQANSEFFQILSQNGAPQADVSMYSLEELATIASEHTSKNTDTFVAVFSFLSGRLVHISEQAALILNRKKDVLASSHFVDLLAPQDMRVFYAHTARAQLPFWNNWTQRAAARYECAPVKPFFCRIRGGEDRKQEKCHSPFRIIPYLIHVHHPAQPELESEPCCLTVVEKIHSGYEAPRIPVNKRIFTTTHTPGCVFLEVDEKAVPLLGYLPQDLIGTSILSYLHPEDRSLMVAIHQKVLKYAGHPPFEHSPIRFCTQNGDYIILDSSWSSFVNPWSRKISFIIGRHKVRTSPLNEDVFATKIKKMNDNDKDITELQEQIYKLLLQPVHVSVSSGYGSLGSSGSQEQLVSIASSSEASGHRVEETKAEQMTLQQVYASVNKIKNLGQQLYIESMTKSSFKPVTGTRTEPNGGGESANGGGECKTFTSFHQTLKNNSVYTEPCEDLRNDEHSPSYQQINCIDSVIRYLKSYNIPALKRKCISCTNTTSSSSEEDKQNHKADDVQALQAGLQIPAIPKSEMPTNGRSIDTGGGAPQILSTAMLSLGSGISQCGYSSTIVHVPPPETARDATLFCEPWTLNMQPAPLTSEEFKHVGLTAAVLSAHTQKEEQNYVDKFREKILSSPYSSYLQQESRSKAKYSYFQGDSTSKQTRSAGCRKGKHKRKKLPEPPDSSSSNTGSGPRRGAHQNAQPCCPSAASSPHTSSPTFPPAAMVPSQAPYLVPAFPLPAATSPGREYAAPGTAPEGLHGPPLSEGLQPYPAFPFPYLDTFMTVFLPDPPVCPLLSPSFLPCPFLGATASSAISPSMSSAMSPTLDPPPSVTSQRREEEKWEAQSEGHPFITSRSSSPLQLNLLQEEMPRPSESPDQMRRNTCPQTEYCVTGNNGSESSPATTGALSTGSPPRENPSHPTASALSTGSPPMKNPSHPTASALSTGSPPMKNPSHPTASTLSMGLPPSRTPSHPTATVLSTGSPPSESPSRTGSAASGSSDSSIYLTSSVYSSKISQNGQQSQDVQKKETFPNVAEEPIWRMIRQTPERILMTYQVPERVKEVVLKEDLEKLESMRQQQPQFSHGQKEELAKVYNWIQSQTVTQEIDIQACVTCENEDSADGAATSCGQVLVEDSC

SEQ ID NO: 863565 - protein, 1184 aa, Homo sapiens [sequence omitted]

SEQ ID NO: 863566 - protein, 716 aa, Homo sapiens
MLGTFNCTSLYSVSGECKTFTSFHQTLKNNSVYTEPCEDLRNDEHSPSYQQINCIDSVIRYLKSYNIPALKRKCISCTNTTSSSSEEDKQNHKADDVQALQAGLQIPAIPKSEMPTNGRSIDTGGGAPQILSTAMLSLGSGISQCGYSSTIVHVPPPETARDATLFCEPWTLNMQPAPLTSEEFKHVGLTAAVLSAHTQKEEQNYVDKFREKILSSPYSSYLQQESRSKAKYSYFQGDSTSKQTRSAGCRKGKHKRKKLPEPPDSSSSNTGSGPRRGAHQNAQPCCPSAASSPHTSSPTFPPAAMVPSQAPYLVPAFPLPAATSPGREYAAPGTAPEGLHGPPLSEGLQPYPAFPFPYLDTFMTVFLPDPPVCPLLSPSFLPCPFLGATASSAISPSMSSAMSPTLDPPPSVTSQRREEEKWEAQSEGHPFITSRSSSPLQLNLLQEEMPRPSESPDQMRRNTCPQTEYCVTGNNGSESSPATTGALSTGSPPRENPSHPTASALSTGSPPMKNPSHPTASALSTGSPPMKNPSHPTASTLSMGLPPSRTPSHPTATVLSTGSPPSESPSRTGSAASGSSDSSIYLTSSVYSSKISQNGQQSQDVQKKETFPNVAEEPIWRMIRQTPERILMTYQVPERVKEVVLKEDLEKLESMRQQQPQFSHGQKEELAKVYNWIQSQTVTQEIDIQACVTCENEDSADGAATSCGQVLVEDSC

SEQ ID NO: 863567 - protein, 1202 aa, Homo sapiens
MPRGEAPGPGRRGAKDEALGEESGERWSPEFHLQRKLADSSHSEQQDRNRVSEELIMVVQEMKKYFPSERRNKPSTLDALNYALRCVHSVQANSEFFQILSQNGAPQADVSMYSLEELATIASEHTSKNTDTFVAVFSFLSGRLVHISEQAALILNRKKDVLASSHFVDLLAPQDMRVFYAHTARAQLPFWNNWTQRAAARYECAPVKPFFCRIRGGEDRKQEKCHSPFRIIPYLIHVHHPAQPELESEPCCLTVVEKIHSGYEAPRIPVNKRIFTTTHTPGCVFLEVDEKAVPLLGYLPQDLIGTSILSYLHPEDRSLMVAIHQKVLKYAGHPPFEHSPIRFCTQNGDYIILDSSWSSFVNPWSRKISFIIGRHKVRTSPLNEDVFATKIKKMNDNDKDITELQEQIYKLLLQPVHVSVSSGYGSLGSSGSQEQLVSIASSSEASGHRVEETKAEQMTLQQVYASVNKIKNLGQQLYIESMTKSSFKPVTGTRTEPNGGGECKTFTSFHQTLKNNSVYTEPCEDLRNDEHSPSYQQINCIDSVIRYLKSYNIPALKRKCISCTNTTSSSSEEDKQNHKADDVQALQAGLQIPAIPKSEMPTNGRSIDTGGGAPQILSTAMLSLGSGISQCGYSSTIVHVPPPETARDATLFCEPWTLNMQPAPLTSEEFKHVGLTAAVLSAHTQKEEQNYVDKFREKILSSPYSSYLQQESRSKAKYSYFQGDSTSKQTRSAGCRKGKHKRKKLPEPPDSSSSNTGSGPRRGAHQNAQPCCPSAASSPHTSSPTFPPAAMVPSQAPYLVPAFPLPAATSPGREYAAPGTAPEGLHGPPLSEGLQPYPAFPFPYLDTFMTVFLPDPPVCPLLSPSFLPCPFLGATASSAISPSMSSAMSPTLDPPPSVTSQRREEEKWEAQSEGHPFITSRSSSPLQLNLLQEEMPRPSESPDQMRRNTCPQTEYCVTGNNGSESSPATTGALSTGSPPRENPSHPTASALSTGSPPMKNPSHPTASALSTGSPPMKNPSHPTASTLSMGLPPSRTPSHPTATVLSTGSPPSESPSRTGSAASGSSDSSIYLTSSVYSSKISQNGQQSQDVQKKETFPNVAEEPIWRMIRQTPERILMTYQVPERVKEVVLKEDLEKLESMRQQQPQFSHGQKEELAKVYNWIQSQTVTQEIDIQACVTCENEDSADGAATSCGQVLVEDSC

SEQ ID NO: 863568 - protein, 270 aa, Homo sapiens
MPRGEAPGPGRRGAKDEALGEESGERWSPEFHLQRKLADSSHSEQQDRNRVSEELIMVVQEMKKYFPSERRNKPSTLDALNYALRCVHSVQANSEFFQILSQNGAPQADVSMYSLEELATIASEHTSKNTDTFVAVFSFLSGRLVHISEQAALILNRKKDVLASSHFVDLLAPQDMRVFYAHTARAQLPFWNNWTQRGNRTNVQMSIFPHQDQFHSYRNSTEINILFRTCTLSGFSYSCYRKSRDENSILKASDNILNTFVSILSHLFHR

SEQ ID NO: 863569 - protein, 85 aa, Homo sapiens
GGEDRKQEKCHSPFRIIPYLIHVHHPAQPELESEPCCLTVVEKIHSGYEGKSVDKMQKCQQSDRNMGKSVYVSHRTTKRALGSPI

SEQ ID NO: 863570 - protein, 1202 aa, Homo sapiens; identical to SEQ ID NO: 863567

SEQ ID NO: 863571 - protein, 1123 aa, Homo sapiens
SVELYYLPEDLTGTSILSYLHPEDRSLMVAIHQKVLKYAGHPPFEHSPIRFCTQNGDYIILEFQLVQHKNQAALILNRKKDVLASSHFVDLLAPQDMRVFYAHTARAQLPFWNNWTQRAAARYECAPVKPFFCRIRGGEDRKQEKCHSPFRIIPYLIHVHHPAQPELESEPCCLTVVEKIHSGYEAPRIPVNKRIFTTTHTPGCVFLEVDEKAVPLLGYLPQDLIGTSILSYLHPEDRSLMVAIHQKVLKYAGHPPFEHSPIRFCTQNGDYIILDSSWSSFVNPWSRKISFIIGRHKVRTSPLNEDVFATKIKKMNDNDKDITELQEQIYKLLLQPVHVSVSSGYGSLGSSGSQEQLVSIASSSEASGHRVEETKAEQMTLQQVYASVNKIKNLGQQLYIESMTKSSFKPVTGTRTEPNGGGECKTFTSFHQTLKNNSVYTEPCEDLRNDEHSPSYQQINCIDSVIRYLKSYNIPALKRKCISCTNTTSSSSEEDKQNHKADDVQALQAGLQIPAIPKSEMPTNGRSIDTGGGAPQILSTAMLSLGSGISQCGYSSTIVHVPPPETARDATLFCEPWTLNMQPAPLTSEEFKHVGLTAAVLSAHTQKEEQNYVDKFREKILSSPYSSYLQQESRSKAKYSYFQGDSTSKQTRSAGCRKGKHKRKKLPEPPDSSSSNTGSGPRRGAHQNAQPCCPSAASSPHTSSPTFPPAAMVPSQAPYLVPAFPLPAATSPGREYAAPGTAPEGLHGPPLSEGLQPYPAFPFPYLDTFMTVFLPDPPVCPLLSPSFLPCPFLGATASSAISPSMSSAMSPTLDPPPSVTSQRREEEKWEAQSEGHPFITSRSSSPLQLNLLQEEMPRPSESPDQMRRNTCPQTEYCVTGNNGSESSPATTGALSTGSPPRENPSHPTASALSTGSPPMKNPSHPTASALSTGSPPMKNPSHPTASTLSMGLPPSRTPSHPTATVLSTGSPPSESPSRTGSAASGSSDSSIYLTSSVYSSKISQNGQQSQDVQKKETFPNVAEEPIWRMIRQTPERILMTYQVPERVKEVVLKEDLEKLESMRQQQPQFSHGQKEELAKVYNWIQSQTVTQEIDIQACVTCENEDSADGAATSCGQVLVEDSC

SEQ ID NO: 863572 - protein, 1035 aa, Homo sapiens
MPRGEAPGPGRRGAKDEALGEESGERWSPEFHLQRKLADSSHSEQQDRNRVSEELIMVVQEMKKYFPSERRNKPSTLDALNYALRCVHSVQANSEFFQILSQNGAPQADVSMYSLEELATIASEHTSKNTDTFVAVFSFLSGRLVHISEQAALILNRKKDVLASSHFVDLLAPQDMRVFYAHTARAQLPFWNNWTQRAAARYECAPVKPFFCRIRGGEDRKQEKCHSPFRIIPYLIHVHHPAQPELESEPCCLTVVEKIHSGYEAPRIPVNKRIFTTTHTPGCVFLEVDEKAVPLLGYLPQDLIGTSILSYLHPEDRSLMVAIHQKVLKYAGHPPFEHSPIRFCTQNGDYIILDSSWSSFVNPWSRKISFIIGRHKVRTSPLNEDVFATKIKKMNDNDKDITELQEQIYKLLLQPVHVSVSSGYGSLGSSGSQEQLVSIASSSEASGHRVEETKAEQMTLQQVYASVNKIKNLGQQLYIESMTKSSFKPVTGTRTEPNGGGECKTFTSFHQTLKNNSVYTEPCEDLRNDEHSPSYQQINCIDSVIRYLKSYNIPALKRKCISCTNTTSSSSEEDKQNHKADDVQALQAGLQIPAIPKSEMPTNGRSIDTGGGAPQILSTAMLSLGSGISQCGYSSTIVHVPPPETARDATLFCEPWTLNMQPAPLTSEEFKHVGLTAAVLSAHTQKEEQNYVDKFREKILSSPYSSYLQQESRSKAKYSYFQGDSTSKQTRSAGCRKGKHKRKKLPEPPDSSSSNTGSGPRRGAHQNAQPCCPSAASSPHTSSPTFPPAAMVPSQAPYLVPAFPLPAATSPGREYAAPGTAPEGLHGPPLSEGLQPYPAFPFPYLDTFMTVFLPDPPVCPLLSPSFLPCPFLGATASSAISPSMSSAMSPTLDPPPSVTSQRREEEKWEAQSEGHPFITSRSSSPLQLNLLQEEMPRPSESPDQMRRNTCPQTEYCVTGNNGSESSPATTVFCPRGHLPANPHPELVQQHQEAATAVYTLLVVFILLKSPKMGSNLRTYRKKKHFLMSPKSPSGE

SEQ ID NO: 863573 - protein, 575 aa, Homo sapiens
MPRGEAPGPGRRGAKDEALGEESGERWSPEFHLQRKLADSSHSEQQDRNRVSEELIMVVQEMKKYFPSERRNKPSTLDALNYALRCVHSVQANSEFFQILSQNGAPQADVSMYSLEELATIASEHTSKNTDTFVAVFSFLSGRLVHISEQAALILNRKKDVLASSHFVDLLAPQDMRVFYAHTARAQLPFWNNWTQRAAARYECAPVKPFFCRIRGGEDRKQEKCHSPFRIIPYLIHVHHPAQPELESEPCCLTVVEKIHSGYEAPRIPVNKRIFTTTHTPGCVFLEVDEKAVPLLGYLPQDLIGTSILSYLHPEDRSLMVAIHQKVLKYAGHPPFEHSPIRFCTQNGDYIILDSSWSSFVNPWSRKISFIIGRHKVRTSPLNEDVFATKIKKMNDNDKDITELQEQIYKLLLQPVHVSVSSGYGSLGSSGSQEQLVSIASSSEASGHRVEETKAEQMTLQQVYASVNKIKNLGQQLYIESMTKSSFKPVTGTRTEPNGGGESANGGGESAGSPKDLLPWAVTLCIDVMYVIREHKVMTLCCCFSYFLICLDSNSNSNSSNNNGSNKYCSERKWY

SEQ ID NO: 863574 - protein, 164 aa, Homo sapiens
MPRGEAPGPGRRGAKDEALGEESGERWSPEFHLQRKLADSSHSEQQDRNRVSEELIMVVQEMKKYFPSERRNKPSTLDALNYALRCVHSVQANSEFFQILSQNGAPQADVSMYSLEELATIASEHTSKNTFQYLLLQVVTTGCYRTGYLCGSIFISVWKVSAHF

SEQ ID NO: 863575 - protein, 428 aa, Homo sapiens
MKRGGRDSDRNSSEEGTAEKSKKLRTTNEHSQTCDWGNLLQDIILQVFKYLPLLDRAHASQVCRNWNQVFHMPDLWRCFEFELNQPATSYLKATHPELIKQIIKRHSNHLQYVSFKVDSSKESAEAACDILSQLVNCSLKTLGLISTARPSFMDLPKSHFISALTVVFVNSKSLSSLKIDDTPVDDPSLKVLVANNSDTLKLLKMSSCPHVSPAGILCVADQCHGLRELALNYHLLSDELLLALSSEKHVRLEHLRIDVVSENPGQTHFHTIQKSSWDAFIRHSPKVNLVMYFFLYEEEFDPFFRYEIPATHLYFGRSVSKDVLGRVGMTCPRLVELVVCANGLRPLDEELIRIAERCKNLSAIGLGECEVSCSAFVEFVKMCGGRLSQLSIMEEVLIPDQKYSLEQIHWEVSKHLGRVWFPDMMPTW

SEQ ID NO: 863576 - protein, 380 aa, Homo sapiens
MKRGGRDSDRNSSEEGTAEKSKKLRTTNEHSQTCDWGNLLQDIILQVFKYLPLLDRAHASQVCRNWNQVDSSKESAEAACDILSQLVNCSLKTLGLISTARPSFMDLPKSHFISALTVVFVNSKSLSSLKIDDTPVDDPSLKVLVANNSDTLKLLKMSSCPHVSPAGILCVADQCHGLRELALNYHLLSDELLLALSSEKHVRLEHLRIDVVSENPGQTHFHTIQKSSWDAFIRHSPKVNLVMYFFLYEEEFDPFFRYEIPATHLYFGRSVSKDVLGRVGMTCPRLVELVVCANGLRPLDEELIRIAERCKNLSAIGLGECEVSCSAFVEFVKMCGGRLSQLSIMEEVLIPDQKYSLEQIHWEVSKHLGRVWFPDMMPTW

SEQ ID NO: 863577 - protein, 276 aa, Homo sapiens
MDLPKSHFISALTVVFVNSKSLSSLKIDDTPVDDPSLKVLVANNSDTLKLLKMSSCPHVSPAGILCVADQCHGLRELALNYHLLSDELLLALSSEKHVRLEHLRIDVVSENPGQTHFHTIQKSSWDAFIRHSPKVNLVMYFFLYEEEFDPFFRYEIPATHLYFGRSVSKDVLGRVGMTCPRLVELVVCANGLRPLDEELIRIAERCKNLSAIGLGECEVSCSAFVEFVKMCGGRLSQLSIMEEVLIPDQKYSLEQIHWEVSKHLGRVWFPDMMPTW

SEQ ID NO: 863578 - protein, 428 aa, Homo sapiens; identical to SEQ ID NO: 863575

SEQ ID NO: 863579 - protein, 227 aa, Homo sapiens
MKRGGRDSDRNSSEEGTAEKSKKLRTTNEHSQTCDWGNLLQDIILQVFKYLPLLDRAHASQVCRNWNQVFHMPDLWRCFEFELNQPATSYLKATHPELIKQIIKRHSNHLQYVSFKVDSSKESAEAACDILSQLVNCSLKTLGLISTARPSFMDLPKSHFISALTVVFVNSKSLSSLKIDDTPVDDPSLKVLVANNSDTLKLLKMSSCPHVSPAETCSVDHQILKGP

SEQ ID NO: 863580 - protein, 428 aa, Homo sapiens; identical to SEQ ID NO: 863575

SEQ ID NO: 863581 - protein, 428 aa, Homo sapiens; identical to SEQ ID NO: 863575

SEQ ID NO: 863582 - protein, 250 aa, Homo sapiens
MKRGGRDSDRNSSEEGTAEKSKKLRTTNEHSQTCDWGNLLQDIILQVFKYLPLLDRAHASQVCRNWNQVFHMPDLWRCFEFELNQPATSYLKATHPELIKQIIKRHSNHLQYVSFKVDSSKESAEAACDILSQLVNCSLKTLGLISTARPSFMDLPKSHFISALTVVFVNSKSLSSLKIDDTPVDDPSLKVLVANNSDTLKLLKMSSCPHVSPAAISDRRRLCLLCQRLESTSQVCGLCPRLRTGVLPPG

SEQ ID NO: 863583 - protein, 130 aa, Homo sapiens [sequence omitted]

SEQ ID NO: 863584 - protein, 130 aa, Homo sapiens [sequence omitted]

SEQ ID NO: 863585 - protein, 130 aa, Homo sapiens [sequence omitted]

SEQ ID NO: 863586 - protein, 118 aa, Homo sapiens
MAGEQSGPRASELRPRHVPPSPPLAGAGAPRRETFRTQAGRRGAVAPSRSFLVSAMFFFFLRRSFALFAQAGGQWRRLGSLQPPPPGLKGLSGLRPRCSCKLEPAYAPSAGLAAAERG

SEQ ID NO: 863587 - protein, 130 aa, Homo sapiens [sequence omitted]

SEQ ID NO: 863588 - protein, 130 aa, Homo sapiens [sequence omitted]

SEQ ID NO: 863589 - protein, 270 aa, Homo sapiens
VTPRTGREPGGVRSRQAAWLMAVCGLGSRLGLGSRLGLRGCFGAARLLYPRFQSRGPQGVEDGDRPQPSSKTPRIPKIYTKTGDKGFSSTFTGERRPKDDQVFEAVGTTDELSSAIGFALELVTEKGHTFAEELQKIQCTLQDVGSALATPCSSAREAHLKYTTFKAGPILELEQWIDKYTSQLPPLTAFILPSGGKISSALHFCRAVCRRAERRVVPLVQMGETDANVAKFLNRLSDYLFTLARYAAMKEGNQEKIYKKNDPSAESEGL

SEQ ID NO: 863590 - protein, 82 aa, Homo sapiens
SSSAAYGVIDCGIFIGENGIFIGRGRCRFRPSLRDSEITESGSLEDPSMAMAVERGACPSGVLVPEELTQRGSKQPFVPAQL

SEQ ID NO: 863591 - protein, 175 aa, Homo sapiens
VTPRTGREPGGVRSRQAAWLMAVCGLGSRLGLGSRLGLRGCFGAARLLYPRFQSRGPQGVEDGDRPQPSSKTPRIPKIYTKTGDKGFSSTFTGERRPKDDQVFEAVGTTDELSSAIGFALELVTEKGHTFAEELQKVSNTISPKLGIFSPGGHHGTQHPATSYSLCHLGLVTLPL

SEQ ID NO: 863592 - protein, 270 aa, Homo sapiens; identical to SEQ ID NO: 863589

SEQ ID NO: 863593 - protein, 270 aa, Homo sapiens; identical to SEQ ID NO: 863589

SEQ ID NO: 863594 - protein, 204 aa, Homo sapiens
VTPRTGREPGGVRSRQAAWLMAVCGLGSRLGLGSRLGLRGCFGAARLLYPRFQSRGPQGVEDGDRPQPSSKTPRIPKIYTKTGDKGFSSTFTGERRPKDDQVFEAVGTTDELSSAIGFALELVTEKGHTFAEELQKIQCTLQDVGSALATPCSSAREAHLIGRQDQLGAAFLPGRVPPGRETCGASCPDGRDRCERGQVLKQTQ

SEQ ID NO: 863595 - protein, 270 aa, Homo sapiens; identical to SEQ ID NO: 863589

SEQ ID NO: 863596 - protein, 145 aa, Homo sapiens
VTPRTGREPGGVRSRQAAWLMAVCGLGSRLGLGSRLGLRGCFGAARLLYPRFQSRGPQGVEDGDRPQPSSKTPRIPKIYTKTGDKGFSSTFTGERRPKDDQVFEAVGTTDELSSAIGQSLEGGLKDGPDQDGPGHAVITDNPKIS

SEQ ID NO: 863597 - protein, 270 aa, Homo sapiens; identical to SEQ ID NO: 863589

SEQ ID NO: 863598 - protein, 193 aa, Homo sapiens
VTPRTGREPGGVRSRQAAWLMAVCGLGSRLGLGSRLGLRGCFGAARLLYPRFQSRGPQGVEDGDRPQPSSKTPRIPKIYTKTGDKGFSSTFTGERRPKDDQVFEAVGTTDELSSAIGFALELVTEKGHTFAEELQKIQCTLQDVGSALATPCSSAREAHLKYTTFKAGPILELEQWIDKYTSQLPPLTAFILP

SEQ ID NO: 863599 - protein, 220 aa, Homo sapiens
ESPRGLDGNLAGSGPVKQPGSWLCAAWGAVLAWGAVLACAGASAPPGSCIPVSRAAALRAWKTGTGHSLPRRHPGSPRFTPKRETKIQCTLQDVGSALATPCSSAREAHLKYTTFKAGPILELEQWIDKYTSQLPPLTAFILPSGGKISSALHFCRAVCRRAERRVVPLVQMGETDANVAKFLNRLSDYLFTLARYAAMKEGNQEKIYKKNDPSAESEGL

SEQ ID NO: 863600 - protein, 237 aa, Homo sapiens
VTPRTGREPGGVRSRQAAWLMAVCGLGSRLGLGSRLGLRGCFGAARLLYPRFQSRGPQGVEDGDRPQPSSKTPRIPKIYTKTGDKGFSSTFTGERRPKDDQVFEAVGTTDELSSAIGFALELVTEKGHTFAEELQKSIPRSRRGPSWSWSSGSTSTPASSHHSRPSSCLDRRCPPVPQVPPGPHRSLPALPTLEQRARREARSARRCISAGPCAAGPRDVWCLLSRWERPMRTWPSS

SEQ ID NO: 863601 - protein, 407 aa, Homo sapiens
MRRNLRLGPSSGADAQGQGAPRPGLAAPRMLLPPASQASRGSGSTGCSLMAQEVDTAQGAEMRRGAGAARGRASWCWALALLWLAVVPGWSRVSGIPSRRHWPVPYKRFDFRPKPDPYCQAKYTFCPTGSPIPVMEGDDDIEVFRLQAPVWEFKYGDLLGHLKIMHDAIGFRSTLTGKNYTMEWYELFQLGNCTFPHLRPEMDAPFWCNQGAACFFEGIDDVHWKENGTLVQVATISGNMFNQMAKWVKQDNETGIYYETWNVKASPEKGAETWFDSYDCSKFVLRTFNKLAEFGAEFKNIETNYTRIFLYSGEPTYLGNETSVFGPTGNKTLGLAIKRFYYPFKPHLPTKEFLLSLLQIFDAVIVHKQFYLFYNFEYWFLPMKFPFIKITYEEIPLPIRNKTLSGL

SEQ ID NO: 863602 - protein, 240 aa, Homo sapiens
MRRNLRLGPSSGADAQGQGAPRPGLAAPRMLLPPASQASRGSGSTGCSLMAQEVDTAQGAEMRRGAGAARGRASWCWALALLWLAVVPGWSRVSGIPSRRHWPVPYKRFDFRPKPDPYCQAKYTFCPTGSPIPVMEGDDDIEVFRLQAPVWEFKYGDLLGHLKIMHDAIGFRSTLTGKNYTMEWYELFQLGNCTFPHLRPEMDAPFWCNQGAACFFEGIDDVHWKENGTLVQVATISGKL

SEQ ID NO: 863603 - protein, 869 aa, Homo sapiens
GSAPGFWSPSAAAALSIPTSPEKPVGNEIMSAFRLWPGLLIMLGSLCHRGSPCGLSTHVEIGHRALEFLQLHNGRVNYRELLLEHQDAYQAGIVFPDCFYPSICKGGKFHDVSESTHWTPFLNASVHYIRENYPLPWEKDTEKLVAFLFGITSHMAADVSWHSLGLEQGFLRTMGAIDFHGSYSEAHSAGDFGGDVLSQFEFNFNYLARRWYVPVKDLLGIYEKLYGRKVITENVIVDCSHIQFLEMYGEMLAVSKLYPTYSTKSPFLVEQFQEYFLGGLDDMAFWSTNIYHLTSFMLENGTSDCNLPENPLFIACGGQQNHTQGSKMQKNDFHRNLTTSLTESVDRNINYTERGVFFSVNSWTPDSMSFIYKALERNIRTMFIGGSQLSQKHVSSPLASYFLSFPYARLGWAMTSADLNQDGHGDLVVGAPGYSRPGHIHIGRVYLIYGNDLGLPPVDLDLDKEAHRILEGFQPSGRFGSALAVLDFNVDGVPDLAVGAPSVGSEQLTYKGAVYVYFGSKQGGMSSSPNITISCQDIYCNLGWTLLAADVNGDSEPDLVIGSPFAPGGGKQKGIVAAFYSGPSLSDKEKLNVEAANWTVRGEEDFSWFGYSLHGVTVDNRTLLLVGSPTWKNASRLGHLLHIRDEKKSLGRVYGYFPPNGQSWFTISGDKAMGKLGTSLSSGHVLMNGTLKQVLLVGAPTYDDVSKVAFLTVTLHQGGATRMYALISDAQPLLLSTFSGDRRFSRFGGVLHLSDLDDDGLDEIIMAAPLRIADVTSGLIGGEDGRVYVYNGKETTLGDMTGKCKSWITPCPEEKAQYVLISPEASSRFGSSLITVRSKAKNQVVIAAGRSSLGARLSGALHVYSLGSD

SEQ ID NO: 863604 - protein, 147 aa, Homo sapiens
EPAAAHEAVGAQQRRREARQAPSVAAELGRAGRRPGGRDQAAGAGAEAAAWKRRPEAPGPTAPQPNAGRHGPGNDGDRKQASGRARTGTQGSRGSKRSEEAPGTRGESVGAGGRLQSHRAAPSLRVFLAAPPRRPLHLALSAARLLS

SEQ ID NO: 863605 - protein, 846 aa, Homo sapiens
MARATTATGNRLWPGLLIMLGSLCHRGSPCGLSTHVEIGHRALEFLQLHNGRVNYRELLLEHQDAYQAGIVFPDCFYPSICKGGKFHDVSESTHWTPFLNASVHYIRENYPLPWEKDTEKLVAFLFGITSHMAADVSWHSLGLEQGFLRTMGAIDFHGSYSEAHSAGDFGGDVLSQFEFNFNYLARRWYVPVKDLLGIYEKLYGRKVITENVIVDCSHIQFLEMYGEMLAVSKLYPTYSTKSPFLVEQFQEYFLGGLDDMAFWSTNIYHLTSFMLENGTSDCNLPENPLFIACGGQQNHTQGSKMQKNDFHRNLTTSLTESVDRNINYTERGVFFSVNSWTPDSMSFIYKALERNIRTMFIGGSQLSQKHVSSPLASYFLSFPYARLGWAMTSADLNQDGHGDLVVGAPGYSRPGHIHIGRVYLIYGNDLGLPPVDLDLDKEAHRILEGFQPSGRFGSALAVLDFNVDGVPDLAVGAPSVGSEQLTYKGAVYVYFGSKQGGMSSSPNITISCQDIYCNLGWTLLAADVNGDSEPDLVIGSPFAPGGGKQKGIVAAFYSGPSLSDKEKLNVEAANWTVRGEEDFSWFGYSLHGVTVDNRTLLLVGSPTWKNASRLGHLLHIRDEKKSLGRVYGYFPPNGQSWFTISGDKAMGKLGTSLSSGHVLMNGTLKQVLLVGAPTYDDVSKVAFLTVTLHQGGATRMYALISDAQPLLLSTFSGDRRFSRFGGVLHLSDLDDDGLDEIIMAAPLRIADVTSGLIGGEDGRVYVYNGKETTLGDMTGKCKSWITPCPEEKAQYVLISPEASSRFGSSLITVRSKAKNQVVIAAGRSSLGARLSGALHVYSLGSD

SEQ ID NO: 863606 - protein, 869 aa, Homo sapiens; identical to SEQ ID NO: 863603

SEQ ID NO: 863607 - protein, 715 aa, Homo sapiens
MAADVSWHSLGLEQGFLRTMGAIDFHGSYSEAHSAGDFGGDVLSQFEFNFNYLARRWYVPVKDLLGIYEKLYGRKVITENVIVDCSHIQFLEMYGEMLAVSKLYPTYSTKSPFLVEQFQEYFLGGLDDMAFWSTNIYHLTSFMLENGTSDCNLPENPLFIACGGQQNHTQGSKMQKNDFHRNLTTSLTESVDRNINYTERGVFFSVNSWTPDSMSFIYKALERNIRTMFIGGSQLSQKHVSSPLASYFLSFPYARLGWAMTSADLNQDGHGDLVVGAPGYSRPGHIHIGRVYLIYGNDLGLPPVDLDLDKEAHRILEGFQPSGRFGSALAVLDFNVDGVPDLAVGAPSVGSEQLTYKGAVYVYFGSKQGGMSSSPNITISCQDIYCNLGWTLLAADVNGDSEPDLVIGSPFAPGGGKQKGIVAAFYSGPSLSDKEKLNVEAANWTVRGEEDFSWFGYSLHGVTVDNRTLLLVGSPTWKNASRLGHLLHIRDEKKSLGRVYGYFPPNGQSWFTISGDKAMGKLGTSLSSGHVLMNGTLKQVLLVGAPTYDDVSKVAFLTVTLHQGGATRMYALISDAQPLLLSTFSGDRRFSRFGGVLHLSDLDDDGLDEIIMAAPLRIADVTSGLIGGEDGRVYVYNGKETTLGDMTGKCKSWITPCPEEKAQYVLISPEASSRFGSSLITVRSKAKNQVVIAAGRSSLGARLSGALHVYSLGSD

SEQ ID NO: 863608 - protein, 167 aa, Homo sapiens
MARATTATGNRLWPGLLIMLGSLCHRGSPCGLSTHVEIGHRALEFLQLHNGRVNYRELLLEHQDAYQAGIVFPDCFYPSICKGGKFHDVSESTHWTPFLNASVHYIRENYPLPWEKVGVVLQSLKYLAPNLPCTVFAPALTPFVPLCKGCPPFHLQCHAHCLDIVDG

SEQ ID NO: 863609 - protein, 167 aa, Homo sapiens; identical to SEQ ID NO: 863608

SEQ ID NO: 863610 - protein, 54 aa, Homo sapiens
KDELSSLEKLNVEAANWTVRGEEDFSWFGYSLHGVTVDNRTLLLVGSPTWKNAS

SEQ ID NO: 863611 - protein, 205 aa, Homo sapiens
GSAPGFWSPSAAAALSIPTSPEKPVGNEIMSAFRLWPGLLIMLGSLCHRGSPCGLSTHVEIGHRALEFLQLHNGRVNYRELLLEHQDAYQAGIVFPDCFYPSICKGGKFHDVSESTHWTPFLNASVHYIRENYPLPWEKDTEKLVAFLFGITSHMAADVSWHSLGLEQGFLRTMGAIDFHGSYSEAHSAGDFGTVYLHLLNFLVV

SEQ ID NO: 863612 - protein, 77 aa, Homo sapiens
GSAPGFWSPSAAAALSIPTSPEKPVGNEIMSAFRLWPGLLIMLGSLCHRGSPCGLSTHVEIAVTRTPGCVSGWNRVS

SEQ ID NO: 863613 - protein, 869 aa, Homo sapiens; identical to SEQ ID NO: 863603

SEQ ID NO: 863614 - protein, 869 aa, Homo sapiens; identical to SEQ ID NO: 863603

SEQ ID NO: 863615 - protein, 830 aa, Homo sapiens
MARATTATGNRLWPGLLIMLGSLCHRGSPCGLSTHVEIGHRALEFLQLHNGRVNYRELLLEHQDAYQAGIVFPDCFYPSICKGGKFHDVSESTHWTPFLNASVHYIRENYPLPWEKDTEKLVAFLFGITSHMAADVSWHSLGLEQGFLRTMGAIDFHGSYSEAHSAGDFGGDVLSQFEFNFNYLARRWYVPVKDLLGIYEKLYGRKVITENVIVDCSHIQFLEMYGEMLAVSKLYPTYSTKSPFLVEQFQEYFLGGLDDMAFWSTNIYHLTSFMLENGTSDCNLPENPLFIACGGQQNHTQGSKMQKNDFHRNLTTSLTESVDRNINYTERGVFFSVNSWTPDSMSFIYKALERNIRTMFIGGSQLSQKHVSSPLASYFLSFPYARLGWAMTSADLNQDGHGDLVVGAPGYSRPGHIHIGRVYLIYGNDLGLPPVDLDLDKEAHRILEGFQPSGRFGSALAVLDFNVDGVPDLAVGAPSVGSEQLTYKGAVYVYFGSKQGGMSSSPNITISCQDIYCNLGWTLLAADVNGDSEPDLVIGSPFAPGGGKQKGIVAAFYSGPSLSDKEKLNVEAANWTVRGEEDFSWFGYSLHGVTVDNRTLLLVGSPTWKNASRLGHLLHIRDEKKSLGRVYGYFPPNGQSWFTISGDKAMGKLGTSLSSGHVLMNGTLKQVLLVGAPTYDDVSKVAFLTVTLHQGGATRMYALISDAQPLLLSTFSGDRRFSRFGGVLHLSDLDDDGLDEIIMAAPLRIADVTSGLIGGEDGRVYVYNGKETTLGDMTGKCKSWITPCPEEKHREVQAKNQVVMLLEESGSRLFGHLRYSLALSYYISPC

SEQ ID NO: 863616 - protein, 182 aa, Homo sapiens
MARATTATGNRLWPGLLIMLGSLCHRGSPCGLSTHVEIGHRALEFLQLHNGRVNYRELLLEHQDAYQAGIVFPDCFYPSICKGGKFHDVSESTHWTPFLNASVHYIRENYPLPWEKDTEKLVAFLFGITSHMAADVSWHSLGLEQGFLRTMGAIDFHGSYSEAHSAGDFGTVYLHLLNFLVV

SEQ ID NO: 863617 - protein, 327 aa, Homo sapiens
MRALPGLLEARARTPRLLLLQCLLAAARPSSADGSAPDSPFTSPPLREEIMANNFSLESHNISLTEHSSMPVEKNITLERPSNVNLTCQFTTSGDLNAVNVTWKKDGEQLENNYLVSATGSTLYTQYRFTIINSKQMGSYSCFFREEKEQRGTFNFKVPELHGKNKPLISYVGDSTVLTCKCQNCFPLNWTWYSSNGSVKVPVGVQMNKYVINGTYANETKLKITQLLEEDGESYWCRALFQLGESEEHIELVVLSYLVPLKPFLVIVAEVILLVATILLCEKYTQKKKKHSDEGKEFEQIEQLKSDDSNGIENNVPRHRKNESLGQ

SEQ ID NO: 863618 - protein, 327 aa, Homo sapiens; identical to SEQ ID NO: 863617

SEQ ID NO: 863619 - protein, 327 aa, Homo sapiens; identical to SEQ ID NO: 863617

SEQ ID NO: 863620 - protein, 277 aa, Homo sapiens
MANNFSLESHNISLTEHSSMPVEKNITLERPSNVNLTCQFTTSGDLNAVNVTWKKDGEQLENNYLVSATGSTLYTQYRFTIINSKQMGSYSCFFREEKEQRGTFNFKVPELHGKNKPLISYVGDSTVLTCKCQNCFPLNWTWYSSNGSVKVPVGVQMNKYVINGTYANETKLKITQLLEEDGESYWCRALFQLGESEEHIELVVLSYLVPLKPFLVIVAEVILLVATILLCEKYTQKKKKHSDEGKEFEQIEQLKSDDSNGIENNVPRHRKNESLGQ

SEQ ID NO: 863621 - protein, 273 aa, Homo sapiens
MRALPGLLEARARTPRLLLLQCLLAAARPSSADGSAPDSPFTSPPLREEIMANNFSLESHNISLTGSTLYTQYRFTIINSKQMGSYSCFFREEKEQRGTFNFKVPELHGKNKPLISYVGDSTVLTCKCQNCFPLNWTWYSSNGSVKVPVGVQMNKYVINGTYANETKLKITQLLEEDGESYWCRALFQLGESEEHIELVVLSYLVPLKPFLVIVAEVILLVATILLCEKYTQKKKKHSDEGKEFEQIEQLKSDDSNGIENNVPRHRKNESLGQ

SEQ ID NO: 863622 - protein, 67 aa, Homo sapiens
VWYPNRYNLLFMTGYTPLVGNFSVISLKDAFFTIPLHTSSQNLFALTGLILTQAAPNNSPDCPPPGV

SEQ ID NO: 863623 - protein, 205 aa, Homo sapiens
MAEIEHFVDPSEKDHPKFQNVADLHLYLYSAKAQVSGQSARKMRLGDAVEQGVINNTVLGYFIGRIYLYLTKVGISPDKLRFRQHMENEMAHYACDCWDAESKTSYGWIEIVGCADRSCYDLSCHARATKVPLVAEKPLKEPISFLVTPKTQDSHVNILLMNKSKSLPCSMDKWRCFRHCSNACLNLLFYLSLCSFPILCTCSLT

SEQ ID NO: 863624 - protein, 807 aa, Homo sapiens
LPIVLVNTVRLIQYPIHLYVVWIKGLFILMEEVSSSEPGGAAISSCSEPGGARRFRRHPLWTAQGRRLMPSPRPVLLRGARAALLLLLPPRLLARPSLLLRRSLSAASCAPISLPAAASRSSMDGAGAEEVLAPLRLAVRQQGDLVRKLKEDKAPQVDVDKAVAELKARKRVLEAKELALQPKDDIVDRAKMEDTLKRRFFYDQAFAIYGGVSGLYDFGPVGCALKNNIIQTWRQHFIQEEQILEIDCTMLTPEPVLKTSGHVDKFADFMVKDVKNGECFRADHLLKAHLQKLMSDKKCSVEKKSEMESVLAQLDNYGQQELADLFVNYNVKSPITGNDLSPPVSFNLMFKTFIGPGGNMPGYLRPETAQGIFLNFKRLLEFNQGKLPFAAAQIGNSFRNEISPRSGLIRVREFTMAEIEHFVDPSEKDHPKFQNVADLHLYLYSAKAQVSGQSARKMRLGDAVEQGVINNTVLGYFIGRIYLYLTKVGISPDKLRFRQHMENEMAHYACDCWDAESKTSYGWIEIVGCADRSCYDLSCHARATKVPLVAEKPLKEPKTVNVVQFEPSKGAIGKAYKKDAKLVMEYLAICDECYITEMEMLLNEKGEFTIETEGKTFQLTKDMINVKRFQKTLYVEEVVPNVIEPSFGLGRIMYTVFEHTFHVREGDEQRTFFSFPAVVAPFKCSVLPLSQNQEFMPFVKELSEALTRHGVSHKVDDSSGSIGRRYARTDEIGVAFGVTIDFDTVNKTPHTATLRDRDSMRQIRAEISELPSIVQDLANGNITWADVEARYPLFEGQETGKKETIEE

SEQ ID NO: 863625 - protein, 807 aa, Homo sapiens; identical to SEQ ID NO: 863624

SEQ ID NO: 863626 - protein, 844 aa, Homo sapiens
HSYKNLCFEGSRVSRPAGLAQSCVPEHPPCWGGLTHFCANLFARNPTYLSPEPEKTFGGVLPGFVSNLRRRPGAASRGGECAADARRVVYAAISSCSEPGGARRFRRHPLWTAQGRRLMPSPRPVLLRGARAALLLLLPPRLLARPSLLLRRSLSAASCAPISLPAAASRSSMDGAGAEEVLAPLRLAVRQQGDLVRKLKEDKAPQVDVDKAVAELKARKRVLEAKELALQPKDDIVDRAKMEDTLKRRFFYDQAFAIYGGVSGLYDFGPVGCALKNNIIQTWRQHFIQEEQILEIDCTMLTPEPVLKTSGHVDKFADFMVKDVKNGECFRADHLLKAHLQKLMSDKKCSVEKKSEMESVLAQLDNYGQQELADLFVNYNVKSPITGNDLSPPVSFNLMFKTFIGPGGNMPGYLRPETAQGIFLNFKRLLEFNQGKLPFAAAQIGNSFRNEISPRSGLIRVREFTMAEIEHFVDPSEKDHPKFQNVADLHLYLYSAKAQVSGQSARKMRLGDAVEQGVINNTVLGYFIGRIYLYLTKVGISPDKLRFRQHMENEMAHYGWIEIVGCADRSCYDLSCHARATKVPLVAEKPLKEPKTVNVVQFEPSKGAIGKAYKKDAKLVMEYLAICDECYITEMEMLLNEKGEFTIETEGKTFQLTKDMINVKRFQKTLYVEEVVPNVIEPSFGLGRIMYTVFEHTFHVREGDEQRTFFSFPAVVAPFKCSVLPLSQNQEFMPFVKELSEALTRHGVSHKVDDSSGSIGRRYARTDEIGVAFGVTIDFDTVNKTPHTATLRDRDSMRQIRAEISELPSIVQDLANGNITWADVEARYPLFEGQETGKKETIEE

SEQ ID NO: 863627 - protein, 595 aa, Homo sapiens
MIGSEAGWLGCALKNNIIQTWRQHFIQEEQILEIDCTMLTPEPVLKTSGHVDKFADFMVKDVKNGECFRADHLLKAHLQKLMSDKKCSVEKKSEMESVLAQLDNYGQQELADLFVNYNVKSPITGNDLSPPVSFNLMFKTFIGPGGNMPGYLRPETAQGIFLNFKRLLEFNQGKLPFAAAQIGNSFRNEISPRSGLIRVREFTMAEIEHFVDPSEKDHPKFQNVADLHLYLYSAKAQVSGQSARKMRLGDAVEQGVINNTVLGYFIGRIYLYLTKVGISPDKLRFRQHMENEMAHYACDCWDAESKTSYGWIEIVGCADRSCYDLSCHARATKVPLVAEKPLKEPKTVNVVQFEPSKGAIGKAYKKDAKLVMEYLAICDECYITEMEMLLNEKGEFTIETEGKTFQLTKDMINVKRFQKTLYVEEVVPNVIEPSFGLGRIMYTVFEHTFHVREGDEQRTFFSFPAVVAPFKCSVLPLSQNQEFMPFVKELSEALTRHGVSHKVDDSSGSIGRRYARTDEIGVAFGVTIDFDTVNKTPHTATLRDRDSMRQIRAEISELPSIVQDLANGNITWADVEARYPLFEGQETGKKETIEE

SEQ ID NO: 863628 - protein, 857 aa, Homo sapiens
HSYKNLCFEGSRVSRPAGLAQSCVPEHPPCWGGLTHFCANLFARNPTYLSPEPEKTFGGVLPGFVSNLRRRPGAASRGGECAADARRVVYAAISSCSEPGGARRFRRHPLWTAQGRRLMPSPRPVLLRGARAALLLLLPPRLLARPSLLLRRSLSAASCAPISLPAAASRSSMDGAGAEEVLAPLRLAVRQQGDLVRKLKEDKAPQVDVDKAVAELKARKRVLEAKELALQPKDDIVDRAKMEDTLKRRFFYDQAFAIYGGVSGLYDFGPVGCALKNNIIQTWRQHFIQEEQILEIDCTMLTPEPVLKTSGHVDKFADFMVKDVKNGECFRADHLLKAHLQKLMSDKKCSVEKKSEMESVLAQLDNYGQQELADLFVNYNVKSPITGNDLSPPVSFNLMFKTFIGPGGNMPGYLRPETAQGIFLNFKRLLEFNQGKLPFAAAQIGNSFRNEISPRSGLIRVREFTMAEIEHFVDPSEKDHPKFQNVADLHLYLYSAKAQVSGQSARKMRLGDAVEQGVINNTVLGYFIGRIYLYLTKVGISPDKLRFRQHMENEMAHYACDCWDAESKTSYGWIEIVGCADRSCYDLSCHARATKVPLVAEKPLKEPKTVNVVQFEPSKGAIGKAYKKDAKLVMEYLAICDECYITEMEMLLNEKGEFTIETEGKTFQLTKDMINVKRFQKTLYVEEVVPNVIEPSFGLGRIMYTVFEHTFHVREGDEQRTFFSFPAVVAPFKCSVLPLSQNQEFMPFVKELSEALTRHGVSHKVDDSSGSIGRRYARTDEIGVAFGVTIDFDTVNKTPHTATLRDRDSMRQIRAEISELPSIVQDLANGNITWADVEARYPLFEGQETGDGVSCHL

SEQ ID NO: 863629 - protein, 697 aa, Homo sapiens
HSYKNLCFEGSRVSRPAGLAQSCVPEHPPCWGGLTHFCANLFARNPTYLSPEPEKTFGGVLPGFVSNLRRRPGAASRGGECAADARRVVYAAISSCSEPGGARRFRRHPLWTAQGRRLMPSPRPVLLRGARAALLLLLPPRLLARPSLLLRRSLSAASCAPISLPAAASRSSMDGAGAEEVLAPLRLAVRQQGDLVRKLKEDKAPQVDVDKAVAELKARKRVLEAKELALQPKDDIVDRAKMEDTLKRRFFYDQAFAIYGGVSGLYDFGPVGCALKNNIIQTWRQHFIQEEQILEIDCTMLTPEPVLKTSGHVDKFADFMVKDVKNGECFRADHLLKAHLQKLMSDKKCSVEKKSEMESVLAQLDNYGQQELADLFVNYNVKSPITGNDLSPPVSFNLMFKTFIGPGGNMPGYLRPETAQGIFLNFKRLLEFNQGKLPFAAAQIGNSFRNEISPRSGLIRVREFTMAEIEHFVDPSEKDHPKFQNVADLHLYLYSAKAQVSGQSARKMRLGDAVEQGVINNTVLGYFIGRIYLYLTKVGISPDKLRFRQHMENEMAHYACDCWDAESKTSYGWIEIVGCADRSCYDLSCHARATKVPLVAEKPLKEPKTVNVVQFEPSKGAIGKAYKKDAKLVMEYLAICDECYITEMEMLLNEKGEFTIETGGKTFQLTVFRIVLKLSFGRVGTCLPDLDIHFMYE

SEQ ID NO: 863630 - protein, 370 aa, Homo sapiens
YGRGLSVGTVFLHRGSNTTNTGVEDAGAQGVINNTVLGYFIGRIYLYLTKVGISPDKLRFRQHMENEMAHYACDCWDAESKTSYGWIEIVGCADRSCYDLSCHARATKVPLVAEKPLKEPKTVNVVQFEPSKGAIGKAYKKDAKLVMEYLAICDECYITEMEMLLNEKGEFTIETEGKTFQLTKDMINVKRFQKTLYVEEVVPNVIEPSFGLGRIMYTVFEHTFHVREGDEQRTFFSFPAVVAPFKCSVLPLSQNQEFMPFVKELSEALTRHGVSHKVDDSSGSIGRRYARTDEIGVAFGVTIDFDTVNKTPHTATLRDRDSMRQIRAEISELPSIVQDLANGNITWADVEARYPLFEGQETGKKETIEE

SEQ ID NO: 863631 - protein, 463 aa, Homo sapiens
HSYKNLCFEGSRVSRPAGLAQSCVPEHPPCWGGLTHFCANLFARNPTYLSPEPEKTFGGVLPGFVSNLRRRPGAASRGGECAADARRVVYAAISSCSEPGGARRFRRHPLWTAQGRRLMPSPRPVLLRGARAALLLLLPPRLLARPSLLLRRSLSAASCAPISLPAAASRSSMDGAGAEEVLAPLRLAVRQQGDLVRKLKEDKAPQVDVDKAVAELKARKRVLEAKELALQPKDDIVDRAKMEDTLKRRFFYDQAFAIYGGVSGLYDFGPVGCALKNNIIQTWRQHFIQEEQILEIDCTMLTPEPVLKTSGHVDKFADFMVKDVKNGECFRADHLLKAHLQKLMSDKKCSVEKKSEMESVLAQLDNYGQQELADLFVNYNVKSPITGNDLSPPVSFNLMFKTFIGPGGNMPGLETAGGDSEFNAWGHPGMPGRHGTVKDPPGVTRIRGMLYQDPYGSLITRPT

SEQ ID NO: 863632 - protein, 186 aa, Homo sapiens
ERPPPIGSEVPDVTATPARLLFFAPTRRAAPLEEMEAPAADAIMSPEEELDGYEPEPLGKLAGSVLPLSQNQEFMPFVKELSEALTRHGVSHKVDDSSGSIGRRYARTDEIGVAFGVTIDFDTVNKTPHTATLRDRDSMRQIRAEISELPSIVQDLANGNITWADVEARYPLFEGQETGKKETIEE

SEQ ID NO: 863633 - protein, 156 aa, Homo sapiens
KDTGGDEIISSNGRFYIIVHKKIRKFLLSIVIKPVLPLSQNQEFMPFVKELSEALTRHGVSHKVDDSSGSIGRRYARTDEIGVAFGVTIDFDTVNKTPHTATLRDRDSMRQIRAEISELPSIVQDLANGNITWADVEARYPLFEGQETGKKETIEE

SEQ ID NO: 863634 - protein, 232 aa, Homo sapiens
LPIVLVNTVRLIQYPIHLYVVWIKGLFILMEEVSSSEPGGAAISSCSEPGGARRFRRHPLWTAQGRRLMPSPRPVLLRGARAALLLLLPPRLLARPSLLLRRSLSAASCAPISLPAAASRSSMDGAGAEEVLAPLRLAVRQQGDLVRKLKEDKAPQVDVDKAVAELKARKRVLEAKELALQPKDDIVDRAKMEDTLKRRFFYDQAFAIYGGVTVGLVLTFLGGPKFWAFCFG

SEQ ID NO: 863635 - protein, 857 aa, Homo sapiens
HSYKNLCFEGSRVSRPAGLAQSCVPEHPPCWGGLTHFCANLFARNPTYLSPEPEKTFGGVLPGFVSNLRRRPGAASRGGECAADARRVVYAAISSCSEPGGARRFRRHPLWTAQGRRLMPSPRPVLLRGARAALLLLLPPRLLARPSLLLRRSLSAASCAPISLPAAASRSSMDGAGAEEVLAPLRLAVRQQGDLVRKLKEDKAPQVDVDKAVAELKARKRVLEAKELALQPKDDIVDRAKMEDTLKRRFFYDQAFAIYGGVSGLYDFGPVGCALKNNIIQTWRQHFIQEEQILEIDCTMLTPEPVLKTSGHVDKFADFMVKDVKNGECFRADHLLKAHLQKLMSDKKCSVEKKSEMESVLAQLDNYGQQELADLFVNYNVKSPITGNDLSPPVSFNLMFKTFIGPGGNMPGYLRPETAQGIFLNFKRLLEFNQGKLPFAAAQIGNSFRNEISPRSGLIRVREFTMAEIEHFVDPSEKDHPKFQNVADLHLYLYSAKAQVSGQSARKMRLGDAVEQGVINNTVLGYFIGRIYLYLTKVGISPDKLRFRQHMENEMAHYACDCWDAESKTSYGWIEIVGCADRSCYDLSCHARATKVPLVAEKPLKEPKTVNVVQFEPSKGAIGKAYKKDAKLVMEYLAICDECYITEMEMLLNEKGEFTIETEGKTFQLTKDMINVKRFQKTLYVEEVVPNVIEPSFGLGRIMYTVFEHTFHVREGDEQRTFFSFPAVVAPFKCSVLPLSQNQEFMPFVKELSEALTRHGVSHKVDDSSGSIGRRYARTDEIGVAFGVTIDFDTVNKTPHTATLRDRDSMRQIRAEISELPSIVQDLANGNITWADVEARYPLFEGQETGKKETIEE

SEQ ID NO: 863636 - protein, 807 aa, Homo sapiens; identical to SEQ ID NO: 863624

SEQ ID NO: 863637 - protein, 807 aa, Homo sapiens; identical to SEQ ID NO: 863624

SEQ ID NO: 863638 - protein, 671 aa, Homo sapiens
GGERKLRLGSEAWVSSKAPQVDVDKAVAELKARKRVLEAKELALQPKDDIVDRAKMEDTLKRRFFYDQAFAIYGGVSGLYDFGPVGCALKNNIIQTWRQHFIQEEQILEIDCTMLTPEPVLKTSGHVDKFADFMVKDVKNGECFRADHLLKAHLQKLMSDKKCSVEKKSEMESVLAQLDNYGQQELADLFVNYNVKSPITGNDLSPPVSFNLMFKTFIGPGGNMPGYLRPETAQGIFLNFKRLLEFNQGKLPFAAAQIGNSFRNEISPRSGLIRVREFTMAEIEHFVDPSEKDHPKFQNVADLHLYLYSAKAQVSGQSARKMRLGDAVEQGVINNTVLGYFIGRIYLYLTKVGISPDKLRFRQHMENEMAHYACDCWDAESKTSYGWIEIVGCADRSCYDLSCHARATKVPLVAEKPLKEPKTVNVVQFEPSKGAIGKAYKKDAKLVMEYLAICDECYITEMEMLLNEKGEFTIETEGKTFQLTKDMINVKRFQKTLYVEEVVPNVIEPSFGLGRIMYTVFEHTFHVREGDEQRTFFSFPAVVAPFKCSVLPLSQNQEFMPFVKELSEALTRHGVSHKVDDSSGSIGRRYARTDEIGVAFGVTIDFDTVNKTPHTATLRDRDSMRQIRAEISELPSIVQDLANGNITWADVEARYPLFEGQETGKKETIEE

SEQ ID NO: 863639 - protein, 1007 aa, Homo sapiens
HSYKNLCFEGSRVSRPAGLAQSCVPEHPPCWGGLTHFCANLFARNPTYLSPEPEKTFGGVLPGFVSNLRRRPGAASRGGECAADARRVVYAAISSCSEPGGARRFRRHPLWTAQGRRLMPSPRPVLLRGARAALLLLLPPRLLARPSLLLRRSLSAASCAPISLPAAASRSSMDGAGAEEVLAPLRLAVRQQGDLVRKLKEDKAPQVDVDKAVAELKARKRVLEAKELALQPKDDIVDRAKMEDTLKRRFFYDQAFAIYGGVSGLYDFGPVGCALKNNIIQTWRQHFIQEEQILEIDCTMLTPEPVLKTSGHVDKFADFMVKDVKNGECFRADHLLKAHLQKLMSDKKCSVEKKSEMESVLAQLDNYGQQELADLFVNYNVKSPITGNDLSPPVSFNLMFKTFIGPGGNMPGYLRPETAQGIFLNFKRLLEFNQGKLPFAAAQIGNSFRNEISPRSGLIRVREFTMAEIEHFVDPSEKDHPKFQNVADLHLYLYSAKAQVSGQSARKMRLGDAVEQGVINNTVLGYFIGRIYLYLTKVGISPDKLRFRQHMENEMAHYACDCWDAESKTSYGWIEIVGCADRSCYDLSCHARATKVPLVAEKPLKEPKTVNVVQFEPSKGAIGKAYKKDAKLVMEYLAICDECYITEMEMLLNEKGEFTIETEGKTFQLTKDMINVKRFQKTLYVEEVVPNVIEPSFGLGRIMYTVFEHTFHVREGDEQRTFFSFPAVVAPFKCSVLPLSQNQEFMPFVKELSEALTRHGVSHKVDDSSGSIGRRYARTDEIGVAFGVTIDFDTVNKTPHTATLRDRDSMRQIRAEISELPSIVQDLANGNITWADVEARYPLFYQSLARRKLLPLLKLKPKQKALKAKKAVLKGVHSHKKKKIRTSPTFRRPKTLRLRRQPKYPRKSAPRRNKLDHYAIIKFPLTTESAMKKIEDNNTLVVIVDVKANKHQIKKAVEEAVDIDVAKVNNLDYGLMERRRDMFWWILITMLWDVGTKMGSSRVSSDS

SEQ ID NO: 863640 - protein, 771 aa, Homo sapiens
HSYKNLCFEGSRVSRPAGLAQSCVPEHPPCWGGLTHFCANLFARNPTYLSPEPEKTFGGVLPGFVSNLRRRPGAASRGGECAADARRVVYAAISSCSEPGGARRFRRHPLWTAQGRRLMPSPRPVLLRGARAALLLLLPPRLLARPSLLLRRSLSAASCAPISLPAAASRSSMDGAGAEEVLAPLRLAVRQQGDLVRKLKEDKAPQVDVDKAVAELKARKRVLEAKELALQPKDDIVDRAKMEDTLKRRFFYDQAFAIYGGVSGLYDFGPVGCALKNNIIQTWRQHFIQEEQILEIDCTMLTPEPVLKTSGHVDKFADFMVKDVKNGECFRADHLLKAHLQKLMSDKKCSVEKKSEMESVLAQLDNYGQQELADLFVNYNVKSPITGNDLSPPVSFNLMFKTFIGPGGNMPGYLRPETAQGIFLNFKRLLEFNQGKLPFAAAQIGNSFRNEISPRSGLIRVREFTMAEIEHFVDPSEKDHPKFQNVADLHLYLYSAKAQVSGQSARKMRLGDAVEQGVINNTVLGYFIGRIYLYLTKVGISPDKLRFRQHMENEMAHYACDCWDAESKTSYGWIEIVGCADRSCYDLSCHARATKVPLVAEKPLKEPKTVNVVQFEPSKGAIGKAYKKDAKLVMEYLAICDECYITEMEMLLNEKGEFTIETEGKTFQLTKDMINVKRFQKTLYVEEVVPNVIEPSFGLGRIMYTVFEHTFHVREGDEQRTFFSFPAVVAPFKCSVLPLSQNQEFMPFVKELCKQIQLGKLHGNTIKETEF

SEQ ID NO: 863641 - protein, 450 aa, Homo sapiens
HSYKNLCFEGSRVSRPAGLAQSCVPEHPPCWGGLTHFCANLFARNPTYLSPEPEKTFGGVLPGFVSNLRRRPGAASRGGECAADARRVVYAAISSCSEPGGARRFRRHPLWTAQGRRLMPSPRPVLLRGARAALLLLLPPRLLARPSLLLRRSLSAASCAPISLPAAASRSSMDGAGAEEVLAPLRLAVRQQGDLVRKLKEDKAPQVDVDKAVAELKARKRVLEAKELALQPKDDIVDRAKMEDTLKRRFFYDQAFAIYGGVSGLYDFGPVGCALKNNIIQTWRQHFIQEEQILEIDCTMLTPEPVLKTSGHVDKFADFMVKDVKNGECFRADHLLKAHLQKLMSDKKCSVEKKSEMESVLAQLDNYGQQELADLFVNYNVKSPITGNDLSPPVSFNLMFKTFIGPGGNMPGYLRPETAQGIFLNFKRLLEFNQGKLPFENSQWQKLSTL

SEQ ID NO: 863642 - protein, 112 aa, Homo sapiens [sequence omitted]

SEQ ID NO: 863643 - protein, 137 aa, Homo sapiens
MYPVILGSAECAIQAVLPLSQNQEFMPFVKELSEALTRHGVSHKVDDSSGSIGRRYARTDEIGVAFGVTIDFDTVNKTPHTATLRDRDSMRQIRAEISELPSIVQDLANGNITWADVEARYPLFEGQETGKKETIEE

SEQ ID NO: 863644 - protein, 88 aa, Homo sapiens
NPLHSQLCAGGAPAVHLARLEICALRDTVAVYLTPESKSSFKQALEALPQLSSGADKKLLEELLNKFKSSMHLQLTCFQAASSTMMKT

SEQ ID NO: 863645 - protein, 924 aa, Homo sapiens
MSRSRQPPLVTGISPNEGIPWTKVTIRGENLGTGPTDLIGLTICGHNCLLTAEWMSASKIVCRVGQAKNDKGDIIVTTKSGGRGTSTVSFKLLKPEKIGILDQSAVWVDEMNYYDMRTDRNKGIPPLSLRPANPLGIEIEKSKFSQKDLEMLFHGMSADFTSENFSAAWYLIENHSNTSFEQLKMAVTNLKRQANKKSEGSLAYVKGGLSTFFEAQDALSAIHQKLEADGTEKVEGSMTQKLENVLNRASNTADTLFQEVLGRKDKADSTRNALNVLQRFKFLFNLPLNIERNIQKGDYDVVINDYEKAKSLFGKTEVQVFKKYYAEVETRIEALRELLLDKLLETPSTLHDQKRYIRYLSDLHASGDPAWQCIGAQHKWILQLMHSCKEGYVKDLKGNPGLHSPMLDLDNDTRPSVLGHLSQTASLKRGSSFQSGRDDTWRYKTPHRVAFVEKLTKLVLSQLPNFWKLWISYVNGSLFSETAEKSGQIERSKNVRQRQNDFKKMIQEVMHSLVKLTRGALLPLSIRDGEAKQYGGWEVKCELSGQWLAHAIQTVRLTHESLTALEIPNDLLQTIQDLILDLRVRCVMATLQHTAEEIKRLAEKEDWIVDNEGLTSLPCQFEQCIVCSLQSLKGVLECKPGEASVFQQPKTQEEVCQLSINIMQVFIYCLEQLSTKPDADIDTTHLSVDVSSPDLFGSIHEDFSLTSEQRLLIVLSNCCYLERHTFLNIAEHFEKHNFQGIEKITQVSMASLKELDQRLFENYIELKADPIVGSLEPGIYAGYFDWKDCLPPTGVRNYLKEALVNIIAVHAEVFTISKELVPRVLSKVIEAVSEELSRLMQCVSSFSKNGALQARLEICALRDTVAVYLTPESKSSFKQALEALPQLSSGADKKLLEELLNKFKSSMHLQLTCFQAASSTMMKT

SEQ ID NO: 863646 - protein, 924 aa, Homo sapiens; identical to SEQ ID NO: 863645

SEQ ID NO: 863647 - protein, 924 aa, Homo sapiens; identical to SEQ ID NO: 863645

SEQ ID NO: 863648 - protein, 806 aa, Homo sapiens
MSRSRQPPLVTGISPNEGIPWTKVTIRGENLGTGPTDLIGLTICGHNCLLTAEWMSASKIVCRVGQAKNDKGDIIVTTKSGGRGTSTVSFKLLKPEKIGILDQSAVWVDEMNYYDMRTDRNKGIPPLSLRPANPLGIEIEKSKFSQKDLEMLFHGMSADFTSENFSAAWYLIENHSNTSFEQLKMAVTNLKRQANKKSEGSLAYVKGGLSTFFEAQDALSAIHQKLEADGTEKVEGSMTQKLENVLNRASNTADTLFQEVLGRKDKADSTRNALNVLQRFKFLFNLPLNIERNIQKGDYDVVINDYEKAKSLFGKTEVQVFKKYYAEVETRIEALRELLLDKLLETPSTLHDQKRYIRYLSDLHASGDPAWQCIGAQHKWILQLMHSCKEGYVKDLKGNPGLHSPMLDLDNDTRPSVLGHLSQTASLKRGSSFQSGRDDTWRYKTPHRVAFVEKLTKLVLSQLPNFWKLWISYVNGSLFSETAEKSGQIERSKNVRQRQNDFKKMIQEVMHSLVKLTRGALLPLSIRDGEAKQYGGWEVKCELSGQWLAHAIQTVRLTHESLTALEIPNDLLQTIQDLILDLRVRCVMATLQHTAEEIKRLAEKEDWIVDNEGLTSLPCQFEQCIVCSLQSLKGVLECKPGEASVFQQPKTQEEVCQLSINIMQVFIYCLEQLSTKPDADIDTTHLSVDVSSPDLFGSIHEDFSLTSEQRLLIVLSNCCYLERHTFLNIAEHFEKHNFQGIEKITQVSMASLKELDQRLFENYIELKADPIVGSLEPGIYAGYFDWKDCLPPTVLGHMCRACRFLT

SEQ ID NO: 863649 - protein, 924 aa, Homo sapiens; identical to SEQ ID NO: 863645

SEQ ID NO: 863650 - protein, 123 aa, Homo sapiens
PDGQALTTLTSEVLRDQVKCWNSEPEKRPSLYHLSEIVENLLPGQYKKKKNRCRLESPGHRGRTADPMCGRTGKYSCRFITSTMSTRVTRSPRTNCGSDVWAYGVWGDIMVTGNESLIFHKCA

SEQ ID NO: 863651 - protein, 924 aa, Homo sapiens; identical to SEQ ID NO: 863645

SEQ ID NO: 863652 - protein, 860 aa, Homo sapiens
MSRSRQPPLVTGISPNEGIPWTKVTIRGENLGTGPTDLIGLTICGHNCLLTAEWMSASKIVCRVGQAKNDKGDIIVTTKSGGRGTSTVSFKLLKPEKIGILDQSAVWVDEMNYYDMRTDRNKGIPPLSLRPANPLGIEIEKSKFSQKDLEMLFHGMSADFTSENFSAAWYLIENHSNTSFEQLKMAVTNLKRQANKKSEGSLAYVKGGLSTFFEAQDALSAIHQKLEADGTEKVEGSMTQKLENVLNRASNTADTLFQEVLGRKDKADSTRNALNVLQRFKFLFNLPLNIERNIQKGDYDVVINDYEKAKSLFGKTEVQVFKKYYAEVETRIEALRELLLDKLLETPSTLHDQKRYIRYLSDLHASGDPAWQCIGAQHKWILQLMHSCKEGYVKDLKGNPGLHSPMLDLDNDTRPSVLGHLSQTASLKRGSSFQSGRDDTWRYKTPHRVAFVEKLTKLVLSQLPNFWKLWISYVNGSLFSETAEKSGQIERSKNVRQRQNDFKKMIQEVMHSLVKLTRGALLPLSIRDGEAKQYGGWEVKCELSGQWLAHAIQTVRLTHESLTALEIPNDLLQTIQDLILDLRVRCVMATLQHTAEEIKRLAEKEDWIVDNEGLTSLPCQFEQCIVCSLQSLKGVLECKPGEASVFQQPKTQEEVCQLSINIMQVFIYCLEQLSTKPDADIDTTHLSVDVSSPDLFGSIHEDFSLTSEQRLLIVLSNCCYLERHTFLNIAEHFEKHNFQGIEKITQVSMASLKELDQRLFENYIELKADPIVGSLEPGIYAEDEMLEGLPTSHFLERLDFCLVFLRNRSWSQVKCTLSNVRVCFVLVAFLFFNLLFRHLKKEKKKLMFLVKCRNVPSATR

SEQ ID NO: 863653 - protein, 468 aa, Homo sapiens
MSRSRQPPLVTGISPNEGIPWTKVTIRGENLGTGPTDLIGLTICGHNCLLTAEWMSASKIVCRVGQAKNDKGDIIVTTKSGGRGTSTVSFKLLKPEKIGILDQSAVWVDEMNYYDMRTDRNKGIPPLSLRPANPLGIEIEKSKFSQKDLEMLFHGMSADFTSENFSAAWYLIENHSNTSFEQLKMAVTNLKRQANKKSEGSLAYVKGGLSTFFEAQDALSAIHQKLEADGTEKVEGSMTQKLENVLNRASNTADTLFQEVLGRKDKADSTRNALNVLQRFKFLFNLPLNIERNIQKGDYDVVINDYEKAKSLFGKTEVQVFKKYYAEVETRIEALRELLLDKLLETPSTLHDQKRYIRYLSDLHASGDPAWQCIGAQHKWILQLMHSCKEGYVKDLKDHTGQKGYVKRTLSICDCSSWFFSTALAYCASGRRLLAAGSHFMSKLVPILHRKKILMMNVKHTLNANFTW

SEQ ID NO: 863654 - protein, 564 aa, Homo sapiens
RPEPQASLLGSWLEGLLLGTPGVSAGRSHILDSGYIIMSDTLTADVIGRRVEVNGEHATVRFAGVVPPVAGPWLGVEWDNPERGKHDGSHEGTVYFKCRHPTGGSFIRPNKVNFGTDFLTAIKNRYVLEDGPEEDRKEQIVTIGNKPVETIGFDSIMKQQSQLSKLQEVSLRNCAVSCAGEKGGVAEACPNIRKVDLSKNLLSSWDEVIHIADQLRHLEVLNVSENKLKFPSGSVLTGTLSVLKVLVLNQTGITWAEVLRCVAGCPGLEELYLESNNIFISERPTDVLQTVKLLDLSSNQLIDENQLYLIAHLPRLEQLILSDTGISSLHFPDAGIGCKTSMFPSLKYLVVNDNQISQWSFFNELEKLPSLRALSCLRNPLTKEDKEAETARLLIIASIGQLKTLNKCEILPEERRRAELDYRKAFGNEWKQAGGHKDPEKNRLSEEFLTAHPRYQFLCLKYGAPEDWELKTQQPLMLKNQLLTLKIKYPHQLDQKVLEKQLPGSMTIQKVKGLLSRLLKVPVSDLLLSYESPKKPGREIELENDLKSLQFYSVENGDCLLVRW

SEQ ID NO: 863655 - protein, 182 aa, Homo sapiens
MKQQSQLSKLQEVSLRNCAVSCAGEKGGVAEACPNIRKVDLSKNLLSSWDEVIHIADQLRHLEVLNVSENKLKFPSGSVLTGTLSVLKVLVLNQTGITWAEVLRCVAGCPGLEELYLESNNIFISERPTDVLQTVKLLDLSSNQLIDENQLYLIAHLPRLEQLILSDTGISSLHFPDAGIGI

SEQ ID NO: 863656 - protein, 408 aa, Homo sapiens
MKQQSQLSKLQEVSLRNCAVSCAGEKGGVAEACPNIRKVDLSKNLLSSWDEVIHIADQLRHLEVLNVSENKLKFPSGSVLTGTLSVLKVLVLNQTGITWAEVLRCVAGCPGLEELYLESNNIFISERPTDVLQTVKLLDLSSNQLIDENQLYLIAHLPRLEQLILSDTGISSLHFPDAGIGCKTSMFPSLKYLVVNDNQISQWSFFNELEKLPSLRALSCLRNPLTKEDKEAETARLLIIASIGQLKTLNKCEILPEERRRAELDYRKAFGNEWKQAGGHKDPEKNRLSEEFLTAHPRYQFLCLKYGAPEDWELKTQQPLMLKNQLLTLKIKYPHQLDQKVLEKQLPGSMTIQKVKGLLSRLLKVPVSDLLLSYESPKKPGREIELENDLKSLQFYSVENGDCLLVRW

SEQ ID NO: 863657 - protein, 272 aa, Homo sapiens
RPEPQASLLGSWLEGLLLGTPGVSAGRSHILDSGYIIMSDTLTADVIGRRVEVNGEHATVRFAGVVPPVAGPWLGVEWDNPERGKHDGSHEGTVYFKCRHPTGGSFIRPNKVNFGTDFLTAIKNRYVLEDGPEEDRKEQIVTIGNKPVETIGFDSIMKQQSQLSKLQEVSLRNCAVSCAGEKGGVAEACPNIRKVDLSKNLLSSWDEVIHIADQLRHLEVLNVSENKLKFPSGSVLTGTLSVLKVLVLNQTGITWAEANRCSPDSQVIRSFL

SEQ ID NO: 863658 - protein, 223 aa, Homo sapiens [sequence omitted]

SEQ ID NO: 863659 - protein, 83 aa, Homo sapiens
RPEPQASLLGSWLEGLLLGTPGVSAGRSHILDSGYIIMSDTLTADVIGRRVEVNGEHATVRFAGVVPPVAGTRQEDPLFVRTR

SEQ ID NO: 863660 - protein, 112 aa, Homo sapiens
RYRPGSRASRCRPRLAGFSTPSSARAFFWGTPRAVGPPVCFCEPSWTVAFFTRGGAAPPHACVLNLFLFGRRAPHHYLCLCSLVFSADDWCFLVSCVCVFFFFFFLFFFILK

SEQ ID NO: 863661 - protein, 315 aa, Homo sapiens
RPEPQASLLGSWLEGLLLGTPGVSAGRSHILDSGYIIMSDTLTADVIGRRVEVNGEHATVRFAGVVPPVAGPWLGVEWDNPERGKHDGSHEGTVYFKCRHPTGGSFIRPNKVNFGTDFLTAIKNRYVLEDGPEEDRKEQIVTIGNKPVETIGFDSIMKQQSQLSKLQEVSLRNCAVSCAGEKGGVAEACPNIRKVDLSKNLLSSWDEVIHIADQLRHLEVLNVSENKLKFPSGSVLTGTLSVLKVLVLNQTGITWAEVLRCVAGCPGLEELYLESNNIFISERPTDVLQTVKLLDLSSNQLIDENQLYLIAHLPR

SEQ ID NO: 863662 - protein, 564 aa, Homo sapiens; identical to SEQ ID NO: 863654

SEQ ID NO: 863663 - protein, 272 aa, Homo sapiens; identical to SEQ ID NO: 863657

SEQ ID NO: 863664 - protein, 428 aa, Homo sapiens
LGRGVGYASPRRGDFGGQWSHMSALAELWPLSSACLYALPGTYVDRHMQPRCLSHGPPWAVRSVTETEVSHVAKLSVLMRGTRGISPDENKLKFPSGSVLTGTLSVLKVLVLNQTGITWAEVLRCVAGCPGLEELYLESNNIFISERPTDVLQTVKLLDLSSNQLIDENQLYLIAHLPRLEQLILSDTGISSLHFPDAGIGCKTSMFPSLKYLVVNDNQISQWSFFNELEKLPSLRALSCLRNPLTKEDKEAETARLLIIASIGQLKTLNKCEILPEERRRAELDYRKAFGNEWKQAGGHKDPEKNRLSEEFLTAHPRYQFLCLKYGAPEDWELKTQQPLMLKNQLLTLKIKYPHQLDQKVLEKQLPGSMTIQKVKGLLSRLLKVPVSDLLLSYESPKKPGREIELENDLKSLQFYSVENGDCLLVRW

SEQ ID NO: 863665 - protein, 557 aa, Homo sapiens
RPEPQASLLGSWLEGLLLGTPGVSAGRSHILDSGYIIMSDTLTADVIGRRVEVNGEHATVRFAGVVPPVAGPWLGVEWDNPERGKHDGSHEGTVYFKCRHPTGGSFIRPNKVNFGTDFLTAIKNRYVLEDGPEEDRKEQIVTIGNKPVETIGFDSIMKQQSQLSKLQEVSLRNCAVSCAGEKGGVAEACPNIRKVDLSKNLLSSWDEVIHIADQLRHLEVLNVSENKLKFPSGSVLTGTLSVLKVLVLNQTGITWAEVLRCVAGCPGLEELYLESNNIFISERPTDVLQTVKLLDLSSNQLIDENQLYLIAHLPRLEQLILSDTGISSLHFPDAGIGCKTSMFPSLKYLVVNDNQISQWSFFNELEKLPSLRALSCLRNPLTKEDKEAETARLLIIASIGQLKTLNKCEILPEERRRAELDYRKAFGNEWKQAGGHKDPEKNRLSEEFLTAHPRYQFLCLKYGAPEDWELKTQQPLMLKNQLLTLKIKYPHQLDQKVLEKQLPGSMTIQKVKGLLSRLLKVPVSDLLLSYESPKVSCPAKYKVKVKLSPRIMTLNCL

SEQ ID NO: 863666 - protein, 487 aa, Homo sapiens
RPEPQASLLGSWLEGLLLGTPGVSAGRSHILDSGYIIMSDTLTADVIGRRVEVNGEHATVRFAGVVPPVAGPWLGVEWDNPERGKHDGSHEGTVYFKCRHPTGGSFIRPNKVNFGTDFLTAIKNRYVLEDGPEEDRKEQIVTIGNKPVETIGFDSIMKQQSQLSKLQEVSLRNCAVSCAGEKGGVAEACPNIRKVDLSKNLLSSWDEVIHIADQLRHLEVLNVSENKLKFPSGSVLTGTLSVLKVLVLNQTGITWAEVLRCVAGCPGLEELYLESNNIFISERPTDVLQTVKLLDLSSNQLIDENQLYLIAHLPRLEQLILSDTGISSLHFPDAGIGCKTSMFPSLKYLVVNDNQISQWSFFNELEKLPSLRALSCLRNPLTKEDKEAETARLLIIASIGQLKTLNKCEILPEERRRAELDYRKAFGNEWKQAGGHKDPEKNRLSEEFLTAHPRYQFLCLKYGAPEDWELKTQQPLMLKNQLLTLID

SEQ ID NO: 863667 - protein, 526 aa, Homo sapiens
PSHMAALLRRLLQRERPSAASGRPVGRREANLGTDAGVAVRVRFAPSPTGFLHLGGLRTALYNYIFAKKYQGSFILRLEDTDQTRVVPGAAENIEDMLEWAGIPPDESPRRGGPAGPYQQSQRLELYAQATEALLKTGAAYPCFCSPQRLELLKKEALRNHQTPRYDNRCRNMSQEQVAQKLAKDPKPAIRFRLEQVVPAFQDLVYGWNRHEVASVEGDPVIMKSDGFPTYHLACVVDDHHMGISHVLRGSEWLVSTAKHLLLYQALGWQPPHFAHLPLLLNRDGSKLSKRQGDVFLEHFAADGFLPDSLLDIITNCGSGFAENQMGRTLPELITQFNLTQVTCHSALLDLEKLPEFNRLHLQRLVSNESQRRQLVGKLQVLVEEAFGCQLQNRDVLNPVYVERILLLRQGHICRLQDLVSPVYSYLWTRPAVGRAQLDAISEKVDVIAKRVLGLLERSGMSLTQDMLNGELKKLSEGLEGTKYSNVMKLLRMALSGQQQGPPVAEMMLALGPKEVRERIQKVVSS

SEQ ID NO: 863668 - protein, 354 aa, Homo sapiens
MSQEQVAQKLAKDPKPAIRFRLEQVVPAFQDLVYGWNRHEVASVEGDPVIMKSDGFPTYHLACVVDDHHMGISHVLRGSEWLVSTAKHLLLYQALGWQPPHFAHLPLLLNRDGSKLSKRQGDVFLEHFAADGFLPDSLLDIITNCGSGFAENQMGRTLPELITQFNLTQVTCHSALLDLEKLPEFNRLHLQRLVSNESQRRQLVGKLQVLVEEAFGCQLQNRDVLNPVYVERILLLRQGHICRLQDLVSPVYSYLWTRPAVGRAQLDAISEKVDVIAKRVLGLLERSGMSLTQDMLNGELKKLSEGLEGTKYSNVMKLLRMALSGQQQGPPVAEMMLALGPKEVRERIQKVVSS

SEQ ID NO: 863669 - protein, 526 aa, Homo sapiens; identical to SEQ ID NO: 863667

SEQ ID NO: 863670 - protein, 526 aa, Homo sapiens; identical to SEQ ID NO: 863667

SEQ ID NO: 863671 - protein, 55 aa, Homo sapiens
AVCTLAVIIPCVPGIPPDESPRRGGPAGPYQQSQRLELYAQATEALLKTGAAYPC

SEQ ID NO: 863672 - protein, 430 aa, Homo sapiens [sequence omitted]

SEQ ID NO: 863673 - protein, 526 aa, Homo sapiens; identical to SEQ ID NO: 863667

SEQ ID NO: 863674 - protein, 526 aa, Homo sapiens; identical to SEQ ID NO: 863667

SEQ ID NO: 863675 - protein, 768 aa, Homo sapiens
MSNLSKGTGSRKDTKMRIRAFPMTMDEKYVNSIWDLLKNAIQEIQRKNNSGLSFEELYRNAYTMVLHKHGEKLYTGLREVVTEHLINKVREDVLNSLNNNFLQTLNQAWNDHQTAMVMIRDILMYMDRVYVQQNNVENVYNLGLIIFRDQVVRYGCIRDHLRQTLLDMIARERKGEVVDRGAIRNACQMLMILGLEGRSVYEEDFEAPFLEMSAEFFQMESQKFLAENSASVYIKKVEARINEEIERVMHCLDKSTEEPIVKVVERELISKHMKTIVEMENSGLVHMLKNGKTEDLGCMYKLFSRVPNGLKTMCECMSSYLREQGKALVSEEGEGKNPVDYIQGLLDLKSRFDRFLLESFNNDRLFKQTIAGDFEYFLNLNSRSPEYLSLFIDDKLKKGVKGLTEQEVETILDKAMVLFRFMQEKDVFERYYKQHLARRLLTNKSVSDDSEKNMISKLKTECGCQFTSKLEGMFRDMSISNTTMDEFRQHLQATGVSLGGVDLTVRVLTTGYWPTQSATPKCNIPPAPRHAFEIFRRFYLAKHSGRQLTLQHHMGSADLNATFYGPVKKEDGSEVGVGGAQVTGSNTRKHILQVSTFQMTILMLFNNREKYTFEEIQQETDIPERELVRALQSLACGKPTQRVLTKEPKSKEIENGHIFTVNDQFTSKLHRVKIQTVAAKQGESDPERKETRQKVDDDRKHEIEAAIVRIMKSRKKMQHNVLVAEVTQQLKARFLPSPVVIKKRIEGLIEREYLARTPEDRKVYTYVA

SEQ ID NO: 863676 - protein, 768 aa, Homo sapiens; identical to SEQ ID NO: 863675

SEQ ID NO: 863677 - protein, 810 aa, Homo sapiens
MSNLSKGTGSRKDTKMRIRAFPMTMDEKYVNSIWDLLKNAIQEIQRKNNSGLSFEELYRNAYTMVLHKHGEKLYTGLREVVTEHLINKEYYISDVVSSVHHIRRHLMSVYPIIGDVNFDHWCPPDFSTVKVREDVLNSLNNNFLQTLNQAWNDHQTAMVMIRDILMYMDRVYVQQNNVENVYNLGLIIFRDQVVRYGCIRDHLRQTLLDMIARERKGEVVDRGAIRNACQMLMILGLEGRSVYEEDFEAPFLEMSAEFFQMESQKFLAENSASVYIKKVEARINEEIERVMHCLDKSTEEPIVKVVERELISKHMKTIVEMENSGLVHMLKNGKTEDLGCMYKLFSRVPNGLKTMCECMSSYLREQGKALVSEEGEGKNPVDYIQGLLDLKSRFDRFLLESFNNDRLFKQTIAGDFEYFLNLNSRSPEYLSLFIDDKLKKGVKGLTEQEVETILDKAMVLFRFMQEKDVFERYYKQHLARRLLTNKSVSDDSEKNMISKLKTECGCQFTSKLEGMFRDMSISNTTMDEFRQHLQATGVSLGGVDLTVRVLTTGYWPTQSATPKCNIPPAPRHAFEIFRRFYLAKHSGRQLTLQHHMGSADLNATFYGPVKKEDGSEVGVGGAQVTGSNTRKHILQVSTFQMTILMLFNNREKYTFEEIQQETDIPERELVRALQSLACGKPTQRVLTKEPKSKEIENGHIFTVNDQFTSKLHRVKIQTVAAKQGESDPERKETRQKVDDDRKHEIEAAIVRIMKSRKKMQHNVLVAEVTQQLKARFLPSPVVIKKRIEGLIEREYLARTPEDRKVYTYVA

SEQ ID NO: 863678 - protein, 750 aa, Homo sapiens
MSNLSKGTGSRKDTKMRIRAFPMTMDEKYVNSIWDLLKNAIQEIQRKNNSGLSFEELYRNAYTMVLHKHGEKLYTGLREVVTEHLINKVREDVLNSLNNNFLQTLNQAWNDHQTAMVMIRDILMYMDRVYVQQNNVENVYNLGLIIFRDQVVRYGCIRDHLRQTLLDMIARERKGEVVDRGAIRNACQMLMILGLEGRSVYEEDFEAPFLEMSAEFFQMESQKFLAENSASVYIKKVEARINEEIERVMHCLDKSTEEPIVKVVERELISKHMKTIVEMENSGLVHMLKNGKTEDLGCMYKLFSRVPNGLKTMCECMSSYLREQGKALVSEEGEGKNPVDYIQGLLDLKSRFDRFLLESFNNDRLFKQTIAGDFEYFLNLNSRSPEYLSLFIDDKLKKGVKGLTEQEVETILDKAMVLFRFMQEKDVFERYYKQHLARRLLTNKSVSDDSEKNMISKLKTECGCQFTSFRQHLQATGVSLGGVDLTVRVLTTGYWPTQSATPKCNIPPAPRHAFEIFRRFYLAKHSGRQLTLQHHMGSADLNATFYGPVKKEDGSEVGVGGAQVTGSNTRKHILQVSTFQMTILMLFNNREKYTFEEIQQETDIPERELVRALQSLACGKPTQRVLTKEPKSKEIENGHIFTVNDQFTSKLHRVKIQTVAAKQGESDPERKETRQKVDDDRKHEIEAAIVRIMKSRKKMQHNVLVAEVTQQLKARFLPSPVVIKKRIEGLIEREYLARTPEDRKVYTYVA

SEQ ID NO: 863679 - protein, 388 aa, Homo sapiens [sequence omitted]

SEQ ID NO: 863680 - protein, 768 aa, Homo sapiens; identical to SEQ ID NO: 863675

SEQ ID NO: 863681 - protein, 768 aa, Homo sapiens; identical to SEQ ID NO: 863675

SEQ ID NO: 863682 - protein, 776 aa, Homo sapiens
MSNLSKGTGSRKDTKMRIRAFPMTMDEKYVNSIWDLLKNAIQEIQRKNNSGLSFEELYRNAYTMVLHKHGEKLYTGLREVVTEHLINKVREDVLNSLNNNFLQTLNQAWNDHQTAMVMIRDILMYMDRVYVQQNNVENVYNLGLIIFRDQVVRYGCIRDHLRQTLLDMIARERKGEVVDRGAIRNACQMLMILGLEGRSVYEEDFEAPFLEMSAEFFQMESQKFLAENSASVYIKKVEARINEEIERVMHCLDKSTEEPIVKVVERELISKHMKTIVEMENSGLVHMLKNGKTEDLGCMYKLFSRVPNGLKTMCECMSSYLREQGKALVSEEGEGKNPVDYIQGLLDLKSRFDRFLLESFNNDRLFKQTIAGDFEYFLNLNSRSPEYLSLFIDDKLKKGVKGLTEQEVETILDKAMVLFRFMQEKDVFERYYKQHLARRLLTNKSVSDDSEKNMISKLKTECGCQFTSKLEGMFRDMSISNTTMDEFRQHLQATGVSLGGVDLTVRVLTTGYWPTQSATPKCNIPPAPRHAFEIFRRFYLAKHSGRQLTLQHHMGSADLNATFYGPVKKEDGSEVGVGGAQVTGSNTRKHILQVSTFQMTILMLFNNREKYTFEEIQQETDIPERELVRALQSLACGKPTQRVLTKEPKSKEIENGHIFTVNDQFTSKLHRVKIQTVAAKQGESDPERKETRQKVDDDRKHEIEAAIVRIMKSRKKMQHNVLVAEVTQQVKAPSFPVPWYEARFEAFGHTLRAHLGLTFTLCYGARLILDRLHAGD

SEQ ID NO: 863683 - protein, 732 aa, Homo sapiens
MSNLSKGTGSRKDTKMRIRAFPMTMDEKYVNSIWDLLKNAIQEIQRKNNSGLSFEELYRNAYTMVLHKHGEKLYTGLREVVTEHLINKVREDVLNSLNNNFLQTLNQAWNDHQTAMVMIRDILMYMDRVYVQQNNVENVYNLGLIIFRDQVVRYGCIRDHLRQTLLDMIARERKGEVVDRGAIRNACQMLMILGLEGRSVYEEDFEAPFLEMSAEFFQMESQKFLAENSASVYIKKVEARINEEIERVMHCLDKSTEEPIVKVVERELISKHMKTIVEMENSGLVHMLKNGKTEDLGCMYKLFSRVPNGLKTMCECMSSYLREQGKALVSEEGEGKNPVDYIQGLLDLKSRFDRFLLESFNNDRLFKQTIAGDFEYFLNLNSRSPEYLSLFIDDKLKKGVKGLTEQEVETILDKAMVLFRFMQEKDVFERYYKQHLARRLLTNKSVSDDSEKNMISKLKTECGCQFTSKLEGMFRDMSISNTTMDEFRQHLQATGVSLGGVDLTVRVLTTGYWPTQSATPKCNIPPAPRHAFEIFRRFYLAKHSGRQLTLQHHMGSADLNATFYGPVKKEDGSEVGVGGAQVTGSNTRKHILQVSTFQMTILMLFNNREKYTFEEIQQETDIPERELVRALQSLACGKPTQRVLTKEPKSKEIENGHIFTVNDQFTSKLHRVKIQTVAAKQGESDPERKETRQKVDDDRKHEIEAAIVRIMKSRKKMQHNVLVAEVRTLHYW

SEQ ID NO: 863684 - protein, 736 aa, Homo sapiens
MSNLSKGTGSRKDTKMRIRAFPMTMDEKYVNSIWDLLKNAIQEIQRKNNSGLSFEELYRNAYTMVLHKHGEKLYTGLREVVTEHLINKVREDVLNSLNNNFLQTLNQAWNDHQTAMVMIRDILMYMDRVYVQQNNVENVYNLGLIIFRDQVVRYGCIRDHLRQTLLDMIARERKGEVVDRGAIRNACQMLMILGLEGRSVYEEDFEAPFLEMSAEFFQMESQKFLAENSASVYIKKVEARINEEIERVMHCLDKSTEEPIVKVVERELISKHMKTIVEMENSGLVHMLKNGKTEDLGCMYKLFSRVPNGLKTMCECMSSYLREQGKALVSEEGEGKNPVDYIQGLLDLKSRFDRFLLESFNNDRLFKQTIAGDFEYFLNLNSRSPEYLSLFIDDKLKKGVKGLTEQEVETILDKAMVLFRFMQEKDVFERYYKQHLARRLLTNKSVSDDSEKNMISKLKTECGCQFTSKLEGMFRDMSISNTTMDEFRQHLQATGVSLGGVDLTVRVLTTGYWPTQSATPKCNIPPAPRHAFEIFRRFYLAKHSGRQLTLQHHMGSADLNATFYGPVKKEDGSEVGVGGAQVTGSNTRKHILQVSTFQMTILMLFNNREKYTFEEIQQETDIPERELVRALQSLACGKPTQRVLTKEPKSKEIENGHIFTVNDQFTSKLHRVKIQTVAAKQGESDPERKETRQKVLCIACANKDGFSRGCPEQEEGSSSFQEVYLYLFRAISMAAT

SEQ ID NO: 863685 - protein, 758 aa, Homo sapiens
MSNLSKGTGSRKDTKMRIRAFPMTMDEKYVNSIWDLLKNAIQEIQRKNNSGLSFEELYRNAYTMVLHKHGEKLYTGLREVVTEHLINKVREDVLNSLNNNFLQTLNQAWNDHQTAMVMIRDILMYMDRVYVQQNNVENVYNLGLIIFRDQVVRYGCIRDHLRQTLLDMIARERKGEVVDRGAIRNACQMLMILGLEGRSVYEEDFEAPFLEMSAEFFQMESQKFLAENSASVYIKKVEARINEEIERVMHCLDKSTEEPIVKVVERELISKHMKTIVEMENSGLVHMLKNGKTEDLGCMYKLFSRVPNGLKTMCECMSSYLREQGKALVSEEGEGKNPVDYIQGLLDLKSRFDRFLLESFNNDRLFKQTIAGDFEYFLNLNSRSPEYLSLFIDDKLKKGVKGLTEQEVETILDKAMVLFRFMQEKDVFERYYKQHLARRLLTNKSVSDDSEKNMISKLKTECGCQFTSFRQHLQATGVSLGGVDLTVRVLTTGYWPTQSATPKCNIPPAPRHAFEIFRRFYLAKHSGRQLTLQHHMGSADLNATFYGPVKKEDGSEVGVGGAQVTGSNTRKHILQVSTFQMTILMLFNNREKYTFEEIQQETDIPERELVRALQSLACGKPTQRVLTKEPKSKEIENGHIFTVNDQFTSKLHRVKIQTVAAKQGESDPERKETRQKVDDDRKHEIEAAIVRIMKSRKKMQHNVLVAEVTQQVKAPSFPVPWYEARFEAFGHTLRAHLGLTFTLCYGARLILDRLHAGD

SEQ ID NO: 863686 - protein, 519 aa, Homo sapiens
MSNLSKGTGSRKDTKMRIRAFPMTMDEKYVNSIWDLLKNAIQEIQRKNNSGLSFEELYRNAYTMVLHKHGEKLYTGLREVVTEHLINKVREDVLNSLNNNFLQTLNQAWNDHQTAMVMIRDILMYMDRVYVQQNNVENVYNLGLIIFRDQVVRYGCIRDHLRQTLLDMIARERKGEVVDRGAIRNACQMLMILGLEGRSVYEEDFEAPFLEMSAEFFQMESQKFLAENSASVYIKKVEARINEEIERVMHCLDKSTEEPIVKVVERELISKHMKTIVEMENSGLVHMLKNGKTEDLGCMYKLFSRVPNGLKTMCECMSSYLREQGKALVSEEGEGKNPVDYIQGLLDLKSRFDRFLLESFNNDRLFKQTIAGDFEYFLNLNSRSPEYLSLFIDDKLKKGVKGLTEQEVETILDKAMVLFRFMQEKDVFERYYKQHLARRLLTNKSVSDDSEKNMISKLKTECGCQFTSKLEGMFRDMSISNTTMDEFRQHLQATGVRFCVNFYLDIHVKSFVMGIFSST

SEQ ID NO: 863687 - protein, 768 aa, Homo sapiens; identical to SEQ ID NO: 863675

SEQ ID NO: 863688 - protein, 768 aa, Homo sapiens; identical to SEQ ID NO: 863675

SEQ ID NO: 863689 - protein, 520 aa, Homo sapiens [sequence omitted]

SEQ ID NO: 863690 - protein, 212 aa, Homo sapiens
MLISRHILCTSEKEDGSEVGVGGAQVTGSNTRKHILQVSTFQMTILMLFNNREKYTFEEIQQETDIPERELVRALQSLACGKPTQRVLTKEPKSKEIENGHIFTVNDQFTSKLHRVKIQTVAAKQGESDPERKETRQKVDDDRKHEIEAAIVRIMKSRKKMQHNVLVAEVTQQLKARFLPSPVVIKKRIEGLIEREYLARTPEDRKVYTYVA

SEQ ID NO: 863691 - protein, 223 aa, Homo sapiens
EIQQFYCNELYFLNFSFIFLFSYSKENKTQHFTFSQVTGSNTRKHILQVSTFQMTILMLFNNREKYTFEEIQQETDIPERELVRALQSLACGKPTQRVLTKEPKSKEIENGHIFTVNDQFTSKLHRVKIQTVAAKQGESDPERKETRQKVDDDRKHEIEAAIVRIMKSRKKMQHNVLVAEVTQQLKARFLPSPVVIKKRIEGLIEREYLARTPEDRKVYTYVA

SEQ ID NO: 863692 - protein, 768 aa, Homo sapiens; identical to SEQ ID NO: 863675

SEQ ID NO: 863693 - protein, 642 aa, Homo sapiens
MSNLSKGTGSRKDTKMRIRAFPMTMDEKYVNSIWDLLKNAIQEIQRKNNSGLSFEELYRNAYTMVLHKHGEKLYTGLREVVTEHLINKVREDVLNSLNNNFLQTLNQAWNDHQTAMVMIRDILMYMDRVYVQQNNVENVYNLGLIIFRDQVVRYGCIRDHLRQTLLDMIARERKGEVVDRGAIRNACQMLMILGLEGRSVYEEDFEAPFLEMSAEFFQMESQKFLAENSASVYIKKVEARINEEIERVMHCLDKSTEEPIVKVVERELISKHMKTIVEMENSGLVHMLKNGKTEDLGCMYKLFSRVPNGLKTMCECMSSYLREQGKALVSEEGEGKNPVDYIQGLLDLKSRFDRFLLESFNNDRLFKQTIAGDFEYFLNLNSRSPEYLSLFIDDKLKKGVKGLTEQEVETILDKAMVLFRFMQEKDVFERYYKQHLARRLLTNKSVSDDSEKNMISKLKTECGCQFTSKLEGMFRDMSISNTTMDEFRQHLQATGVSLGGVDLTVRVLTTGYWPTQSATPKCNIPPAPRHAFEIFRRFYLAKHSGRQLTLQHHMGSADLNATFYGPVKKEDGSEVGVGGAQVTGSNTRKHILQVSTFQMTILMLFNNREKYTFEVWIVVIYILTVLFLTLTCYLSLSYLNNL

SEQ ID NO: 863694 - protein, 80 aa, Homo sapiens
TLCVTAHVILRPDVFLSPSTISSFPIIPTESWSLLQILQALGKSYHPGCFRCVICNECLDGVPFTVDSENKIYCVRDYHK

SEQ ID NO: 863695 - protein, 676 aa, Homo sapiens
MDKYDDLGLEASKFIEDLNMYEASKDGLFRVDKGAGNNPEFEETRRVFATKMAKIHLQQQQQQLLQEETLPRGSRGPVNGGGRLGPQARWEVVGSKLTVDGAAKPPLAASTGAPGAVTTLAAGQPPYPPQEQRSRPYLHGTRHGSQDCGSRESLATSEMSAFHQPGPCEDPSCLTHGDYYDNLSLASPKWGDKPGVSPSIGLSVGSGWPSSPGSDPPLPKPCGDHPLNHRQLSLSSSRSSEGSLGGQNSGIGGRSSEKPTGLWSTASSQRVSPGLPSPNLENGAPAVGPVQPRTPSVSAPLALSCPRQGGLPRSNSGLGGEVSGVMSKPNVDPQPWFQDGPKSYLSSSAPSSSPAGLDGSQQGAVPGLGPKPGCTDLGTGPKLSPTSLVHPVMSTLPELSCKEGPLGWSSDGSLGSVLLDSPSSPRVRLPCQPLVPGPELRPSAAELKLEALTQRLEREMDAHPKADYFGACVKCSKGVFGAGQACQAMGNLYHDTCFTCAACSRKLRGKAFYFVNGKVFCEEDFLYSGFQQSADRCFLCGHLIMDMILQALGKSYHPGCFRCVICNECLDGVPFTVDSENKIYCVRDYHKVLAPKCAACGLPILPPEGSDETIRVVSMDRDYHVECYHCEDCGLELNDEDGHRCYPLEDHLFCHSCHVKRLEKRPSSTALHQHHF

SEQ ID NO: 863696 - protein, 188 aa, Homo sapiens
MGNLYHDTCFTCAACSRKLRGKAFYFVNGKVFCEEDFLYSGFQQSADRCFLCGHLIMDMILQALGKSYHPGCFRCVICNECLDGVPFTVDSENKIYCVRDYHKVLAPKCAACGLPILPPEGSDETIRVVSMDRDYHVECYHCEDCGLELNDEDGHRCYPLEDHLFCHSCHVKRLEKRPSSTALHQHHF

SEQ ID NO: 863697 - protein, 620 aa, Homo sapiens
MDKYDDLGLEASKFIEDLNMYEASKDGLFRVDKGAGNNPEFEETRRVFATKMAKIHLQQQQQQLLQEETLPRGSRGPVNGGGRLGPQARWEVVGSKLTVDGAAKPPLAASTGAPGAVTTLAAGQPPYPPQEQRSRPYLHGTRHGSQDCGSRESLATSEMSAFHQPGPCEDPSCLTHGDYYDNLSLASPKWGDKPGVSPSIGLSVGSGWPSSPGSDPPLPKPCGDHPLNHRQLSLSSSRSSEGSLGGQNSGIGGRSSEKPTGLWSTASSQRVSPGLPSPNLENGAPAVGPVQPRTPSVSAPLALSCPRQGGLPRSNSGLGGEVSGVMSKPNVDPQPWFQDGPKSYLSSSAPSSSPAGLDGSQQGAVPGLGPKPGCTDLGTGPKLSPTSLVHPVMSTLPELSCKEGPLGWSSDGSLGSVLLDSPSSPRVRLPCQPLVPGPELRPSAAELKLEALTQRLEREMDAHPKADYFGACVKCSKGVFGAGQACQAMGNLYHDTCFTCAACSRKLRGKAFYFVNGKVFCEEDFLYSGFQQSADRCFLCGHLIMDMILQALGKSYHPGCFRCVICNECLDGVPFTVDSENKIYCVRDYHKVLAPKCAACGLPILPPEVRCPSRHAPRGF

SEQ ID NO: 863698 - protein, 152 aa, Homo sapiens
GRRHLCCACCLTQLLGLGHLVLEELLQLGLLLLDEALPCVICNECLDGVPFTVDSENKIYCVRDYHKVLAPKCAACGLPILPPEGSDETIRVVSMDRDYHVECYHCEDCGLELNDEDGHRCYPLEDHLFCHSCHVKRLEKRPSSTALHQHHF

SEQ ID NO: 863699 - protein, 95 aa, Homo sapiens
MGRSLRPSGVQCSSAVLGNRALSRQRREIFRVIWVGGNILHHHFCSGSIVLCPPDPSPASPGASSGSTPRTREVTKINLQLGCDVIGGFPENMGI

SEQ ID NO: 863700 - protein, 498 aa, Homo sapiens
MKRKSERRSSWAAAPPCSRRCSSTSPGVKKIRSSTQQDPRRRDPQDDVYLDITDRLCFAILYSRPKSASNVHYFSIDNELEYENFYADFGPLNLAMVYRYCCKINKKLKSITMLRKKIVHFTGSDQRKQANAAFLVGCYMVIYLGRTPEEAYRILIFGETSYIPFRDAAYGSCNFYITLLDCFHAVKKAMQYGFLNFNSFNLDEYEHYEKAENGDLNWIIPDRFIAFCGPHSRARLESGYHQHSPETYIQYFKNHNVTTIIRLNKRMYDAKRFTDAGFDHHDLFFADGSTPTDAIVKEFLDICENAEGAIAVHCKAGLGRTGTLIACYIMKHYRMTAAETIAWVRICRPGSVIGPQQQFLVMKQTNLWLEGDYFRQKLKGQENGQHRAAFSKLLSGVDDISINGVENQDQQEPEPYSDDDEINGVTQGDRLRALKSRRQSKTNAIPLTVILQSSVQSCKTSEPNISGSAGITKRTTRSASRKSSVKSLSISRTKTVLR

SEQ ID NO: 863701 - protein, 471 aa, Homo sapiens
MKRKSERRSSWAAAPPCSRRCSSTSPGVKKIRSSTQQDPRRRDPQDDVYLDITDRLCFAILYSRPKSASNVHYFSIDNELEYENFYADFGPLNLAMVYRYCCKINKKLKSITMLRKKIVHFTGSDQRKQANAAFLVGCYMVIYLGRTPEEAYRILIFGETSYIPFRDAAYGSCNFYITLLDCFHAVKKAMQYGFLNFNSFNLDEYEHYEKAENGDLNWIIPDRFIAFCGPHSRARLESGYHQHSPETYIQYFKNHNVTTIIRLNKRMYDAKRFTDAGFDHHDLFFADGSTPTDAIVKEFLDICENAEGAIAVHCKAGLGRTGTLIACYIMKHYRMTAAETIAWVRICRPGSVIGPQQQFLVMKQTNLWLEGDYFRQKLKGQENGQHRAAFSKLLSGVDDISINGVENQDQQEPEPYSDDDEINGVTQGDRLRALKSRRQSKTNAIPLTDGWLSQAVTFLDRLLIWLGIHKD

SEQ ID NO: 863702 - protein, 485 aa, Homo sapiens
MKRKSERRSSWAAAPPCSRRCSSTSPGVKKIRSSTQQDPRRRDPQDDVYLDITDRLCFAILYSRPKSASNVHYFSIDNELEYENFYADFGPLNLAMVYRYCCKINKKLKSITMLRKKIVHFTGSDQRKQANAAFLVGCYMVIYLGRTPEEAYRILIFGETSYIPFRDAAYGSCNFYITLLDCFHAVKKAMQYGFLNFNSFNLDEYEHYEKAENGDLNWIIPDRFIAFCGPHSRARLESGYHQHSPETYIQYFKNHNVTTIIRLNKRMYDAKRFTDAGFDHHDLFFADGSTPTDAIVKEFLDICENAEGAIAVHCKAGLGRTGTLIACYIMKHYRMTAAETIAWVRICRPGSVIGPQQQFLVMKQTNLWLEGDYFRQKLKGQENGQHRAAFSKLLSGVDDISINGVENQDQQEPEPYSDDDEINGVTQGDRLRALKSRRQSKTNAIPLTCPLAVLTSALCSVVIWWIVCDYILPILLFCLDGFRTQ

SEQ ID NO: 863703 - protein, 485 aa, Homo sapiens; identical to SEQ ID NO: 863702

SEQ ID NO: 863704 - protein, 452 aa, Homo sapiens [sequence omitted]

SEQ ID NO: 863705 - protein, 246 aa, Homo sapiens
PSRCFGVMSREGAGAALVAEVIKDRLCFAILYSRPKSASNVHYFSIDNELEYENFYADFGPLNLAMVYRYCCKINKKLKSITMLRKKIVHFTGSDQRKQANAAFLVGCYMVIYLGRTPEEAYRILIFGETSYIPFRDAAYGSCNFYITLLDCFHAVKKAMQYGFLNFNSFNLDEYEHYEKAENGDLNWIIPDRFIAFCGPHSRARLESGYHQHSPETYIQYFKNHNVTTIIRLNKRMYDAQTSLWR

SEQ ID NO: 863706 - protein, 171 aa, Homo sapiens
MKRKSERRSSWAAAPPCSRRCSSTSPGVKKIRSSTQQDPRRRDPQDDVYLDITDRLCFAILYSRPKSASNVHYFSIDNELEYENFYADFGPLNLAMVYRYCCKINKKLKSITMLRKKIVHFTGSDQRKQANAAFLVGCYMVSICFPNVFIKMHTTVVLYICSWNFEIKIMS

SEQ ID NO: 863707 - protein, 143 aa, Homo sapiens
RNSPPGVPTSRVLLCPGAYAAAAAAAVGTHGYPGQLRPPAAAPSPRPRQPAAGTWGRAGGAGRGRRRCSEGCGAGPAAAAGGSGAGAVGRAPPPAPARPPPAGLCRRPPSPQRRSAPAAPSARAGLAGASAGARARGAMVVAP

SEQ ID NO: 863708 - protein, 498 aa, Homo sapiens; identical to SEQ ID NO: 863700

SEQ ID NO: 863709 - protein, 498 aa, Homo sapiens; identical to SEQ ID NO: 863700

SEQ ID NO: 863710 - protein, 485 aa, Homo sapiens; identical to SEQ ID NO: 863702

SEQ ID NO: 863711 - protein, 465 aa, Homo sapiens
AFQMLWSHEPGGRGGSFGSRGDQRKEHCNFSISDRLCFAILYSRPKSASNVHYFSIDNELEYENFYADFGPLNLAMVYRYCCKINKKLKSITMLRKKIVHFTGSDQRKQANAAFLVGCYMVIYLGRTPEEAYRILIFGETSYIPFRDAAYGSCNFYITLLDCFHAVKKAMQYGFLNFNSFNLDEYEHYEKAENGDLNWIIPDRFIAFCGPHSRARLESGYHQHSPETYIQYFKNHNVTTIIRLNKRMYDAKRFTDAGFDHHDLFFADGSTPTDAIVKEFLDICENAEGAIAVHCKAGLGRTGTLIACYIMKHYRMTAAETIAWVRICRPGSVIGPQQQFLVMKQTNLWLEGDYFRQKLKGQENGQHRAAFSKLLSGVDDISINGVENQDQQEPEPYSDDDEINGVTQGDRLRALKSRRQSKTNAIPLTCPLAVLTSALCSVVIWWIVCDYILPILLFCLDGFRTQ

SEQ ID NO: 863712 - protein, 390 aa, Homo sapiens
MVYRYCCKINKKLKSITMLRKKIVHFTGSDQRKQANAAFLVGCYMVIYLGRTPEEAYRILIFGETSYIPFRDAAYGSCNFYITLLDCFHAVKKAMQYGFLNFNSFNLDEYEHYEKAENGDLNWIIPDRFIAFCGPHSRARLESGYHQHSPETYIQYFKNHNVTTIIRLNKRMYDAKRFTDAGFDHHDLFFADGSTPTDAIVKEFLDICENAEGAIAVHCKAGLGRTGTLIACYIMKHYRMTAAETIAWVRICRPGSVIGPQQQFLVMKQTNLWLEGDYFRQKLKGQENGQHRAAFSKLLSGVDDISINGVENQDQQEPEPYSDDDEINGVTQGDRLRALKSRRQSKTNAIPLTCPLAVLTSALCSVVIWWIVCDYILPILLFCLDGFRTQ

SEQ ID NO: 863713 - protein, 485 aa, Homo sapiens; identical to SEQ ID NO: 863702

SEQ ID NO: 863714 - protein, 471 aa, Homo sapiens; identical to SEQ ID NO: 863701

SEQ ID NO: 863715 - protein, 485 aa, Homo sapiens; identical to SEQ ID NO: 863702

SEQ ID NO: 863716 - protein, 282 aa, Homo sapiens
MKVKVIPVLEDNYMYLVIEELTREAVAVDVAVPKRLLEIVGREGVSLTAVLTTHHHWDHARGNPELARLRPGLAVLGADERIFSLTRRLAHGEELRFGAIHVRCLLTPGHTAGHMSYFLWEDDCPDPPALFSGDALSVAGCGSCLEGSAQQMYQSLAELGTLPPETKVFCGHEHTLSNLEFAQKVEPCNDHVRAKLSWAKKRDEDDVPTVPSTLGEERLYNPFLRVAEEPVRKFTGKAVPADVLEALCKERARFEQAGEPRQPQARALLALQWGLLSAAPHD

SEQ ID NO: 863717 - protein, 354 aa, Homo sapiens
RRALWSHRAQDPGRAGAGAGRVRGGGRLAAPEPSAALSPDPVTGGRGPASVSLSFGSSAQPCRRHRWPSSVTMKVKVIPVLEDNYMYLVIEELTREAVAVDVAVPKRLLEIVGREGVSLTAVLTTHHHWDHARGNPELARLRPGLAVLGADERIFSLTRRLAHGEELRFGAIHVRCLLTPGHTAGHMSYFLWEDDCPDPPALFSGDALSVAGCGSCLEGSAQQMYQSLAELGTLPPETKVFCGHEHTLSNLEFAQKVEPCNDHVRAKLSWAKKRDEDDVPTVPSTLGEERLYNPFLRVAEEPVRKFTGKAVPADVLEALCKERARFEQAGEPRQPQARALLALQWGLLSAAPHD

SEQ ID NO: 863718 - protein, 316 aa, Homo sapiens
MKVKVIPVLEDNYMYLVIEELTREAVAVDVAVPKRLLEIVGREGVSLTAVLTTHHHWDHARGNPELARLRPGLAVLGADERIFSLTRRLAHGEELRFGAIHVRCLLTPGHTAGHMSYFLWEDDCPDPPALFSGTRSAERPTPPPAGPAPSALTRPPPPGDALSVAGCGSCLEGSAQQMYQSLAELGTLPPETKVFCGHEHTLSNLEFAQKVEPCNDHVRAKLSWAKARPLSRRGKRVGGEGTGFGVGGALRQGLMVTGACGHSRRGMRMTCPLCRRLWARSASTTPSCGWREYGCCPGASTVTWTLRKASGDCVLG

SEQ ID NO: 863719 - protein, 282 aa, Homo sapiens; identical to SEQ ID NO: 863716

SEQ ID NO: 863720 - protein, 309 aa, Homo sapiens
MKVKVIPVLEDNYMYLVIEELTREAVAVDVAVPKRLLEIVGREGVSLTAVLTTHHHWDHARGNPELARLRPGLAVLGADERIFSLTRRLAHGEELRVSARSREGRGGRPGSTRPHRSACSSAEFGAIHVRCLLTPGHTAGHMSYFLWEDDCPDPPALFSGDALSVAGCGSCLEGSAQQMYQSLAELGTLPPETKVFCGHEHTLSNLEFAQKVEPCNDHVRAKLSWAKKRDEDDVPTVPSTLGEERLYNPFLRVAEEPVRKFTGKAVPADVLEALCKERARFEQAGEPRQPQARALLALQWGLLSAAPHD

SEQ ID NO: 863721 - protein, 282 aa, Homo sapiens; identical to SEQ ID NO: 863716

SEQ ID NO: 863722 - protein, 227 aa, Homo sapiens
MKVKVIPVLEDNYMYLVIEELTREAVAVDVAVPKRLLEIVGREGVSLTAVLTTHHHWDHARGNPELARLRPGLAVLGADERIFSLTRRLAHGEELRFGAIHVRCLLTPGHTAGHMSYFLWEDDCPDPPALFSGDALSVAGCGSCLEGSAQQMYQSLAELGTLPPETKVFCGHEHTLSNLEFAQKVEPCNDHVRAKLSWAKKRDEDDVPTVPSTLGEERLYNPFLRVA

SEQ ID NO: 863723 - protein, 290 aa, Homo sapiens
MKVKVIPVLEDNYMYLVIEELTREAVAVDVAVPKRLLEIVGREGVSLTAVLTTHHHWDHARGNPELARLRPGLAVLGADERIFSLTRRLAHGEELRFGAIHVRCLLTPGHTAGHMSYFLWEDDCPDPPALFSGDALSVAGCGSCLEGSAQQMYQSLAELGTLPPETKVFCGHEHTLSNLEFAQKVEPCNDHVRAKLSWAKARPLSRRGKRVGGEGTGFGVGGALRQGLMVTGACGHSRRGMRMTCPLCRRLWARSASTTPSCGWREYGCCPGASTVTWTLRKASGDCVLG

SEQ ID NO: 863724 - protein, 282 aa, Homo sapiens; identical to SEQ ID NO: 863716

SEQ ID NO: 863725 - protein, 684 aa, Homo sapiens
MARHRNVRGYNYDEDFEDDDLYGQSVEDDYCISPSTAAQFIYSRRDKPSVEPVEEYDYEDLKESSNSVSNHQLSGFDQARLYSCLDHMREVLGDAVPDEILIEAVLKNKFDVQKALSGVLEQDRVQSLKDKNEATVSTGKIAKGKPVDSQTSRSESEIVPKVAKMTVSGKKQTMGFEVPGVSSEENGHSFHTPQKGPPIEDAIASSDVLETASKSANPPHTIQASEEQSSTPAPVKKSGKLRQQIDVKAELEKRQGGKQLLNLVVIGHVDAGKSTLMGHMLYLLGNINKRTMHKYEQESKKAGKASFAYAWVLDETGEERERGVTMDVGMTKFETTTKVITLMDAPGHKDFIPNMITGAAQADVAVLVVDASRGEFEAGFETGGQTREHGLLVRSLGVTQLAVAVNKMDQVNWQQERFQEITGKLGHFLKQAGFKESDVGFIPTSGLSGENLITRSQSSELTKWYKGLCLLEQIDSFKPPQRSIDKPFRLCVSDVFKDQGSGFCITGKIEAGYIQTGDRLLAMPPNETCTVKGITLHDEPVDWAAAGDHVSLTLVGMDIIKINVGCIFCGPKVPIKACTRFRARILIFNIEIPITKGFPVLLHYQTVSEPAVIKRLISVLNKSTGEVTKKKPKFLTKGQNALVELQTQRPIALELYKDFKELGRFMLRYGGSTIAAGVVTEIKE

SEQ ID NO: 863726 - protein, 202 aa, Homo sapiens
MARHRNVRGYNYDEDFEDDDLYGQSVEDDYCISPSTAAQFIYSRRDKPSVEPVEEYDYEDLKESSNSVSNHQLSGFDQARLYSCLDHMREVLGDAVPDEILIEAVLKNKFDVQKALSGVLEQDRVQSLKDKNEATVSTGKIAKGVLFSSSEVSADNVQSSYPQSANHLDYSSKPFDFASSVGKYGLSHNSSVPTHCLLHRKK

SEQ ID NO: 863727 - protein, 165 aa, Homo sapiens
MARHRNVRGYNYDEDFEDDDLYGQSVEDDYCISPSTAAQFIYSRRDKPSVEPVEEYDYEDLKESSNSVSNHQLSGFDQARLYSCLDHMREVLGDAVPDEILIEAVLKNKFDVQKALSGVLEQDRVQSLKDKNEATVSTGKIAKGHLAVDPFIRGKDRIHIGIQFL

SEQ ID NO: 863728 - protein, 684 aa, Homo sapiens; identical to SEQ ID NO: 863725

SEQ ID NO: 863729 - protein, 597 aa, Homo sapiens
MREVLGDAVPDEILIEAVLKNKFDVQKALSGVLEQDRVQSLKDKNEATVSTGKIAKGKPVDSQTSRSESEIVPKVAKMTVSGKKQTMGFEVPGVSSEENGHSFHTPQKGPPIEDAIASSDVLETASKSANPPHTIQASEEQSSTPAPVKKSGKLRQQIDVKAELEKRQGGKQLLNLVVIGHVDAGKSTLMGHMLYLLGNINKRTMHKYEQESKKAGKASFAYAWVLDETGEERERGVTMDVGMTKFETTTKVITLMDAPGHKDFIPNMITGAAQADVAVLVVDASRGEFEAGFETGGQTREHGLLVRSLGVTQLAVAVNKMDQVNWQQERFQEITGKLGHFLKQAGFKESDVGFIPTSGLSGENLITRSQSSELTKWYKGLCLLEQIDSFKPPQRSIDKPFRLCVSDVFKDQGSGFCITGKIEAGYIQTGDRLLAMPPNETCTVKGITLHDEPVDWAAAGDHVSLTLVGMDIIKINVGCIFCGPKVPIKACTRFRARILIFNIEIPITKGFPVLLHYQTVSEPAVIKRLISVLNKSTGEVTKKKPKFLTKGQNALVELQTQRPIALELYKDFKELGRFMLRYGGSTIAAGVVTEIKE

SEQ ID NO: 863730 - protein, 272 aa, Homo sapiens
KQWYQRRVAITSGGHFLKQAGFKESDVGFIPTSGLSGENLITRSQSSELTKWYKGLCLLEQIDSFKPPQRSIDKPFRLCVSDVFKDQGSGFCITGKIEAGYIQTGDRLLAMPPNETCTVKGITLHDEPVDWAAAGDHVSLTLVGMDIIKINVGCIFCGPKVPIKACTRFRARILIFNIEIPITKGFPVLLHYQTVSEPAVIKRLISVLNKSTGEVTKKKPKFLTKGQNALVELQTQRPIALELYKDFKELGRFMLRYGGSTIAAGVVTEIKE

SEQ ID NO: 863731 - protein, 684 aa, Homo sapiens; identical to SEQ ID NO: 863725

SEQ ID NO: 863732 - protein, 684 aa, Homo sapiens; identical to SEQ ID NO: 863725

SEQ ID NO: 863733 - protein, 684 aa, Homo sapiens; identical to SEQ ID NO: 863725

SEQ ID NO: 863734 - protein, 520 aa, Homo sapiens
MTVSGKKQTMGFEVPGVSSEENGHSFHTPQKGPPIEDAIASSDVLETASKSANPPHTIQASEEQSSTPAPVKKSGKLRQQIDVKAELEKRQGGKQLLNLVVIGHVDAGKSTLMGHMLYLLGNINKRTMHKYEQESKKAGKASFAYAWVLDETGEERERGVTMDVGMTKFETTTKVITLMDAPGHKDFIPNMITGAAQADVAVLVVDASRGEFEAGFETGGQTREHGLLVRSLGVTQLAVAVNKMDQVNWQQERFQEITGKLGHFLKQAGFKESDVGFIPTSGLSGENLITRSQSSELTKWYKGLCLLEQIDSFKPPQRSIDKPFRLCVSDVFKDQGSGFCITGKIEAGYIQTGDRLLAMPPNETCTVKGITLHDEPVDWAAAGDHVSLTLVGMDIIKINVGCIFCGPKVPIKACTRFRARILIFNIEIPITKGFPVLLHYQTVSEPAVIKRLISVLNKSTGEVTKKKPKFLTKGQNALVELQTQRPIALELYKDFKELGRFMLRYGGSTIAAGVVTEIKE

SEQ ID NO: 863735 - protein, 147 aa, Homo sapiens
MARHRNVRGYNYDEDFEDDDLYGQSVEDDYCISPSTAAQFIYSRRDKPSVEPVEEYDYEDLKESSNSVSNHQLSGFDQARLYSCLDHMREVLGDAVPDEILIEAVLKNKFDVQKALSGVLEQDRVQSLKDKNEATVSTGKIAKGPCC

SEQ ID NO: 863736 - protein, 353 aa, Homo sapiens
MTSPCSPPLKPPISPPKTPVPQASSIPSPPLPPSPLDFSALPSPPWSQQTPVPPPLPLPPPPAATGPAPPHVFGLEKSQLLKEAFDKAGPVPKGREDVKRLLKLHKDRFRGDLRWILFCADLPSLIQEGPQCGLVALWMAGTLLSPPSGVPLERLIRVATERGYTAQGEMFSVADMGRLAQEVLGCQAKLLSGGLGGPNRDLVLQHLVTGHPLLIPTSYDEDFNHEPCQRKGHKAHWAVSAGVLLGVRAVPSLGYTEDPELPGLFHPVLGTPCQPPSLPEEGSPGAVYLLSKQGKSWHYQLWDYDQVRESNLQLTDFSPSRATDGRVYVVPVGGVRAGLCGQALLLTPQDCSH

SEQ ID NO: 863737 - protein, 309 aa, Homo sapiens
MTSPCSPPLKPPISPPKTPVPQASSIPSPPLPPSPLDFSALPSPPWSQQTPVPPPLPLPPPPAATGPAPPHVFGLEKSQLLKEAFDKAGPVPKGREDVKRLLKLHKDRFRGDLRWILFCADLPSLIQEGPQCGLVALWMAGTLLSPPSGVPLERLIRVATERGYTAQGEMFSASYDEDFNHEPCQRKGHKAHWAVSAGVLLGVRAVPSLGYTEDPELPGLFHPVLGTPCQPPSLPEEGSPGAVYLLSKQGKSWHYQLWDYDQVRESNLQLTDFSPSRATDGRVYVVPVGGVRAGLCGQALLLTPQDCSH

SEQ ID NO: 863738 - protein, 215 aa, Homo sapiens
MAGTLLSPPSGVPLERLIRVATERGYTAQGEMFSVADMGRLAQEVLGCQAKLLSGGLGGPNRDLVLQHLVTGHPLLIPTSYDEDFNHEPCQRKGHKAHWAVSAGVLLGVRAVPSLGYTEDPELPGLFHPVLGTPCQPPSLPEEGSPGAVYLLSKQGKSWHYQLWDYDQVRESNLQLTDFSPSRATDGRVYVVPVGGVRAGLCGQALLLTPQDCSH

SEQ ID NO: 863739 - protein, 134 aa, Homo sapiens
MTSPCSPPLKPPISPPKTPVPQASSIPSPPLPPSPLDFSALPSPPWSQQTPVPPPLPLPPPPAATGPAPPHVFGLEKSQLLKEAFDKAGPVPKGREDVKRLLKLHKDRFRGDLRWILFCADLPSLIQEGPQYVP

SEQ ID NO: 863740 - protein, 309 aa, Homo sapiens; identical to SEQ ID NO: 863737

SEQ ID NO: 863741 - protein, 195 aa, Homo sapiens
MTSPCSPPLKPPISPPKTPVPQASSIPSPPLPPSPLDFSALPSPPWSQQTPVPPPLPLPPPPAATGPAPPHVFGLEKSQLLKEAFDKAGPVPKGREDVKRLLKLHKDRFRGDLRWILFCADLPSLIQEGPQCGLVALWMAGTLLSPPSGVPLERLIRVATERGYTAQGEMFSAPATTRTSTMSRVRGRATRHTGR

SEQ ID NO: 863742 - protein, 132 aa, Homo sapiens
TVCSNPYPNTTLRFFQVMSHRCLKFDESRTGPSMPLTFSPRALHLNKDHHHPTTLRLRPLNPLGLPSQPCPVCRQTHIPPLLVLQVPPPSPESNHCPLRIPPAQGFLWQSTTLTANTEVCCFFLNFSNIYTT

SEQ ID NO: 863743 - protein, 574 aa, Homo sapiens
KEAASGKSDRRTPESSLHEALDQCMTALDLFLTNQFSEALSYLKPRTKESMYHSLTYATILEMQAMMTFDPQDILLAGNMMKEAQMLCQRHRRKSSVTDSFSSLVNRPTLGQFTEEEIHAEVCYAECLLQRAALTFLQDENMVSFIKGGIKVRNSYQTYKELDSLVQSSQYCKGENHPHFEGGVKLGVGAFNLTLSMLPTRILRLLEFVGFSGNKDYGLLQLEEGASGHSFRSVLCVMLLLCYHTFLTFVLGTGNVNIEEAEKLLKPYLNRYPKGAIFLFFAGRIEVIKGNIDAAIRRFEECCEAQQHWKQFHHMCYWELMWCFTYKGQWKMSYFYADLLSKENCWSKATYIYMKAAYLSMFGKEDHKPFGDDEVELFRAVPGLKLKIAGKSLPTEKFAIRKSRRYFSSNPISLPVPALEMMYIWNGYAVIGKQPKLTDGILEIITKAEEMLEKGPENEYSVDDECLVKLLKGLCLKYLGRVQEAEENFRSISANEKKIKYDHYLIPNALLELALLLMEQDRNEEAIKLLESAKQNYKNYSMESRTHFRIQAATLQAKSSLENSSRSMVSSVSL

SEQ ID NO: 863744 - protein, 425 aa, Homo sapiens
MTSAGGAPGALPAGTPESSLHEALDQCMTALDLFLTNQFSEALSYLKPRTKESMYHSLTYATILEMQAMMTFDPQDILLAGNMMKEAQMLCQRHRRKSSVTDSFSSLVNRPTLGQFTEEEIHAEVCYAECLLQRAALTFLQGSSHGGAVRPRALHDPSHACSCPPGPGRQHLFSCDENMVSFIKGGIKVRNSYQTYKELDSLVQSSQYCKGENHPHFEGGVKLGVGAFNLTLSMLPTRILRLLEFVGFSGNKDYGLLQLEEGASGHSFRSVLCVMLLLCYHTFLTFVLGTGNVNIEEAEKLLKPYLNRYPKGAIFLFFAGRIEVIKGNIDAAIRRFEECCEAQQHWKQFHHMCYWELMWCFTYKGQWKMSYFYADLLSKENCWSKATYIYMKAAYLSMFGKEDHKPFGDDEVELFRWVPHRAPTV

SEQ ID NO: 863745 - protein, 1088 aa, Homo sapiens
MEVSSVALPGDQAEGEFSGSGAGGAGEEEQASTELSTCLAPVMSSTPHPVRRSYYLHWAHEGQLMLSEDCDFPTHMAVGDRHLDLRTVLCDSEASASLLLLESSWGVGACPEPTLLLKVLPQAQLPWPPHPLLITSYSQKGQSLREPFFFFERQGLAMLVRLVLNSWAQAIFPPLPPKVLGFWALGNLFELKVTSKPSCRVRWVAGANHMGKERPGGGTQLLYRGTEGGPGLPAVRKSGSVPRPLCGFGGGQSLSLCNTLLMRTSVKNGGCNPLSSGAPPISNLQNLATTDSTNFYVLGPGPLAIAIGTTCSVQAAPPSARILRGQLLGLTRRPWLSEDERSMQTQACLSADGGPLPESAAAPISLPRLHLFSTDVMTKAYSKLHLWVINIVAPPERAVLRMMIKGQVPRPKKTNLSRSIPLLLVIYSERIQLPSAKSFPEAFAKPPSLPRFASFCNFSHHPDLSPAVSPVEAFVFPPVLAASEAEMARNKVVTVACSGLGKPKELKAAQATKEDRKASEERPLRWVLERKDLGRQSGGSERTPQAKRAAGPKAQKPGRCRGAVCHRVKSLCGRRAGGLHQGGQLLFCPSIAPVHPWRAGASTTLSHSPHPNPGGAVRVSCLWAGGKTLGDEPGEGIMASRAEEQHRQRPGESLRSVGEEMAEDEPEKERLGQVLEDMSGCFGLYPAVGEPWQACGLDRCFRKPTSSCWATPLAGSCSKAGNTSMSRKRPPQGSRPSGETRNTDGQYNTMSGSSKCSEEQARLDAGSDGRGFVRGGRGKPVSEDTRMERRSSTWQSHGRPLGQRELGRAQQGRSVLMCPGNRPEAVVWLECCRCQGNCRRCLLSVMEYNQISRRNCHDLTKKATYIYMKAAYLSMFGKEDHKPFGDDEVELFRAVPGLKLKIAGKSLPTEKFAIRKSRRYFSSNPISLPVPALEMMYIWNGYAVIGKQPKLTDGILEIITKAEEMLEKGPENEYSVDDECLVKLLKGLCLKYLGRVQEAEENFRSISANEKKIKYDHYLIPNALLELALLLMEQDRNEEAIKLLESAKQNYKNYSMESRTHFRIQAATLQAKSSLENSSRSMVSSVSL

SEQ ID NO: 863746 - protein, 1139 aa, Homo sapiens
MADIANQSSAMSLAVTLDTFPAKLQAAVRTDPHWHLLGDLLICIWSLPLLCMEVSSVALPGDQAEGEFSGSGAGGAGEEEQASTELSTCLAPVMSSTPHPVRRSYYLHWAHEGQLMLSEDCDFPTHMAVGDRHLDLRTVLCDSEASASLLLLESSWGVGACPEPTLLLKVLPQAQLPWPPHPLLITSYSQKGQSLREPFFFFERQGLAMLVRLVLNSWAQAIFPPLPPKVLGFWALGNLFELKVTSKPSCRVRWVAGANHMGKERPGGGTQLLYRGTEGGPGLPAVRKSGSVPRPLCGFGGGQSLSLCNTLLMRTSVKNGGCNPLSSGAPPISNLQNLATTDSTNFYVLGPGPLAIAIGTTCSVQAAPPSARILRGQLLGLTRRPWLSEDERSMQTQACLSADGGPLPESAAAPISLPRLHLFSTDVMTKAYSKLHLWVINIVAPPERAVLRMMIKGQVPRPKKTNLSRSIPLLLVIYSERIQLPSAKSFPEAFAKPPSLPRFASFCNFSHHPDLSPAVSPVEAFVFPPVLAASEAEMARNKVVTVACSGLGKPKELKAAQATKEDRKASEERPLRWVLERKDLGRQSGGSERTPQAKRAAGPKAQKPGRCRGAVCHRVKSLCGRRAGGLHQGGQLLFCPSIAPVHPWRAGASTTLSHSPHPNPGGAVRVSCLWAGGKTLGDEPGEGIMASRAEEQHRQRPGESLRSVGEEMAEDEPEKERLGQVLEDMSGCFGLYPAVGEPWQACGLDRCFRKPTSSCWATPLAGSCSKAGNTSMSRKRPPQGSRPSGETRNTDGQYNTMSGSSKCSEEQARLDAGSDGRGFVRGGRGKPVSEDTRMERRSSTWQSHGRPLGQRELGRAQQGRSVLMCPGNRPEAVVWLECCRCQGNCRRCLLSVMEYNQISRRNCHDLTKKATYIYMKAAYLSMFGKEDHKPFGDDEVELFRAVPGLKLKIAGKSLPTEKFAIRKSRRYFSSNPISLPVPALEMMYIWNGYAVIGKQPKLTDGILEIITKAEEMLEKGPENEYSVDDECLVKLLKGLCLKYLGRVQEAEENFRSISANEKKIKYDHYLIPNALLELALLLMEQDRNEEAIKLLESAKQNYKNYSMESRTHFRIQAATLQAKSSLENSSRSMVSSVSL

SEQ ID NO: 863747 - protein, 1139 aa, Homo sapiens; identical to SEQ ID NO: 863746

SEQ ID NO: 863748 - protein, 571 aa, Homo sapiens
GLGEGGGLGEGGGKKGLWDLVAGLHPLGGQQSPMGQKGHKDSLYPCGGTPESSLHEALDQCMTALDLFLTNQFSEALSYLKPRTKESMYHSLTYATILEMQAMMTFDPQDILLAGNMMKEAQMLCQRHRRKSSVTDSFSSLVNRPTLGQFTEEEIHAEVCYAECLLQRAALTFLQDENMVSFIKGGIKVRNSYQTYKELDSLVQSSQYCKGENHPHFEGGVKLGVGAFNLTLSMLPTRILRLLEFVGFSGNKDYGLLQLEEGASGHSFRSVLCVMLLLCYHTFLTFVLGTGNVNIEEAEKLLKPYLNRYPKGAIFLFFAGRIEVIKGNIDAAIRRFEECCEAQQHWKQFHHMCYWELMWCFTYKGQWKMSYFYADLLSKENCWSKATYIYMKAAYLSMFGKEDHKPFGDDEVELFRAVPGLKLKIAGKSLPTEKFAIRKSRRYFSSNPISLPVPALEMMYIWNGYAVIGKQPKLTDGILEIITKAEEMLEKGPENEYSVDDECLVKLLKGLCLKYLGRVQEAEENFRSISANEKKIKYDHYLIPNALLELALLLMEQDRNEEAIKLLESAK

SEQ ID NO: 863749 - protein, 131 aa, Homo sapiens
MNKSVFFPHIPISENEYSVDDECLVKLLKGLCLKYLGRVQEAEENFRSISANEKKIKYDHYLIPNALLELALLLMEQDRNEEAIKLLESAKQNYKNYSMESRTHFRIQAATLQAKSSLENSSRSMVSSVSL

SEQ ID NO: 863750 - protein, 611 aa, Homo sapiens
GLGEGGGLGEGGGKKGLWDLVAGLHPLGGQQSPMGQKGHKDSLYPCGGTPESSLHEALDQCMTALDLFLTNQFSEALSYLKPRTKESMYHSLTYATILEMQAMMTFDPQDILLAGNMMKEAQMLCQRHRRKSSVTDSFSSLVNRPTLGQFTEEEIHAEVCYAECLLQRAALTFLQDENMVSFIKGGIKVRNSYQTYKELDSLVQSSQYCKGENHPHFEGGVKLGVGAFNLTLSMLPTRILRLLEFVGFSGNKDYGLLQLEEGASGHSFRSVLCVMLLLCYHTFLTFVLGTGNVNIEEAEKLLKPYLNRYPKGAIFLFFAGRIEVIKGNIDAAIRRFEECCEAQQHWKQFHHMCYWELMWCFTYKGQWKMSYFYADLLSKENCWSKATYIYMKAAYLSMFGKEDHKPFGDDEVELFRAVPGLKLKIAGKSLPTEKFAIRKSRRYFSSNPISLPVPALEMMYIWNGYAVIGKQPKLTDGILEIITKAEEMLEKGPENEYSVDDECLVKLLKGLCLKYLGRVQEAEENFRSISANEKKIKYDHYLIPNALLELALLLMEQDRNEEAIKLLESAKQNYKNYSMESRTHFRIQAATLQAKSSLENSSRSMVSSVSL

SEQ ID NO: 863751 - protein, 160 aa, Homo sapiens
MWWTASSAGLTSTPRNGWLHQCAFNDFNPPCKEQEDGSPQGLPAGTPESSLHEALDQCMTALDLFLTNQFSEALSYLKPRTKESMYHSLTYATILEMQAMMTFDPQDILLAGNMMKEAQMLCQRHRRKSSVTDSFSSLVNRPTLGQFTEGVASRTSFQPC

SEQ ID NO: 863752 - protein, 466 aa, Homo sapiens
VETPPQGSVHSGHLGSVVGDPHTGTGNAGERGPRGKGARVLALDSGGMDSSPSLPLIRTPESSLHEALDQCMTALDLFLTNQFSEALSYLKPRTKESMYHSLTYATILEMQAMMTFDPQDILLAGNMMKEAQMLCQRHRRKSSVTDSFSSLVNRPTLGQFTEEEIHAEVCYAECLLQRAALTFLQGSSQEGQSGPEPCMIPLTPAAAHLGQAVSIFSSCDENMVSFIKGGIKVRNSYQTYKELDSLVQSSQYCKGENHPHFEGGVKLGVGAFNLTLSMLPTRILRLLEFVGFSGNKDYGLLQLEEGASGHSFRSVLCVMLLLCYHTFLTFVLGTGNVNIEEAEKLLKPYLNRYPKGAIFLFFAGRIEVIKGNIDAVSDGGPGRGWGSLGVSQTSRKSGTCDILRDRIDWGRGGGQERTNQRAGAGEALLAEQPGKTREEEAFVVPGILTGRYRTAALQWREVEGGA

SEQ ID NO: 863753 - protein, 1088 aa, Homo sapiens
MEVSSVALPGDQAEGEFSGSGAGGAGEGSRLLLSSQHVWHLSCPPHHTQGGEVIISIGHMRATDAKLRTVTFPPTWLLVTDTGFEDSPVGLRGLCFSLAPRVLLRSRGLPWAHPAVEGASSGPAPMAPTPPPHHLLLPKRTKPQGTFFLFLETGSCYVGQAVLNSWAQAIFPPLPPKVLGFWALGNLFELKVTSKPSCRVRWVAGANHMGKERPGGGTQLLYRGTEGGPGLPAVRKSGSVPRPLCGFGGGQSLSLCNTLLMRTSVKNGGCNPLSSGAPPISNLQNLATTDSTNFYVLGPGPLAIAIGTTCSVQAAPPSARILRGQLLGLTRRPWLSEDERSMQTQACLSADGGPLPESAAAPISLPRLHLFSTDVMTKAYSKLHLWVINIVAPPERAVLRMMIKGQVPRPKKTNLSRSIPLLLVIYSERIQLPSAKSFPEAFAKPPSLPRFASFCNFSHHPDLSPAVSPVEAFVFPPVLAASEAEMARNKVVTVACSGLGKPKELKAAQATKEDRKASEERPLRWVLERKDLGRQSGGSERTPQAKRAAGPKAQKPGRCRGAVCHRVKSLCGRRAGGLHQGGQLLFCPSIAPVHPWRAGASTTLSHSPHPNPGGAVRVSCLWAGGKTLGDEPGEGIMASRAEEQHRQRPGESLRSVGEEMAEDEPEKERLGQVLEDMSGCFGLYPAVGEPWQACGLDRCFRKPTSSCWATPLAGSCSKAGNTSMSRKRPPQGSRPSGETRNTDGQYNTMSGSSKCSEEQARLDAGSDGRGFVRGGRGKPVSEDTRMERRSSTWQSHGRPLGQRELGRAQQAGVCLMCPGNRPEAVVWLECCRCQGNCRRCLLSVMEYNQISRRNCHDLDLKEATYIYMKAAYLSMFGKEDHKPFGDDEVELFRAVPGLKLKIAGKSLPTEKFAIRKSRRYFSSNPISLPVPALEMMYIWNGYAVIGKQPKLTDGILEIITKAEEMLEKGPENEYSVDDECLVKLLKGLCLKYLGRVQEAEENFRSISANEKKIKYDHYLIPNALLELALLLMEQDRNEEAIKLLESAKQNYKNYSMESRTHFRIQAATLQAKSSLENSSRSMVSSVSL

SEQ ID NO: 863754 - protein, 1139 aa, Homo sapiens
MADIANQSSAMSLAVTLDTFPAKLQAAVRTDPHWHLLGDLLICIWSLPLLCMEVSSVALPGDQAEGEFSGSGAGGAGEGSRLLLSSQHVWHLSCPPHHTQGGEVIISIGHMRATDAKLRTVTFPPTWLLVTDTGFEDSPVGLRGLCFSLAPRVLLRSRGLPWAHPAVEGASSGPAPMAPTPPPHHLLLPKRTKPQGTFFLFLETGSCYVGQAVLNSWAQAIFPPLPPKVLGFWALGNLFELKVTSKPSCRVRWVAGANHMGKERPGGGTQLLYRGTEGGPGLPAVRKSGSVPRPLCGFGGGQSLSLCNTLLMRTSVKNGGCNPLSSGAPPISNLQNLATTDSTNFYVLGPGPLAIAIGTTCSVQAAPPSARILRGQLLGLTRRPWLSEDERSMQTQACLSADGGPLPESAAAPISLPRLHLFSTDVMTKAQSKLHLWVINIVAPPERAVLRMMIKGQVPRPKKTNLSRSIPLLLVIYSERIQLPSAKSFPEAFAKPPSLPRFASFCNFSHHPDLSPAVSPVEAFVFPPVLAASEAEMARNKVVTVACSGLGKPKELKAAQATKEDRKASEERPLRWVLERKDLGRQSGGSERTPQAKRAAGPKAQKPGRCRGAVCHRVKSLCGRRAGGLHQGGQLLFCPSIAPVHPWRAGASTTLSHSPHPNPGGAVRVSCLWAGGKTLGDEPGEGIMASRAEEQHRQRPGESLRSVGEEMAEDEPEKERLGQVLEDMSGCFGLYPAVGEPWQACGLDRCFRKPTSSCWATPLAGSCSKAGNTSMSRKRPPQGSRPSGETRNTDGQYNTMSGSSKCSEEQARLDAGSDGRGFVRGGRGKPVSEDTRMERRSSTWQSHGRPLGQRELGRAQQGRSVLMCPGNRPEAVVWLECCRCQGNCRRCLLSVMEYNQISRRNCHDLDLKKATYIYMKAAYLSMFGKEDHKPFGDDEVELFRAVPGLKLKIAGKSLPTEKFAIRKSRRYFSSNPISLPVPALEMMYIWNGYAVIGKQPKLTDGILEIITKAEEMLEKGPENEYSVDDECLVKLLKGLCLKYLGRVQEAEENFRSISANEKKIKYDHYLIPNALLELALLLMEQDRNEEAIKLLESAKQNYKNYSMESRTHFRIQAATLQAKSSLENSSRSMVSSVSL

SEQ ID NO: 863755 - protein, 221 aa, Homo sapiens
MKAAYLSMFGKEDHKPFGDDEVELFRAVPGLKLKIAGKSLPTEKFAIRKSRRYFSSNPISLPVPALEMMYIWNGYAVIGKQPKLTDGILEIITKAEEMLEKGPENEYSVDDECLVKLLKGLCLKYLGRVQEAEENFRSISANEKKIKYDHYLIPNALLELALLLMEQDRNEEAIKLLESAKQNYKNYSMESRTHFRIQAATLQAKSSLENSSRSMVSSVSL

SEQ ID NO: 863756 - protein, 378 aa, Homo sapiens
MLPTRILRLLEFVGFSGNKDYGLLQLEEGASGHSFRSVLCVMLLLCYHTFLTFVLGTGNVNIEEAEKLLKPYLNRYPKGAIFLFFAGRIEVIKGNIDAAIRRFEECCEAQQHWKQFHHMCYWELMWCFTYKGQWKMSYFYADLLSKENCWSKATYIYMKAAYLSMFGKEDHKPFGDDEVELFRAVPGLKLKIAGKSLPTEKFAIRKSRRYFSSNPISLPVPALEMMYIWNGYAVIGKQPKLTDGILEIITKAEEMLEKGPENEYSVDDECLVKLLKGLCLKYLGRVQEAEENFRSISANEKKIKYDHYLIPNALLELALLLMEQDRNEEAIKLLESAKQNYKNYSMESRTHFRIQAATLQAKSSLENSSRSMVSSVSL

SEQ ID NO: 863757 - protein, 408 aa, Homo sapiens
GLGEGGGLGEGGGKKGLWDLVAGLHPLGGQQSPMGQKGHKDSLYPCGGTPESSLHEALDQCMTALDLFLTNQFSEALSYLKPRTKESMYHSLTYATILEMQAMMTFDPQDILLAGNMMKEAQMLCQRHRRKSSVTDSFSSLVNRPTLGQFTEEEIHAEVCYAECLLQRAALTFLQDENMVSFIKGGIKVRNSYQTYKELDSLVQSSQYCKGENHPHFEGGVKLGVGAFNLTLSMLPTRILRLLEFVGFSGNKDYGLLQLEEGASGHSFRSVLCVMLLLCYHTFLTFVLGTGNVNIEEAEKLLKPYLNRYPKGAIFLFFAGRIEVIKGNIDAVSDGGPGRGWGSLGVSQTSRKSGTCDILRDRIDWGRGGGPRENQPESRGRRGPSGRAAWEDKGGGGICGAWDFDWEI

SEQ ID NO: 863758 - protein, 457 aa, Homo sapiens
MTTDEGAKNNEESPTATVAEQGEDITSKKDRGVLKIVKRVGNGEETPMIGDKVYVHYKGKLSNGKKFDSSHDRNEPFVFSLGKGQVIKAWDIGVATMKKGEICHLLCKPEYAYGSAGSLPKIPSNATLFFEIELLDFKGEDLFEDGGIIRRTKRKGEGYSNPNEGATVEIHLEGRCGGRMFDCRDVAFTVGEGEDHDIPIGIDKALEKMQREEQCILYLGPRYGFGEAGKPKFGIEPNAELIYEVTLKSFEKAKESWEMDTKEKLEQAAIVKEKGTVYFKGGKYMQAVIQYGKIVSWLEMEYGLSEKESKASESFLLAAFLNLAMCYLKLREYTKAVECCDKALGLDSANEKGLYRRGEAQLLMNEFESAKGDFEKVLEVNPQNKAARLQISMCQKKAKEHNERDRRIYANMFKKFAEQDAKEEANKAMGKKTSEGVTNEKGTDSQAMEEEKPEGHV

SEQ ID NO: 863759 - protein, 457 aa, Homo sapiens; identical to SEQ ID NO: 863758

SEQ ID NO: 863760 - protein, 457 aa, Homo sapiens; identical to SEQ ID NO: 863758

SEQ ID NO: 863761 - protein, 457 aa, Homo sapiens; identical to SEQ ID NO: 863758

SEQ ID NO: 863762 - protein, 173 aa, Homo sapiens [sequence omitted]

SEQ ID NO: 863763 - protein, 168 aa, Homo sapiens
MYGKIVSWLEMEYGLSEKESKASESFLLAAFLNLAMCYLKLREYTKAVECCDKALGLDSANEKGLYRRGEAQLLMNEFESAKGDFEKVLEVNPQNKAARLQISMCQKKAKEHNERDRRIYANMFKKFAEQDAKEEANKAMGKKTSEGVTNEKGTDSQAMEEEKPEGHV

SEQ ID NO: 863764 - protein, 457 aa, Homo sapiens; identical to SEQ ID NO: 863758

SEQ ID NO: 863765 - protein, 457 aa, Homo sapiens; identical to SEQ ID NO: 863758

SEQ ID NO: 863766 - protein, 443 aa, Homo sapiens
MTTDEGAKNNEESPTATVAEQGEDITSKKDRGVLKIVKRVGNGEETPMIGDKVYVHYKGKLSNGKKFDSSHDRNEPFVFSLGKGQVIKAWDIGVATMKKGEICHLLCKPEYAYGSAGSLPKIPSNATLFFEIELLDFKGEDLFEDGGIIRRTKRKGEGYSNPNEGATVEIHLEGRCGGRMFDCRDVAFTVGEGEDHDIPIGIDKALEKMQREEQCILYLGPRYGFGEAGKPKFGIEPNAELIYEVTLKSFEKAKESWEMDTKEKLEQAAIVKEKGTVYFKGGKYMQAVIQYGKIVSWLEMEYGLSEKESKASESFLLAAFLNLAMCYLKLREYTKAVECCDKALGLDSANEKGLYRRGEAQLLMNEFESAKGDFEKVLEVNPQNKAARLQISMCQKKAKEHNERDRRIYANMFKKFAEQDAKRVDLLLFAKGESGTLEGSLLW

SEQ ID NO: 863767 - protein, 218 aa, Homo sapiens
MTTDEGAKNNEESPTATVAEQGEDITSKKDRGVLKIVKRVGNGEETPMIGDKVYVHYKGKLSNGKKFDSSHDRNEPFVFSLGKGQVIKAWDIGVATMKKGEICHLLCKPEYAYGSAGSLPKIPSNATLFFEIELLDFKGEDLFEDGGIIRRTKRKGEGYSNPNEGATVEIHLEGRCGGRMFDCRDVAFPPIQAFLIGTVQSKGLVTAFNSFGVFSKLQ

SEQ ID NO: 863768 - protein, 194 aa, Homo sapiens
VYRMPYCLKAKGKWLDVGVHMGSLAVTDPLGTTSVSFSPIIGLPDTCGGIENTYGSAGSLPKIPSNATLFFEIELLDFKGEDLFEDGGIIRRTKRKGEGYSNPNEGATVEIHLEGRCGGRMFDCRDVAFLINTGVYRCHLLEKKQQMAREYREKIERELRDICNDVLSLLEKFLIPNASQAESKVFYLKMTGDT

SEQ ID NO: 863769 - protein, 457 aa, Homo sapiens; identical to SEQ ID NO: 863758

SEQ ID NO: 863770 - protein, 457 aa, Homo sapiens; identical to SEQ ID NO: 863758

SEQ ID NO: 863771 - protein, 387 aa, Homo sapiens
MTTDEGAKNNEESPTATVAEQGEDITSKKDRGVLKIVKRVGNGEETPMIGDKVYVHYKGKLSNGKKFDSSHDRNEPFVFSLGKGQVIKAWDIGVATMKKGEICHLLCKPEYAYGSAGSLPKIPSNATLFFEIELLDFKGEDLFEDGGIIRRTKRKGEGYSNPNEGATVEIHLEGRCGGRMFDCRDVAFTVGEGEDHDIPIGIDKALEKMQREEQCILYLGPRYGFGEAGKPKFGIEPNAELIYEVTLKSFEKAKESWEMDTKEKLEQAAIVKEKGTVYFKGGKYMQAVIQYGKIVSWLEMEYGLSEKESKASESFLLAAFLNLAMCYLKLREYTKAVECCDKALGCLKLVHEQLGFTPPIQAFLIGTVQSKGLVTAFNSFGVFSKLQ

SEQ ID NO: 863772 - protein, 105 aa, Homo sapiens
NKLLPLFATKSYIPHAKTFRGVPKGEIPRCRTAPTLEDLTFSLGRAEARQRQGLRSDNPQPCVCKEPPRGRQPRCRRLDSPTPREPGVGCRDRTLLRGGSLLKRQ

SEQ ID NO: 863773 - protein, 222 aa, Homo sapiens
MGLFGKTQEKPPKELVNEWSLKIRKEMRVVDRQIRDIQREEEKVKRSVKDAAKKGQKDVCIVLAKEMIRSRKAVSKLYASKAHMNSVLMGMKNQLAVLRVAGSLQKSTEVMKAMQSLVKIPEIQATMRELSKEMMKAGIIEEMLEDTFESMDDQEEMEEEAEMEIDRILFEITAGALGKAPSKVTDALPEPEPPGAMAASEDEEEEEEALEAMQSRLATLRS

SEQ ID NO: 863774 - protein, 222 aa, Homo sapiens; identical to SEQ ID NO: 863773

SEQ ID NO: 863775 - protein, 142 aa, Homo sapiens
RGTITSVLFCREPATRKTASWFIIPMSTEVMKAMQSLVKIPEIQATMRELSKEMMKAGIIEEMLEDTFESMDDQEEMEEEAEMEIDRILFEITAGALGKAPSKVTDALPEPEPPGAMAASEDEEEEEEALEAMQSRLATLRS

SEQ ID NO: 863776 - protein, 222 aa, Homo sapiens; identical to SEQ ID NO: 863773

SEQ ID NO: 863777 - protein, 222 aa, Homo sapiens; identical to SEQ ID NO: 863773

SEQ ID NO: 863778 - protein, 222 aa, Homo sapiens; identical to SEQ ID NO: 863773

SEQ ID NO: 863779 - protein, 164 aa, Homo sapiens
MGLFGKTQEKPPKELVNEWSLKIRKEMRVVDRQIRDIQREEEKVKRSVKDAAKKGQKDVCIVLAKEMIRSRKAVSKLYASKAHMNSVLMGMKNQLAVLRVAGSLQKSTEVMKAMQSLVKIPEIQATMRELSKEMMKAGIIEEMLEDTFESMDDQEEMVVLTTEV

SEQ ID NO: 863780 - protein, 125 aa, Homo sapiens
MGLFGKTQEKPPKELVNEWSLKIRKEMRVVDRQIRDIQREEEKVKRSVKDAAKKGQKDVCIVLAKEMIRSRKAVSKLYASKAHMNSVLMGMKNQLETGFYHVAQDGLELLSSSDPLPQSSKVLGL

SEQ ID NO: 863781 - protein, 117 aa, Homo sapiens
MGLFGKTQEKPPKELAGVQWRDLSSLQPPPSSHLPWPPKVLRLQPLPGRHPVWEVRSVSAQPPIVWEVRSASARPPRLGGEERLCPAAPSGRRGAPLPGHPAWEARSTSARPPRLGG

SEQ ID NO: 863782 - protein, 167 aa, Homo sapiens
ELVAQVVCGAGTERKADGYPWLETKPERLSGHEDKGNESCDRQIRDIQREEEKVKRSVKDAAKKGQKDVCIVLAKEMIRSRKAVSKLYASKAHMNSVLMGMKNQLAVLRVAGSLQKSTEVMKAMQSLVKIPEIQATMRELSKEMMKAGIIEEMLRGHEVTGTELNCI

SEQ ID NO: 863783 - protein, 231 aa, Homo sapiens
GAGGRVFRSRLWDARAPGAMALEQVNEWSLKIRKEMRVVDRQIRDIQREEEKVKRSVKDAAKKGQKDVCIVLAKEMIRSRKAVSKLYASKAHMNSVLMGMKNQLAVLRVAGSLQKSTEVMKAMQSLVKIPEIQATMRELSKEMMKAGIIEEMLEDTFESMDDQEEMEEEAEMEIDRILFEITAGALGKAPSKVTDALPEPEPPGAMAASEDEEEEEEALEAMQSRLATLRS

SEQ ID NO: 863784 - protein, 214 aa, Homo sapiens
MLARAEQVNEWSLKIRKEMRVVDRQIRDIQREEEKVKRSVKDAAKKGQKDVCIVLAKEMIRSRKAVSKLYASKAHMNSVLMGMKNQLAVLRVAGSLQKSTEVMKAMQSLVKIPEIQATMRELSKEMMKAGIIEEMLEDTFESMDDQEEMEEEAEMEIDRILFEITAGALGKAPSKVTDALPEPEPPGAMAASEDEEEEEEALEAMQSRLATLRS

SEQ ID NO: 863785 - protein, 246 aa, Homo sapiens
EALCQTARALNDGQYYNGPAQAAARDLPGRGELKAGRGKTGSVRHGAVWKDPGEAAQRTDIQREEEKVKRSVKDAAKKGQKDVCIVLAKEMIRSRKAVSKLYASKAHMNSVLMGMKNQLAVLRVAGSLQKSTEVMKAMQSLVKIPEIQATMRELSKEMMKAGIIEEMLEDTFESMDDQEEMEEEAEMEIDRILFEITAGALGKAPSKVTDALPEPEPPGAMAASEDEEEEEEALEAMQSRLATLRS

SEQ ID NO: 863786 - protein, 186 aa, Homo sapiens
EALCQTARALNDGQYYNGPAQAAARDLPGRGELKAGRGKTGSVRHGAVWKDPGEAAQRTAVLRVAGSLQKSTEVMKAMQSLVKIPEIQATMRELSKEMMKAGIIEEMLEDTFESMDDQEEMEEEAEMEIDRILFEITAGALGKAPSKVTDALPEPEPPGAMAASEDEEEEEEALEAMQSRLATLRS

SEQ ID NO: 863787 - protein, 112 aa, Homo sapiens
MKAMQSLVKIPEIQATMRELSKEMMKAGIIEEMLEDTFESMDDQEEMEEEAEMEIDRILFEITAGALGKAPSKVTDALPEPEPPGAMAASEDEEEEEEALEAMQSRLATLRS

SEQ ID NO: 863788 - protein, 105 aa, Homo sapiens
RLGRGGVNRTRELSKEMMKAGIIEEMLEDTFESMDDQEEMEEEAEMEIDRILFEITAGALGKAPSKVTDALPEPEPPGAMAASEDEEEEEEALEAMQSRLATLRS

SEQ ID NO: 863789 - protein, 222 aa, Homo sapiens; identical to SEQ ID NO: 863773

SEQ ID NO: 863790 - protein, 227 aa, Homo sapiens
MGLFGKTQEKPPKELVNEWSLKIRKEMRVVDRQIRDIQREEEKVKRSVKDAAKKGQKDVCIVLAKEMIRSRKAVSKLYASKAHMNSVLMGMKNQLAVLRVAGSLQKSTEVMKAMQSLVKIPEIQATMRELSKEMMKAGIIEEMLEDTFESMDDQEEMEEEAEMEIDRILFEITAGALGKAPSKVTDALPEPEPPGAMAASEDEEEEEEALEAMQSRLASRVGVLPWV

SEQ ID NO: 863791 - protein, 157 aa, Homo sapiens
MGLFGKTQEKPPKELVNEWSLKIRKEMRVVDRQIRDIQREEEKVKRSVKDAAKKGQKDVCIVLAKEMIRSRKAVSKLYASKAHMNSVLMGMKNQLAVLRVAGSLQKSTEVMKAMQSLVKIPEIQATMRELSKEMMKAGIIEEMLRGHEVTGTELNCI

SEQ ID NO: 863792 - protein, 63 aa, Homo sapiens
GHRQQFSVCAYSTCCLCWVSEHRLPLPLNQQKGPPLRTSPAAHSPPNFAGIASGRLFRRPNEH

SEQ ID NO: 863793 - protein, 291 aa, Homo sapiens
MASPPESDGFSDVRKVGYLRKPKSMHKRFFVLRAASEAGGPARLEYYENEKKWRHKSSAPKRSIPLESCFNINKRADSKNKHLVALYTRDEHFAIAADSEAEQDSWYQALLQLHNRAKGHHDGAAALGAGGGGGSCSGSSGLGEAGEDLSYGDVPPGPAFKEVWQVILKPKGLGQTKNLIGIYRLCLTSKTISFVKLNSEAAAVVLQLMNIRRCGHSENFFFIEVGRSAVTGPGEFWMQVDDSVVAQNMHETILEAMRAMSDEFRPRSKSQSSSNCSNPISVPLANAHTSC

SEQ ID NO: 863794 - protein, 1242 aa, Homo sapiens
MASPPESDGFSDVRKVGYLRKPKSMHKRFFVLRAASEAGGPARLEYYENEKKWRHKSSAPKRSIPLESCFNINKRADSKNKHLVALYTRDEHFAIAADSEAEQDSWYQALLQLHNRAKGHHDGAAALGAGGGGGSCSGSSGLGEAGEDLSYGDVPPGPAFKEVWQVILKPKGLGQTKNLIGIYRLCLTSKTISFVKLNSEAAAVVLQLMNIRRCGHSENFFFIEVGRSAVTGPGEFWMQVDDSVVAQNMHETILEAMRAMSDEFRPRSKSQSSSNCSNPISVPLRRHHLNNPPPSQVGLTRRSRTESITATSPASMVGGKPGSFRVRASSDGEGTMSRPASVDGSPVSPSTNRTHAHRHRGSARLHPPLNHSRSIPMPASRCSPSATSPVSLSSSSTSGHGSTSDCLFPRRSSASVSGSPSDGGFISSDEYGSSPCDFRSSFRSVTPDSLGHTPPARGEEELSNYICMGGKGPSTLTAPNGHYILSRGGNGHRCTPGTGLGTSPALAGDEAASAADLDNRFRKRTHSAGTSPTITHQKTPSQSSVASIEEYTEMMPAYPPGGGSGGRLPGHRHSAFVPTRSYPEEGLEMHPLERRGGHHRPDSSTLHTDDGYMPMSPGVAPVPSGRKGSGDYMPMSPKSVSAPQQIINPIRRHPQRVDPNGYMMMSPSGGCSPDIGGGPSSSSSSSNAVPSGTSYGKLWTNGVGGHHSHVLPHPKPPVESSGGKLLPCTGDYMNMSPVGDSNTSSPSDCYYGPEDPQHKPVLSYYSLPRSFKHTQRPGEPEEGARHQHLRLSTSSGRLLYAATADDSSSSTSSDSLGGGYCGARLEPSLPHPHHQVLQPHLPRKVDTAAQTNSRLARPTRLSLGDPKASTLPRAREQQQQQQPLLHPPEPKSPGEYVNIEFGSDQSGYLSGPVAFHSSPSVRCPSQLQPAPREEETGTEEYMKMDLGPGRRAAWQESTGVEMGRLGPAPPGAASICRPTRAVPSSRGDYMTMQMSCPRQSYVDTSPAAPVSYADMRTGIAAEEVSLPRATMAAASSSSAASASPTGPQGAAELAAHSSLLGGPQGPGGMSAFTRVNLSPNRNQSAKVIRADPQGCRRRHSSETFSSTPSATRVGNTVPFGAGAAVGGGGGSSSSSEDVKRHSSASFENVWLRPGELGGAPKEPAKLCGAAGGLENGLNYIDLDLVKDFKQCPQECTPEPQPPPPPPPHQPLGSGESSSTRRSSEDLSAYASISFQKQPEDRQ

SEQ ID NO: 863795 - protein, 1242 aa, Homo sapiens; identical to SEQ ID NO: 863794

SEQ ID NO: 863796 - protein, 1242 aa, Homo sapiens; identical to SEQ ID NO: 863794

SEQ ID NO: 863797 - protein, 1242 aa, Homo sapiens; identical to SEQ ID NO: 863794

SEQ ID NO: 863798 - protein, 1242 aa, Homo sapiens; identical to SEQ ID NO: 863794

SEQ ID NO: 863799 - protein, 1242 aa, Homo sapiens; identical to SEQ ID NO: 863794

SEQ ID NO: 863800 - protein, 540 aa, Homo sapiens
MALARPVRLFSLVTRLLLAPRRGLTVRSPDEPLPVVRIPVALQRQLEQRQSRRRNLPRPVLVRPGPLLVSARRPELNQPARLTLGRWERAPLASQGWKSRRARRDHFSIERAQQEAPAVRKLSSKGSFADLGLEPRVLHALQEAAPEVVQPTTVQSSTIPSLLRGRHVVCAAETGSGKTLSYLLPLLQRLLGQPSLDSLPIPAPRGLVLVPSRELAQQVRAVAQPLGRSLGLLVRDLEGGHGMRRIRLQLSRQPSADVLVATPGALWKALKSRLISLEQLSFLVLDEADTLLDESFLELVDYILEKSHIAEGPADLEDPFNPKAQLVLVGATFPEGVGQLLNKVASPDAVTTITSSKLHCIMPHVKQTFLRLKGADKVAELVHILKHRDRAERTGPSGTVLVFCNSSSTVNWLGYILDDHKIQHLRLQGQMPALMRVGIFQSFQKSSRDILLCTDIASRGLDSTGVELVVNYDFPPTLQDYIHRAGRVGRVGSEVPGTVISFVTHPWDVSLVQKIELAARRRRSLPGLASSVKEPLPQAT

SEQ ID NO: 863801 - protein, 540 aa, Homo sapiens; identical to SEQ ID NO: 863800

SEQ ID NO: 863802 - protein, 552 aa, Homo sapiens
TCVQPGLLRGWVAPLARPVRLFSLVTRLLLAPRRGLTVRSPDEPLPVVRIPVALQRQLEQRQSRRRNLPRPVLVRPGPLLVSARRPELNQPARLTLGRWERAPLASQGWKSRRARRDHFSIERAQQEAPAVRKLSSKGSFADLGLEPRVLHALQEAAPEVVQPTTVQSSTIPSLLRGRHVVCAAETGSGKTLSYLLPLLQRLLGQPSLDSLPIPAPRGLVLVPSRELAQQVRAVAQPLGRSLGLLVRDLEGGHGMRRIRLQLSRQPSADVLVATPGALWKALKSRLISLEQLSFLVLDEADTLLDESFLELVDYILEKSHIAEGPADLEDPFNPKAQLVLVGATFPEGVGQLLNKVASPDAVTTITSSKLHCIMPHVKQTFLRLKGADKVAELVHILKHRDRAERTGPSGTVLVFCNSSSTVNWLGYILDDHKIQHLRLQGQMPALMRVGIFQSFQKSSRDILLCTDIASRGLDSTGVELVVNYDFPPTLQDYIHRAGRVGRVGSEVPGTVISFVTHPWDVSLVQKIELAARRRRSLPGLASSVKEPLPQAT

SEQ ID NO: 863803 - protein, 540 aa, Homo sapiens; identical to SEQ ID NO: 863800

SEQ ID NO: 863804 - protein, 540 aa, Homo sapiens; identical to SEQ ID NO: 863800

SEQ ID NO: 863805 - protein, 480 aa, Homo sapiens
MALARPVRLFSLVTRLLLAPRRGLTVRSPDEPLPVVRIPVALQRQLEQRQSRRRNLPRPVLVRPGPLLVSARRPELNQPARLTLGRWERAPLASQGWKSRRARRDHFSIERAQQEAPAVRKLSSKGSFADLGLEPRVLHALQEAAPEVVQPTTVQSSTIPSLLRGRHVVCAAETGSGKTLSYLLPLLQRLLGQPSLDSLPIPAPRGLVLVPSRELAQQVRAVAQPLGRSLGLLVRDLEGGHGMRRIRLQLSRQPSADVLVATPGALWKALKSRLISLEQLSFLVLDEADTLLDESFLELVDYILEKSHIAEGPADLEDPFNPKAQLVLVGATFPEGVGQLLNKVASPDAVTTITSSKLHCIMPHVKQTFLRLKGADKVAELVHILKHRDRAERTGPSGTVLVFCNSSSTVNWLGYILDDHKIQHLRLQGQMPALMRVGIFQSFQKSSRDILLCTDIASRGLDSTGVELVVNYDFPPTLQD

SEQ ID NO: 863806 - protein, 328 aa, Homo sapiens
MALARPVRLFSLVTRLLLAPRRGLTVRSPDEPLPVVRIPVALQRQLEQRQSRRRNLPRPVLVRPGPLLVSARRPELNQPARLTLGRWERAPLASQGWKSRRARRDHFSIERAQQEAPAVRKLSSKGSFADLGLEPRVLHALQEAAPEVVQPTTVQSSTIPSLLRGRHVVCAAETGSGKTLSYLLPLLQRLLGQPSLDSLPIPAPRGLVLVPSRELAQQVRAVAQPLGRSLGLLVRDLEGGHGMRRIRLQLSRQPSADVLVATPGALWKALKSRLISLEQLSFLVLDEADTLLDESFLELVDYILEKSHIAEGPAELEKKLLSMAFCSL

SEQ ID NO: 863807 - protein, 295 aa, Homo sapiens
ARRRQHWRGPFLPPTPGSSLRSHSVPVNMAAPVVTAPGRALLRAGAGRLLRGGVQELLRPRHEGNAPDLACNFSLSQNRGTVIVERWWKVPLAGEGRKPRLHRRHRVYKLVEDTKHRPKENLELILTQSVENVGVRGDLVSVKKSLGRNRLLPQGLAVYASPENKKLFEEEKLLRQEGKLEKIQTKAGEATVKFLKSCRLEVGMKNNVKWELNPEIVARHFFKNLGVVVAPHTLKLPAEPITRWGEYWCEVTVNGLDTVRVPMSVVNFEKPKTKRYKYWLAQQAAKAMAPTSPQI

SEQ ID NO: 863808 - protein, 282 aa, Homo sapiens
RLGTRLGLNRPRTVNMAAPVVTAPGRALLRAGAGRLLRGGVQELLRPRHEGNAPDLACNFSLSQNRGTVIVERWWKVPLAGEGRKPRLHRRHRVYKLVEDTKHRPKENLELILTQSVENVGVRGDLVSVKKSLGRNRLLPQGLAVYASPENKKLFEEEKLLRQEGKLEKIQTKAGEATVKFLKSCRLEVGMKNNVKWELNPEIVARHFFKNLGVVVAPHTLKLPAEPITRWGEYWCEVTVNGLDTVRVPMSVVNFEKPKTKRYKYWLAQQAAKAMAPTSPQI

SEQ ID NO: 863809 - protein, 294 aa, Homo sapiens
ARRRQHWRGPFLPPTPGSSLRSHSVPVNMAAPVVTAPGRALLRAGAGRLLRGGVQELLRPRHEGNAPDLACNFSLSQNRGTVIVERWWKVPLAGEGRKPRLHRRHRVYKLVEDTKHRPKENLELILTQSVENVGVRGDLVSVKKSLGRNRLLPQGLAVYASPENKKLFEEEKLLRQEGKLEKIQTKAGEATVKFLKSCRLEVGMKNNVKWELNPEIVARHFFKNLGVVVAPHTLKLPAEPITRWGEYWCEVTQQSRIGSSGAEMCKHPDLTPSSDQIQNFREHLKTSDCTAYTC

SEQ ID NO: 863810 - protein, 301 aa, Homo sapiens
RLGTRLGLNRPRTVNMAAPVVTAPGRALLRAGAGRLLRGGVQELLRPRHEGNAPDLACNFSLSQNRGTVIVERWWKVPLAGEGRKPRLHRRHRVYKLVEDTKHRPKENLELILTQSVENVGVRGDLVSVKKSLGRNRLLPQGLAVYASPENKKLFEEEKLLRQEGKLEKIQTKAGEADCRPKSGRKGKCCGCPTKQTVKFLKSCRLEVGMKNNVKWELNPEIVARHFFKNLGVVVAPHTLKLPAEPITRWGEYWCEVTVNGLDTVRVPMSVVNFEKPKTKRYKYWLAQQAAKAMAPTSPQI

SEQ ID NO: 863811 - protein, 248 aa, Homo sapiens
RLGTRLGLNRPRTVNMAAPVVTAPGRALLRAGAGRLLRGGVQELLRPRHEGNAPDLACNFSLSQNRGTVIVERWWKVPLAGEGRKPRLHRRHRVYKLVEDTKHRPKENLELILTQSVENVGVRGDLVSVKKSLGRNRLLPQGLAVYASPENKKLFEEEKLLRQEGKLEKIQTKAGEALGVVVAPHTLKLPAEPITRWGEYWCEVTVNGLDTVRVPMSVVNFEKPKTKRYKYWLAQQAAKAMAPTSPQI

SEQ ID NO: 863812 - protein, 129 aa, Homo sapiens
CRLAVRYHGAVMLRHEVIVADVDETVKFLKSCRLEVGMKNNVKWELNPEIVARHFFKNLGVVVAPHTLKLPAEPITRWGEYWCEVTVNGLDTVRVPMSVVNFEKPKTKRYKYWLAQQAAKAMAPTSPQI

SEQ ID NO: 863813 - protein, 138 aa, Homo sapiens
RLGTRLGLNRPRTVNMAAPVVTAPGRALLRAGAGRLLRGGVQELLRPRHEGNAPDLACNFSLSQNRGTVIVERWWKVPLAGEGRKPRLHRRHRVYKLVEDTKHRPKENLELILTQSVESKARAEALPLRLVRFGISFF

SEQ ID NO: 863814 - protein, 172 aa, Homo sapiens
RLGTRLGLNRPRTVNMAAPVVTAPGRALLRAGAGRLLRGGVQELLRPRHEGNAPDLACNFSLSQNRGTVIVERWWKVPLAGEGRKPRLHRRHRVYKLVEDTKHRPKENLELILTQSVENVGVRGDLVSVKKSLGRNRLLPQGLAVYASPENKKLFEEEKLVSSKEGQRDLGR

SEQ ID NO: 863815 - protein, 282 aa, Homo sapiens; identical to SEQ ID NO: 863808

SEQ ID NO: 863816 - protein, 282 aa, Homo sapiens; identical to SEQ ID NO: 863808

SEQ ID NO: 863817 - protein, 235 aa, Homo sapiens
HLCAHPTCVLIPLCAPVCYGTVIVERWWKVPLAGEGRKPRLHRRHRVYKLVEDTKHRPKENLELILTQSVENVGVRGDLVSVKKSLGRNRLLPQGLAVYASPENKKLFEEEKLLRQEGKLEKIQTKAGEATVKFLKSCRLEVGMKNNVKWELNPEIVARHFFKNLGVVVAPHTLKLPAEPITRWGEYWCEVTVNGLDTVRVPMSVVNFEKPKTKRYKYWLAQQAAKAMAPTSPQI

SEQ ID NO: 863818 - protein, 136 aa, Homo sapiens
RLGTRLGLNRPRTVNMAAPVVTAPGRALLRAGAGRLLRGGVQELLRPRHEGNAPDLACNFSLSQNRGTVIVERWWKVPLAGEGRKPRLHRRHRVYKLVEDTKHRPKENLELILTQSVESKARAEALPLRLVCWSPG

SEQ ID NO: 863819 - protein, 136 aa, Homo sapiens; identical to SEQ ID NO: 863818

SEQ ID NO: 863820 - protein, 220 aa, Homo sapiens
RLGTRLGLNRPRTVNMAAPVVTAPGRALLRAGAGRLLRGGVQELLRPRHEGNAPDLACNFSLSQNRGTVIVERWWKVPLAGEGRKPRLHRRHRVYKLVEDTKHRPKENLELILTQSVENVGVRGDLVSVKKSLGRNRLLPQGLAVYASPENKKLFEEEKLLRQEGKLEKIQTKAGEAVNGLDTVRVPMSVVNFEKPKTKRYKYWLAQQAAKAMAPTSPQI

SEQ ID NO: 863821 - protein, 182 aa, Homo sapiens
RLGTRLGLNRPRTVNMAAPVVTAPGRALLRAGAGRLLRGGVQELLRPRHEGNAPDLACNFSLSQNRGTVIVERWWKVPLAGEGRKPRLHRRHRVYKLVEDTKHRPKENLELILTQSVENVGVRGDLVSVKKSLGRNRLLPQGLAVYASPENKKLFEEEKLLRQEGKLEKTQHSVLRGPSLLL

SEQ ID NO: 863822 - protein, 285 aa, Homo sapiens
PEPASANDPGAAPFHSGNLQRSLRKDTAGCFSQRRSRAMLVLRSALTRALASRTLAPQMCSSFATGPRQYDGIFYEFRSYYLKPSKMNEFLENFEKNAHLRTAHSELVGYWSVEFGGRMNTVFHIWKYDNFAHRTEVRKALAKDKEWQEQFLIPNLALIDKQESEITYLVPWCKLEKPPKEGVYELATFQMKPGGPALWGDAFKRAVHAHVNLGYTKLVGVFHTEYGALNRVHVLWWNESADSRAAGRHKSHEDPRVVAAVRESVNYLVSQQNMLLIPTSFSPLK

SEQ ID NO: 863823 - protein, 285 aa, Homo sapiens; identical to SEQ ID NO: 863822

SEQ ID NO: 863824 - protein, 235 aa, Homo sapiens
PEPASANDPGAAPFHSGNLQRSLRKDTAGCFSQRRSRAMLVLRSALTRALASRTLAPQMCSSFATGPRQYDGIFYEFRSYYLKPSKMNEFLENFEKNAHLRTAHSELVGYWSVEFGGRMNTVFHIWKYDNFAHRAEVRKALANCKEWQEQSIIPNLARIDKQETEITYLIPWSKLEKPPKEVHVLWWNESADSRAAGRHKSHEDPRVVAAVRESVNYLVSQQNMLLIPASFSPLK

SEQ ID NO: 863825 - protein, 227 aa, Homo sapiens
MCSSFATGPRQYDGIFYEFRSYYLKPSKMNEFLENFEKNAHLRTAHSELVGYWSVEFGGRMNTVFHIWKYDNFAHRTEVRKALAKDKEWQEQFLIPNLALIDKQESEITYLVPWCKLEKPPKEGVYELATFQMKPGGPALWGDAFKRAVHAHVNLGYTKLVGVFHTEYGALNRVHVLWWNESADSRAAGRHKSHEDPRVVAAVRESVNYLVSQQNMLLIPTSFSPLK

SEQ ID NO: 863826 - protein, 285 aa, Homo sapiens; identical to SEQ ID NO: 863822

SEQ ID NO: 863827 - protein, 265 aa, Homo sapiens
PEPASANDPGAAPFHSGNLQRSLRKDTAGCFSQRRSRAMLVLRSALTRALASRTLAPQMCSSFATGPRQYDGIFYEFRSYYLKPSKMNEFLENFEKNAHLRTAHSELVGYWSVEFGGRMNTVFHIWKYDNFAHRTEVRKALAKDKEWQEQFLIPNLALIDKQESEITYLVPWCKLEKPPKEGVYELATFQMKPGGPALWGDAFKRAVHAHVNLGYTKLVGVFHTEYGALNRVHVLWWNESADSRAAGRHKSHEDPRVVAAGKLFD

SEQ ID NO: 863828 - protein, 494 aa, Homo sapiens
SFAWAPDGLPERVRGQLPVWVTSGGRSRGTARDAQAGTMADGGSERADGRIVKMEVDYSATVDQRLPECAKLAKEGRLQEVIETLLSLEKQTRTASDMVSTSRILVAVVKMCYEAKEWDLLNENIMLLSKRRSQLKQAVAKMVQQCCTYVEEITDLPIKLRLIDTLRMVTEGKIYVEIERARLTKTLATIKEQNGDVKEAASILQELQVETYGSMEKKERVEFILEQMRLCLAVKDYIRTQIISKKINTKFFQEENTEKLKLKYYNLMIQLDQHEGSYLSICKHYRAIYDTPCIQAESEKWQQALKSVVLYVILAPFDNEQSDLVHRISGDKKLEEIPKYKDLLKLFTTMELMRWSTLVEDYGMELRKGSLESPATDVFGSTEEGEKRWKDLKNRVVEHNIRIMAKYYTRITMKRMAQLLDLSVDESEAFLSNLVVNKTIFAKVDRLAGIINFQRPKDPNNLLNDWSQKLNSLMSLVNKTTHLIAKEEMIHNLQ

SEQ ID NO: 863829 - protein, 140 aa, Homo sapiens
SFAWAPDGLPERVRGQLPVWVTSGGRSRGTARDAQAGTMADGGSERADGRIVKMEVDYSATVDQRLPECAKLAKEGRLQEVIETLLSLEKQTRTASDMVSTSRILVAVVKMCYEAKEWDLLNENIMLLSKRRSQLKQVSS

SEQ ID NO: 863830 - protein, 203 aa, Homo sapiens
GCSRGSLIGRRQALKSVVLYVILAPFDNEQSDLVHRISGDKKLEEIPKYKDLLKLFTTMELMRWSTLVEDYGMELRKGSLESPATDVFGSTEEGEKRWKDLKNRVVEHNIRIMAKYYTRITMKRMAQLLDLSVDESEAFLSNLVVNKTIFAKVDRLAGIINFQRPKDPNNLLNDWSQKLNSLMSLVNKTTHLIAKEEMIHNLQ

SEQ ID NO: 863831 - protein, 504 aa, Homo sapiens
SFAWAPDGLPERVRGQLPVWVTSGGRSRGTARDAQAGTMADGGSERADGRIVKMEVDYSATVDQRLPECAKLAKEGRLQEVIETLLSLEKQTRTASDMVSTSRILVAVVKMCYEAKEWDLLNENIMLLSKRRSQLKQAVAKMVQQCCTYVEEITDLPIKLRLIDTLRMVTEGKIYVEIERARLTKTLATIKEQNGDVKEAASILQELQVETYGSMEKKERVEFILEQMRLCLAVKDYIRTQIISKKINTKFFQEENTEKLKLKYYNLMIQLDQHEGSYLSICKHYRAIYDTPCIQAESEKWQQALKSVVLYVILAPFDNEQSDLVHRISGDKKLEEIPKYKFGILRCIHFQDLLKLFTTMELMRWSTLVEDYGMELRKGSLESPATDVFGSTEEGEKRWKDLKNRVVEHNIRIMAKYYTRITMKRMAQLLDLSVDESEAFLSNLVVNKTIFAKVDRLAGIINFQRPKDPNNLLNDWSQKLNSLMSLVNKTTHLIAKEEMIHNLQ

SEQ ID NO: 863832 - protein, 430 aa, Homo sapiens
SSVPPDISGQEGRLQEVIETLLSLEKQTRTASDMVSTSRILVAVVKMCYEAKEWDLLNENIMLLSKRRSQLKQAVAKMVQQCCTYVEEITDLPIKLRLIDTLRMVTEGKIYVEIERARLTKTLATIKEQNGDVKEAASILQELQVETYGSMEKKERVEFILEQMRLCLAVKDYIRTQIISKKINTKFFQEENTEKLKLKYYNLMIQLDQHEGSYLSICKHYRAIYDTPCIQAESEKWQQALKSVVLYVILAPFDNEQSDLVHRISGDKKLEEIPKYKDLLKLFTTMELMRWSTLVEDYGMELRKGSLESPATDVFGSTEEGEKRWKDLKNRVVEHNIRIMAKYYTRITMKRMAQLLDLSVDESEAFLSNLVVNKTIFAKVDRLAGIINFQRPKDPNNLLNDWSQKLNSLMSLVNKTTHLIAKEEMIHNLQ

SEQ ID NO: 863833 - protein, 42 aa, Homo sapiens
LQSEREQGQCQLRAQQELLQSLQREKQGLEQATTDLRLTILE

SEQ ID NO: 863834 - protein, 382 aa, Homo sapiens
MDGETAEEQGGPVPPPVAPGGPGLGGAPGGRREPKKYAVTDDYQLSKQVLGLGVNGKVLECFHRRTGQKCALKLLYDSPKARQEVDHHWQASGGPHIVCILDVYENMHHGKRCLLIIMECMEGGELFSRIQERGDQAFTEREAAEIMRDIGTAIQFLHSHNIAHRDVKPENLLYTSKEKDAVLKLTDFGFAKETTQNALQTPCYTPYYVAPEVLGPEKYDKSCDMWSLGVIMYILLCGFPPFYSNTGQAISPGMKRRIRLGQYGFPNPEWSEVSEDAKQLIRLLLKTDPTERLTITQFMNHPWINQSMVVPQTPLHTARVLQEDKDHWDEVKEEMTSALATMRVDYDQVKIKDLKTSNNRLLNKRRKKQAGSSSASQGCNNQ

SEQ ID NO: 863835 - protein, 382 aa, Homo sapiens; identical to SEQ ID NO: 863834

SEQ ID NO: 863836 - protein, 382 aa, Homo sapiens; identical to SEQ ID NO: 863834

SEQ ID NO: 863837 - protein, 382 aa, Homo sapiens; identical to SEQ ID NO: 863834

SEQ ID NO: 863838 - protein, 382 aa, Homo sapiens; identical to SEQ ID NO: 863834

SEQ ID NO: 863839 - protein, 355 aa, Homo sapiens
MDGETAEEQGGPVPPPVAPGGPGLGGAPGGRREPKKYAVTDDYQLSKQVLGLGVNGKVLECFHRRTGQKCALKLLYDSPKARQEVDHHWQASGGPHIVCILDVYENMHHGKRCLLIIMECMEGGELFSRIQERGDQAFTEREAAEIMRDIGTAIQFLHSHNIAHRDVKPENLLYTSKEKDAVLKLTDFGFAKETTQNALQTPCYTPYYVAPEVLGPEKYDKSCDMWSLGVIMYILLCGFPPFYSNTGQAISPGMKRRIRLGQYGFPNPEWSEVSEDAKQLIRLLLKTDPTERLTITQFMNHPWINEEMTSALATMRVDYDQVKIKDLKTSNNRLLNKRRKKQAGSSSASQGCNNQ

SEQ ID NO: 863840 - protein, 268 aa, Homo sapiens
VIADSRGYTRGEFSRIQERGDQAFTEREAAEIMRDIGTAIQFLHSHNIAHRDVKPENLLYTSKEKDAVLKLTDFGFAKETTQNALQTPCYTPYYVAPEVLGPEKYDKSCDMWSLGVIMYILLCGFPPFYSNTGQAISPGMKRRIRLGQYGFPNPEWSEVSEDAKQLIRLLLKTDPTERLTITQFMNHPWINQSMVVPQTPLHTARVLQEDKDHWDEVKEEMTSALATMRVDYDQVKIKDLKTSNNRLLNKRRKKQAGSSSASQGCNNQ

SEQ ID NO: 863841 - protein, 191 aa, Homo sapiens
GLGRSVCCSLCSQPAYYVAPEVLGPEKYDKSCDMWSLGVIMYILLCGFPPFYSNTGQAISPGMKRRIRLGQYGFPNPEWSEVSEDAKQLIRLLLKTDPTERLTITQFMNHPWINQSMVVPQTPLHTARVLQEDKDHWDEVKEEMTSALATMRVDYDQVKIKDLKTSNNRLLNKRRKKQAGSSSASQGCNNQ

SEQ ID NO: 863842 - protein, 279 aa, Homo sapiens
MDGETAEEQGGPVPPPVAPGGPGLGGAPGGRREPKKYAVTDDYQLSKQVLGLGVNGKVLECFHRRTGQKCALKLLYDSPKARQEVDHHWQASGGPHIVCILDVYENMHHGKRCLLIIMECMEGGELFSRIQERGDQAFTEREAAEIMRDIGTAIQFLHSHNIAHRDVKPENLLYTSKEKDAVLKLTDFGFAKETTQNALQTPCYTPYYVAPEVLGPEKYDKSCDMWSLGVIMYILLCGFPPFYSNTGQAISPGMKRRIRLGQYGFPNPEWSEVSEDVPE

SEQ ID NO: 863843 - protein, 299 aa, Homo sapiens
MDGETAEEQGGPVPPPVAPGGPGLGGAPGGRREPKKYAVTDDYQLSKQVLGLGVNGKVLECFHRRTGQKCALKLLYDSPKARQEVDHHWQASGGPHIVCILDVYENMHHGKRCLLIIMECMEGGELFSRIQERGDQAFTEREAAEIMRDIGTAIQFLHSHNIAHRDVKPENLLYTSKEKDAVLKLTDFGFAKETTQNALQTPCYTPYYVAPEVLGPEKYDKSCDMWSLGVIMYILLCGFPPFYSNTGQAISPGMKRRIRLGQYGFPNPEWSEVSEDASRAVVDVLRSGLRGTLAECRRR

SEQ ID NO: 863844 - protein, 294 aa, Homo sapiens
MDGETAEEQGGPVPPPVAPGGPGLGGAPGGRREPKKYAVTDDYQLSKQVLGLGVNGKVLECFHRRTGQKCALKLLYDSPKARQEVDHHWQASGGPHIVCILDVYENMHHGKRCLLIIMECMEGGELFSRIQERGDQAFTEREAAEIMRDIGTAIQFLHSHNIAHRDVKPENLLYTSKEKDAVLKLTDFGFAKETTQNALQTPCYTPYYVAPEVLGPEKYDKSCDMWSLGVIMYILLCGFPPFYSNTGQAISPGMKRRIRLGQYGLTNSMIAMSSLSNPNHVLQLHRSENTRQAE

SEQ ID NO: 863845 - protein, 407 aa, Homo sapiens
MDGETAEEQGGPVPPPVAPGGPGLGGAPGGRREPKKYAVTDDYQLSKQVLGLGVNGKVLECFHRRTGQKCALKLLYDSPKARQEVDHHWQASGGPHIVCILDVYENMHHGKRCLLIIMECMEGGELFSRIQERGDQAFTEREAAEIMRDIGTAIQFLHSHNIAHRDVKPENLLYTSKEKDAVLKLTDSGYCIRQTQPKMTPARTTLEILPKLIVEPPEEGSMEEPTAKVYDKGNWGPLVRHLRASKQLDTLPSYRWHTHSILIPTKGTQGRLTREMKTQDYRPRGQQRELAQDSTVRTTASQKRPHRQTRKNRVRNEEQQNKYEKYKRNRDSNRRDNAEYEDHERNTHEHSRQKENEAQHNQEKTSSISNTEEKKAIRPAEQAGRHVGLKTRGQEPCSTAVLNDCRD

SEQ ID NO: 863846 - protein, 382 aa, Homo sapiens; identical to SEQ ID NO: 863834

SEQ ID NO: 863847 - protein, 382 aa, Homo sapiens; identical to SEQ ID NO: 863834

SEQ ID NO: 863848 - protein, 382 aa, Homo sapiens; identical to SEQ ID NO: 863834

SEQ ID NO: 863849 - protein, 320 aa, Homo sapiens
MDGETAEEQGGPVPPPVAPGGPGLGGAPGGRREPKKYAVTDDYQLSKQVLGLGVNGKVLECFHRRTGQKCALKLLYDSPKARQEVDHHWQASGGPHIVCILDVYENMHHGKRCLLIIMECMEGGELFSRIQERGDQAFTEREAAEIMRDIGTAIQFLHSHNIAHRDVKPENLLYTSKEKDAVLKLTDFGFAKETTQNALQTPCYTPYYVAPEVLGPEKYDKSCDMWSLGVIMYILLCGFPPFYSNTGQAISPGMKRRIRLGQYGFPNPEWSEVSEDAKQLIRLLLKTDPTERLTITQFMNHPWINVSPSSSHGSEAPSPP

SEQ ID NO: 863850 - protein, 328 aa, Homo sapiens
MDGETAEEQGGPVPPPVAPGGPGLGGAPGGRREPKKYAVTDDYQLSKQVLGLGVNGKVLECFHRRTGQKCALKLLYDSPKARQEVDHHWQASGGPHIVCILDVYENMHHGKRCLLIIMECMEGGELFSRIQERGDQAFTEREAAEIMRDIGTAIQFLHSHNIAHRDVKPENLLYTSKEKDAVLKLTDFGFAKETTQNALQTPCYTPYYVAPEVLGPEKYDKSCDMWSLGVIMYILLCGFPPFYSNTGQAISPGMKRRIRLGQYGFPNPEWSEVSEDAIDGSATDPTPHGPSAAGGQRPLGRSQGGDDQCLGHYAGRLRPGEDQGPEDL

SEQ ID NO: 863851 - protein, 146 aa, Homo sapiens
GRVGRPTRRTGQAISPGMKRRIRLGQYGFPNPEWSEVSEDAKQLIRLLLKTDPTERLTITQFMNHPWINQSMVVPQTPLHTARVLQEDKDHWDEVKEEMTSALATMRVDYDQVKIKDLKTSNNRLLNKRRKKQAGSSSASQGCNNQ

SEQ ID NO: 863852 - protein, 278 aa, Homo sapiens
MDGETAEEQGGPVPPPVAPGGPGLGGAPGGRREPKKYAVTDDYQLSKQVLGLGVNGKVLECFHRRTGQKCALKLLYDSPKARQEVDHHWQASGGPHIVCILDVYENMHHGKRCLLIIMECMEGGELFSRIQERGDQAFTEREAAEIMRDIGTAIQFLHSHNIAHRDVKPENLLYTSKEKDAVLKLTDFGFAKETTQNALQTPCYTPYYVAPEVLGPEKYDKSCDMWSLGVIMYILLCGFPPFYSNTGQAISPGMKRRIRLGQYGFPNPEWSEVSEDAL

SEQ ID NO: 863853 - protein, 250 aa, Homo sapiens
MDGETAEEQGGPVPPPVAPGGPGLGGAPGGRREPKKYAVTDDYQLSKQVLGLGVNGKVLECFHRRTGQKCALKLLYDSPKARQEVDHHWQASGGPHIVCILDVYENMHHGKRCLLIIMECMEGGELFSRIQERGDQAFTEREAAEIMRDIGTAIQFLHSHNIAHRDVKPENLLYTSKEKDAVLKLTDFGFAKETTQNALQTPCYTPYYVAPEVLGPEKYDKSCDMWSLGVIMYILKNKALLGTWNQSAVI

SEQ ID NO: 863854 - protein, 69 aa, Homo sapiens
MYRVGLDLRLASLTPSSSVSAEAAEIMRDIGTAIQFLHSHNIAHRDVKVRLQDSGWGPGEEDIVPLHNP

SEQ ID NO: 863855 - protein, 109 aa, Homo sapiens
LPRRLDTVFLIQYLFLTFPRIVFMLGFVVVLSFLLGGYLLFVLYLAATNQTTNEWYRGDWAWCQRCPLVAWPPSAEPQVHRNIHSHGLRSNLQEIFLPAFPCHERKKQE

SEQ ID NO: 863856 - protein, 344 aa, Homo sapiens
MDFLVLFLFYLASVLMGLVLICVCSKTHSLKGLARGGAQIFSCIIPECLQRAVHGLLHYLFHTRNHTFIVLHLVLQGMVYTEYTWEVFGYCQELELSLHYLLLPYLLLGVNLFFFTLTCGTNPGIITKANELLFLHVYEFDEVMFPKNVRCSTCDLRKPARSKHCSVCNWCVHRFDHHCVWVNNCIGAWNIRYFLIYVLTLTASAATVAIVSTTFLVHLVVMSDLYQETYIDDLGHLHVMDTVFLIQYLFLTFPRIVFMLGFVVVLSFLLGGYLLFVLYLAATNQTTNEWYRGDWAWCQRCPLVAWPPSAEPQVHRNIHSHGLRSNLQEIFLPAFPCHERKKQE

SEQ ID NO: 863857 - protein, 94 aa, Homo sapiens
KDRVHNMEVSKVIDEVSWYKSDITTKLDQKSGAHNGPGASVVPLWPGLRQQSPKSTGTFTPMGFGATFKRSFYLPFHVMRGRNKNDKCMTAFEL

SEQ ID NO: 863858 - protein, 344 aa, Homo sapiens; identical to SEQ ID NO: 863856

SEQ ID NO: 863859 - protein, 344 aa, Homo sapiens; identical to SEQ ID NO: 863856

SEQ ID NO: 863860 - protein, 344 aa, Homo sapiens; identical to SEQ ID NO: 863856

SEQ ID NO: 863861 - protein, 344 aa, Homo sapiens; identical to SEQ ID NO: 863856

SEQ ID NO: 863862 - protein, 344 aa, Homo sapiens; identical to SEQ ID NO: 863856

SEQ ID NO: 863863 - protein, 344 aa, Homo sapiens; identical to SEQ ID NO: 863856

SEQ ID NO: 863864 - protein, 212 aa, Homo sapiens
MDFLVLFLFYLASVLMGLVLICVCSKTHSLKGLARGGAQIFSCIIPECLQRAVHGLLHYLFHTRNHTFIVLHLVLQGMVYTEYTWEVFGYCQELELSLHYLLLPYLLLGVNLFFFTLTCGTNPGIITKANELLFLHVYEFDEVMFPKNVRCSTCDLRKPARSKHCSECGSRDSSGTSNSTCVGFVCEGMFPESESRASSPPDMVWPLLVELR

SEQ ID NO: 863865 - protein, 212 aa, Homo sapiens; identical to SEQ ID NO: 863864

SEQ ID NO: 863866 - protein, 212 aa, Homo sapiens; identical to SEQ ID NO: 863864

SEQ ID NO: 863867 - protein, 104 aa, Homo sapiens
ARGAHAWRQIQAPGRTMSGSYWSCQAHTAAQEELLFVLYLAATNQTTNEWYRGDWAWCQRCPLVAWPPSAEPQVHRNIHSHGLRSNLQEIFLPAFPCHERKKQE

SEQ ID NO: 863868 - protein, 344 aa, Homo sapiens; identical to SEQ ID NO: 863856

SEQ ID NO: 863869 - protein, 344 aa, Homo sapiens; identical to SEQ ID NO: 863856

SEQ ID NO: 863870 - protein, 282 aa, Homo sapiens
MDFLVLFLFYLASVLMGLVLICVCSKTHSLKGLARGGAQIFSCIIPECLQRAVHGLLHYLFHTRNHTFIVLHLVLQGMVYTEYTWEVFGYCQELELSLHYLLLPYLLLGVNLFFFTLTCGTNPGIITKANELLFLHVYEFDEVMFPKNVRCSTCDLRKPARSKHCSVCNWCVHRFDHHCVWVNNCIGAWNIRYFLIYVLTLTASAATVAIVSTTFLVHLVVMSDLYQETYIDDLGHLHVMDTVFLIQCEHFIHPTGNSCMYWDYSGLLLSAVYVQFVTSGHK

SEQ ID NO: 863871 - protein, 212 aa, Homo sapiens; identical to SEQ ID NO: 863864

SEQ ID NO: 863872 - protein, 212 aa, Homo sapiens; identical to SEQ ID NO: 863864

SEQ ID NO: 863873 - protein, 155 aa, Homo sapiens
IAPVTCQRRAKGAFGVGFLEAAFSFTWKASLVMDPYMIQMSSKGNLPSILDVHVNVGGRSSVPGKMKGRKARWSVRPSDMAKKTFNPIRAIVDNMKVKPNPNKTMISLSIGDPTVFGNLPTDPEVTQAMKDALDSGKYNGYAPSIGKLLLRLHTW

SEQ ID NO: 863874 - protein, 382 aa, Homo sapiens
IAPVTCQRRAKGAFGVGFLEAAFSFTWKASLVMDPYMIQMSSKGNLPSILDVHVNVGGRSSVPGKMKGRKARWSVRPSDMAKKTFNPIRAIVDNMKVKPNPNKTMISLSIGDPTVFGNLPTDPEVTQAMKDALDSGKYNGYAPSIGFLSSREEIASYYHCPEAPLEAKDVILTSGCSQAIDLCLAVLANPGQNILVPRPGFSLYKTLAESMGIEVKLYNLLPEKSWEIDLKQLEYLIDEKTACLIVNNPSNPCGSVFSKRHLQKILAVAARQCVPILADEIYGDMVFSDCKYEPLATLSTDVPILSCGGLAKRWLVPGWRLGWILIHDRRDIFGNEIRDGLVKLSQRILGPCTIVQGALLKHPMSHPGRVLPQHSELPQVQC

SEQ ID NO: 863875 - protein, 519 aa, Homo sapiens
IAPVTCQRRAKGAFGVGFLEAAFSFTWKASLVMDPYMIQMSSKGNLPSILDVHVNVGGRSSVPGKMKGRKARWSVRPSDMAKKTFNPIRAIVDNMKVKPNPNKTMISLSIGELGTLLRGCHCPPLLSCSQAGWRRWQLGVSLSTEHGRITSWLLLCFPPIKGDPTVFGNLPTDPEVTQAMKDALDSGKYNGYAPSIGFLSSREEIASYYHCPEAPLEAKDVILTSGCSQAIDLCLAVLANPGQNILVPRPGFSLYKTLAESMGIEVKLYNLLPEKSWEIDLKQLEYLIDEKTACLIVNNPSNPCGSVFSKRHLQKILAVAARQCVPILADEIYGDMVFSDCKYEPLATLSTDVPILSCGGLAKRWLVPGWRLGWILIHDRRDIFGNEIRDGLVKLSQRILGPCTIVQGALLKSNADLCYGALAAIPGLRPVRPSGAMYLMVGIEMEHFPEFENDVEFTERLVAEQSVHCLPATCFEYPNFIRVVITVPEVMMLEACSRIQEFCEQHYHCAEGSQEECDK

SEQ ID NO: 863876 - protein, 174 aa, Homo sapiens
IAPVTCQRRAKGAFGVGFLEAAFSFTWKASLVMDPYMIQMSSKGNLPSILDVHVNVGGRSSVPGKMKGRKARWSVRPSDMAKKTFNPIRAIVDNMKVKPNPNKTMISLSIGELGTLLRGCHCPPLLSCSQAGWRRWQLGVSLSTEHGRITSWLLLCFPPIKRGPYCVWKPAYRP

SEQ ID NO: 863877 - protein, 382 aa, Homo sapiens; identical to SEQ ID NO: 863874

SEQ ID NO: 863878 - protein, 519 aa, Homo sapiens; identical to SEQ ID NO: 863875

SEQ ID NO: 863879 - protein, 519 aa, Homo sapiens; identical to SEQ ID NO: 863875

SEQ ID NO: 863880 - protein, 433 aa, Homo sapiens
IAPVTCQRRAKGAFGVGFLEAAFSFTWKASLVMDPYMIQMSSKGNLPSILDVHVNVGGRSSVPGKMKGRKARWSVRPSDMAKKTFNPIRAIVDNMKVKPNPNKTMISLSIGELGTLLRGCHCPPLLSCSQAGWRRWQLGVSLSTEHGRITSWLLLCFPPIKGDPTVFGNLPTDPEVTQAMKDALDSGKYNGYAPSIGFLSSREEIASYYHCPEAPLEAKDVILTSGCSQAIDLCLAVLANPGQNILVPRPGFSLYKTLAESMGIEVKLYNLLPEKSWEIDLKQLEYLIDEKTACLIVNNPSNPCGSVFSKRHLQKILAVAARQCVPILADEIYGDMVFSDCKYEPLATLSTDVPILSCGGLAKRWLVPGWRLGWILIHDRRDIFGNEIRDGLVKLSQRILGPCTIVQGALLKHPMSHPGRVLPQHSELPQVQC

SEQ ID NO: 863881 - protein, 690 aa, Homo sapiens
MDMDTPHCLTCPQQSTAESEGATICTCESGHYRAPGEGPQVACTGPPSAPRNLSFSASGTQLSLRWEPPADTGGRQDVRYSVRCSQCQGTAQDGGPCQPCGVGVHFSPGARGLTTPAVHVNGLEPYANYTFNVEAQNGVSGLGSSGHASTSVSISMGHAESLSGLSLRLVKKEPRQLELTWAGSRPRSPGANLTYELHVLNQDEERYQMVLEPRVLLTELQPDTTYIVRVRMLTPLGPGPFSPDHEFRTSPPVSRGLTGGEIVAVIFGLLLGAALLLGILVFRSRRAQRQRQQRQRDRATDVDREDKLWLKPYVDLQAYEDPAQGALDFTRELDPAWLMVDTVIGEGEFGEVYRGTLRLPSQDCKTVAIKTLKDTSPGGQWWNFLREATIMGQFSHPHILHLEGVVTKRKPIMIITEFMENGALDAFLREREDQLVPGQLVAMLQGIASGMNYLSNHNYVHRDLAARNILVNQNLCCKVSDFGLTRLLDDFDGTYETQGGKIPIRWTAPEAIAHRIFTTASDVWSFGIVMWEVLSFGDKPYGEMSNQEVMKSIEDGYRLPPPVDCPAPLYELMKNCWAYDRARRPHFQKLQAHLEQLLANPHSLRTIANFDPRVTLRLPSLSGSDGIPYRTVSEWLESIRMKRYILHFHSAGLDTMECVLELTAEDLTQMGITLPGHQKRILCSIQGFKD

SEQ ID NO: 863882 - protein, 701 aa, Homo sapiens
MDMDTPHCLTCPQQSTAESEGATICTCESGHYRAPGEGPQVACTGPPSAPRNLSFSASGTQLSLRWEPPADTGGRQDVRYSVRCSQCQGTAQDGGPCQPCGVGVHFSPGARGLTTPAVHVNGLEPYANYTFNVEAQNGVSGLGSSGHASTSVSISMGHAESLSGLSLRLVKKEPRQLELTWAGSRPRSPGANLTYELHVLNQDEERYQMVLEPRVLLTELQPDTTYIVRVRMLTPLGPGPFSPDHEFRTSPPVSRGLTGGEIVAVIFGLLLGAALLLGILVFRSRRAQRQRQQRQRDRATDVDREDKLWLKPYVDLQAYEDPAQGALDFTRELDPAWLMVDTVIGEGEFGEVYRGTLRLPSQDCKTVAIKTLKDTSPGGQWWNFLREATIMGQFSHPHILHLEGVVTKRKPIMIITEFMENGALDAFLREREDQLVPGQLVAMLQGIASGMNYLSNHNYVHRDLAARNILVNQNLCCKVSDFGLTRLLDDFDGTYETQGGKIPIRWTAPEAIAHRIFTTASDVWSFGIVMWEVLSFGDKPYGEMSNQEVMKSIEDGYRLPPPVDCPAPLYELMKNCWAYDRARRPHFQKLQAHLEQLLANPHSLRTIANFDPRVTLRLPSLSGSDGIPYRTVSEWLESIRMKRYITIPKLHTSLAVVKIRWAMASGAVQRIGIFPPWVSYVPSKSSRRRVRPKSDTLQHRF

SEQ ID NO: 863883 - protein, 166 aa, Homo sapiens
MVDTVIGEGEFGEVYRGTLRLPSQDCKTVAIKTLKDTSPGGQWWNFLREATIMGQFSHPHILHLEGVVTKRKPIMIITEFMENGALDAFLREREDQLVPGQLVAMLQGIASGMNYLSNHNYVHRDLAARNILVNQNLCCKVSDFGLTRLLDDFDGTYETQVRGRYK

SEQ ID NO: 863884 - protein, 184 aa, Homo sapiens
SSGINQSAHYGRGALRNEMAVLWRLSAVCGALGGRALLLRTPVVRPAHISAFLQDRPIPEWCGVQHIHLSPSHHSGSKAASLHWTSERVVSVLLLGLLPAAYLNPCSAMDYSLAAALTLHGHWGLGPSCYWTMFMGMPCKKKLPRAGAFVGTFSFNLVAGLLLFQPITMWGICKGWCAMLCGKL

SEQ ID NO: 863885 - protein, 611 aa, Homo sapiens
QSRQFCACSLFSSTQNCQCERIWKSLDLLNTKMFFRVFLHFIRSHSATAVDFLPVMVHRLPVFKRYMGNTPQKKAVFGQCRGLPCVAPLLTTVEEAPRGISARVWGHFPKWLNGSLLRIGPGKFEFGKDKYNHWFDGMALLHQFRMAKGTVTYRSKFLQSDTYKANSAKNRIVISEFGTLALPDPCKNVFERFMSRFELPGKAAAMTDNTNVNYVRYKGDYYLCTETNFMNKVDIETLEKTEKVDWSKFIAVNGATAHPHYDPDGTAYNMGNSFGPYGFSYKVIRVPPEKVDLGETIHGVQVICSIASTEKGKPSYYHSFGMTRNYIIFIEQPLKMNLWKIATSKIRGKAFSDGISWEPQCNTRFHVVEKRTGQLLPGRYYSKPFVTFHQINAFEDQGCVIIDLCCQDNGRTLEVYQLQNLRKAGEGLDQVHNSAAKSFPRRFVLPLNVSLNAPEGDNLSPLSYTSASAVKQADGTIWCSHENLHQEDLEKEGGIEFPQIYYDRFSGKKYHFFYGCGFRHLVGDSLIKVDVVNKTLKVWREDGFYPSEPVFVPAPGTNEEDGGVILSVVITPNQNESNFLLVLDAKNFEELGRAEVPVQMPYGFHGTFIPI

SEQ ID NO: 863886 - protein, 539 aa, Homo sapiens
MGNTPQKKAVFGQCRGLPCVAPLLTTVEEAPRGISARVWGHFPKWLNGSLLRIGPGKFEFGKDKYNHWFDGMALLHQFRMAKGTVTYRSKFLQSDTYKANSAKNRIVISEFGTLALPDPCKNVFERFMSRFELPGKAAAMTDNTNVNYVRYKGDYYLCTETNFMNKVDIETLEKTEKVDWSKFIAVNGATAHPHYDPDGTAYNMGNSFGPYGFSYKVIRVPPEKVDLGETIHGVQVICSIASTEKGKPSYYHSFGMTRNYIIFIEQPLKMNLWKIATSKIRGKAFSDGISWEPQCNTRFHVVEKRTGQLLPGRYYSKPFVTFHQINAFEDQGCVIIDLCCQDNGRTLEVYQLQNLRKAGEGLDQVHNSAAKSFPRRFVLPLNVSLNAPEGDNLSPLSYTSASAVKQADGTIWCSHENLHQEDLEKEGGIEFPQIYYDRFSGKKYHFFYGCGFRHLVGDSLIKVDVVWREDGFYPSEPVFVPAPGTNEEDGGVILSVVITPNQNESNFLLVLDAKNFEELGRAEVPVQMPYGFHGTFIPI

SEQ ID NO: 863887 - protein, 166 aa, Homo sapiens
MAVLWRLSAVCGALGGRALLLRTPVVRPAHISAFLQDRPIPEWCGVQHIHLSPSHHSGSKAASLHWTSERVVSVLLLGLLPAAYLNPCSAMDYSLAAALTLHGHWGLGPSCYWTMFMGMPCKKKLPRAGAFVGTFSFNLVAGLLLFQPITMWGICKGWCAMLCGKL

SEQ ID NO: 863888 - protein, 166 aa, Homo sapiens; identical to SEQ ID NO: 863887

SEQ ID NO: 863889 - protein, 184 aa, Homo sapiens; identical to SEQ ID NO: 863884

SEQ ID NO: 863890 - protein, 167 aa, Homo sapiens
QEFTNGGLSAGCGALGGRALLLRTPVVRPAHISAFLQDRPIPEWCGVQHIHLSPSHHSGSKAASLHWTSERVVSVLLLGLLPAAYLNPCSAMDYSLAAALTLHGHWGLGPSCYWTMFMGMPCKKKLPRAGAFVGTFSFNLVAGLLLFQPITMWGICKGWCAMLCGKL

SEQ ID NO: 863891 - protein, 145 aa, Homo sapiens
SSGINQSAHYGRGALRNEMAVLWRLSAVCGALGGRAGSKAASLHWTSERVVSVLLLGLLPAAYLNPCSAMDYSLAAALTLHGHWGLGPSCYWTMFMGMPCKKKLPRAGAFVGTFSFNLVAGLLLFQPITMWGICKGWCAMLCGKL

SEQ ID NO: 863892 - protein, 140 aa, Homo sapiens
MGSWAWLHAIIIGFVLHRGAATYVDVQKDLTGSKAASLHWTSERVVSVLLLGLLPAAYLNPCSAMDYSLAAALTLHGHWGLGPSCYWTMFMGMPCKKKLPRAGAFVGTFSFNLVAGLLLFQPITMWGICKGWCAMLCGKL

SEQ ID NO: 863893 - protein, 104 aa, Homo sapiens
MAVLWRLSAVCGALGGRALLLRTPVVRPAHISAFLQDRPIPEWCGVQHIHLSPSHHSGSKAASLHWTSERVVSVLLLGLLPAAYLNPCSAMDYSLAAALTLHGH

SEQ ID NO: 863894 - protein, 126 aa, Homo sapiens
MTLSPQERDGGSLEAECRLRCPRRPSSVASNSSGQTCSYLSISSGPTYPRMVWSAAHTLVTEPPLGLGPSCYWTMFMGMPCKKKLPRAGAFVGTFSFNLVAGLLLFQPITMWGICKGWCAMLCGKL

SEQ ID NO: 863895 - protein, 111 aa, Homo sapiens
MAVLWRLSAVCGALGGRALLLRTPVVRPAHISAFLQDRPIPEWCGVQHIHLSPSHHSGSKAASLHWTSERVVSVLLLGLLPAAYLNPCSAMDYSLAAALTLHGHWKIKNNE

SEQ ID NO: 863896 - protein, 297 aa, Homo sapiens
MAVLWRLSAVCGALGGRALLLRTPVVRPAHISAFLQDRPIPEWCGVQHIHLSPSHHSGSKAASLHWTSERVVSVLLLGLLPAAYLNPCSAMDYSLAAALTLHGHCLQCQIVHSCPLLENQIHLSLKFPDYFIKMKPVEKDLNVFKRYMGNTPQKKAVFGQCRGLPCVAPLLTTVEEAPRGISARVWGHFPKWLNGSLLRIGPGKFEFGKDKYNHWFDGMALLHQFRMAKGTVTYRSKFLQSDTYKANSAKNRIVISEFGTLALPDPCKNVFERFMSRFELPGKAAGDSDDYLNYYDI

SEQ ID NO: 863897 - protein, 128 aa, Homo sapiens
MAVLWRLSAVCGALGGRALLLRTPVVRPAHISAFLQDRPIPEWCGVQHIHLSPSHHSGSKAASLHWTSERVVSVLLLGLLPAAYLNPCSAMDYSLAAALTLHGHCGGLDNCYDQFRGCLPAKAGFARF

SEQ ID NO: 863898 - protein, 311 aa, Homo sapiens
MAVLWRLSAVCGALGGRALLLRTPVVRPAHISAFLQDRPIPEWCGVQHIHLSPSHHSGSKAASLHWTSERVVSVLLLGLLPAAYLNPCSAMDYSLAAALTLHGHCLQCQIVHSCPLLENQIHLSLKFPDYFIKMKPVEKDLNVFKRYMGNTPQKKAVFGQCRGLPCVAPLLTTVEEAPRGISARVWGHFPKWLNGSLLRIGPGKFEFGKDKYNHWFDGMALLHQFRMAKGTVTYRSKFLQSDTYKANSAKNRIVISEFGTLALPDPCKNVFEVDVAAHVGGEGRPHVLDLLLGEAVTLRGQQLLQELLLDG

SEQ ID NO: 863899 - protein, 593 aa, Homo sapiens
QSRQFCACSLFSSTQNCQCERIWKSLDLLNTKMFFRVFLHFIRSHSATAVDFLPVMVHRLPVFKRYMGNTPQNTVEEAPRGISARVWGHFPKWLNGSLLRIGPGKFEFGKDKYNHWFDGMALLHQFRMAKGTVTYRSKFLQSDTYKANSAKNRIVISEFGTLALPDPCKNVFERFMSRFELPGKAAAMTDNTNVNYVRYKGDYYLCTETNFMNKVDIETLEKTEKVDWSKFIAVNGATAHPHYDPDGTAYNMGNSFGPYGFSYKVIRVPPEKVDLGETIHGVQVICSIASTEKGKPSYYHSFGMTRNYIIFIEQPLKMNLWKIATSKIRGKAFSDGISWEPQCNTRFHVVEKRTGQLLPGRYYSKPFVTFHQINAFEDQGCVIIDLCCQDNGRTLEVYQLQNLRKAGEGLDQVHNSAAKSFPRRFVLPLNVSLNAPEGDNLSPLSYTSASAVKQADGTIWCSHENLHQEDLEKEGGIEFPQIYYDRFSGKKYHFFYGCGFRHLVGDSLIKVDVVNKTLKVWREDGFYPSEPVFVPAPGTNEEDGGVILSVVITPNQNESNFLLVLDAKNFEELGRAEVPVQMPYGFHGTFIPI

SEQ ID NO: 863900 - protein, 290 aa, Homo sapiens
MTRNYIIFIEQPLKMNLWKIATSKIRGKAFSDGISWEPQCNTRFHVVEKRTGQLLPGRYYSKPFVTFHQINAFEDQGCVIIDLCCQDNGRTLEVYQLQNLRKAGEGLDQVHNSAAKSFPRRFVLPLNVSLNAPEGDNLSPLSYTSASAVKQADGTIWCSHENLHQEDLEKEGGIEFPQIYYDRFSGKKYHFFYGCGFRHLVGDSLIKVDVVNKTLKVWREDGFYPSEPVFVPAPGTNEEDGGVILSVVITPNQNESNFLLVLDAKNFEELGRAEVPVQMPYGFHGTFIPI

SEQ ID NO: 863901 - protein, 166 aa, Homo sapiens; identical to SEQ ID NO: 863887

SEQ ID NO: 863902 - protein, 545 aa, Homo sapiens
MGNTPQKKAVFGQCRGLPCVAPLLTTVEEAPRGISARVWGHFPKWLNGSLLRIGPGKFEFGKDKYNHWFDGMALLHQFRMAKGTVTYRSKFLQSDTYKANSAKNRIVISEFGTLALPDPCKNVFERFMSRFELPGKAAAMTDNTNVNYVRYKGDYYLCTETNFMNKVDIETLEKTEKVDWSKFIAVNGATAHPHYDPDGTAYNMGNSFGPYGFSYKVIRVPPEKVDLGETIHGVQVICSIASTEKGKPSYYHSFGMTRNYIIFIEQPLKMNLWKIATSKIRGKAFSDGISWEPQCNTRFHVVEKRTGQLLPGRYYSKPFVTFHQINAFEDQGCVIIDLCCQDNGRTLEVYQLQNLRKAGEGLDQVHNSAAKSFPRRFVLPLNVSLNAPEGDNLSPLSYTSASAVKQADGTIWCSHENLHQEDLEKEGGIEFPQIYYDRFSGKKYHFFYGCGFRHLVGDSLIKVDVVNKTLKVWREDGFYPSEPVFVPAPGTNEEDGGVILSVVITPNQNESNFLLVLDAKNFEELGRAEVPVQMPYGFHGTFIPI

SEQ ID NO: 863903 - protein, 216 aa, Homo sapiens
QSRQFCACSLFSSTQNCQCERIWKSLDLLNTKMFFRVFLHFIRSHSATAVDFLPVMVHRLPVFKRYMGNTPQKKAVFGQCRGLPCVAPLLTTVEEAPRGISARVWGHFPKWLNGSLLRIGPGKFEFGKDKYNHWFDGMALLHQFRMAKGTVTYRSKFLQSDTYKANSAKNRIVISEFGTLALPDPCKNVFERFMSRFELPGKAAGDSDDYLNYYDI

SEQ ID NO: 863904 - protein, 166 aa, Homo sapiens; identical to SEQ ID NO: 863887

SEQ ID NO: 863905 - protein, 166 aa, Homo sapiens; identical to SEQ ID NO: 863887

SEQ ID NO: 863906 - protein, 178 aa, Homo sapiens
SSGINAECPLRPGSPQERDGGSLEAECRLRCPRRPSSVASNSSGQTCSYLSISEWCGVQHIHLSPSHHSGSKAASLHWTSERVVSVLLLGLLPAAYLNPCSAMDYSLAAALTLHGHWGLGPSCYWTMFMGMPCKKKLPRAGAFVGTFSFNLVAGLLLFQPITMWGICKGWCAMLCGKL

SEQ ID NO: 863907 - protein, 231 aa, Homo sapiens
QLYWTYLGLGFRRRRGVVSRKGDTLSINQYSESELPDRYADWAADAGQWEVLWHTVSRDQCMNSWLGSQIPVRYSTWCISAAFSNTKIRDWYAHWNGVVTDMLYNNCVHHGRTTPVSWNTQAGSKAASLHWTSERVVSVLLLGLLPAAYLNPCSAMDYSLAAALTLHGHWGLGPSCYWTMFMGMPCKKKLPRAGAFVGTFSFNLVAGLLLFQPITMWGICKGWCAMLCGKL

SEQ ID NO: 863908 - protein, 104 aa, Homo sapiens; identical to SEQ ID NO: 863893

SEQ ID NO: 863909 - protein, 686 aa, Homo sapiens
MAVLWRLSAVCGALGGRALLLRTPVVRPAHISAFLQDRPIPEWCGVQHIHLSPSHHSGSKAASLHWTSERVVSVLLLGLLPAAYLNPCSAMDYSLAAALTLHGHCLQCQIVHSCPLLENQIHLSLKFPDYFIKMKPVEKDLNVFKRYMGNTPQKKAVFGQCRGLPCVAPLLTTVEEAPRGISARVWGHFPKWLNGSLLRIGPGKFEFGKDKYNHWFDGMALLHQFRMAKGTVTYRSKFLQSDTYKANSAKNRIVISEFGTLALPDPCKNVFERFMSRFELPGKAAAMTDNTNVNYVRYKGDYYLCTETNFMNKVDIETLEKTEKVDWSKFIAVNGATAHPHYDPDGTAYNMGNSFGPYGFSYKVIRVPPEKVDLGETIHGVQVICSIASTEKGKPSYYHSFGMTRNYIIFIEQPLKMNLWKIATSKIRGKAFSDGISWEPQCNTRFHVVEKRTGQLLPGRYYSKPFVTFHQINAFEDQGCVIIDLCCQDNGRTLEVYQLQNLRKAGEGLDQVHNSAAKSFPRRFVLPLNVSLNAPEGDNLSPLSYTSASAVKQADGTIWCSHENLHQEDLEKEGGIEFPQIYYDRFSGKKYHFFYGCGFRHLVGDSLIKVDVVWREDGFYPSEPVFVPAPGTNEEDGGVILSVVITPNQNESNFLLVLDAKNFEELGRAEVPVQMPYGFHGTFIPI

SEQ ID NO: 863910 - protein, 692 aa, Homo sapiens
MAVLWRLSAVCGALGGRALLLRTPVVRPAHISAFLQDRPIPEWCGVQHIHLSPSHHSGSKAASLHWTSERVVSVLLLGLLPAAYLNPCSAMDYSLAAALTLHGHCLQCQIVHSCPLLENQIHLSLKFPDYFIKMKPVEKDLNVFKRYMGNTPQKKAVFGQCRGLPCVAPLLTTVEEAPRGISARVWGHFPKWLNGSLLRIGPGKFEFGKDKYNHWFDGMALLHQFRMAKGTVTYRSKFLQSDTYKANSAKNRIVISEFGTLALPDPCKNVFERFMSRFELPGKAAAMTDNTNVNYVRYKGDYYLCTETNFMNKVDIETLEKTEKVDWSKFIAVNGATAHPHYDPDGTAYNMGNSFGPYGFSYKVIRVPPEKVDLGETIHGVQVICSIASTEKGKPSYYHSFGMTRNYIIFIEQPLKMNLWKIATSKIRGKAFSDGISWEPQCNTRFHVVEKRTGQLLPGRYYSKPFVTFHQINAFEDQGCVIIDLCCQDNGRTLEVYQLQNLRKAGEGLDQVHNSAAKSFPRRFVLPLNVSLNAPEGDNLSPLSYTSASAVKQADGTIWCSHENLHQEDLEKEGGIEFPQIYYDRFSGKKYHFFYGCGFRHLVGDSLIKVDVVNKTLKVWREDGFYPSEPVFVPAPGTNEEDGGVILSVVITPNQNESNFLLVLDAKNFEELGRAEVPVQMPYGFHGTFIPI

SEQ ID NO: 863911 - protein, 121 aa, Homo sapiens
MAVLWRLSAVCGALGGRALLLRTPVVRPAHISAFLQDRPIPEWCGVQHIHLSPSHHSGSKAASLHWTSERVVSVLLLGLLPAAYLNPCSAMDYSLAAALTLHGHWASIAIPNIVVCSVCLL

SEQ ID NO: 863912 - protein, 474 aa, Homo sapiens
MALLHQFRMAKGTVTYRSKFLQSDTYKANSAKNRIVISEFGTLALPDPCKNVFERFMSRFELPGKAAAMTDNTNVNYVRYKGDYYLCTETNFMNKVDIETLEKTEKVDWSKFIAVNGATAHPHYDPDGTAYNMGNSFGPYGFSYKVIRVPPEKVDLGETIHGVQVICSIASTEKGKPSYYHSFGMTRNYIIFIEQPLKMNLWKIATSKIRGKAFSDGISWEPQCNTRFHVVEKRTGQLLPGRYYSKPFVTFHQINAFEDQGCVIIDLCCQDNGRTLEVYQLQNLRKAGEGLDQVHNSAAKSFPRRFVLPLNVSLNAPEGDNLSPLSYTSASAVKQADGTIWCSHENLHQEDLEKEGGIEFPQIYYDRFSGKKYHFFYGCGFRHLVGDSLIKVDVVNKTLKVWREDGFYPSEPVFVPAPGTNEEDGGVILSVVITPNQNESNFLLVLDAKNFEELGRAEVPVQMPYGFHGTFIPI

SEQ ID NO: 863913 - protein, 538 aa, Homo sapiens
QSRQFCACSLFSSTQNCQCERIWKSLDLLNTKMFFRVFLHFIRSHSATAVDFLPVMVHRLPVFKRYMGNTPQKKAVFGQCRGLPCVAPLLTTVEEAPRGISARVWGHFPKWLNGSLLRIGPGKFEFGKDKYNHWFDGMALLHQFRMAKGTVTYRSKFLQSDTYKANSAKNRIVISEFGTLALPDPCKNVFERFMSRFELPGKAAGFSYKVIRVPPEKVDLGETIHGVQVICSIASTEKGKPSYYHSFGMTRNYIIFIEQPLKMNLWKIATSKIRGKAFSDGISWEPQCNTRFHVVEKRTGQLLPGRYYSKPFVTFHQINAFEDQGCVIIDLCCQDNGRTLEVYQLQNLRKAGEGLDQVHNSAAKSFPRRFVLPLNVSLNAPEGDNLSPLSYTSASAVKQADGTIWCSHENLHQEDLEKEGGIEFPQIYYDRFSGKKYHFFYGCGFRHLVGDSLIKVDVVNKTLKVWREDGFYPSEPVFVPAPGTNEEDGGVILSVVITPNQNESNFLLVLDAKNFEELGRAEVPVQMPYGFHGTFIPI

SEQ ID NO: 863914 - protein, 275 aa, Homo sapiens
MAEPASVAAESLAGSRARAARTVLGQVVLPGEELLLPEQEDAEGPGGAVERPLSLNARACSRVRVVCGPGLRRCGDRLLVTKCGRLRHKEPGSGSGGGVYWVDSQQKRYVPVKGDHVIGIVTAKSGDIFKVDVGGSEPASLSYLSFEGATKRNRPNVQVGDLIYGQFVVANKDMEPEMVCIDSCGRANGMGVIGQDGLLFKVTLGLIRKLLAPDCEIIQEVGKLYPLEIVFGMNGRIWVKAKTIQQTLILANILEACEHMTSDQRKQIFSRLAES

SEQ ID NO: 863915 - protein, 275 aa, Homo sapiens; identical to SEQ ID NO: 863914

SEQ ID NO: 863916 - protein, 173 aa, Homo sapiens
RKRCLVEPAMAEPASVAAESLAGSRARAARTVLGQVVLPGEELLLPEQEDAEGPGGAVERPLSLNARACSRVRVVCGPGLRRCGDRLLVTKCGRLRHKEPGSGSGGGVYWVDSQQKRYVPVKGDHVIGIVTAKSGDIFKVDVGGSEPASLSYLSFEGATKRNRPNVQAISSRL

SEQ ID NO: 863917 - protein, 181 aa, Homo sapiens
RKRCLVEPAMAEPASVAAESLAGSRARAARTVLGQVVLPGEELLLPEQEDAEGPGGAVERPLSLNARACSRVRVVCGPGLRRCGDRLLVTKCGRLRHKEPGSGSGGGVYWVDSQQKRYVPVKGDHVIGIVTAKSGDIFKVDVGGSEPASLSYLSFEGATKRNRPNVQVITGAFGFKETNIH

SEQ ID NO: 863918 - protein, 101 aa, Homo sapiens
GRPPSEGPRLPVGRVLEVEDGAVGAGAEVHRVRGVDGTVEASHGAKIVPRRVHEQPAAQAALFQPPEQPSARAAQARAEAVSAPALGPAVWPGPPARRGGR

SEQ ID NO: 863919 - protein, 284 aa, Homo sapiens
RKRCLVEPAMAEPASVAAESLAGSRARAARTVLGQVVLPGEELLLPEQEDAEGPGGAVERPLSLNARACSRVRVVCGPGLRRCGDRLLVTKCGRLRHKEPGSGSGGGVYWVDSQQKRYVPVKGDHVIGIVTAKSGDIFKVDVGGSEPASLSYLSFEGATKRNRPNVQVGDLIYGQFVVANKDMEPEMVCIDSCGRANGMGVIGQDGLLFKVTLGLIRKLLAPDCEIIQEVGKLYPLEIVFGMNGRIWVKAKTIQQTLILANILEACEHMTSDQRKQIFSRLAES

SEQ ID NO: 863920 - protein, 275 aa, Homo sapiens; identical to SEQ ID NO: 863914

SEQ ID NO: 863921 - protein, 275 aa, Homo sapiens; identical to SEQ ID NO: 863914

SEQ ID NO: 863922 - protein, 173 aa, Homo sapiens; identical to SEQ ID NO: 863916

SEQ ID NO: 863923 - protein, 195 aa, Homo sapiens
GRPPSEGPRLPVGRVLEVEDGAVGAGAEYVPVKGDHVIGIVTAKSGDIFKVDVGGSEPASLSYLSFEGATKRNRPNVQVGDLIYGQFVVANKDMEPEMVCIDSCGRANGMGVIGQDGLLFKVTLGLIRKLLAPDCEIIQEVGKLYPLEIVFGMNGRIWVKAKTIQQTLILANILEACEHMTSDQRKQIFSRLAES

SEQ ID NO: 863924 - protein, 218 aa, Homo sapiens
RKRCLVEPAMAEPASVAAESLAGSRARAARTVLGQVVLPGEELLLPEQEDAEGPGGAVERPLSLNARACSRVRVVCGPGLRRCGDRLLVTKCGRLRHKEPGSGSGGGVYWVDSQQKRYVPVKGDHVIGIVTAKSGDIFKVDVGGSEPASLSYLSFEGATKRNRPNVQVGDLIYGQFVVANKDMEPEMVCIDSCGRANGMGVIGQDGLLFKVTLGLIRK

SEQ ID NO: 863925 - protein, 639 aa, Homo sapiens
MVWEILVSERDIRALIPLAKAEELVNTAPLTGVPQHVPVRLVTVDGGGALVEVTEHVGCESANTQVLQVSEACDAVFVAGKESRGARGVRVDFWWRRLRASLRLTVWAPLLPLRIELTDTTLEQVRGWRVPGPAEGPAEPAAEASDEAERRARGCHLQYQRAGVRFLAPFAAHPLDGGRRLTHLLGPDWLLDVSHLVAPHARVLDSRVASLEGGRVVVGREPGVTSIEVRSPLSDSILGEQALAVTDDKVSVLELRVQPVMGISLTLSRGTAHPGEVTATCWAQSALPAPKQEVALSLWLSFSDHTVAPAELYDRRDLGLSVSAEEPGAILPAEEQGAQLGVVVSGAGAEGLPLHVALHPPEPCRRGRHRVPLASGTAWLGLPPASTPAPALPSSPAWSPPATEATMGGKRQVAGSVGGNTGVRGKFERAEEEARKEETEAREEEEEEEEEMVPAPQHVTELELGMYALLGVFCVAIFIFLVNGVVFVLRYQRKEPPDSATDPTSPQPHNWVWLGTDQEELSRQLDRQSPGPPKGEGSCPCESGGGGEAPTLAPGPPGGTTSSSSTLARKEAGGRRKRVEFVTFAPAPPAQSPEEPVGAPAVQSILVAGEEDIRWVCEDMGLKDPEELRNYMERIRGSS

SEQ ID NO: 863926 - protein, 1020 aa, Homo sapiens [sequence omitted]

SEQ ID NO: 863927 - protein, 1020 aa, Homo sapiens [sequence omitted]

SEQ ID NO: 863928 - protein, 1020 aa, Homo sapiens [sequence omitted]

SEQ ID NO: 863929 - protein, 1020 aa, Homo sapiens [sequence omitted]

SEQ ID NO: 863930 - protein, 436 aa, Homo sapiens
VVRGEGTFTALFSLPCPQLLCPSMAPGSAPASSGAVIISPSYASSVDCGQAPLDPVYLPAALELLDAPEHFRVQQVGHYPPANSSLSSRSETFLLLQPWPRAQPLLRASYPPFATQQVVPPRVTEPHQRPVPWDVRAVSVEAAVTPAEPYARVLFHLKGQDWPPGSGSLPCARLHATHPAGTAHQACRFQPSLGACVVELELPSHWFSQASTTRAELAYTLEPAAEGPGGCGSGEENDPGEQALPVGGVELRPADPPQYQEVPLDEAVTLRVPDMPVRPGQLFSATLLLRHNFTASLLTLRIKVKKGLHVTAARPAQPTLWTAKLDRFKGSRHHTTLITCHRAGLTEPDSSSPLELSEFLWVDFVVENSTGGGVAVTRPVTWQLEYPGQAPEAEKDKMVWEILVSERDIRALIPLAKVRRPPSLPGKAGGQVPGAP

SEQ ID NO: 863931 - protein, 549 aa, Homo sapiens
MSAFEKQELLVIRSRRGRAAGLQQLGPGQAGAAQRCRPVPASPPCRPAEPAAEASDEAERRARGCHLQYQRAGVRFLAPFAAHPLDGGRRLTHLLGPDWLLDVSHLVAPHARVLDSRVASLEGGRVVVGREPGVTSIEVRSPLSDSILGEQALAVTDDKVSVLELRVQPVMGISLTLSRGTAHPGEVTATCWAQSALPAPKQEVALSLWLSFSDHTVAPAELYDRRDLGLSVSAEEPGAILPAEEQGAQLGVVVSGAGAEGLPLHVALHPPEPCRRGRHRVPLASGTAWLGLPPASTPAPALPSSPAWSPPATEATMGGKRQVAGSVGGNTGVRGKFERAEEEARKEETEAREEEEEEEEEMVPAPQHVTELELGMYALLGVFCVAIFIFLVNGVVFVLRYQRKEPPDSATDPTSPQPHNWVWLGTDQEELSRQLDRQSPGPPKGEGSCPCESGGGGEAPTLAPGPPGGTTSSSSTLARKEAGGRRKRVEFVTFAPAPPAQSPEEPVGAPAVQSILVAGEEDIRWVCEDMGLKDPEELRNYMERIRGSS

SEQ ID NO: 863932 - protein, 1160 aa, Homo sapiens
MAGRTTAAPRGPYGPWLCLLVALALDVVRVDCGQAPLDPVYLPAALELLDAPEHFRVQQVGHYPPANSSLSSRSETFLLLQPWPRAQPLLRASYPPFATQQVVPPRVTEPHQRPVPWDVRAVSVEAAVTPAEPYARVLFHLKGQDWPPGSGSLPCARLHATHPAGTAHQACRFQPSLGACVVELELPSHWFSQASTTRAELAYTLEPAAEGPGGCGSGEENDPGEQALPVGGVELRPADPPQYQEVPLDEAVTLRVPDMPVRPGQLFSATLLLRHNFTASLLTLRIKVKKGLHVTAARPAQPTLWTAKLDRFKGSRHHTTLITCHRAGLTEPDSSSPLELSEFLWVDFVVENSTGGGVAVTRPVTWQLEYPGQAPEAEKDKMVWEILVSERDIRALIPLAKAEELVNTAPLTGVPQHVPVRLVTVDGGGALVEVTEHVGCESANTQVLQVSEACDAVFVAGKESRGARGVRVDFWWRRLRASLRLTVWAPLLPLRIELTDTTLEQVRGWRVPGPAEGPAEPAAEASDEAERRARGCHLQYQRAGVRFLAPFAAHPLDGGRRLTHLLGPDWLLDVSHLVAPHARVLDSRVASLEGGRVVVGREPGVTSIEVRSPLSDSILGEQALAVTDDKVSVLELRVQPVMGISLTLSRGTAHPGEVTATCWAQSALPAPKQVTVGGSGGGGQHLQMGAHGRGEWEEGTLVPRPLRVFRVRTDSVRYVSSLQLEVIKQWLEYGSGRLVRWLYLRTLPITQTLGLSGRQVIDTRPLSPCVCLSACVSVFSLVSPPCGLSLWEWFLCACVRALACLCLCLCAPQEVALSLWLSFSDHTVAPAELYDRRDLGLSVSAEEPGAILPAEEQGAQLGVVVSGAGAEGLPLHVALHPPEPCRRGRHRVPLASGTAWLGLPPASTPAPALPSSPAWSPPATEATMGGKRQVAGSVGGNTGVRGKFERAEEEARKEETEAREEEEEEEEEMVPAPQHVTELELGMYALLGVFCVAIFIFLVNGVVFVLRYQRKEPPDSATDPTSPQPHNWVWLGTDQEELSRQLDRQSPGPPKGEGSCPCESGGGGEAPTLAPGPPGGTTSSSSTLARKEAGGRRKRVEFVTFAPAPPAQSPEEPVGAPAVQSILVAGEEDIRWVCEDMGLKDPEELRNYMERIRGSS

SEQ ID NO: 863933 - protein, 1211 aa, Homo sapiens
MAGRTTAAPRGPYGPWLCLLVALALDVVRVDCGQAPLDPVYLPAALELLDAPEHFRVQQVGHYPPANSSLSSRSETFLLLQPWPRAQPLLRASYPPFATQQVVPPRVTEPHQRPVPWDVRAVSVEAAVTPAEPYARVLFHLKGQDWPPGSGSLPCARLHATHPAGTAHQACRFQPSLGACVVELELPSHWFSQASTTRAELAYTLEPAAEGPGGCGSGEENDPGEQALPVGGVELRPADPPQYQEVPLDEAVTLRVPDMPVRPGQLFSATLLLRHNFTASLLTLRIKVKKGLHVTAARPAQPTLWTAKLDRFKGSRHHTTLITCHRAGLTEPDSSSPLELSEFLWVDFVVENSTGGGVAVTRPVTWQLEYPGQAPEAEKDKMVWEILVSERDIRALIPLAKAEELVNTAPLTGVPQHVPVRLVTVDGGGALVEVTEHVGCESANTQVLQVSEACDAVFVGVSGGLRKLAGLGESHWDGEGAGDTAMGPSRGQKNCPVACSSFCPPPPWAAQPMIAFCEIADFRIPLLLPCLTSPVAPSTSYSTSVLVNVACPSFPRSSPENVSPLKLRSVYAGRTLRAYDDTELQEMNTLGGGSPKPRERWPTPLESSFQALQRVSAPRVPVRERLPCGPLGSKSGDRGTAPVGSGLGRLACRWKGLTPRGADVAFEKQELLVIRSRRGRAAGLQQLGPGQAGAAQRCRPVPASPPCRPAEPAAEASDEAERRARGCHLQYQRAGVRFLAPFAAHPLDGGRRLTHLLGPDWLLDVSHLVAPHARVLDSRVASLEGGRVVVGREPGVTSIEVRSPLSDSILGEQALAVTDDKVSVLELRVQPVMGISLTLSRGTAHPGEVTATCWAQSALPAPKQEVALSLWLSFSDHTVAPAELYDRRDLGLSVSAEEPGAILPAEEQGAQLGVVVSGAGAEGLPLHVALHPPEPCRRGRHRVPLASGTAWLGLPPASTPAPALPSSPAWSPPATEATMGGKRQVAGSVGGNTGVRGKFERAEEEARKEETEAREEEEEEEEEMVPAPQHVTELELGMYALLGVFCVAIFIFLVNGVVFVLRYQRKEPPDSATDPTSPQPHNWVWLGTDQEELSRQLDRQSPGPPKGEGSCPCESGGGGEAPTLAPGPPGGTTSSSSTLARKEAGGRRKRVEFVTFAPAPPAQSPEEPVGAPAVQSILVAGEEDIRWVCEDMGLKDPEELRNYMERIRGSS

SEQ ID NO: 863934 - protein, 632 aa, Homo sapiens
SSTSKGRIGHQGLAACPVPGSMPHTLDVVRVDCGQAPLDPVYLPAALELLDAPEHFRVQQVGHYPPANSSLSSRSETFLLLQPWPRAQPLFRASLRLTVWAPLLPLRIELTDTTLEQVRGWRVPGPAEGPAEPAAEASDEAERRARGCHLQYQRAGVRFLAPFAAHPLDGGRRLTHLLGPDWLLDVSHLVAPHARVLDSRVASLEGGRVVVGREPGVTSIEVRSPLSDSILGEQALAVTDDKVSVLELRVQPVMGISLTLSRGTAHPGEVTATCWAQSALPAPKQEVALSLWLSFSDHTVAPAELYDRRDLGLSVSAEEPGAILPAEEQGAQLGVVVSGAGAEGLPLHVALHPPEPCRRGRHRVPLASGTAWLGLPPASTPAPALPSSPAWSPPATEATMGGKRQVAGSVGGNTGVRGKFERAEEEARKEETEAREEEEEEEEEMVPAPQHVTELELGMYALLGVFCVAIFIFLVNGVVFVLRYQRKEPPDSATDPTSPQPHNWVWLGTDQEELSRQLDRQSPGPPKGEGSCPCESGGGGEAPTLAPGPPGGTTSSSSTLARKEAGGRRKRVEFVTFAPAPPAQSPEEPVGAPAVQSILVAGEEDIRWVCEDMGLKDPEELRNYMERIRGSS

SEQ ID NO: 863935 - protein, 205 aa, Homo sapiens
MAGAAGLTAEVSWKVLERRARTKRSGSVYEPLKSINLPRPDNETLWDKLDHYYRIVKSTLLLYQSPTTGLFPTKTCGGDQKAKIQDSLYCAAGAWALALAYRRIDDDKGRTHELEHSAIKCMRGILYCYMRQADKVQQFKQDPRPTTCLHSVFNVHTGDELLSYEEYGHLQINAVSLYLLYLVEMISSGLQIIYNTDEMESCSVT

SEQ ID NO: 863936 - protein, 1093 aa, Homo sapiens
MAGAAGLTAEVSWKVLERRARTKRSGSVYEPLKSINLPRPDNETLWDKLDHYYRIVKSTLLLYQSPTTGLFPTKTCGGDQKAKIQDSLYCAAGAWALALAYRRIDDDKGRTHELEHSAIKCMRGILYCYMRQADKVQQFKQDPRPTTCLHSVFNVHTGDELLSYEEYGHLQINAVSLYLLYLVEMISSGLQIIYNTDEVSFIQNLVFCVERVYRVPDFGVWERGSKYNNGSTELHSSSVGLAKAALEAINGFNLFGNQGCSWSVIFVDLDAHNRNRQTLCSLLPRESRSHNTDAALLPCISYPAFALDDEVLFSQTLDKVVRKLKGKYGFKRFLRDGYRTSLEDPNRCYYKPAEIKLFDGIECEFPIFFLYMMIDGVFRGNPKQVQEYQDLLTPVLHHTTEGYPVVPKYYYVPADFVEYEKNNPGSQKRFPSNCGRDGKLFLWGQALYIIAKLLADELISPKDIDPVQRYVPLKDQRNVSMRFSNQGPLENDLVVHVALIAESQRLQVFLNTYGIQTQTPQQVEPIQIWPQQELVKAYLQLGINEKLGLSGRPDRPIGCLGTSKIYRILGKTVVCYPIIFDLSDFYMSQDVFLLIDDIKNALQFIKQYWKMHGRPLFLVLIREDNIRGSRFNPILDMLAALKKGIIGGVKVHVDRLQTLISGAVVEQLDFLRISDTEELPEFKSFEELEPPKHSKVKRQSSTPSAPELGQQPDVNISEWKDKPTHEILQKLNDCSCLASQAILLGILLKREGPNFITKEGTVSDHIERVYRRAGSQKLWSVVRRAASLLSKVVDSLAPSITNVLVQGKQVTLGAFGHEEEVISNPLSPRVIQNIIYYKCNTHDEREAVIQQELVIHIGWIISNNPELFSGMLKIRIGWIIHAMEYELQIRGGDKPALDLYQLSPSEVKQLLLDILQPQQNGRCWLNRRQIDGSLNRTPTGFYDRVWQILERTPNGIIVAGKHLPQQPTLSDMTMYEMNFSLLVEDTLGNIDQPQYRQIVVELLMVVSIVLERNPELEFQDKVDLDRLVKEAFNEFQKDQSRLKEIEKQDDMTSFYNTPPLGKRGTCSYLTKAVMNLLLEGEVKPNNDDPCLIS

SEQ ID NO: 863937 - protein, 1086 aa, Homo sapiens
MACSPDAVVSPSSAFLRSGSVYEPLKSINLPRPDNETLWDKLDHYYRIVKSTLLLYQSPTTGLFPTKTCGGDQKAKIQDSLYCAAGAWALALAYRRIDDDKGRTHELEHSAIKCMRGILYCYMRQADKVQQFKQDPRPTTCLHSVFNVHTGDELLSYEEYGHLQINAVSLYLLYLVEMISSGLQIIYNTDEVSFIQNLVFCVERVYRVPDFGVWERGSKYNNGSTELHSSSVGLAKAALEAINGFNLFGNQGCSWSVIFVDLDAHNRNRQTLCSLLPRESRSHNTDAALLPCISYPAFALDDEVLFSQTLDKVVRKLKGKYGFKRFLRDGYRTSLEDPNRCYYKPAEIKLFDGIECEFPIFFLYMMIDGVFRGNPKQVQEYQDLLTPVLHHTTEGYPVVPKYYYVPADFVEYEKNNPGSQKRFPSNCGRDGKLFLWGQALYIIAKLLADELISPKDIDPVQRYVPLKDQRNVSMRFSNQGPLENDLVVHVALIAESQRLQVFLNTYGIQTQTPQQVEPIQIWPQQELVKAYLQLGINEKLGLSGRPDRPIGCLGTSKIYRILGKTVVCYPIIFDLSDFYMSQDVFLLIDDIKNALQFIKQYWKMHGRPLFLVLIREDNIRGSRFNPILDMLAALKKGIIGGVKVHVDRLQTLISGAVVEQLDFLRISDTEELPEFKSFEELEPPKHSKVKRQSSTPSAPELGQQPDVNISEWKDKPTHEILQKLNDCSCLASQAILLGILLKREGPNFITKEGTVSDHIERVYRRAGSQKLWSVVRRAASLLSKVVDSLAPSITNVLVQGKQVTLGAFGHEEEVISNPLSPRVIQNIIYYKCNTHDEREAVIQQELVIHIGWIISNNPELFSGMLKIRIGWIIHAMEYELQIRGGDKPALDLYQLSPSEVKQLLLDILQPQQNGRCWLNRRQIDGSLNRTPTGFYDRVWQILERTPNGIIVAGKHLPQQPTLSDMTMYEMNFSLLVEDTLGNIDQPQYRQIVVELLMVVSIVLERNPELEFQDKVDLDRLVKEAFNEFQKDQSRLKEIEKQDDMTSFYNTPPLGKRGTCSYLTKAVMNLLLEGEVKPNNDDPCLIS

SEQ ID NO: 863938 - protein, 1086 aa, Homo sapiens; identical to SEQ ID NO: 863937

SEQ ID NO: 863939 - protein, 1066 aa, Homo sapiens
MACSPDAVVSPSSAFLRSGSVYEPLKSINLPRPDNETLWDKLDHYYRIVKSTLLLYQSPTTGLFPTKTCGGDQKAKIQDSLYCAAGAWALALAYRRIDDDKGRTHELEHSAIKCMRGILYCYMRQADKVQQFKQDPRPTTCLHSVFNVHTGDELLSYEEYGHLQINAVSLYLLYLVEMISSGLQIIYNTDEVSFIQNLVFCVERVYRVPDFGVWERGSKYNNGSTELHSSSVGLAKAALEAINGFNLFGNQGCSWSVIFVDLDAHNRNRQTLCSLLPRESRSHNTDAALLPCISYPAFALDDEVLFSQTLDKVVRKLKGKYGFKRFLRDGYRTSLEDPNRCYYKPAEIKLFDGIECEFPIFFLYMMIDGVFRGNPKQVQEYQDLLTPVLHHTTEGYPVVPKYYYVPADFVEYEKNNPGSQKRFPSNCGRDGKLFLWGQALYIIAKLLADELISPKDIDPVQRYVPLKDQRNVSMRFSNQGPLENDLVVHVALIAESQRLQVFLNTYGIQTQTPQQVEPIQIWPQQELVKAYLQLGINEKLGLSGRPDRPIGCLGTSKIYRILGKTVVCYPIIFDLSDFYMSQDVFLLIDDIKNALQFIKQYWKMHGRPLFLVLIREDNIRGSRFNPILDMLAALKKGIIGGVKVHVDRLQTLISGAVVEQLDFLRISDTEELPEFKSFEELEPPKHSKVKRQSSTPSAPELGQQPDVNISEWKDKPTHEILQKLNDCSCLASQAILLGILLKREGPNFITKEGTVSDHIERVYRRAGSQKLWSVVRRAASLLSKVVDSLAPSITNVLVQGKQVTLGAFGHEEEVISNPLSPRVIQNIIYYKCNTHDEREAVIQQELVIHIGWIISNNPELFSGMLKIRIGWIIHAMEYELQIRGGDKPALDLYQLSPSEVKQLLLDILQPQQNGRCWLNRRQIDGSLNRTPTGFYDRVWQILERTPNGIIVAGKHLPQQPTLSDMTMYEMNFSLLVEDTLGNIDQPQYRQIVVELLMVVSIVLERNPELEFQDKVDLDRLVKEAFNEFQKDQSRLKEIEKQLTQILPVNSLQTEDRMPCLLFSFVG

SEQ ID NO: 863940 - protein, 334 aa, Homo sapiens
MHSSSFRFVNIWPALFFAPRSVVRRAASLLSKVVDSLAPSITNVLVQGKQVTLGAFGHEEEVISNPLSPRVIQNIIYYKCNTHDEREAVIQQELVIHIGWIISNNPELFSGMLKIRIGWIIHAMEYELQIRGGDKPALDLYQLSPSEVKQLLLDILQPQQNGRCWLNRRQIDGSLNRTPTGFYDRVWQILERTPNGIIVAGKHLPQQPTLSDMTMYEMNFSLLVEDTLGNIDQPQYRQIVVELLMVVSIVLERNPELEFQDKVDLDRLVKEAFNEFQKDQSRLKEIEKQDDMTSFYNTPPLGKRGTCSYLTKAVMNLLLEGEVKPNNDDPCLIS

SEQ ID NO: 863941 - protein, 1085 aa, Homo sapiens
MACSPDAVVSPSSAFLRSGSVYEPLKSINLPRPDNETLWDKLDHYYRIVKSTLLLYQSPTTGLFPTKTCGGDQKAKIQDSLYCAAGAWALALAYRRIDDDKGRTHELEHSAIKCMRGILYCYMRQADKVQQFKQDPRPTTCLHSVFNVHTGDELLSYEEYGHLQINAVSLYLLYLVEMISSGLQIIYNTDEVSFIQNLVFCVERVYRVPDFGVWERGSKYNNGSTELHSSSVGLAKAALEAINGFNLFGNQGCSWSVIFVDLDAHNRNRQTLCSLLPRESRSHNTDAALLPCISYPAFALDDEVLFSQTLDKVVRKLKGKYGFKRFLRDGYRTSLEDPNRCYYKPAEIKLFDGIECEFPIFFLYMMIDGVFRGNPKQVQEYQDLLTPVLHHTTEGYPVVPKYYYVPADFVEYEKNNPGSQKRFPSNCGRDGKLFLWGQALYIIAKLLADELISPKDIDPVQRYVPLKDQRNVSMRFSNQGPLENDLVVHVALIAESQRLQVFLNTYGIQTQTPQQVEPIQIWPQQELVKAYLQLGINEKLGLSGRPDRPIGCLGTSKIYRILGKTVVCYPIIFDLSDFYMSQDVFLLIDDIKNALQFIKQYWKMHGRPLFLVLIREDNIRGSRFNPILDMLAALKKGIIGGVKVHVDRLQTLISGAVVEQLDFLRISDTEELPEFKSFEELEPPKHSKVKRQSSTPSAPELGQQPDVNISEWKDKPTHEILQKLNDCSCLASQAILLGILLKREGPNFITKEGTVSDHIERVYRRAGSQKLWSVVRRAASLLSKVVDSLAPSITNVLVQGKQVTLGAFGHEEEVISNPLSPRVIQNIIYYKCNTHDEREAVIQQELVIHIGWIISNNPELFSGMLKIRIGWIIHAMEYELQIRGGDKPALDLYQLSPSEVKQLLLDILQPQQNGRCWLNRRQIDGSLNRTPTGFYDRVWQILERTPNGIIVAGKHLPQQPTLSDMTMYEMNFSLLVEDTLGNIDQPQYRQIVVELLMVVSIVLERNPELEFQDKVDLDRLVKEAFNEFQKDQSRLKEIEKQDDMTSFYNTPPLGKRGTCSYLTKAVMNLLLEGEPLIYELSMLGR

SEQ ID NO: 863942 - protein, 791 aa, Homo sapiens [sequence omitted]

SEQ ID NO: 863943 - protein, 896 aa, Homo sapiens
MACSPDAVVSPSSAFLRSGSVYEPLKSINLPRPDNETLWDKLDHYYRIVKSTLLLYQSPTTGLFPTKTCGGDQKAKIQDSLYCAAGAWALALAYRRIDDDKGRTHELEHSAIKCMRGILYCYMRQADKVQQFKQDPRPTTCLHSVFNVHTGDELLSYEEYGHLQINAVSLYLLYLVEMISSGLQIIYNTDEVSFIQNLVFCVERVYRVPDFGVWERGSKYNNGSTELHSSSVGLAKAALEAINGFNLFGNQGCSWSVIFVDLDAHNRNRQTLCSLLPRESRSHNTDAALLPCISYPAFALDDEVLFSQTLDKVVRKLKGKYGFKRFLRDGYRTSLEDPNRCYYKPAEIKLFDGIECEFPIFFLYMMIDGVFRGNPKQVQEYQDLLTPVLHHTTEGYPVVPKYYYVPADFVEYEKNNPGSQKRFPSNCGRDGKLFLWGQALYIIAKLLADELISPKDIDPVQRYVPLKDQRNVSMRFSNQGPLENDLVVHVALIAESQRLQVFLNTYGIQTQTPQQVEPIQIWPQQELVKAYLQLGINEKLGLSGRPDRPIGCLGTSKIYRILGKTVVCYPIIFDLSDFYMSQDVFLLIDDIKNALQFIKQYWKMHGRPLFLVLIREDNIRGSRFNPILDMLAALKKGIIGGVKVHVDRLQTLISGAVVEQLDFLRISDTEELPEFKSFEELEPPKHSKVKRQSSTPSAPELGQQPDVNISEWKDKPTHEILQKLNDCSCLASQAILLGILLKREGPNFITKEGTVSDHIERVYRRAGSQKLWSVVRRAASLLSKVVDSLAPSITNVLVQGKQVTLGAFGHEEEVISNPLSPRVIQNIIYYKCNTHDEREAVIQQELVIHIGWIISNNPELFSGMLKIRIGFAKAVCSHKRSSPWRRGPFQPWLSPL

SEQ ID NO: 863944 - protein, 453 aa, Homo sapiens
MACSPDAVVSPSSAFLRSGSVYEPLKSINLPRPDNETLWDKLDHYYRIVKSTLLLYQSPTTGLFPTKTCGGDQKAKIQDSLYCAAGAWALALAYRRIDDDKGRTHELEHSAIKCMRGILYCYMRQADKVQQFKQDPRPTTCLHSVFNVHTGDELLSYEEYGHLQINAVSLYLLYLVEMISSGLQIIYNTDEVSFIQNLVFCVERVYRVPDFGVWERGSKYNNGSTELHSSSVGLAKAALEAINGFNLFGNQGCSWSVIFVDLDAHNRNRQTLCSLLPRESRSHNTDAALLPCISYPAFALDDEVLFSQTLDKVVRKLKGKYGFKRFLRDGYRTSLEDPNRCYYKPAEIKLFDGIECEFPIFFLYMMIDGVFRGNPKQVQEYQDLLTPVLHHTTEGYPVVPKYYYVPADFVEYEKNNPGSQKRFPSNCGRDGKLFLWGQALYIIAKLLETLPLS

SEQ ID NO: 863945 - protein, 256 aa, Homo sapiens
MAGAAGLTAEVSWKVLERRARTKRSGSVYEPLKSINLPRPDNETLWDKLDHYYRIVKSTLLLYQSPTTGLFPTKTCGGDQKAKIQDSLYCAAGAWALALAYRRIDDDKGRTHELEHSAIKCMRGILYCYMRQADKVQQFKQDPRPTTCLHSVFNVHTGDELLSYEEYGHLQINAVSLYLLYLVEMISSGLQIIYNTDEVSFIQNLVFCVERVYRVPDFGVWERGSKYNNGSTELHSSSGLASWSSIFGDLDAHSHG

SEQ ID NO: 863946 - protein, 1093 aa, Homo sapiens; identical to SEQ ID NO: 863936

SEQ ID NO: 863947 - protein, 1086 aa, Homo sapiens; identical to SEQ ID NO: 863937

SEQ ID NO: 863948 - protein, 223 aa, Homo sapiens
MLKIRIGWIIHAMEYELQIRGGDKPALDLYQLSPSEVKQLLLDILQPQQNGRCWLNRRQIDGSLNRTPTGFYDRVWQILERTPNGIIVAGKHLPQQPTLSDMTMYEMNFSLLVEDTLGNIDQPQYRQIVVELLMVVSIVLERNPELEFQDKVDLDRLVKEAFNEFQKDQSRLKEIEKQDDMTSFYNTPPLGKRGTCSYLTKAVMNLLLEGEVKPNNDDPCLIS

SEQ ID NO: 863949 - protein, 1059 aa, Homo sapiens
MACSPDAVVSPSSAFLRSGSVYEPLKSINLPRPDNETLWDKLDHYYRIVKSTLLLYQSPTTGLFPTKTCGGDQKAKIQDSLYCAAGAWALALAYRRIDDDKGRTHELEHSAIKCMRGILYCYMRQADKVQQFKQDPRPTTCLHSVFNVHTGDELLSYEEYGHLQINAVSLYLLYLVEMISSGLQIIYNTDEVSFIQNLVFCVERVYRVPDFGVWERGSKYNNGSTELHSSSVGLAKAALEAINGFNLFGNQGCSWSVIFVDLDAHNRNRQTLCSLLPRESRSHNTDAALLPCISYPAFALDDEVLFSQTLDKVVRKLKGKYGFKRFLRDGYRTSLEDPNRCYYKPAEIKLFDGIECEFPIFFLYMMIDGVFRGNPKQVQEYQDLLTPVLHHTTEGYPVVPKYYYVPADFVEYEKNNPGSQKRFPSNCGRDGKLFLWGQALYIIAKLLADELISPKDIDPVQRYVPLKDQRNVSMRFSNQGPLENDLVVHVALIAESQRLQVFLNTYGIQTQTPQQVEPIQIWPQQELVKAYLQLGINEKLGLSGRPDRPIGCLGTSKIYRILGKTVVCYPIIFDLSDFYMSQDVFLLIDDIKNALQFIKQYWKMHGRPLFLVLIREDNIRGSRFNPILDMLAALKKGIIGGVKVHVDRLQTLISGAVVEQLDFLRISDTEELPEFKSFEELEPPKHSKVKRQSSTPSAPELGQQPDVNISEWKDKPTHEILQKLNDCSCLASQAILLGILLKREGPNFITKEGTVSDHIERVYRRAGSQKLWSVVRRAASLLSKVVDSLAPSITNVLVQGKQVTLGAFGHEEEVISNPLSPRVIQNIIYYKCNTHDEREAVIQQELVIHIGWIISNNPELFSGMLKIRIGWIIHAMEYELQIRGGDKPALDLYQLSPSEVKQLLLDILQPQQNGRCWLNRRQIDGSLNRTPTGFYDRVWQILERTPNGIIVAGKHLPQQPTLSDMTMYEMNFSLLVEDTLGNIDQPQYRQIVVELLMVVSIVLERNPELEFQDKVDLDRLVKEAFNEFQKDQSRLKEIEKQDDMTSFYNTPPLGSQAKQ

SEQ ID NO: 863950 - protein, 181 aa, Homo sapiens
NSETFAFCYRCWLNRRQIDGSLNRTPTGFYDRVWQILERTPNGIIVAGKHLPQQPTLSDMTMYEMNFSLLVEDTLGNIDQPQYRQIVVELLMVVSIVLERNPELEFQDKVDLDRLVKEAFNEFQKDQSRLKEIEKQDDMTSFYNTPPLGKRGTCSYLTKAVMNLLLEGEVKPNNDDPCLIS

SEQ ID NO: 863951 - protein, 488 aa, Homo sapiens
MACSPDAVVSPSSAFLRSGSVYEPLKSINLPRPDNETLWDKLDHYYRIVKSTLLLYQSPTTGLFPTKTCGGDQKAKIQDSLYCAAGAWALALAYRRIDDDKGRTHELEHSAIKCMRGILYCYMRQADKVQQFKQDPRPTTCLHSVFNVHTGDELLSYEEYGHLQINAVSLYLLYLVEMISSGLQIIYNTDEVSFIQNLVFCVERVYRVPDFGVWERGSKYNNGSTELHSSSVGLAKAALEAINGFNLFGNQGCSWSVIFVDLDAHNRNRQTLCSLLPRESRSHNTDAALLPCISYPAFALDDEVLFSQTLDKVVRKLKGKYGFKRFLRDGYRTSLEDPNRCYYKPAEIKLFDGIECEFPIFFLYMMIDGVFRGNPKQVQEYQDLLTPVLHHTTEGYPVVPKYYYVPADFVEYEKNNPGSQKRFPSNCGRDGKLFLWGQALYIIAKLLADELISPKDIDPVQRYVPLKDQRNVSMRFSNQVDNVSLREV

SEQ ID NO: 863952 - protein, 245 aa, Homo sapiens
MFFFFSVQGCSWSVIFVDLDAHNRNRQTLCSLLPRESRSHNTDAALLPCISYPAFALDDEVLFSQTLDKVVRKLKGKYGFKRFLRDGYRTSLEDPNRCYYKPAEIKLFDGIECEFPIFFLYMMIDGVFRGNPKQVQEYQDLLTPVLHHTTEGYPVVPKYYYVPADFVEYEKNNPGSQKRFPSNCGRDGKLFLWGQALYIIAKLLADELISPKDIDPVQRYVPLKDQRNVSMRFSNQVDNVSLREV

SEQ ID NO: 863953 - protein, 111 aa, Homo sapiens
FHLYVTTTVSNSQQAYQEAFEISKKEMQPTHPIRLGLALNFSVFYYEILNSPEKACSLAKTAFDEAIAELDTLNEESYKDSTLIMQLLRDNLTLWTSENQGDEGDAGEGEN

SEQ ID NO: 863954 - protein, 111 aa, Homo sapiens; identical to SEQ ID NO: 863953

SEQ ID NO: 863955 - protein, 111 aa, Homo sapiens; identical to SEQ ID NO: 863953

SEQ ID NO: 863956 - protein, 111 aa, Homo sapiens; identical to SEQ ID NO: 863953

SEQ ID NO: 863957 - protein, 111 aa, Homo sapiens; identical to SEQ ID NO: 863953

SEQ ID NO: 863958 - protein, 111 aa, Homo sapiens; identical to SEQ ID NO: 863953

SEQ ID NO: 863959 - protein, 111 aa, Homo sapiens; identical to SEQ ID NO: 863953

SEQ ID NO: 863960 - protein, 111 aa, Homo sapiens; identical to SEQ ID NO: 863953

SEQ ID NO: 863961 - protein, 111 aa, Homo sapiens; identical to SEQ ID NO: 863953

SEQ ID NO: 863962 - protein, 111 aa, Homo sapiens; identical to SEQ ID NO: 863953

SEQ ID NO: 863963 - protein, 111 aa, Homo sapiens; identical to SEQ ID NO: 863953

SEQ ID NO: 863964 - protein, 89 aa, Homo sapiens
AAAYYYYCSEFKLLTMYGDMLFVPVTQVSQVHSSQVSAQMCLRRPYIQGSCVNTAVGRIENSQAYQSHRITPLPLIFHLAVESICLSIC

SEQ ID NO: 863965 - protein, 111 aa, Homo sapiens; identical to SEQ ID NO: 863953

SEQ ID NO: 863966 - protein, 111 aa, Homo sapiens; identical to SEQ ID NO: 863953

SEQ ID NO: 863967 - protein, 111 aa, Homo sapiens; identical to SEQ ID NO: 863953

SEQ ID NO: 863968 - protein, 94 aa, Homo sapiens
FHLYVTTTVSNSQQAYQEAFEISKKEMQPTHPIRLGLALNFSVFYYEILNSPEKACSLAKTAFDEAIAELDTLNEESYKDSNSDHASYLGTISL

SEQ ID NO: 863969 - protein, 111 aa, Homo sapiens; identical to SEQ ID NO: 863953

SEQ ID NO: 863970 - protein, 111 aa, Homo sapiens; identical to SEQ ID NO: 863953

SEQ ID NO: 863971 - protein, 111 aa, Homo sapiens; identical to SEQ ID NO: 863953

SEQ ID NO: 863972 - protein, 111 aa, Homo sapiens; identical to SEQ ID NO: 863953

SEQ ID NO: 863973 - protein, 111 aa, Homo sapiens; identical to SEQ ID NO: 863953

SEQ ID NO: 863974 - protein, 111 aa, Homo sapiens; identical to SEQ ID NO: 863953

SEQ ID NO: 863975 - protein, 1011 aa, Homo sapiens
MGAYARASGVCARGCLDSAGPWTMSRALRPPLPPLCFFLLLLAAAGARAGGYETCPTVQPNMLNVHLLPHTHDDVGWLKTVDQYFYGIKNDIQHAGVQYILDSVISALLADPTRRFIYVEIAFFSRWWHQQTNATQEVVRDLVRQGRLEFANGGWVMNDEAATHYGAIVDQMTLGLRFLEDTFGNDGRPRVAWHIDPFGHSREQASLFAQMGFDGFFFGRLDYQDKWVRMQKLEMEQVWRASTSLKPPTADLFTGVLPNGYNPPRNLCWDVLCVDQPLVEDPRSPEYNAKELVDYFLNVATAQGRYYRTNHTVMTMGSDFQYENANMWFKNLDKLIRLVNAQQAKGSSVHVLYSTPACYLWELNKANLTWSVKHDDFFPYADGPHQFWTGYFSSRPALKRYERLSYNFLQVCNQLEALVGLAANVGPYGSGDSAPLNEAMAVLQHHDAVSGTSRQHVANDYARQLAAGWGPCEVLLSNALARLRGFKDHFTFCQQLNISICPLSQTAARFQVIVYNPLGRKVNWMVRLPVSEGVFVVKDPNGRTVPSDVVIFPSSDSQAHPPELLFSASLPALGFSTYSVAQVPRWKPQARAPQPIPRRSWSPALTIENEHIRATFDPDTGLLMEIMNMNQQLLLPVRQTFFWYNASIGDNESDQASGAYIFRPNQQKPLPVSRWAQIHLVKTPLVQEVHQNFSAWCSQVVRLYPGQRHLELEWSVGPIPVGDTWGKEVISRFDTPLETKGRFYTDSNGREILERRRDYRPTWKLNQTEPVAGNYYPVNTRIYITDGNMQLTVLTDRSQGGSSLRDGSLELMVHRRLLKDDGRGVSEPLMENGSGAWVRGRHLVLLDTAQAAAAGHRLLAEQEVLAPQVVLAPGGGAAYNLGAPPRTQFSGLRRDLPPSVHLLTLASWGPEMVLLRLEHQFAVGEDSGRNLSAPVTLNLRDLFSTFTITRLQETTLVANQLREAASRLKWTTNTGPTPHQTPYQLDPANITLEPMEIRTFLASVQWKEVDG

SEQ ID NO: 863976 - protein, 471 aa, Homo sapiens
MGVWVLLIQVFVLGFWVLLPRCGRFWGPLSRHSGRGDHSPGEARFPADAGGREPSRRRCRQKTASAQTKQHIRATFDPDTGLLMEIMNMNQQLLLPVRQTFFWYNASIGDNESDQASGAYIFRPNQQKPLPVSRWAQIHLVKTPLVQEVHQNFSAWCSQVVRLYPGQRHLELEWSVGPIPVGDTWGKEVISRFDTPLETKGRFYTDSNGREILERRRDYRPTWKLNQTEPVAGNYYPVNTRIYITDGNMQLTVLTDRSQGGSSLRDGSLELMVHRRLLKDDGRGVSEPLMENGSGAWVRGRHLVLLDTAQAAAAGHRLLAEQEVLAPQVVLAPGGGAAYNLGAPPRTQFSGLRRDLPPSVHLLTLASWGPEMVLLRLEHQFAVGEDSGRNLSAPVTLNLRDLFSTFTITRLQETTLVANQLREAASRLKWTTNTGPTPHQTPYQLDPANITLEPMEIRTFLASVQWKEVDG

SEQ ID NO: 863977 - protein, 1011 aa, Homo sapiens; identical to SEQ ID NO: 863975

SEQ ID NO: 863978 - protein, 1011 aa, Homo sapiens; identical to SEQ ID NO: 863975

SEQ ID NO: 863979 - protein, 1011 aa, Homo sapiens; identical to SEQ ID NO: 863975

SEQ ID NO: 863980 - protein, 572 aa, Homo sapiens
MAVLQHHDAVSGTSRQHVANDYARQLAAGWGPCEVLLSNALARLRGFKDHFTFCQQLNISICPLSQTAARFQVIVYNPLGRKVNWMVRLPVSEGVFVVKDPNGRTVPSDVVIFPSSDSQAHPPELLFSASLPALGFSTYSVAQVPRWKPQARAPQPIPRRSWSPALTIENEHIRATFDPDTGLLMEIMNMNQQLLLPVRQTFFWYNASIGDNESDQASGAYIFRPNQQKPLPVSRWAQIHLVKTPLVQEVHQNFSAWCSQVVRLYPGQRHLELEWSVGPIPVGDTWGKEVISRFDTPLETKGRFYTDSNGREILERRRDYRPTWKLNQTEPVAGNYYPVNTRIYITDGNMQLTVLTDRSQGGSSLRDGSLELMVHRRLLKDDGRGVSEPLMENGSGAWVRGRHLVLLDTAQAAAAGHRLLAEQEVLAPQVVLAPGGGAAYNLGAPPRTQFSGLRRDLPPSVHLLTLASWGPEMVLLRLEHQFAVGEDSGRNLSAPVTLNLRDLFSTFTITRLQETTLVANQLREAASRLKWTTNTGPTPHQTPYQLDPANITLEPMEIRTFLASVQWKEVDG

SEQ ID NO: 863981 - protein, 572 aa, Homo sapiens; identical to SEQ ID NO: 863980

SEQ ID NO: 863982 - protein, 743 aa, Homo sapiens
MGAYARASGVCARGCLDSAGPWTMSRALRPPLPPLCFFLLLLAAAGARAGGYETCPTVQPNMLNVHLLPHTHDDVGWLKTVDQYFYGIKNDIQHAGVQYILDSVISALLADPTRRFIYVEIAFFSRWWHQQTNATQEVVRDLVRQGRLEFANGGWVMNDEAATHYGAIVDQMTLGLRFLEDTFGNDGRPRVAWHIDPFGHSREQASLFAQMGFDGFFFGRLDYQDKWVRMQKLEMEQVWRASTSLKPPTADLFTGVLPNGYNPPRNLCWDVLCVDQPLVEDPRSPEYNAKELVDYFLNVATAQGRYYRTNHTVMTMGSDFQYENANMWFKNLDKLIRLVNAQQAKGSSVHVLYSTPACYLWELNKANLTWSVKHDDFFPYADGPHQFWTGYFSSRPALKRYERLSYNFLQVCNQLEALVGLAANVGPYGSGDSAPLNEAMAVLQHHDAVSGTSRQHVANDYARQLAAGWGPCEVLLSNALARLRGFKDHFTFCQQLNISICPLSQTAARFQVIVYNPLGRKVNWMVRLPVSEGVFVVKDPNGRTVPSDVVIFPSSDSQAHPPELLFSASLPALGFSTYSVAQVPRWKPQARAPQPIPRRSWSPALTIENEHIRATFDPDTGLLMEIMNMNQQLLLPVRQTFFWYNASIGDNESDQASGAYIFRPNQQKPLPVSRWAQIHLVKTPLVQEVHQNFSAWCSQVVRLYPGQRHLELEWSVGPIPVGDTWGKEVISRFDTPAWSTSLP

SEQ ID NO: 863983 - protein, 812 aa, Homo sapiens
MGAYARASGVCARGCLDSAGPWTMSRALRPPLPPLCFFLLLLAAAGARAGGYETCPTVQPNMLNVHLLPHTHDDVGWLKTVDQYFYGIKNDIQHAGVQYILDSVISALLADPTRRFIYVEIAFFSRWWHQQTNATQEVVRDLVRQGRLEFANGGWVMNDEAATHYGAIVDQMTLGLRFLEDTFGNDGRPRVAWHIDPFGHSREQASLFAQMGFDGFFFGRLDYQDKWVRMQKLEMEQVWRASTSLKPPTADLFTGVLPNGYNPPRNLCWDVLCVDQPLVEDPRSPEYNAKELVDYFLNVATAQGRYYRTNHTVMTMGSDFQYENANMWFKNLDKLIRLVNAQQAKGSSVHVLYSTPACYLWELNKANLTWSVKHDDFFPYADGPHQFWTGYFSSRPALKRYERLSYNFLQVCNQLEALVGLAANVGPYGSGDSAPLNEAMAVLQHHDAVSGTSRQHVANDYARQLAAGWGPCEVLLSNALARLRGFKDHFTFCQQLNISICPLSQTAARFQVIVYNPLGRKVNWMVRLPVSEGVFVVKDPNGRTVPSDVVIFPSSDSQAHPPELLFSASLPALGFSTYSVAQVPRWKPQARAPQPIPRRSWSPALTIENEHIRATFDPDTGLLMEIMNMNQQLLLPVRQTFFWYNASIGDNESDQASGAYIFRPNQQKPLPVSRWAQIHLVKTPLVQEVHQNFSAWCSQVVRLYPGQRHLELEWSVGPIPVGDTWGKEVISRFDTPLETKGRFYTDSNGREILERRRDYRPTWKLNQTEPVAGNYYPVNTRIYITLDPANITLEPMEIRTFLASVQWKEVDG

SEQ ID NO: 863984 - protein, 358 aa, Homo sapiens
MGAYARASGVCARGCLDSAGPWTMSRALRPPLPPLCFFLLLLAAAGARAGGYETCPTVQPNMLNVHLLPHTHDDVGWLKTVDQYFYGIKNDIQHAGVQYILDSVISALLADPTRRFIYVEIAFFSRWWHQQTNATQEVVRDLVRQGRLEFANGGWVMNDEAATHYGAIVDQMTLGLRFLEDTFGNDGRPRVAWHIDPFGHSREQASLFAQMGFDGFFFGRLDYQDKWVRMQKLEMEQVWRASTSLKPPTADLFTGVLPNGYNPPRNLCWDVLCVDQPLVEDPRSPEYNAKELVDYFLNVATAQGRYYRTNHTVMTMGSDFQYENANMWFKNLDPANITLEPMEIRTFLASVQWKEVDG

SEQ ID NO: 863985 - protein, 277 aa, Homo sapiens
KKKKKRVGEPDPKPDQLTPNPRRDYRPTWKLNQTEPVAGNYYPVNTRIYITDGNMQLTVLTDRSQGGSSLRDGSLELMVHRRLLKDDGRGVSEPLMENGSGAWVRGRHLVLLDTAQAAAAGHRLLAEQEVLAPQVVLAPGGGAAYNLGAPPRTQFSGLRRDLPPSVHLLTLASWGPEMVLLRLEHQFAVGEDSGRNLSAPVTLNLRDLFSTFTITRLQETTLVANQLREAASRLKWTTNTGPTPHQTPYQLDPANITLEPMEIRTFLASVQWKEVDG

SEQ ID NO: 863986 - protein, 171 aa, Homo sapiens
LFLSVFLHLLPRLPPRSGVPYPGPPVRHLPPSGLVPMPTWILPLLGLPYQTLTFILIRSSHPLISFDIPTRPYPVSGPRTPTNPRLSPPPGHSPPQVHRRLLKDDGRGVSEPLMENGSGAWVRGRHLVLLDTAQAAAAGHRLLAEQEVLAPQVVLAPGGGAAYNLGAPPRT

SEQ ID NO: 863987 - protein, 1011 aa, Homo sapiens; identical to SEQ ID NO: 863975

SEQ ID NO: 863988 - protein, 875 aa, Homo sapiens
MRRSVKHDDFFPYADGPHQFWTGYFSSRPALKRYERLSYNFLQVCNQLEALVGLAANVGPYGSGDSAPLNEAMAVLQHHDAVSGTSRQHVANDYARQLAAGWGPCEVLLSNALARLRGFKDHFTFCQQLNISICPLSQTAARFQVIVYNPLGRKVNWMVRLPVSEGVFVVKDPNGRTVPSDVSPNNEYSPAGTPPPVGISSSPPWISPASMNTSHSCISLPPSCIFSLCPLISVSPWEHMPPVSGPPFFFFFGDGVSLCHPGWSAVARSWLTSNSACWIIGMSHRAWLVLHFNTPLPQENLLLFMDISFIPENVLPQTSSSPENLPQGFLPLLPPSLPRLHGLSTLPVGFFFHLVNLLCKSFPWNLTVPPPHTPPFPFPISGLFSFLEFFVSMHVQLSMGTLDSVSLLLYPEVVIFPSSDSQAHPPELLFSASLPALGFSTYSVAQVPRWKPQARAPQPIPRRSWSPALTIENEHIRATFDPDTGLLMEIMNMNQQLLLPVRQTFFWYNASIGDNESDQASGAYIFRPNQQKPLPVSRWAQIHLVKTPLVQEVHQNFSAWCSQVVRLYPGQRHLELEWSVGPIPVGDTWGKEVISRFDTPLETKGRFYTDSNGREILERRRDYRPTWKLNQTEPVAGNYYPVNTRIYITDGNMQLTVLTDRSQGGSSLRDGSLELMVHRRLLKDDGRGVSEPLMENGSGAWVRGRHLVLLDTAQAAAAGHRLLAEQEVLAPQVVLAPGGGAAYNLGAPPRTQFSGLRRDLPPSVHLLTLASWGPEMVLLRLEHQFAVGEDSGRNLSAPVTLNLRDLFSTFTITRLQETTLVANQLREAASRLKWTTNTGPTPHQTPYQLDPANITLEPMEIRTFLASVQWKEVDG

SEQ ID NO: 863989 - protein, 1023 aa, Homo sapiens
MGAYARASGVCARGCLDSAGPWTMSRALRPPLPPLCFFLLLLAAAGARAGGYETCPTVQPNMLNVHLLPHTHDDVGWLKTVDQYFYGIKNDIQHAGVQYILDSVISALLADPTRRFIYVEIAFFSRWWHQQTNATQEVVRDLVRQGRLEFANGGWVMNDEAATHYGAIVDQMTLGLRFLEDTFGNDGRPRVAWHIDPFGHSREQASLFAQMGFDGFFFGRLDYQDKWVRMQKLEMEQVWRASTSLKPPTADLFTGVLPNGYNPPRNLCWDVLCVDQPLVEDPRSPEYNAKELVDYFLNVATAQGRYYRTNHTVMTMGSDFQYENANMWFKNLDKLIRLVNAQQAKGSSVHVLYSTPACYLWELNKANLTWSVKHDDFFPYADGPHQFWTGYFSSRPALKRYERLSYNFLQVCNQLEALVGLAANVGPYGSGDSAPLNEAMAVLQHHDAVSGTSRQHVANDYARQLAAGWGPCEVLLSNALARLRGFKDHFTFCQQLNISICPLSQTAARFQVIVYNPLGRKVNWMVRLPVSEGVFVVKDPNGRTVPSDVVIFPSSDSQAHPPELLFSASLPALGFSTYSVAQVPRWKPQARAPQPIPRRSWSPALTIENEHIRATFDPDTGLLMEIMNMNQQLLLPVRQTFFWYNASIGDNESDQASGAYIFRPNQQKPLPVSRWAQIHLVKTPLVQEVHQNFSAWCSQVVRLYPGQRHLELEWSVGPIPVGDTWGKEVISRFDTPLETKGRFYTDSNGREILERRRDYRPTWKLNQTEPVAGNYYPVNTRIYITDGNMQLTVLTDRSQGGSSLRDGSLELMVHRRLLKDDGRGVSEPLMENGSGAWVRGRHLVLLDTAQAAAAGHRLLAEQEVLAPQVVLAPGGGAAYNLGAPPRTQFSGLRRDLPPSVHLLTLASWGPEMVLLRLEHQFAVGEDSGRNLSAPVTLNLRDLFSTFTITRLQETTLVANQLREAASRLKWTTNTGPTPHQTPYQLDPANITLEPMEIRTFLASVQWKEKDFDSLWGCGIKTLY

SEQ ID NO: 863990 - protein, 479 aa, Homo sapiens
KLGNAWKDPNGRVPSDVVIFPSSDSQAHPPELLFSASLPALGFSTYSVAQVPRWKPQARAPQPIPRRSWSPALTIENEHIRATFDPDTGLLMEIMNMNQQLLLPVRQTFFWYNASIGDNESDQASGAYIFRPNQQKPLPVSRWAQIHLVKTPLVQEVHQNFSAWCSQVVRLYPGQRHLELEWSVGPIPVGDTWGKEVISRFDTPLETKGRFYTDSNGREILERRRDYRPTWKLNQTEPVAGNYYPVNTRIYITDGNMQLTVLTDRSQGGSSLRDGSLELMVHRRLLKDDGRGVSEPLMENGSGAWVRGRHLVLLDTAQAAAAGHRLLAEQEVLAPQVVLAPGGGAAYNLGAPPRTQFSGLRRDLPPSVHLLTLASWGPEMVLLRLEHQFAVGEDSGRNLSAPVTLNLRDLFSTFTITRLQETTLVANQLREAASRLKWTTNTGPTPHQTPYQLDPANITLEPMEIRTFLASVQWKEVDG

SEQ ID NO: 863991 - protein, 723 aa, Homo sapiens
MGAYARASGVCARGCLDSAGPWTMSRALRPPLPPLCFFLLLLAAAGARAGGYETCPTVQPNMLNVHLLPHTHDDVGWLKTVDQYFYGIKNDIQHAGVQYILDSVISALLADPTRRFIYVEIAFFSRWWHQQTNATQEVVRDLVRQGRLEFANGGWVMNDEAATHYGAIVDQMTLGLRFLEDTFGNDGRPRVAWHIDPFGHSREQASLFAQMGFDGFFFGRLDYQDKWVRMQKLEMEQVWRASTSLKPPTADLFTGVLPNGYNPPRNLCWDVLCVDQPLVEDPRSPEYNAKELVDYFLNVATAQGRYYRTNHTVMTMGSDFQYENANMWFKNLDKLIRLVNAQQAKGSSVHVLYSTPACYLWELNKANLTWSVKHDDFFPYADGPHQFWTGYFSSRPALKRYERLSYNFLQVCNQLEALVGLAANVGPYGSGDSAPLNEAMAVLQHHDAVSGTSRQHVANDYARQLAAGWGPCEVLLSNALARLRGFKDHFTFCQQLNISICPLSQTAARFQVIVYNPLGRKVNWMVRLPVSEGVFVVKDPNGRTVPSDVVIFPSSDSQAHPPELLFSASLPALGFSTYSVAQVPRWKPQARAPQPIPRRSWSPALTIENEHIRATFDPDTGLLMEIMNMNQQLLLPVRQTFFWYNASIGDNESDQAPPGSSGQQTQAPHPTKLRTSWTRPTSRWNPWKSALSWPQFNGRRWMVRSAGMGPPSPSLLLRGQTRL

SEQ ID NO: 863992 - protein, 810 aa, Homo sapiens
MGAYARASGVCARGCLDSAGPWTMSRALRPPLPPLCFFLLLLAAAGARAGGYETCPTVQPNMLNVHLLPHTHDDVGWLKTVDQYFYGIKNDIQHAGVQYILDSVISALLADPTRRFIYVEIAFFSRWWHQQTNATQEVVRDLVRQGRLEFANGGWVMNDEAATHYGAIVDQMTLGLRFLEDTFGNDGRPRVAWHIDPFGHSREQASLFAQMGFDGFFFGRLDYQDKWVRMQKLEMEQVWRASTSLKPPTADLFTGVLPNGYNPPRNLCWDVLCVDQPLVEDPRSPEYNAKELVDYFLNVATAQGRYYRTNHTVMTMGSDFQYENANMWFKNLDKLIRLVNAQQAKGSSVHVLYSTPACYLWELNKANLTWSVKHDDFFPYADGPHQFWTGYFSSRPALKRYERLSYNFLQVCNQLEALVGLAANVGPYGSGDSAPLNEAMAVLQHHDAVSGTSRQHVANDYARQLAAGWGPCEVLLSNALARLRGFKDHFTFCQQLNISICPLSQTAARFQVIVYNPLGRKVNWMVRLPVSEGVFVVKDPNGRTVPSDVVIFPSSDSQAHPPELLFSASLPALGFSTYSVAQVPRWKPQARAPQPIPRRSWSPALTIENEHIRATFDPDTGLLMEIMNMNQQLLLPVRQTFFWYNASIGDNESDQASGAYIFRPNQQKPLPVSRWAQIHLVKTPLVQEVHQNFSAWCSQVVRLYPGQRHLELEWSVGPIPVGDTWGKEVISRFDTPLETKGRFYTDSNGREILERRRDYRPTWKLNQTGSARWRVPHTFSISFPFHSESQEKAGSRKFCVTFSGMFSDSH

SEQ ID NO: 863993 - protein, 339 aa, Homo sapiens
MGAYARASGVCARGCLDSAGPWTMSRALRPPLPPLCFFLLLLAAAGARAGGYETCPTVQPNMLNVHLLPHTHDDVGWLKTVDQYFYGIKNDIQHAGVQYILDSVISALLADPTRRFIYVEIAFFSRWWHQQTNATQEVVRDLVRQGRLEFANGGWVMNDEAATHYGAIVDQMTLGLRFLEDTFGNDGRPRVAWHIDPFGHSREQASLFAQMGFDGFFFGRLDYQDKWVRMQKLEMEQVWRASTSLKPPTADLFTGVLPNGYNPPRNLCWDVLCVDQPLVEDPRSPEYNAKELVDYFLNVATAQTHSSLSNRMKLYLKQKQKQTPQNFQIWKRKNEYEDP

SEQ ID NO: 863994 - protein, 101 aa, Homo sapiens
LLKIVLIQDLFPSTPLPSSVHSGDYGDSGQDPSGTRNTFRRFCSPSFPPSCQLPRPEAHTHANTRNPPPSPHLLSFHIRALNLRGVKSLFEKPKVGRCHYP

SEQ ID NO: 863995 - protein, 1172 aa, Homo sapiens
MFGLKNFEELPRMASDCFPSENRHLEFLLLVFIYVQINLYIYIYTHTYQYKYSFDSRKTRIWRVQLRNLVAHGCWGSSLCWRDTSALGSWGGPGCSHLRVSEKPPSASPPDPAGITSRALHALAEELVCGEDFLGYLYVTVNLQPKQQNTVGGQVHAGPTVTQPWALAHLSGGKVQCCLPWYVFLIDVSPAQQPGLHYKRQECPCKEPSSLDRSFFLCCWMRVSEYALDLILERRSKAMMREAVITQVLKEDIVGGTQGFGGKTLNPASRAQRHTHTSPVAVGDVGWQQPGMYPCHRTAHCGFAHCLRVKLCCCLQKKAFVGCRVESWVRLVSPEEKAYKKWLILSLFSVMQLDSSEIVKSSFSVFLLLMSCTHLFFTWGCEIEFSKVKPDDHSDKGNLNLIHMLCIFDYLFSFLTIKELFFLLRVYLGDFTSLTHHLQMCFCIKFKFSHITSILKVVICWRRKILKTHEGPHSQVFQGKASSPPRSGSQQGSVPLTPDTDPPLQGLLTQLPSLLLPESTDLSQQPAQTTGGYSHVVWGALDLRKAPLSEQMGSCGAQAFLLCSSPFPKQGFNLIYPPCSFLWPFKWGGRDMVGPCHTRAGEATSFDFDRVAGGKVAIKVLLGLLSVQMEPTGFCCNLCVPSARSHQEGWGRANQVVSELTERLHLVVKLMGVQRASGLGEGLRASFLVFIPELLPAHKSDLFEWGRSPSTEKFLWQRSFYLALDPAESSILTALKSRAGEGTQRLGMRLGRPWLPYGQGQGKAPPSQFLKVLSLGSQDFEDDKEHIGTSLLLLVQSFHSPENLAFVAALAAERREEGSRSGGDSEAPSLLSTWIGGEPQGTERSLSIYLPLVPLPSETGLKRVFMCACTHTHEHLYVLMNSFSWLMLFNFCSFPEVDDSKFNVTWLGAVAHTCNPSTLGGQEEADHLRSGVRDQPDRHGETPFLLKIQKLAGRGGARLESQLLRRLRKENHLNPGGGGCSELRSCHCTPAWATERNSVSKKKKKLNVTGVKSEMSGCLALNRELQVLGLSQESNLSRNTFKRKIYMVPMNPVICLGRSCHSSLVPAHTVWSRSCSLLGTGPEPHMRLSAGVRSASPTPQQGPSTAIRLFSVRLGRGQGRSSHPCVEGSRCASEQLLCSEVLGGSDCAIIVIKEKTRPPSFLPCWPLFIEFY

SEQ ID NO: 863996 - protein, 823 aa, Homo sapiens
MQLDSSEIVKSSFSVFLLLMSCTHLFFTWGCEIEFSKVKPDDHSDKGNLNLIHMLCIFCLLVFVFDYKGALFSCSEFDLGDFTSLTHHLQMCFCIKFKFSHITSILKVVICWRRKILKTHEGPHSQVFQGKASSPPRSGSQQGSVPLTPDTDPPLQGLLTQLPSLLLPESTDLSQQPAQTTGGYSHVVWGALDLRKAPLSEQMGSCGAQAFLLCSSPFPKQGFNLIYPPCSFLWPFKWGGRDMVGPCHTRAGEATSFDFDRVAGGKVAIKVLLGLLSVQMEPTGFCCNLCVPSARSHQEGWGRANQVVSELTERLHLVVKLMGVQRASGLGEGLRASFLVFIPELLPAHKSDLFEWGRSPSTEKFLWQRSFYLALDPAESSILTALKSRAGEGTQRLGMRLGRPWLPYGQGQGKAPPSQFLKVLSLGSQDFEDDKEHIGTSLLLLVQSFHSPENLAFVAALAAERREEGSRSGGDSEAPSLLSTWIGGEPQGTERSLSIYLPLVPLPSETGLKRVFMCACTHTHEHLYVLMNSFSWLMLFNFCSFPEVDDSKFNVTWLGAVAHTCNPSTLGGQEEADHLRSGVRDQPDRHGETPFLLKIQKLAGRGGARLESQLLRRLRKENHLNPGGGGCSELRSCHCTPAWATERNSVSKKKKKLNVTGVKSEMSGCLALNRELQVLGLSQESNLSRNTFKRKIYMVPMNPVICLGRSCHSSLVPAHTVWSRSCSLLGTGPEPHMRLSAGVRSASPTPQQGPSTAIRLFSVRLGRGQGRSSHPCVEGSRCASEQLLCSEVLGGSDCAIIVIKEKTRPPSFLPCWPLFIEFY

SEQ ID NO: 863997 - protein, 966 aa, Homo sapiens
MASKRKSTTPCMIPVKTVVLQDASMEAQPAETLPEGPQQDLPPEASAASSEAAQNPSSTDGSTLANGHRSTLDGYLYSCKYCDFRSHDMTQFVGHMNSEHTDFNKDPTFVCSGCSFLAKTPEGLSLHNATCHSGEASFVWNVAKPDNHVVVEQSIPESTSTPDLAGEPSAEGADGQAEIIITKTPIMKIMKGKAEAKKIHTLKENVPSQPVGEALPKLSTGEMEVREGDHSFINGAVPVSQASASSAKNPHAANGPLIGTVPVLPAGIAQFLSLQQQPPVHAQHHVHQPLPTAKALPKVMIPLSSIPTYSAAMDSNSFLKNSFHKFPYPTKAELCYLTVVTKYPEEQLKIWFTAQRLKQGISWSPEEIEDARKKMFNTVIQSVPQPTITVLNTPLVASAGNVQHLIQAALPGHVVGQPEGTGGGLLVTQPLMANGLQATSSPLPLTVTSVPKQPGVAPINTVCSNTTSAVKVVNAAQSLLTACPSITSQAFLDASIYKNKKSHEQLSALKGSFCRNQFPGQSEVEHLTKVTGLSTREVRKWFSDRRYHCRNLKGSRAMIPGDHSSIIIDSVPEVSFSPSSKVPEVTCIPTTATLATHPSAKRQSWHQTPDFTPTKYKERAPEQLRALESSFAQNPLPLDEELDRLRSETKMTRREIDSWFSERRKKVNAEETKKAEENASQEEEEAAEDEGGEEDLASELRVSGENGSLEMPSSHILAERKVSPIKINLKNLRVTEANGRNEIPGLGACDPEDDESNKLAEQLPGKVSCKKTAQQRHLLRQLFVQTQWPSNQDYDSIMAQTGLPRPEVVRWFGDSRYALKNGQLKWYEDYKRGNFPPGLLVIAPGNRELLQDYYMTHKMLYEEDLQNLCDKTQMSSQQVKQWFAEKMGEETRAVADTGSEDQGPGTGELTAVHKGMGDTYSEVSENSESWEPRVPEASSEPFDTSSPQAGRQLGKESTGAMAILCG

SEQ ID NO: 863998 - protein, 1418 aa, Homo sapiens
MSPFSTLISEPPMVWEGITHWPISKGEGWRDLLTSWNYQRRVVFSTKTCMQRSLAEHPECPWLPPQGLAGVLDACPRVLGITGPCEDAFKVLYLCPQTWKQELYFSLTLMSFFELRKLQEMVPLKIRKLAYRAVLNGKSSISPRPVALRVAGKEGRTKDLSTCSSAHFLETTCFPECQATSTRLRGHRHLLGWAELTVLEDPRERARALGKKHWWCFRDLSFSPTQGTGPGRAPCSCGSKDKHGGGPFCLPGEVLLLKPKSCSSKVSSSALPVPIGTTSYLSQTGTCEYLASFAAYFCILNLGSKDVWSQKPLRNCQEWRVIAFLQRTDTWNFSFECLYTCRLIYIYIYTHTHIQYKYSFDSRKTRIWRVQLRNLVAHGCWGSSLCWRDTSALGSWGGPGCSHLRVSEKPPSASPPDPAGITSRALHALAEELVCGEDFLGYLYVTVNLQPKQQNTVGGQVHAGPTVTQPWALAHLSGGKVQCCLPWYVFLIDVSPAQQPGLHYKRQECPCKEPSSLDRSFFLCCWMRVSEYALDLILERRSKAMMREAVITQVLKEDIVGGTQGFGGKTLNPASRAQRHTHTSPVAVGDVGWQQPGMEPCHRTAHCGFAHCLRVKLCCCLQYKAFVGCRVESWVRLVSPEEKAYKKWLNLIPFLCMQLDSSEIVKSSFSVFLLLMSCTHLFFTWGCEIEFSKVKPDDHSDKGNLNLIHMLCIFDYLFSFLTIKELFFLLRVYLGDFTSLTHHLQMCFCIKFKFSHITSILKVVICWRRKILKTHEGPHSQVFQGKASSPPRSGSQQGSVPLTPDTDPPLQGLLTQLPSLLLPESTDLSQQPAQTTGGYSHVVWGALDLRKAPLSEQMGSCGAQAFLLCSSPFPKQGFNLIYPPCSFLWPFKWGGRDMVGPCHTRAGEATSFDFDRVAGGKVAIKVLLGLLSVQMEPTGFCCNLCVPSARSHQEGWGRANQVVSELTERLHLVVKLMGVQRASGLGEGLRASFLVFIPELLPAHKSDLFEWGRSPSTEKFLWQRSFYLALDPAESSILTALKSRAGEGTQRLGMRLGRPWLPYGQGQGKAPPSQFLKVLSLGSQDFEDDKEHIGTSLLLLVQSFHSPENLAFVAALAAERREEGSRSGGDSEAPSLLSTWIGGEPQGTERSLSIYLPLVPLPSGDWLETCVHVACTHTHEHLYVLMNSFSWLMLFNFCSFPEVDDSKFNVTWLGAVAHTCNPSTLGGQEEADHLRSGVRDQPDRHGETPFLLKIQKLAGRGGARLESQLLRRLRKENHLNPGGGGCSELRSCHCTPAWATERNSVSKKKKKLNVTGVKSEMSGCLALNRELQVLGLSQESNLSRNTFKRKIYMVPMNPVICLGRSCHSSLVPAHTVWSRSCSLLGTGPEPHMRLSAGVRSASPYSSAGTQHSNPVVLG

SEQ ID NO: 863999 - protein, 1369 aa, Homo sapiens
MQRSLAEHPECPWLPPQGLAGVLDACPRVLGITGPCEDAFKVLYLCPQTWKQELYFSLTLMSFFELRKLQEMVPLKIRKLAYRAVLNGKSSISPRPVALRVAGKEGRTKDLSTCSSAHFLETTCFPECQATSTRLRGHRHLLGWAELTVLEDPRERARALGKKHWWCFRDRPSPLPRELDLAGHRAHVAPRTSMAVAPSAFQEEVLLLKPKSCSSKVSSSALPVPIGTTSYLSQTGTCEYLASFAAYFCILNLGSKDVWSQKPLRNCQEWRVIAFLQRTDTWNFSFYCLYTCRLIYIYIYTHTHIQYKYSFDSRKTRIWRVQLRNLVAHGCWGSSLCWRDTSALGSWGGPGCSHLRVSEKPPSASPPDPAGITSRALHALAEELVCGEDFLGYLYVTVNLQPKQQNTVGGQVHAGPTVTQPWALAHLSGGKVQCCLPWYVFLIDVSPAQQPGLHYKRQECPCKEPSSLDRSFFLCCWMRVSEYALDLILERRSKAMMREAVITQVLKEDIVGGTQGFGGKTLNPASRAQRHTHTSPVAVGDVGWQQPGMYPCHRTAHCGFAHCLRVKLCCCLQYKAFVGCRVESWVRLVSPEEKAYKKWLILSLFSVMQLDSSEIVKSSFSVFLLLMSCTHLFFTWGCEIEFSKVKPDDHSDKGNLNLIHMLCIFDYLFSFLTIKELFFLLRVYLGDFTSLTHHLQMCFCIKFKFSHITSILKVVICWRRKILKTHEGPHSQVFQGKASSPPRSGSQQGSVPLTPDTDPPLQGLLTQLPSLLLPESTDLSQQPAQTTGGYSHVVWGALDLRKAPLSEQMGSCGAQAFLLCSSPFPKQGFNLIYPPCSFLWPFKWGGRDMVGPCHTRAGEATSFDFDRVAGGKVAIKVLLGLLWVQMEPTGFCCNLCVPSARSHQEGWGRANQVVSELTERLHLVVKLMGVQRASGLGEGLRASFLVFIPELLPAHKSDLFEWGRSPSTEKFLWQRSFYLALDPAESSILTALKSRAGEGTQRLGMRLGRPWLPYGQGQGKAPPSQFLKVLSLGSQDFEDDKEHIGTSLLLLVQSFHSPENLAFVAALAAERREEGSRSGGDSEAPSLLSTWIGGEPQGTERSLSIYLPLVPLPSGDWLETCVHVRVHTHNEHLYVLMNSFSWLMLFNFCSFPEVDDSKFNVTWLGAVAHTCNPSTLGGQEEADHLRSGVRDQPDRHGETPFLLKIQKLAGRGGARLESQLLRRLRKENHLNPGGGGCSELRSCHCTPAWATERNSVSKKKKKLNVTGVKSEMSGCLALNRELQVLGLSQESNLSRNTFKRKIYMVPMNPVICLGRSCHSSLVPAHTVWSRSCSLLGTGPEPHMRLSAGVRSASPYSSAGTQHSNPVVLG

SEQ ID NO: 864000 - protein, 1369 aa, Homo sapiens
MQRSLAEHPECPWLPPQGLAGVLDACPRVLGITGPCEDAFKVLYLCPQTWKQELYFSLTLMSFFELRKLQEMVPLKIRKLAYRAVLNGKSSISPRPVALRVAGKEGRTKDLSTCSSAHFLETTCFPECQATSTRLRGHRHLLGWAELTVLEDPRERARALGKKHWWCFRDRPSPLPRELDLAGHRAHVAPRTSMAVAPSAFQERSVLLKPKSCSSKVSSSALPVPIGTTSYLSQTGTCEYLASFAAYFCILNLGSKDVWSQKPLRNCQEWRVIAFLQRTDTWNFSFECLYTCRLIYIYIYTHTHIQYKYSFDSRKTRIWRVQLRNLVAHGCWGSSLCWRDTSALGSWGGPGCSHLRVSEKPPSASPPDPAGITSRALHALAEELVCGEDFLGYLYVTVNLQPKQQNTVGGQVHAGPTVTQPWALAHLSGGKVQCCLPWYVFLIDVSPAQQPGLHYKRQECPCKEPSSLDRSFFLCCWMRVSEYALDLILERSSKAMMREAVITQVLKEDIVGGTQGFGGKTLNPASRAQRHTHTSPVAVGDVGWQQPGMYPCHRTAHCGFAHCLRVKLCCCLQKKAFVGCRVESWVRLVSPEEKAYKKWLILSLFSVMQLDSSEIVKSSFSVFLLLMSCTHLFFTWGCEIEFSKVKPDDHSDKGNLNLIHMLCIFDYLFSFLTIKELFFLLRVYLGDFTSLTHHLQMCFCIKFKFSHITSILKVVICWRRKILKTHEGPHSQVFQGKASSPPRSGSQQGSVPLTPDTDPPLQGLLTQLPSLLLPESTDLSQQPAQTTGGYSHVVWGALDLRKAPLSEQMGSCGAQAFLLCSSPFPKQGFNLIYPPCSFLWPFKWGGRDMVGPCHTRAGEATSFDFDRVAGGKVAIKVLLGLLSVQMEPTGFCCNLCVPSARSHQEGWGRANQVVSELTERLHLVVKLMGVQRASGLGEGLRASFLVFIPELLPAHKSDLFEWGRSPSTEKFLWQRSFYLALDPAESSILTALKSRAGEGTQRLGMRLGRPWLPYGQGQGKAPPSQFLKVLSLGSQDFEDDKEHIGTSLLLLVQSFHSPENLAFVAALAAERREEGSRSGGDSEAPSLLSTWIGGEPQGTERSLSIYLPLVPLPSETGLKRVFMCACTHTHEHLYVLMNSFSWLMLFNFCSFPEVDDSKFNVTWLGAVAHTCNPSTLGGQEEADHLRSGVRDQPDRHGETPFLLKIQKLAGRGGARLESQLLRRLRKENHLNPGGGGCSELRSCHCTPAWATERNSVSKKKKKLNVTGVKSEMSGCLALNRELQVLGLSQESNLSRNTFKRKIYMVPMNPVICLGRSCHSSLVPAHTVWSRSCSLLGTGPEPHMRLSAGVRSASPYSSAGTQHSNPVVLG

SEQ ID NO: 864001 - protein, 1076 aa, Homo sapiens
MLRVSEKPPSASPPDPAGITSRALHALAEELVCGEDFLGYLYVTVNLQPKQQNTVGGQVHAGPTVTQPWALAHLSGGKVQCCLPWYVFLIDVSPAQQPGLHYKRQECPCKEPSSLDRSFFLCCWMRVSEYALDLILERRSKAMMREAVITQVLKEDIVGGTQGFGGKTLNPASRAQRHTHTSPVAVGDVGWQQPGMEPCHRTAHCGFAHCLRVKLCCCLQKKAFVGCRVESWVRLVSPEEKAYKKWLILSLFSVMQLDSSEIVKSSFSVFLLLMSCTHLFFTWGCEIEFSKVKPDDHSDKGNLNLIHMLCIFDYLFSFLTIKELFFLLRVYLGDFTSLTHHLQMCFCIKFKFSHITSILKVVICWRRKILKTHEGPHSQVFQGKASSPPRSGSQQGSVPLTPDTDPPLQGLLTQLPSLLLPESTDLSQQPAQTTGGYSHVVWGALDLRKAPLSEQMGSCGAQAFLLCSSPFPKQGFNLIYPPCSFLWPFKWGGRDMVGPCHTRAGEATSFDFDRVAGGKVAIKVLLGLLSVQMEPTGFCCNLCVPSARSHQEGWGRANQVVSELTERLHLVVKLMGVQRASGLGEGLRASFLVFIPELLPAHKSDLFEWGRSPSTEKFLWQRSFYLALDPAESSILTALKSRAGEGTQRLGMRLGRPWLPYGQGQGKAPPSQFLKVLSLGSQDFEDDKEHIGTSLLLLVQSFHSPENLAFVAALAAERREEGSRSGGDSEAPSLLSTWIGGEPQGTERSLSIYLPLVPLPSETGLKRVFMCACTHTHEHLYVLMNSFSWLMLFNFCSFPEVDDSKFNVTWLGAVAHTCNPSTLGGQEEADHLRSGVRDQPDRHGETPFLLKIQKLAGRGGARLESQLLRRLRKENHLNPGGGGCSELRSCHCTPAWATERNSVSKKKKKLNVTGVKSEMSGCLALNRELQVLGLSQESNLSRNTFKRKIYMVPMNPVICLGRSCHSSLVPAHTVWSRSCSLLGTGPEPHMRLSAGVRSASPTPQQGPSTAIRLFSVRLGRGQGRSSHPCVEGSRCASEQLLCSEVLGGSDCAIIVIKEKTRPPSFLPCWPLFIEFY

SEQ ID NO: 864002 - protein, 986 aa, Homo sapiens
MLALPNSQGYTTKGKNAQCKEPSSLDRSFFLCCWMRVSEYALDLILERRSKAMMREAVITQVLKEDIVGGTQGFGGKTLNPASRAQRHTHTSPVAVGDVGWQQPGMEPCHRTAHCGFAHCLRVKLCCCLQYKAFVGCRVESWVRLVSPEEKAYKKWLILSLFSVMQLDSSEIVKSSFSVFLLLMSCTHLFFTWGCEIEFSKVKPDDHSDKGNLNLIHMLCIFDYLFSFLTIKELFFLLRVYLGDFTSLTHHLQMCFCIKFKFSHITSILKVVICWRRKILKTHEGPHSQVFQGKASSPPRSGSQQGSVPLTPDTDPPLQGLLTQLPSLLLPESTDLSQQPAQTTGGYSHVVWGALDLRKAPLSEQMGSCGAQAFLLCSSPFPKQGFNLIYPPCSFLWPFKWGGRDMVGPCHTRAGEATSFDFDRVAGGKVAIKVLLGLLSVQMEPTGFCCNLCVPSARSHQEGWGRANQVVSELTERLHLVVKLMGVQRASGLGEGLRASFLVLHSWLLPAHKSDLFEWGRSPSTEKFLWQRSFYLALDPAESSILTALKSRAGEGTQRLGMRLGRPWLPYGQGQGKAPPSQFLKVLSLGSQDFEDDKEHIGTSLLLLVQSFHSPENLAFVAALAAERREEGSRSGGDSEAPSLLSTWIGGEPQGTERSLSIYLPLVPLPSGDWLETCVHVRVHTHHEHLYVLMNSFSWLMLFNFCFLSVSGWFKINVTWLGAVAHTCNPSTLGGQEEADHLRSGVRDQPDRHGETPFLLKIQKLAGRGGARLESQLLRRLRKENHLNPGGGGCSELRSCHCTPAWATERNSVSKKKKKLNVTGVKSEMSGCLALNRELQVLGLSQESNLSRNTFKRKIYMVPMNPVICLGRSCHSSLVPAHTVWSRSCSLLGTGPEPHMRLSAGVRSASPTPQQGPSTAIRLFSVRLGRGQGRSSHPCVEGSRCASEQLLCSEVLGGSDCAIIVIKEKTRPPSFLPCWPLFIEFY

SEQ ID NO: 864003 - protein, 956 aa, Homo sapiens
MASKRKSTTPCMIPVKTVVLQDASMEAQPAETLPEGPQQDLPPEASAASSEAAQNPSSTDGSTLANGHRSTLDGYLYSCKYCDFRSHDMTQFVGHMNSEHTDFNKDPTFVCSGCSFLAKTPEGLSLHNATCHSGEASFVWNVAKPDNHVVVEQSIPESTSTPDLAGEPSAEGADGQAEIIITKTPIMKIMKGKAEAKKIHTLKENVPSQPVGEALPKLSTGEMEVREGDHSFINGAVPVSQASASSAKNPHAANGPLIGTVPVLPAGIAQFLSLQQQPPVHAQHHVHQPLPTAKALPKVMIPLSSIPTYSAAMDSNSFLKNSFHKFPYPTKAELCYLTVVTKYPEEQLKIWFTAQRLKQGISWSPEEIEDARKKMFNTVIQSVPQPTITVLNTPLVASAGNVQHLIQAALPGHVVGQPEGTGGGLLVTQPLMANGLQATSSPLPLTVTSVPKQPGVAPINTVCSNTTSAVKVVNAAQSLLTACPSITSQAFLDASIYKNKKSHEQLSALKGSFCRNQFPGQSEVEHLTKVTGLSTREVRKWFSDRRYHCRNLKGSRAMIPGDHSSIIIDSVPEVSFSPSSKVPEVTCIPTTATLATHPSAKRQSWHQTPDFTPTKYKERAPEQLRALESSFAQNPLPLDEELDRLRSETKMTRREIDSWFSERRKKVNAEETKKAEENASQEEEEAAEDEGGEEDLASELRVSGENGSLEMPSSHILAERKVSPIKINLKNLRVTEANGRNEIPGLGACDPEDDESNKLAEQLPGKVSCKKTAQQRHLLRQLFVQTQWPSNQDYDSIMAQTGLPRPEVVRWFGDSRYALKNGQLKWYEDYKRGNFPPGLLVIAPGNRELLQDYYMTHKMLYEEDLQNLCDKTQMSSQQVKQWFAEKMGEETRAVADTGSEDQGPGTGELTAVHKGMGDTYSEVSENSESWEPRVPEASSEPFDTSSPQAGRQLETD

SEQ ID NO: 864004 - protein, 956 aa, Homo sapiens; identical to SEQ ID NO: 864003

SEQ ID NO: 864005 - protein, 568 aa, Homo sapiens
MASKRKSTTPCMIPVKTVVLQDASMEAQPAETLPEGPQQDLPPEASAASSEAAQNPSSTDGSTLANGHRSTLDGYLYSCKYCDFRSHDMTQFVGHMNSEHTDFNKDPTFVCSGCSFLAKTPEGLSLHNATCHSGEASFVWNVAKPDNHVVVEQSIPESTSTPDLAGEPSAEGADGQAEIIITKTPIMKIMKGKAEAKKIHTLKENVPSQPVGEALPKLSTGEMEVREGDHSFINGAVPVSQASASSAKNPHAANGPLIGTVPVLPAGIAQFLSLQQQPPVHAQHHVHQPLPTAKALPKVMIPLSSIPTYSAAMDSNSFLKNSFHKFPYPTKAELCYLTVVTKYPEEQLKIWFTAQRLKQGISWSPEEIEDARKKMFNTVIQSVPQPTITVLNTPLVASAGNVQHLIQAALPGHVVGQPEGTGGGLLVTQPLMANGLQATSSPLPLTVTSVPKQPGVAPINTVCSNTTSAVKVVNAAQSLLTACPSITSQAFLDASIYKNKKSHEQLSALKGSFCRNQFPGQSEVEHLTKVRLGAEVRLGAEVRLGAEVRLGAEVRLGAEVRREQKAPG

SEQ ID NO: 864006 - protein, 266 aa, Homo sapiens
MKLRSSHNASKTLNANNMETLIECQSEGDIKEHPLLASCESEDSICQLIEVKKRKKVLSWPFLMRRLSPASDFSGALETDLKASLFDQPLSIICGDSDTLPRPIQDILTILCLKGPSTEGIFRRAANEKARKELKEELNSGDAVDLERLPVHLLAVVFKDFLRSIPRKLLSSDLFEEWMGALEMQDEEDRIEALKQVADKLPRPNLLLLKHLVYVLHLISKNSEVNRMDSSNLAICIGPNMLTLENDQSLSFEAQKDLNNKVCSAY

SEQ ID NO: 864007 - protein, 1009 aa, Homo sapiens
MSLAFKIFFPQTLRALSRKELCLFRKHHWRDVRQFSQWSETDLLHGHPLFLRRKPVLSFQGSHLRSRATYLVFLPGLHVGLCSGPCEMAEQRFCVDYAKRGTAGCKKCKEKIVKGVCRIGKVVPNPFSESGGDMKEWYHIKCMFEKLERARATTKKIEDLTELEGWEELEDNEKEQITQHIADLSSKAAGTPKKKAVVQAKLTTTGQVTSPVKGASFVTSTNPRKFSGFSAKPNNSGEAPSSPTPKRSLSSSKCDPRHKDCLLREFRKLCAMVADNPSYNTKTQIIQDFLRKGSAGDGFHGDVYLTVKLLLPGVIKTVYNLNDKQIVKLFSRIFNCNPDDMARDLEQGDVSETIRVFFEQSKSFPPAAKSLLTIQEVDEFLLRLSKLTKEDEQQQALQDIASRCTANDLKCIIRLIKHDLKMNSGAKHVLDALDPNAYEAFKASRNLQDVVERVLHNAQEVEKEPGQRRALSVQASLMTPVQPMLAEACKSVEYAMKKCPNGMFSEIKYDGERVQVHKNGDHFSYFSRSLKPVLPHKVAHFKDYIPQAFPGGHSMILDSEVLLIDNKTGKPLPFGTLGVHKKAAFQDANVCLFVFDCIYFNDVSLMDRPLCERRKFLHDNMVEIPNRIMFSEMKRVTKALDLADMITRVIQEGLEGLVLKDVKGTYEPGKRHWLKVKKDYLNEGAMADTADLVVLGAFYGQGSKGGMMSIFLMGCYDPGSQKWCTVTKCAGGHDDATLARLQNELDMVKISKDPSKIPSWLKVNKIYYPDFIVPDPKKAAVWEITGAEFSKSEAHTADGISIRFPRCTRIRDDKDWKSATNLPQLKELYQLSKEKADFTVVAGDEGSSTTGGSSEENKGPSGSAVSRKAPSKPSASTKKAEGKLSNSNSKDGNMQTAKPSAMKVGEKLATKSSPVKVGEKRKAADETLCQTKVLLDIFTGVRLYLPPSTPDFSRLRRYFVAFDGDLVQEFDMTSATHVLGSRDKNPAAQQVSPEWIWACIRKRRLVAPC

SEQ ID NO: 864008 - protein, 1009 aa, Homo sapiens; identical to SEQ ID NO: 864007

SEQ ID NO: 864009 - protein, 738 aa, Homo sapiens
MVADNPSYNTKTQIIQDFLRKGSAGDGFHGDVYLTVKLLLPGVIKTVYNLNDKQIVKLFSRIFNCNPDDMARDLEQGDVSETIRVFFEQSKSFPPAAKSLLTIQEVDEFLLRLSKLTKEDEQQQALQDIASRCTANDLKCIIRLIKHDLKMNSGAKHVLDALDPNAYEAFKASRNLQDVVERVLHNAQEVEKEPGQRRALSVQASLMTPVQPMLAEACKSVEYAMKKCPNGMFSEIKYDGERVQVHKNGDHFSYFSRSLKPVLPHKVAHFKDYIPQAFPGGHSMILDSEVLLIDNKTGKPLPFGTLGVHKKAAFQDANVCLFVFDCIYFNDVSLMDRPLCERRKFLHDNMVEIPNRIMFSEMKRVTKALDLADMITRVIQEGLEGLVLKDVKGTYEPGKRHWLKVKKDYLNEGAMADTADLVVLGAFYGQGSKGGMMSIFLMGCYDPGSQKWCTVTKCAGGHDDATLARLQNELDMVKISKDPSKIPSWLKVNKIYYPDFIVPDPKKAAVWEITGAEFSKSEAHTADGISIRFPRCTRIRDDKDWKSATNLPQLKELYQLSKEKADFTVVAGDEGSSTTGGSSEENKGPSGSAVSRKAPSKPSASTKKAEGKLSNSNSKDGNMQTAKPSAMKVGEKLATKSSPVKVGEKRKAADETLCQTKVLLDIFTGVRLYLPPSTPDFSRLRRYFVAFDGDLVQEFDMTSATHVLGSRDKNPAAQQVSPEWIWACIRKRRLVAPC

SEQ ID NO: 864010 - protein, 1046 aa, Homo sapiens
CACALPPALGPGFKETGAPTVVGCPRPVMSKFRGLRYMSLAFKIFFPQTLRALSRKELCLFRKHHWRDVRQFSQWSETDLLHGHPLFLRRKPVLSFQGSHLRSRATYLVFLPGLHVGLCSGPCEMAEQRFCVDYAKRGTAGCKKCKEKIVKGVCRIGKVVPNPFSESGGDMKEWYHIKCMFEKLERARATTKKIEDLTELEGWEELEDNEKEQITQHIADLSSKAAGTPKKKAVVQAKLTTTGQVTSPVKGASFVTSTNPRKFSGFSAKPNNSGEAPSSPTPKRSLSSSKCDPRHKDCLLREFRKLCAMVADNPSYNTKTQIIQDFLRKGSAGDGFHGDVYLTVKLLLPGVIKTVYNLNDKQIVKLFSRIFNCNPDDMARDLEQGDVSETIRVFFEQSKSFPPAAKSLLTIQEVDEFLLRLSKLTKEDEQQQALQDIASRCTANDLKCIIRLIKHDLKMNSGAKHVLDALDPNAYEAFKASRNLQDVVERVLHNAQEVEKEPGQRRALSVQASLMTPVQPMLAEACKSVEYAMKKCPNGMFSEIKYDGERVQVHKNGDHFSYFSRSLKPVLPHKVAHFKDYIPQAFPGGHSMILDSEVLLIDNKTGKPLPFGTLGVHKKAAFQDANVCLFVFDCIYFNDVSLMDRPLCERRKFLHDNMVEIPNRIMFSEMKRVTKALDLADMITRVIQEGLEGLVLKDVKGTYEPGKRHWLKVKKDYLNEGAMADTADLVVLGAFYGQGSKGGMMSIFLMGCYDPGSQKWCTVTKCAGGHDDATLARLQNELDMVKISKDPSKIPSWLKVNKIYYPDFIVPDPKKAAVWEITGAEFSKSEAHTADGISIRFPRCTRIRDDKDWKSATNLPQLKELYQLSKEKADFTVVAGDEGSSTTGGSSEENKGPSGSAVSRKAPSKPSASTKKAEGKLSNSNSKDGNMQTAKPSAMKVGEKLATKSSPVKVGEKRKAADETLCQTKVLLDIFTGVRLYLPPSTPDFSRLRRYFVAFDGDLVQEFDMTSATHVLGSRDKNPAAQQVSPEWIWACIRKRRLVAPC

SEQ ID NO: 864011 - protein, 922 aa, Homo sapiens
MAEQRFCVDYAKRGTAGCKKCKEKIVKGVCRIGKVVPNPFSESGGDMKEWYHIKCMFEKLERARATTKKIEDLTELEGWEELEDNEKEQITQHIADLSSKAAGTPKKKAVVQAKLTTTGQVTSPVKGASFVTSTNPRKFSGFSAKPNNSGEAPSSPTPKRSLSSSKCDPRHKDCLLREFRKLCAMVADNPSYNTKTQIIQDFLRKGSAGDGFHGDVYLTVKLLLPGVIKTVYNLNDKQIVKLFSRIFNCNPDDMARDLEQGDVSETIRVFFEQSKSFPPAAKSLLTIQEVDEFLLRLSKLTKEDEQQQALQDIASRCTANDLKCIIRLIKHDLKMNSGAKHVLDALDPNAYEAFKASRNLQDVVERVLHNAQEVEKEPGQRRALSVQASLMTPVQPMLAEACKSVEYAMKKCPNGMFSEIKYDGERVQVHKNGDHFSYFSRSLKPVLPHKVAHFKDYIPQAFPGGHSMILDSEVLLIDNKTGKPLPFGTLGVHKKAAFQDANVCLFVFDCIYFNDVSLMDRPLCERRKFLHDNMVEIPNRIMFSEMKRVTKALDLADMITRVIQEGLEGLVLKDVKGTYEPGKRHWLKVKKDYLNEGAMADTADLVVLGAFYGQGSKGGMMSIFLMGCYDPGSQKWCTVTKCAGGHDDATLARLQNELDMVKISKDPSKIPSWLKVNKIYYPDFIVPDPKKAAVWEITGAEFSKSEAHTADGISIRFPRCTRIRDDKDWKSATNLPQLKELYQLSKEKADFTVVAGDEGSSTTGGSSEENKGPSGSAVSRKAPSKPSASTKKAEGKLSNSNSKDGNMQTAKPSAMKVGEKLATKSSPVKVGEKRKAADETLCQTKVLLDIFTGVRLYLPPSTPDFSRLRRYFVAFDGDLVQEFDMTSATHVLGSRDKNPAAQQVSPEWIWACIRKRRLVAPC

SEQ ID NO: 864012 - protein, 1015 aa, Homo sapiens
MSLAFKIFFPQTLRALSRKELCLFRKHHWRDVRQFSQWSETDLLHGHPLFLRRKPVLSFQGSHLRSRATYLVFLPGLHVGLCSGPCEMAEQRFCVDYAKRGTAGCKKCKEKIVKGVCRIGKVVPNPFSESGGDMKEWYHIKCMFEKLERARATTKKIEDLTELEGWEELEDNEKEQITQHIADLSSKAAGTPKKKAVVQAKLTTTGQVTSPVKGASFVTSTNPRKFSGFSAKPNNSGEAPSSPTPKRSLSSSKCDPRHKDCLLREFRKLCAMVADNPSYNTKTQIIQDFLRKGSAGDGFHGDVYLTVKLLLPGVIKTVYNLNDKQIVKLFSRIFNCNPDDMARDLEQGDVSETIRVFFEQSKSFPPAAKSLLTIQEVDEFLLRLSKLTKEDEQQQALQDIASRCTANDLKCIIRLIKHDLKMNSGAKHVLDALDPNAYEAFKASRNLQDVVERVLHNAQEVEKEPGQRRALSVQASLMTPVQPMLAEACKSVEYAMKKCPNGMFSEIKYDGERVQVHKNGDHFSYFSRSLKPVLPHKVAHFKDYIPQAFPGGHSMILDSEVLLIDNKTGKPLPFGTLGVHKKAAFQDANVCLFVFDCIYFNDVSLMDRPLCERRKFLHDNMVEIPNRIMFSEMKRVTHLSVPQKALDLADMITRVIQEGLEGLVLKDVKGTYEPGKRHWLKVKKDYLNEGAMADTADLVVLGAFYGQGSKGGMMSIFLMGCYDPGSQKWCTVTKCAGGHDDATLARLQNELDMVKISKDPSKIPSWLKVNKIYYPDFIVPDPKKAAVWEITGAEFSKSEAHTADGISIRFPRCTRIRDDKDWKSATNLPQLKELYQLSKEKADFTVVAGDEGSSTTGGSSEENKGPSGSAVSRKAPSKPSASTKKAEGKLSNSNSKDGNMQTAKPSAMKVGEKLATKSSPVKVGEKRKAADETLCQTKVLLDIFTGVRLYLPPSTPDFSRLRRYFVAFDGDLVQEFDMTSATHVLGSRDKNPAAQQVSPEWIWACIRKRRLVAPC

SEQ ID NO: 864013 - protein, 389 aa, Homo sapiens [sequence omitted]

SEQ ID NO: 864014 - protein, 905 aa, Homo sapiens
MSLAFKIFFPQTLRALSRKELCLFRKHHWRDVRQFSQWSETDLLHGHPLFLRRKPVLSFQGSHLRSRATYLVFLPGLHVGLCSGPCEMAEQRFCVDYAKRGTAGCKKCKEKIVKGVCRIGKVVPNPFSESGGDMKEWYHIKCMFEKLERARATTKKIEDLTELEGWEELEDNEKEQITQHIADLSSKAAGTPKKKAVVQAKLTTTGQVTSPVKGASFVTSTNPRKFSGFSAKPNNSGEAPSSPTPKRSLSSSKCDPRHKDCLLREFRKLCAMVADNPSYNTKTQIIQDFLRKGSAGDGFHGDVYLTVKLLLPGVIKTVYNLNDKQIVKLFSRIFNCNPDDMARDLEQGDVSETIRVFFEQSKSFPPAAKSLLTIQEVDEFLLRLSKLTKEDEQQQALQDIASRCTANDLKCIIRLIKHDLKMNSGAKHVLDALDPNAYEAFKASRNLQDVVERVLHNAQEVEKEPGQRRALSVQASLMTPVQPMLAEACKSVEYAMKKCPNGMFSEIKYDGERVQVHKNGDHFSYFSRSLKPVLPHKVAHFKDYIPQAFPGGHSMILDSEVLLIDNKTGKPLPFGTLGVHKKAAFQDANVCLFVFDCIYFNDVSLMDRPLCERRKFLHDNMVEIPNRIMFSEMKRVTKALDLADMITRVIQEGLEGLVLKDVKGTYEPGKRHWLKVKKDYLNEGAMADTADLVVLGAFYGQGSKGGMMSIFLMGCYDPGSQKWCTVTKCAGGHDDATLARLQNELDMVKISKDPSKIPSWLKVNKIYYPDFIVPDPKKAAVWEITGAEFSKSEAHTADGISIRFPRCTRIRDDKDWKSATNLPQLKELYQLSKEKADFTVVAGDEGSSTTGGSSEENKGPSGSAVSRKAPSKPSASTKKAEGKLSNSNSKDGKDREGAGMVKRAV

SEQ ID NO: 864015 - protein, 949 aa, Homo sapiens
MSLAFKIFFPQTLRALSRKELCLFRKHHWRDVRQFSQWSETDLLHGHPLFLRRKPVLSFQGSHLRSRATYLVFLPGLHVGLCSGPCEMAEQRFCVDYAKRGTAGCKKCKEKIVKGVCRIGKVVPNPFSESGGDMKEWYHIKCMFEKLERARATTKKIEDLTELEGWEELEDNEKEQITQHIADLSSKAAGTPKKKAVVQAKLTTTGQVTSPVKGASFVTSTNPRKFSGFSAKPNNSGEAPSSPTPKRSLSSSKCDPRHKDCLLREFRKLCAMVADNPSYNTKTQIIQDFLRKGSAGDGFHGDVYLTVKLLLPGVIKTVYNLNDKQIVKLFSRIFNCNPDDMARDLEQGDVSETIRVFFEQSKSFPPAAKSLLTIQEVDEFLLRLSKLTKEDEQQQALQDIASRCTANDLKCIIRLIKHDLKMNSGAKHVLDALDPNAYEAFKASRNLQDVVERVLHNAQEVEKEPGQRRALSVQASLMTPVQPMLAEACKSVEYAMKKCPNGMFSEIKYDGERVQVHKNGDHFSYFSRSLKPVLPHKVAHFKDYIPQAFPGGHSMILDSEVLLIDNKTGKPLPFGTLGVHKKAAFQDANVCLFVFDCIYFNDVSLMDRPLCERRKFLHDNMVEIPNRIMFSEMKRVTKALDLADMITRVIQEGLEGLVLKDVKGTYEPGKRHWLKVKKDYLNEGAMADTADLVVLGAFYGQGSKGGMMSIFLMGCYDPGSQKWCTVTKCAGGHDDATLARLQNELDMVKISKDPSKIPSWLKVNKIYYPDFIVPDPKKAAVWEITGAEFSKSEAHTADGISIRFPRCTRIRDDKDWKSATNLPQLKELYQLSKEKADFTVVAGDEGSSTTGGSSEENKGPSGSAVSRKAPSKPSASTKKAEGKLSNSNSKDGNMQTAKPSAMKVGEKLATKSSPVKVGEKRKAADETLCQTKRRPASEQRGRTVPAGRR

SEQ ID NO: 864016 - protein, 1037 aa, Homo sapiens
MFSRPYVMFPTDEVSVLAVNEKFRGLRYMSLAFKIFFPQTLRALSRKELCLFRKHHWRDVRQFSQWSETDLLHGHPLFLRRKPVLSFQGSHLRSRATYLVFLPGLHVGLCSGPCEMAEQRFCVDYAKRGTAGCKKCKEKIVKGVCRIGKVVPNPFSESGGDMKEWYHIKCMFEKLERARATTKKIEDLTELEGWEELEDNEKEQITQHIADLSSKAAGTPKKKAVVQAKLTTTGQVTSPVKGASFVTSTNPRKFSGFSAKPNNSGEAPSSPTPKRSLSSSKCDPRHKDCLLREFRKLCAMVADNPSYNTKTQIIQDFLRKGSAGDGFHGDVYLTVKLLLPGVIKTVYNLNDKQIVKLFSRIFNCNPDDMARDLEQGDVSETIRVFFEQSKSFPPAAKSLLTIQEVDEFLLRLSKLTKEDEQQQALQDIASRCTANDLKCIIRLIKHDLKMNSGAKHVLDALDPNAYEAFKASRNLQDVVERVLHNAQEVEKEPGQRRALSVQASLMTPVQPMLAEACKSVEYAMKKCPNGMFSEIKYDGERVQVHKNGDHFSYFSRSLKPVLPHKVAHFKDYIPQAFPGGHSMILDSEVLLIDNKTGKPLPFGTLGVHKKAAFQDANVCLFVFDCIYFNDVSLMDRPLCERRKFLHDNMVEIPNRIMFSEMKRVTKALDLADMITRVIQEGLEGLVLKDVKGTYEPGKRHWLKVKKDYLNEGAMADTADLVVLGAFYGQGSKGGMMSIFLMGCYDPGSQKWCTVTKCAGGHDDATLARLQNELDMVKISKDPSKIPSWLKVNKIYYPDFIVPDPKKAAVWEITGAEFSKSEAHTADGISIRFPRCTRIRDDKDWKSATNLPQLKELYQLSKEKADFTVVAGDEGSSTTGGSSEENKGPSGSAVSRKAPSKPSASTKKAEGKLSNSNSKDGNMQTAKPSAMKVGEKLATKSSPVKVGEKRKAADETLCQTKVLLDIFTGVRLYLPPSTPDFSRLRRYFVAFDGDLVQEFDMTSATHVLGSRDKNPAAQQVSPEWIWACIRKRRLVAPC

SEQ ID NO: 864017 - protein, 738 aa, Homo sapiens; identical to SEQ ID NO: 864009

SEQ ID NO: 864018 - protein, 905 aa, Homo sapiens; identical to SEQ ID NO: 864014

SEQ ID NO: 864019 - protein, 961 aa, Homo sapiens
MSLAFKIFFPQTLRALSRKELCLFRKHHWRDVRQFSQWSETDLLHGHPLFLRRKPVLSFQGSHLRSRATYLVFLPGLHVGLCSGPCEMAEQRFCVDYAKRGTAGCKKCKEKIVKGVCRIGKVVPNPFSESGGDMKEWYHIKCMFEKLERARATTKKIEDLTELEGWEELEDNEKEQITQHIADLSSKAAGTPKKKAVVQAKLTTTGQVTSPVKGASFVTSTNPRKFSGFSAKPNNSGEAPSSPTPKRSLSSSKCDPRHKDCLLREFRKLCAMVADNPSYNTKTQIIQDFLRKGSAGDGFHGDVYLTVKLLLPGVIKTVYNLNDKQIVKLFSRIFNCNPDDMARDLEQGDVSETIRVFFEQSKSFPPAAKSLLTIQEVDEFLLRLSKLTKEDEQQQALQDIASRCTANDLKCIIRLIKHDLKMNSGAKHVLDALDPNAYEAFKASRNLQDVVERVLHNAQEVEKEPGQRRALSVQASLMTPVQPMLAEACKSVEYAMKKCPNGMFSEIKYDGERVQVHKNGDHFSYFSRSLKPVLPHKVAHFKDYIPQAFPGGHSMILDSEVLLIDNKTGKPLPFGTLGVHKKAAFQDANVCLFVFDCIYFNDVSLMDRPLCERRKFLHDNMVEIPNRIMFSEMKRVTKALDLADMITRVIQEGLEGLVLKDVKGTYEPGKRHWLKVKKDYLNEGAMADTADLVVLGAFYGQGSKGGMMSIFLMGCYDPGSQKWCTVTKCAGGHDDATLARLQNELDMVKISKDPSKIPSWLKVNKIYYPDFIVPDPKKAAVWEITGAEFSKSEAHTADGISIRFPRCTRIRDDKDWKSATNLPQLKELYQLSKEKADFTVVAGDEGSSTTGGSSEENKGPSGSAVSRKAPSKPSASTKKAEGKLSNSNSKDGNMQTAKPSAMKVGEKLATKSSPVKVGEKRKAADETLCQTKVRVKTATHHVGQFSPGCVPNLLYKKFERG

SEQ ID NO: 864020 - protein, 299 aa, Homo sapiens
MSLAFKIFFPQTLRALSRKELCLFRKHHWRDVRQFSQWSETDLLHGHPLFLRRKPVLSFQGSHLRSRATYLVFLPGLHVGLCSGPCEMAEQRFCVDYAKRGTAGCKKCKEKIVKGVCRIGKVVPNPFSESGGDMKEWYHIKCMFEKLERARATTKKIEDLTELEGWEELEDNEKEQITQHIADLSSKAAGTPKKKAVVQAKLTTTGQVTSPVKGASFVTSTNPRKFSGFSAKPNNSGEAPSSPTPKRSLSSSKCDPRHKDCLLREFRKLCAMVADNPSYNTKTQIIQDFLRKGSAGGVA

SEQ ID NO: 864021 - protein, 315 aa, Homo sapiens
LLLLGHASTSTGGGKRASKMATTKRVLYVGGLAEEVDDKVLHAAFIPFGDITDIQIPLDYETEKHRGFAFVEFELAEDAAAAIDNMNESELFGRTIRVNLAKPMRIKEGSSRPVWSDDDWLKKFSGKTLEENKEEEGSEPPKAETQEGEPIAKKARSNPQVYMDIKIGNKPAGRIQMLLRSDVVPMTAENFRCLCTHEKGFGFKGSSFHRIIPQFMCQGGDFTNHNGTGGKSIYGKKFDDENFILKHTGPGLLSMANSGPNTNGSQFFLTCDKTDWLDGKHVVFGEVTEGLDVLRQIEKQEESAITSQPRSWKLT

SEQ ID NO: 864022 - protein, 325 aa, Homo sapiens
KLTARYEAGWWQMATTKRVLYVGGLAEEVDDKVLHAAFIPFGDITDIQIPLDYETEKHRGFAFVEFELAEDAAAAIDNMNESELFGRTIRVNLAKPMRIKEGSSRPVWSDDDWLKKFSGKTLEENKEEEGSEPPKAETQEGEPIAKKARSNPQVYMDIKIGNKPAGRIQMLLRSDVVPMTAENFRCLCTHEKGFGFKGSSFHRIIPQFMCQGGDFTNHNGTGGKSIYGKKFDDENFILKHTGPGLLSMANSGPNTNGSQFFLTCDKTDWLDGKHVVFGEVTEGLDVLRQIEWGNEAGPDGTTKGPARGDVRDSFPRYVRGAQGPV

SEQ ID NO: 864023 - protein, 207 aa, Homo sapiens
MPLSKRPLIFSGERDIQMGNNPGRPGFQMRAGVFERPAPATRKGSSCRVPGTTSIEIGAFRPLRGMPKPSHPAVHSAPSLQCMPSPGELSALSPPIGHLGGQRVHFNAEEKFRMDGKSCIPSKVIYRGTKGLTIPSGPKLLGPPKPPQMGSSSFFLTCDKTDWLDGKHVVFGEVTEGLDVLRQIEAQGSKDGKPKQKVIIADCGEYV

SEQ ID NO: 864024 - protein, 319 aa, Homo sapiens
SRRHGCEKTTKGGKRASKMATTKRVLYVGGLAEEVDDKVLHAAFIPFGDITDIQIPLDYETEKHRGFAFVEFELAEDAAAAIDNMNESELFGRTIRVNLAKPMRIKEGSSRPVWSDDDWLKKFSGKTLEENKEEEGSEPPKAETQEGEPIAKKARSNPQVYMDIKIGNKPAGRIQMLLRSDVVPMTAENFRCLCTHEKGFGFKGSSFHRIIPQFMCQGGDFTNHNGTGGKSIYGKKFDDENFILKHTGPGLLSMANSGPNTNGSQFFLTCDKTDWLDGKHVVFGEVTEGLDVLRQIEAQGSKDGKPKQKVIIADCGEYV

SEQ ID NO: 864025 - protein, 309 aa, Homo sapiens
RLVQAGVIGRGTKRVLYVGGLAEEVDDKVLHAAFIPFGDITDIQIPLDYETEKHRGFAFVEFELAEDAAAAIDNMNESELFGRTIRVNLAKPMRIKEGSSRPVWSDDDWLKKFSGKTLEENKEEEGSEPPKAETQEGEPIAKKARSNPQVYMDIKIGNKPAGRIQMLLRSDVVPMTAENFRCLCTHEKGFGFKGSSFHRIIPQFMCQGGDFTNHNGTGGKSIYGKKFDDENFILKHTGPGLLSMANSGPNTNGSQFFLTCDKTDWLDGKHVVFGEVTEGLDVLRQIEAQGSKDGKPKQKVIIADCGEYV

SEQ ID NO: 864026 - protein, 313 aa, Homo sapiens
KLTARYEAGWWQMATTKRVLYVGGLAEEVDDKVLHAAFIPFGDITDIQIPLDYETEKHRGFAFVEFELAEDAAAAIDNMNESELFGRTIRVNLAKPMRIKEGSSRPVWSDDDWLKKFSGKTLEENKEEEGSEPPKAETQEGEPIAKKARSNPQVYMDIKIGNKPAGRIQMLLRSDVVPMTAENFRCLCTHEKGFGFKGSSFHRIIPQFMCQGGDFTNHNGTGGKSIYGKKFDDENFILKHTGPGLLSMANSGPNTNGSQFFLTCDKTDWLDGKHVVFGEVTEGLDVLRQIEAQGSKDGKPKQKVIIADCGEYV

SEQ ID NO: 864027 - protein, 345 aa, Homo sapiens
DPQGSGRGVGRISEPGGRRAAVKAGSLAVVLAIALAVLKLLPRFPTVLRKKLQTCGLAEEVDDKVLHAAFIPFGDITDIQIPLDYETEKHRGFAFVEFELAEDAAAAIDNMNESELFGRTIRVNLAKPMRIKEGSSRPVWSDDDWLKKFSGKTLEENKEEEGSEPPKAETQEGEPIAKKARSNPQVYMDIKIGNKPAGRIQMLLRSDVVPMTAENFRCLCTHEKGFGFKGSSFHRIIPQFMCQGGDFTNHNGTGGKSIYGKKFDDENFILKHTGPGLLSMANSGPNTNGSQFFLTCDKTDWLDGKHVVFGEVTEGLDVLRQIEAQGSKDGKPKQKVIIADCGEYV

SEQ ID NO: 864028 - protein, 322 aa, Homo sapiens
RLVQAGVIGRGTKRVLYVGGLAEEVDDKVLHAAFIPFGDITDIQIPLDYETEKHRGFAFVEFELAEDAAAAIDNMNESELFGRTIRVNLAKPMRIKEGSSRPVWSDDDWLKKFSGKTLEENKEEEGSEPPKAETQEGEPIAKKARSNPQVYMDIKIGNKPAGRIQMLLRSDVVPMTAENFRCLCTHEKGFGFKGSSFHRIIPQFMCQGGDFTNHNGTGGKSIYGKKFDDENFILKHTGPGLLSMANSGPNTNGSQFFLTCDKTDWLDGKHVVFGEVTEGLDVLRQIEVAPDTKASKARGSRKNKDGQERNWGKSQKVESHTI

SEQ ID NO: 864029 - protein, 321 aa, Homo sapiens
RLVQAGVIGRGTKRVLYVGGLAEEVDDKVLHAAFIPFGDITDIQIPLDYETEKHRGFAFVEFELAEDAAAAIDNMNESELFGRTIRVNLAKPMRIKEGSSRPVWSDDDWLKKFSGKTLEENKEEEGSEPPKAETQEGEPIAKKARSNPQVYMDIKIGNKPAGRIQMLLRSDVVPMTAENFRCLCTHEKGFGFKGSSFHRIIPQFMCQGGDFTNHNGTGGKSIYGKKFDDENFILKHTGPGLLSMANSGPNTNGSQFFLTCDKTDWLDGKHVVFGEVTEGLDVLRQIEWGNEAGPDGTTKGPARGDVRDSFPRYVRGAQGPV

SEQ ID NO: 864030 - protein, 356 aa, Homo sapiens
SRRHGCEKTTKGGKRASKMATTKRVLYVGGLAEEVDDKVLHAAFIPFGDITDIQIPLDYETEKHRGFAFVEFELAEDAAAAIDNMVWLGILILTKVAFWWYRGSLFIYQCSGLPKLQGCMEENESELFGRTIRVNLAKPMRIKEGSSRPVWSDDDWLKKFSGKTLEENKEEEGSEPPKAETQEGEPIAKKARSNPQVYMDIKIGNKPAGRIQMLLRSDVVPMTAENFRCLCTHEKGFGFKGSSFHRIIPQFMCQGGDFTNHNGTGGKSIYGKKFDDENFILKHTGPGLLSMANSGPNTNGSQFFLTCDKTDWLDGKHVVFGEVTEGLDVLRQIEAQGSKDGKPKQKVIIADCGEYV

SEQ ID NO: 864031 - protein, 306 aa, Homo sapiens
SRRHGCEKTTKGGKRASKMATTKRVLYVGGLAEEVDDKVLHAAFIPFGDITDIQIPLDYETEKHRGFAFVEFELAEDAAAAIDNMNESELFGRTIRVNLAKPMRIKEGSSRPVWSDDDWLKKFSGKTLEENKEEEGSEPPKAETQEVYMDIKIGNKPAGRIQMLLRSDVVPMTAENFRCLCTHEKGFGFKGSSFHRIIPQFMCQGGDFTNHNGTGGKSIYGKKFDDENFILKHTGPGLLSMANSGPNTNGSQFFLTCDKTDWLDGKHVVFGEVTEGLDVLRQIEAQGSKDGKPKQKVIIADCGEYV

SEQ ID NO: 864032 - protein, 268 aa, Homo sapiens
SRRHGCEKTTKGGKRASKMATTKRVLYVGGLAEEVDDKVLHAAFIPFGDITDIQIPLDYETVWSDDDWLKKFSGKTLEENKEEEGSEPPKAETQEGEPIAKKARSNPQVYMDIKIGNKPAGRIQMLLRSDVVPMTAENFRCLCTHEKGFGFKGSSFHRIIPQFMCQGGDFTNHNGTGGKSIYGKKFDDENFILKHTGPGLLSMANSGPNTNGSQFFLTCDKTDWLDGKHVVFGEVTEGLDVLRQIEAQGSKDGKPKQKVIIADCGEYV

SEQ ID NO: 864033 - protein, 196 aa, Homo sapiens
KLTARYEAGWWQMATTKRVLYVGGLAEEVDDKVLHAAFIPFGDITDIQIPLDYETEKHRGFAFVEFELAEDAAAAIDNMNESELFGRTIRVNLAKPMRIKEGSSRPVWSDDDWLKKFSGKTLEENKEEEGSEPPKAETQEGEPIAKKARSNPQVYMDIKIGNKPAGRIQMLLRSDVVPMTAARCMVHACSPSYSRG

SEQ ID NO: 864034 - protein, 105 aa, Homo sapiens
MCQGGDFTNHNGTGGKSIYGKKFDDENFILKHTGPGLLSMANSGPNTNGSQFFLTCDKTDWLDGKHVVFGEVTEGLDVLRQIEAQGSKDGKPKQKVIIADCGEYV

SEQ ID NO: 864035 - protein, 303 aa, Homo sapiens
SRRHGCEKTTKGGKRASKMATTKRVLYVGGLAEEVDDKVLHAAFIPFGDITDIQIPLDYETEKHRGFAFVEFELAEDAAAAIDNMNESELFGRTIRVNLAKPMRIKEGSSRPVWSDDDWLKKFSGKTLEENKEEEGSEPPKAETQEGEPIAKKARSNPQVYMDIKIGNKPAGRIQMLLRSDVVPMTAENFRCLCTHEKGFGFKGSSFHRIIPQFMCQGGDFTNHNGTGGKSIYGKKFDDENFILKHTGPVYIMAILAKQCIHFRALTPAGCCTLCRRPRKSGDKPVHAEQPHNTGTVRSALTT

SEQ ID NO: 864036 - protein, 85 aa, Homo sapiens
GRVDTAARRRQKGESARARWPPPSASCTWVDWQRKWTTKFFMLRSFLLETSQIFRFLWIMKQKSTEDLLLLNLSWQRMLQQLSTT

SEQ ID NO: 864037 - protein, 320 aa, Homo sapiens
LLLLGHASTSTGGGKRASKMATTKRVLYVGGLAEEVDDKVLHAAFIPFGDITDIQIPLDYETEKHRGFAFVEFELAEDAAAAIDNMNESELFGRTIRVNLAKPMRIKEGSSRPVWSDDDWLKKFSGKTLEENKEEEGSEPPKAETQEGEPIAKKARSNPQVYMDIKIGNKPAGRIQMLLRSDVVPMTAENFRCLCTHEKGFGFKGSSFHRIIPQFMCQGGDFTNHNGTGGKSIYGKKFDDENFILKHTGPGLLSMANSGPNTNGSQFFLTCDKTDWLDGKHVVFGEVTEGLDVLRQIEAQGSKDGKPKQKVIIADCGEYV

SEQ ID NO: 864038 - protein, 292 aa, Homo sapiens
RLGTRLGVTRPRRVLYVGGLAEEVDDKVLHAAFIPFGDITDIQIPLDYETEKHRGFAFVEFELAEDAAAAIDNMNESELFGRTIRVNLAKPMRIKEGSSRPVWSDDDWLKKFSGKTLEENKEEEGSEPPKAETQEGEPIAKKARSNPQVYMDIKIGNKPAGRIQMLLRSDVVPMTAENFRCLCTHEKGFGFKGSSFHRIIPQFMCQGGDFTNHNGTGGKSIYGKKFDDENFILKHTGPVYIMAILAKQCIHFRALTPAGCCTLCRRPRKSGDKPVHAEQPHNTGTVRSALTT

SEQ ID NO: 864039 - protein, 309 aa, Homo sapiens; identical to SEQ ID NO: 864025

SEQ ID NO: 864040 - protein, 309 aa, Homo sapiens; identical to SEQ ID NO: 864025

SEQ ID NO: 864041 - protein, 308 aa, Homo sapiens
RLGTRLGVTRPRRVLYVGGLAEEVDDKVLHAAFIPFGDITDIQIPLDYETEKHRGFAFVEFELAEDAAAAIDNMNESELFGRTIRVNLAKPMRIKEGSSRPVWSDDDWLKKFSGKTLEENKEEEGSEPPKAETQEGEPIAKKARSNPQVYMDIKIGNKPAGRIQMLLRSDVVPMTAENFRCLCTHEKGFGFKGSSFHRIIPQFMCQGGDFTNHNGTGGKSIYGKKFDDENFILKHTGPGLLSMANSGPNTNGSQFFLTCDKTDWLDGKHVVFGEVTEGLDVLRQIEAQGSKDGKPKQKVIIADCGEYV

SEQ ID NO: 864042 - protein, 314 aa, Homo sapiens
SRRHGCEKTTKGGKRASKMATTKRVLYVGGLAEEVDDKVLHAAFIPFGDITDIQIPLDYETEKHRGFAFVEFELAEDAAAAIDNMNESELFGRTIRVNLAKPMRIKEGSSRPVWSDDDWLKKFSGKTLEENKEEEGSEPPKAETQEGEPIAKKARSNPQVYMDIKIGNKPAGRIQMLLRSDVVPMTAENFRCLCTHEKGFGFKGSSFHRIIPQFMCQGGDFTNHNGTGGKSIYGKKFDDENFILKHTGPGLLSMANSGPNTNGSQFFLTCDKTDWLDGKHVVFGEVTEGLDVLRQIEKQEESAITSQPRSWKLT

SEQ ID NO: 864043 - protein, 217 aa, Homo sapiens
MRIKEGSSRPVWSDDDWLKKFSGKTLEENKEEEGSEPPKAETQEGEPIAKKARSNPQVYMDIKIGNKPAGRIQMLLRSDVVPMTAENFRCLCTHEKGFGFKGSSFHRIIPQFMCQGGDFTNHNGTGGKSIYGKKFDDENFILKHTGPGLLSMANSGPNTNGSQFFLTCDKTDWLDGKHVVFGEVTEGLDVLRQIEAQGSKDGKPKQKVIIADCGEYV

SEQ ID NO: 864044 - protein, 301 aa, Homo sapiens
SRRHGCEKTTKGGKRASKMATTKRVLYVGGLAEEVDDKVLHAAFIPFGDITDIQIPLDYETEKHRGFAFVEFELAEDAAAAIDNMNESELFGRTIRVNLAKPMRIKEGSSRPVWSDDDWLKKFSGKTLEENKEEEGSEPPKAETQEGEPIAKKARSNPQVYMDIKIGNKPAGRIQMLLRSDVVPMTAENFRCLCTHEKGFGFKGSSFHRIIPQFMCQGGDFTNHNGTGGKSIYGKKFDDGPNTNGSQFFLTCDKTDWLDGKHVVFGEVTEGLDVLRQIEAQGSKDGKPKQKVIIADCGEYV

SEQ ID NO: 864045 - protein, 202 aa, Homo sapiens
SRRHGCEKTTKGGKRASKMATTKRVLYVGGLAEEVDDKVLHAAFIPFGDITDIQIPLDYETEKHRGFAFVEFELAEDAAAAIDNMNESELFGRTIRVNLAKPMRIKEGSSRPVWSDDDWLKKFSGKTLEENKEEEGSEPPKAETQEGEPIAKKARSNPQVYMDIKIGNKPAGRIQMLLRSDVVPMTAARCMVHACSPSYSRG

SEQ ID NO: 864046 - protein, 134 aa, Homo sapiens
MAENFRCLCTHEKGFGFKGSSFHRIIPQFMCQGGDFTNHNGTGGKSIYGKKFDDENFILKHTGPGLLSMANSGPNTNGSQFFLTCDKTDWLDGKHVVFGEVTEGLDVLRQIEAQGSKDGKPKQKVIIADCGEYV

SEQ ID NO: 864047 - protein, 226 aa, Homo sapiens
SRRHGCEKTTKGGKRASKMATTKRVLYVGGLAEEVDDKVLHAAFIPFGDITDIQIPLDYETEKHRGFAFVEFELAEDAAAAIDNMNESELFGRTIRVNLAKPMRIKEGSSRPVWSDDDWLKKFSGKTLEENKEEEGSEPPKAETQERISAACALMKRALALREAASTASSPSSCARAVISQTTMALGASPSMGRSSMMKTLSSSIRDQVYYPWPTLAQTPMALSSS

SEQ ID NO: 864048 - protein, 376 aa, Homo sapiens
MGLLAFLKTQFVLHLLVGFVFVVSGLVINFVQLCTLALWPVSKQLYRRLNCRLAYSLWSQLVMLLEWWSCTECTLFTDQATVERFGKEHAVIILNHNFEIDFLCGWTMCERFGVLGSSKVLAKKELLYVPLIGWTWYFLEIVFCKRKWEEDRDTVVEGLRRLSDYPEYMWFLLYCEGTRFTETKHRVSMEVAAAKGLPVLKYHLLPRTKGFTTAVKCLRGTVAAVYDVTLNFRGNKNPSLLGILYGKKYEADMCVRRFPLEDIPLDEKEAAQWLHKLYQEKDALQEIYNQKGMFPGEQFKPARRPWTLLNFLSWATILLSPLFSFVLGVFASGSPLLILTFLGFVGAASFGVRRLIGVTEIEKGSSYGNQEFKKKE

SEQ ID NO: 864049 - protein, 44 aa, Homo sapiens
MCITALSVAPKGWVPAAVGRERITVARPCRGGHSAATDAPWVLS

SEQ ID NO: 864050 - protein, 376 aa, Homo sapiens; identical to SEQ ID NO: 864048

SEQ ID NO: 864051 - protein, 314 aa, Homo sapiens
MLLEWWSCTECTLFTDQATVERFGKEHAVIILNHNFEIDFLCGWTMCERFGVLGSSKVLAKKELLYVPLIGWTWYFLEIVFCKRKWEEDRDTVVEGLRRLSDYPEYMWFLLYCEGTRFTETKHRVSMEVAAAKGLPVLKYHLLPRTKGFTTAVKCLRGTVAAVYDVTLNFRGNKNPSLLGILYGKKYEADMCVRRFPLEDIPLDEKEAAQWLHKLYQEKDALQEIYNQKGMFPGEQFKPARRPWTLLNFLSWATILLSPLFSFVLGVFASGSPLLILTFLGFVGAASFGVRRLIGVTEIEKGSSYGNQEFKKKE

SEQ ID NO: 864052 - protein, 480 aa, Homo sapiens
VDWKDTLSAAPCHHHTLLEPLPPRPVLTPERVKARSLPTDGCPQRGAVHPLLSSAMGLLAFLKTQFVLHLLVGFVFVVSGLVINFVQLCTLALWPVSKQLYRRLNCRLAYSLWSLAQNKKQPKHLSLETNYAAPIQGPSAAIMESLHLARTVLSEKEVYNKVHKLVMLLEWWSCTECTLFTDQATVERFGKEHAVIILNHNFEIDFLCGWTMCERFGVLGSSKVLAKKELLYVPLIGWTWYFLEIVFCKRKWEEDRDTVVEGLRRLSDYPEYMWFLLYCEGTRFTETKHRVSMEVAAAKGLPVLKYHLLPRTKGFTTAVKCLRGTVAAVYDVTLNFRGNKNPSLLGILYGKKYEADMCVRRFPLEDIPLDEKEAAQWLHKLYQEKDALQEIYNQKGMFPGEQFKPARRPWTLLNFLSWATILLSPLFSFVLGVFASGSPLLILTFLGFVGAASFGVRRLIGVTEIEKGSSYGNQEFKKKE

SEQ ID NO: 864053 - protein, 540 aa, Homo sapiens
ADTWSFDFWLGLFCECGAWSYPLGQCLCDDENGKTATVPTLAGLSPLAGAGSAAVSGRRHCPGPSCGCSQPCCWLLLPSWLAETLGHAGKRAESSSLLRQERIQQDFFLPTLLPLPVWAADKSQGPTLLATSCCSHTPARDLPPGSNKDGCPQRGAVHPLLSSAMGLLAFLKTQFVLHLLVGFVFVVSGLVINFVQLCTLALWPVSKQLYRRLNCRLAYSLWSQLVMLLEWWSCTECTLFTDQATVERFGKEHAVIILNHNFEIDFLCGWTMCERFGVLGSSKVLAKKELLYVPLIGWTWYFLEIVFCKRKWEEDRDTVVEGLRRLSDYPEYMWFLLYCEGTRFTETKHRVSMEVAAAKGLPVLKYHLLPRTKGFTTAVKCLRGTVAAVYDVTLNFRGNKNPSLLGILYGKKYEADMCVRRFPLEDIPLDEKEAAQWLHKLYQEKDALQEIYNQKGMFPGEQFKPARRPWTLLNFLSWATILLSPLFSFVLGVFASGSPLLILTFLGFVGAASFGVRRLIGVTEIEKGSSYGNQEFKKKE

SEQ ID NO: 864054 - protein, 376 aa, Homo sapiens; identical to SEQ ID NO: 864048

SEQ ID NO: 864055 - protein, 376 aa, Homo sapiens; identical to SEQ ID NO: 864048

SEQ ID NO: 864056 - protein, 376 aa, Homo sapiens; identical to SEQ ID NO: 864048

SEQ ID NO: 864057 - protein, 337 aa, Homo sapiens
LPDHPRRRGPTSANALPLSAELVMLLEWWSCTECTLFTDQATVERFGKEHAVIILNHNFEIDFLCGWTMCERFGVLGSSKVLAKKELLYVPLIGWTWYFLEIVFCKRKWEEDRDTVVEGLRRLSDYPEYMWFLLYCEGTRFTETKHRVSMEVAAAKGLPVLKYHLLPRTKGFTTAVKCLRGTVAAVYDVTLNFRGNKNPSLLGILYGKKYEADMCVRRFPLEDIPLDEKEAAQWLHKLYQEKDALQEIYNQKGMFPGEQFKPARRPWTLLNFLSWATILLSPLFSFVLGVFASGSPLLILTFLGFVGAASFGVRRLIGVTEIEKGSSYGNQEFKKKE

SEQ ID NO: 864058 - protein, 376 aa, Homo sapiens; identical to SEQ ID NO: 864048

SEQ ID NO: 864059 - protein, 376 aa, Homo sapiens; identical to SEQ ID NO: 864048

SEQ ID NO: 864060 - protein, 517 aa, Homo sapiens
ADTWSFDFWLGLFCECGAWSYPLGQCLCDDENGKTATVPTLAGLSPLAGAGSAAVSGRRHCPGPSCGCSQPCCWLLLPSWLAETLGHAGKRAESSSLLRQERIQQDFFLPTLLPLPVWAADKSQGPTLLATSCCSHTPARDLPPGSNKDGCPQRGAVHPLLSSAMGLLAFLKTQFVLHLLVGFVFVVSGLVINFVQLCTLALWPVSKQLYRRLNCRLAYSLWSQLVMLLEWWSCTECTLFTDQATVERFGKEHAVIILNHNFEIDFLCGWTMCERFGVLGSSKVLAKKELLYVPLIGWTWYFLEIVFCKRKWEEDRDTVVEGLRRLSDYPEYMWFLLYCEGTRFTETKHRVSMEVAAAKGLPVLKYHLLPRTKGFTTAVKCLRGTVAAVYDVTLNFRGNKNPSLLGILYGKKYEADMCVRRFPLEDIPLDEKEAAQWLHKLYQEKDALQEIYNQKGMFPGEQFKPARRPWTLLNFLSWATILLSPLFSFVLGVFASGSPLLILTFLGFVGAGNGHCR

SEQ ID NO: 864061 - protein, 406 aa, Homo sapiens
ADTWSFDFWLGLFCECGAWSYPLGQCLCDDENGKTATVPTLAGLSPLAGAGSAAVSGRRHCPGPSCGCSQPCCWLLLPSWLAETLGHAGKRAESSSLLRQERIQQDFFLPTLLPLPVWAADKSQGPTLLATSCCSHTPARDLPPGSNKDGCPQRGAVHPLLSSAMGLLAFLKTQFVLHLLVGFVFVVSGLVINFVQLCTLALWPVSKQLYRRLNCRLAYSLWSQLVMLLEWWSCTECTLFTDQATVERFGKEHAVIILNHNFEIDFLCGWTMCERFGVLGSSKVLAKKELLYVPLIGWTWYFLEIVFCKRKWEEDRDTVVEGLRRLSDYPEYMWFLLYCEGTRFTETKHRVSMEVAAAKGLPVLKYHLLPRTKGFTTAVKCLRGTGRPQTARAGATAMLTENSDFF

SEQ ID NO: 864062 - protein, 199 aa, Homo sapiens
VHCAVIRPWELSTSLHLPPNITTLRPVRPSQHPRGDKFWSSESWEGSCWCDLSCSPDPKGIWDLPPSTNGVGLLSSRLWFHAPTVAPAPSDTASSPREGRTTKVMDLQDVEVDDPGRWPSAREHVKRLWAVQTAGGHRPGCDLGPHGRVVDLLLELGSRAEASPSDLALAGSIHPFWGLLPQRLPLRRAGPKTPEFRGH

SEQ ID NO: 864063 - protein, 160 aa, Homo sapiens
GPLCSHQALGAFHIPPPPTQHHHSPASETVTAPQRRQILELRELGVAPAPSDTASSPREGRTTKVMDLQDVEVDDPGRWPSAREHVKRLWAVQTAGGHRPGCDLGPHGRVVDLLLELGSRAEASPSDLALAGSIHPFWGLLPQRLPLRRAGPKTPEFRGH

SEQ ID NO: 864064 - protein, 314 aa, Homo sapiens; identical to SEQ ID NO: 864051

SEQ ID NO: 864065 - protein, 376 aa, Homo sapiens; identical to SEQ ID NO: 864048

SEQ ID NO: 864066 - protein, 376 aa, Homo sapiens; identical to SEQ ID NO: 864048

SEQ ID NO: 864067 - protein, 376 aa, Homo sapiens; identical to SEQ ID NO: 864048

SEQ ID NO: 864068 - protein, 83 aa, Homo sapiens
DSYLHHYLQYSRGLSYCSFSMALQVQVGLQAREEAPPGQGRAGVKRGTLHMGEGRPGPSAAWQTQTCGSHVNLRTSGSHPPCF

SEQ ID NO: 864069 - protein, 381 aa, Homo sapiens
MLLSIGMLMLSATQVYTILTVQLFAFLNLLPVEADILAYNFENASQTFDDLPARFGYRLPAEGLKGFLINSKPENACEPIVPPPVKDNSSGTFIVLIRRLDCNFDIKVLNAQRAGYKAAIVHNVDSDDLISMGSNDIEVLKKIDIPSVFIGESSANSLKDEFTYEKGGHLILVPEFSLPLEYYLIPFLIIVGICLILIVIFMITKFVQDRHRARRNRLRKDQLKKLPVHKFKKGDEYDVCAICLDEYEDGDKLRILPCSHAYHCKCVDPWLTKTKKTCPVCKQKVVPSQGDSDSDTDSSQEENEVTEHTPLLRPLASVSAQSFGALSESRSHQNMTESSDYEEDDNEDTDSSDAENEINEHDVVVQLQPNGERDYNIANTV

SEQ ID NO: 864070 - protein, 381 aa, Homo sapiens; identical to SEQ ID NO: 864069

SEQ ID NO: 864071 - protein, 168 aa, Homo sapiens
MLLSIGMLMLSATQVYTILTVQLFAFLNLLPVEADILAYNFENASQTFDDLPARFGYRLPAEGLKGFLINSKPENACEPIVPPPVKDNSSGTFIVLIRRLDCNFDIKVLNAQRAGYKAAIVHNVDSDDLISMGSNDIEVLKKIDIPSVFIGESSANSLKDEFTYEKGT

SEQ ID NO: 864072 - protein, 250 aa, Homo sapiens
MGSNDIEVLKKIDIPSVFIGESSANSLKDEFTYEKGGHLILVPEFSLPLEYYLIPFLIIVGICLILIVIFMITKFVQDRHRARRNRLRKDQLKKLPVHKFKKGDEYDVCAICLDEYEDGDKLRILPCSHAYHCKCVDPWLTKTKKTCPVCKQKVVPSQGDSDSDTDSSQEENEVTEHTPLLRPLASVSAQSFGALSESRSHQNMTESSDYEEDDNEDTDSSDAENEINEHDVVVQLQPNGERDYNIANTV

SEQ ID NO: 864073 - protein, 225 aa, Homo sapiens
GTARKLRDEKGGHLILVPEFSLPLEYYLIPFLIIVGICLILIVIFMITKFVQDRHRARRNRLRKDQLKKLPVHKFKKGDEYDVCAICLDEYEDGDKLRILPCSHAYHCKCVDPWLTKTKKTCPVCKQKVVPSQGDSDSDTDSSQEENEVTEHTPLLRPLASVSAQSFGALSESRSHQNMTESSDYEEDDNEDTDSSDAENEINEHDVVVQLQPNGERDYNIANTV

SEQ ID NO: 864074 - protein, 381 aa, Homo sapiens; identical to SEQ ID NO: 864069

SEQ ID NO: 864075 - protein, 381 aa, Homo sapiens; identical to SEQ ID NO: 864069

SEQ ID NO: 864076 - protein, 358 aa, Homo sapiens
MLLSIGMLMLSATQVYTILTVQLFAFLNLLPVEADILAYNFENASQTFDDLPARFGYRLPAEGLKGFLINSKPENACEPIVPPPVLNAQRAGYKAAIVHNVDSDDLISMGSNDIEVLKKIDIPSVFIGESSANSLKDEFTYEKGGHLILVPEFSLPLEYYLIPFLIIVGICLILIVIFMITKFVQDRHRARRNRLRKDQLKKLPVHKFKKGDEYDVCAICLDEYEDGDKLRILPCSHAYHCKCVDPWLTKTKKTCPVCKQKVVPSQGDSDSDTDSSQEENEVTEHTPLLRPLASVSAQSFGALSESRSHQNMTESSDYEEDDNEDTDSSDAENEINEHDVVVQLQPNGERDYNIANTV

SEQ ID NO: 864077 - protein, 129 aa, Homo sapiens [sequence omitted]

SEQ ID NO: 864078 - protein, 81 aa, Homo sapiens
GHRPFQCRYCPYSASQKGNLKTHVLCVHRMPFDNSQYPDRRFKRSRVDSEASGNFEEPTAVKAGSSADLTEEGGKGQEETN

SEQ ID NO: 864079 - protein, 432 aa, Homo sapiens
MILLRASEVRQLLHNKFVVILGDSVHRAVYKDLVLLLQKDRLLTPGQLRARGELNFEQDELVDGGQRGHMHNGLNYREVREFRSDHHLVRFYFLTRVYSDYLQTILKELQSGEHAPDLVIMNSCLWDISRYGPNSWRSYLENLENLFQCLGQVLPESCLLVWNTAMPVGEEVTGGFLPPKLRRQKATFLKNEVVKANFHSATEARKHNFDVLDLHFHFRHARENLHWDGVHWNGRVHRCLSQLLLAHVADAWGVELPHRHPVGEWIKKKKPGPRVEGPPQANRNHPALPLSPPLPSPTYRPLLGFPPQRLPLLPLLSPQPPPPILHHQGMPRFPQGPPDACFSSDHTFQSDQFYCHSDVPSSAHAGFFVEDNFMVGPQLPMPFFPTPRYQRPAPVVHRGFGRYRPRGPYTPWGQRPRPSKRRAPANPEPRPQ

SEQ ID NO: 864080 - protein, 432 aa, Homo sapiens; identical to SEQ ID NO: 864079

SEQ ID NO: 864081 - protein, 125 aa, Homo sapiens
MILLRASEVRQLLHNKFVVILGDSVHRAVYKDLVLLLQKDRLLTPGQLRARGELNFEQDELVDGGQRGHMHNGLNYREVREFRSDHHLVRFYFLTRVYSDYLQTILKELQSGEHAPDLVIMNSCL

SEQ ID NO: 864082 - protein, 432 aa, Homo sapiens; identical to SEQ ID NO: 864079

SEQ ID NO: 864083 - protein, 312 aa, Homo sapiens
MNSCLWDISRYGPNSWRSYLENLENLFQCLGQVLPESCLLVWNTAMPVGEEVTGGFLPPKLRRQKATFLKNEVVKANFHSATEARKHNFDVLDLHFHFRHARENLHWDGVHWNGRVHRCLSQLLLAHVADAWGVELPHRHPVGEWIKKKKPGPRVEGPPQANRNHPALPLSPPLPSPTYRPLLGFPPQRLPLLPLLSPQPPPPILHHQGMPRFPQGPPDACFSSDHTFQSDQFYCHSDVPSSAHAGFFVEDNFMVGPQLPMPFFPTPRYQRPAPVVHRGFGRYRPRGPYTPWGQRPRPSKRRAPANPEPRPQ

SEQ ID NO: 864084 - protein, 1298 aa, Homo sapiens
MAAETQTLNFGPEWLRALSSGGSITSPPLSPALPKYKLADYRYGREEMLALFLKDNKIPSDLLDKEFLPILQEEPLPPLALVPFTEEEQRNFSMSVNSAAVLRLTGRGGGGTVVGAPRGRSSSRGRGRGRGECGFYQRSFDEVEGVFGRGGGREMHRSQSWEERGDRRFEKPGRKDVGRPNFEEGGPTSVGRKHEFIRSESENWRIFREEQNGEDEDGGWRLAGSRRDGERWRPHSPDGPRSAGWREHMERRRRFEFDFRDRDDERGYRRVRSGSGSIDDDRDSLPEWCLEDAEEEMGTFDSSGAFLSLKKVQKEPIPEEQEMDFRPVDEGEECSDSEGSHNEEAKEPDKTNKKEGEKTDRVGVEASEETPQTSSSSARPGTPSDHQSQEASQFERKDEPKTEQTEKAEEETRMENSLPAKVPSRGDEMVADVQQPLSQIPSDTASPLLILPPPVPNPSPTLRPVETPVVGAPGMGSVSTEPDDEEGLKHLEQQAEKMVAYLQDSALDDERLASKLQEHRAKGVSIPLMHEAMQKWYYKDPQGEIQGPFNNQEMAEWFQAGYFTMSLLVKRACDESFQPLGDIMKMWGRVPFSPGPAPPPHMGELDQERLTRQQELTALYQMQHLQYQQFLIQQQYAQVLAQQQKAALSSQQQQQLALLLQQFQTLKMRISDQNIIPSVTRSVSVPDTGSIWELQPTASQPTVWEGGSVWDLPLDTTTPGPALEQLQQLEKAKAAKLEQERREAEMRAKREEEERKRQEELRRQQEEILRRQQEEERKRREEEELARRKQEEALRRQREQEIALRRQREEEERQQQEEALRRLEERRREEEERRKQEELLRKQEEEAAKWAREEEEAQRRLEENRLRMEEEAARLRHEEEERKRKELEVQRQKELMRQRQQQQEALRRLQQQQQQQQLAQMKLPSSSTWGQQSNTTACQSQATLSLAEIQKLEEERERQLREEQRRQQRELMKALQQQQQQQQQKLSGWGNVSKPSGTTKSLLEIQQEEARQMQKQQQQQQQHQQPNRARNNTHSNLHTSIGNSVWGSINTGPPNQWASDLVSSIWSNADTKNSNMGFWDDAVKEVGPRNSTNKNKNNASLSKSVGVSNRQNKKVEEEEKLLKLFQGVNKAQDGFTQWCEQMLHALNTANNLDVPTFVSFLKEVESPYEVHDYIRAYLGDTSEAKEFAKQFLERRAKQKANQQRQQQQLPQQQQQPPQQPPQQPQQQDSVWGMNHSTLHSVFQTNQSNNQQSNFEAVQSGKKKKKQKMVRADPSLLGFSVNASSERLNMGEIETLDDY

SEQ ID NO: 864085 - protein, 1298 aa, Homo sapiens; identical to SEQ ID NO: 864084

SEQ ID NO: 864086 - protein, 1144 aa, Homo sapiens [sequence omitted]

SEQ ID NO: 864087 - protein, 1298 aa, Homo sapiens; identical to SEQ ID NO: 864084

SEQ ID NO: 864088 - protein, 1048 aa, Homo sapiens
RIADLLADLFSLLLSYLSYRVRSGSGSIDDDRDSLPEWCLEDAEEEMGTFDSSGAFLSLKKVQKEPIPEEQEMDFRPVDEGEECSDSEGSHNEEAKEPDKTNKKEGEKTDRVGVEASEETPQTSSSSARPGTPSDHQSQEASQFERKDEPKTEQTEKAEEETRMENSLPAKVPSRGDEMVADVQQPLSQIPSDTASPLLILPPPVPNPSPTLRPVETPVVGAPGMGSVSTEPDDEEGLKHLEQQAEKMVAYLQDSALDDERLASKLQEHRAKGVSIPLMHEAMQKWYYKDPQGEIQGPFNNQEMAEWFQAGYFTMSLLVKRACDESFQPLGDIMKMWGRVPFSPGPAPPPHMGELDQERLTRQQELTALYQMQHLQYQQFLIQQQYAQVLAQQQKAALSSQQQQQLALLLQQFQTLKMRISDQNIIPSVTRSVSVPDTGSIWELQPTASQPTVWEGGSVWDLPLDTTTPGPALEQLQQLEKAKAAKLEQERREAEMRAKREEEERKRQEELRRQQEEILRRQQEEERKRREEEELARRKQEEALRRQREQEIALRRQREEEERQQQEEALRRLEERRREEEERRKQEELLRKQEEEAAKWAREEEEAQRRLEENRLRMEEEAARLRHEEEERKRKELEVQRQKELMRQRQQQQEALRRLQQQQQQQQLAQMKLPSSSTWGQQSNTTACQSQATLSLAEIQKLEEERERQLREEQRRQQRELMKALQQQQQQQQQKLSGWGNVSKPSGTTKSLLEIQQEEARQMQKQQQQQQQHQQPNRARNNTHSNLHTSIGNSVWGSINTGPPNQWASDLVSSIWSNADTKNSNMGFWDDAVKEVGPRNSTNKNKNNASLSKSVGVSNRQNKKVEEEEKLLKLFQGVNKAQDGFTQWCEQMLHALNTANNLDVPTFVSFLKEVESPYEVHDYIRAYLGDTSEAKEFAKQFLERRAKQKANQQRQQQQLPQQQQQPPQQPPQQPQQQDSVWGMNHSTLHSVFQTNQSNNQQSNFEAVQSGKKKKKQKMVRADPSLLGFSVNASSERLNMGEIETLDDY

SEQ ID NO: 864089 - protein, 1298 aa, Homo sapiens; identical to SEQ ID NO: 864084

SEQ ID NO: 864090 - protein, 1298 aa, Homo sapiens; identical to SEQ ID NO: 864084

SEQ ID NO: 864091 - protein, 1401 aa, Homo sapiens
MAAETQTLNFGPEWLRALSSGGSITSPPLSPALPKYKLADYRYGREEMLALFLKDNKIPSDLLDKEFLPILQEEPLPPLALVPFTEEEQRNFSMSVNSAAVLRLTGRGGGGTVVGAPRGRSSSRGRGRGRGECGFYQRSFDEVEGVFGRGGGREMHRSQSWEERGDRRFEKPGRKDVGRPNFEEGGPTSVGRKHEFIRSESENWRIFREEQNGEDEDGGWRLAGSRRDGERWRPHSPDGPRSAGWREHMERRRRFEFDFRDRDDERGYRRVRSGSGSIDDDRDSLPEWCLEDAEEEMGTFDSSGAFLSLKKVQKEPIPEEQEMDFRPVDEGEECSDSEGSHNEEAKEPDKTNKKEGEKTDRVGVEASEETPQTSSSSARPGTPSDHQSQEASQFERKDEPKTEQTEKAEEETRMENSLPAKVPSRGDEMVADVQQPLSQIPSDTASPLLILPPPVPNPSPTLRPVETPVVGAPGMGSVSTEPDDEEGLKHLEQQAEKMVAYLQDSALDDERLASKLQEHRAKGVSIPLMHEAMQKWYYKDPQGEIQGPFNNQEMAEWFQAGYFTMSLLVKRACDESFQPLGDIMKMWGRVPFSPGPAPPPHMGELDQERLTRQQELTALYQMQHLQYQQFLIQQQYAQVLAQQQKAALSSQQQQQLALLLQQFQTLKMRISDQNIIPSVTRSVSVPDTGSIWELQPTASQPTVWEGGSVWDLPLDTTTPGPALEQLQQLEKAKAAKLEQERREAEMRAKREEEERKRQEELRRQQEEILRRQQEEERKRREEEELARRKQEEALRRQREQEIALRRQREEEERQQQEEALRRLEERRREEEERRKQEELLRKQEEEAAKWAREEEEAQRRLEENRLRMEEEAARLRHEEEERKRKELEVQRQKELMRQRQQQQEALRRLQQQQQQQQLAQMKLPSSSTWGQQSNTTACQSQATLSLAEIQKLEEERERQLREEQRRQQRELMKALQQQQQQQQQKLSGWGNVSKPSGTTKSLLEIQQEEARQMQKQQQQQQQHQQPNRARNNTHSNLHTSIGNSVWGSINTGPPNQWASDLVSSIWSNADTKNSNMGFWDDAVKEVGPRNSTNKNKNNASLSKSVGVSNRQNKKVEEEEKLLKLFQGVNKAQDGFTQWCEQMLHALNTANNLDVPTFVSFLKEVESPYEVHDYIRAYLGDTSEAKEFAKQFLERRAKQKANQQRQQQQLPQQQQQPPQQPPQQPQQQDSVWGMNHSTLHSVFQQLEKAKAAKLEQERREAEMRAKREEEERKRQEDLRRQQEEILRRQQEEERKWREEEELARRKQEEALRRQREQEIALRRQREEEERQQQEEALRRLEERRREEEERRKQEELLRKQEEGRPQLRQTALSVSGVLQVEAQIRSHVEARPWLFLPLWKPP

SEQ ID NO: 864092 - protein, 157 aa, Homo sapiens
MLHALNTANNLDVPTFVSFLKEVESPYEVHDYIRAYLGDTSEAKEFAKQFLERRAKQKANQQRQQQQLPQQQQQPPQQPPQQPQQQDSVWGMNHSTLHSVFQTNQSNNQQSNFEAVQSGKKKKKQKMVRADPSLLGFSVNASSERLNMGEIETLDDY

SEQ ID NO: 864093 - protein, 79 aa, Homo sapiens
NVSISPMLSRSDDAWVKSRRWMTTEHLPVDWPSLSCLPTMESPPLDTTLTHHLLFITLQQITEPIISGFFFWPFVSKIL

SEQ ID NO: 864094 - protein, 356 aa, Homo sapiens
MAAETQTLNFGPEWLRALSSGGSITSPPLSPALPKYKLADYRYGREEMLALFLKDNKIPSDLLDKEFLPILQEEPLPPLALVPFTEEEQRNFSMSVNSAAVLRLTGRGGGGTVVGAPRGRSSSRGRGRGRGECGFYQRSFDEVEGVFGRGGGREMHRSQSWEERGDRRFEKPGRKDVGRPNFEEGGPTSVGRKHEFIRSESENWRIFREEQNGEDEDGGWRLAGSRRDGERWRPHSPDGPRSAGWREHMERRRRFEFDFRDRDDERGYRRVRSGSGSIDDDRDSLPEWCLEDAEEEMGTFDSSGAFLSLKKVQKEPIPEEQEMDFRPVDEGEECSDSEGSHNEEAKDADKLANMGK

SEQ ID NO: 864095 - protein, 1298 aa, Homo sapiens; identical to SEQ ID NO: 864084

SEQ ID NO: 864096 - protein, 1298 aa, Homo sapiens; identical to SEQ ID NO: 864084

SEQ ID NO: 864097 - protein, 1298 aa, Homo sapiens; identical to SEQ ID NO: 864084

SEQ ID NO: 864098 - protein, 1129 aa, Homo sapiens
MTKLPDDPGRPNFEEGGPTSVGRKHEFIRSESENWRIFREEQNGEDEDGGWRLAGSRRDGERWRPHSPDGPRSAGWREHMERRRRFEFDFRDRDDERGYRRVRSGSGSIDDDRDSLPEWCLEDAEEEMGTFDSSGAFLSLKKVQKEPIPEEQEMDFRPVDEGEECSDSEGSHNEEAKEPDKTNKKEGEKTDRVGVEASEETPQTSSSSARPGTPSDHQSQEASQFERKDEPKTEQTEKAEEETRMENSLPAKVPSRGDEMVADVQQPLSQIPSDTASPLLILPPPVPNPSPTLRPVETPVVGAPGMGSVSTEPDDEEGLKHLEQQAEKMVAYLQDSALDDERLASKLQEHRAKGVSIPLMHEAMQKWYYKDPQGEIQGPFNNQEMAEWFQAGYFTMSLLVKRACDESFQPLGDIMKMWGRVPFSPGPAPPPHMGELDQERLTRQQELTALYQMQHLQYQQFLIQQQYAQVLAQQQKAALSSQQQQQLALLLQQFQTLKMRISDQNIIPSVTRSVSVPDTGSIWELQPTASQPTVWEGGSVWDLPLDTTTPGPALEQLQQLEKAKAAKLEQERREAEMRAKREEEERKRQEELRRQQEEILRRQQEEERKRREEEELARRKQEEALRRQREQEIALRRQREEEERQQQEEALRRLEERRREEEERRKQEELLRKQEEEAAKWAREEEEAQRRLEENRLRMEEEAARLRHEEEERKRKELEVQRQKELMRQRQQQQEALRRLQQQQQQQQLAQMKLPSSSTWGQQSNTTACQSQATLSLAEIQKLEEERERQLREEQRRQQRELMKALQQQQQQQQQKLSGWGNVSKPSGTTKSLLEIQQEEARQMQKQQQQQQQHQQPNRARNNTHSNLHTSIGNSVWGSINTGPPNQWASDLVSSIWSNADTKNSNMGFWDDAVKEVGPRNSTNKNKNNASLSKSVGVSNRQNKKVEEEEKLLKLFQGVNKAQDGFTQWCEQMLHALNTANNLDVPTFVSFLKEVESPYEVHDYIRAYLGDTSEAKEFAKQFLERRAKQKANQQRQQQQLPQQQQQPPQQPPQQPQQQDSVWGMNHSTLHSVFQTNQSNNQQSNFEAVQSGKKKKKQKMVRADPSLLGFSVNASSERLNMGEIETLDDY

SEQ ID NO: 864099 - protein, 1280 aa, Homo sapiens
MAAETQTLNFGPEWLRALSSGGSITSPPLSPALPKYKLADYRYGREEMLALFLKDNKIPSDLLDKEFLPILQEEPLPPLALVPFTEEEQRNFSMSVNSAAVLRLTGRGGGGTVVGAPRGRSSSRGRGRGRGECGFYQRSFDEVEGVFGRGGGREMHRSQSWEERGDRRFEKPGRKDVGRPNFEEGGPTSVGRKHEFIRSESENWRIFREEQNGEDEDGGWRLAGSRRDGERWRPHSPDGPRSAGWREHMERRRRFEFDFRDRDDERGYRRVRSGSGSIDDDRDSLPEWCLEDAEEEMGTFDSSGAFLSLKKVQKEPIPEEQEMDFRPVDEGEECSDSEGSHNEEAKEPDKTNKKEGEKTDRVGVEASEETPQTSSSSARPGTPSDHQSQEASQFERKDEPKTEQTEKAEEETRMENSLPAKVPSRGDEMVADVQQPLSQIPSDTASPLLILPPPVPNPSPTLRPVETPVVGAPGMGSVSTEPDDEEGLKHLEQQAEKMVAYLQDSALDDERLASKLQEHRAKGVSIPLMHEAMQKWYYKDPQGEIQGPFNNQEMAEWFQAGYFTMSLLVKRACDESFQPLGDIMKMWGRVPFSPGPAPPPHMGELDQERLTRQQELTALYQMQHLQYQQFLIQQQYAQVLAQQQKAALSSQQQQQLALLLQQFQTLKMRISDQNIIPSVTRSVSVPDTGSIWELQPTASQPTVWEGGSVWDLPLDTTTPGPALEQLQQLEKAKAAKLEQERREAEMRAKREEEERKRQEELRRQQEEILRRQQEEERKRREEEELARRKQEEALRRQREQEIALRRQREEEERQQQEEALRRLEERRREEEERRKQEELLRKQEEEAAKWAREEEEAQRRLEENRLRMEEEAARLRHEEEERKRKELEVQRQKELMRQRQQQQEALRRLQQQQQQQQLAQMKLPSSSTWGQQSNTTACQSQATLSLAEIQKLEEERERQLREEQRRQQRELMKALQQQQQQQQQKLSGWGNVSKPSGTTKSLLEIQQEEARQMQKQQQQQQQHQQPNRARNNTHSNLHTSIGNSVWGSINTGPPNQWASDLVSSIWSNADTKNSNMGFWDDAVKEVGPRNSTNKNKNNASLSKSVGVSNRQNKKVEEEEWCEQMLHALNTANNLDVPTFVSFLKEVESPYEVHDYIRAYLGDTSEAKEFAKQFLERRAKQKANQQRQQQQLPQQQQQPPQQPPQQPQQQDSVWGMNHSTLHSVFQTNQSNNQQSNFEAVQSGKKKKKQKMVRADPSLLGFSVNASSERLNMGEIETLDDY

SEQ ID NO: 864100 - protein, 475 aa, Homo sapiens
NSFLKQLFRSETQTSIQTPNEEEAAKWAREEEEAQRRLEENRLRMEEEAARLRHEEEERKRKELEVQRQKELMRQRQQQQEALRRLQQQQQQQQLAQMKLPSSSTWGQQSNTTACQSQATLSLAEIQKLEEERERQLREEQRRQQRELMKALQQQQQQQQQKLSGWGNVSKPSGTTKSLLEIQQEEARQMQKQQQQQQQHQQPNRARNNTHSNLHTSIGNSVWGSINTGPPNQWASDLVSSIWSNADTKNSNMGFWDDAVKEVGPRNSTNKNKNNASLSKSVGVSNRQNKKVEEEEKLLKLFQGVNKAQDGFTQWCEQMLHALNTANNLDVPTFVSFLKEVESPYEVHDYIRAYLGDTSEAKEFAKQFLERRAKQKANQQRQQQQLPQQQQQPPQQPPQQPQQQDSVWGMNHSTLHSVFQTNQSNNQQSNFEAVQSGKKKKKQKMVRADPSLLGFSVNASSERLNMGEIETLDDY

SEQ ID NO: 864101 - protein, 1298 aa, Homo sapiens; identical to SEQ ID NO: 864084

SEQ ID NO: 864102 - protein, 255 aa, Homo sapiens
LGRGRGYSAEAYQWASDLVSSIWSNADTKNSNMGFWDDAVKEVGPRNSTNKNKNNASLSKSVGVSNRQNKKVEEEEKLLKLFQGVNKAQDGFTQWCEQMLHALNTANNLDVPTFVSFLKEVESPYEVHDYIRAYLGDTSEAKEFAKQFLERRAKQKANQQRQQQQLPQQQQQPPQQPPQQPQQQDSVWGMNHSTLHSVFQTNQSNNQQSNFEAVQSGKKKKKQKMVRADPSLLGFSVNASSERLNMGEIETLDDY

SEQ ID NO: 864103 - protein, 737 aa, Homo sapiens
MAAETQTLNFGPEWLRALSSGGSITSPPLSPALPKYKLADYRYGREEMLALFLKDNKIPSDLLDKEFLPILQEEPLPPLALVPFTEEEQRNFSMSVNSAAVLRLTGRGGGGTVVGAPRGRSSSRGRGRGRGECGFYQRSFDEVEGVFGRGGGREMHRSQSWEERGDRRFEKPGRKDVGRPNFEEGGPTSVGRKHEFIRSESENWRIFREEQNGEDEDGGWRLAGSRRDGERWRPHSPDGPRSAGWREHMERRRRFEFDFRDRDDERGYRRVRSGSGSIDDDRDSLPEWCLEDAEEEMGTFDSSGAFLSLKKVQKEPIPEEQEMDFRPVDEGEECSDSEGSHNEEAKEPDKTNKKEGEKTDRVGVEASEETPQTSSSSARPGTPSDHQSQEASQFERKDEPKTEQTEKAEEETRMENSLPAKVPSRGDEMVADVQQPLSQIPSDTASPLLILPPPVPNPSPTLRPVETPVVGAPGMGSVSTEPDDEEGLKHLEQQAEKMVAYLQDSALDDERLASKLQEHRAKGVSIPLMHEAMQKWYYKDPQGEIQGPFNNQEMAEWFQAGYFTMSLLVKRACDESFQPLGDIMKMWGRVPFSPGPAPPPHMGELDQERLTRQQELTALYQMQHLQYQQFLIQQQYAQVLAQQQKAALSSQQQQQLALLLQQFQTLKMRISDQNIIPSVTRSVSVPDTGSIWELQPTASQPTVWEGGSVWDLPLDTTTPGPALEQLQQLEKAKAAKV

SEQ ID NO: 864104 - protein, 127 aa, Homo sapiens
MAAETQTLNFGPEWLRALSSGGSITSPPLSPALPKYKLADYRYGREEMLALFLKDNKIPSDLLDKEFLPILQEEPLPPLALVPFTEEEQRNFSMSVNSAAVLRLTGRGGGGTVVGAPRGRSSSRGRG

SEQ ID NO: 864105 - protein, 311 aa, Homo sapiens
RTRGSTHASSNVYITPAGSQGLPPHYDDVEVFILQLEGEKHWRLYHPTVPLAREYSVEAEERIGRPVHEFMLKPGDLLYFPRGTIHQADTPAGLAHSTHVTISTYQNNSWGDFLLDTISGLVFDTAKEDVELRTGIPRQLLLQVESTTVATRRLSGFLRTLADRLEGTKELLSSDMKKDFIMHRLPPYSAGDGAELSTPGGKLPRLDSVVRLQFKDHIVLTVLPDQDQSDETQEKMVYIYHSLKNSRETHMMGNEEETEFHGLRFPLSHLDALKQIWNSPAISVKDLKLTTDEEKESLVLSLWTECLIQVV

SEQ ID NO: 864106 - protein, 496 aa, Homo sapiens
AAAPQRSGLAAASNRPCRVCISLLLCLEDRTMPKKAKPTGSGKEEGPAPCKQMKLEAAGGPSALNFDSPSSLFESLISPIKTETFFKEFWEQKPLLIQRDDPALATYYGSLFKLTDLKSLCSRGMYYGRDVNVCRCVNGKKKVLNKDGKAHFLQLRKDFDQKRATIQFHQPQRFKDELWRIQEKLECYFGSLVGSNVYITPAGSQGLPPHYDDVEVFILQLEGEKHWRLYHPTVPLAREYSVEAEERIGRPVHEFMLKPGDLLYFPRGTIHQADTPAGLAHSTHVTISTYQNNSWGDFLLDTISGLVFDTAKEDVELRTGIPRQLLLQVESTTVATRRLSGFLRTLADRLEGTKELLSSDMKKDFIMHRLPPYSAGDGAELSTPGGKLPRLDSVVRLQFKDHIVLTVLPDQDQSDETQEKMVYIYHSLKNSRETHMMGNEEETEFHGLRFPLSHLDALKQIWNSPAISVKDLKLTTDEEKESLVLSLWTECLIQVV

SEQ ID NO: 864107 - protein, 465 aa, Homo sapiens
MPKKAKPTGSGKEEGPAPCKQMKLEAAGGPSALNFDSPSSLFESLISPIKTETFFKEFWEQKPLLIQRDDPALATYYGSLFKLTDLKSLCSRGMYYGRDVNVCRCVNGKKKVLNKDGKAHFLQLRKDFDQKRATIQFHQPQRFKDELWRIQEKLECYFGSLVGSNVYITPAGSQGLPPHYDDVEVFILQLEGEKHWRLYHPTVPLAREYSVEAEERIGRPVHEFMLKPGDLLYFPRGTIHQADTPAGLAHSTHVTISTYQNNSWGDFLLDTISGLVFDTAKEDVELRTGIPRQLLLQVESTTVATRRLSGFLRTLADRLEGTKELLSSDMKKDFIMHRLPPYSAGDGAELSTPGGKLPRLDSVVRLQFKDHIVLTVLPDQDQSDETQEKMVYIYHSLKNSRETHMMGNEEETEFHGLRFPLSHLDALKQIWNSPAISVKDLKLTTDEEKESLVLSLWTECLIQVV

SEQ ID NO: 864108 - protein, 448 aa, Homo sapiens
AAAPQRSGLAAASNRPCRVCISLLLCLEDRTMPKKAKPTGSGKEEGPAPCKQMKLEAAGGPSALNFDSPSSLFESLISPIKTETFFKEFWEQKPLLIQRDDPALATYYGSLFKLTDLKSLCSRGMYYGRDVNVCRCVNGKKKVLNKDGKAHFLQLRKDFDQKRATIQFHQPQRFKDELWRIQEKLECYFGSLVGSNVYITPAGSQGLPPHYDDVEVFILQLEGEKHWRLYHPTVPLAREYSVEAEERIGRPVHEFMLKPGDLLYFPRGTIHQADTPAGLAHSTHVTISTYQNNSWGDFLLDTISGLVFDTAKEDVELRTGIPRQLLLQVESTTVATRRLSGFLRTLADRLEGTKELLSSDMKKDFIMHRLPPYSAGDGAELSTPGGKLPRLDSVVRLQFKDHIVLTVLPDQDQSDETQEKMVYIYHSLKNSRETHMMGNEEETEVCFN

SEQ ID NO: 864109 - protein, 117 aa, Homo sapiens
MKKDFIMHRLPPYSAGDGAELSTPGGKLPRLDSVVRLQFKDHIVLTVLPDQDQSTHMMGNEEETEFHGLRFPLSHLDALKQIWNSPAISVKDLKLTTDEEKESLVLSLWTECLIQVV

SEQ ID NO: 864110 - protein, 116 aa, Homo sapiens
KKKKKLFSTKRWQHHHPYLMYKSVGLQMAHPDLLTIAHTSPCLPKCCCLPHKAPTLCGPVFQLCPHEDPWEGRTQAPLGCFPAVLWTPHRGVTSNWSLHLSLKACLGTFLSGNIIF

SEQ ID NO: 864111 - protein, 89 aa, Homo sapiens
SQSESNQILCLLMEVHIPPMKQFCQKSHLIMMKPPDLTTPSLEIQGTEGQIIYKGLNQQNPDSGKLQDIWSCFNNRNAKRKDNDGLKET

SEQ ID NO: 864112 - protein, 238 aa, Homo sapiens
GDAEAGRRQHAEERGRRNPKTGLTLERVGPESSPYLSRRHRGQGQEGEHYHSCVQLAPTRGLEELGHGPLSLAGGPRVGGVAAAATEAPRMEWKVKVRSDGTRYVAKRPVRDRLLKARALKIREERSGMTTDDDAVSEMKMGRYWSKEERKQHLIRAREQRKRREFMMQSRLECLREQQNGDSKPELNIIALSHRKTMKKRNKKILDNWITIQEMLAHGARSADGKRVYNPLLSVTTV

SEQ ID NO: 864113 - protein, 622 aa, Homo sapiens
GAGRGLGAGREAVTSSRRRKNMAGASELGTGPGAAGGDGDDSLYPIAVLIDELRNEDVQLRLNSIKKLSTIALALGVERTRSELLPFLTDTIYDEDEVLLALAEQLGNFTGLVGGPDFAHCLLPPLENLATVEETVVRDKAVESLRQISQEHTPVALEAYFVPLVKRLASGDWFTSRTSACGLFSVCYPRASNAVKAEIRQQFRSLCSDDTPMVRRAAASKLGEFAKVLELDSVKSEIVPLFTSLASDEQDSVRLLAVEACVSIAQLLSQDDLETLVMPTLRQAAEDKSWRVRYMVADRFSELQKAMGPKITLNDLIPAFQNLLKDCEAEVRAAAAHKVKELGENLPIEDRETIIMNQILPYIKELVSDTNQHVKSALASVIMGLSTILGKENTIEHLLPLFLAQLKDECPDVRLNIISNLDCVNEVIGIRQLSQSLLPAIVELAEDAKWRVRLAIIEYMPLLAGQLGVEFFDEKLNSLCMAWLVDHVYAIREAATNNLMKLVQKFGTEWAQNTIVPKVLVMANDPNYLHRMTTLFCINALSEACGQEITTKQMLPIVLKMAGDQVANVRFNVAKSLQKIGPILDTNALQGEVKPVLQKLGQDEDMDVKYFAQEAISVLALA

SEQ ID NO: 864114 - protein, 587 aa, Homo sapiens
GAGRGLGAGREAVTSSRRRKNMAGASELGTGPGAAGGDGDDSLYPIAVLIDELRNEDVQLRLNSIKKLSTIALALGVERTRSELLPFLTDTIYDEDEVLLALAEQLGNFTGLVGGPDFAHCLLPPLENLATVEETVVRDKAVESLRQISQEHTPVALEAYFVPLVKRLASGDWFTSRTSACGLFSVCYPRASNAVKAEIRQQFRSLCSDDTPMVRRAAASKLGEFAKVLELDSVKSEIVPLFTSLASDEQDSVRLLAVEACVSIAQLLSQDDLETLVMPTLRQAAEDKSWRVRYMVADRFSELQKAMGPKITLNDLIPAFQNLLKDCEAEVRAAAAHKVKELGENLPIEDRETIIMNQILPYIKELVSDTNQHVKSALASVIMGLSTILGKENTIEHLLPLFLAQLKDECPDVRLNIISNLDCVNEVIGIRQLSQSLLPAIVELAEDAKWRVRLAIIEYMPLLAGQLGVEFFDEKLNSLCMAWLVDHVYAIREAATNNLMKLVQKFGTEWAQNTIVPKVLVMANDPNYLHRMTTLFCINALSEACGQEITTKQMLPIVLKMAGDQVANVRFNVAKSLQKIGPILDTK

SEQ ID NO: 864115 - protein, 622 aa, Homo sapiens; identical to SEQ ID NO: 864113

SEQ ID NO: 864116 - protein, 481 aa, Homo sapiens
GAGRGLGAGREAVTSSRRRKNMAGASELGTGPGAAGGDGDDSLYPIAVLIDELRNEDVQLRLNSIKKLSTIALALGVERTRSELLPFLTDTIYDEDEVLLALAEQLGNFTGLVGGPDFAHCLLPPLENLATVEETVVRDKAVESLRQISQEHTPVALEAYFVPLVKRLASGDWFTSRTSACGLFSVCYPRASNAVKAEIRQQFRSLCSDDTPMVRRAAASKLGEFAKVLELDSVKSEIVPLFTSLASDEQDSVRLLAVEACVSIAQLLSQDDLETLVMPTLRQAAEDKSWRVRYMVADRFSELQKAMGPKITLNDLIPAFQNLLKDCEAEVRAAAAHKVKELGENLPIEDRETIIMNQILPYIKELVSDTNQHVKSALASVIMGLSTILGKENTIEHLLPLFLAQLKDECPDVRLNIISNLDCVNEVIGIRQLSQSLLPAIVELAEDAKWRVRLAIIEYMPLLAGQLLGIAELVHFSQSTD

SEQ ID NO: 864117 - protein, 341 aa, Homo sapiens
GAGRGLGAGREAVTSSRRRKNMAGASELGTGPGAAGGDGDDSLYPIAVLIDELRNEDVQLRLNSIKKLSTIALALGVERTRSELLPFLTDTIYDEDEVLLALAEQLGNFTGLVGGPDFAHCLLPPLENLATVEETVVRDKAVESLRQISQEHTPVALEAYFVPLVKRLASGDWFTSRTSACGLFSVCYPRASNAVKAEIRQQFRSLCSDDTPMVRRAAASKLGEFAKVLELDSVKSEIVPLFTSLASDEQDSVRLLAVEACVSIAQLLSQDDLETLVMPTLRQAAEDKSWRVRYMVADRFSELQKAMGPKITLNDLIPAFQNLLKDCEAEVRAAAAHKVKG

SEQ ID NO: 864118 - protein, 550 aa, Homo sapiens
GAGRGLGAGREAVTSSRRRKNMAGASELGTGPGAAGGDGDDSLYPIAVLIDELRNEDVQLRLNSIKKLSTIALALGVERTRSELLPFLTDTIYDEDEVLLALAEQLGNFTGLVGGPDFAHCLLPPLENLATVEETVVRDKAVESLRQISQEHTPVALEAYFVPLVKRLASGDWFTSRTSACGLFSVCYPRASNAVKAEIRQQFRSLCSDDTPMVRRAAASKLGEFAKVLELDSVKSEIVPLFTSLASDEQDSVRLLAVEACVSIAQLLSQDDLETLVMPTLRQAAEDKSWRVRYMVADRFSELQKAMGPKITLNDLIPAFQNLLKDCEAEVRAAAAHKVKELGENLPIEDRETIIMNQILPYIKELVSDTNQHVKSALASVIMGLSTILGKENTIEHLLPLFLAQLKDECPDVRLNIISNLDCVNEVIGIRQLSQSLLPAIVELAEDAKWRVRLAIIEYMPLLAGQLALSEACGQEITTKQMLPIVLKMAGDQVANVRFNVAKSLQKIGPILDTNALQGEVKPVLQKLGQDEDMDVKYFAQEAISVLALA

SEQ ID NO: 864119 - protein, 267 aa, Homo sapiens [sequence omitted]

SEQ ID NO: 864120 - protein, 688 aa, Homo sapiens
GAGRGLGAGREAVTSSRRRKNMAGASELGTGPGAAGGDGDDSLYPIAVLIDELRNEDVQLRLNSIKKLSTIALALGVERTRSELLPFLTDTIYDEDEVLLALAEQLGNFTGLVGGPDFAHCLLPPLENLATVEETVVRDKAVESLRQISQEHTPVALEAYFVPLVKRLASGDWFTSRTSACGLFSVCYPRASNAVKAEIRQQFRSLCSDDTPMVRRAAASKLGEFAKVLELDSVKSEIVPLFTSLASDEQDSVRLLAVEACVSIAQLLSQDDLETLVMPTLRQAAEDKSWRVRYMVADRFSELQKAMGPKITLNDLIPAFQNLLKDCEAEVRAAAAHKVKELGENLPIEDRETIIMNQILPYIKELVSDTNQHVKSALASVIMGLSTILGKENTIEHLLPLFLAQLKDECPDVRLNIISNLDCVNEVIGIRQLSQSLLPAIVELAEDAKWRVRLAIIEYMPLLAGQLGVEFFDEKLNSLCMAWLVDHVYAIREAATNNLMKLVQKFGTEWAQNTIVPKVLVMANDPNYLHRMTTLFCINALSEACGQEITTKQMLPIVLKMAGDQVANVRFNVAKSLQKIGPILDTNALQGEVKPVLQKLGQDEDMDVKYFAQEAISVVAQRLRKLEFPVKDSGEPSVPRADKNHFPRPTVPGEDMGKGPVYQLRGDTRDTLAQLGIAELVHFSQSTD

SEQ ID NO: 864121 - protein, 258 aa, Homo sapiens
GNRGGHFPSPRGGSGVASLERAESWSTEPAKAIKPIDRKSVHQICSGPVVLSLSTAVKKMVENSLDAGATNIDLKLKDYGMDLIEVSGNGCGVEEENFEGLTLKHHTSKIQEFADLTQVETFGFRGEALSSLCALSDVTISTCHVSAKVGTRLVFDHDGKIIQKTPYPHPRGTTVSVKQLFSTLPVRHKEFQRNIKKKRACFPFAFCRDCQFLEGSPAMLPVQPAKLTPRSTPPHPCSLEDNVITVFSSVKNGPGSSR

SEQ ID NO: 864122 - protein, 203 aa, Homo sapiens
VGTVEGTFPVPEADPVLHPWRELRAGGELGSRSPLSRALFENHGFQPPWKWGEHGRGAWRGHLVEAPERHPQRPSDPVPIRCALKPSTEPAKAIKPIDRKSVHQICSGPVVLSLSTAVKKMVENSLDAGATNIDLKLKDYGMDLIEVSGNGCGVEEENFEGLMMSPFLPATYRRRLGLDWCLITMGKSSRKPPTPTPEGPQSA

SEQ ID NO: 864123 - protein, 203 aa, Homo sapiens; identical to SEQ ID NO: 864122

SEQ ID NO: 864124 - protein, 197 aa, Homo sapiens
VGTVEGTFPVPEADPVLHPWRELRAGGELGSRSPLSRALFENHGFQPPWKWGEHGRGAWRGHLVEAPERHPQRPSDPVPISTEPAKAIKPIDRKSVHQICSGPVVLSLSTAVKKMVENSLDAGATNIDLKLKDYGMDLIEVSGNGCGVEEENFEGLMMSPFLPATYRRRLGLDWCLITMGKSSRKPPTPTPEGPQSA

SEQ ID NO: 864125 - protein, 142 aa, Homo sapiens
GNRGGHFPSPRGGSGVASLERAESWSTEPAKAIKPIDRKSVHQICSGPVVLSLSTAVKKMVENSLDAGATNIDLKLKDYGMDLIEVSGNGCGVEEENFEGLMMSPFLPATYRRRLGLDWCLITMGKSSRKPPTPTPEGPQSA

SEQ ID NO: 864126 - protein, 123 aa, Homo sapiens
MHFYLLGTEPAKAIKPIDRKSVHQICSGPVVLSLSTAVKKMVENSLDAGATNIDLKLKDYGMDLIEVSGNGCGVEEENFEGLMMSPFLPATYRRRLGLDWCLITMGKSSRKPPTPTPEGPQSA

SEQ ID NO: 864127 - protein, 197 aa, Homo sapiens; identical to SEQ ID NO: 864124

SEQ ID NO: 864128 - protein, 287 aa, Homo sapiens
MEVMEGPLNLAHQQSRRADRLLAAGKYEEAISCHKKAAAYLSEAMKLTQSEQAHLSLELQRDSHMKQLLLIQERWKRAQREERLKAQQNTDKDAAAHLQTSHKPSAEDAEGQSPLSQKYSPSTEKCLPEIQGIFDRDPDTLLYLLQQKSEPAEPCIGSKAPKDDKTIIEEQATKIADLKRHVEFLVAENERLRKENKQLKAEKARLLKGPIEKELDVDADFVETSELWSLPPHAETATASSTWQKFAANTGKAKDIPIPNLPPLDFPSPELPLMELSEDILKGFMNN

SEQ ID NO: 864129 - protein, 251 aa, Homo sapiens
MEVMEGPLNLAHQQSRRADRLLAAGKYEEAISCHKKAAAYLSEAMKLTQSEQAHLSLELQRDSHMKQLLLIQERWKRAQREERLKAQQNTDKDAAAHLQTSHKPSAEDAEGQSPLSQKYSPSTEKCLPEIQGIFDRDPDTLLYLLQQKSEPAEPCIGSKAPKDDKTIIEEQATKIADLKRHVEFLVAENERLRKENKQLKAEKARLLKGPIEKELDVDADFVETSELWSLPPHAETATASSTWHGPVVPAT

SEQ ID NO: 864130 - protein, 260 aa, Homo sapiens
MEVMEGPLNLAHQQSRRADRLLAAGKYEEAISCHKKAAAYLSEAMKLTQSEQAHLSLELQRDSHMKQLLLIQERWKRAQREERLKAQQNTDKDAAAHLQTSHKPSAEDAEGQSPLSQKYSPSTEKCLPEIQGIFDRDPDTLLYLLQQKSEPAEPCIGSKAPKDDKTIIEEQATKIADLKRHVEFLVAENERLRKENKQLKAEKARLLKGPIELATTCRNCYSLLNLAEVRSKYWESQGHSNPQSSSLGFSISRTSSYGAL

SEQ ID NO: 864131 - protein, 107 aa, Homo sapiens
RRGRARGAAPEEEVVRLLLLQRLSLALGAQRGAAVSAAASSSLAVPSMFPGATTPLPKAAAYPGVYGSNGRTPQPGSSTEQTSRPFISCRQIRRGYFLSQKGCSISF

SEQ ID NO: 864132 - protein, 132 aa, Homo sapiens
RRGRARGAAPEEEVVRLLLLQRLSLALGAQRGAAVSAAASSSLAVPSMFPGATTPLPKAAAYPGVYGSNGRTPQPGSSTEQTSRPFISCRQIRRGYFLSQKGCSRDGVSPCWPGWSRTPDLRRSTSLSLPKC

SEQ ID NO: 864133 - protein, 103 aa, Homo sapiens
TTTPRVLRVLAAVAAAETKMAARVGAFLKNAWDKEPVLVVSFVVGGLAVILPPLSPYFKYSVMINKATPYNYPVPVRDDGNMPDVPSHPQDPQGPSLEWLKKL

SEQ ID NO: 864134 - protein, 105 aa, Homo sapiens
FAAASTRRRQKGAAVAAAETKMAARVGAFLKNAWDKEPVLVVSFVVGGLAVILPPLSPYFKYSVMINKATPYNYPVPVRDDGNMPDVPSHPQDPQGPSLEWLKKL

SEQ ID NO: 864135 - protein, 99 aa, Homo sapiens
LLLLNSRPVAAAETKMAARVGAFLKNAWDKEPVLVVSFVVGGLAVILPPLSPYFKYSVMINKATPYNYPVPVRDDGNMPDVPSHPQDPQGPSLEWLKKL

SEQ ID NO: 864136 - protein, 105 aa, Homo sapiens; identical to SEQ ID NO: 864134

SEQ ID NO: 864137 - protein, 105 aa, Homo sapiens; identical to SEQ ID NO: 864134

SEQ ID NO: 864138 - protein, 84 aa, Homo sapiens
TTTPRVLRVLAAVAAAETKMAARVGAFLKNAWDKEPVLVVSFVVGGLEQSHDTTPRMLHDDPTLKRAHSMTNPTAASSRPHVSL

SEQ ID NO: 864139 - protein, 86 aa, Homo sapiens
FAAASTRRRQKGAAVAAAETKMAARVGAFLKNAWDKEPVLVVSFVVGGLEQSHDTTPRMLHDDPTLKRAHSMTNPTAASSRPHVSL

SEQ ID NO: 864140 - protein, 86 aa, Homo sapiens; identical to SEQ ID NO: 864139

SEQ ID NO: 864141 - protein, 100 aa, Homo sapiens
TTTPRVLRVLAAVAAAETKMAARVGAFLKNAWDKEPVLVVSFVVGGLAVILPPLSPYFKYSVMINKATPYNYPAAGEKGHRIELSSHSTQRQSCPGARRS

SEQ ID NO: 864142 - protein, 105 aa, Homo sapiens; identical to SEQ ID NO: 864134

SEQ ID NO: 864143 - protein, 105 aa, Homo sapiens
ATRPRDTAARRRQKGAAAETKMAARVGAFLKNAWDKEPVLVVSFVVGGLAVILPPLSPYFKYSVMINKATPYNYPVPVRDDGNMPDVPSHPQDPQGPSLEWLKKL

SEQ ID NO: 864144 - protein, 105 aa, Homo sapiens; identical to SEQ ID NO: 864143

SEQ ID NO: 864145 - protein, 105 aa, Homo sapiens; identical to SEQ ID NO: 864134

SEQ ID NO: 864146 - protein, 105 aa, Homo sapiens; identical to SEQ ID NO: 864134

SEQ ID NO: 864147 - protein, 103 aa, Homo sapiens; identical to SEQ ID NO: 864133

SEQ ID NO: 864148 - protein, 91 aa, Homo sapiens
TTTPRVLRVLAAVAAAETKMAARVGAFLKNAWDKEPVLVVSFVVGGLAVILPPLSPYFKYSVMINKATPYNYPVEAGFHRVSQDCLDLLTL

SEQ ID NO: 864149 - protein, 70 aa, Homo sapiens
FAAASTRRRQKGAAVAAAETKMAARVGAFLKNAWDKEPVLVVSFVVGGLAVILPPLSPYFKYSVNWEFPG

SEQ ID NO: 864150 - protein, 133 aa, Homo sapiens
AYTELQCKAGMEAVDCAIFSVSSAITNWYDEIQDYDFKTRICKKVCGHYTQVVWADSYKVGCAVQFCPKVSGFDALSNGAHFICNYGPGGNYPTWPYKRGATCSACPNNDKCLDNLCVNRQRDQVKRTYINLK

SEQ ID NO: 864151 - protein, 266 aa, Homo sapiens
MRVTLATIAWMVSFVSNYSHTANILPDIENEDFIKDCVRIHNKFRSEVKPTASDMLYMTWDPALAQIAKAWASNCQFSHNTRLKPPHKLHPNFTSLGENIWTGSVPIFSVSSAITNWYDEIQDYDFKTRICKKVCGHYTQVVWADSYKVGCAVQFCPKVSGFDALSNGAHFICNYGPGGNYPTWPYKRGATCSACPNNDKCLDNLCVNRQRDQVKRYYSVVYPGWPIYPRNRYTSLFLIVNSVILILSVIITILVQHKYPNLVLLD

SEQ ID NO: 864152 - protein, 266 aa, Homo sapiens; identical to SEQ ID NO: 864151

SEQ ID NO: 864153 - protein, 266 aa, Homo sapiens; identical to SEQ ID NO: 864151

SEQ ID NO: 864154 - protein, 266 aa, Homo sapiens; identical to SEQ ID NO: 864151

SEQ ID NO: 864155 - protein, 248 aa, Homo sapiens
MRVTLATIAWMVSFVSNYSHTANILPDIENEDFIKDCVRIHNKFRSEVKPTASDMLYMTWDPALAQIAHKLHPNFTSLGENIWTGSVPIFSVSSAITNWYDEIQDYDFKTRICKKVCGHYTQVVWADSYKVGCAVQFCPKVSGFDALSNGAHFICNYGPGGNYPTWPYKRGATCSACPNNDKCLDNLCVNRQRDQVKRYYSVVYPGWPIYPRNRYTSLFLIVNSVILILSVIITILVQHKYPNLVLLD

SEQ ID NO: 864156 - protein, 229 aa, Homo sapiens
MRVTLATIAWMVSFVSNYSHTANILPDIENEDFIKDCVRIHNKFRSEVKPTASDMLYMTWDPALAQIAKAWASNCQFSHNTRLKPPHKLHPNFTSLGENIWTGSVPIFSVSSAITNWYDEIQDYDFKTRICKKVCGHYTQVVWADSYKVGCAVQFCPKVSGFDALSNGAHFICNYGPGGNYPTWPYKRGATCSACPNNDKCLDNLCGNRRRTSPPLLLCCISRLAHIST

SEQ ID NO: 864157 - protein, 229 aa, Homo sapiens
MRVTLATIAWMVSFVSNYSHTANILPDIENEDFIKDCVRIHNKFRSEVKPTASDMLYMTWDPALAQIAKAWASNCQFSHNTRLKPPHKLHPNFTSLGENIWTGSVPIFSVSSAITNWYDEIQDYDFKTRICKKVCGHYTQVVWADSYKVGCAVQFCPKVSGFDALSNGAHFICNYGPGGNYPTWPYKRGATCSACPNNDKCLDNLCVTNSETKSNVTTLLYQVGPYRGY

SEQ ID NO: 864158 - protein, 125 aa, Homo sapiens
MTKSRTMTSRLGYAKKSVATTLRLFGQIVTKLAAQFNFALKFLALTLFPMEHILYATTDQEGITQLGHIREEPPAVPAPIMTSVWTISVLTDSETKSNVTTLLYIQAGPYIHVTDTLLSFSLLIQ

SEQ ID NO: 864159 - protein, 266 aa, Homo sapiens; identical to SEQ ID NO: 864151

SEQ ID NO: 864160 - protein, 266 aa, Homo sapiens; identical to SEQ ID NO: 864151

SEQ ID NO: 864161 - protein, 266 aa, Homo sapiens; identical to SEQ ID NO: 864151

SEQ ID NO: 864162 - protein, 266 aa, Homo sapiens; identical to SEQ ID NO: 864151

SEQ ID NO: 864163 - protein, 265 aa, Homo sapiens
MRVTLATIAWMVSFVSNYSHTANILPDIENEDFIKDCVRIHNKFRSEVKPTASDMLYMTWDPALAQIAKAWASNCQFSHNTRLKPPHKLHPNFTSLGENIWTGSVPIFSVSSAITNWYDEIQDYDFKTRICKKVCGHYTQVVWADSYKVGCAVQFCPKVSGFDALSNGAHFICNYGPGGNYPTWPYKRGATCSACPNNDKCLDNLCVTEGEQVHRYYSVVYPGWPIYPRNRYTSLFLIVNSVILILSVIITILVQHKYPNLVLLD

SEQ ID NO: 864164 - protein, 125 aa, Homo sapiens; identical to SEQ ID NO: 864158

SEQ ID NO: 864165 - protein, 116 aa, Homo sapiens
MRVTLATIAWMVSFVSNYSHTANILPDIENEDFIKDCVRIHNKFRSEVKPTASDMLYMTWDPALAQIAKAWASNCQFSHNTRLKPPHKLHPNFTSLMGRRLAQSSSIRKAVLMIRT

SEQ ID NO: 864166 - protein, 109 aa, Homo sapiens
MVHLTVNCVLDSNMAHGFAGSHLTSCIRARGFGLGNGAEMWFEILPGLSVMGVCLLIPGLATAYIHRFTNGGKEKRVAHFGYHWSLMERDRRISGVDRYYVSKGLENID

SEQ ID NO: 864167 - protein, 88 aa, Homo sapiens
MWWGRGGAQEGTVEHQWGHTAVSPPKERPLASTDQRRVGVSFPTVKKKPPGGGNQDPCFWNKFPNGGARRGTTGIQPTGVSKEKPRIS

SEQ ID NO: 864168 - protein, 153 aa, Homo sapiens
MCYVVLNKNKMKKPHTPTTPNTTTPPPTHTTPATHHEQATTTQKADTTKHNTHTRGPRRAHNNNTTRGGDETKYRDERSNTRRQRTATEDRGLLTQKTAGGRSCNNKWRRRGQRTNEAADNPRRRETRRTRTKDEHEKKTTDKRGADNRTKQT

SEQ ID NO: 864169 - protein, 79 aa, Homo sapiens
LVPNSARAEMWFEILPGLSVMGVCLLIPGLATAYIHRFTNGGKEKRVAHFGYHWSLMERDRRISGVDRYYVSKGLENID

SEQ ID NO: 864170 - protein, 86 aa, Homo sapiens
MWFEILPGLSVMGVCLLIPGLATAYIHRFTNGGKEKRVAHFGYHWSLMERDVVRDSPRTLRHGRVLVDSTDLATAYIHSFTSWQRY

SEQ ID NO: 864171 - protein, 193 aa, Homo sapiens
MPNWGGGKKCGVCQKTVYFAEEVQCEGNSFHKSCFLCMVCKKNLDSTTVAVHGEEIYCKSCYGKKYGPKGYGYGQGAGTLSTDKGESLGIKHEEAPGHRPTTNPNASKFAQKIGGSERCPRCSQAVYAAEKVIGAGKSWHKACFRCAKCGKGLESTTLADKDGEIYCKGCYAKNFGPKGFGFGQGAGALVHSE

SEQ ID NO: 864172 - protein, 215 aa, Homo sapiens
RPLQHQNGNSACRPCAAEPAARMPNWGGGKKCGVCQKTVYFAEEVQCEGNSFHKSCFLCMVCKKNLDSTTVAVHGEEIYCKSCYGKKYGPKGYGYGQGAGTLSTDKGESLGIKHEEAPGHRPTTNPNASKFAQKIGGSERCPRCSQAVYAAEKVIGAGKSWHKACFRCAKCGKGLESTTLADKDGEIYCKGCYAKNFGPKGFGFGQGAGALVHSE

SEQ ID NO: 864173 - protein, 193 aa, Homo sapiens; identical to SEQ ID NO: 864171

SEQ ID NO: 864174 - protein, 193 aa, Homo sapiens; identical to SEQ ID NO: 864171

SEQ ID NO: 864175 - protein, 193 aa, Homo sapiens; identical to SEQ ID NO: 864171

SEQ ID NO: 864176 - protein, 193 aa, Homo sapiens; identical to SEQ ID NO: 864171

SEQ ID NO: 864177 - protein, 193 aa, Homo sapiens; identical to SEQ ID NO: 864171

SEQ ID NO: 864178 - protein, 115 aa, Homo sapiens
CQGGGLKAFATLGTSKAGLMPGLPNPNASKFAQKIGGSERCPRCSQAVYAAEKVIGAGKSWHKACFRCAKCGKGLESTTLADKDGEIYCKGCYAKNFGPKGFGFGQGAGALVHSE

SEQ ID NO: 864179 - protein, 193 aa, Homo sapiens; identical to SEQ ID NO: 864171

SEQ ID NO: 864180 - protein, 193 aa, Homo sapiens; identical to SEQ ID NO: 864171

SEQ ID NO: 864181 - protein, 193 aa, Homo sapiens; identical to SEQ ID NO: 864171

SEQ ID NO: 864182 - protein, 173 aa, Homo sapiens
MPNWGGGKKCGVCQKTVYFAEEVQCEGNSFHKSCFLCMVCKKNLDSTTVAVHGEEIYCKSCYGKKYGPKGYGYGQGAGTLSTDKGESLGIKHEEAPGHRPTTNPNASKFAQKIGGSERCPRCSQAVYAAEKVIGAGKSWHKACFRCAKCGKGLESTTLADKDGEIYCKGMLNA

SEQ ID NO: 864183 - protein, 116 aa, Homo sapiens
RPLQHQNGNSACRPCAAEPAARMPNWGGGKKCGVCQKTVYFAEEVQCEGNSFHKSCFLCMVCKKNLDSTTVAVHGEEIYCKSCYGKKYGPKGYGYGQGAGTLSTDKGESLGIKHEE

SEQ ID NO: 864184 - protein, 101 aa, Homo sapiens
RPLQHQNGNSACRPCAAEPAARMPNWGGGKKCGVCQKTVYFAEEVQCEGNSFHKSCFLCSEYAPGPIAVALDTLDGPAPTGWACQHPRELIPWDVNSLTFG

SEQ ID NO: 864185 - protein, 81 aa, Homo sapiens
KKLAMSKKVTPASTQCVRFPFPSTVVCKKNLDSTTVAVHGEEIYCKSCYGKKYGPKGYGYGQGAGTLSTDKGESLGIKHEE

SEQ ID NO: 864186 - protein, 193 aa, Homo sapiens; identical to SEQ ID NO: 864171

SEQ ID NO: 864187 - protein, 193 aa, Homo sapiens; identical to SEQ ID NO: 864171

SEQ ID NO: 864188 - protein, 193 aa, Homo sapiens; identical to SEQ ID NO: 864171

SEQ ID NO: 864189 - protein, 193 aa, Homo sapiens; identical to SEQ ID NO: 864171

SEQ ID NO: 864190 - protein, 114 aa, Homo sapiens
RLYLVSRLYLVSRLYLVSRLYLVSRLYLVSRLYLVSRLYLVSRLYLVSRLYLVSRLYLVSRLYLVSRLYLAWDLTPSPVGDLSVLGLGESRPLSPHLAPQSSVLSLLCCVSIIS

SEQ ID NO: 864191 - protein, 66 aa, Homo sapiens
GRVGRPTRPARRSRVHHQLTKTPEDTSWHPEEQQQQAGGRGKQDQDEEGGRLGFLDLRDSPLWERG

SEQ ID NO: 864192 - protein, 193 aa, Homo sapiens; identical to SEQ ID NO: 864171

SEQ ID NO: 864193 - protein, 158 aa, Homo sapiens
MPNWGGGKKCGVCQKTVYFAEEVQCEGNSFHKSCFLCMVCKKNLDSTTVAVHGEEIYCKSCYGKKYGPKGYGYGQGAGTLSTDKGESLGIKHEEAPGHRPTTNPNASKFAQKIGGSERCPRCSQAVYAAEKVIGAGKSGLLSSASVASWSHWRQVAVA

SEQ ID NO: 864194 - protein, 135 aa, Homo sapiens
MPNWGGGKKCGVCQKTVYFAEEVQCEGNSFHKSCFLCMVCKKNLDSTTVAVHGEEIYCKSCYGKKYGPKGYGYGQGAGTLSTDKGESLGIKHEEAPGHRPTTNHLLRSIDCLAASGAALSHQSSGEICCIGTELD

SEQ ID NO: 864195 - protein, 140 aa, Homo sapiens
GPGLPPVLQICCPRSLRGVTAPTAMSALPGSESPLANTTVVRPQRHWQGARGLPLMSLLPPFSRTGRELAWVLHIDGQTLTKWRDEMSTPKDPTEEQRCREGREPADGWLSCWRLKVHSFQAACQACAILPDFLPAPKLR

SEQ ID NO: 864196 - protein, 1174 aa, Homo sapiens
SAGPDMAEEEVAKLEKHLMLLRQEYVKLQKKLAETEKRCALLAAQANKESSSESFISRLLAIVADLYEQEQYSDLKIKVGDRHISAHKFVLAARSDSWSLANLSSTKELDLSDANPEVTMTMLRWIYTDELEFREDDVFLTELMKLANRFQLQLLRERCEKGVMSLVNVRNCIRFYQTAEELNASTLMNYCAEIIASHWDDLRKEDFSSMSAQLLYKMIKSKTEYPLHKAIKVEREDVVFLYLIEMDSQLPGKLNEADHNGDLALDLALSRRLESIATTLVSHKADVDMVDKSGWSLLHKGIQRGDLFAATFLIKNGAFVNAATLGAQETPLHLVALYSSKKHSADVMSEMAQIAEALLQAGANPNMQDSKGRTPLHVSIMAGNEYVFSQLLQCKQLDLELKDHEGSTALWLAVQHITVSSDQSVNPFEDVPVVNGTSFDENSFAARLIQRGSHTDAPDTATGNCLLQRAAGAGNEAAALFLATNGAHVNHRNKWGETPLHTACRHGLANLTAELLQQGANPNLQTEEALPLPKEAASLTSLADSVHLQTPLHMAIAYNHPDVVSVILEQKANALHATNNLQIIPDFSLKDSRDQTVLGLALWTGMHTIAAQLLGSGAAINDTMSDGQTLLHMAIQRQDSKSALFLLEHQADINVRTQDGETALQLAIRNQLPLVVDAICTRGADMSVPDEKGNPPLWLALANNLEDIASTLVRHGCDATCWGPGPGGCLQTLLHRAIDENNEPTACFLIRSGCDVNSPRQPGANGEGEEEARDGQTPLHLAASWGLEETVQCLLEFGANVNAQDAEGRTPIHVAISSQHGVIIQLLVSHPDIHLNVRDRQGLTPFACAMTFKNNKSAEAILKRESGAAEQVDNKGRNFLHVAVQNSDIESVLFLISVHANVNSRVQDASKLTPLHLAVQAGSEIIVRNLLLAGAKVNELTKHRQTALHLAAQQDLPTICSVLLENGVDFAAVDENGNNALHLAVMHGRLNNIRVLLTECTVDAEAFNLRGQSPLHILGQYGKENAAAIFDLFLECMPGYPLDKPDADGSTVLLLAYMKGNANLCRAIVRSGARLGVNNNQGVNIFNYQVATKQLLFRLLDMLSKEPPWCDGSYCYECTARFGVTTRKHHCRHCGRLLCHKCSTKEIPIIKFDLNKPVRVCNICFDVLTLGGVS

SEQ ID NO: 864197 - protein, 1174 aa, Homo sapiens; identical to SEQ ID NO: 864196

SEQ ID NO: 864198 - protein, 1174 aa, Homo sapiens; identical to SEQ ID NO: 864196

SEQ ID NO: 864199 - protein, 621 aa, Homo sapiens
MAIAYNHPDVVSVILEQKANALHATNNLQIIPDFSLKDSRDQTVLGLALWTGMHTIAAQLLGSGAAINDTMSDGQTLLHMAIQRQDSKSALFLLEHQADINVRTQDGETALQLAIRNQLPLVVDAICTRGADMSVPDEKGNPPLWLALANNLEDIASTLVRHGCDATCWGPGPGGCLQTLLHRAIDENNEPTACFLIRSGCDVNSPRQPGANGEGEEEARDGQTPLHLAASWGLEETVQCLLEFGANVNAQDAEGRTPIHVAISSQHGVIIQLLVSHPDIHLNVRDRQGLTPFACAMTFKNNKSAEAILKRESGAAEQVDNKGRNFLHVAVQNSDIESVLFLISVHANVNSRVQDASKLTPLHLAVQAGSEIIVRNLLLAGAKVNELTKHRQTALHLAAQQDLPTICSVLLENGVDFAAVDENGNNALHLAVMHGRLNNIRVLLTECTVDAEAFNLRGQSPLHILGQYGKENAAAIFDLFLECMPGYPLDKPDADGSTVLLLAYMKGNANLCRAIVRSGARLGVNNNQGVNIFNYQVATKQLLFRLLDMLSKEPPWCDGSYCYECTARFGVTTRKHHCRHCGRLLCHKCSTKEIPIIKFDLNKPVRVCNICFDVLTLGGVS

SEQ ID NO: 864200 - protein, 1231 aa, Homo sapiens
SAGPDMAEEEVAKLEKHLMLLRQEYVKLQKKLAETEKRCALLAAQANKESSSESFISRLLAIVADLYEQEQYSDLKIKVGDRHISAHKFVLAARSDSWSLANLSSTKELDLSDANPEVTMTMLRWIYTDELEFREDDVFLTELMKLANRFQLQLLRERCEKGVMSLVNVRNCIRFYQTAEELNASTLMNYCAEIIASHWDDLRKEDFSSMSAQLLYKMIKSKTEYPLHKAIKVEREDVVFLYLIEMDSQLPGKLNEADHNGDLALDLALSRRLESIATTLVSHKADVDMVDKSGWSLLHKGIQRGDLFAATFLIKNGAFVNAATLGAQETPLHLVALYSSKKHSADVMSEMAQIAEALLQAGANPNMQDSKGRTPLHVSIMAGNEYVFSQLLQCKQLDLELKDHEGSTALWLAVQHITVSSDQSVNPFEDVPVVNGTSFDENSFAARLIQRGSHTDAPDTATGNCLLQRAAGAGNEAAALFLATNGAHVNHRNKWGETPLHTACRHGLANLTAELLQQGANPNLQTEEALPLPKEAASLTSLADSVHLQTPLHMAIAYNHPDVVSVILEQKANALHATNNLQIIPDFSLKDSRDQTVLGLALWTGMHTIAAQLLGSGAAINDTMSDGQTLLHMAIQRQDSKSALFLLEHQADINVRTQDGETALQLAIRNQLPLVVDAICTRGADMSVPDEKGNPPLWLALANNLEDIASTLVRHGCDATCWGPGPGGCLQTLLHRAIDENNEPTACFLIRSGCDVNSPRQPGANGEGEEEARDGQTPLHLAASWGLEETVQCLLEFGANVNAQDAEGRTPIHVAISSQHGVIIQLLVSHPDIHLNVRDRQGLTPFACAMTFKNNKSAEAILKRESGAAEQVDNKGRNFLHVAVQNSDIESVLFLISVHANVNSRVQDASKLTPLHLAVQAGSEIIVRNLLLAGAKVNELTKHRQTALHLAAQQDLPTICSVLLENGVDFAAVDENGNNALHLAVMHGRLNNIRVLLTECTVDAEAFNLRGQSPLHILGQYGKENAAAIFDLFLECMPGYPLDKPDADGSTVLLLAYMKGNANLCRAIVRSGARLGVNNNQGVNIFNYQVATKQLLFRLLDMLSKEPPWCDGSYCYECTARFGVTTRKHHVVRPQRHWQGARGLPLMSLLPPFSRTGRELAWVLHIDGQTLTKWRDEMSTPKDPTEEQRCREGREPADGWLSCWRLKVHSFQAACQACAILPDFLPAPKLR

SEQ ID NO: 864201 - protein, 1138 aa, Homo sapiens
SAGPDMAEEEVAKLEKHLMLLRQEYVKLQKKLAETEKRCALLAAQANKESSSESFISRLLAIVADLYEQEQYSDLKIKVGDRHISAHKFVLAARSDSWSLANLSSTKELDLSDANPEVTMTMLRWIYTDELEFREDDVFLTELMKLANRFQLQLLRERCEKGVMSLVNVRNCIRFYQTAEELNASTLMNYCAEIIASHWDDLRKEDFSSMSAQLLYKMIKSKTEYPLHKAIKVEREDVVFLYLIEMDSQLPGKLNEADHNGDLALDLALSRRLESIATTLVSHKADVDMVDKSGWSLLHKGIQRGDLFAATFLIKNGAFVNAATLGAQETPLHLVALYSSKKHSADVMSEMAQIAEALLQAGANPNMQDSKGRTPLHVSIMAGNEYVFSQLLQCKQLDLELKDHEGSTALWLAVQHITVSSDQSVNPFEDVPVVNGTSFDENSFAARLIQRGSHTDAPDTATGNCLLQRAAGAGNEAAALFLATNGAHVNHRNKWGETPLHTACRHGLANLTAELLQQGANPNLQTEEALPLPKEAASLTSLADSVHLQTPLHMAIAYNHPDVVSVILEQKANALHATNNLQIIPDFSLKDSRDQTVLGLALWTGMHTIAAQLLGSGAAINDTMSDGQTLLHMAIQRQDSKSALFLLEHQADINVRTQDGETALQLAIRNQLPLVVDAICTRGADMSVPDEKGNPPLWLALANNLEDIASTLVRHGCDATCWGPGPGGCLQTLLHRAIDENNEPTACFLIRSGCDVNSPRQPGANGEGEEEARDGQTPLHLAASWGLEETVQCLLEFGANVNAQDAEGRTPIHVAISSQHGVIIQLLVSHPDIHLNVRDRQGLTPFACAMTFKNNKSAEAILKRESGAAEQVDNKGRNFLHVAVQNSDIESVLFLISVHANVNSRVQDASKLTPLHLAVQAGSEIIVRNLLLAGAKVNELTKHRQTALHLAAQQDLPTICSVLLENGVDFAAVDENGNNALHLAVMHGRLNNIRVLLTECTVDAEAFNLRGQSPLHILGQYGKENAAAIFDLFLECMPGYPLDKPDADGSTVLLLAYMKGNANLCRAIVRSGARLGVNNNQGVNIFNYQVATKQLLFRLLDMLSKEPPWCDGSYCYECTARFGVTTRKHHCMPGLSCS

SEQ ID NO: 864202 - protein, 1174 aa, Homo sapiens; identical to SEQ ID NO: 864196

SEQ ID NO: 864203 - protein, 1174 aa, Homo sapiens; identical to SEQ ID NO: 864196

SEQ ID NO: 864204 - protein, 325 aa, Homo sapiens
MTFKNNKSAEAILKRESGAAEQVDNKGRNFLHVAVQNSDIESVLFLISVHANVNSRVQDASKLTPLHLAVQAGSEIIVRNLLLAGAKVNELTKHRQTALHLAAQQDLPTICSVLLENGVDFAAVDENGNNALHLAVMHGRLNNIRVLLTECTVDAEAFNLRGQSPLHILGQYGKENAAAIFDLFLECMPGYPLDKPDADGSTVLLLAYMKGNANLCRAIVRSGARLGVNNNQGVNIFNYQVATKQLLFRLLDMLSKEPPWCDGSYCYECTARFGVTTRKHHCRHCGRLLCHKCSTKEIPIIKFDLNKPVRVCNICFDVLTLGGVS

SEQ ID NO: 864205 - protein, 1174 aa, Homo sapiens; identical to SEQ ID NO: 864196

SEQ ID NO: 864206 - protein, 210 aa, Homo sapiens
SAGPDMAEEEVAKLEKHLMLLRQEYVKLQKKLAETEKRCALLAAQANKESSSESFISRLLAIVADLYEQEQYSDLKIKVGDRHISAHKFVLAARSDSWSLANLSSTKELDLSDANPEVTMTMLRWIYTDELEFREDDVFLTELMKLANRFQLQLLRERCEKGVMSLVNVRNCIRFYQTAEELNASTLMNYCAEIIASHWVSEVEGVNKAL

SEQ ID NO: 864207 - protein, 1211 aa, Homo sapiens
MKNLLTEKCISSHNFHQKVIKQRMEKKVDSRYFKDGAVKKPYSAKTLSNKKSSASFGIRRELPSTSHLVQYRGTHTCTRQGRLRELRIRCVARKFLYLWIRMTFGRVFPSKARFYYEQRLLRKVFEEWKEEWWVFQHEWKLCVRADCHYRYYLYNLMFQTWKTYVRQQQEMRNKYIRAEVHDAKQKMRQAWKSWLIYVVVRRTKLQMQTTALEFRQRIILRVWWSTWRQRLGQVRVSRALHASALKHRALSLQVQAWSQWREQLLYVQKEKQKVVSAVKHHQHWQKRRFLKAWLEYLQVRRVKRQQNEMAERFHHVTVLQIYFCDWQQAWERRESLYAHHAQVEKLARKMALRRAFTHWKHYMLLCAEEAAQFEMAEEHHRHSQLLLHRFWNLWRSQIEQKKERELLPLLHAAWDHYRIALLCKCIELWLQYTQKRRYKQLLQARADGHFQQRALPAAFHTWNRLWRWRHQENVLSARATRFHRETLEKQVFSLWRQKMFQHRENRLAERMAILHAERQLLYRSWFMWHQQAAARHQEQEWQTVACAHHRHGRLKKAFCLWRESAQGLRTERTGRVRAAEFHMAQLLRWAWSQWRECLALRGAERQKLMRADLHHQHSVLHRALQAWVTYQGRVRSILREVAARESQHNRQLLRGALRRWKENTMARVDEAKKTFQASTHYRRTICSKVLVQWREAVSVQMYYRQQEDCAIWEAQKVLDRGCLRTWFQRWWDCSRRSAQQRLQLERAVQHHHRQLLLEGLARWKTHHLQCVRKRLLHRQSTQLLAQRLSRTCFRQWRQQLAARRQEQRATVRALWFWAFSLQAKVWATWLAFVLERRRKKARLQWALQAYQGQLLQEGATRLLRFAASMKASRQQLQAQQQVQAAHSLHRAVRRCATLWKQKVLGRGGKPQPLAAIAPSRKVTFEGPLLNRIAAGAGDGTLETKRPQASRPLGALGRLAAEEPHALELNTAHSARKQPRRPHFLLEPAQSQRPQKPQEHGLGMAQPAAPSLTRPFLAEAPTALVPHSPLPGALSSAPGPKQPPTASTGPELLLLPLSSFMPCGAAAPARVSAQRATPRDKPPVPSSLASVPDPHLLLPGDFSATRAGPGLSTAGSLDLEAELEEIQQQLLHYQTTKQNLWSCRRQASSLRRWLELNREEPGPEDQEVEQQVQKELEQVEMQIQLLAEELQAQRQPIGACVARIQALRQALC

SEQ ID NO: 864208 - protein, 929 aa, Homo sapiens
MKNLLTEKCISSHNFHQKVIKQRMEKKVDSRYFKDGAVKKPYSAKTLSNKKSSASFGIRRELPSTSHLVQYRGTHTCTRQGRLRELRIRCVARKFLYLWIRMTFGRVFPSKARFYYEQRLLRKVFEEWKEEWWVFQHEWKLCVRADCHYRYYLYNLMFQTWKTYVRQQQEMRNKYIRAEVHDAKQKMRQAWKSWLIYVVVRRTKLQMQTTALEFRQRIILRVWWSTWRQRLGQVRVSRALHASALKHRALSLQVQAWSQWREQLLYVQKEKQKVVSAVKHHQHWQKRRFLKAWLEYLQVRRVKRQQNEMAERFHHVTVLQIYFCDWQQAWERRESLYAHHAQVEKLARKMALRRAFTHWKHYMLLCAEEAAQFEMAEEHHRHSQLYFCFRALKDNVTHAHLQQIRRNLAHQQHGVTLLHRFWNLWRSQIEQKKERELLPLLHAAWDHYRIALLCKCIELWLQYTQKRRYKQLLQARADGHFQQRALPAAFHTWNRLWRWRHQENVLSARATRFHRETLEKQVFSLWRQKMFQHRENRLAERMAILHAERQLLYRSWFMWHQQAAARHQEQEWQTVACAHHRHGRLKKAFCLWRESAQGLRTERTGRVRAAEFHMAQLLRWAWSQWRECLALRGAERQKLMRADLHHQHSVLHRALQAWVTYQGRVRSILREVAARESQHNRQLLRGALRRWKENTMARVDEAKKTFQASTHYRRTICSKVLVQWREAVSVQMYYRQQEDCAIWEAQKVLDRGCLRTWFQRWWDCSRRSAQQRLQLERAVQHHHRQLLLEGLARWKTHHLQCVRKRLLHRQSTQLLAQRLSRTCFRQWRQQLAARRQEQRATVRALWFWAFSLQAKVWATWLAFVLERRRKKARLQWALQAYQGQLLQEGATRLLRFAASMKASRQQLQAQQQVQVGPGPLPVGSRQGVA

SEQ ID NO: 864209 - protein, 1241 aa, Homo sapiens
MKNLLTEKCISSHNFHQKVIKQRMEKKVDSRYFKDGAVKKPYSAKTLSNKKSSASFGIRRELPSTSHLVQYRGTHTCTRQGRLRELRIRCVARKFLYLWIRMTFGRVFPSKARFYYEQRLLRKVFEEWKEEWWVFQHEWKLCVRADCHYRYYLYNLMFQTWKTYVRQQQEMRNKYIRAEVHDAKQKMRQAWKSWLIYVVVRRTKLQMQTTALEFRQRIILRVWWSTWRQRLGQVRVSRALHASALKHRALSLQVQAWSQWREQLLYVQKEKQKVVSAVKHHQHWQKRRFLKAWLEYLQVRRVKRQQNEMAERFHHVTVLQIYFCDWQQAWERRESLYAHHAQVEKLARKMALRRAFTHWKHYMLLCAEEAAQFEMAEEHHRHSQLYFCFRALKDNVTHAHLQQIRRNLAHQQHGVTLLHRFWNLWRSQIEQKKERELLPLLHAAWDHYRIALLCKCIELWLQYTQKRRYKQLLQARADGHFQQRALPAAFHTWNRLWRWRHQENVLSARATRFHRETLEKQVFSLWRQKMFQHRENRLAERMAILHAERQLLYRSWFMWHQQAAARHQEQEWQTVACAHHRHGRLKKAFCLWRESAQGLRTERTGRVRAAEFHMAQLLRWAWSQWRECLALRGAERQKLMRADLHHQHSVLHRALQAWVTYQGRVRSILREVAARESQHNRQLLRGALRRWKENTMARVDEAKKTFQASTHYRRTICSKVLVQWREAVSVQMYYRQQEDCAIWEAQKVLDRGCLRTWFQRWWDCSRRSAQQRLQLERAVQHHHRQLLLEGLARWKTHHLQCVRKRLLHRQSTQLLAQRLSRTCFRQWRQQLAARRQEQRATVRALWFWAFSLQAKVWATWLAFVLERRRKKARLQWALQAYQGQLLQEGATRLLRFAASMKASRQQLQAQQQVQVGPGPFLWGAGRVWHELTRGCVVAAHSLHRAVRRCATLWKQKVLGRGGKPQPLAAIAPSRKVTFEGPLLNRIAAGAGDGTLETKRPQASRPLGALGRLAAEEPHALELPQKPQEHGLGMAQPAAPSLTRPFLAEAPTALVPHSPLPGALSSAPGPKQPPTASTGPELLLLPLSSFMPCGAAAPARVSAQRATPRDKPPVPSSLASVPDPHLLLPGDFSATRAGPGLSTAGSLDLEAELEEIQQQLLHYQTTKQNLWSCRRQASSLRRWLELNREEPGPEDQEVEQQVQKELEQVEMQIQLLAEELQAQRQPIGACVARIQALRQALC

SEQ ID NO: 864210 - protein, 929 aa, Homo sapiens; identical to SEQ ID NO: 864208

SEQ ID NO: 864211 - protein, 334 aa, Homo sapiens [sequence omitted]

SEQ ID NO: 864212 - protein, 506 aa, Homo sapiens
MKNLLTEKCISSHNFHQKVIKQRMEKKVDSRYFKDGAVKKPYSAKTLSNKKSSASFGIRRELPSTSHLVQYRGTHTCTRQGRLRELRIRCVARKFLYLWIRMTFGRVFPSKARFYYEQRLLRKVFEEWKEEWWVFQHEWKLCVRADCHYRYYLYNLMFQTWKTYVRQQQEMRNKYIRAEVHDAKQKMRQAWKSWLIYVVVRRTKLQMQTTALEFRQRIILRVWWSTWRQRLGQVRVSRALHASALKHRALSLQVQAWSQWREQLLYVQKEKQKVVSAVKHHQHWQKRRFLKAWLEYLQVRRVKRQQNEMAERFHHVTVLQIYFCDWQQAWERRESLYAHHAQVEKLARKMALRRAFTHWKHYMLLCAEEAAQFEMAEEHHRHSQLLLHRFWNLWRSQIEQKKERELLPLLHAAWDHYRIALLCKCIELWLQYTQKRRYKQLLQARADGHFQQRALPAAFHTWNRLWRWRHQENVLSARATRFHRETLEKQVFSLWRQKMFQLLNLG

SEQ ID NO: 864213 - protein, 492 aa, Homo sapiens
MKNLLTEKCISSHNFHQKVIKQRMEKKVDSRYFKDGAVKKPYSAKTLSNKKSSASFGIRRELPSTSHLVQYRGTHTCTRQGRLRELRIRCVARKFLYLWIRMTFGRVFPSKARFYYEQRLLRKVFEEWKEEWWVFQHEWKLCVRADCHYRYYLYNLMFQTWKTYVRQQQEMRNKYIRAEVHDAKQKMRQAWKSWLIYVVVRRTKLQMQTTALEFRQRIILRVWWSTWRQRLGQVRVSRALHASALKHRALSLQVQAWSQWREQLLYVQKEKQKVVSAVKHHQHWQKRRFLKAWLEYLQVRRVKRQQNEMAERFHHVTVLQIYFCDWQQAWERRESLYAHHAQVEKLARKMALRRAFTHWKHYMLLCAEEAAQFEMAEEHHRHSQLYFCFRALKDNVTHAHLQQIRRNLAHQQHGVTLLHRFWNLWRSQIEQKKERELLPLLHAAWDHYRIALLCKCIELWLQYTQKRRYKQLLQARADVIFSKQLCPLLCIH

SEQ ID NO: 864214 - protein, 113 aa, Homo sapiens
LGNTATLHLKKKKKCRGDRPVTQLHSVVWGPFNMQQPQSFQGNRLAPHPWLCTGGERQGVCSCPGPPELLSAGEGGGDWERKKNKCLAPKQGPAVQVRGPTRPPLSTRYPHQN

SEQ ID NO: 864215 - protein, 1437 aa, Homo sapiens
DTPVQQCYSVVVPGSMQEGEQLSFLFLLNLRPPEVPEPVQQRDTMLLVSKIPSYLEMSVHIVFEGSKAKDTALEFRQRIILRVWWSTWRQRLGQVRVSRALHASALKHRALSLQVQAWSQWREQLLYVQKEKQKVVSAVKHHQHWQKRRFLKAWLEYLQVRRVKRQQNEMAERFHHVTVLQIYFCDWQQAWERRESLYAHHAQVEKLARKMALRRAFTHWKHYMLLCAEEAAQFEMAEEHHRHSQLYFCFRALKDNVTHAHLQQIRRNLAHQQHGVTLLHRFWNLWRSQIEQKKERELLPLLHAAWDHYRIALLCKCIELWLQYTQKRRYKQLLQARADGHFQQRALPAAFHTWNRLWRWRHQENVLSARATRFHRETLEKQVFSLWRQKMFQHRENRLAERMAILHAERQLLYRSWFMWHQQAAARHQEQEWQTVACAHHRHGRLKKAFCLWRESAQGLRTERTGRVRAAEFHMAQLLRWAWSQWRECLALRGAERQKLMRADLHHQHSVLHRALQAWVTYQGRVRSILREVAARESQHNRQLLRGALRRWKENTMARVDEAKKTFQASTHYRRTICSKVLVQWREAVSVQMYYRQQEDCAIWEAQKVLDRGCLRTWFQRWWDCSRRSAQQRLQLERAVQHHHRQLLLEGLARWKTHHLQCVRKRLLHRQSTQLLAQRLSRTCFRQWRQQLAARRQEQRATVRALWFWAFSLQAKVWATWLAFVLERRRKKARLQWALQAYQGQLLQEGATRLLRFAASMKASRQQLQAQQQVQVGPGPFLWGAGRVWHELTRGCVVAAHSLHRAVRRCATLWKQKVLGRGGKPQPLAAIAPSRKVTFEGPLLNRIAAGAGDGTLETKRPQASRPLGALGRLAAEEPHALELLSSLCSPCPRFHPGQKVGWHSREENSPDGMGRAGHGLVTAELLGTPSSPARSHPSHGKRERMEWDFQTLSPLPGQSSGNRCPLLCKTSYPLSVLLTRSFPGVIHVVDKGNKLSSYPCLPASLLLHHSQDTGFFVRSPSFLCELAPVPLPTPTMVSSNPNLPCPMLMKLVAPTATSTTREPWARGRCQVGAWGLGPGPCCAPHCLTDLDGILKSQRLLPCDMDPGDLYTSVTRVVLQVKRDNVGEAVPWRQVPFVGTAGSSMAQAHPSLLADLGLAFPDFQSPYKIGDPTEISDPPAAPGQPRGTDPMFLSSNTAHSARKQPRRPHFLLEPAQSQRPQKPQEHGLGMAQPAAPSLTRPFLAEAPTALVPHSPLPGALSSAPGPKQPPTASTGPELLLLPLSSFMPCGAAAPARVSAQRATPRDKPPVPSSLASVPDPHLLLPGDFSATRAGPGLSTAGSLDLEAELEEIQQQLLHYQTTKQNLWSCRRQASSLRRWLELNREEPGPEDQEVEQQVQKELEQVEMQIQLLAEELQAQRQPIGACVARIQALRQALC

SEQ ID NO: 864216 - protein, 334 aa, Homo sapiens [sequence omitted]

SEQ ID NO: 864217 - protein, 334 aa, Homo sapiens [sequence omitted]

SEQ ID NO: 864218 - protein, 514 aa, Homo sapiens
MKNLLTEKCISSHNFHQKVIKQRMEKKVDSRYFKDGAVKKPYSAKTLSNKKSSASFGIRRELPSTSHLVQYRGTHTCTRQGRLRELRIRCVARKFLYLWIRMTFGRVFPSKARFYYEQRLLRKVFEEWKEEWWVFQHEWKLCVRADCHYRYYLYNLMFQTWKTYVRQQQEMRNKYIRAEVHDAKQKMRQAWKSWLIYVVVRRTKLQMQTTALEFRQRIILRVWWSTWRQRLGQVRVSRALHASALKHRALSLQVQAWSQWREQLLYVQKEKQKVVSAVKHHQHWQKRRFLKAWLEYLQVRRVKRQQNEMAERFHHVTVLQIYFCDWQQAWERRESLYAHHAQVEKLARKMALRRAFTHWKHYMLLCAEEAAQFEMAEEHHRHSQLLLHRFWNLWRSQIEQKKERELLPLLHAAWDHYRIALLCKCIELWLQYTQKRRYKQLLQARADGHFQQRALPAAFHIMEQTLAMAPPGKCPQCKSNTFPQEDGQGAGSRIPHGAGLSGRPQATSRNRTQF

SEQ ID NO: 864219 - protein, 214 aa, Homo sapiens
MKNLLTEKCISSHNFHQKVIKQRMEKKVDSRYFKDGAVKKPYSAKTLSNKKSSASFGIRRELPSTSHLVQYRGTHTCTRQGRLRELRIRCVARKFLYLWIRMTFGRVFPSKARFYYEQRLLRKVFEEWKEEWWVFQHEWKLCVRADCHYRYYLYNLMFQTWKTYVRQQQEMRNKYIRAEVHGEKKKSMSEEDAHIYFAEGHRKDKHIVSEREEL

SEQ ID NO: 864220 - protein, 131 aa, Homo sapiens
PTDSFWAGPRPDIHSFCLSHYLWPVNSFLASVPLSYLIYSVLSFLSCLRPSFTQSDSFCIGLGSCGTSRQQHVTRSRSGKQWPVPTTATGGSRKLSASGGKVPKGSEQSEWPVLPYKPFHHRPALLVLAAP

SEQ ID NO: 864221 - protein, 440 aa, Homo sapiens
RGGRTRQLPALLASLLALGCAAGQAWEPRALSRRPHLSERRSEPRPGRAARRGTVLGMAGIPGLLFLLFFLLCAVGQVSPYSAPWKPTWPAYRLPVVLPQSTLNLAKPDFGAEAKLEVSSSCGPQCHKGTPLPTYEEAKQYLSYETLYANGSRTETQVGIYILSSSGDGAQHRDSGSSGKSRRKRQIYGYDSRFSIFGKDFLLNYPFSTSVKLSTGCTGTLVAEKHVLTAAHCIHDGKTYVKGTQKLRVGFLKPKFKDGGRGANDSTSAMPEQMKFQWIRVKRTHVPKGWIKGNANDIGMDYDYALLELKKPHKRKFMKIGVSPPAKQLPGGRIHFSGYDNDRPGNLVYRFCDVKDETYDLLYQQCDAQPGASGSGVYVRMWKRQQQKWERKIIGIFSGHQWVDMNGSPQDFNVAVRITPLKYAQICYWIKGNYLDCREG

SEQ ID NO: 864222 - protein, 440 aa, Homo sapiens; identical to SEQ ID NO: 864221

SEQ ID NO: 864223 - protein, 440 aa, Homo sapiens; identical to SEQ ID NO: 864221

SEQ ID NO: 864224 - protein, 405 aa, Homo sapiens
SFAWPLRKWAVEFPYDTGVHMKKILLIWLLFLLFFLLCAVGQVSPYSAPWKPTWPAYRLPVVLPQSTLNLAKPDFGAEAKLEVSSSCGPQCHKGTPLPTYEEAKQYLSYETLYANGSRTETQVGIYILSSSGDGAQHRDSGSSGKSRRKRQIYGYDSRFSIFGKDFLLNYPFSTSVKLSTGCTGTLVAEKHVLTAAHCIHDGKTYVKGTQKLRVGFLKPKFKDGGRGANDSTSAMPEQMKFQWIRVKRTHVPKGWIKGNANDIGMDYDYALLELKKPHKRKFMKIGVSPPAKQLPGGRIHFSGYDNDRPGNLVYRFCDVKDETYDLLYQQCDAQPGASGSGVYVRMWKRQQQKWERKIIGIFSGHQWVDMNGSPQDFNVAVRITPLKYAQICYWIKGNYLDCREG

SEQ ID NO: 864225 - protein, 440 aa, Homo sapiens; identical to SEQ ID NO: 864221

SEQ ID NO: 864226 - protein, 138 aa, Homo sapiens
AGGGPASCLRCSPACSHSAVRRGRHGSRALSPGAHTCLSGAASRGPGGLLGADGSLMSRMRPVCQPWPSPHAPTTVKREGSTVSNSIQPPPPEYQLGSRTWLEAETPGQKRQCSAFMEFTEESRRASHFSSILKIEPV

SEQ ID NO: 864227 - protein, 440 aa, Homo sapiens; identical to SEQ ID NO: 864221

SEQ ID NO: 864228 - protein, 383 aa, Homo sapiens
MAGIPGLLFLLFFLLCAVGQVSPYSAPWKPTWPAYRLPVVLPQSTLNLAKPDFGAEAKLEVSSSCGPQCHKGTPLPTYEEAKQYLSYETLYANGSRTETQVGIYILSSSGDGAQHRDSGSSGKSRRKRQIYGYDSRFSIFGKDFLLNYPFSTSVKLSTGCTGTLVAEKHVLTAAHCIHDGKTYVKGTQKLRVGFLKPKFKDGGRGANDSTSAMPEQMKFQWIRVKRTHVPKGWIKGNANDIGMDYDYALLELKKPHKRKFMKIGVSPPAKQLPGGRIHFSGYDNDRPGNLVYRFCDVKDETYDLLYQQCDAQPGASGSGVYVRMWKRQQQKWERKIIGIFSGHQWVDMNGSPQDFNVAVRITPLKYAQICYWIKGNYLDCREG

SEQ ID NO: 864229 - protein, 440 aa, Homo sapiens; identical to SEQ ID NO: 864221

SEQ ID NO: 864230 - protein, 440 aa, Homo sapiens; identical to SEQ ID NO: 864221

SEQ ID NO: 864231 - protein, 532 aa, Homo sapiens
CTRMALKWTSVLLLIHLSCYFSSGSCGKVLVWAAEYSHWMNMKTILKELVQRGHEVTVLASSASILFDPNDASTLKLEVYPTSLTKTEFENIIMQQVKRWSDIRKDSFWLYFSQEQEILWELYDIFRNFCKDVVSNKKVMKKLQESRFDIVFADAVFPCGELLAALLNIRFVYSLRFTPGYTIERHSGGLIFPPSYIPIVMSKLSDQMTFMERVKNMIYVLYFDFWFQMSDMKKWDQFYSEVLGRPTTLFETMGKADIWLMRNSWSFQFPHPFLPNVDFVGGFHCKPAKPLPKEMEEFVQSSGENGVVVFSLGSVISNMTAERANVIATALAKIPQKVLWRFDGNKPDALGLNTRLYKWIPQNDLLGHPKTRAFITHGGANGIYEAIYHGIPMVGIPLFWDQPDNIAHMKAKGAAVRLDFHTMSSTDLLNALKTVINDPLYKENVMKLSRIQHDQPVKPLDRAVFWIEFVMRHKGAKHLRVAARDLTWFQYHSLDVIGFLLACVATVIFIITKFCLFCFWKFARKGKKGKRD

SEQ ID NO: 864232 - protein, 415 aa, Homo sapiens
CTRMALKWTSVLLLIHLSCYFSSGSCGKVLVWAAEYSHWMNMKTILKELVQRGHEVTVLASSASILFDPNDASTLKLEVYPTSLTKTEFENIIMQQVKRWSDIRKDNFWFQMSDMKKWDQFYSEVLGRPTTLFETMGKADIWLMRNSWSFQFPHPFLPNVDFVGGFHCKPAKPLPKEMEEFVQSSGENGVVVFSLGSVISNMTAERANVIATALAKIPQKVLWRFDGNKPDALGLNTRLYKWIPQNDLLGHPKTRAFITHGGANGIYEAIYHGIPMVGIPLFWDQPDNIAHMKAKGAAVRLDFHTMSSTDLLNALKTVINDPLYKENVMKLSRIQHDQPVKPLDRAVFWIEFVMRHKGAKHLRVAARDLTWFQYHSLDVIGFLLACVATVIFIITKFCLFCFWKFARKGKKGKRD

SEQ ID NO: 864233 - protein, 440 aa, Homo sapiens
CTRMALKWTSVLLLIHLSCYFSSGSCGKVLVWAAEYSHWMNMKTILKELVQRGHEVTVLASSASILFDPNDASTLKLEVYPTSLTKTEFENIIMQQVKRWSDIRKDSFWLYFSQEQEILWELYDIFRNFCKDVVSNKKVMKKLQESRFDIVFADAVFPCGELLAALLNIRFVYSLRFTPGYTIERHSGGLIFPPSYIPIVMSKLSDQMTFMERVKNMIYVLYFDFWFQMSDMKKWDQFYSEVLGRPTTLFETMGKADIWLMRNSWSFQFPHPFLPNVDFVGGFHCKPAKPLPKEMEEFVQSSGENGVVVFSLGSVISNMTAERANVIATALAKIPQKVLWRFDGNKPDALGLNTRLYKWIPQNDLLGHPKTRAFITHGGANGIYEAIYHGIPMVGIPLFWDQPDNIAHMKAKGAAVRLDFHTMSSTDLLNALKTVINDPL

SEQ ID NO: 864234 - protein, 250 aa, Homo sapiens
CTRMALKWTSVLLLIHLSCYFSSGSCGKVLVWAAEYSHWMNMKTILKELVQRGHEVTVLASSASILFDPNDASTLKLEVYPTSLTKTEFENIIMQQVKRWSDIRKDSFWLYFSQEQEILWELYDIFRNFCKDVVSNKKVMKKLQESRFDIVFADAVFPCGELLAALLNIRFVYSLRFTPGYTIERHSGGLIFPPSYIPIVMSKLSDQMTFMERVKNMIYVLYFDFWFQMSDMKKWDQFYSEVLGKNLFNR

SEQ ID NO: 864235 - protein, 318 aa, Homo sapiens
MTSGFTSARNEGVRVRSSRGRAGGVWRFERDEDGTGAGCGQWTRFCREPKMAVNVYSTSVTSDNLSRHDMLAWINESLQLNLTKIEQLCSGAAYCQFMDMLFPGSIALKKVKFQAKLEHEYIQNFKILQAGFKRMGVDKIIPVDKLVKGKFQDNFEFVQWFKKFFDANYDGKDYDPVAARQGQETAVAPSLVAPALNKPKKPLTSSSAAPQRPISTQRTAAAPKAGPGVVRKNPGVGNGDDEAAELMQQVNVLKLTVEDLEKERDFYFGKLRNIELICQENEGENDPVLQRIVDILYATDEGFVIPDEGGPQEEQEEY

SEQ ID NO: 864236 - protein, 297 aa, Homo sapiens
SGPPLRCGPCAAATGGPRVVGPWEGVGEKMAVNVYSTSVTSDNLSRHDMLAWINESLQLNLTKIEQLCSGAAYCQFMDMLFPGSIALKKVKFQAKLEHEYIQNFKILQAGFKRMGVDKIIPVDKLVKGKFQDNFEFVQWFKKFFDANYDGKDYDPVAARQGQETAVAPSLVAPALNKPKKPLTSSSAAPQRPISTQRTAAAPKAGPGVVRKNPGVGNGDDEAAELMQQVNVLKLTVEDLEKERDFYFGKLRNIELICQENEGENDPVLQRIVDILYATDEGFVIPDEGGPQEEQEEY

SEQ ID NO: 864237 - protein, 242 aa, Homo sapiens
NLRLGTSAGVNPAEGAAYCQFMDMLFPGSIALKKVKFQAKLEHEYIQNFKILQAGFKRMGVDKIIPVDKLVKGKFQDNFEFVQWFKKFFDANYDGKDYDPVAARQGQETAVAPSLVAPALNKPKKPLTSSSAAPQRPISTQRTAAAPKAGPGVVRKNPGVGNGDDEAAELMQQVNVLKLTVEDLEKERDFYFGKLRNIELICQENEGENDPVLQRIVDILYATDEGFVIPDEGGPQEEQEEY

SEQ ID NO: 864238 - protein, 258 aa, Homo sapiens
MTSGFTSARNEGVRVRSSRGRAGGVWRFERDEDGTGAGCGQWTRFCREPKMAVNVYSTSVTSDNLSRHDMLAWINESLQLNLTKIEQLCSGAAYCQFMDMLFPGSIALKKVKFQAKLEHEYIQNFKILQAGFKRMGVDKIIPVDKLVKGKFQDNFEFVQWFKKFFDANYDGKDPGVGNGDDEAAELMQQVNVLKLTVEDLEKERDFYFGKLRNIELICQENEGENDPVLQRIVDILYATDEGFVIPDEGGPQEEQEEY

SEQ ID NO: 864239 - protein, 318 aa, Homo sapiens; identical to SEQ ID NO: 864235

SEQ ID NO: 864240 - protein, 114 aa, Homo sapiens
MTSGFTSARNEGVRVRSSRGRAGGVWRFERDEDGTGAGCGQWTRFCREPKMAVNVYSTSVTSDNLSRHDMLAWINESLQLNLTKIEQLCSGAAYCQFMDMLFPGSIALKKLKCV

SEQ ID NO: 864241 - protein, 156 aa, Homo sapiens
MTSGFTSARNEGVRVRSSRGRAGGVWRFERDEDGTGAGCGQWTRFCREPKMAVNVYSTSVTSDNLSRHDMLAWINESLQLNLTKIEQLCSGAAYCQFMDMLFPGSIALKKVKFQAKLEHEYIQNFKILQAGFKRMGVDKVSKRYLLLWLMFLNDRC

SEQ ID NO: 864242 - protein, 281 aa, Homo sapiens
MTSGFTSARNEGKMAVNVYSTSVTSDNLSRHDMLAWINESLQLNLTKIEQLCSGAAYCQFMDMLFPGSIALKKVKFQAKLEHEYIQNFKILQAGFKRMGVDKIIPVDKLVKGKFQDNFEFVQWFKKFFDANYDGKDYDPVAARQGQETAVAPSLVAPALNKPKKPLTSSSAAPQRPISTQRTAAAPKAGPGVVRKNPGVGNGDDEAAELMQQVNVLKLTVEDLEKERDFYFGKLRNIELICQENEGENDPVLQRIVDILYATDEGFVIPDEGGPQEEQEEY

SEQ ID NO: 864243 - protein, 181 aa, Homo sapiens
MTSGFTSARNEGVRVRSSRGRAGGVWRFERDEDGTGAGCGQWTRFCREPKMAVNVYSTSVTSDNLSRHDMLAWINESLQLNLTKIEQLCSGAAYCQFMDMLFPGSIALKKVKFQAKLEHEYIQNFKILQAGFKRMGVDKIIPVDKLVKGKFQDNFEFVQWFKKFFDANYDGKDFPCCSSSE

SEQ ID NO: 864244 - protein, 318 aa, Homo sapiens; identical to SEQ ID NO: 864235

SEQ ID NO: 864245 - protein, 318 aa, Homo sapiens; identical to SEQ ID NO: 864235

SEQ ID NO: 864246 - protein, 334 aa, Homo sapiens
HEAPCDHMEYAVNCHVITWERIISHFDIFAFGHFWGWAMKALLIRSYGLCWTISITWELTELFFMHLLPNFAECWWDQVILDILLCNGGGIWLGMVVCRFLEMRTYHWASFKDIHTTTGKIKRAVLQFTPASWTYVRWFDPKSSFQRVAGVYLFMIIWQLTELNTFFLKHIFVFQASHPLSWGRILFIGGITAPTVRQYYAYLTDTQCKRVGTQCWVFGVIGFLEAIVCIKFGQDLFSKTQILYVVLWLLCVAFTTFLCLYGMIWYAEHYGHREKTYSECEDGTYSPEISWHHRKGTKGSEDSPPKHAGNNESHSSRRRNRHSKSKVTNGVGKK

SEQ ID NO: 864247 - protein, 473 aa, Homo sapiens
MASCVGSRTLSKDDVNYKMHFRMINEQQVEDITIDFFYRPHTITLLSFTIVSLMYFAFTRDDSVPEDNIWRGILSVIFFFLIISVLAFPNGPFTRPHPALWRMVFGLSVLYFLFLVFLLFLNFEQVKSLMYWLDPNLRYATREADVMEYAVNCHVITWERIISHFDIFAFGHFWGWAMKALLIRSYGLCWTISITWELTELFFMHLLPNFAECWWDQVILDILLCNGGGIWLGMVVCRFLEMRTYHWASFKDIHTTTGKIKRAVLQFTPASWTYVRWFDPKSSFQRVAGVYLFMIIWQLTELNTFFLKHIFVFQASHPLSWGRILFIGGITAPTVRQYYAYLTDTQCKRVGTQCWVFGVIGFLEAIVCIKFGQDLFSKTQILYVVLWLLCVAFTTFLCLYGMIWYAEHYGHREKTYSECEDGTYSPEISWHHRKGTKGSEDSPPKHAGNNESHSSRRRNRHSKSKVTNGVGKK

SEQ ID NO: 864248 - protein, 371 aa, Homo sapiens [sequence omitted]

SEQ ID NO: 864249 - protein, 101 aa, Homo sapiens
LVAGQDGHRVVCVLIAPRLGFRFTCALTSGPHHHDHVHHTQDRCTHASGTTQTLGRYCVEPRATACAPSVLVLCLRASPSFMNEATRGSARIREGPVPRQA

SEQ ID NO: 864250 - protein, 358 aa, Homo sapiens
MASCVGSRTLSKDDVNYKMHFRMINEQQVEDITIDFFYRPHTITLLSFTIVSLMYFAFTRDDSVPEDNIWRGILSVIFFFLIISVLAFPNGPFTRPHPALWRMVFGLSVLYFLFLVFLLFLNFEQVKSLMYWLDPNLRYATREADVMEYAVNCHVITWERIISHFDIFAFGHFWGWAMKALLIRSYGLCWTISITWELTELFFMHLLPNFAECWWDQVILDILLCNGGGIWLGMVVCRFLEMRTYHWASFKDIHTTTGKIKRAVLQFTPASWTYVRWFDPKSSFQRVAGVYLFMIIWQLTELNTFFLKHIFVFQASHPLSWGRILFIGGITAPTVRQYYAYLTDTQCKRVGTQCWVFG

SEQ ID NO: 864251 - protein, 327 aa, Homo sapiens
MEYAVNCHVITWERIISHFDIFAFGHFWGWAMKALLIRSYGLCWTISITWELTELFFMHLLPNFAECWWDQVILDILLCNGGGIWLGMVVCRFLEMRTYHWASFKDIHTTTGKIKRAVLQFTPASWTYVRWFDPKSSFQRVAGVYLFMIIWQLTELNTFFLKHIFVFQASHPLSWGRILFIGGITAPTVRQYYAYLTDTQCKRVGTQCWVFGVIGFLEAIVCIKFGQDLFSKTQILYVVLWLLCVAFTTFLCLYGMIWYAEHYGHREKTYSECEDGTYSPEISWHHRKGTKGSEDSPPKHAGNNESHSSRRRNRHSKSKVTNGVGKK

SEQ ID NO: 864252 - protein, 473 aa, Homo sapiens; identical to SEQ ID NO: 864247

SEQ ID NO: 864253 - protein, 473 aa, Homo sapiens; identical to SEQ ID NO: 864247

SEQ ID NO: 864254 - protein, 552 aa, Homo sapiens
MASCVGSRTLSKDDVNYKMHFRMINEQQVEDITIDFFYRPHTITLLSFTIVSLMYFAFTRDDSVPEDNIWRGILSVIFFFLIISVLAFPNGPFTRPHPALWRMVFGLSVLYFLFLVFLLFLNFEQVKSLMYWLDPNLRYATREADVMEYAVNCHVITWERIISHFDIFAFGHFWGWAMKALLIRSYGLCWTISITWELTELFFMHLLPNFAECWWDQVILDILLCNGGGIWLGMVVCRFLEMRTYHWASFKDIHTTTGKIKRAVLQFTPASWTYVRWFDPKSSFQRVAGVYLFMIIWQLTELNTFFLKHIFVFQASHPLSWGRILFIGGITAPTVRQYYAYLTDTQCKRVGTQCWVFGVIGFLEAIVCIKFGQDLFSKTQILYVVLWLLCVAFTTFLCLYGMIWYAEHYGHREKTYSECEDGTYSPEISWHHRKGTKGSEGQPHPKHACATNESQFFPATQAHRAIPNVATKVHQLRVGTRNGHTPLVSSKACTQKHAVELTEAHMGNLHSGNHPPPKRPSDAPHRALPGQTRPNAPPARAHTPSPHSTTAT

SEQ ID NO: 864255 - protein, 167 aa, Homo sapiens
MASCVGSRTLSKDDVNYKMHFRMINEQQVEDITIDFFYRPHTITLLSFTIVSLMYFAFTRDDSVPEDNIWRGILSVIFFFLIISVLAFPNGPFTRPHPALWRMVFGLSVLYFLFLVFLLFLNFEQVKSLMYWLDPNLRYATREADVMVCTCQWPLGETRRLFLGCKR

SEQ ID NO: 864256 - protein, 713 aa, Homo sapiens
MARARGSPCPPLPPGRMSWPHGALLFLWLFSPPLGAGGGGVAVTSAAGGGSPPATSCPVACSCSNQASRVICTRRDLAEVPASIPVNTRYLNLQENGIQVIRTDTFKHLRHLEILQLSKNLVRKIEVGAFNGLPSLNTLELFDNRLTTVPTQAFEYLSKLRELWLRNNPIESIPSYAFNRVPSLRRLDLGELKRLEYISEAAFEGLVNLRYLNLGMCNLKDIPNLTALVRLEELELSGNRLDLIRPGSFQGLTSLRKLWLMHAQVATIERNAFDDLKSLEELNLSHNNLMSLPHDLFTPLHRLERVHLNHNPWHCNCDVLWLSWWLKETVPSNTTCCARCHAPAGLKGRYIGELDQSHFTCYAPVIVEPPTDLNVTEGMAAELKCRTGTSMTSVNWLTPNGTLMTHGSYRVRISVLHDGTLNFTNVTVQDTGQYTCMVTNSAGNTTASATLNVSAVDPVAAGGTGSGGGGPGGSGGVGGGSGGYTYFTTVTVETLETQPGEEALQPRGTEKEPPGPTTDGVWGGGRPGDAAGPASSSTTAPAPRSSRPTEKAFTVPITDVTENALKDLDDVMKTTKIIIGCFVAITFMAAVMLVAFYKLRKQHQLHKHHGPTRTVEIINVEDELPAASAVSVAAAAAAASGGGVGGDSHLALPALERDHLNHHHYVAAAFKAHYSSNPSGGGCGGKGPPGLNSIHEPLLFKSGSKENVQETQI

SEQ ID NO: 864257 - protein, 276 aa, Homo sapiens
MSWPHGALLFLWLFSPPLGAGGGGVAVTSAAGGGSPPATSCPVACSCSNQASRVICTRRDLAEVPASIPVNTRYLNLQENGIQVIRTDTFKHLRHLEILQLSKNLVRKIEVGAFNGLPSLNTLELFDNRLTTVPTQAFEYLSKLRELWLRNNPIESIPSYAFNRVPSLRRLDLGELKRLEYISEAAFEGLVNLRYLNLGMCNLKDIPNLTALVRLEELELSGNRLDLIRPGSFQGLTSLRKLWLMHAQVATIERNAFDDLKSLEELNLSHLPHRHF

SEQ ID NO: 864258 - protein, 697 aa, Homo sapiens
MSWPHGALLFLWLFSPPLGAGGGGVAVTSAAGGGSPPATSCPVACSCSNQASRVICTRRDLAEVPASIPVNTRYLNLQENGIQVIRTDTFKHLRHLEILQLSKNLVRKIEVGAFNGLPSLNTLELFDNRLTTVPTQAFEYLSKLRELWLRNNPIESIPSYAFNRVPSLRRLDLGELKRLEYISEAAFEGLVNLRYLNLGMCNLKDIPNLTALVRLEELELSGNRLDLIRPGSFQGLTSLRKLWLMHAQVATIERNAFDDLKSLEELNLSHNNLMSLPHDLFTPLHRLERVHLNHNPWHCNCDVLWLSWWLKETVPSNTTCCARCHAPAGLKGRYIGELDQSHFTCYAPVIVEPPTDLNVTEGMAAELKCRTGTSMTSVNWLTPNGTLMTHGSYRVRISVLHDGTLNFTNVTVQDTGQYTCMVTNSAGNTTASATLNVSAVDPVAAGGTGSGGGGPGGSGGVGGGSGGYTYFTTVTVETLETQPGEEALQPRGTEKEPPGPTTDGVWGGGRPGDAAGPASSSTTAPAPRSSRPTEKAFTVPITDVTENALKDLDDVMKTTKIIIGCFVAITFMAAVMLVAFYKLRKQHQLHKHHGPTRTVEIINVEDELPAASAVSVAAAAAAASGGGVGGDSHLALPALERDHLNHHHYVAAAFKAHYSSNPSGGGCGGKGPPGLNSIHEPLLFKSGSKENVQETQI

SEQ ID NO: 864259 - protein, 607 aa, Homo sapiens
IQLVSEHILQLSKNLVRKIEVGAFNGLPSLNTLELFDNRLTTVPTQAFEYLSKLRELWLRNNPIESIPSYAFNRVPSLRRLDLGELKRLEYISEAAFEGLVNLRYLNLGMCNLKDIPNLTALVRLEELELSGNRLDLIRPGSFQGLTSLRKLWLMHAQVATIERNAFDDLKSLEELNLSHNNLMSLPHDLFTPLHRLERVHLNHNPWHCNCDVLWLSWWLKETVPSNTTCCARCHAPAGLKGRYIGELDQSHFTCYAPVIVEPPTDLNVTEGMAAELKCRTGTSMTSVNWLTPNGTLMTHGSYRVRISVLHDGTLNFTNVTVQDTGQYTCMVTNSAGNTTASATLNVSAVDPVAAGGTGSGGGGPGGSGGVGGGSGGYTYFTTVTVETLETQPGEEALQPRGTEKEPPGPTTDGVWGGGRPGDAAGPASSSTTAPAPRSSRPTEKAFTVPITDVTENALKDLDDVMKTTKIIIGCFVAITFMAAVMLVAFYKLRKQHQLHKHHGPTRTVEIINVEDELPAASAVSVAAAAAAASGGGVGGDSHLALPALERDHLNHHHYVAAAFKAHYSSNPSGGGCGGKGPPGLNSIHEPLLFKSGSKENVQETQI

SEQ ID NO: 864260 - protein, 181 aa, Homo sapiens
YLASGKTKTIRHMVANVRGNHIASGSTDTWNGKTLKIPPVTPSILDCCIIRVDYSLAVYIHIPGAKKLMLELPLVIGTIPYNGFGSRNSSIASQFSMDMSWLTLTLPEQPEAPPNYADVVSEEEFSRHIPPYPQPPNCEGEVCCPVFACIQEFRFQPPPLYSEVDPHPSDVEESQPVSFIL

SEQ ID NO: 864261 - protein, 181 aa, Homo sapiens; identical to SEQ ID NO: 864260

SEQ ID NO: 864262 - protein, 181 aa, Homo sapiens; identical to SEQ ID NO: 864260

SEQ ID NO: 864263 - protein, 181 aa, Homo sapiens; identical to SEQ ID NO: 864260

SEQ ID NO: 864264 - protein, 73 aa, Homo sapiens
AWEKKKEVPAVPETLKKKRRNFAELKIKRLRKKFAQKMLRKARRKPLHLLAQGPSLCKQGAWAVVSPVCADLY

SEQ ID NO: 864265 - protein, 894 aa, Homo sapiens
MNSMNPMKPALPPAPHGDGSFAYESVPWQQSATQPAGSLSVVTTVWGVGNATQSQVLGNPMGPAGSPSGSSMMPGVAGGSSALTSPQCLGQQAFAEGGANKGYVQQGVYSRGGYPGAPGFTTGYAGGPGGLGLPSHAARPSTDFTQAAAAAAVAAAAATATATATATVAALQEKQSQELSQYGAMGAGQSFNSQFLQHGGPRGPSVPAGMNPTGIGGVMGPSGLSPLAMNPTRAAGMTPLYAGQRLPQHGYPGPPQAQPLPRQGVKRTYSEVYPGQQYLQGGQYAPSTAQFAPSPGQPPAPSPSYPGHRLPLQQGMTQSLSVPGPTGLHYKPTRSIPGYPSSPLPGNPTPPMTPSSSVPYMSPNQEVKSPFLPDLKPNLNSLHSSPSGSGPCDELRLTFPVRDGVVLEPFRLQHNLAVSNHVFQLRDSVYKTLIMRPDLELQFKCYHHEDRQMNTNWPASVQVSVNATPLTIERGDNKTSHKPLYLKHVCQPGRNTIQITVTACCCSHLFVLQLVHRPSVRSVLQGLLKKRLLPAEHCITKIKRNFSSGTIPGTPGPNGEDGVEQTAIKVSLKCPITFRRIQLPARGHDCRHIQCFDLESYLQLNCERGTWRCPVCNKTALLEGLEVDQYMLGILIYIQNSDYEEITIDPTCSWKPVPVKPDMHIKEEPDGPALKRCRTVSPAHVLMPSVMEMIAALGPGAAPFAPLQPPSVPAPSDYPGQGSSFLGPGTFPESFPPTTPSTPTLAEFTPGPPPISYQSDIPSSLLTSEKSTACLPSQMAPAGHLDPTHNPGTPGLHTSNLGAPPGPQLHHSNPPPASRQSLGQASLGPTGELAFSPATGVMGPPSMSGAGEAPEPALDLLPELTNPDELLSYLGPPDLPTNNNDDLLSLFENN

SEQ ID NO: 864266 - protein, 985 aa, Homo sapiens
MNSMNPMKPALPPAPHGDGSFAYESVPWQQSATQPAGSLSVVTTVWGVGNATQSQVLGNPMGPAGSPSGSSMMPGVAGGSSALTSPQCLGQQAFAEGGANKGYVQQGVYSRGGYPGAPGFTTGYAGGPGGLGLPSHAARPSTDFTQAAAAAAVAAAAATATATATATVAALQEKQSQELSQYGAMGAGQSFNSQFLQHGGPRGPSVPAGMNPTGIGGVMGPSGLSPLAMNPTRAAGMTPLYAGQRLPQHGYPGPPQAQPLPRQGVKRTYSEVYPGQQYLQGGQYAPSTAQFAPSPGQPPAPSPSYPGHRLPLQQGMTQSLSVPGPTGLHYKPTEQFNGQGASFNGGSVSYSQPGLSGVGAWPGGWAGRLTGWAYGERATGQAPLGPPPVHLCYHGSQWVRREQTPLPSTLAICLDCLCSTLQPTRSIPGYPSSPLPGNPTPPMTPSSSVPYMSPNQEVKSPFLPDLKPNLNSLHSSPSGSGPCDELRLTFPVRDGVVLEPFRLQHNLAVSNHVFQLRDSVYKTLIMRPDLELQFKCYHHEDRQMNTNWPASVQVSVNATPLTIERGDNKTSHKPLYLKHVCQPGRNTIQITVTACCCSHLFVLQLVHRPSVRSVLQGLLKKRLLPAEHCITKIKRNFSSGTIPGTPGPNGEDGVEQTAIKVSLKCPITFRRIQLPARGHDCRHIQCFDLESYLQLNCERGTWRCPVCNKTALLEGLEVDQYMLGILIYIQNSDYEEITIDPTCSWKPVPVKPDMHIKEEPDGPALKRCRTVSPAHVLMPSVMEMIAALGPGAAPFAPLQPPSVPAPSDYPGQGSSFLGPGTFPESFPPTTPSTPTLAEFTPGPPPISYQSDIPSSLLTSEKSTACLPSQMAPAGHLDPTHNPGTPGLHTSNLGAPPGPQLHHSNPPPASRQSLGQASLGPTGELAFSPATGVMGPPSMSGAGEAPEPALDLLPELTNPDELLSYLGPPDLPTNNNDDLLSLFENN

SEQ ID NO: 864267 - protein, 894 aa, Homo sapiens; identical to SEQ ID NO: 864265

SEQ ID NO: 864268 - protein, 894 aa, Homo sapiens; identical to SEQ ID NO: 864265

SEQ ID NO: 864269 - protein, 951 aa, Homo sapiens
MNSMNPMKPALPPAPHGDGSFAYESVPWQQSATQPAGSLSVVTTVWGVGNATQSQVLGNPMGPAGSPSGSSMMPGVAGGSSALTSPQCLGQQAFAEGGANKGYVQQGVYSRGGYPGAPGFTTGYAGGPGGLGLPSHAARPSTDFTQAAAAAAVAAAAATATATATATVAALQEKQSQELSQYGAMGAGQSFNSQFLQHGGPRGPSVPAGMNPTGIGGVMGPSGLSPLAMNPTRAAGMTPLYAGQRLPQHGYPGPPQAQPLPRQGVKRTYSEVYPGQQYLQGGQYAPSTAQFAPSPGQPPAPSPSYPGHRLPLQQGMTQSLSVPGPTGLHYKPTEQFNGQGASFNGGSVSYSQPGLSGPTRSIPGYPSSPLPGNPTPPMTPSSSVPYMSPNQEVKSPFLPDLKPNLNSLHSSPSGSGPCDELRLTFPVRDGVVLEPFRLQHNLAVSNHVFQLRDSVYKTLIMRPDLELQFKCYHHEDRQMNTNWPASVQVSVNATPLTIERGDNKTSHKPLYLKHVCQPGRNTIQITVTACCCSHLFVLQLVHRPSVRSVLQGLLKKRLLPAEHCITKIKRNFSSGTIPGTPGPNGEDGVEQTAIKVSLKCPITFRRIQLPARGHDCRHIQCFDLESYLQLNCERGTWRCPVCNKTALLEGLEVDQYMLGILIYIQNSDYEEITIDPTCSWKPVPVKPDMHIKEEPDGPALKRCRTVSPAHVLMPSVMEMIAALGPGAAPFAPLQPPSVPAPSDYPGQGIPKANSLGSNEKKCPFPNSDFCKTLLLFVGGSSFLGPGTFPESFPPTTPSTPTLAEFTPGPPPISYQSDIPSSLLTSEKSTACLPSQMAPAGHLDPTHNPGTPGLHTSNLGAPPGPQLHHSNPPPASRQSLGQASLGPTGELAFSPATGVMGPPSMSGAGEAPEPALDLLPELTNPDELLSYLGPPDLPTNNNDDLLSLFENN

SEQ ID NO: 864270 - protein, 264 aa, Homo sapiens
MLGILIYIQNSDYEEITIDPTCSWKPVPVKPDMHIKEEPDGPALKRCRTVSPAHVLMPSVMEMIAALGPGAAPFAPLQPPSVPAPSDYPGQGSSFLGPGTFPESFPPTTPSTPTLAEFTPGPPPISYQSDIPSSLLTSEKSTACLPSQMAPAGHLDPTHNPGTPGLHTSNLGAPPGPQLHHSNPPPASRQSLGQASLGPTGELAFSPATGVMGPPSMSGAGEAPEPALDLLPELTNPDELLSYLGPPDLPTNNNDDLLSLFENN

SEQ ID NO: 864271 - protein, 758 aa, Homo sapiens
MNSMNPMKPALPPAPHGDGSFAYESVPWQQSATQPAGSLSVVTTVWGVGNATQSQVLGNPMGPAGSPSGSSMMPGVAGGSSALTSPQCLGQQAFAEGGANKGYVQQGVYSRGGYPGAPGFTTGYAGGPGGLGLPSHAARPSTDFTQAAAAAAVAAAAATATATATATVAALQEKQSQELSQYGAMGAGQSFNSQFLQHGGPRGPSVPAGMNPTGIGGVMGPSGLSPLAMNPTRAAGMTPLYAGQRLPQHGYPGPPQAQPLPRQGVKRTYSEVYPGQQYLQGGQYAPSTAQFAPSPGQPPAPSPSYPGHRLPLQQGMTQSLSVPGPTGLHYKPTEQFNGQGASFNGGSVSYSQPGLSGPTRSIPGYPSSPLPGNPTPPMTPSSSVPYMSPNQEVKSPFLPDLKPNLNSLHSSPSGSGPCDELRLTFPVRDGVVLEPFRLQHNLAVSNHVFQLRDSVYKTLIMRPDLELQFKCYHHEDRQMNTNWPASVQVSVNATPLTIERGDNKTSHKPLYLKHVCQPGRNTIQITVTACCCSHLFVLQLVHRPSVRSVLQGLLKKRLLPAEHCITKIKRNFSSGTIPGTPGPNGEDGVEQTAIKVSLKCPITFRRIQLPARGHDCRHIQCFDLESYLQLNCERGTWRCPVCNKTALLEGLEVDQYMLGILIYIQNSDYEEITIDPTCSWKPVPVKPDMHIKEEPDGPALKRCRTVSPAHVLMPSVMEMIAALGPGAAPFAPLQPPSVPAPSDYPGQGMSQGQFPWQQ

SEQ ID NO: 864272 - protein, 104 aa, Homo sapiens [sequence omitted]

SEQ ID NO: 864273 - protein, 868 aa, Homo sapiens
MNSMNPMKPALPPAPHGDGSFAYESVPWQQSATQPAGSLSVVTTVWGVGNATQSQVLGNPMGPAGSPSGSSMMPGVAGGSSALTSPQCLGQQAFAEGGANKGYVQQGVYSRGGYPGAPGFTTGYAGGPGGLGLPSHAARPSTDFTQAAAAAAVAAAAATATATATATVAALQEKQSQELSQYGAMGAGQSFNSQFLQHGGPRGPSVPAGMNPTGIGGVMGPSGLSPLAMNPTRAAGMTPLYAGQRLPQHGYPGPPQAQPLPRQGVKRTYSEVYPGQQYLQGGQYAPSTAQFAPSPGQPPAPSPSYPGHRLPLQQGMTQSLSVPGPTGLHYKPTEQFNGQGASFNGGSVSYSQPGLSGPTRSIPGYPSSPLPGNPTPPMTPSSSVPYMSPNQEVKSPFLPDLKPNLNSLHSSPSGSGPCDELRLTFPVRDGVVLEPFRLQHNLAVSNHVFQLRDSVYKTLIMRPDLELQFKCYHHEDRQMNTNWPASVQVSVNATPLTIERGDNKTSHKPLYLKHVCQPGRNTIQITVTACCCSHLFVLQLVHRPSVRSVLQGLLKKRLLPAEHCITKIKRNFSSGTIPGTPGPNGEDGVEQTAIKVSLKCPITFRRIQLPARGHDCRHIQCFDLESYLQLNCERGTWRCPVCNKTALLEGLEVDQYMLGILIYIQNSDYEEITIDPTCSWKPVPVKPDMHIKEEPDGPALKRCRTVSPAHVLMPSVMEMIAALGPGAAPFAPLQPPSVPAPSDYPGQGKYSRLALNLKMTLGIWLLSPDQSPHLQECGYAGHTPRLSVLPHKTMTAGHLQPLPSQGRGGEGTVSAMVPGNRQWGLHPSFPVWIKGLLAGTPHRTGPIWGPPLGPTSHAWCIPRWYFRR

SEQ ID NO: 864274 - protein, 401 aa, Homo sapiens [sequence omitted]

SEQ ID NO: 864275 - protein, 401 aa, Homo sapiens [sequence omitted]

SEQ ID NO: 864276 - protein, 920 aa, Homo sapiens
MNSMNPMKPALPPAPHGDGSFAYESVPWQQSATQPAGSLSVVTTVWGVGNATQSQVLGNPMGPAGSPSGSSMMPGVAGGSSALTSPQCLGQQAFAEGGANKGYVQQGVYSRGGYPGAPGFTTGYAGGPGGLGLPSHAARPSTDFTQAAAAAAVAAAAATATATATATVAALQEKQSQELSQYGAMGAGQSFNSQFLQHGGPRGPSVPAGMNPTGIGGVMGPSGLSPLAMNPTRAAGMTPLYAGQRLPQHGYPGPPQAQPLPRQGVKRTYSEVYPGQQYLQGGQYAPSTAQFAPSPGQPPAPSPSYPGHRLPLQQGMTQSLSVPGPTGLHYKPTEQFNGQGASFNGGSVSYSQPGLSGPTRSIPGYPSSPLPGNPTPPMTPSSSVPYMSPNQEVKSPFLPDLKPNLNSLHSSPSGSGPCDELRLTFPVRDGVVLEPFRLQHNLAVSNHVFQLRDSVYKTLIMRPDLELQFKCYHHEDRQMNTNWPASVQVSVNATPLTIERGDNKTSHKPLYLKHVCQPGRNTIQITVTACCCSHLFVLQLVHRPSVRSVLQGLLKKRLLPAEHCITKIKRNFSSGTIPGTPGPNGEDGVEQTAIKVSLKCPITFRRIQLPARGHDCRHIQCFDLESYLQLNCERGTWRCPVCNKTALLEGLEVDQYMLGILIYIQNSDYEEITIDPTCSWKPVPVKPDMHIKEEPDGPALKRCRTVSPAHVLMPSVMEMIAALGPGAAPFAPLQPPSVPAPSDYPGQGSSFLGPGTFPESFPPTTPSTPTLAEFTPGPPPISYQSDIPSSLLTSEKSTACLPSQMAPAGHLDPTHNPGTPGLHTSNLGAPPGPQLHHSNPPPASRQSLGQASLGPTGELAFSPATGVMGPPSMSGAGEAPEPALDLLPELTNPDELLSYLGPPDLPTNNNDDLLSLFENN

SEQ ID NO: 864277 - protein, 543 aa, Homo sapiens
MTPSSSVPYMSPNQEVKSPFLPDLKPNLNSLHSSPSGSGPCDELRLTFPVRDGVVLEPFRLQHNLAVSNHVFQLRDSVYKTLIMRPDLELQFKCYHHEDRQMNTNWPASVQVSVNATPLTIERGDNKTSHKPLYLKHVCQPGRNTIQITVTACCCSHLFVLQLVHRPSVRSVLQGLLKKRLLPAEHCITKIKRNFSSGTIPGTPGPNGEDGVEQTAIKVSLKCPITFRRIQLPARGHDCRHIQCFDLESYLQLNCERGTWRCPVCNKTALLEGLEVDQYMLGILIYIQNSDYEEITIDPTCSWKPVPVKPDMHIKEEPDGPALKRCRTVSPAHVLMPSVMEMIAALGPGAAPFAPLQPPSVPAPSDYPGQGSSFLGPGTFPESFPPTTPSTPTLAEFTPGPPPISYQSDIPSSLLTSEKSTACLPSQMAPAGHLDPTHNPGTPGLHTSNLGAPPGPQLHHSNPPPASRQSLGQASLGPTGELAFSPATGVMGPPSMSGAGEAPEPALDLLPELTNPDELLSYLGPPDLPTNNNDDLLSLFENN

SEQ ID NO: 864278 - protein, 894 aa, Homo sapiens; identical to SEQ ID NO: 864265

SEQ ID NO: 864279 - protein, 433 aa, Homo sapiens
MCQALLNQNPNCLKHYQVIIMTLYLKHVCQPGRNTIQITVTACCCSHLFVLQLVHRPSVRSVLQGLLKKRLLPAEHCITKIKRNFSSGTIPGTPGPNGEDGVEQTAIKVSLKCPITFRRIQLPARGHDCRHIQCFDLESYLQLNCERGTWRCPVCNKTALLEGLEVDQYMLGILIYIQNSDYEEITIDPTCSWKPVPVKPDMHIKEEPDGPALKRCRTVSPAHVLMPSVMEMIAALGPGAAPFAPLQPPSVPAPSDYPGQGSSFLGPGTFPESFPPTTPSTPTLAEFTPGPPPISYQSDIPSSLLTSEKSTACLPSQMAPAGHLDPTHNPGTPGLHTSNLGAPPGPQLHHSNPPPASRQSLGQASLGPTGELAFSPATGVMGPPSMSGAGEAPEPALDLLPELTNPDELLSYLGPPDLPTNNNDDLLSLFENN

SEQ ID NO: 864280 - protein, 819 aa, Homo sapiens
MNSMNPMKPALPPAPHGDGSFAYESVPWQQSATQPAGSLSVVTTVWGVGNATQSQVLGNPMGPAGSPSGSSMMPGVAGGSSALTSPQCLGQQAFAEGGANKGYVQQGVYSRGGYPGAPGFTTGYAGGPGGLGLPSHAARPSTDFTQAAAAAAVAAAAATATATATATVAALQEKQSQELSQYGAMGAGQSFNSQFLQHGGPRGPSVPAGMNPTGIGGVMGPSGLSPLAMNPTRAAGMTPLYAGQRLPQHGYPGPPQAQPLPRQGVKRTYSEVYPGQQYLQGGQYAPSTAQFAPSPGQPPAPSPSYPGHRLPLQQGMTQSLSVPGPTGLHYKPTEQFNGQGASFNGGSVSYSQPGLSGPTRSIPGYPSSPLPGNPTPPMTPSSSVPYMSPNQEVKSPFLPDLKPNLNSLHSSPSGSGPCDELRLTFPVRDGVVLEPFRLQHNLAVSNHVFQLRDSVYKTLIMRPDLELQFKCYHHEDRQMNTNWPASVQVSVNATPLTIERGDNKTSHKPLYLKHVCQPGRNTIQITVTACCCSHLFVLQLVHRPSVRSVLQGLLKKRLLPAEHCITKIKRNFSSGTIPGTPGPNGEDGVEQTAIKVSLKCPITFRRIQLPARGHDCRHIQCFDLESYLQLNCERGTWRCPVCNKTALLEGLEVDQYMLGILIYIQNSDYEEITIDPTCSWKPVPVKPDMHIKEEPDGPALKRCRTVSPAHVLMPSVMEMIAALGPGAAPFAPLQPPSVPPPASRQSLGQASLGPTGELAFSPATGVMGPPSMSGAGEAPEPALDLLPELTNPDELLSYLGPPDLPTNNNDDLLSLFENN

SEQ ID NO: 864281 - protein, 920 aa, Homo sapiens; identical to SEQ ID NO: 864276

SEQ ID NO: 864282 - protein, 848 aa, Homo sapiens
MNSMNPMKPALPPAPHGDGSFAYESVPWQQSATQPAGSLSVVTTVWGVGNATQSQVLGNPMGPAGSPSGSSMMPGVAGGSSALTSPQCLGQQAFAEGGANKGYVQQGVYSRGGYPGAPGFTTGYAGGPGGLGLPSHAARPSTDFTQAAAAAAVAAAAATATATATATVAALQEKQSQELSQYGAMGAGQSFNSQFLQHGGPRGPSVPAGMNPTGIGGVMGPSGLSPLAMNPTRAAGMTPLYAGQRLPQHGYPGPPQAQPLPRQGVKRTYSEVYPGQQYLQGGQYAPSTAQFAPSPGQPPAPSPSYPGHRLPLQQGMTQSLSVPGPTGLHYKPTEQFNGQGASFNGGSVSYSQPGLSGPTRSIPGYPSSPLPGNPTPPMTPSSSVPYMSPNQEVKSPFLPDLKPNLNSLHSSPSGSGPCDELRLTFPVRDGVVLEPFRLQHNLAVSNHVFQLRDSVYKTLIMRPDLELQFKCYHHEDRQMNTNWPASVQVSVNATPLTIERGDNKTSHKPLYLKHVCQPGRNTIQITVTACCCSHLFVLQLVHRPSVRSVLQGLLKKRLLPAEHCITKIKRNFSSGTIPGTPGPNGEDGVEQTAIKVSLKCPITFRRIQLPARGHDCRHIQCFDLESYLQLNCERGTWRCPVCNKTALLEGLEVDQYMLGILIYIQNSDYEEITIDPTCSWKPVPVKPDMHIKEEPDGPALKRCRTVSPAHVLMPSVMEMIAALGPGAGFWISSTDHVCSMAQSWDSGGETFCAPIAGEYVVDGVTAVVLIRCIKLTPRIVDLDRLIRRRSFRDHKRRRWLKNIVLQDIKEQEEEGESDSEAATQETSKREITQRETVEVQETGDDNAQ

SEQ ID NO: 864283 - protein, 401 aa, Homo sapiens [sequence omitted]

SEQ ID NO: 864284 - protein, 88 aa, Homo sapiens
RYRCIHRQVYSTGRCTQEVKSPFLPDLKPNLNSLHSSPSGSGPCDELRLTFPVRDGVVLEPFRLQHNLAVSNHVFQLRDSVYKTLIMR

SEQ ID NO: 864285 - protein, 222 aa, Homo sapiens
MPKVVSRSVVCSDTRDREEYDDGEKPLHVYYCLCGQMVLVLDCQLEKLPMRPRDRSRVIDAAKHAHKFCNTEDEETMYLRRPEGIERQYRKKCAKCGLPLFYQSQPKNAPVTFIVDGAVVKFGQGFGKTNIYTQKQEPPKKVMMTKRTKDMGKFSSVTVSTIDEEEEEIEAREVADSYAQNAKVIEKQLERKGMSKRRLQELAELEAKKAKMKGTLIDNQFK

SEQ ID NO: 864286 - protein, 222 aa, Homo sapiens; identical to SEQ ID NO: 864285

SEQ ID NO: 864287 - protein, 222 aa, Homo sapiens; identical to SEQ ID NO: 864285

SEQ ID NO: 864288 - protein, 250 aa, Homo sapiens
ATRHRHTQTRADLAVSRCYRTRRLLLGTMPKVVSRSVVCSDTRDREEYDDGEKPLHVYYCLCGQMVLVLDCQLEKLPMRPRDRSRVIDAAKHAHKFCNTEDEETMYLRRPEGIERQYRKKCAKCGLPLFYQSQPKNAPVTFIVDGAVVKFGQGFGKTNIYTQKQEPPKKVMMTKRTKDMGKFSSVTVSTIDEEEEEIEAREVADSYAQNAKVIEKQLERKGMSKRRLQELAELEAKKAKMKGTLIDNQFK

SEQ ID NO: 864289 - protein, 247 aa, Homo sapiens
GDTIDNLYKNRRYGPEFPGRLLLGTMPKVVSRSVVCSDTRDREEYDDGEKPLHVYYCLCGQMVLVLDCQLEKLPMRPRDRSRVIDAAKHAHKFCNTEDEETMYLRRPEGIERQYRKKCAKCGLPLFYQSQPKNAPVTFIVDGAVVKFGQGFGKTNIYTQKQEPPKKVMMTKRTKDMGKFSSVTVSTIDEEEEEIEAREVADSYAQNAKVIEKQLERKGMSKRRLQELAELEAKKAKMKGTLIDNQFK

SEQ ID NO: 864290 - protein, 222 aa, Homo sapiens; identical to SEQ ID NO: 864285

SEQ ID NO: 864291 - protein, 732 aa, Homo sapiens
MERQVLLSEPEEAAALYRGLSRQPALSAACLGPEVTTQYGGQYRTVHTEWTQRDLERMENIRFCRQYLVFHDGDSVVFAGPAGNSVETRGELLSRESPSGTMKAVLRKAGGTGPGEEKQFLEVWEKNRKLKSFNLSALEKHGPVYEDDCFGCLSWSHSETHLLYVAEKKRPKAESFFQTKALDVSASDDEIARLKKPDQAIKGDQFVFYEDWGENMVSKSIPVLCVLDVESGNISVLEGVPENVSPGQAFWAPGDAGVVFVGWWHEPFRLGIRFCTNRRSALYYVDLIGGKCELLSDDSLAVSSPRLSPDQCRIVYLQYPSLIPHHQCSQLCLYDWYTKVTSVVVDVVPRQLGENFSGIYCSLLPLGCWSADSQRVVFDSAQRSRQDLFAVDTQVGTVTSLTAGGSGGSWKLLTIDQDLMVAQFSTPSLPPTLKVGFLPSAGKEQSVLWVSLEEAEPIPDIHWGIRVLQPPPEQENVQYAGLDFEAILLQPGSPPDKTQVPMVVMPHGGPHSSFVTAWMLFPAMLCKMGFAVLLVNYRGSTGFGQDSILSLPGNVGHQDVKDVQFAVEQVLQEEHFDASHVALMGGSHGGFISCHLIGQYPETYRACVARNPVINIASMLGSTDIPDWCVVEAGFPFSSDCLPDLSVWAEMLDKSPIRYIPQVKTPLLLMLGQEDRRVPFKQGMEYYRALKTRNVPVRLLLYPKSTHALSEVEVESDSFMNAVLWLRTHLGS

SEQ ID NO: 864292 - protein, 148 aa, Homo sapiens
TRPSSPKGTMKAVLRKAGGTGPGEEKQFLEVWEKNRKLKSFNLSALEKHGPVYEDDCFGCLSWSHSETHLLYVAEKKRPKAESFFQTKALDVSASDDEIARLKKPDQAIKVLVVNPRRPGRAALGLSVLPSHTVPVRPGEALAFRKQS

SEQ ID NO: 864293 - protein, 520 aa, Homo sapiens
MERQVLLSEPEEAAALYRGLSRQPALSAACLGPEVTTQYGGQYRTVHTEWTQRDLERMENIRFCRQYLVFHDGDSVVFAGPAGNSVETRGELLSRESPSGTMKAVLRKAGGTGPGEEKQFLEVWEKNRKLKSFNLSALEKHGPVYEDDCFGCLSWSHSETHLLYVAEKKRPKAESFFQTKALDVSASDDEIARLKKPDQAIKGDQFVFYEDWGENMVSKSIPVLCVLDVESGNISVLEGVPENVSPGQAFWAPGDAGVVFVGWWHEPFRLGIRFCTNRRSALYYVDLIGGKCELLSDDSLAVSSPRLSPDQCRIVYLQYPSLIPHHQCSQLCLYDWYTKVTSVVVDVVPRQLGENFSGIYCSLLPLGCWSADSQRVVFDSAQRSRQDLFAVDTQVGTVTSLTAGGSGGSWKLLTIDQDLMVAQFSTPSLPPTLKVGFLPSAGKEQSVLWVSLEEAEPIPDIHWGIRVLQPPPEQENVQYAGLDFEAILLQPGSPPDKTQVPMVVMPHASSPSQAMWATRM

SEQ ID NO: 864294 - protein, 757 aa, Homo sapiens
MERQVRARPAVPVVPAARAGPDPGVSPAQVLLSEPEEAAALYRGLSRQPALSAACLGPEVTTQYGGQYRTVHTEWTQRDLERMENIRFCRQYLVFHDGDSVVFAGPAGNSVETRGELLSRESPSGTMKAVLRKAGGTGPGEEKQFLEVWEKNRKLKSFNLSALEKHGPVYEDDCFGCLSWSHSETHLLYVAEKKRPKAESFFQTKALDVSASDDEIARLKKPDQAIKGDQFVFYEDWGENMVSKSIPVLCVLDVESGNISVLEGVPENVSPGQAFWAPGDAGVVFVGWWHEPFRLGIRFCTNRRSALYYVDLIGGKCELLSDDSLAVSSPRLSPDQCRIVYLQYPSLIPHHQCSQLCLYDWYTKVTSVVVDVVPRQLGENFSGIYCSLLPLGCWSADSQRVVFDSAQRSRQDLFAVDTQVGTVTSLTAGGSGGSWKLLTIDQDLMVAQFSTPSLPPTLKVGFLPSAGKEQSVLWVSLEEAEPIPDIHWGIRVLQPPPEQENVQYAGLDFEAILLQPGSPPDKTQVPMVVMPHGGPHSSFVTAWMLFPAMLCKMGFAVLLVNYRGSTGFGQDSILSLPGNVGHQDVKDVQFAVEQVLQEEHFDASHVALMGGSHGGFISCHLIGQYPETYRACVARNPVINIASMLGSTDIPDWCVVEAGFPFSSDCLPDLSVWAEMLDKSPIRYIPQVKTPLLLMLGQEDRRVPFKQGMEYYRALKTRNVPVRLLLYPKSTHALSEVEVESDSFMNAVLWLRTHLGS

SEQ ID NO: 864295 - protein, 729 aa, Homo sapiens
MVLLSEPEEAAALYRGLSRQPALSAACLGPEVTTQYGGQYRTVHTEWTQRDLERMENIRFCRQYLVFHDGDSVVFAGPAGNSVETRGELLSRESPSGTMKAVLRKAGGTGPGEEKQFLEVWEKNRKLKSFNLSALEKHGPVYEDDCFGCLSWSHSETHLLYVAEKKRPKAESFFQTKALDVSASDDEIARLKKPDQAIKGDQFVFYEDWGENMVSKSIPVLCVLDVESGNISVLEGVPENVSPGQAFWAPGDAGVVFVGWWHEPFRLGIRFCTNRRSALYYVDLIGGKCELLSDDSLAVSSPRLSPDQCRIVYLQYPSLIPHHQCSQLCLYDWYTKVTSVVVDVVPRQLGENFSGIYCSLLPLGCWSADSQRVVFDSAQRSRQDLFAVDTQVGTVTSLTAGGSGGSWKLLTIDQDLMVAQFSTPSLPPTLKVGFLPSAGKEQSVLWVSLEEAEPIPDIHWGIRVLQPPPEQENVQYAGLDFEAILLQPGSPPDKTQVPMVVMPHGGPHSSFVTAWMLFPAMLCKMGFAVLLVNYRGSTGFGQDSILSLPGNVGHQDVKDVQFAVEQVLQEEHFDASHVALMGGSHGGFISCHLIGQYPETYRACVARNPVINIASMLGSTDIPDWCVVEAGFPFSSDCLPDLSVWAEMLDKSPIRYIPQVKTPLLLMLGQEDRRVPFKQGMEYYRALKTRNVPVRLLLYPKSTHALSEVEVESDSFMNAVLWLRTHLGS

SEQ ID NO: 864296 - protein, 631 aa, Homo sapiens
MKAVLRKAGGTGPGEEKQFLEVWEKNRKLKSFNLSALEKHGPVYEDDCFGCLSWSHSETHLLYVAEKKRPKAESFFQTKALDVSASDDEIARLKKPDQAIKGDQFVFYEDWGENMVSKSIPVLCVLDVESGNISVLEGVPENVSPGQAFWAPGDAGVVFVGWWHEPFRLGIRFCTNRRSALYYVDLIGGKCELLSDDSLAVSSPRLSPDQCRIVYLQYPSLIPHHQCSQLCLYDWYTKVTSVVVDVVPRQLGENFSGIYCSLLPLGCWSADSQRVVFDSAQRSRQDLFAVDTQVGTVTSLTAGGSGGSWKLLTIDQDLMVAQFSTPSLPPTLKVGFLPSAGKEQSVLWVSLEEAEPIPDIHWGIRVLQPPPEQENVQYAGLDFEAILLQPGSPPDKTQVPMVVMPHGGPHSSFVTAWMLFPAMLCKMGFAVLLVNYRGSTGFGQDSILSLPGNVGHQDVKDVQFAVEQVLQEEHFDASHVALMGGSHGGFISCHLIGQYPETYRACVARNPVINIASMLGSTDIPDWCVVEAGFPFSSDCLPDLSVWAEMLDKSPIRYIPQVKTPLLLMLGQEDRRVPFKQGMEYYRALKTRNVPVRLLLYPKSTHALSEVEVESDSFMNAVLWLRTHLGS

SEQ ID NO: 864297 - protein, 640 aa, Homo sapiens
TRPSSPKGTMKAVLRKAGGTGPGEEKQFLEVWEKNRKLKSFNLSALEKHGPVYEDDCFGCLSWSHSETHLLYVAEKKRPKAESFFQTKALDVSASDDEIARLKKPDQAIKGDQFVFYEDWGENMVSKSIPVLCVLDVESGNISVLEGVPENVSPGQAFWAPGDAGVVFVGWWHEPFRLGIRFCTNRRSALYYVDLIGGKCELLSDDSLAVSSPRLSPDQCRIVYLQYPSLIPHHQCSQLCLYDWYTKVTSVVVDVVPRQLGENFSGIYCSLLPLGCWSADSQRVVFDSAQRSRQDLFAVDTQVGTVTSLTAGGSGGSWKLLTIDQDLMVAQFSTPSLPPTLKVGFLPSAGKEQSVLWVSLEEAEPIPDIHWGIRVLQPPPEQENVQYAGLDFEAILLQPGSPPDKTQVPMVVMPHGGPHSSFVTAWMLFPAMLCKMGFAVLLVNYRGSTGFGQDSILSLPGNVGHQDVKDVQFAVEQVLQEEHFDASHVALMGGSHGGFISCHLIGQYPETYRACVARNPVINIASMLGSTDIPDWCVVEAGFPFSSDCLPDLSVWAEMLDKSPIRYIPQVKTPLLLMLGQEDRRVPFKQGMEYYRALKTRNVPVRLLLYPKSTHALSEVEVESDSFMNAVLWLRTHLGS

SEQ ID NO: 864298 - protein, 686 aa, Homo sapiens
MERQVLLSEPEEAAALYRGLSRQPALSAACLGPEVTTQYGGQYRTVHTEWTQRDLERMENIRFCRQYLVFHDGDSVVFAGPAGNSVETRGELLSRESPSGTMKAVLRKAGGTGPGEEKQFLEVWEKNRKLKSFNLSALEKHGPVYEDDCFGCLSWSHSETHLLYVAEKKRPKAESFFQTKALDVSASDDEIARLKKPDQAIKAFWAPGDAGVVFVGWWHEPFRLGIRFCTNRRSALYYVDLIGGKCELLSDDSLAVSSPRLSPDQCRIVYLQYPSLIPHHQCSQLCLYDWYTKVTSVVVDVVPRQLGENFSGIYCSLLPLGCWSADSQRVVFDSAQRSRQDLFAVDTQVGTVTSLTAGGSGGSWKLLTIDQDLMVAQFSTPSLPPTLKVGFLPSAGKEQSVLWVSLEEAEPIPDIHWGIRVLQPPPEQENVQYAGLDFEAILLQPGSPPDKTQVPMVVMPHGGPHSSFVTAWMLFPAMLCKMGFAVLLVNYRGSTGFGQDSILSLPGNVGHQDVKDVQFAVEQVLQEEHFDASHVALMGGSHGGFISCHLIGQYPETYRACVARNPVINIASMLGSTDIPDWCVVEAGFPFSSDCLPDLSVWAEMLDKSPIRYIPQVKTPLLLMLGQEDRRVPFKQGMEYYRALKTRNVPVRLLLYPKSTHALSEVEVESDSFMNAVLWLRTHLGS

SEQ ID NO: 864299 - protein, 744 aa, Homo sapiens
MERQVLLSEPEEAAALYRGLSRQPALSAACLGPEVTTQYGGQYRTVHTEWTQRDLERMENIRFCRQYLVFHDGDSVVFAGPAGNSVETRGELLSRESPSGTMKAVLRKAGGTGPGEEKQFLEVWEKNRKLKSFNLSALEKHGPVYEDDCFGCLSWSHSETHLLYVAEKKRPKAESFFQTKALDVSASDDEIARLKKPDQAIKGDQFVFYEDWGENMVSKSIPVLCVLDVESGNISVLEGVPENVSPGQAFWAPGDAGVVFVGWWHEPFRLGIRFCTNRRSALYYVDLIGGKCELLSDDSLAVSSPRLSPDQCRIVYLQYPSLIPHHQCSQLCLYDWYTKVTSVVVDVVPRQLGENFSGIYCSLLPLGCWSADSQRVVFDSAQRSRQDLFAVDTQVGTVTSLTAGGSGGSWKLLTIDQDLMVAQFSTPSLPPTLKVGFLPSAGKEQSVLWVSLEEAEPIPDIHWGIRVLQPPPEQENVQYAGLDFEAILLQPGSPPDKTQVPMVVMPHGGPHSSFVTAWMLFPAMLCKMGFAVLLVNYRGSTGFGQDSILSLPGNVGHQDVKDVQFAVEQVLQEEHFDASHVALMGGSHGGFISCHLIGQYPETYRACVARNPVINIASMLGSTDIPDWCVVEAGFPFSSDCLPDLSVWAEMLDKSPIRYIPQVKTPLLLMLGQEDRRVPFKQGMEYYRALKTRNVPVRHMASRLGLTQSHDLVNPVHKHRDTREDSWPAGPCAYSVGDYNSFQD

SEQ ID NO: 864300 - protein, 757 aa, Homo sapiens; identical to SEQ ID NO: 864294

SEQ ID NO: 864301 - protein, 491 aa, Homo sapiens
MGLFMRMAFWAPGDAGVVFVGWWHEPFRLGIRFCTNRRSALYYVDLIGGKCELLSDDSLAVSSPRLSPDQCRIVYLQYPSLIPHHQCSQLCLYDWYTKVTSVVVDVVPRQLGENFSGIYCSLLPLGCWSADSQRVVFDSAQRSRQDLFAVDTQVGTVTSLTAGGSGGSWKLLTIDQDLMVAQFSTPSLPPTLKVGFLPSAGKEQSVLWVSLEEAEPIPDIHWGIRVLQPPPEQENVQYAGLDFEAILLQPGSPPDKTQVPMVVMPHGGPHSSFVTAWMLFPAMLCKMGFAVLLVNYRGSTGFGQDSILSLPGNVGHQDVKDVQFAVEQVLQEEHFDASHVALMGGSHGGFISCHLIGQYPETYRACVARNPVINIASMLGSTDIPDWCVVEAGFPFSSDCLPDLSVWAEMLDKSPIRYIPQVKTPLLLMLGQEDRRVPFKQGMEYYRALKTRNVPVRLLLYPKSTHALSEVEVESDSFMNAVLWLRTHLGS

SEQ ID NO: 864302 - protein, 423 aa, Homo sapiens
MTGTQWCLQDPSLIPHHQCSQLCLYDWYTKVTSVVVDVVPRQLGENFSGIYCSLLPLGCWSADSQRVVFDSAQRSRQDLFAVDTQVGTVTSLTAGGSGGSWKLLTIDQDLMVAQFSTPSLPPTLKVGFLPSAGKEQSVLWVSLEEAEPIPDIHWGIRVLQPPPEQENVQYAGLDFEAILLQPGSPPDKTQVPMVVMPHGGPHSSFVTAWMLFPAMLCKMGFAVLLVNYRGSTGFGQDSILSLPGNVGHQDVKDVQFAVEQVLQEEHFDASHVALMGGSHGGFISCHLIGQYPETYRACVARNPVINIASMLGSTDIPDWCVVEAGFPFSSDCLPDLSVWAEMLDKSPIRYIPQVKTPLLLMLGQEDRRVPFKQGMEYYRALKTRNVPVRLLLYPKSTHALSEVEVESDSFMNAVLWLRTHLGS

SEQ ID NO: 864303 - protein, 295 aa, Homo sapiens
SACSWYTVRAELVEVDVDVDQQVTKWGIRVLQPPPEQENVQYAGLDFEAILLQPGSPPDKTQVPMVVMPHGGPHSSFVTAWMLFPAMLCKMGFAVLLVNYRGSTGFGQDSILSLPGNVGHQDVKDVQFAVEQVLQEEHFDASHVALMGGSHGGFISCHLIGQYPETYRACVARNPVINIASMLGSTDIPDWCVVEAGFPFSSDCLPDLSVWAEMLDKSPIRYIPQVKTPLLLMLGQEDRRVPFKQGMEYYRALKTRNVPVRLLLYPKSTHALSEVEVESDSFMNAVLWLRTHLGS

SEQ ID NO: 864304 - protein, 435 aa, Homo sapiens
MERQVLLSEPEEAAALYRGLSRQPALSAACLGPEVTTQYGGQYRTVHTEWTQRDLERMENIRFCRQYLVFHDGDSVVFAGPAGNSVETRGELLSRESPSGTMKAVLRKAGGTGPGEEKQFLEVWEKNRKLKSFNLSALEKHGPVYEDDCFGCLSWSHSETHLLYVAEKKRPKAESFFQTKALDVSASDDEIARLKKPDQAIKGDQFVFYEDWGENMVSKSIPVLCVLDVESGNISVLEGVPENVSPGQAFWAPGDAGVVFVGWWHEPFRLGIRFCTNRRSALYYVDLIGGKCELLSDDSLAVSSPRLSPDQCRIVYLQYPSLIPHHQCSQLCLYDWYTKVTSVVVDVVPRQLGENFSGIYCSLLPLGCWSADSQRVVFDSAQRSRQGPVLLVGQPKWALVTSLHKLEGSQVGTGNCHTLAQNSWGPDYTTQLLKP

SEQ ID NO: 864305 - protein, 265 aa, Homo sapiens
MVELVCIGRGSYAGLDFEAILLQPGSPPDKTQVPMVVMPHGGPHSSFVTAWMLFPAMLCKMGFAVLLVNYRGSTGFGQDSILSLPGNVGHQDVKDVQFAVEQVLQEEHFDASHVALMGGSHGGFISCHLIGQYPETYRACVARNPVINIASMLGSTDIPDWCVVEAGFPFSSDCLPDLSVWAEMLDKSPIRYIPQVKTPLLLMLGQEDRRVPFKQGMEYYRALKTRNVPVRLLLYPKSTHALSEVEVESDSFMNAVLWLRTHLGS

SEQ ID NO: 864306 - protein, 149 aa, Homo sapiens
MGGSHGGFISCHLIGQYPETYRACVARNPVINIASMLGSTDIPDWCVVEAGFPFSSDCLPDLSVWAEMLDKSPIRYIPQVKTPLLLMLGQEDRRVPFKQGMEYYRALKTRNVPVRLLLYPKSTHALSEVEVESDSFMNAVLWLRTHLGS

SEQ ID NO: 864307 - protein, 142 aa, Homo sapiens
YKPNRGWWEPRLTVRVVEFGQERRAGGEAHRGTVEPCGLVDQTPGGVSLFHWQLCDVWAEMLDKSPIRYIPQVKTPLLLMLGQEDRRVPFKQGMEYYRALKTRNVPVRLLLYPKSTHALSEVEVESDSFMNAVLWLRTHLGS

SEQ ID NO: 864308 - protein, 288 aa, Homo sapiens
MKAVLRKAGGTGPGEEKQFLEVWEKNRKLKSFNLSALEKHGPVYEDDCFGCLSWSHSETHLLYVAEKKRPKAESFFQTKALDVSASDDEIARLKKPDQAIKAFWAPGDAGVVFVGWWHEPFRLGIRFCTNRRSALYYVDLIGGKCELLSDDSLAVSSPRLSPDQCRIVYLQYPSLIPHHQCSQLCLYDWYTKVTSVVVDVVPRQLGENFSGIYCSLLPLGCWSADSQRVVFDSAQRSRQGPVLLVGQPKWALVTSLHKLEGSQVGTGNCHTLAQNSWGPDYTTQLLKP

SEQ ID NO: 864309 - protein, 156 aa, Homo sapiens
GTRLNPFSRRPFYPPRSRAPGFRFHRAAPSPPRSNASPLGKRPRTQPTAPPPTWLVRPWRDPCSHPPRTSRSQAGSSHRQGPPPANGPHPLAEGPAPHRLPQGRGGDSPGRPRLRPRKPHFRARARPASPRRQRGDYGTSGAAERARGGGGSVSGP

SEQ ID NO: 864310 - protein, 175 aa, Homo sapiens
RPNHLWLEDPGPKKIGLIQASVTTPHPECCCCRMGFPDEGRRSMSLLGSMCHGVDYLGQVSDPEVSPTPAARDGALVGEAPRLTLLTAALSLQPGLDFEAILLQPGSPPDKTQVPMVVMPHEASGVKSPCPPSPLPSWPFHPPLPVCRGAPFILCHCLDAVPSHALQDGLCGTTR

SEQ ID NO: 864311 - protein, 732 aa, Homo sapiens; identical to SEQ ID NO: 864291

SEQ ID NO: 864312 - protein, 732 aa, Homo sapiens; identical to SEQ ID NO: 864291

SEQ ID NO: 864313 - protein, 740 aa, Homo sapiens
MSLDEIGRGERQVLLSEPEEAAALYRGLSRQPALSAACLGPEVTTQYGGQYRTVHTEWTQRDLERMENIRFCRQYLVFHDGDSVVFAGPAGNSVETRGELLSRESPSGTMKAVLRKAGGTGPGEEKQFLEVWEKNRKLKSFNLSALEKHGPVYEDDCFGCLSWSHSETHLLYVAEKKRPKAESFFQTKALDVSASDDEIARLKKPDQAIKGDQFVFYEDWGENMVSKSIPVLCVLDVESGNISVLEGVPENVSPGQAFWAPGDAGVVFVGWWHEPFRLGIRFCTNRRSALYYVDLIGGKCELLSDDSLAVSSPRLSPDQCRIVYLQYPSLIPHHQCSQLCLYDWYTKVTSVVVDVVPRQLGENFSGIYCSLLPLGCWSADSQRVVFDSAQRSRQDLFAVDTQVGTVTSLTAGGSGGSWKLLTIDQDLMVAQFSTPSLPPTLKVGFLPSAGKEQSVLWVSLEEAEPIPDIHWGIRVLQPPPEQENVQYAGLDFEAILLQPGSPPDKTQVPMVVMPHGGPHSSFVTAWMLFPAMLCKMGFAVLLVNYRGSTGFGQDSILSLPGNVGHQDVKDVQFAVEQVLQEEHFDASHVALMGGSHGGFISCHLIGQYPETYRACVARNPVINIASMLGSTDIPDWCVVEAGFPFSSDCLPDLSVWAEMLDKSPIRYIPQVKTPLLLMLGQEDRRVPFKQGMEYYRALKTRNVPVRLLLYPKSTHALSEVEVESDSFMNAVLWLRTHLGS

SEQ ID NO: 864314 - protein, 732 aa, Homo sapiens; identical to SEQ ID NO: 864291

SEQ ID NO: 864315 - protein, 723 aa, Homo sapiens
GTRLNPFSRRPFYPPRSRAPGFRFHRAAPSPPRSNASPLEWTQRDLERMENIRFCRQYLVFHDGDSVVFAGPAGNSVETRGELLSRESPSGTMKAVLRKAGGTGPGEEKQFLEVWEKNRKLKSFNLSALEKHGPVYEDDCFGCLSWSHSETHLLYVAEKKRPKAESFFQTKALDVSASDDEIARLKKPDQAIKGDQFVFYEDWGENMVSKSIPVLCVLDVESGNISVLEGVPENVSPGQAFWAPGDAGVVFVGWWHEPFRLGIRFCTNRRSALYYVDLIGGKCELLSDDSLAVSSPRLSPDQCRIVYLQYPSLIPHHQCSQLCLYDWYTKVTSVVVDVVPRQLGENFSGIYCSLLPLGCWSADSQRVVFDSAQRSRQDLFAVDTQVGTVTSLTAGGSGGSWKLLTIDQDLMVAQFSTPSLPPTLKVGFLPSAGKEQSVLWVSLEEAEPIPDIHWGIRVLQPPPEQENVQYAGLDFEAILLQPGSPPDKTQVPMVVMPHGGPHSSFVTAWMLFPAMLCKMGFAVLLVNYRGSTGFGQDSILSLPGNVGHQDVKDVQFAVEQVLQEEHFDASHVALMGGSHGGFISCHLIGQYPETYRACVARNPVINIASMLGSTDIPDWCVVEAGFPFSSDCLPDLSVWAEMLDKSPIRYIPQVKTPLLLMLGQEDRRVPFKQGMEYYRALKTRNVPVRLLLYPKSTHALSEVEVESDSFMNAVLWLRTHLGS

SEQ ID NO: 864316 - protein, 682 aa, Homo sapiens
AQAPPPEASLPGASPRRRRLCIGDSVVFAGPAGNSVETRGELLSRESPSGTMKAVLRKAGGTGPGEEKQFLEVWEKNRKLKSFNLSALEKHGPVYEDDCFGCLSWSHSETHLLYVAEKKRPKAESFFQTKALDVSASDDEIARLKKPDQAIKGDQFVFYEDWGENMVSKSIPVLCVLDVESGNISVLEGVPENVSPGQAFWAPGDAGVVFVGWWHEPFRLGIRFCTNRRSALYYVDLIGGKCELLSDDSLAVSSPRLSPDQCRIVYLQYPSLIPHHQCSQLCLYDWYTKVTSVVVDVVPRQLGENFSGIYCSLLPLGCWSADSQRVVFDSAQRSRQDLFAVDTQVGTVTSLTAGGSGGSWKLLTIDQDLMVAQFSTPSLPPTLKVGFLPSAGKEQSVLWVSLEEAEPIPDIHWGIRVLQPPPEQENVQYAGLDFEAILLQPGSPPDKTQVPMVVMPHGGPHSSFVTAWMLFPAMLCKMGFAVLLVNYRGSTGFGQDSILSLPGNVGHQDVKDVQFAVEQVLQEEHFDASHVALMGGSHGGFISCHLIGQYPETYRACVARNPVINIASMLGSTDIPDWCVVEAGFPFSSDCLPDLSVWAEMLDKSPIRYIPQVKTPLLLMLGQEDRRVPFKQGMEYYRALKTRNVPVRLLLYPKSTHALSEVEVESDSFMNAVLWLRTHLGS

SEQ ID NO: 864317 - protein, 667 aa, Homo sapiens
MSSHKGSVVAQGNGAPAGNSVETRGELLSRESPSGTMKAVLRKAGGTGPGEEKQFLEVWEKNRKLKSFNLSALEKHGPVYEDDCFGCLSWSHSETHLLYVAEKKRPKAESFFQTKALDVSASDDEIARLKKPDQAIKGDQFVFYEDWGENMVSKSIPVLCVLDVESGNISVLEGVPENVSPGQAFWAPGDAGVVFVGWWHEPFRLGIRFCTNRRSALYYVDLIGGKCELLSDDSLAVSSPRLSPDQCRIVYLQYPSLIPHHQCSQLCLYDWYTKVTSVVVDVVPRQLGENFSGIYCSLLPLGCWSADSQRVVFDSAQRSRQDLFAVDTQVGTVTSLTAGGSGGSWKLLTIDQDLMVAQFSTPSLPPTLKVGFLPSAGKEQSVLWVSLEEAEPIPDIHWGIRVLQPPPEQENVQYAGLDFEAILLQPGSPPDKTQVPMVVMPHGGPHSSFVTAWMLFPAMLCKMGFAVLLVNYRGSTGFGQDSILSLPGNVGHQDVKDVQFAVEQVLQEEHFDASHVALMGGSHGGFISCHLIGQYPETYRACVARNPVINIASMLGSTDIPDWCVVEAGFPFSSDCLPDLSVWAEMLDKSPIRYIPQVKTPLLLMLGQEDRRVPFKQGMEYYRALKTRNVPVRLLLYPKSTHALSEVEVESDSFMNAVLWLRTHLGS

SEQ ID NO: 864318 - protein, 537 aa, Homo sapiens
MGLFMRMGDQFVFYEDWGENMVSKSIPVLCVLDVESGNISVLEGVPENVSPGQAFWAPGDAGVVFVGWWHEPFRLGIRFCTNRRSALYYVDLIGGKCELLSDDSLAVSSPRLSPDQCRIVYLQYPSLIPHHQCSQLCLYDWYTKVTSVVVDVVPRQLGENFSGIYCSLLPLGCWSADSQRVVFDSAQRSRQDLFAVDTQVGTVTSLTAGGSGGSWKLLTIDQDLMVAQFSTPSLPPTLKVGFLPSAGKEQSVLWVSLEEAEPIPDIHWGIRVLQPPPEQENVQYAGLDFEAILLQPGSPPDKTQVPMVVMPHGGPHSSFVTAWMLFPAMLCKMGFAVLLVNYRGSTGFGQDSILSLPGNVGHQDVKDVQFAVEQVLQEEHFDASHVALMGGSHGGFISCHLIGQYPETYRACVARNPVINIASMLGSTDIPDWCVVEAGFPFSSDCLPDLSVWAEMLDKSPIRYIPQVKTPLLLMLGQEDRRVPFKQGMEYYRALKTRNVPVRLLLYPKSTHALSEVEVESDSFMNAVLWLRTHLGS

SEQ ID NO: 864319 - protein, 698 aa, Homo sapiens
MERQVLLSEPEEAAALYRGLSRQPALSAACLGPEVTTQYGGQYRTVHTEWTQRDLERMENIRFCRQYLVFHDGDSVVFAGPAGNSVETRGELLSRESPSGTMKAVLRKAGGTGPGEEKQFLEVWEKNRKLKSFNLSALEKHGPVYEDDCFGCLSWSHSETHLLYVAEKKRPKAESFFQTKALDVSASDDEIARLKKPDQAIKGDQFVFYEDWGENMVSKSIPVLCVLDVESGNISVLEGVPENVSPGQAFWAPGDAGVVFVGWWHEPFRLGIRFCTNRRSALYYVDLIGGKCELLSDDSLAVSSPRLSPDQCRIVYLQYPSLIPHHQCSQLCLYDWYTKVTSVVVDVVPRQLGENFSGIYCSLLPLGCWSADSQRVVFDSAQRSRQDLFAVDTQVGTVTSLTAGGSGGSWKLLTIDQDLMVAQFSTPSLPPTLKVGFLPSAGKEQSVLWVSLEEAEPIPDIHWGIRVLQPPPEQENVQYAGLDFEAILLQPGSPPDKTQVPMVVMPHGGPHSSFVTAWMLFPAMLCKMGFAVLLVNYRGSTGFGQDSILSLPGNVGHQDVKDVQFAVEQVLQEEHFDASHVALMGGSHGGFISCHLIGQYPETYRACVARNPVINIASMLGSTDIPDWCVVEAGFPFSSDCLPDLSVWAEMLDKSPIRYIPQVKTPLLLMLGQEDRRVPFKQGMEYYRALKTRNVPVR

SEQ ID NO: 864320 - protein, 712 aa, Homo sapiens
MERQVLLSEPEEAAALYRGLSRQPALSAACLGPEVTTQYGGQYRTVHTEWTQRDLERMENIRFCRQYLVFHDGDSVVFAGPAGNSVETRGELLSRESPSGTMKAVLRKAGGTGPGEEKQFLEVWEKNRKLKSFNLSALEKHGPVYEDDCFGCLSWSHSETHLLYVAEKKRPKAESFFQTKALDVSASDDEIARLKKPDQAIKGDQFVFYEDWGENMVSKSIPVLCVLDVESGNISVLEGVPENVSPGQAFWAPGDAGVVFVGWWHEPFRLGIRFCTNRRSALYYVDLIGGKCELLSDDSLAVSSPRLSPDQCRIVYLQYPSLIPHHQCSQLCLYDWYTKVTSVVVDVVPRQLGENFSGIYCSLLPLGCWSADSQRVVFDSAQRSRQDLFAVDTQVGTVTSLTAGGSGGSWKLLTIDQDLMVAQFSTPSLPPTLKVGFLPSAGKEQSVLWVSLEEAEPIPDIHWGIRVLQPPPEQENVQYAGLDFEAILLQPGSPPDKTQVPMVVMPHGGPHSSFVTAWMLFPAMLCKMGFAVLLVNYRGSTGFGQDSILSLPGNVGHQDVKDVQFAVEQVLQEEHFDASHVALMGGSHGGFISCHLIGQYPETYRACVARNPVINIASMLGSTDIPDWCVVEAGFPFSSDCLPDLSVWAEMLDKSPIRYIPQVKTPLLLMLGQEDRRVPFKQGMEYYRALKSEVWHRLISSCRMAGLQLPST

SEQ ID NO: 864321 - protein, 574 aa, Homo sapiens
SRKVEARVFGVWEKNRKLKSFNLSALEKHGPVYEDDCFGCLSWSHSETHLLYVAEKKRPKAESFFQTKALDVSASDDEIARLKKPDQAIKAFWAPGDAGVVFVGWWHEPFRLGIRFCTNRRSALYYVDLIGGKCELLSDDSLAVSSPRLSPDQCRIVYLQYPSLIPHHQCSQLCLYDWYTKVTSVVVDVVPRQLGENFSGIYCSLLPLGCWSADSQRVVFDSAQRSRQDLFAVDTQVGTVTSLTAGGSGGSWKLLTIDQDLMVAQFSTPSLPPTLKVGFLPSAGKEQSVLWVSLEEAEPIPDIHWGIRVLQPPPEQENVQYAGLDFEAILLQPGSPPDKTQVPMVVMPHGGPHSSFVTAWMLFPAMLCKMGFAVLLVNYRGSTGFGQDSILSLPGNVGHQDVKDVQFAVEQVLQEEHFDASHVALMGGSHGGFISCHLIGQYPETYRACVARNPVINIASMLGSTDIPDWCVVEAGFPFSSDCLPDLSVWAEMLDKSPIRYIPQVKTPLLLMLGQEDRRVPFKQGMEYYRALKTRNVPVRLLLYPKSTHALSEVEVESDSFMNAVLWLRTHLGS

SEQ ID NO: 864322 - protein, 503 aa, Homo sapiens
MERQVLLSEPEEAAALYRGLSRQPALSAACLGPEVTTQYGGQYRTVHTEWTQRDLERMENIRFCRQYLVFHDGDSVVFAGPAGNSVETRGELLSRESPSGTMKAVLRKAGGTGPGEEKQFLEVWEKNRKLKSFNLSALEKHGPVYEDDCFGCLSWSHSETHLLYVAEKKRPKAESFFQTKALDVSASDDEIARLKKPDQAIKGDQFVFYEDWGENMVSKSIPVLCVLDVESGNISVLEGVPENVSPGQAFWAPGDAGVVFVGWWHEPFRLGIRFCTNRRSALYYVDLIGGKCELLSDDSLAVSSPRLSPDQCRIVYLQYPSLIPHHQCSQLCLYDWYTKVTSVVVDVVPRQLGENFSGIYCSLLPLGCWSADSQRVVFDSAQRSRQDLFAVDTQVGTVTSLTAGGSGGSWKLLTIDQDLMVAQFSTPSLPPTLKVGFLPSAGKEQSVLWVSLEEAEPIPDIHWGIRVLQPPPEQENVQYVRQLHECCALATHTLGQLKPCHSA

SEQ ID NO: 864323 - protein, 436 aa, Homo sapiens
MERQVLLSEPEEAAALYRGLSRQPALSAACLGPEVTTQYGGQYRTVHTEWTQRDLERMENIRFCRQYLVFHDGDSVVFAGPAGNSVETRGELLSRESPSGTMKAVLRKAGGTGPGEEKQFLEVWEKNRKLKSFNLSALEKHGPVYEDDCFGCLSWSHSETHLLYVAEKKRPKAESFFQTKALDVSASDDEIARLKKPDQAIKGDQFVFYEDWGENMVSKSIPVLCVLDVESGNISVLEGVPENVSPGQAFWAPGDAGVVFVGWWHEPFRLGIRFCTNRRSALYYVDLIGGKCELLSDDSLAVSSPRLSPDQCRIVYLQYPSLIPHHQCSQLCLYDWYTKVTSVVVDVVPRQLGEELFWDPTAGFCLGDAWSVTGSRVGSDSVQTQPVRTCWLWTPTWALGPGQTVRASCTGSCHHLAGPLGSKFHTHLHQPRNGIT

SEQ ID NO: 864324 - protein, 275 aa, Homo sapiens
VASILQAAAGLLQSQGQHTAHSPGLDFEAILLQPGSPPDKTQVPMVVMPHGGPHSSFVTAWMLFPAMLCKMGFAVLLVNYRGSTGFGQDSILSLPGNVGHQDVKDVQFAVEQVLQEEHFDASHVALMGGSHGGFISCHLIGQYPETYRACVARNPVINIASMLGSTDIPDWCVVEAGFPFSSDCLPDLSVWAEMLDKSPIRYIPQVKTPLLLMLGQEDRRVPFKQGMEYYRALKTRNVPVRLLLYPKSTHALSEVEVESDSFMNAVLWLRTHLGS

SEQ ID NO: 864325 - protein, 323 aa, Homo sapiens
MERQVLLSEPEEAAALYRGLSRQPALSAACLGPEVTTQYGGQYRTVHTEWTQRDLERMENIRFCRQYLVFHDGDSVVFAGPAGNSVETRGELLSRESPSGTMKAVLRKAGGTGPGEEKQFLEVWEKNRKLKSFNLSALEKHGPVYEDDCFGCLSWSHSETHLLYVAEKKRPKAESFFQTKALDVSASDDEIARLKKPDQAIKGDQFVFYEDWGENMVSKSIPVLCVLDVESGNISVLEGVPENVSPGQAFWAPGDAGVVFVGWWHEPFRLGIRFCTNRRFSLYYVDLIGGSVSSSGVTPGGPLPVDPDMLLGTGGHFGPFMGV

SEQ ID NO: 864326 - protein, 115 aa, Homo sapiens
SINRTGFHINCDLILNSEAPNPCLIRLCNTTNDQYEIRPLTDAQVCVVEAGFPFSSDCLPDLSVWAEMLDKSPIRYIPQVKTPLLLMLGQEDRRVPFKQGMEYYRALKTRNVPVR

SEQ ID NO: 864327 - protein, 127 aa, Homo sapiens
MERQVLLSEPEEAAALYRGLSRQPALSAACLGPEVTTQYGGQYRTVHTGVCAEGELEGMEYYRALKTRNVPVRLLLYPKSTHALSEVEVESDSFMNAGQIAHQIHPSGEDTTVTDVGQEDRLPFCMS

SEQ ID NO: 864328 - protein, 338 aa, Homo sapiens
MNSLSEANTKFMFDLFQQFRKSKENNIFYSPISITSALGMVLLGAKDNTAQQIKKVLHFDQVTENTTGKAATYHVDRSGNVHHQFQKLLTEFNKSTDAYELKIANKLFGEKTYLFLQEYLDAIKKFYQTSVESVDFANAPEESRKKINSWVESQTNEKIKNLIPEGNIGSNTTLVLVNAIYFKGQWEKKFNKEDTKEEKFWPNKLEEKLTAEKLMEWTSLQNMRETRVDLHLPRFKVEESYDLKDTLRTMGMVDIFNGDADLSGMTGSRGLVLSGVLHKAFVEVTEEGAEAAAATAVVGFGSSPTSTNEEFHCNHPFLFFIRQNKTNSILFYGRFSSP

SEQ ID NO: 864329 - protein, 390 aa, Homo sapiens
MNSLSEANTKFMFDLFQQFRKSKENNIFYSPISITSALGMVLLGAKDNTAQQIKKVLHFDQVTENTTGKAATYHVDRSGNVHHQFQKLLTEFNKSTDAYELKIANKLFGEKTYLFLQEYLDAIKKFYQTSVESVDFANAPEESRKKINSWVESQTNEKIKNLIPEGNIGSNTTLVLVNAIYFKGQWEKKFNKEDTKEEKFWPNKNTYKSIQMMRQYTSFHFASLEDVQAKVLEIPYKGKDLSMIVLLPNEIDGLQKLEEKLTAEKLMEWTSLQNMRETRVDLHLPRFKVEESYDLKDTLRTMGMVDIFNGDADLSGMTGSRGLVLSGVLHKAFVEVTEEGAEAAAATAVVGFGSSPTSTNEEFHCNHPFLFFIRQNKTNSILFYGRFSSP

SEQ ID NO: 864330 - protein, 390 aa, Homo sapiens; identical to SEQ ID NO: 864329

SEQ ID NO: 864331 - protein, 96 aa, Homo sapiens
TLEDPLGSYNSAQQIKKVLHFDQVTENTTGKAATYHVDRSGNVHHQFQKLLTEFNKSTDAYELKIANKLFGEKTYLFLQEYLDAIKKFYQILRGPY

SEQ ID NO: 864332 - protein, 140 aa, Homo sapiens
MNSLSEANTKFMFDLFQQFRKSKENNIFYSPISITSALGMVLLGAKDNTAQQIKKVLHFDQVTENTTGKAATYHVDRSGNVHHQFQKLLTEFNKSTDAYELKIANKLFGEKTYLFLQKYLDASKKFYQTSVGSRMVISLS

SEQ ID NO: 864333 - protein, 176 aa, Homo sapiens
SRMLGKWFCSFVGGLELIVNLLKSDNKEVLASVCAAITNIAKDQENLAVITDHGVVPLLSKLANTNNNKLRHHLAEAISRCCMWGRNRVAFGEHKAVAPLVRYLKSNDTNVHRATAQALYQLSEDADNCITMHENGAVKLLLDMVGSPDQDLQEAAAGCISNIRRLALATEKARYT

SEQ ID NO: 864334 - protein, 176 aa, Homo sapiens; identical to SEQ ID NO: 864333

SEQ ID NO: 864335 - protein, 176 aa, Homo sapiens; identical to SEQ ID NO: 864333

SEQ ID NO: 864336 - protein, 254 aa, Homo sapiens
RPLAPASSPASRLAASPPCHPAALPPCRPAALPPCRPAAGGRCPWCSVAPATSRPPVRRERLGYNMLGMIKNSLFGSVETWPWQVLSKGDKEEVAYEERACEGGKFATVEVTDKPVDEALREAMPKVAKYAGGTNDKGIGMGMTVPISFAVFPNEDGSLQKKLKVWFRIPNQFQSDPPAPSDKSVKIEEREGITVYSMQFGGYAKEADYVAQATRLRAALEGTATYRGDIYFCTGYDPPMKPYGRRNEIWLLKT

SEQ ID NO: 864337 - protein, 73 aa, Homo sapiens
ISSMILTTIIKKKKPPRQFGGYAKEADYVAQATRLRAALEGTATYRGDIYFCTGYDPPMKPYGRRNEIWLLKT

SEQ ID NO: 864338 - protein, 254 aa, Homo sapiens; identical to SEQ ID NO: 864336

SEQ ID NO: 864339 - protein, 254 aa, Homo sapiens; identical to SEQ ID NO: 864336

SEQ ID NO: 864340 - protein, 254 aa, Homo sapiens; identical to SEQ ID NO: 864336

SEQ ID NO: 864341 - protein, 254 aa, Homo sapiens; identical to SEQ ID NO: 864336

SEQ ID NO: 864342 - protein, 254 aa, Homo sapiens; identical to SEQ ID NO: 864336

SEQ ID NO: 864343 - protein, 254 aa, Homo sapiens; identical to SEQ ID NO: 864336

SEQ ID NO: 864344 - protein, 74 aa, Homo sapiens
GSQMCDRKNNNHNNISGQYKLSYAFEADYVAQATRLRAALEGTATYRGDIYFCTGYDPPMKPYGRRNEIWLLKT

SEQ ID NO: 864345 - protein, 198 aa, Homo sapiens
RPLAPASSPASRLAASPPCHPAALPPCRPAALPPCRPAAGGRCPWCSVAPATSRPPVRRERLGYNMLGMIKNSLFGSVETWPWQVLSKGDKEEVAYEERACEGGKFATVEVTDKPVDEALREAMPKVAKYAGGTNDKGIGMGMTVPISFAVFPNEDGSLQKKLKVWFRIPNQFQSDPPAPSDKSVKIEEREGITVYSI

SEQ ID NO: 864346 - protein, 342 aa, Homo sapiens
MTCPRNVTPNSYAEPLAAPGGGERYSRSAGMYMQSGSDFNCGVMRGCGLAPSLSKRDEGSSPSLALNTYPSYLSQLDSWGDPKAAYRLEQPVGRPLSSCSYPPSVKEENVCCMYSAEKRAKSGPEAALYSHPLPESCLGEHEVPVPSYYRASPSYSALDKTPHCSGANDFEAPFEQRASLNPRAEHLESPQLGGKVSFPETPKSDSQTPSPNEIKTEQSLAGPKGSPSESEKERAKAADSSPDTSDNEAKEEIKAENTTGNWLTAKSGRKKRCPYTKHQTLELEKEFLFNMYLTRERRLEISKTINLTDRQVKIWFQNRRMKLKKMNRENRIRELTSNFNFT

SEQ ID NO: 864347 - protein, 112 aa, Homo sapiens
LAFDQRPLSSRLVARHLAGEEEIKAENTTGNWLTAKSGRKKRCPYTKHQTLELEKEFLFNMYLTRERRLEISKTINLTDRQVKIWFQNRRMKLKKMNRENRIRELTSNFNFT

SEQ ID NO: 864348 - protein, 152 aa, Homo sapiens
LPGACWLWFAFSMLVSWGADVPQLRSGACKKPKMAILGQGLGKAGEMGGVLFTAFSQLKIVSCETRFVVCGSDLCVRLGLLRLLARPGALGSEAGAGRGGGEGLPATSLPPPDAWLGWRWNRAFGMLGDKGRKHHRKLADSKERKEEEVPLY

SEQ ID NO: 864349 - protein, 116 aa, Homo sapiens
SQARAGCGLLSQCWCPGELTSPSSEEIKAENTTGNWLTAKSGRKKRCPYTKHQTLELEKEFLFNMYLTRERRLEISKTINLTDRQVKIWFQNRRMKLKKMNRENRIRELTSNFNFT

SEQ ID NO: 864350 - protein, 290 aa, Homo sapiens
MEVSLNHPASNTTSTKNNNSAFFYFESCQPPSPALLLLCIAYTVVLIVGLFGNLSLIIIIFKKQRKAQNFTSILIANLSLSDTLVCVMCIHFTIIYTLMDHWIFGDTMCRLTSYVQSVSISVSIFSLVFTAVERYQLIVNPRGWKPSVTHAYWGITLIWLFSLLLSIPFFLSYHLTDEPFRNLSLPTDLYTHQVACVENWPSKKDRLLFTTSLFLLQYFVPLGFILICYLKIVICLRRRNAKVDKKKENEGRLNENKRINTMLISIVVTFGACWLPRISSMSSLTGIMRC

SEQ ID NO: 864351 - protein, 290 aa, Homo sapiens; identical to SEQ ID NO: 864350

SEQ ID NO: 864352 - protein, 718 aa, Homo sapiens
AGLGNRLLVGGWGGKMAELMLLSEIADPTRFFTDNLLSPEDWGLQNSTLYSGLDEVAEEQTQLFRCPEQDVPFDGSSLDVGMDVSPSEPPWELLPIFPDLQVKSEPSSPCSSSSLSSESSRLSTEPSSEALGVGEVLHVKTESLAPPLCLLGDDPTSSFETVQINVIPTSDDSSDVQTKIEPVSPCSSVNSEASLLSADSSSQAFIGEEVLEVKTESLSPSGCLLWDVPAPSLGAVQISMGPSLDGSSGKALPTRKPPLQPKPVVLTTVPMPSRAVPPSTTVLLQSLVQPPPVSPVVLIQGAIRVQPEGPAPSLPRPERKSIVPAPMPGNSCPPEVDAKLLKRQQRMIKNRESACQSRRKKKEYLQGLEARLQAVLADNQQLRRENAALRRRLEALLAENSELKLGSGNRKVVCIMVFLLFIAFNFGPVSISEPPSAPISPRMNKGEPQPRRHLLGFSEQEPVQGVEPLQGSSQGPKEPQPSPTDQPSFSNLTAFPGGAKELLLRDLDQLFLSSDCRHFNRTESLRLADELSGWVQRHQRGRRKIPQRAQERQKSQPRKKSPPVKAVPIQPPGPPERDSVGQLQLYRHPDRSQPAFLDAIDRREDTFYVVSFRRDHLLLPAISHNKTSRPKMSLVMPAMAPNETLSGRGAPGDYEEMMQIECEVMDTRVIHIKTSTVPPSLRKQPSPTPGNATGGPLPVSAASQAHQASHQPLYLNHP

SEQ ID NO: 864353 - protein, 333 aa, Homo sapiens
AGLGNRLLVGGWGGKMAELMLLSEIADPTRFFTDNLLSPEDWGLQNSTLYSGLDEVAEEQTQLFRCPEQDVPFDGSSLDVGMDVSPSEPPWELLPIFPDLQVKSEPSSPCSSSSLSSESSRLSTEPSSEALGVGEVLHVKTESLAPPLCLLGDDPTSSFETVQINVIPTSDDSSDVQTKIEPVSPCSSVNSEASLLSADSSSQAFIGEEVLEVKTESLSPSGCLLWDVPAPSLGAVQISMGPSLDGSSGKALPTRKPPLQPKPVVLTTVPMPSRAVPPSTTVLLQSLVQPPPGTEEGEKGRAWWLTPVIPALWEAEAGESPEVRSLRPAWPTW

SEQ ID NO: 864354 - protein, 66 aa, Homo sapiens
LTPFPPDLQVKSEPSSPCSSSSLSSESSRLSTEPSSETSSQPWTSSQPWTSTSHGWLVGVELERFH

SEQ ID NO: 864355 - protein, 748 aa, Homo sapiens
AGLGNRLLVGGWGGKMAELMLLSEIADPTRFFTDNLLSPEDWGLQNSTLYSGLDEVAEEQTQLFRCPEQDVPFDGSSLDVGMDVSPSEPPWELLPIFPDLQVKSEPSSPCSSSSLSSESSRLSTEPSSEALGVGEVLHVKTESLAPPLCLLGDDPTSSFETVQINVIPTSDDSSDVQTKIEPVSPCSSVNSEASLLSADSSSQAFIGEEVLEVKTESLSPSGCLLWDVPAPSLGAVQISMGPSLDGSSGKALPTRKPPLQPKPVVLTTVPMPSRAVPPSTTVLLQSLVQPPPVSPVVLIQGAIRVQPEGPAPSLPRPERKSIVPAPMPGNSCPPEVDAKLLKRQQRMIKNRESACQSRRKKKEYLQGLEARLQAVLADNQQLRRENAALRRRLEALLAEVRPVCPWETNRNTASLEMIPLFLVSFFVPENSELKLGSGNRKVVCIMVFLLFIAFNFGPVSISEPPSAPISPRMNKGEPQPRRHLLGFSEQEPVQGVEPLQGSSQGPKEPQPSPTDQPSFSNLTAFPGGAKELLLRDLDQLFLSSDCRHFNRTESLRLADELSGWVQRHQRGRRKIPQRAQERQKSQPRKKSPPVKAVPIQPPGPPERDSVGQLQLYRHPDRSQPAFLDAIDRREDTFYVVSFRRDHLLLPAISHNKTSRPKMSLVMPAMAPNETLSGRGAPGDYEEMMQIECEVMDTRVIHIKTSTVPPSLRKQPSPTPGNATGGPLPVSAASQAHQASHQPLYLNHP

SEQ ID NO: 864356 - protein, 745 aa, Homo sapiens
SHRPSNELFGEVRCSIRRQSPWHPPCVSWEMTPHPSVLSPRKMAELMLLSEIADPTRFFTDNLLSPEDWGLQNSTLYSGLDEVAEEQTQLFRCPEQDVPFDGSSLDVGMDVSPSEPPWELLPIFPDLQVKSEPSSPCSSSSLSSESSRLSTEPSSEALGVGEVLHVKTESLAPPLCLLGDDPTSSFETVQINVIPTSDDSSDVQTKIEPVSPCSSVNSEASLLSADSSSQAFIGEEVLEVKTESLSPSGCLLWDVPAPSLGAVQISMGPSLDGSSGKALPTRKPPLQPKPVVLTTVPMPSRAVPPSTTVLLQSLVQPPPVSPVVLIQGAIRVQPEGPAPSLPRPERKSIVPAPMPGNSCPPEVDAKLLKRQQRMIKNRESACQSRRKKKEYLQGLEARLQAVLADNQQLRRENAALRRRLEALLAENSELKLGSGNRKVVCIMVFLLFIAFNFGPVSISEPPSAPISPRMNKGEPQPRRHLLGFSEQEPVQGVEPLQGSSQGPKEPQPSPTDQPSFSNLTAFPGGAKELLLRDLDQLFLSSDCRHFNRTESLRLADELSGWVQRHQRGRRKIPQRAQERQKSQPRKKSPPVKAVPIQPPGPPERDSVGQLQLYRHPDRSQPAFLDAIDRREDTFYVVSFRRDHLLLPAISHNKTSRPKMSLVMPAMAPNETLSGRGAPGDYEEMMQIECEVMDTRVIHIKTSTVPPSLRKQPSPTPGNATGGPLPVSAASQAHQASHQPLYLNHP

SEQ ID NO: 864357 - protein, 617 aa, Homo sapiens
AGLGNRLLVGGWGGKMAELMLLSEIADPTRFFTDNLLSPEDWGLQNSTLYSGLDEVAEEQTQLFRCPEQDVPFDGSSLDVGMDVSPSEPPWELLPIFPDLQVKSEPSSPCSSSSLSSESSRLSTEPSSEALGVGEVLHVKTESLAPPLCLLGDDPTSSFETVQINVIPTSDDSSDVQTKIEPVSPCSSVNSEASLLSADSSSQAFIGEEVLEVKTESLSPSGCLLWDVPAPSLGAVQISMGPSLDGSSGKALPTRKPPLQPKPVVLTTVPMPSRAVPPSTTVLLQSLVQPPPVSPVVLIQGAIRVQPEGPAPSLPRPERKSIVPAPMPGNSCPPEVDAKLLKRQQRMIKNRESACQSRRKKKEYLQGLEARLQAVLADNQQLRRENAALRRRLEALLAENSELKLGSGNRKVVCIMVFLLFIAFNFGPVSISEPPSAPISPRMNKGEPQPRRHLLGFSEQEPVQGVEPLQGSSQGPKEPQPSPTDQPSFSNLTAFPGGAKELLLRDLDQLFLSSDCRHFNRTESLRLADELSGWVQRHQRGRRKIPQRAQERQKSQPRKKSPPVKAVPIQPPGPPERDSVGQLQLYRHPDRSQPAFLDAIDRREDTFYVVSFRRPPE

SEQ ID NO: 864358 - protein, 461 aa, Homo sapiens
WSPGVGLADSFKVMISSSVHFPPSAQPSDLCSLAPVSPVVLIQGAIRVQPEGPAPSLPRPERKSIVPAPMPGNSCPPEVDAKLLKRQQRMIKNRESACQSRRKKKEYLQGLEARLQAVLADNQQLRRENAALRRRLEALLAENSELKLGSGNRKVVCIMVFLLFIAFNFGPVSISEPPSAPISPRMNKGEPQPRRHLLGFSEQEPVQGVEPLQGSSQGPKEPQPSPTDQPSFSNLTAFPGGAKELLLRDLDQLFLSSDCRHFNRTESLRLADELSGWVQRHQRGRRKIPQRAQERQKSQPRKKSPPVKAVPIQPPGPPERDSVGQLQLYRHPDRSQPAFLDAIDRREDTFYVVSFRRDHLLLPAISHNKTSRPKMSLVMPAMAPNETLSGRGAPGDYEEMMQIECEVMDTRVIHIKTSTVPPSLRKQPSPTPGNATGGPLPVSAASQAHQASHQPLYLNHP

SEQ ID NO: 864359 - protein, 455 aa, Homo sapiens
MSALPPLGNGIRAVLQTQSFCSPVVEPPPVSPVVLIQGAIRVQPEGPAPSLPRPERKSIVPAPMPGNSCPPEVDAKLLKRQQRMIKNRESACQSRRKKKEYLQGLEARLQAVLADNQQLRRENAALRRRLEALLAENSELKLGSGNRKVVCIMVFLLFIAFNFGPVSISEPPSAPISPRMNKGEPQPRRHLLGFSEQEPVQGVEPLQGSSQGPKEPQPSPTDQPSFSNLTAFPGGAKELLLRDLDQLFLSSDCRHFNRTESLRLADELSGWVQRHQRGRRKIPQRAQERQKSQPRKKSPPVKAVPIQPPGPPERDSVGQLQLYRHPDRSQPAFLDAIDRREDTFYVVSFRRDHLLLPAISHNKTSRPKMSLVMPAMAPNETLSGRGAPGDYEEMMQIECEVMDTRVIHIKTSTVPPSLRKQPSPTPGNATGGPLPVSAASQAHQASHQPLYLNHP

SEQ ID NO: 864360 - protein, 303 aa, Homo sapiens [sequence omitted]

SEQ ID NO: 864361 - protein, 221 aa, Homo sapiens
AGLGNRLLVGGWGGKMAELMLLSEIADPTRFFTDNLLSPEDWGLQNSTLYSGLDEVAEEQTQLFRCPEQDVPFDGSSLDVGMDVSPSEPPWELLPIFPDLQVKSEPSSPCSSSSLSSESSRLSTEPSSEALGVGEVLHVKTESLAPPLCLLGDDPTSSFETVQINVIPTSDDSSDVQTKIEPVSPCSSVNSEASLLSADSSSQVSTTFLPSSRFSSEFLLT

SEQ ID NO: 864362 - protein, 92 aa, Homo sapiens
AGLGNRLLVGGWGGKMAELMLLSEIADPTRFFTDNLLSPEDWGLQNSTLYSGLDEVAEEQTQLFRCPEQDVPFDGSSLDVGMDVSPSEPPST

SEQ ID NO: 864363 - protein, 151 aa, Homo sapiens
AGLGNRLLVGGWGGKMAELMLLSEIADPTRFFTDNLLSPEDWGLQNSTLYSGLDEVAEEQTQLFRCPEQDVPFDGSSLDVGMDVSPSEPPWELLPIFPDLQVKSEPSSPCSSSSLSSHPFSEYRAPLIPVNPQSWLLCLRGLCEVQLWGGW

SEQ ID NO: 864364 - protein, 423 aa, Homo sapiens
MPGNSCPPEVDAKLLKRQQRMIKNRESACQSRRKKKEYLQGLEARLQAVLADNQQLRRENAALRRRLEALLAENSELKLGSGNRKVVCIMVFLLFIAFNFGPVSISEPPSAPISPRMNKGEPQPRRHLLGFSEQEPVQGVEPLQGSSQGPKEPQPSPTDQPSFSNLTAFPGGAKELLLRDLDQLFLSSDCRHFNRTESLRLADELSGWVQRHQRGRRKIPQRAQERQKSQPRKKSPPLCLLGDDPTSSFETVQINVIPTSDDSSDVQTKIEPVSPCSSVNSEASLLSADSSSQAFIGEEVLEVKTESLSPSGCLLWDVPAPSLGAVQISMGPSLDGSSGKALPTRKPPLQPKPVVLTTVPMPSRAVPPSTTVLLQSLVQPPPGTEEGEKGQVWWLMPVTPALWEAEVGRSPELRSSRPAWSRW

SEQ ID NO: 864365 - protein, 718 aa, Homo sapiens; identical to SEQ ID NO: 864352

SEQ ID NO: 864366 - protein, 726 aa, Homo sapiens
AGLGNRLLVGGWGGKMAELMLLSEIADPTRFFTDNLLSPEDWGLQNSTLYSGLDEVAEEQTQLFRCPEQDVPFDGSSLDVGMDVSPSEPPWELLPIFPDLQVKSEPSSPCSSSSLSSESSRLSTEPSSEALGVGEVLHVKTESLAPPLCLLGDDPTSSFETVQINVIPTSDDSSDVQTKIEPVSPCSSVNSEASLLSADSSSQAFIGEEVLEVKTESLSPSGCLLWDVPAPSLGAVQISMGPSLDGSSGKALPTRKPPLQPKPVVLTTVPMPSRAVPPSTTVLLQSLVQPPPVSPVVLIQGAIRVQPEGPAPSLPRPERKSIVPAPMPGNSCPPEVDAKLLKRQQRMIKNRESACQSRRKKKEYLQGLEARLQAVLADNQQLRRENAALRRRLEALLAENSELKLGSGNRKVVCIMVFLLFIAFNFGPVSISEPPSAPISPRMNKGEPQPRRHLLGFSEQEPVQGVEPLQGSSQGPKEPQPSPTDQPSFSNLTAFPGGAKELLLRDLDQLFLSSDCRHFNRTESLRLADELSGWVQRHQRGRRKIPQRAQERQSFRYFSFQKSQPRKKSPPVKAVPIQPPGPPERDSVGQLQLYRHPDRSQPAFLDAIDRREDTFYVVSFRRDHLLLPAISHNKTSRPKMSLVMPAMAPNETLSGRGAPGDYEEMMQIECEVMDTRVIHIKTSTVPPSLRKQPSPTPGNATGGPLPVSAASQAHQASHQPLYLNHP

SEQ ID NO: 864367 - protein, 655 aa, Homo sapiens
AGLGNRLLVGGWGGKMAELMLLSEIADPTRFFTDNLLSPEDWGLQNSTLYSGLDEVAEEQTQLFRCPEQDVPFDGSSLDVGMDVSPSEPPWELLPIFPDLQVKSEPSSPCSSSSLSSESSRLSTEPSSEALGVGEVLHVKTESLAPPLCLLGDDPTSSFETVQINVIPTSDDSSDVQTKIEPVSPCSSVNSEASLLSADSSSQAFIGEEVLEVKTESLSPSGCLLWDVPAPSLGAVQISMGPSLDGSSGKALPTRKPPLQPKPVVLTTVPMPSRAVPPSTTVLLQSLVQPPPVSPVVLIQGAIRVQPEGPAPSLPRPERKSIVPAPMPGNSCPPEVDAKLLKRQQRMIKNRESACQSRRKKKEYLQGLEARLQAVLADNQQLRRENAALRRRLEALLAENSELKLGSGNRKVVCIMVFLLFIAFNFGPVSISEPPSAPISPRMNKGEPQPRRHLLGFSEQEPVQGVEPLQGSSQGPKEPQPSPTDQPSFSNLTAFPGGAKELLLRDLDQLFLSSDCRHFNRTESLRLADELSGWVQRHQRGRRKIPQRAQERQKSQPRKKSPPVKAVPIQPPGPPERDSVGQLQLYRHPDRSQPAFLDAIDRREDTFYVVSFRRTTCRSDPPVTNKTSRPQMSMKPHGPNETCQAGPRDTEERAR

SEQ ID NO: 864368 - protein, 294 aa, Homo sapiens
AGLGNRLLVGGWGGKMAELMLLSEIADPTRFFTDNLLSPEDWGLQNSTLYSGLDEVAEEQTQLFRCPEQDVPFDGSSLDVGMDVSPSEPPWELLPIFPDLQVKSEPSSPCSSSSLSSESSRLSTEPSSEALGVGEVLHVKTESLAPPLCLLGDDPTSSFETVQINVIPTSDDSSDVQTKIEPVSPCSSVNSEASLLSADSSSQAFIGEEVLEVKTESLSPSGCLLWDVPAPSLGAVQISMGPSLDGSSGKALPTRKPPLQPKPVVLTTVPMPSRAASAEDVIPARAASAEDKTL

SEQ ID NO: 864369 - protein, 392 aa, Homo sapiens [sequence omitted]

SEQ ID NO: 864370 - protein, 231 aa, Homo sapiens
MIVILPCLCLGVVLTLQTVKHDRCSRLIGGRWIRGEMLRLADELSGWVQRHQRGRRKIPQRAQERQKSQPRKKSPPVKAVPIQPPGPPERDSVGQLQLYRHPDRSQPAFLDAIDRREDTFYVVSFRRDHLLLPAISHNKTSRPKMSLVMPAMAPNETLSGRGAPGDYEEMMQIECEVMDTRVIHIKTSTVPPSLRKQPSPTPGNATGGPLPVSAASQAHQASHQPLYLNHP

SEQ ID NO: 864371 - protein, 208 aa, Homo sapiens
MGEVEISALAYVKMCLHAARYPHAAVNGLFLAPAPRSGECLCLTDCVPLFHSHLALSVMLEVALNQVDVWGAQAGLVVAGYYHANAAVNDQSPGPLALKIAGRIAEFFPDAVLIMLDNQKLVPQPRVPPVIVLENQGLRWVPKDKNLVMWRDWEESRQMVGALLEDRAHQHLVDFDCHLDDIRQDWTNQRLNTQITQWVGPTNGNGNA

SEQ ID NO: 864372 - protein, 208 aa, Homo sapiens; identical to SEQ ID NO: 864371

SEQ ID NO: 864373 - protein, 208 aa, Homo sapiens; identical to SEQ ID NO: 864371

SEQ ID NO: 864374 - protein, 123 aa, Homo sapiens
MGEVEISALAYVKMCLHAARYPHAAVNGLFLAPAPRSGECLCLTDCVPLFHSHLALSVMLEVALNQVDVWGAQAGLVVAGYYHANAAVNDQSTQASSSRASSIQQARSPQATYRERPQLRPHL

SEQ ID NO: 864375 - protein, 123 aa, Homo sapiens; identical to SEQ ID NO: 864374

SEQ ID NO: 864376 - protein, 123 aa, Homo sapiens; identical to SEQ ID NO: 864374

SEQ ID NO: 864377 - protein, 112 aa, Homo sapiens
MGFAHSWLLTPLIFPLHSPGPLALKIAGRIAEFFPDAVLIMLDNQKLVPQPRVPPVIVLENQGLRWVPKDKNLVMWRDWEESRQMVGALLEDRAHQHLVDFDCLNIYMPIYI

SEQ ID NO: 864378 - protein, 275 aa, Homo sapiens
MGEVEISALAYVKMCLHAARYPHAAVNGLFLAPAPRSGECLCLTDCVPLFHSHLALSVMLEVALNQVDVWGAQAGLVVAGYYHANAAVNDQSNIEHLSPTALKHQAVVHQASSRPDPRRPPTGKGHSCAHTYETWEAQLKWMGFAHSWLLTPLIFPLHSPGPLALKIAGRIAEFFPDAVLIMLDNQKLVPQPRVPPVIVLENQGLRWVPKDKNLVMWRDWEESRQMVGALLEDRAHQHLVDFDCHLDDIRQDWTNQRLNTQITQWVGPTNGNGNA

SEQ ID NO: 864379 - protein, 130 aa, Homo sapiens
MGEVEISALAYVKMCLHAARYPHAAVNGLFLAPAPRSGECLCLTDCVPLFHSHLALSVMLEVALNQVDVWGAQAGLVVAGYYHANAAVNDQSPGPLALKIAGRIAEFFPDAVLIMQPAAQHSNHPVGWSH

SEQ ID NO: 864380 - protein, 485 aa, Homo sapiens
KEMPVCRQTGNTCKELRDPVTSGLNTSVVFGFLNLVLWVGNLWFVFKETGWAAPFLRAPPGPRNNRHPGTLRDAGYGQGPGGYGPQDSYGPQGGYQPDYGQPAGSGGSGYGPQGDYGQQGYGPQCTHLLLQSDVVLVSEAQEDLGGARAQEKACPPSHPYTLGLHPSSQETLSLLFIYMDVVNQLVAGGQFRVVKEPLGFVKVLQWVFAIFAFATCGSYSGELQLSVDCANKTESDLSIEVEFEYPFRLHQVYFDAPTCRGGTTKVFLVGDYSSSAEFFVTVAVFAFLYSMGALATYIFLQNKYRENNKGPMLDFLATAVFAFMWLVSSSAWAKGLSDVKMATDPENIIKEMPVCRQTGNTCKELRDPVTSGLNTSVVFGFLNLVLWVGNLWFVFKETGWAAPFLRAPPGAPEKQPAPGDAYGDAGYGQGPGGYGPQDSYGPQGGYQPDYGQPAGSGGSGYGPQGDYGQQGYGPQGAPTSFSNQM

SEQ ID NO: 864381 - protein, 259 aa, Homo sapiens
HPLGSLSTCLVPGTALDSRTMWLHQVYFDAPTCRGGTTKVFLVGDYSSSAEFFVTVAVFAFLYSMGALATYIFLQNKYRENNKGPMLDFLATAVFAFMWLVSSSAWAKGLSDVKMATDPENIIKEMPVCRQTGNTCKELRDPVTSGLNTSVVFGFLNLVLWVGNLWFVFKETGWAAPFLRAPPGAPEKQPAPGDAYGDAGYGQGPGGYGPQDSYGPQGGYQPDYGQPAGSGGSGYGPQGDYGQQGYGPQGAPTSFSNQM

SEQ ID NO: 864382 - protein, 200 aa, Homo sapiens
MDVVNQLVAGGQFRVVKEPLGFVKVLQWDFLATAVFAFMWLVSSSAWAKGLSDVKMATDPENIIKEMPVCRQTGNTCKELRDPVTSGLNTSVVFGFLNLVLWVGNLWFVFKETGWAAPFLRAPPGAPEKQPAPGDAYGDAGYGQGPGGYGPQDSYGPQGGYQPDYGQPAGSGGSGYGPQGDYGQQGYGPQGAPTSFSNQM

SEQ ID NO: 864383 - protein, 485 aa, Homo sapiens; identical to SEQ ID NO: 864380

SEQ ID NO: 864384 - protein, 93 aa, Homo sapiens
MGQGAVRCEDGHRPREHYQGDACLPPDREHMQGAERPCDLGTQHLGGKPWVLAGGGRVENSTVRHGEWWSGRIRGESGEIQGVSLKNAANNNV

SEQ ID NO: 864385 - protein, 485 aa, Homo sapiens; identical to SEQ ID NO: 864380

SEQ ID NO: 864386 - protein, 195 aa, Homo sapiens
MGALATYIFLQNKYRENNKGPMLDFLATAVFAFMWLVSSSAWAKGLSDVKMATDPENIIKEMPVCRQTGNTCKELRDPVTSGLNTSVVFGFLNLVLWVGNLWFVFKETGWAAPFLRAPPGAPEKQPAPGDAYGDAGYGQGPGGYGPQDSYGPQGGYQPDYGQPAGSGGSGYGPQGDYGQQGYGPQGAPTSFSNQM

SEQ ID NO: 864387 - protein, 485 aa, Homo sapiens; identical to SEQ ID NO: 864380

SEQ ID NO: 864388 - protein, 585 aa, Homo sapiens
MYEGKENVSFELQRDFSQETDFSEASLLEKQQEVHSAGNIKKEKSNTIDGTVKDETSPVEECFFSQSSNSYQCHTITGEQPSGCTGLGKSISFDTKLVKHEIINSEERPFKCEELVEPFRCDSQLIQHQENNTEEKPYQCSECGKAFSINEKLIWHQRLHSGEKPFKCVECGKSFSYSSHYITHQTIHSGEKPYQCKMCGKAFSVNGSLSRHQRIHTGEKPYQCKECGNGFSCSSAYITHQRVHTGEKPYECNDCGKAFNVNAKLIQHQRIHTGEKPYECNECGKGFRCSSQLRQHQSIHTGEKPYQCKECGKGFNNNTKLIQHQRIHTGEKPYECTECGKAFSVKGKLIQHQRIHTGEKPYECNECGKAFRCNSQFRQHLRIHTGEKPYECNECGKAFSVNGKLMRHQRIHTGEKPFECNECGRCFTSKRNLLDHHRIHTGEKPYQCKECGKAFSINAKLTRHQRIHTGEKPFKCMECEKAFSCSSNYIVHQRIHTGEKPFQCKECGKAFHVNAHLIRHQRSHTGEKPFRCVECGKGFSFSSDYIIHQTVHTWKKPYMCSVCGKAFRFSFQLSQHQSVHSEGKS

SEQ ID NO: 864389 - protein, 585 aa, Homo sapiens; identical to SEQ ID NO: 864388

SEQ ID NO: 864390 - protein, 722 aa, Homo sapiens
MDFHGLQKSVTFEDVAVYFTQAEWDGLSPAQRTLYRDVMLENYGNVASLGFPLLKPAVISQLEGGSELGGSSPLAAGTGLQGLQTDGVSLCRPNWSAVAELGSPQLPFPGFEQFSCLILPSSWNYSDIQTDNDLTKEMYEGKENVSFELQRDFSQETDFSEASLLEKQQEVHSAGNIKKEKSNTIDGTVKDETSPVEECFFSQSSNSYQCHTITGEQPSGCTGLGKSISFDTKLVKHEIINSEERPFKCEELVEPFRCDSQLIQHQENNTEEKPYQCSECGKAFSINEKLIWHQRLHSGEKPFKCVECGKSFSYSSHYITHQTIHSGEKPYQCKMCGKAFSVNGSLSRHQRIHTGEKPYQCKECGNGFSCSSAYITHQRVHTGEKPYECNDCGKAFNVNAKLIQHQRIHTGEKPYECNECGKGFRCSSQLRQHQSIHTGEKPYQCKECGKGFNNNTKLIQHQRIHTGEKPYECTECGKAFSVKGKLIQHQRIHTGEKPYECNECGKAFRCNSQFRQHLRIHTGEKPYECNECGKAFSVNGKLMRHQRIHTGEKPFECNECGRCFTSKRNLLDHHRIHTGEKPYQCKECGKAFSINAKLTRHQRIHTGEKPFKCMECEKAFSCSSNYIVHQRIHTGEKPFQCKECGKAFHVNAHLIRHQRSHTGEKPFRCVECGKGFSFSSDYIIHQTVHTWKKPYMCSVCGKAFRFSFQLSQHQSVHSEGKS

SEQ ID NO: 864391 - protein, 585 aa, Homo sapiens; identical to SEQ ID NO: 864388

SEQ ID NO: 864392 - protein, 252 aa, Homo sapiens
MAAMPLKAQYQEMVTFEDVAVHFTKTEWTGLSPAQRALYRSVMLENFGNLTALGYPVPKPALISLLERGDMAWGLEAQDDPPAERTKNVCKDVETNIDSESTLIQGISEERDGMMSHGQLKSVPQRTDFPETRNVEKHQDIPTVKNIQGKVPRIPCARKPFICEECGKSFSYFSYYARHQRIHTGEKPFECSECGKAFNGNSSLIRHQRIHTGERPYQCEECGRAFNDNANLIRHQRIHSGGQTLLLYRVWE

SEQ ID NO: 864393 - protein, 458 aa, Homo sapiens
MAAMPLKAQYQEMVTFEDVAVHFTKTEWTGLSPAQRALYRSVMLENFGNLTALGYPVPKPALISLLERGDMAWGLEAQDDPPAERTKNVCKDVETNIDSESTLIQGISEERDGMMSHGQLKSVPQRTDFPETRNVEKHQDIPTVKNIQGKVPRIPCARKPFICEECGKSFSYFSYYARHQRIHTGEKPFECSECGKAFNGNSSLIRHQRIHTGERPYQCEECGRAFNDNANLIRHQRIHSGDRPYYCTECGNSFTSSSEFVIHQRIHTGEKPYECNECGKAFVGNSPLLRHQKIHTGEKPYECNECGKSFGRTSHLSQHQRIHTGEKPYSCKVCGQAFNFHTKLTRHQRIHSEEKPFDCVDCGKAFSAQEQLKRHLRIHTQESSYVCDECGKALTSKRNLHQHQRIHTGEKPYECSKYEKAFGTSSQLGHLEHVYSGEKPVLDICRFGLPEFFTPFYW

SEQ ID NO: 864394 - protein, 82 aa, Homo sapiens [sequence omitted]

SEQ ID NO: 864395 - protein, 84 aa, Homo sapiens
CRAPGAVCRALSPRLWVRLRRTPTLGAAGSPVAYAARRPRLGEGAGRRPGVLFRAPRLQLWSLWLNSLRPLEGETHVAVPATRP

SEQ ID NO: 864396 - protein, 726 aa, Homo sapiens
MAAMHLTAWPQKSVTFEDVAVYFTQAEWDGLSPAQRTLYRDVMLENYGNVASLGFPLLKPAVISQLEGGSELGGSSPLAAGTGLQGLQTDGVSLCRPNWSAVAELGSPQLPFPGFEQFSCLILPSSWNYSDIQTDNDLTKEMYEGKENVSFELQRDFSQETDFSEASLLEKQQEVHSAGNIKKEKSNTIDGTVKDETSPVEECFFSQSSNSYQCHTITGEQPSGCTGLGKSISFDTKLVKHEIINSEERPFKCEELVEPFRCDSQLIQHQENNTEEKPYQCSECGKAFSINEKLIWHQRLHSGEKPFKCVECGKSFSYSSHYITHQTIHSGEKPYQCKMCGKAFSVNGSLSRHQRIHTGEKPYQCKECGNGFSCSSAYITHQRVHTGEKPYECNDCGKAFNVNAKLIQHQRIHTGEKPYECNECGKGFRCSSQLRQHQSIHTGEKPYQCKECGKGFNNNTKLIQHQRIHTGEKPYECTECGKAFSVKGKLIQHQRIHTGEKPYECNECGKAFRCNSQFRQHLRIHTGEKPYECNECGKAFSVNGKLMRHQRIHTGEKPFECNECGRCFTSKRNLLDHHRIHTGEKPYQCKECGKAFSINAKLTRHQRIHTGEKPFKCMECEKAFSCSSNYIVHQRIHTGEKPFQCKECGKAFHVNAHLIRHQRSHTGEKPFRCVECGKGFSFSSDYIIHQTVHTWKKPYMCSVCGKAFRFSFQLSQHQSVHSEGKS

SEQ ID NO: 864397 - protein, 698 aa, Homo sapiens
MAAMHLTAWPQKSVTFEDVAVYFTQAEWDGLSPAQRTLYRDVMLENYGNVASLGFPLLKPAVISQLEGGSELGGSSPLAAGTGLQGLQTDGVSLCRPNWSAVAELGSPQLPFPGFEQFSCLILPSSWNYSDIQTDNDLTKEMYEGKENVSFELQRDFSQETDFSEASLLEKQQEVHSAGNIKKEKSNTIDGTVKDETSPVEECFFSQSSNSYQCHTITGEQPSGCTGLGKSISFDTKLVKHEIINSEERPFKCEELVEPFRCDSQLIQHQENNTEEKPYQCSECGKAFSINEKLIWHQRLHSGEKPFKCVECGKSFSYSSHYITHQTIHSGEKPYQCKMCGKAFSVNGSLSRHQRIHTGEKPYQCKECGNGFSCSSAYITHQRVHTGEKPYECNDCGKAFNVNAKLIQHQRIHTGEKPYECNECGKGFRCSSQLRQHQSIHTGEKPYQCKECGKGFNNNTKLIQHQRIHTGEKPYECNECGKAFRCNSQFRQHLRIHTGEKPYECNECGKAFSVNGKLMRHQRIHTGEKPFECNECGRCFTSKRNLLDHHRIHTGEKPYQCKECGKAFSINAKLTRHQRIHTGEKPFKCMECEKAFSCSSNYIVHQRIHTGEKPFQCKECGKAFHVNAHLIRHQRSHTGEKPFRCVECGKGFSFSSDYIIHQTVHTWKKPYMCSVCGKAFRFSFQLSQHQSVHSEGKS

SEQ ID NO: 864398 - protein, 446 aa, Homo sapiens
MVTFEDVAVHFTKTEWTGLSPAQRALYRSVMLENFGNLTALGYPVPKPALISLLERGDMAWGLEAQDDPPAERTKNVCKDVETNIDSESTLIQGISEERDGMMSHGQLKSVPQRTDFPETRNVEKHQDIPTVKNIQGKVPRIPCARKPFICEECGKSFSYFSYYARHQRIHTGEKPFECSECGKAFNGNSSLIRHQRIHTGERPYQCEECGRAFNDNANLIRHQRIHSGDRPYYCTECGNSFTSSSEFVIHQRIHTGEKPYECNECGKAFVGNSPLLRHQKIHTGEKPYECNECGKSFGRTSHLSQHQRIHTGEKPYSCKVCGQAFNFHTKLTRHQRIHSEEKPFDCVDCGKAFSAQEQLKRHLRIHTQESSYVCDECGKALTSKRNLHQHQRIHTGEKPYECSKYEKAFGTSSQLGHLEHVYSGEKPVLDICRFGLPEFFTPFYW

SEQ ID NO: 864399 - protein, 726 aa, Homo sapiens; identical to SEQ ID NO: 864396

SEQ ID NO: 864400 - protein, 608 aa, Homo sapiens
MYFPSWLSQLYRGLSRPIRRTTQPIWGSLYRSLLQSSQRRIPEFSSFVVRTNTCGELRSSHLGQEVTLCGWIQYRRQNTFLVLRDFDGLVQVIIPQDESAASVKKILCEAPVESVVQVSGTVISRPAGQENPKMPTGEIEIKVKTAELLNACKKLPFEIKNFVKKTEALRLQYRYLDLRSFQMQYNLRLRSQMVMKMREYLCNLHGFVDIETPTLFKRTPGGAKEFLVPSREPGKFYSLPQSPQQFKQLLMVGGLDRYFQVARCYRDEGSRPDRQPEFTQIDIEMSFVDQTGIQSLIEGLLQYSWPNDKDPVVVPFPTMTFAEVLATYGTDKPDTRFGMKIIDISDVFRNTEIGFLQDALSKPHGTVKAICIPEGAKYLKRKDIESIRNFAADHFNQEILPVFLNANRNWNSPVANFIMESQRLELIRLMETQEEDVVLLTAGEHNKACSLLGKLRLECADLLETRGVVLRDPTLFSFLWVVDFPLFLPKEENPRELESAHHPFTAPHPSDIHLLYTEPKKEDVKMLSHLLQALDYGAPPHGGIALGLDRLICLVTGSPSIRDVIAFPKSFRGHDLMSNTPDSVPPEELKPYHIRVSKPTDSKAERAH

SEQ ID NO: 864401 - protein, 227 aa, Homo sapiens [sequence omitted]

SEQ ID NO: 864402 - protein, 645 aa, Homo sapiens
MYFPSWLSQLYRGLSRPIRRTTQPIWGSLYRSLLQSSQRRIPEFSSFVVRTNTCGELRSSHLGQEVTLCGWIQYRRQNTFLVLRDFDGLVQVIIPQDESAASVKKILCEAPVESVVQVSGTVISRPAGQENPKMPTGEIEIKVKTAELLNACKKLPFEIKNFVKKTEALRLQYRYLDLRSFQMQYNLRLRSQMVMKMREYLCNLHGFVDIETPTLFKRTPGGAKEFLVPSREPGKFYSLPQSPQQFKQLLMVGGLDRYFQVARCYRDEGSRPDRQPEFTQIDIEMSFVDQTGIQSLIEGLLQYSWPNDKDPVVVPFPTMTFAEVLATYGTDKPDTRFGMKIIDISDVFRNTEIGFLQDALSKPHGTVKAICIPEGAKYLKRKDIESIRNFAADHFNQEILPVFLNANRNWNSPVANFIMESQRLELIRLMETQEEDVVLLTAGEHNKACSLLGKLRLECADLLETRGVVLRDPTLFSFLWVVDFPLFLPKEENPRELESAHHPFTAPHPSDIHLLYTEPKKARSQHYDLVLNGNEIGGGSIRIHNAELQRYILATLLKEDVKMLSHLLQALDYGAPPHGGIALGLDRLICLVTGSPSIRDVIAFPKSFRGHDLMSNTPDSVPPEELKPYHIRVSKPTDSKAERAH

SEQ ID NO: 864403 - protein, 645 aa, Homo sapiens; identical to SEQ ID NO: 864402

SEQ ID NO: 864404 - protein, 608 aa, Homo sapiens; identical to SEQ ID NO: 864400

SEQ ID NO: 864405 - protein, 482 aa, Homo sapiens
MYFPSWLSQLYRGLSRPIRRTTQPIWGSLYRSLLQSSQRRIPEFSSFVVRTNTCGELRSSHLGQEVTLCGWIQYRRQNTFLVLRDFDGLVQVIIPQDESAASVKKILCEAPVESVVQVSGTVISRPAGQENPKMPTGEIEIKVKTAELLNACKKLPFEIKNFVKKTEALRLQYRYLDLRSFQMQYNLRLRSQMVMKMREYLCNLHGFVDIETPTLFKRTPGGAKEFLVPSREPGKFYSLPQSPQQFKQLLMVGGLDRYFQVARCYRDEGSRPDRQPEFTQIDIEMSFVDQTGIQSLIEGLLQYSWPNDKDPVVVPFPTMTFAEVLATYGTDKPDTRFGMKIIDISDVFRNTEIGFLQDALSKPHGTVKAICIPEGAKYLKRKDIESIRNFAADHFNQEILPVFLNANRNWNSPVANFIMESQRLELIRLMETQEEDVVLLTAGEHNKAKKFQSSASKLNVIPRLPFPYNSKMKKAIYFQILL

SEQ ID NO: 864406 - protein, 212 aa, Homo sapiens
MNNQKQQKPTLSGQRFKTRKRDEKERFDPTQFQDCIIQGLTETGTDLEAVAKFLDASGAKLDYRRYAETLFDILVAGGMLAPGGTLADDMMRTDVCVFAAQEDLETMQAFAQVFNKLIRRYKYLEKGFEDEVKKLLLFLKGFSESERNKLAMLTGVLLANGTLNASILNSLYNENLVKEGVSAAFAVKLFKSWINETRYQCSSCKSSESQHG

SEQ ID NO: 864407 - protein, 212 aa, Homo sapiens; identical to SEQ ID NO: 864406

SEQ ID NO: 864408 - protein, 155 aa, Homo sapiens
MSRGDPFKDIILYVKEEMKKNNIPEPVVIGIVWSSVMSTVEWNKKEELVAEQAIKHLKQYSPLLAAFTTQGQSELTLLLKIQEYCYDNIHFMKAFQKIVVLFYKAEVLSEEPILKWYKDAHVAKGKSVFLEQMKKFVEWLKNAEEESESEAEEGD

SEQ ID NO: 864409 - protein, 212 aa, Homo sapiens; identical to SEQ ID NO: 864406

SEQ ID NO: 864410 - protein, 212 aa, Homo sapiens; identical to SEQ ID NO: 864406

SEQ ID NO: 864411 - protein, 212 aa, Homo sapiens; identical to SEQ ID NO: 864406

SEQ ID NO: 864412 - protein, 203 aa, Homo sapiens
MNNQKQQKPTLSGQRFKTRKRDEKERFDPTQFQDCIIQGLTETGTDLEAVAKFLDASGAKLDYRRYAETLFDILVAGGMLAPGGTLADDMMRTDVCVFAAQEDLETMQAFAQVFNKLIRRYKYLEKGFEDEVKKLLLFLKGFSESERNKLAMLTGVLLANGTLNASILNSLYNENLVKEGVREIGGEAFNRGREEFSGRQILI

SEQ ID NO: 864413 - protein, 96 aa, Homo sapiens
MNNQKQQKPTLSGQRFKTRKRDEKERFDPTQFQDCIIQGLTETGTDLEAVAKFLDASGAPNAVPSSHTVIGYDPDRRLLAPAHAPQVHLHALAPAP

SEQ ID NO: 864414 - protein, 212 aa, Homo sapiens; identical to SEQ ID NO: 864406

SEQ ID NO: 864415 - protein, 212 aa, Homo sapiens; identical to SEQ ID NO: 864406

SEQ ID NO: 864416 - protein, 212 aa, Homo sapiens; identical to SEQ ID NO: 864406

SEQ ID NO: 864417 - protein, 212 aa, Homo sapiens; identical to SEQ ID NO: 864406

SEQ ID NO: 864418 - protein, 268 aa, Homo sapiens
GRRGCHPPPLRPPPPPLLSLEGGRMYGAPGAPAQSASVTVVRSLRRPPPQATGVSFMNNQKQQKPTLSGQRFKTRKRDEKERFDPTQFQDCIIQGLTETGTDLEAVAKFLDASGAKLDYRRYAETLFDILVAGGMLAPGGTLADDMMRTDVCVFAAQEDLETMQAFAQVFNKLIRRYKYLEKGFEDEVKKLLLFLKGFSESERNKLAMLTGVLLANGTLNASILNSLYNENLVKEGVSAAFAVKLFKSWINETRYQCSSCKSSESQHG

SEQ ID NO: 864419 - protein, 227 aa, Homo sapiens
MGFWLLLFALHRVSFMNNQKQQKPTLSGQRFKTRKRDEKERFDPTQFQDCIIQGLTETGTDLEAVAKFLDASGAKLDYRRYAETLFDILVAGGMLAPGGTLADDMMRTDVCVFAAQEDLETMQAFAQVFNKLIRRYKYLEKGFEDEVKKLLLFLKGFSESERNKLAMLTGVLLANGTLNASILNSLYNENLVKEGVSAAFAVKLFKSWINETRYQCSSCKSSESQHG

SEQ ID NO: 864420 - protein, 212 aa, Homo sapiens; identical to SEQ ID NO: 864406

SEQ ID NO: 864421 - protein, 212 aa, Homo sapiens; identical to SEQ ID NO: 864406

SEQ ID NO: 864422 - protein, 167 aa, Homo sapiens
SRRTSTLGSEDSRQSPGDPSDIILYVKEEMKKNNIPEPVVIGIVWSSVMSTVEWNKKEELVAEQAIKHLKQYSPLLAAFTTQGQSELTLLLKIQEYCYDNIHFMKAFQKIVVLFYKAEVLSEEPILKWYKDAHVAKGKSVFLEQMKKFVEWLKNAEEESESEAEEGD

SEQ ID NO: 864423 - protein, 212 aa, Homo sapiens; identical to SEQ ID NO: 864406

SEQ ID NO: 864424 - protein, 212 aa, Homo sapiens; identical to SEQ ID NO: 864406

SEQ ID NO: 864425 - protein, 105 aa, Homo sapiens
MNNQKQQKPTLSGQRFKTRKRDEKERFDPTQFQDCIIQGLTETGTDLEAVAKFLDASGAKLDYRRYAETLFDILVAGGMLGKCLWFVGLIIKKGIIYGDYGESRI

SEQ ID NO: 864426 - protein, 681 aa, Homo sapiens
MKCVLVATEGAEVLFYWTDQEFEESLRLKFGQSENEEEELPALEDQLSTLLAPVIISSMTMLEKLSDTYTCFSTENGNFLYVLHLFGECLFIAINGDHTESEGDLRRKLYVLKYLFEVHFGLVTVDGHLIRKELRPPDLAQRVQLWEHFQSLLWTYSRLREQEQCFAVEVTTGRGSPQDLKLSALERLIHPQLCELCIEALERHVIQAVNTSPERGGEEALHAFLLVHSKLLAFYSSHSASSLRPADLLALILLVQDLYPSESTAEDDIQETDSFSLPEEYFTPAPSPGDQSSGSTIWLEGGTPPMDALQIAEDTLQTLVPHCPVPSGPRRIFLDANVKESYCPLVPHTMYCLPLWQGINLVLLTRSPSAPLALVLSQLMDGFSMLEKKLKEGPEPGASLRSQPLVGDLRQRMDKFVKNRGAQEIQSTWLEFKAKAFSKSEPGSSWELLQACGKLKRQLCAIYRLNFLTTAPSRGGPHLPQHLQDQVQRLMREKLTDWKDFLLVKSRRNITMVSYLEDFPGLVHFIYVDRTTGQMVAPSLNCSQKTSSELGKGPLAAFVKTKVWSLIQLARRYLQKGYTTLLFQEGDFYCSYFLWFENDMGYKLQMIEVPVLSDDSVPIGMLGGDYYRKLLRYYSKNRPTEAVRCYELLALHLSVIPTDLLVQQAGQLARRLWEASRIPLL

SEQ ID NO: 864427 - protein, 133 aa, Homo sapiens
MAASGRGLCKAVAASPFPAWRRDNTEARGGLKPEYDAVVIGAGRHLGFRCWLCCVAWGKCLPSLGLDLPMENDRKTRGPQMHDCQLGLYRDNDGTESRRHSTCSFEGMPSFSYVLEQLRAGRYSTLTSPGKNV

SEQ ID NO: 864428 - protein, 700 aa, Homo sapiens [sequence omitted]

SEQ ID NO: 864429 - protein, 700 aa, Homo sapiens [sequence omitted]

SEQ ID NO: 864430 - protein, 646 aa, Homo sapiens
MKCVLVATEGAEVLFYWTDQEFEESLRLKFGQSENEEEELPALEDQLSTLLAPVIISSMTMLEKLSDTYTCFSTENGNFLYVLHLFGECLFIAINGDHTESEGDLRRKLYVLKYLFEVHFGLVTVDGHLIRKELRPPDLAQRVQLWEHFQSLLWTYSRLREQEQCFAVEPQCQLPAPGRPACPHPPGSGPLPQREHSRGRHSAFPAEGPEQPEHPRAAGLEPSLTGPTGGSSAETETDSFSLPEEYFTPAPSPGDQSSGSTIWLEGGTPPMDALQIAEDTLQTLVPHCPVPSGPRRIFLDANVKESYCPLVPHTMYCLPLWQGINLVLLTRSPSAPLALVLSQLMDGFSMLEKKLKEGPEPGASLRSQPLVGDLRQRMDKFVKNRGAQEIQSTWLEFKAKAFSKSEPGSSWELLQACGKLKRQLCAIYRLNFLTTAPSRGGPHLPQHLQDQVQRLMREKLTDWKDFLLVKSRRNITMVSYLEDFPGLVHFIYVDRTTGQMVAPSLNCSQKTSSELGKGPLAAFVKTKVWSLIQLARRYLQKGYTTLLFQEGDFYCSYFLWFENDMGYKLQMIEVPVLSDDSVPIGMLGGDYYRKLLRYYSKNRPTEAVRCYELLALHLSVIPTDLLVQQAGQLARRLWEASRIPLL

SEQ ID NO: 864431 - protein, 700 aa, Homo sapiens [sequence omitted]

SEQ ID NO: 864432 - protein, 700 aa, Homo sapiens [sequence omitted]

SEQ ID NO: 864433 - protein, 700 aa, Homo sapiens [sequence omitted]

SEQ ID NO: 864434 - protein, 700 aa, Homo sapiens [sequence omitted]

SEQ ID NO: 864435 - protein, 275 aa, Homo sapiens
MKCVLVATEGAEVLFYWTDQEFEESLRLKFGQSENEEEELPALEDQLSTLLAPVIISSMTMLEKLSDTYTCFSTENGNFLYVLHLFGECLFIAINGDHTESEGDLRRKLYVLKYLFEVHFGLVTVDGHLIRKELRPPDLAQRVQLWEHFQSLLWTYSRLREQEQCFAVEVTTGRGSPQDLKLSATVPAPCARPTCLPSSSWFRTSTPARAQQRTTFRRQTASPSLRSTSHQLLPLAIRAQVRTGGKQEETIASCERQAAQDICLRLQWTPVPPKA

SEQ ID NO: 864436 - protein, 199 aa, Homo sapiens
MKCVLVATEGAEVLFYWTDQEFEESLRLKFGQSENEEEELPALEDQLSTLLAPVIISSMTMLEKLSDTYTCFSTENGNFLYVLHLFGECLFIAINGDHTESEGDLRRKLYVLKYLFEVHFGLVTVDGHLIRKELRPPDLAQRVQLWEHFQSLLWTYSRLREQEQCFAVEVTTGRGSPQDLKLSGQRGRPPLRPCFNPNE

SEQ ID NO: 864437 - protein, 72 aa, Homo sapiens
AVLPGSAPGLLQAGRCARRDPVRGPPGCPLWGRRSSLRSPPSTLPEVSICRTRDAVLLSHEPVTESVCCSPF

SEQ ID NO: 864438 - protein, 112 aa, Homo sapiens
GPTRKRARAPAGGALCAPRSGTWASGLSPLGAAILPPEPPFNPPGSEVGSLGVPERAHSYLTHSGRVAVGRSLPRSGPKFLSREEGWMSQVKPPSQGGREHLQDQGCCAALP

SEQ ID NO: 864439 - protein, 324 aa, Homo sapiens
MKCVLVATEGAEVLFYWTDQEFEESLRLKFGQSENEEEELPALEDQLSTLLAPVIISSMTMLEKLSDTYTCFSTENGNFLYVLHLFGECLFIAINGDHTESEGDLRRKLYVLKYLFEVHFGLVTVDGHLIRKELRPPDLAQRVQLWEHFQSLLWTYSRLREQEQCFAVEALERLIHPQLCELCIEALERHVIQAVNTSPERGGEEALHAFLLVHSKLLAFYSSHSASSLRPADLLALILLVQDLYPSESTAEDDIQPSPRRARSSQNIPVQQAWSPHSTGPTGGSSAETETDSFSLPEEYFTPAPSPGDQSSGEDRRKAGGNNS

SEQ ID NO: 864440 - protein, 133 aa, Homo sapiens [sequence omitted]

SEQ ID NO: 864441 - protein, 82 aa, Homo sapiens
AEMAASGRGLCKAVAASPFPAWRRDNTEARGGLKPEYDAVVIGAEGPKCMIANWVYTEIMTGPKADGTQHAALRACLHFHMY

SEQ ID NO: 864442 - protein, 700 aa, Homo sapiens [sequence omitted]

SEQ ID NO: 864443 - protein, 580 aa, Homo sapiens
MKCVLVATEGAEVLFYWTDQEFEESLRLKFGQSENEEEELPALEDQLSTLLAPVIISSMTMLEKLSDTYTCFSTENGNFLYVLHLAAAPRPGAACPAVGALPEPAVDLQPPAGAGAVLRRGGDYWARESSGLEAVSHSASSLRPADLLALILLVQDLYPSESTAEDDIQETDSFSLPEEYFTPAPSPGDQSSGSTIWLEGGTPPMDALQIAEDTLQTLVPHCPVPSGPRRIFLDANVKESYCPLVPHTMYCLPLWQGINLVLLTRSPSAPLALVLSQLMDGFSMLEKKLKEGPEPGASLRSQPLVGDLRQRMDKFVKNRGAQEIQSTWLEFKAKAFSKSEPGSSWELLQACGKLKRQLCAIYRLNFLTTAPSRGGPHLPQHLQDQVQRLMREKLTDWKDFLLVKSRRNITMVSYLEDFPGLVHFIYVDRTTGQMVAPSLNCSQKTSSELGKGPLAAFVKTKVWSLIQLARRYLQKGYTTLLFQEGDFYCSYFLWFENDMGYKLQMIEVPVLSDDSVPIGMLGGDYYRKLLRYYSKNRPTEAVRCYELLALHLSVIPTDLLVQQAGQLARRLWEASRIPLL

SEQ ID NO: 864444 - protein, 644 aa, Homo sapiens
RSPPKLWTQEALRDGARVSQSCEFGPNKVKDLLANGVVPSGIVMGSTLLAPVIISSMTMLEKLSDTYTCFSTENGNFLYVLHLFGECLFIAINGDHTESEGDLRRKLYVLKYLFEVHFGLVTVDGHLIRKELRPPDLAQRVQLWEHFQSLLWTYSRLREQEQCFAVEPQCQLPAPGRPACPHPPGSGPLPQREHSRGRHSAFPAEGPEQPEHPRAAGLEPSLTGPTGGSSAETETDSFSLPEEYFTPAPSPGDQSSGSTIWLEGGTPPMDALQIAEDTLQTLVPHCPVPSGPRRIFLDANVKESYCPLVPHTMYCLPLWQGINLVLLTRSPSAPLALVLSQLMDGFSMLEKKLKEGPEPGASLRSQPLVGDLRQRMDKFVKNRGAQEIQSTWLEFKAKAFSKSEPGSSWELLQACGKLKRQLCAIYRLNFLTTAPSRGGPHLPQHLQDQVQRLMREKLTDWKDFLLVKSRRNITMVSYLEDFPGLVHFIYVDRTTGQMVAPSLNCSQKTSSELGKGPLAAFVKTKVWSLIQLARRYLQKGYTTLLFQEGDFYCSYFLWFENDMGYKLQMIEVPVLSDDSVPIGMLGGDYYRKLLRYYSKNRPTEAVRCYELLALHLSVIPTDLLVQQAGQLARRLWEASRIPLL

SEQ ID NO: 864445 - protein, 332 aa, Homo sapiens
MYCLPLWQGINLVLLTRSPSAPLALVLSQLMDGFSMLEKKLKEGPEPGASLRSQPLVGDLRQRMDKFVKNRGAQEIQSTWLEFKAKAFSKSEPGSSWELLQACGKLKRQLCAIYRLNFLTTAPSRGGPHLPQHLQDQVQRLMREKLTDWKDFLLVKSRRNITMVSYLEDFPGLVHFIYVDRTTGQMVAPSLNCSQKTSSELGKGPLAAFVKTKVWSLIQLARRYLQKGYTTLLFQEGDFYCSYFLWFENDMGYKLQMIEVPVLSDDSVPIGMLGGDYYRKLLRYYSKNRPTEAVRCYELLALHLSVIPTDLLVQQAGQLARRLWEASRIPLL

SEQ ID NO: 864446 - protein, 700 aa, Homo sapiens [sequence omitted]

SEQ ID NO: 864447 - protein, 700 aa, Homo sapiens [sequence omitted]

SEQ ID NO: 864448 - protein, 322 aa, Homo sapiens
MKCVLVATEGAEVLFYWTDQEFEESLRLKFGQSENEEEELPALEDQLSTLLAPVIISSMTMLEKLSDTYTCFSTENGNFLYVLHLFGECLFIAINGDHTESEGDLRRKLYVLKYLFEVHFGLVTVDGHLIRKELRPPDLAQRVQLWEHFQSLLWTYSRLREQEQCFAVEALERLIHPQLCELCIEALERHVIQAVNTSPERGGEEALHAFLLVHSKLLAFYSSHSASSLRPADLLALILLVQDLYPSESTAEDDIQPSPRRARSSQNIPVQQAWSPHSTGPTGGSSAETVCAVHFVESGAGGDRPLQATRPFPSLLGEQGQG

SEQ ID NO: 864449 - protein, 360 aa, Homo sapiens
MKCVLVATEGAEVLFYWTDQEFEESLRLKFGQSENEEEELPALEDQLSTLLAPVIISSMTMLEKLSDTYTCFSTENGNFLYVLHLFGECLFIAINGDHTESEGDLRRKLYVLKYLFEVHFGLVTVDGHLIRKELRPPDLAQRVQLWEHFQSLLWTYSRLREQEQCFAVEALERLIHPQLCELCIEALERHVIQAVNTSPERGGEEALHAFLLVHSKLLAFYSSHSASSLRPADLLALILLVQDLYPSESTAEDDIQETDSFSLPEEYFTPAPSPGDQSSGSTIWLEGGTPPMDALQIAEDTLQTLVPHCPVPSGPRRIFLDANVKESYCPLVPHTMYCLPLWQGINLVLLTRVGEPLTLP

SEQ ID NO: 864450 - protein, 204 aa, Homo sapiens
MKCVLVATEGAEVLFYWTDQEFEESLRLKFGQSENEEEELPALEDQLSTLLAPVIISSMTMLEKLSDTYTCFSTENGNFLYVLHLAAAPRPGAACPAVGALPEPAVDLQPPAGAGAVLRRGGDYWARESSGLEAVSHSASSLRPADLLALILLVQDLYPSESTAEDDIQETDSFSLPEEYFTPAPSPGDQSSGEDRRKAGGNNS

SEQ ID NO: 864451 - protein, 117 aa, Homo sapiens
MKCVLVATEGAEVLFYWTDQEFEESLRLKFGQSENEEEEVSAGEAVPGGVDRKEPYKTPSRQRGRKTCVHPVLGSMSRVLGGVQHPSHLDPYPQGWPLDALSSVTPPPHPTSPLWTK

SEQ ID NO: 864452 - protein, 72 aa, Homo sapiens; identical to SEQ ID NO: 864437

SEQ ID NO: 864453 - protein, 283 aa, Homo sapiens
MGASVSRGRAARVPAPEPEPEEALDLSQLPPELLLVVLSHVPPRTLLGRCRQVCRGWRALVDGQALWLLILARDHGATGRALLHLARSCQSPARNARPCPLGRFCARRPIGRNLIRNPCGQEGLRKWMVQHGGDGWVVEENRTTVPGAPSQTCFVTSFSWCCKKQVLDLEEEGLWPELLDSGRIEICVSDWWGARHDSGCMYRLLVQLLDANQTVLDKFSAVPDPIPQWNNNACLHVTHVFSNIKMGVRFVSFEHRGQDTQFWAGHYGARVTNSSVIVRVRLS

SEQ ID NO: 864454 - protein, 95 aa, Homo sapiens
GHKPFLFHRRPPKVDGATRWGRLGGGGKQDNRAWGPFSDVLRDFIQVNAPAIQRSGPLLRKACLFSLPCLLHSQLVLQEAGLGPRGGGSVARTAG

SEQ ID NO: 864455 - protein, 159 aa, Homo sapiens
MGASVSRGRAARVPAPEPEPEEALDLSQLPPELLLVVLSHVPPRTLLGRCRQVCRGWRALVDGQALWLLILARDHGATGRALLHLARSCQSPARNARPCPLGRFCARRPIGRNLIRNPCGQEGLRKWMVQHGGDGWVVEENRTTVPGAPSQTCFVTSFR

SEQ ID NO: 864456 - protein, 290 aa, Homo sapiens
MGASVSRGRAARVPAPEPEPEEALDLSQLPPELLLVVLSHVPPRTLLGRCRQVCRGWRALVDGQALWLLILARDHGATGRALLHLARSCQSPARNARPCPLGRFCARRPIGRNLIRNPCGQEGLRKWMVQHGGDGWVVEENRTTVPGAPSQTCFVTSFSWCCKKQVLDLEEEGLWPELLDSGRIEICVSDWWGARHDSGCMYRLLVQLLDANQTVLDKFSAVPDPIPQWNNNACLHRHSFTMLPGLVLNSCAQAILSPQPPTVLGLQAQATASSPCVFLSAPIPALRLTR

SEQ ID NO: 864457 - protein, 290 aa, Homo sapiens; identical to SEQ ID NO: 864456

SEQ ID NO: 864458 - protein, 351 aa, Homo sapiens
MGASVSRGRAARVPAPEPEPEEALDLSQLPPELLLVVLSHVPPRTLLGRCRQVCRGWRALVDGQALWLLILARDHGATGRALLHLARSCQSPARNARPCPLGRFCARRPIGRNLIRNPCGQEGLRKWMVQHGGDGWVVEENRTTVPGAPSQTCFVTSFSWCCKKQVLDLEEEGLWPELLDSGRIEICVSDWWGARHDSGCMYRLLVQLLDANQTVLDKFSAVPDPIPQWNNNACLHRHSFTMLPGLVLNSCAQAILSPQPPTVLGLQAQATASSPCVFLSAPIPALRLTRRSLTVSPRLECSGVISAHCKLCLPGSRHSPASASRVAGTTGAHHHTRLIFRIFSRDGVSPY

SEQ ID NO: 864459 - protein, 283 aa, Homo sapiens; identical to SEQ ID NO: 864453

SEQ ID NO: 864460 - protein, 171 aa, Homo sapiens
LGTSLFYFTEGLRKWMVQHGGDGWVVEENRTTVPGAPSQTCFVTSFSWCCKKQVLDLEEEGLWPELLDSGRIEICVSDWWGARHDSGCMYRLLVQLLDANQTVLDKFSAVPDPIPQWNNNACLHVTHVFSNIKMGVRFVSFEHRGQDTQFWAGHYGARVTNSSVIVRVRLS

SEQ ID NO: 864461 - protein, 244 aa, Homo sapiens
MGASVSRGRAARVPAPEPEPEEALDLSQLPPELLLVVLSHVPPRTLLGRCRQVCRGWRALVDGQALWLLILARDHGATGRALLHLARSCQSPARNARPCPLGRFCARRPIGRNLIRNPCGQEGLRKWMVQHGGDGWVVEENRTTVPGAPSQTCFVTSFSWCCKKQVLDLEEEGLWPELLDSGRIEICVSDWWGARHDSGCMYRLLVQLLDANQTVLDKFSAVPDPIPQWNNNACLHCSSMLNSS

SEQ ID NO: 864462 - protein, 208 aa, Homo sapiens
SRRGAPPGPGVGLGVRCRCGRRGGLIACNSGHTHRPRGLRDIGAIKDGLGDGDLGTGPRDGEDGGAAGRIRAGRGCAPRRLLVPDALTLPLPAATAGPGGGTMGASVSRGRAARVPAPEPEPEEALDLSQLPPELLLVVLSHVPPRTLLGRCRQVCRGWRALVDGQALWLLILARDHGATGRALLHLARSCQSPARNARPCPLGRFCA

SEQ ID NO: 864463 - protein, 407 aa, Homo sapiens
MAAKMEITLSSNTEASSKQERHIIAKLEEKRGPPLQKNCPDPELCRQSFRRFCYQEVSGPQEALSQLRQLCRQWLQPELHTKEQILELLVMEQFLTILPPEIQARVRHRCPMSSKEIVTLVEDFHRASKKPKQWVAVCMQGQKVLLEKTGSQLGEQELPDFQPQTPRRDLRESSPAEPSQAGAYDRLSPHHWEKSPLLQEPTPKLAGTEAPRMRSDNKENPQQEGAKGAKPCAVSAGRSKGNGLQNPEPRGANMSEPRLSRRQVSSPNAQKPFAHYQRHCRVEYISSPLKSHPLRELKKSKGGKRSLSNRLQHLGHQPTRSAKKPYKCDDCGKSFTWNSELKRHKRVHTGERPYTCGECGNCFGRQSTLKLHQRIHTGEKPYQCGQCGKSFRQSSNLHQHHRLHHGD

SEQ ID NO: 864464 - protein, 407 aa, Homo sapiens; identical to SEQ ID NO: 864463

SEQ ID NO: 864465 - protein, 234 aa, Homo sapiens
MAAKMEITLSSNTEASSKQERHIIAKLEEKRGPPLQKNCPDPELCRQSFRRFCYQEVSGPQEALSQLRQLCRQWLQPELHTKEQILELLVMEQFLTILPPEIQARVRHRCPMSSKEIVTLVEDFHRASKKPKQWVAVCMQGQKVLLEKTGSQLGEQELPDFQPQTPRRDLRESSPAEPSQAGAYDRLSPHHWEKSPLLQEPTPKLAGTELLIEKTDPNMATDELPCKLWLSFIA

SEQ ID NO: 864466 - protein, 249 aa, Homo sapiens
MAAKMEITLSSNTEASSKQERHIIAKLEEKRGPPLQKNCPDPELCRQSFRRFCYQEVSGPQEALSQLRQLCRQWLQPELHTKEQILELLVMEQFLTILPPEIQARVRHRCPMSSKEIVTLVEDFHRASKKPKQWVAVCMQGQKVLLEKTGSQLGEQELPDFQPQTPRRDLRESSPAEPSQAGAYDRLSPHHWEKSPLLQEPTPKLAGTGKHSAFSLPLISPLSPSMYLMVLQRHRPHVCVFLNVIYNSR

SEQ ID NO: 864467 - protein, 407 aa, Homo sapiens; identical to SEQ ID NO: 864463

SEQ ID NO: 864468 - protein, 234 aa, Homo sapiens; identical to SEQ ID NO: 864465

SEQ ID NO: 864469 - protein, 249 aa, Homo sapiens; identical to SEQ ID NO: 864466

SEQ ID NO: 864470 - protein, 848 aa, Homo sapiens
MNSSSANITYASRKRRKPVQKTVKPIPAEGIKSNPSKRHRDRLNTELDRLASLLPFPQDVINKLDKLSVLRLSVSYLRAKSFFDVALKSSPTERNGGQDNCRAANFREGLNLQEGEFLLQALNGFVLVVTTDALVFYASSTIQDYLGFQQSDVIHQSVYELIHTEDRAEFQRQLHWALNPSQCTESGQGIEEATGLPQTVVCYNPDQIPPENSPLMERCFICRLRCLLDNSSGFLAMNFQGKLKYLHGQKKKGKDGSILPPQLALFAIATPLQPPSILEIRTKNFIFRTKHKLDFTPIGCDAKGRIVLGYTEAELCTRGSGYQFIHAADMLYCAESHIRMIKTGESGMIVFRLLTKNNRWTWVQSNARLLYKNGRPDYIIVTQRPLTDEEGTEHLRKRNTKLPFMFTTGEAVLYEATNPFPAIMDPLPLRTKNGTSGKDSATTSTLSKDSLNPSSLLAAMMQQDESIYLYPASSTSSTAPFENNFFNESMNECRNWQDNTAPMGNDTILKHEQIDQPQDVNSFAGGHPGLFQDSKNSDLYSIMKNLGIDFEDIRHMQNEKFFRNDFSGEVDFRDIDLTDEILTYVQDSLSKSPFIPSDYQQQQSLALNSSCMVQEHLHLEQQQQHHQKQVVVEPQQQLCQKMKHMQVNGMFENWNSNQFVPFNCPQQDPQQYNVFTDLHGISQEFPYKSEMDSMPYTQNFISCNQPVLPQHSKCTELDYPMGSFEPSPYPTTSSLEDFVTCLQLPENQKHGLNPQSAIITPQTCYAGAVSMYQCQPEPQHTHVGQMQYNPVLPGQQAFLNKFQNGVLNETYPAELNNINNTQTTTHLQPLHHPSEARPFPDLTSSGFL

SEQ ID NO: 864471 - protein, 848 aa, Homo sapiens; identical to SEQ ID NO: 864470

SEQ ID NO: 864472 - protein, 848 aa, Homo sapiens; identical to SEQ ID NO: 864470

SEQ ID NO: 864473 - protein, 833 aa, Homo sapiens
MPAKLLRVKPIPAEGIKSNPSKRHRDRLNTELDRLASLLPFPQDVINKLDKLSVLRLSVSYLRAKSFFDVALKSSPTERNGGQDNCRAANFREGLNLQEGEFLLQALNGFVLVVTTDALVFYASSTIQDYLGFQQSDVIHQSVYELIHTEDRAEFQRQLHWALNPSQCTESGQGIEEATGLPQTVVCYNPDQIPPENSPLMERCFICRLRCLLDNSSGFLAMNFQGKLKYLHGQKKKGKDGSILPPQLALFAIATPLQPPSILEIRTKNFIFRTKHKLDFTPIGCDAKGRIVLGYTEAELCTRGSGYQFIHAADMLYCAESHIRMIKTGESGMIVFRLLTKNNRWTWVQSNARLLYKNGRPDYIIVTQRPLTDEEGTEHLRKRNTKLPFMFTTGEAVLYEATNPFPAIMDPLPLRTKNGTSGKDSATTSTLSKDSLNPSSLLAAMMQQDESIYLYPASSTSSTAPFENNFFNESMNECRNWQDNTAPMGNDTILKHEQIDQPQDVNSFAGGHPGLFQDSKNSDLYSIMKNLGIDFEDIRHMQNEKFFRNDFSGEVDFRDIDLTDEILTYVQDSLSKSPFIPSDYQQQQSLALNSSCMVQEHLHLEQQQQHHQKQVVVEPQQQLCQKMKHMQVNGMFENWNSNQFVPFNCPQQDPQQYNVFTDLHGISQEFPYKSEMDSMPYTQNFISCNQPVLPQHSKCTELDYPMGSFEPSPYPTTSSLEDFVTCLQLPENQKHGLNPQSAIITPQTCYAGAVSMYQCQPEPQHTHVGQMQYNPVLPGQQAFLNKFQNGVLNETYPAELNNINNTQTTTHLQPLHHPSEARPFPDLTSSGFL

SEQ ID NO: 864474 - protein, 848 aa, Homo sapiens; identical to SEQ ID NO: 864470

SEQ ID NO: 864475 - protein, 577 aa, Homo sapiens
MNSSSANITYASRKRRKPVQKTVKPIPAEGIKSNPSKRHRDRLNTELDRLASLLPFPQDVINKLDKLSVLRLSVSYLRAKSFFDVALKSSPTERNGGQDNCRAANFREGLNLQEGEFLLQALNGFVLVVTTDALVFYASSTIQDYLGFQQSDVIHQSVYELIHTEDRAEFQRQLHWALNPSQCTESGQGIEEATGLPQTVVCYNPDQIPPENSPLMERCFICRLRCLLDNSSGFLAMNFQGKLKYLHGQKKKGKDGSILPPQLALFAIATPLQPPSILEIRTKNFIFRTKHKLDFTPIGCDAKGRIVLGYTEAELCTRGSGYQFIHAADMLYCAESHIRMIKTGESGMIVFRLLTKNNRWTWVQSNARLLYKNGRPDYIIVTQRPLTDEEGTEHLRKRNTKLPFMFTTGEAVLYEATNPFPAIMDPLPLRTKNGTSGKDSATTSTLSKDSLNPSSLLAAMMQQDESIYLYPASSTSSTAPFENNFFNESMNECRNWQDNTAPMGNDTILKHEQIDQPQDVNSFAGGHPGLFQDSKNSDLYSIMKNLGIDFEDIRHMQKAKIMSKDFVCWYSSQETAT

SEQ ID NO: 864476 - protein, 848 aa, Homo sapiens; identical to SEQ ID NO: 864470

SEQ ID NO: 864477 - protein, 848 aa, Homo sapiens; identical to SEQ ID NO: 864470

SEQ ID NO: 864478 - protein, 633 aa, Homo sapiens
MERCFICRLRCLLDNSSGFLAMNFQGKLKYLHGQKKKGKDGSILPPQLALFAIATPLQPPSILEIRTKNFIFRTKHKLDFTPIGCDAKGRIVLGYTEAELCTRGSGYQFIHAADMLYCAESHIRMIKTGESGMIVFRLLTKNNRWTWVQSNARLLYKNGRPDYIIVTQRPLTDEEGTEHLRKRNTKLPFMFTTGEAVLYEATNPFPAIMDPLPLRTKNGTSGKDSATTSTLSKDSLNPSSLLAAMMQQDESIYLYPASSTSSTAPFENNFFNESMNECRNWQDNTAPMGNDTILKHEQIDQPQDVNSFAGGHPGLFQDSKNSDLYSIMKNLGIDFEDIRHMQNEKFFRNDFSGEVDFRDIDLTDEILTYVQDSLSKSPFIPSDYQQQQSLALNSSCMVQEHLHLEQQQQHHQKQVVVEPQQQLCQKMKHMQVNGMFENWNSNQFVPFNCPQQDPQQYNVFTDLHGISQEFPYKSEMDSMPYTQNFISCNQPVLPQHSKCTELDYPMGSFEPSPYPTTSSLEDFVTCLQLPENQKHGLNPQSAIITPQTCYAGAVSMYQCQPEPQHTHVGQMQYNPVLPGQQAFLNKFQNGVLNETYPAELNNINNTQTTTHLQPLHHPSEARPFPDLTSSGFL

SEQ ID NO: 864479 - protein, 548 aa, Homo sapiens
MNSSSANITYASRKRRKPVQKTVKPIPAEGIKSNPSKRHRDRLNTELDRLASLLPFPQDVINKLDKLSVLRLSVSYLRAKSFFDVALKSSPTERNGGQDNCRAANFREGLNLQEGEFLLQALNGFVLVVTTDALVFYASSTIQDYLGFQQSDVIHQSVYELIHTEDRAEFQRQLHWALNPSQCTESGQGIEEATGLPQTVVCYNPDQIPPENSPLMERCFICRLRCLLDNSSGFLAMNFQGKLKYLHGQKKKGKDGSILPPQLALFAIATPLQPPSILEIRTKNFIFRTKHKLDFTPIGCDAKGRIVLGYTEAELCTRGSGYQFIHAADMLYCAESHIRMIKTGESGMIVFRLLTKNNRWTWVQSNARLLYKNGRPDYIIVTQRPLTDEEGTEHLRKRNTKLPFMFTTGEAVLYEATNPFPAIMDPLPLRTKNGTSGKDSATTSTLSKDSLNPSSLLAAMMQQDESIYLYPASSTSSTAPFENNFFNESMNECRNWQDNTAPMGNDTILKHEQIDQPQDVNSFAGGHPGVSPVSKISDSAERRFTLRN

SEQ ID NO: 864480 - protein, 85 aa, Homo sapiens
CTPPAASVSLSVVLRMLGPRSSGLEAQGPSREGHHPRHGAAATAQSTGQRKLQDEDNSITRRKPGSLCYHKEERCLTKTVCKDFV

SEQ ID NO: 864481 - protein, 113 aa, Homo sapiens
FRFNTRAAAGASSILGQLILVISWRFTLLQKPECKRLFPVPSPRGSNQLRGTEPPSIQSASPLGSQGNDGWLLKPILDKLTPKNENFQGTGTLSWGTLGHIIPHSIQIKNTFY

SEQ ID NO: 864482 - protein, 1076 aa, Homo sapiens [sequence omitted]

SEQ ID NO: 864483 - protein, 211 aa, Homo sapiens
MDLRTMTQSLVTLAEDNIAFFSSQGPGETAQRLSGVFAGVREQALGLEPALGRLLGVAHLFDLDPETPANGYRSLVHTARCCLAHLLHKSRYVASNRRSIFFRTSHNLAELEAYLAALTQLRALVYYAQRLLVTNRPGVLFFEGDEGLTADFLREYVTLHKGCFYGRCLGFQFTPAIRPFLQTISIGLVSFGEHYKRNETGLSESQPGSTR

SEQ ID NO: 864484 - protein, 1000 aa, Homo sapiens
MEPGSKSVSRSDWQPEPHQRPITPLEPGPEKTPIAQPESKTLQGSNTQQKPASNQRPLTQQETPAQHDAESQKEPRAQQKSASQEEFLAPQKPAPQQSPYIQRVLLTQQEAASQQGPGLGKESITQQEPALRQRHVAQPGPGPGEPPPAQQEAESTPAAQAKPGAKREPSAPTESTSQETPEQSDKQTTPVQGAKSKQGSLTELGFLTKLQELSIQRSALEWKALSEWVADSESESDVGSSSDTDSPATMGGMVAQGVKLGFKGKSGYKVMSGYSGTSPHEKTSARNHRHYQDTASRLIHNMDLRTMTQSLVTLAEDNIAFFSSQGPGETAQRLSGVFAGVREQALGLEPALGRLLGVAHLFDLDPETPANGYRSLVHTARCCLAHLLHKSRYVASNRRSIFFRTSHNLAELEAYLAALTQLRALVYYAQRLLVTNRPGVLFFEGDEGLTADFLREYVTLHKGCFYGRCLGFQFTPAIRPFLQTISIGLVSFGEHYKRNETGLSVAASSLFTSGRFAIDPELRGAEFERITQNLDVHFWKAFWNITEMEVLSSLANMASATVRVSRLLSLPPEAFEMPLTADPTLTVTISPPLAHTGPGPVLVRLISYDLREGQDSEELSSLIKSNGQRSLELWPRPQQAPRSRSLIVHFHGGGFVAQTSRSHEPYLKSWAQELGAPIISIDYSLAPEAPFPRALEECFFAYCWAIKHCALLGAKTEDHSNSDQKALGMMGLVRRDTALLLRDFRLGASSWLNSFLELSGRKSQKMSEPIAEPMRRSVSEAALAQPQGPLGTDSLKNLTLRDLSLRGNSETSSDTPEMSLSAETLSPSTPSDVNFLLPPEDAGEEAEAKNELSPMDRGLGVRAAFPEGFHPRRSSQGATQMPLYSSPIVKNPFMSPLLAPDSMLKSLPPVHIVACALDPMLDDSVMLARRLRNLGQPVTLRVVEDLPHGFLTLAALCRETRQAAELCVERIRLVLTPPAGAGPSGETGAAGVDGGCGGRH

SEQ ID NO: 864485 - protein, 775 aa, Homo sapiens
MDLRTMTQSLVTLAEDNIAFFSSQGPGETAQRLSGVFAGVREQALGLEPALGRLLGVAHLFDLDPETPANGYRSLVHTARCCLAHLLHKSRYVASNRRSIFFRTSHNLAELEAYLAALTQLRALVYYAQRLLVTNRPGVLFFEGDEGLTADFLREYVTLHKGCFYGRCLGFQFTPAIRPFLQTISIGLVSFGEHYKRNETGLSVAASSLFTSGRFAIDPELRGAEFERITQNLDVHFWKAFWNITEMEVLSSLANMASATVRVSRLLSLPPEAFEMPLTADPTLTVTISPPLAHTGPGPVLVRLISYDLREGQDSEELSSLIKSNGQRSLELWPRPQQAPRSRSLIVHFHGGGFVAQTSRSHEPYLKSWAQELGAPIISIDYSLAPEAPFPRALEECFFAYCWAIKHCALLGSTGERICLAGDSAGGNLCFTVALRAAAYGVRVPDGIMAAYPATMLQPAASPSRLLSLMDPLLPLSVLSKCVSAYAGAKTEDHSNSDQKALGMMGLVRRDTALLLRDFRLGASSWLNSFLELSGRKSQKMSEPIAEPMRRSVSEAALAQPQGPLGTDSLKNLTLRDLSLRGNSETSSDTPEMSLSAETLSPSTPSDVNFLLPPEDAGEEAEAKNELSPMDRGLGVRAAFPEGFHPRRSSQGATQMPLYSSPIVKNPFMSPLLAPDSMLKSLPPVHIVACALDPMLDDSVMLARRLRNLGQPVTLRVVEDLPHGFLTLAALCRETRQAAELCVERIRLVLTPPAGAGPSGETGAAGVDGGCGGRH

SEQ ID NO: 864486 - protein, 775 aa, Homo sapiens; identical to SEQ ID NO: 864485

SEQ ID NO: 864487 - protein, 665 aa, Homo sapiens
MRASWTRVPARIPYSLCDQGQRMPSVFPTWGMLQAPMFRAPALLRGKGGRRLAGVTQRGSLAFTPAIRPFLQTISIGLVSFGEHYKRNETGLSVAASSLFTSGRFAIDPELRGAEFERITQNLDVHFWKAFWNITEMEVLSSLANMASATVRVSRLLSLPPEAFEMPLTADPTLTVTISPPLAHTGPGPVLVRLISYDLREGQDSEELSSLIKSNGQRSLELWPRPQQAPRSRSLIVHFHGGGFVAQTSRSHEPYLKSWAQELGAPIISIDYSLAPEAPFPRALEECFFAYCWAIKHCALLGSTGERICLAGDSAGGNLCFTVALRAAAYGVRVPDGIMAAYPATMLQPAASPSRLLSLMDPLLPLSVLSKCVSAYAGAKTEDHSNSDQKALGMMGLVRRDTALLLRDFRLGASSWLNSFLELSGRKSQKMSEPIAEPMRRSVSEAALAQPQGPLGTDSLKNLTLRDLSLRGNSETSSDTPEMSLSAETLSPSTPSDVNFLLPPEDAGEEAEAKNELSPMDRGLGVRAAFPEGFHPRRSSQGATQMPLYSSPIVKNPFMSPLLAPDSMLKSLPPVHIVACALDPMLDDSVMLARRLRNLGQPVTLRVVEDLPHGFLTLAALCRETRQAAELCVERIRLVLTPPAGAGPSGETGAAGVDGGCGGRH

SEQ ID NO: 864488 - protein, 58 aa, Homo sapiens
MASATVRVSRLLSLPPEAFEMPLTADPTLTVTISPPLAHTGPGPVLVRLISYDLREGQ

SEQ ID NO: 864489 - protein, 682 aa, Homo sapiens
MEPGSKSVSRSDWQPEPHQRPITPLEPGPEKTPIAQPESKTLQGSNTQQKPASNQRPLTQQETPAQHDAESQKEPRAQQKSASQEEFLAPQKPAPQQSPYIQRVLLTQQEAASQQGPGLGKESITQQEPALRQRHVAQPGPGPGEPPPAQQEAESTPAAQAKPGAKREPSAPTESTSQETPEQSDKQTTPVQGAKSKQGSLTELGFLTKLQELSIQRSALEWKALSEWVADSESESDVGSSSDTDSPATMGGMVAQGVKLGFKGKSGYKVMSGYSGTSPHEKTSARNHRHYQDTASRLIHNMDLRTMTQSLVTLAEDNIAFFSSQGPGETAQRLSGVFAGVREQALGLEPALGRLLGVAHLFDLDPETPANGYRSLVHTARCCLAHLLHKSRYVASNRRSIFFRTSHNLAELEAYLAALTQLRALVYYAQRLLVTNRPGVLFFEGDEGLTADFLREYVTLHKGCFYGRCLGFQFTPAIRPFLQTISIGLVSFGEHYKRNETGLSVAASSLFTSGRFAIDPELRGAEFERITQNLDVHFWKAFWNITEMEVLSSLANMASATVRVSRLLSLPPEAFEMPLTADPTLTVTISPPLAHTGPGPVLVRLISYDLREGQDSEELSSLIKSNGQRSLELWPRPQQAPRSRSLIVHFHGGGFVAQTSRSHEPYLKSWAQELGAPIISID

SEQ ID NO: 864490 - protein, 525 aa, Homo sapiens
MEPGSKSVSRSDWQPEPHQRPITPLEPGPEKTPIAQPESKTLQGSNTQQKPASNQRPLTQQETPAQHDAESQKEPRAQQKSASQEEFLAPQKPAPQQSPYIQRVLLTQQEAASQQGPGLGKESITQQEPALRQRHVAQPGPGPGEPPPAQQEAESTPAAQAKPGAKREPSAPTESTSQETPEQSDKQTTPVQGAKSKQGSLTELGFLTKLQELSIQRSALEWKALSEWVADSESESDVGSSSDTDSPATMGGMVAQGVKLGFKGKSGYKVMSGYSGTSPHEKTSARNHRHYQDTASRLIHNMDLRTMTQSLVTLAEDNIAFFSSQGPGETAQRLSGVFAGVREQALGLEPALGRLLGVAHLFDLDPETPANGYRSLVHTARCCLAHLLHKSRYVASNRRSIFFRTSHNLAELEAYLAALTQLRALVYYAQRLLVTNRPGVLFFEGDEGLTADFLREYVTLHKGCFYGRCLGFQFTPAIRPFLQTISIGLVSFGEHYKRNETGLSVAASSLFTQRPLCHRPRAAWG

SEQ ID NO: 864491 - protein, 271 aa, Homo sapiens
MGLVRRDTALLLRDFRLGASSWLNSFLELSGRKSQKMSEPIAEPMRRSVSEAALAQPQGPLGTDSLKNLTLRDLSLRGNSETSSDTPEMSLSAETLSPSTPSDVNFLLPPEDAGEEAEAKNELSPMDRGLGVRAAFPEGFHPRRSSQGATQMPLYSSPIVKNPFMSPLLAPDSMLKSLPPVHIVACALDPMLDDSVMLARRLRNLGQPVTLRVVEDLPHGFLTLAALCRETRQAAELCVERIRLVLTPPAGAGPSGETGAAGVDGGCGGRH

SEQ ID NO: 864492 - protein, 69 aa, Homo sapiens
ARYPRAPVSIHQASSTTGSLHETHHDYCNRADCYVEIQRGARGLMNGYRGPANGFRGKKIKKEVLMTFY

SEQ ID NO: 864493 - protein, 709 aa, Homo sapiens
MPSATSHSGSGSKSSGPPPPSGSSGSEAAAGAGAAAPASQHPATGTGAVQTEAMKQILGVIDKKLRNLEKKKGKLDDYQERMNKGERLNQDQLDAVSKYQEVTNNLEFAKELQRSFMALSQDIQKTIKKTARREQLMREEAEQKRLKTVLELQYVLDKLGDDEVRTDLKQGLNGVPILSEEELSLLDEFYKLVDPERDMSLRLNEQYEHASIHLWDLLEGKEKPVCGTTYKVLKEIVERVFQSNYFDSTHNHQNGLCEEEEAASAPAVEDQVPEAEPEPAEEYTEQSEVESTEYVNRQFMAETQFTSGEKEQVDEWTVETVEVVNSLQQQPQAASPSVPEPHSLTPVAQADPLVRRQRVQDLMAQMQGPYNFIQDSMLDFENQTLDPAIVSAQPMNPTQNMDMPQLVCPPVHSESRLAQPNQVPVQPEATQVPLVSSTSEGYTASQPLYQPSHATEQRPQKEPIDQIQATISLNTDQTTASSSLPAASQPQVFQAGTSKPLHSSGINVNAAPFQSMQTVFNMNAPVPPVNEPETLKQQNQYQASYNQSFSSQPHQVEQTELQQEQLQTVVGTYHGSPDQSHQVTGNHQQPPQQNTGFPRSNQPYYNSRGVSRGGSRGARGLMNGYRGPANGFRGGYDGYRPSFSNTPNSGYTQSQFSAPRDYSGYQRDGYQQNFKRGSGQSGPRGAPRGRGGPPRPNRGMPQMNTQQVN

SEQ ID NO: 864494 - protein, 709 aa, Homo sapiens; identical to SEQ ID NO: 864493

SEQ ID NO: 864495 - protein, 709 aa, Homo sapiens; identical to SEQ ID NO: 864493

SEQ ID NO: 864496 - protein, 694 aa, Homo sapiens
MPSATSHSGSGSKSSGPPPPSGSSGSEAAAGAGAAAPASQHPATGTGAVQTEAMKQILGVIDKKLRNLEKKKGKLDDYQERMNKGERLNQDQLDAVSKYQEVTNNLEFAKELQRSFMALSQDIQKTIKKTARREQLMREEAEQKRLKTVLELQYVLDKLGDDEVRTDLKQGLNGVPILSEEELSLLDEFYKLVDPERDMSLRLNEQYEHASIHLWDLLEGKEKPVCGTTYKVLKEIVERVFQSNYFDSTHNHQNGLCEEEEAASAPAVEDQVPEAEPEPAEEYTEQSEVESTEYVNRQFMAETQFTSGEKEQVDEWTVETVEVVNSLQQQPQAASPSVPEPHSLTPVAQADPLVRRQRVQDLMAQMQGPYNFIQDSMLDFENQTLDPAIVSAQPMNPTQNMDMPQLVCPPVHSESRLAQPNQVPVQPEATQVPLVSSTSEGYTASQPLYQPSHATEQRPQKEPIDQIQATISLNTDQTTASSSLPAASQPQVFQAGTSKPLHSSGINVNAAPFQSMQTVFNMNAPVPPVNEPETLKQQNQYQASYNQSFSSQPHQVEQTELQQEQLQTVVGTYHGSPDQSHQVTGNHQQPPQQNTGFPRSNQPYYNSRGVSRGGSRGARGLMNGYRGPANGFRGGYDGYRPSFSNTPNSGYTQSQFSAPRDYSGYQRDGYQQNFKRGSGQSGPRGAPRGNILWW

SEQ ID NO: 864497 - protein, 698 aa, Homo sapiens
MPSATSHSGSGSKSSGPPPPSGSSGSEAAAGAGAAAPASQHPATGTGAVQTEAMKQILGVIDKKLRNLEKKKGKLDDYQERMNKGERLNQDQLDAVSKYQEVTNNLEFAKELQRSFMALSQDIQKTIKKTARREQLMREEAEQKRLKTVLELQYVLDKLGDDEVRTDLKQGLNGVPILSEEELSLLDEFYKLVDPERDMSLRLNEQYEHASIHLWDLLEGKEKPVCGTTYKVLKEIVERVFQSNYFDSTHNHQNGLCEEEEAASAPAVEDQVPEAEPEPAEEYTEQSEVESTEYVNRQFMAETQFTSGEKEQVDEWTVETVEVVNSLQQQPQAASPSVPEPHSLTPVAQADPLVRRQRVQDLMAQMQGPYNFIQDSMLDFENQTLDPAIVSAQPMNPTQNMDMPQLVCPPVHSESRLAQPNQVPVQPEATQVPLVSSTSEGYTASQPLYQPSHATEQRPQKEPIDQIQATISLNTDQTTASSSLPAASQPQVFQAGTSKPLHSSGINVNAAPFQSMQTVFNMNAPVPPVNEPETLKQQNQYQASYNQSFSSQPHQVEQTELQQEQLQTVVGTYHGSPDQSHQVTGNHQQPPQQNTGFPRSNQPYYNSRGVSRGGSRGARGLMNGYRGPANGFRGGYDGYRPSFSNTPNSGYTQSQFSAPRDYSGYQRDGYQQNFKRGGRGGPPRPNRGMPQMNTQQVN

SEQ ID NO: 864498 - protein, 692 aa, Homo sapiens
MPSATSHSGSGSKSSGPPPPSGSSGSEAAAGAGAAAPASQHPATGTGAVQTEAMKQILGVIDKKLRNLEKKKGKLDDYQERMNKGERLNQDQLDAVSKYQEVTNNLEFAKELQRSFMALSQDIQKTIKKTARREQLMREEAEQKRLKTVLELQYVLDKLGDDEVRTDLKQGLNGVPILSEEELSLLDEFYKLVDPERDMSLRLNEQYEHASIHLWDLLEGKEKPVCGTTYKVLKEIVERVFQSNYFDSTHNHQNGLCEEEEAASAPAVEDQVPEAEPEPAEEYTEQSEVESTEYVNRQFMAETQFTSGEKEQVDEWTVETVEVVNSLQQQPQAASPSVPEPHSLTPVAQADPLVRRQRVQDLMAQMQGPYNFIQDSMLDFENQTLDPAIVSAQPMNPTQNMDMPQLVCPPVHSESRLAQPNQVPVQPEATQVPLVSSTSEGYTASQPLYQPSHATEQRPQKEPIDQIQATISLNTDQTTASSSLPAASQPQVFQAGTSKPLHSSGINVNAAPFQSMQTVFNMNAPVPPVNEPETLKQQNQYQASYNQSFSSQPHQVEQTELQQEQLQTVVGTYHGSPDQSHQVTGNHQQPPQQNTGFPRSNQPYYNSRGVSRGGSRGARGLMNGYRGPANGFRGGYDGYRPSFSNTPNSGYTQSQFSAPRDYSGYQPLGRVDHGEPHEVVEGPQDPTEGCRK

SEQ ID NO: 864499 - protein, 709 aa, Homo sapiens; identical to SEQ ID NO: 864493

SEQ ID NO: 864500 - protein, 671 aa, Homo sapiens
MPSATSHSGSGSKSSGPPPPSGSSGSEAAAGAGAAAPASQHPATGTGAVQTEAMKQILGVIDKKLRNLEKKKGKLDDYQERMNKGERLNQDQLDAVSKYQEVTNNLEFAKELQRSFMALSQDIQKTIKKTARREQLMREEAEQKRLKTVLELQYVLDKLGDDEVRTDLKQGLNGVPILSEEELSLLDEFYKLVDPERDMSLRLNEQYEHASIHLWDLLEGKEKPVCGTTYKVLKEIVERVFQSNYFDSTHNHQNGLCEEEEAASAPAVEDQVPEAEPEPAEEYTEQSEVESTEYVNRQFMAETQFTSGEKEQVDEWTVETVEVVNSLQQQPQAASPSVPEPHSLTPVAQADPLVRRQRVQDLMAQMQGPYNFIQDSMLDFENQTLDPAIVSAQPMNPTQNMDMPQLVCPPVHSESRLAQPNQVPVQPEATQVPLVSSTSEGYTASQPLYQPSHATEQRPQKEPIDQIQATISLNTDQTTASSSLPAASQPQVFQAGTSKPLHSSGINVNAAPFQSMQTVFNMNAPVPPVNEPETLKQQNQYQASYNQSFSSQPHQVEQTELQQEQLQTVVGTYHGSPDQSHQVTGNHQQPPQQNTGFPRSNQPYYNSRGARGLMNGYRGPANGFRGGYDGYRPSFSNTPNSGYTQSQFSAPRDYSGYQRDAANEHSASELI

SEQ ID NO: 864501 - protein, 709 aa, Homo sapiens; identical to SEQ ID NO: 864493

SEQ ID NO: 864502 - protein, 709 aa, Homo sapiens; identical to SEQ ID NO: 864493

SEQ ID NO: 864503 - protein, 709 aa, Homo sapiens; identical to SEQ ID NO: 864493

SEQ ID NO: 864504 - protein, 561 aa, Homo sapiens
MPSATSHSGSGSKSSGPPPPSGSSGSEAAAGAGAAAPASQHPATGTGAVQTEAMKQILGVIDKKLRNLEKKKGKLDDYQERMNKGERLNQDQLDAVSKYQEVTNNLEFAKELQRSFMALSQDIQKTIKKTARREQLMREEAEQKRLKTVLELQYVLDKLGDDEVRTDLKQGLNGVPILSEEELSLLDEFYKLVDPERDMSLRLNEQYEHASIHLWDLLEGKEKPVCGTTYKVLKEIVERVFQSNYFDSTHNHQNGLCEEEEAASAPAVEDQVPEAEPEPAEEYTEQSEVESTEYVNRQFMAETQFTSGEKEQVDEWTVETVEVVNSLQQQPQAASPSVPEPHSLTPVAQADPLVRRQRVQDLMAQMQGPYNFIQDSMLDFENQTLDPAIVSAQPMNPTQNMDMPQLVCPPVHSESRLAQPNQVPVQPEATQVPLVSSTSEGYTASQPLYQPSHATEQRPQKEPIDQIQATISLNTDQTTASSSLPAASQPQVFQAGTSKPLHSSGINVNAAPFQSMQTVFNMNAPVPPVNEPVYHNMLPEELLSICSPFQETYCKGTVFIP

SEQ ID NO: 864505 - protein, 709 aa, Homo sapiens; identical to SEQ ID NO: 864493

SEQ ID NO: 864506 - protein, 694 aa, Homo sapiens; identical to SEQ ID NO: 864496

SEQ ID NO: 864507 - protein, 692 aa, Homo sapiens; identical to SEQ ID NO: 864498

SEQ ID NO: 864508 - protein, 120 aa, Homo sapiens
MPSATSHSGSGSKSSGPPPPSGSSGSEAAAGAGAAAPASQHPATGTGAVQTEAMKQILGVIDKKLRNLEKKKPDSDAALYPRPLYYSSAVGPAFWPLGVGHVRVGACRQDFTVWCPSFRL

SEQ ID NO: 864509 - protein, 163 aa, Homo sapiens
AGSRHARYVSLTGRRFTTSRCFSLLGLKCPRHIHWKGFRTTPSGSSGSEAAAGAGAAAPASQHPATGTGAVQTEAMKQILGVIDKKLRNLEKKKVPGVGGEGRGGCGRALRPLRPWSLEPSLLFVSGALLGPLLPPPGPHAPSPRSAGASCPENGLLEEALVT

SEQ ID NO: 864510 - protein, 262 aa, Homo sapiens
MPSATSHSGSGSKSSGPPPPSGSSGSEAAAGAGAAAPASQHPATGTGAVQTEAMKQILGVIDKKLRNLEKKKGKLDDYQERMNKGERLNQDQLDAAGKAFGMPTMRLLSFVVLALFAVTQAEEGARLLVPNQLLNRYAVEGRELTLQYNIYNVGSSAALDLELSDDSFLQKTFGIVVWMVHVKWDRIGPVALSPHCGLRLFRLFFHFPSAHFTGRGGRGLVSQALARGLAAVDGVPFGGLVRSPGPLVPGMPRSWGAPQAQG

SEQ ID NO: 864511 - protein, 709 aa, Homo sapiens; identical to SEQ ID NO: 864493

SEQ ID NO: 864512 - protein, 731 aa, Homo sapiens
AGSRHARYVSLTGRRFTTSRCFSLLGLKCPRHIHWKGFRTTPSGSSGSEAAAGAGAAAPASQHPATGTGAVQTEAMKQILGVIDKKLRNLEKKKGKLDDYQERMNKGERLNQDQLDAVSKYQEVTNNLEFAKELQRSFMALSQDIQKTIKKTARREQLMREEAEQKRLKTVLELQYVLDKLGDDEVRTDLKQGLNGVPILSEEELSLLDEFYKLVDPERDMSLRLNEQYEHASIHLWDLLEGKEKPVCGTTYKVLKEIVERVFQSNYFDSTHNHQNGLCEEEEAASAPAVEDQVPEAEPEPAEEYTEQSEVESTEYVNRQFMAETQFTSGEKEQVDEWTVETVEVVNSLQQQPQAASPSVPEPHSLTPVAQADPLVRRQRVQDLMAQMQGPYNFIQDSMLDFENQTLDPAIVSAQPMNPTQNMDMPQLVCPPVHSESRLAQPNQVPVQPEATQVPLVSSTSEGYTASQPLYQPSHATEQRPQKEPIDQIQATISLNTDQTTASSSLPAASQPQVFQAGTSKPLHSSGINVNAAPFQSMQTVFNMNAPVPPVNEPETLKQQNQYQASYNQSFSSQPHQVEQTELQQEQLQTVVGTYHGSPDQSHQVTGNHQQPPQQNTGFPRSNQPYYNSRGVSRGGSRGARGLMNGYRGPANGFRGGYDGYRPSFSNTPNSGYTQSQFSAPRDYSGYQRDGYQQNFKRGSGQSGPRGAPRGRGGPPRPNRGMPQMNTQQVN

SEQ ID NO: 864513 - protein, 709 aa, Homo sapiens; identical to SEQ ID NO: 864493

SEQ ID NO: 864514 - protein, 724 aa, Homo sapiens
DDLLPLPLWLVAEGIVRARRPLEITSGQLRGQGWRSLPGSVARSVGAGRFALSLLHREPLLVRREPGAGGTQPASSPLGREGREKQKGKLDDYQERMNKGERLNQDQLDAVSKYQEVTNNLEFAKELQRSFMALSQDIQKTIKKTARREQLMREEAEQKRLKTVLELQYVLDKLGDDEVRTDLKQGLNGVPILSEEELSLLDEFYKLVDPERDMSLRLNEQYEHASIHLWDLLEGKEKPVCGTTYKVLKEIVERVFQSNYFDSTHNHQNGLCEEEEAASAPAVEDQVPEAEPEPAEEYTEQSEVESTEYVNRQFMAETQFTSGEKEQVDEWTVETVEVVNSLQQQPQAASPSVPEPHSLTPVAQADPLVRRQRVQDLMAQMQGPYNFIQDSMLDFENQTLDPAIVSAQPMNPTQNMDMPQLVCPPVHSESRLAQPNQVPVQPEATQVPLVSSTSEGYTASQPLYQPSHATEQRPQKEPIDQIQATISLNTDQTTASSSLPAASQPQVFQAGTSKPLHSSGINVNAAPFQSMQTVFNMNAPVPPVNEPETLKQQNQYQASYNQSFSSQPHQVEQTELQQEQLQTVVGTYHGSPDQSHQVTGNHQQPPQQNTGFPRSNQPYYNSRGVSRGGSRGARGLMNGYRGPANGFRGGYDGYRPSFSNTPNSGYTQSQFSAPRDYSGYQRDGYQQNFKRGSGQSGPRGAPRGRGGPPRPNRGMPQMNTQQVN

SEQ ID NO: 864515 - protein, 709 aa, Homo sapiens; identical to SEQ ID NO: 864493

SEQ ID NO: 864516 - protein, 694 aa, Homo sapiens; identical to SEQ ID NO: 864496

SEQ ID NO: 864517 - protein, 679 aa, Homo sapiens
MPSATSHSGSGSKSSGPPPPSGSSGSEAAAGAGAAAPASQHPATGTGAVQTEAMKQILGVIDKKLRNLEKKKGKLDDYQERMNKGERLNQDQLDAVSKYQEVTNNLEFAKELQRSFMALSQDIQKTIKKTARREQLMREEAEQKRLKTVLELQYVLDKLGDDEVRTDLKQGLNGVPILSEEELSLLDEFYKLVDPERDMSLRLNEQYEHASIHLWDLLEGKEKPVCGTTYKVLKEIVERVFQSNYFDSTHNHQNGLCEEEEAASAPAVEDQVPEAEPEPAEEYTEQSEVESTEYVNRQFMAETQFTSGEKEQVDEWTVETVEVVNSLQQQPQAASPSVPEPHSLTPVAQADPLVRRQRVQDLMAQMQGPYNFIQDSMLDFENQTLDPAIVSAQPMNPTQNMDMPQLVCPPVHSESRLAQPNQVPVQPEATQVPLVSSTSEGYTASQPLYQPSHATEQRPQKEPIDQIQATISLNTDQTTASSSLPAASQPQVFQAGTSKPLHSSGINVNAAPFQSMQTVFNMNAPVPPVNEPETLKQQNQYQASYNQSFSSQPHQVEQTELQQEQLQTVVGTYHGSPDQSHQVTGNHQQPPQQNTGFPRSNQPYYNSRGVSRGGSRGARGLMNGYRGPANGFRGGYDGYRPSFSNTPNSGYTQSQFSAPRDYSGYQRDAANEHSASELI

SEQ ID NO: 864518 - protein, 704 aa, Homo sapiens
MPSATSHSGSGSKSSGPPPPSGSSGSEAAAGAGAAAPASQHPATGTGAVQTEAMKQILGVIDKKLRNLEKKKGKLDDYQERMNKGERLNQDQLDAVSKYQEVTNNLEFAKELQRSFMALSQDIQKTIKKTARREQLMREEAEQKRLKTVLELQYVLDKLGDDEVRTDLKQGLNGVPILSEEELSLLDEFYKLVDPERDMSLRLNEQYEHASIHLWDLLEGKEKPVCGTTYKVLKEIVERVFQSNYFDSTHNHQNGLCEEEEAASAPAVEDQVPEAEPEPAEEYTEQSEVESTEYVNRQFMAETQFTSGEKEQVDEWTVETVEVVNSLQQQPQAASPSVPEPHSLTPVAQADPLVRRQRVQDLMAQMQGPYNFIQDSMLDFENQTLDPAIVSAQPMNPTQNMDMPQLVCPPVHSESRLAQPNQVPVQPEATQVPLVSSTSEGYTASQPLYQPSHATEQRPQKEPIDQIQATISLNTDQTTASSSLPAASQPQVFQAGTSKPLHSSGINVNAAPFQSMQTVFNMNAPVPPVNEPETLKQQNQYQASYNQSFSSQPHQVEQTELQQEQLQTVVGTYHGSPDQSHQVTGNHQQPPQQNTGFPRSNQPYYNSRGVSRGGSRGARGLMNGYRGPANGFRGGYDGYRPSFSNTPNSGYTQSQFSAPRDYSGYQLSSHKDRTTIVSFLLPGYGRKLFLLCMFCPKRHLEPCT

SEQ ID NO: 864519 - protein, 338 aa, Homo sapiens
MPSATSHSGSGSKSSGPPPPSGSSGSEAAAGAGAAAPASQHPATGTGAVQTEAMKQILGVIDKKLRNLEKKKGKLDDYQERMNKGERLNQDQLDAVSKYQEVTNNLEFAKELQRSFMALSQDIQKTIKKTARREQLMREEAEQKRLKTVLELQYVLDKLGDDEVRTDLKQGLNGVPILSEEELSLLDEFYKLVDPERDMSLRLNEQYEHASIHLWDLLEGKEKPVCGTTYKVLKEIVERVFQSNYFDSTHNHQNGLCEEEEAASAPAVEDQVPEAEPEPAEEYTEQSEVESTEYVNRQFMAEGMDISRISSEALGRVDHGEPHEVVEGPQDPTEGCRK

SEQ ID NO: 864520 - protein, 709 aa, Homo sapiens; identical to SEQ ID NO: 864493

SEQ ID NO: 864521 - protein, 709 aa, Homo sapiens; identical to SEQ ID NO: 864493

SEQ ID NO: 864522 - protein, 694 aa, Homo sapiens; identical to SEQ ID NO: 864496

SEQ ID NO: 864523 - protein, 709 aa, Homo sapiens; identical to SEQ ID NO: 864493

SEQ ID NO: 864524 - protein, 125 aa, Homo sapiens
MPSATSHSGSGSKSSGPPPPSGSSGSEAAAGAGAAAPASQHPATGTGAVQTEAMKQILGVIDKKLRNLEKKKGKLDDYQERMNKGERLNQDQLDAVSKYQEVTNNLDFAVLSPKLVQVLMKISSG

SEQ ID NO: 864525 - protein, 395 aa, Homo sapiens
MPSATSHSGSGSKSSGPPPPSGSSGSEAAAGAGAAAPASQHPATGTGAVQTEAMKQILGVIDKKLRNLEKKKGKLDDYQERMNKGERLNQDQLDAVSKYQEVTNNLEFAKELQRSFMALSQDIQKTIKKTARREQLMREEAEQKRLKTVLELQYVLDKLGDDEVRTDLKQGLNGVPILSEEELSLLDEFYKLVDPERDMSLRLNEQYEHASIHLWDLLEGKEKPVCGTTYKVLKEIVERVFQSNYFDSTHNHQNGLCEEEEAASAPAVEDQVPEAEPEPAEEYTEQSEVESTEYVNRQFMAETQFTSGEKEQVDEWTVETVEVVNSLQQQPQAASPSVPEPHSLTPVAQADPLVRRQRVQDLMAQMQGPYNFILRAPGGLRAPGGLRAPGGLRAP

SEQ ID NO: 864526 - protein, 141 aa, Homo sapiens [sequence omitted]

SEQ ID NO: 864527 - protein, 116 aa, Homo sapiens
MREAETEPHEGKRKVESLWPIFRIHHQKTRYIFDLFYKRKAISRELYEYCIKEGYADKNLIAKWKKQGYENLCCLRCIQTRDTNFGTNCICRVPKSKLEVGRIIECTHCGCRGCSG

SEQ ID NO: 864528 - protein, 117 aa, Homo sapiens
MREAETEPHEGKRKVESLWPIFRIHHQKTRYIFDLFYKRKAISRELYEYCIKEGYADKNLIAKWKKQGYENLCCLRCIQTRDTNFGTNCICRVPKSKLEVVMSDTQAWCCFQLKILP

SEQ ID NO: 864529 - protein, 110 aa, Homo sapiens
MREAETEPHEGKRKVESLWPIFRIHHQKTRYIFDLFYKRKAISRELYEYCIKEGYADKNLIAKWKKQGYENLCCLRCIQTRDTNFGTNCICRVPKSKLEVVPHYRVHTVV

SEQ ID NO: 864530 - protein, 116 aa, Homo sapiens; identical to SEQ ID NO: 864527

SEQ ID NO: 864531 - protein, 116 aa, Homo sapiens; identical to SEQ ID NO: 864527

SEQ ID NO: 864532 - protein, 119 aa, Homo sapiens
MREAETEPHEGKRKVESLWPIFRIHHQKTRYIFDLFYKRKAISRELYEYCIKEGYADKNLIAKWKKQGYENLCCLRCIQTRDTNFGNKIEFCRGAPKSKAWESWGPLLYGGGPHPLWVC

SEQ ID NO: 864533 - protein, 89 aa, Homo sapiens
AAAAASVAAVAARTRTSGRPPHEVGPSCAPPKSRLARLLPGNNAPSLSVREDAWPCLPPTGSEGKWQQRLWNSIQALLRTPKMTQSPRG

SEQ ID NO: 864534 - protein, 89 aa, Homo sapiens; identical to SEQ ID NO: 864533

SEQ ID NO: 864535 - protein, 116 aa, Homo sapiens; identical to SEQ ID NO: 864527

SEQ ID NO: 864536 - protein, 116 aa, Homo sapiens; identical to SEQ ID NO: 864527

SEQ ID NO: 864537 - protein, 116 aa, Homo sapiens; identical to SEQ ID NO: 864527

SEQ ID NO: 864538 - protein, 142 aa, Homo sapiens
GFLHVGQAGLELLASSDPPTSASQSDGITAETEPHEGKRKVESLWPIFRIHHQKTRYIFDLFYKRKAISRELYEYCIKEGYADKNLIAKWKKQGYENLCCLRCIQTRDTNFGTNCICRVPKSKLEVGRIIECTHCGCRGCSG

SEQ ID NO: 864539 - protein, 1051 aa, Homo sapiens
GDLLSLLPKMADAFGDELFSVFEGDSTTAAGTKKDKEKDKGKWKGPPGSADKAGKRFDGKLQSESTNNGKNKRDVDFEGTDEPIFGKKPRIEESITEDLSLADLMPRVKVQSVETVEGCTHEVALPAEEDYLPLKPRVGKAAKEYPFILDAFQREAIQCVDNNQSVLVSAHTSAGKTVCAEYAIALALREKQRVIFTSPIKALSNQKYREMYEEFQDVGLMTGDVTINPTASCLVMTTEILRSMLYRGSEVMREVAWVIFDEIHYMRDSERGVVWEETIILLPDNVHYVFLSATIPNARQFAEWICHLHKQPCHVIYTDYRPTPLQHYIFPAGGDGLHLVVDENGDFREDNFNTAMQVLRDAGDLAKGDQKGRKGGTKGPSNVFKIVKMIMERNFQPVIIFSFSKKDCEAYALQMTKLDFNTDEEKKMVEEVFSNAIDCLSDEDKKLPQVEHVLPLLKRGIGIHHGGLLPILKETIEILFSEGLIKALFATETFAMGINMPARTVLFTNARKFDGKDFRWISSGEYIQMSGRAGRRGMDDRGIVILMVDEKMSPTIGKQLLKGSADPLNSAFHLTYNMVLNLLRVEEINPEYMLEKSFYQFQHYRAIPGVVEKVKNSEEQYNKIVIPNEESVVIYYKIRQQLAKLGKEIEEYIHKPKYCLPFLQPGRLVKVKNEGDDFGWGVVVNFSKKSNVKPNSGELDPLYVVEVLLRCSKESLKNSATEAAKPAKPDEKGEMQVVPVLVHLLSAISSVRLYIPKDLRPVDNRQSVLKSIQEVQKRFPDGIPLLDPIDDMGIQDQGLKKVIQKVEAFEHRMYSHPLHNDPNLETVYTLCEKKAQIAIDIKSAKRELKKARTVLQMDELKCRKRVLRRLGFATSSDVIEMKGRVACEISSADELLLTEMMFNGLFNDLSAEQATALLSCFVFQENSSEMPKLTEQLAGPLRQMQECAKRIAKVSAEAKLEIDEETYLSSFKPHLMDVVYTWATGATFAHICKMTDVFEGSIIRCMRRLEELLRQMCQAAKAIGNTELENKFAEGITKIKRDIVFAASLYL

SEQ ID NO: 864540 - protein, 1051 aa, Homo sapiens; identical to SEQ ID NO: 864539

SEQ ID NO: 864541 - protein, 1051 aa, Homo sapiens; identical to SEQ ID NO: 864539

SEQ ID NO: 864542 - protein, 872 aa, Homo sapiens
MRYAIALALREKQRVIFTSPIKALSNQKYREMYEEFQDVGLMTGDVTINPTASCLVMTTEILRSMLYRGSEVMREVAWVIFDEIHYMRDSERGVVWEETIILLPDNVHYVFLSATIPNARQFAEWICHLHKQPCHVIYTDYRPTPLQHYIFPAGGDGLHLVVDENGDFREDNFNTAMQVLRDAGDLAKGDQKGRKGGTKGPSNVFKIVKMIMERNFQPVIIFSFSKKDCEAYALQMTKLDFNTDEEKKMVEEVFSNAIDCLSDEDKKLPQVEHVLPLLKRGIGIHHGGLLPILKETIEILFSEGLIKALFATETFAMGINMPARTVLFTNARKFDGKDFRWISSGEYIQMSGRAGRRGMDDRGIVILMVDEKMSPTIGKQLLKGSADPLNSAFHLTYNMVLNLLRVEEINPEYMLEKSFYQFQHYRAIPGVVEKVKNSEEQYNKIVIPNEESVVIYYKIRQQLAKLGKEIEEYIHKPKYCLPFLQPGRLVKVKNEGDDFGWGVVVNFSKKSNVKPNSGELDPLYVVEVLLRCSKESLKNSATEAAKPAKPDEKGEMQVVPVLVHLLSAISSVRLYIPKDLRPVDNRQSVLKSIQEVQKRFPDGIPLLDPIDDMGIQDQGLKKVIQKVEAFEHRMYSHPLHNDPNLETVYTLCEKKAQIAIDIKSAKRELKKARTVLQMDELKCRKRVLRRLGFATSSDVIEMKGRVACEISSADELLLTEMMFNGLFNDLSAEQATALLSCFVFQENSSEMPKLTEQLAGPLRQMQECAKRIAKVSAEAKLEIDEETYLSSFKPHLMDVVYTWATGATFAHICKMTDVFEGSIIRCMRRLEELLRQMCQAAKAIGNTELENKFAEGITKIKRDIVFAASLYL

SEQ ID NO: 864543 - protein, 1051 aa, Homo sapiens; identical to SEQ ID NO: 864539

SEQ ID NO: 864544 - protein, 1037 aa, Homo sapiens
GDLLSLLPKMADAFGDELFSVFEGDSTTAAGTKKDKEKDKGKWKGPPGSADKAGKRFDGKLQSESTNNGKNKRDVDFEGTDEPIFGKKPRIEESITEDLSLADLMPRVKVQSVETVEGCTHEVALPAEEDYLPLKPRVGKAAKEYPFILDAFQREAIQCVDNNQSVLVSAHTSAGKTVCAEYAIALALREKQRVIFTSPIKALSNQKYREMYEEFQDVGLMTGDVTINPTASCLVMTTEILRSMLYRGSEVMREVAWVIFDEIHYMRDSERGVVWEETIILLPDNVHYVFLSATIPNARQFAEWICHLHKQPCHVIYTDYRPTPLQHYIFPAGGDGLHLVVDENGDFREDNFNTAMQVLRDAGDLAKGDQKGRKGGTKGPSNVFKIVKMIMERNFQPVIIFSFSKKDCEAYALQMTKLDFNTDEEKKMVEEVFSNAIDCLSDEDKKSLSHHGGLLPILKETIEILFSEGLIKALFATETFAMGINMPARTVLFTNARKFDGKDFRWISSGEYIQMSGRAGRRGMDDRGIVILMVDEKMSPTIGKQLLKGSADPLNSAFHLTYNMVLNLLRVEEINPEYMLEKSFYQFQHYRAIPGVVEKVKNSEEQYNKIVIPNEESVVIYYKIRQQLAKLGKEIEEYIHKPKYCLPFLQPGRLVKVKNEGDDFGWGVVVNFSKKSNVKPNSGELDPLYVVEVLLRCSKESLKNSATEAAKPAKPDEKGEMQVVPVLVHLLSAISSVRLYIPKDLRPVDNRQSVLKSIQEVQKRFPDGIPLLDPIDDMGIQDQGLKKVIQKVEAFEHRMYSHPLHNDPNLETVYTLCEKKAQIAIDIKSAKRELKKARTVLQMDELKCRKRVLRRLGFATSSDVIEMKGRVACEISSADELLLTEMMFNGLFNDLSAEQATALLSCFVFQENSSEMPKLTEQLAGPLRQMQECAKRIAKVSAEAKLEIDEETYLSSFKPHLMDVVYTWATGATFAHICKMTDVFEGSIIRCMRRLEELLRQMCQAAKAIGNTELENKFAEGITKIKRDIVFAASLYL

SEQ ID NO: 864545 - protein, 837 aa, Homo sapiens
GDLLSLLPKMADAFGDELFSVFEGDSTTAAGTKKDKEKDKGKWKGPPGSADKAGKRFDGKLQSESTNNGKNKRDVDFEGTDEPIFGKKPRIEESITEDLSLADLMPRVKVQSVETVEGCTHEVALPAEEDYLPLKPRVGKAAKEYPFILDAFQREAIQCVDNNQSVLVSAHTSAGKTVCAEYAIALALREKQRVIFTSPIKALSNQKYREMYEEFQDVGLMTGDVTINPTASCLVMTTEILRSMLYRGSEVMREVAWVIFDEIHYMRDSERGVVWEETIILLPDNVHYVFLSATIPNARQFAEWICHLHKQPCHVIYTDYRPTPLQHYIFPAGGDGLHLVVDENGDFREDNFNTAMQVLRDAGDLAKGDQKGRKGGTKGPSNVFKIVKMIMERNFQPVIIFSFSKKDCEAYALQMTKLDFNTDEEKKMVEEVFSNAIDCLSDEDKKLPQVEHVLPLLKRGIGIHHGGLLPILKETIEILFSEGLIKALFATETFAMGINMPARTVLFTNARKFDGKDFRWISSGEYIQMSGRAGRRGMDDRGIVILMVDEKMSPTIGKQLLKGSADPLNSAFHLTYNMVLNLLRVEEINPEYMLEKSFYQFQHYRAIPGVVEKVKNSEEQYNKIVIPNEESVVIYYKIRQQLAKLGKEIEEYIHKPKYCLPFLQPGRLVKVKNEGDDFGWGVVVNFSKKSNVKPNSGELDPLYVVEVLLRCSKESLKNSATEAAKPAKPDEKGEMQVVPVLVHLLSAISSVRLYIPKDLRPVDNRQSVLKSIQEVQKRFPDGIPLLDPIDDMGIQDQGLKKVIQKVEAFEHRMYSHPLHNDPNLETVYTLCEKKAQC

SEQ ID NO: 864546 - protein, 1041 aa, Homo sapiens
GDLLSLLPKMADAFGDELFSVFEGDSTTAAGTKKDKEKDKGKWKGPPGSADKAGKRFDGKLQSESTNNGKNKRDVDFEGTDEPIFGKKPRIEESITEDLSLADLMPRVKVQSVETVEGCTHEVALPAEEDYLPLKPRVGKAAKEYPFILDAFQREAIQCVDNNQSVLVSAHTSAGKTVCAEYAIALALREKQRVIFTSPIKALSNQKYREMYEEFQDVGLMTGDVTINPTASCLVMTTEILRSMLYRGSEVMREVAWVIFDEIHYMRDSERGVVWEETIILLPDNVHYVFLSATIPNARQFAEWICHLHKQPCHVIYTDYRPTPLQHYIFPAGGDGLHLVVDENGDFREDNFNTAMQVLRDAGDLAKGDQKGRKGGTKGPSNVFKIVKMIMERNFQPVIIFSFSKKDCEAYALQMTKLDFNTDEEKKMVEEVFSNAIDCLSDEDKKLPQVEHVLPLLKRGIGIHHGGLLPILKETIEILFSEGLIKALFATETFAMGINMPARTVLFTNARKFDGKDFRWISSGEYIQMSGRAGRRGMDDRGIVILMVDEKMSPTIGKQLLKGSADPLNSAFHLTYNMVLNLLRVEEINPEYMLEKSFYQFQHYRAIPGVVEKVKNSEEQYNKIVIPNEESVVIYYKIRQQLAKLGKEIEEYIHKPKYCLPFLQPGRLVKVKNEGDDFGWGVVVNFSKKSNVKPNSGELDPLYVVEVLLRCSKESLKNSATEAAKPAKPDEKGEMQVVPVLVHLLSAISSVRLYIPKDLRPVDNRQSVLKSIQEVQKRFPDGIPLLDPIDDMGIQDQGLKKVIQKVEAFEHRMYSHPLHNDPNLETVYTLCEKKAQIAIDIKSAKRELKKARTVLQMDELKCRKRVLRRLGFATSSDVIEMKGRVACEISSADELLLTEMMFNGLFNDLSAEQATALLSCFVFQENSSEMPKLTEQLAGPLRQMQECAKRIAKVSAEAKLEIDEETYLSSFKPHLMDVVYTWATGATFAHICKMTDVFEGSIIRCMRRLEELLRQMCQAAKAIGNTELENKFAEGRSVSNG

SEQ ID NO: 864547 - protein, 1051 aa, Homo sapiens; identical to SEQ ID NO: 864539

SEQ ID NO: 864548 - protein, 265 aa, Homo sapiens
SCVLRLSRSRSRSLPCVGISQAESHQSRASARCISPPCQLNCVYACEKQQIAIDIKSAKRELKKARTVLQMDELKCRKRVLRRLGFATSSDVIEMKGRVACEISSADELLLTEMMFNGLFNDLSAEQATALLSCFVFQENSSEMPKLTEQLAGPLRQMQECAKRIAKVSAEAKLEIDEETYLSSFKPHLMDVVYTWATGATFAHICKMTDVFEGSIIRCMRRLEELLRQMCQAAKAIGNTELENKFAEGITKIKRDIVFAASLYL

SEQ ID NO: 864549 - protein, 529 aa, Homo sapiens
GDLLSLLPKMADAFGDELFSVFEGDSTTAAGTKKDKEKDKGKWKGPPGSADKAGKRFDGKLQSESTNNGKNKRDVDFEGTDEPIFGKKPRIEESITEDLSLADLMPRVKVQSVETVEGCTHEVALPAEEDYLPLKPRVGKAAKEYPFILDAFQREAIQCVDNNQSVLVSAHTSAGKTVCAEYAIALALREKQRVIFTSPIKALSNQKYREMYEEFQDVGLMTGDVTINPTASCLVMTTEILRSMLYRGSEVMREVAWVIFDEIHYMRDSERGVVWEETIILLPDNVHYVFLSATIPNARQFAEWICHLHKQPCHVIYTDYRPTPLQHYIFPAGGDGLHLVVDENGDFREDNFNTAMQVLRDAGDLAKGDQKGRKGGTKGPSNVFKIVKMIMERNFQPVIIFSFSKKDCEAYALQMTKLDFNTDEEKKMVEEVFSNAIDCLSDEDKKLPQVEHVLPLLKRGIGIHHGGLLPILKETIEILFSEGLIKALFATETFAMGINMPARTVLFTNARKFDGKDFRWVSKAIHISK

SEQ ID NO: 864550 - protein, 462 aa, Homo sapiens
GDLLSLLPKMADAFGDELFSVFEGDSTTAAGTKKDKEKDKGKWKGPPGSADKAGKRFDGKLQSESTNNGKNKRDVDFEGTDEPIFGKKPRIEESITEDLSLADLMPRVKVQSVETVEGCTHEVALPAEEDYLPLKPRVGKAAKEYPFILDAFQREAIQCVDNNQSVLVSAHTSAGKTVCAEYAIALALREKQRVIFTSPIKALSNQKYREMYEEFQDVGLMTGDVTINPTASCLVMTTEILRSMLYRGSEVMREVAWVIFDEIHYMRDSERGVVWEETIILLPDNVHYVFLSATIPNARQFAEWICHLHKQPCHVIYTDYRPTPLQHYIFPAGGDGLHLVVDENGDFREDNFNTAMQVLRDAGDLAKGDQKGRKGGTKGPSNVFKIVKMIMERNFQPVIIFSFSKKDCEAYALQMTKLDFNTDEEKKMVEEVFSNAIDCLSDEDKKLPQSPWWFYETIEISF

SEQ ID NO: 864551 - protein, 1051 aa, Homo sapiens; identical to SEQ ID NO: 864539

SEQ ID NO: 864552 - protein, 1044 aa, Homo sapiens
GDLLSLLPKMADAFGDELFSVFEGDSTTAAGTKKDKEKDKGKWKGPPGSADKAGKRFDGKLQSESTNNGKNKRDVDFEGTDEPIFGKKPRIEESITEDLSLADLMPRVKVQSVETVEGCTHEVALPAEEDYLPLKPRVGKAAKEYPFILDAFQREAIQCVDNNQSVLVSAHTSAGKTVCAEYAIALALREKQRVIFTSPIKALSNQKYREMYEEFQDVGLMTGDVTINPTASCLVMTTEILRSMLYRGSEVMREVAWVIFDEIHYMRDSERGVVWEETIILLPDNVHYVFLSATIPNARQFAEWICHLHKQIIGPLHCNTTFFQQGEMALHLVVDENGDFREDNFNTAMQVLRDAGDLAKGDQKGRKGGTKGPSNVFKIVKMIMERNFQPVIIFSFSKKDCEAYALQMTKLDFNTDEEKKMVEEVFSNAIDCLSDEDKKLPQVEHVLPLLKRGIGIHHGGLLPILKETIEILFSEGLIKALFATETFAMGINMPARTVLFTNARKFDGKDFRWISSGEYIQMSGRAGRRGMDDRGIVILMVDEKMSPTIGKQLLKGSADPLNSAFHLTYNMVLNLLRVEEINPEYMLEKSFYQFQHYRAIPGVVEKVKNSEEQYNKIVIPNEESVVIYYKIRQQLAKLGKEIEEYIHKPKYCLPFLQPGRLVKVKNEGDDFGWGVVVNFSKKSNVKPNSGELDPLYVVEVLLRCSKESLKNSATEAAKPAKPDEKGEMQVVPVLVHLLSAISSVRLYIPKDLRPVDNRQSVLKSIQEVQKRFPDGIPLLDPIDDMGIQDQGLKKVIQKVEAFEHRMYSHPLHNDPNLETVYTLCEKKAQIAIDIKSAKRELKKARTVLQMDELKCRKRVLRRLGFATSSDVIEMKGRVACEISSADELLLTEMMFNGLFNDLSAEQATALLSCFVFQENSSEMPKLTEQLAGPLRQMQECAKRIAKVSAEAKLEIDEETYLSSFKPHLMDVVYTWATGATFAHICKMTDVFEGSIIRCMRRLEELLRQMCQAAKAIGNTELENKFAEGITKIKRDIVFAASLYL

SEQ ID NO: 864553 - protein, 1051 aa, Homo sapiens; identical to SEQ ID NO: 864539

SEQ ID NO: 864554 - protein, 701 aa, Homo sapiens
ILINKTDLVPEEDVKKLRTTLRSINGLGQILETQRSSLQKKLQHVPGTQPHLDHKKDCEAYALQMTKLDFNTDEEKKMVEEVFSNAIDCLSDEDKKLPQVEHVLPLLKRGIGIHHGGLLPILKETIEILFSEGLIKALFATETFAMGINMPARTVLFTNARKFDGKDFRWISSGEYIQMSGRAGRRGMDDRGIVILMVDEKMSPTIGKQLLKGSADPLNSAFHLTYNMVLNLLRVEEINPEYMLEKSFYQFQHYRAIPGVVEKVKNSEEQYNKIVIPNEESVVIYYKIRQQLAKLGKEIEEYIHKPKYCLPFLQPGRLVKVKNEGDDFGWGVVVNFSKKSNVKPNSGELDPLYVVEVLLRCSKESLKNSATEAAKPAKPDEKGEMQVVPVLVHLLSAISSVRLYIPKDLRPVDNRQSVLKSIQEVQKRFPDGIPLLDPIDDMGIQDQGLKKVIQKVEAFEHRMYSHPLHNDPNLETVYTLCEKKAQIAIDIKSAKRELKKARTVLQMDELKCRKRVLRRLGFATSSDVIEMKGRVACEISSADELLLTEMMFNGLFNDLSAEQATALLSCFVFQENSSEMPKLTEQLAGPLRQMQECAKRIAKVSAEAKLEIDEETYLSSFKPHLMDVVYTWATGATFAHICKMTDVFEGSIIRCMRRLEELLRQMCQAAKAIGNTELENKFAEGITKIKRDIVFAASLYL

SEQ ID NO: 864555 - protein, 195 aa, Homo sapiens
MDELKCRKRVLRRLGFATSSDVIEMKGRVACEISSADELLLTEMMFNGLFNDLSAEQATALLSCFVFQENSSEMPKLTEQLAGPLRQMQECAKRIAKVSAEAKLEIDEETYLSSFKPHLMDVVYTWATGATFAHICKMTDVFEGSIIRCMRRLEELLRQMCQAAKAIGNTELENKFAEGITKIKRDIVFAASLYL

SEQ ID NO: 864556 - protein, 845 aa, Homo sapiens
GDLLSLLPKMADAFGDELFSVFEGDSTTAAGTKKDKEKDKGKWKGPPGSADKAGKRFDGKLQSESTNNGKNKRDVDFEGTDEPIFGKKPRIEESITEDLSLADLMPRVKVQSVETVEGCTHEVALPAEEDYLPLKPRVGKAAKEYPFILDAFQREAIQCVDNNQSVLVSAHTSAGKTVCAEYAIALALREKQRVIFTSPIKALSNQKYREMYEEFQDVGLMTGDVTINPTASCLVMTTEILRSMLYRGSEVMREVAWVIFDEIHYMRDSERGVVWEETIILLPDNVHYVFLSATIPNARQFAEWICHLHKQPCHVIYTDYRPTPLQHYIFPAGGDGLHLVVDENGDFREDNFNTAMQVLRDAGDLAKGDQKGRKGGTKGPSNVFKIVKMIMERNFQPVIIFSFSKKDCEAYALQMTKLDFNTDEEKKMVEEVFSNAIDCLSDEDKKLPQVEHVLPLLKRGIGIHHGGLLPILKETIEILFSEGLIKALFATETFAMGINMPARTVLFTNARKFDGKDFRWISSGEYIQMSGRAGRRGMDDRGIVILMVDEKMSPTIGKQLLKGSADPLNSAFHLTYNMVLNLLRVEEINPEYMLEKSFYQFQHYRAIPGVVEKVKNSEEQYNKIVIPNEESVVIYYKIRQQLAKLGKEIEEYIHKPKYCLPFLQPGRLVKVKNEGDDFGWGVVVNFSKKSNVKPNSGELDPLYVVEVLLRCSKESLKNSATEAAKPAKPDEKGEMQVVPVLVHLLSAISSVRLYIPKDLRPVDNRQSVLKSIQEVQKRFPDGIPLLDPIDDMGIQDQGLKKVIQKVEAFEHRMYSHPLHNDPNLETVYTLCEKKAQTGMAEIWFL

SEQ ID NO: 864557 - protein, 211 aa, Homo sapiens
LGNLYTVYCEPSEAGTNAHIQYIQCGTICGFTHTHTRYHRKRGGISSQNRAGEKYVVEFSLTPALWFQGVKELCLLLLNQSLLLPSLKLLLESRDEHLHEMALEQITAVTTVNDSNCDQELLSLLLDAKLLVKCVSTPFYPRIVDHLLASLQQGRWDAEELGRHLREAGHEAEAGSLLLAVRGTHQAFRTFSTALRAAQHWVLRATCGPAP

SEQ ID NO: 864558 - protein, 1345 aa, Homo sapiens
MVDQLEQILSVSELLEKHGLEKPISFVKNTQSSSEEARKLMVRLTRHTGRKQPPVSESHWRTLLQDMLTMQQNVYTCLDSDACYEIFTESLLCSSRLENIHLAGQMMHCSACSENPPAGIAHKGKPHYRVSYEKSIDLVLAASREYFNSSTNLTDSCMDLARCCLQLITDRPPAIQEELDLIQAVGCLEEFGVKILPLQVRLCPDRISLIKECISQSPTCYKQSTKLLGLAELLRVAGENPEERRGQVLILLVEQALRFHDYKAASMHCQELMATGYPKSWDVCSQLGQSEGYQDLATRQELMAFALTHCPPSSIELLLAASSSLQTEILYQRVNFQIHHEGGENISASPLTSKAVQEDEVGVPGSNSADLLRWTTATTMKVLSNTTTTTKAVLQAVSDGQWWKKSLTYLRPLQGQKCGGAYQIGTTANEDLEKQGCHPFYESVISNPFVAESEGTYDTYQHVPVESFAEVLLRTGKLAEAKNKGEVFPTTEVLLQLASEALPNDMTLALAYLLALPQVLDANRCFEKQSPSALSLQLAAYYYSLQIYARLAPCFRDKCHPLYRADPKELIKMVTRHVTRHEHEAWPEDLISLTKQLHCYNERLLDFTQAQILQGLRKGVDVQRFTADDQYKRETILGLAETLEESVYSIAISLAQRYSVSRWEVFMTHLEFLFTDSGLSTLEIENRAQDLHLFETLKTDPEAFHQHMVKYIYPTIGGFDHERLQYYFTLLENCGCADLGNCAIKPETHIRLLKKFKVVASGLNYKKLTDENMSPLEALEPVLSSQNILSISKLVPKIPEKDGQMLSPSSLYTIWLQKLFWTGDPHLIKQVPGSSPEWLHAYDVCMKYFDRLHPGDLITVVDAVTFSPKAVTKLSVEARKEMTRKAIKTVKHFIEKPRKRNSEDEAQEAKDSKVTYADTLNHLEKSLAHLETLSHSFILSLKNSEQETLQKYSHLYDLSRSEKEKLHDEAVAICLDGQPLAMIQQLLEVAVGPLDISPKDIVQSAIMKIISALSGGSADLGGPRDPLKVLEGVVAAVHASVDKGEELVSPEDLLEWLRPFCADDAWPVRPRIHVLQILGQSFHLTEEDSKLLVFFRTEAILKASWPQRQVDIADIENEENRYCLFMELLESSHHEAEFQHLVLLLQAWPPMKSEYVITNNPWVRLATVMLTRCTMENKEGLGNEVLKMCRSLYNTKQMLPAEGVKELCLLLLNQSLLLPSLKLLLESRDEHLHEMALEQITAVTTVNDSNCDQELLSLLLDAKLLVKCVSTPFYPRIVDHLLASLQQGRWDAEELGRHLREAGHEAEAGSLLLAVRGTHQAFRTFSTALRAAQHWVLRATCGPAP

SEQ ID NO: 864559 - protein, 174 aa, Homo sapiens
MIAVGFLCLLMLEEPRLSSQSVTYLRGARDPHTLLNPGQGMNDDEGSPVESEGSKGEAEQSKHPLTLCLSYFLKVNDSNCDQELLSLLLDAKLLVKCVSTPFYPRIVDHLLASLQQGRWDAEELGRHLREAGHEAEAGSLLLAVRGTHQAFRTFSTALRAAQHWVLRATCGPAP

SEQ ID NO: 864560 - protein, 118 aa, Homo sapiens
YNNNRPASHQPLQRQRLQVNDSNCDQELLSLLLDAKLLVKCVSTPFYPRIVDHLLASLQQGRWDAEELGRHLREAGHEAEAGSLLLAVRGTHQAFRTFSTALRAAQHWVLRATCGPAP

SEQ ID NO: 864561 - protein, 243 aa, Homo sapiens
SEQRYDAEFFKKFRNQNIVLSARTYAQESNVQALEILFTYHGSDLLPHRLAILSNFPETTSPHEYSVLLPEACFNGDSLMIIPWHEHKHRAKDWCEELACRMVVEPNLQDESEFLYAAQPELLRFRMTQLTVEKVMDWYQTRAEEIEHYARQVDCALSLIRLGMERNIPGLLVLCDNLVTLETLVYEARCDVTLTLKELQQMKDIEKLRLLMNSVGFILTSFLNILKHFLCTLIHMCLKPKMK

SEQ ID NO: 864562 - protein, 1673 aa, Homo sapiens
SEQRYDAEFFKKFRNQNIVLSARTYAQESNVQALEILFTYHGSDLLPHRLAILSNFPETTSPHEYSVLLPEACFNGDSLMIIPWHEHKHRAKDWCEELACRMVVEPNLQDESEFLYAAQPELLRFRMTQLTVEKVMDWYQTRAEEIEHYARQVDCALSLIRLGMERNIPGLLVLCDNLVTLETLVYEARCDVTLTLKELQQMKDIEKLRLLMNSCSEDKYVTSAYQWMVPFLHRCEKQSPGVANELLKEYLVTLAKGDLKFPLKIFQHSKPDLQQKIIPDQDQLMAIALECIYTCERNDQLCLCYDLLECLPERGYGDKTEATTKLHDMVDQLEQILSVSELLEKHGLEKPISFVKNTQSSSEEARKLMVRLTRHTGRKQPPVSESHWRTLLQDMLTMQQNVYTCLDSDACYEIFTESLLCSSRLENIHLAGQMMHCSACSENPPAGIAHKGKPHYRVSYEKSIDLVLAASREYFNSSTNLTDSCMDLARCCLQLITDRPPAIQEELDLIQAVGCLEEFGVKILPLQVRLCPDRISLIKECISQSPTCYKQSTKLLGLAELLRVAGENPEERRGQVLILLVEQALRFHDYKAASMHCQELMATGYPKSWDVCSQLGQSEGYQDLATRQELMAFALTHCPPSSIELLLAASSSLQTEILYQRVNFQIHHEGGENISASPLTSKAVQEDEVGVPGSNSADLLRWTTATTMKVLSNTTTTTKAVLQAVSDGQWWKKSLTYLRPLQGQKCGGAYQIGTTANEDLEKQGCHPFYESVISNPFVAESEGTYDTYQHVPVESFAEVLLRTGKLAEAKNKGEVFPTTEVLLQLASEALPNDMTLALAYLLALPQVLDANRCFEKQSPSALSLQLAAYYYSLQIYARLAPCFRDKCHPLYRADPKELIKMVTRHVTRHEHEAWPEDLISLTKQLHCYNERLLDFTQAQILQGLRKGVDVQRFTADDQYKRETILGLAETLEESVYSIAISLAQRYSVSRWEVFMTHLEFLFTDSGLSTLEIENRAQDLHLFETLKTDPEAFHQHMVKYIYPTIGGFDHERLQYYFTLLENCGCADLGNCAIKPETHIRLLKKFKVVASGLNYKKLTDENMSPLEALEPVLSSQNILSISKLVPKIPEKDGQMLSPSSLYTIWLQKLFWTGDPHLIKQVPGSSPEWLHAYDVCMKYFDRLHPGDLITVVDAVTFSPKAVTKLSVEARKEMTRKAIKTVKHFIEKPRKRNSEDEAQEAKDSKVTYADTLNHLEKSLAHLETLSHSFILSLKNSEQETLQKYSHLYDLSRSEKEKLHDEAVAICLDGQPLAMIQQLLEVAVGPLDISPKDIVQSAIMKIISALSGGSADLGGPRDPLKVLEGVVAAVHASVDKGEELVSPEDLLEWLRPFCADDAWPVRPRIHVLQILGQSFHLTEEDSKLLVFFRTEAILKASWPQRQVDIADIENEENRYCLFMELLESSHHEAEFQHLVLLLQAWPPMKSEYVITNNPWVRLATVMLTRCTMENKEGLGNEVLKMCRSLYNTKQMLPAEGVKELCLLLLNQSLLLPSLKLLLESRDEHLHEMALEQITAVTTVNDSNCDQELLSLLLDAKLLVKCVSTPFYPRIVDHLLASLQQGRWDAEELGRHLREAGHEAEAGSLLLAVRGTHQAFRTFSTALRAAQHWVLRATCGPAP

SEQ ID NO: 864563 - protein, 597 aa, Homo sapiens
MLFLLKKFKVVASGLNYKKLTDENMSPLEALEPVLSSQNILSISKLVPKIPEKDGQMLSPSSLYTIWLQKLFWTGDPHLIKQVPGSSPEWLHAYDVCMKYFDRLHPGDLITVVDAVTFSPKAVTKLSVEARKEMTRKAIKTVKHFIEKPRKRNSEDEAQEAKDSKVTYADTLNHLEKSLAHLETLSHSFILSLKNSEQETLQKYSHLYDLSRSEKEKLHDEAVAICLDGQPLAMIQQLLEVAVGPLDISPKDIVQSAIMKIISALSGGSADLGGPRDPLKVLEGVVAAVHASVDKGEELVSPEDLLEWLRPFCADDAWPVRPRIHVLQILGQSFHLTEEDSKLLVFFRTEAILKASWPQRQVDIADIENEENRYCLFMELLESSHHEAEFQHLVLLLQAWPPMKSEYVITNNPWVRLATVMLTRCTMENKEGLGNEVLKMCRSLYNTKQMLPAEGVKELCLLLLNQSLLLPSLKLLLESRDEHLHEMALEQITAVTTVNDSNCDQELLSLLLDAKLLVKCVSTPFYPRIVDHLLASLQQGRWDAEELGRHLREAGHEAEAGSLLLAVRGTHQAFRTFSTALRAAQHWVLRATCGPAP

SEQ ID NO: 864564 - protein, 1673 aa, Homo sapiens; identical to SEQ ID NO: 864562

SEQ ID NO: 864565 - protein, 252 aa, Homo sapiens
MKGRGSSLSAFKTSRYVDIADIENEENRYCLFMELLESSHHEAEFQHLVLLLQAWPPMKSEYVITNNPWVRLATVMLTRCTMENKEGLGNEVLKMCRSLYNTKQMLPAEGVKELCLLLLNQSLLLPSLKLLLESRDEHLHEMALEQITAVTTVNDSNCDQELLSLLLDAKLLVKCVSTPFYPRIVDHLLASLQQGRWDAEELGRHLREAGHEAEAGSLLLAVRGTHQAFRTFSTALRAAQHWVLRATCGPAP

SEQ ID NO: 864566 - protein, 1606 aa, Homo sapiens
SEQRYDAEFFKKFRNQNIVLSARTYAQESNVQALEILFTYHGSDLLPHRLAILSNFPETTSPHEYSVLLPEACFNGDSLMIIPWHEHKHRAKDWCEELACRMVVEPNLQDESEFLYAAQPELLRFRMTQLTVEKVMDWYQTRAEEIEHYARQVDCALSLIRLGMERNIPGLLVLCDNLVTLETLVYEARCDVTLTLKELQQMKDIEKLRLLMNSCSEDKYVTSAYQWMVPFLHRCEKQSPGVANELLKEYLVTLAKGDLKFPLKIFQHSKPDLQQKIIPDQDQLMAIALECIYTCERNDQLCLCYDLLECLPERGYGDKTEATTKLHDMVDQLEQILSVSELLEKHGLEKPISFVKNTQSSSEEARKLMVRLTRHTGRKQPPVSESHWRTLLQDMLTMQQNVYTCLDSDACYEIFTESLLCSSRLENIHLAGQMMHCSACSENPPAGIAHKGKPHYRVSYEKSIDLVLAASREYFNSSTNLTDSCMDLARCCLQLITDRPPAIQEELDLIQAVGCLEEFGVKILPLQVRLCPDRISLIKECISQSPTCYKQSTKLLGLAELLRVAGENPEERRGQVLILLVEQALRFHDYKAASMHCQELMATGYPKSWDVCSQLGQSEGYQDLATRQELMAFALTHCPPSSIELLLAASSSLQTEILYQRVNFQIHHEGGENISASPLTSKAVQEDEVGVPGSNSADLLRWTTATTMKVLSNTTTTTKAVLQAVSDGQWWKKSLTYLRPLQGQKCGGAYQIGTTANEDLEKQGCHPFYESVISNPFVAESEGTYDTYQHVPVESFAEVLLRTGKLAEAKNKGEVFPTTEVLLQLASEALPNDMTLALAYLLALPQVLDANRCFEKQSPSALSLQLAAYYYSLQIYARLAPCFRDKCHPLYRADPKELIKMVTRHVTRHEHEAWPEDLISLTKQLHCYNERLLDFTQAQILQGLRKGVDVQRFTADDQYKRETILGLAETLEESVYSIAISLAQRYSVSRWEVFMTHLEFLFTDSGLSTLEIENRAQDLHLFETLKTDPEAFHQHMVKYIYPTIGGFDHERLQYYFTLLENCGCADLGNCAIKPETHIRLLKKFKVVASGLNYKKLTDENMSPLEALEPVLSSQNILSISKLVPKIPEKDGQMLSPSSLYTIWLQKLFWTGDPHLIKQVPGSSPEWLHAYDVCMKYFDRLHPGDLITVVDAVTFSPKAVTKLSVEARKEMTRKAIKTVKHFIEKPRKRNSEDEAQEAKDSKVTYADTLNHLEKSLAHLETLSHSFILSLKNSEQETLQKYSHLYDLSRSEKEKLHDEAVAICLDGQPLAMIQQLLEVAVGPLDISPKDIVQSAIMKIISALSGGSADLGGPRDPLKVLEGVVAAVHASVDKGEELVSPEDLLEWLRPFCADDAWPVRPRIHVLQILGQSFHLTEEDSKLLVFFRTEAILKASWPQRQVDIADIENEENRYCLFMELLESSHHEAEFQHLVLLLQAWPPMKSEYVITNNPWVRLATVMLTRCTMENKEGLGNEVLKMCRSLYNTKQMLPAEGVKELCLLLLNQSLLLPSLKLLLESRDEHLHEMALEQITAVTTVNDSNCDQELLSLLLDCRKLGLGVGQKGWVGSS

SEQ ID NO: 864567 - protein, 1576 aa, Homo sapiens
SEQRYDAEFFKKFRNQNIVLSARTYAQESNVQALEILFTYHGSDLLPHRLAILSNFPETTSPHEYSVLLPEACFNGDSLMIIPWHEHKHRAKDWCEELACRMVVEPNLQDESEFLYAAQPELLRFRMTQLTVEKVMDWYQTRAEEIEHYARQVDCALSLIRLGMERNIPGLLVLCDNLVTLETLVYEARCDVTLTLKELQQMKDIEKLRLLMNSCSEDKYVTSAYQWMVPFLHRCEKQSPGVANELLKEYLVTLAKGDLKFPLKIFQHSKPDLQQKIIPDQDQLMAIALECIYTCERNDQLCLCYDLLECLPERGYGDKTEATTKLHDMVDQLEQILSVSELLEKHGLEKPISFVKNTQSSSEEARKLMVRLTRHTGRKQPPVSESHWRTLLQDMLTMQQNVYTCLDSDACYEIFTESLLCSSRLENIHLAGQMMHCSACSENPPAGIAHKGKPHYRVSYEKSIDLVLAASREYFNSSTNLTDSCMDLARCCLQLITDRPPAIQEELDLIQAVGCLEEFGVKILPLQVRLCPDRISLIKECISQSPTCYKQSTKLLGLAELLRVAGENPEERRGQVLILLVEQALRFHDYKAASMHCQELMATGYPKSWDVCSQLGQSEGYQDLATRQELMAFALTHCPPSSIELLLAASSSLQTEILYQRVNFQIHHEGGENISASPLTSKAVQEDEVGVPGSNSADLLRWTTATTMKVLSNTTTTTKAVLQAVSDGQWWKKSLTYLRPLQGQKCGGAYQIGTTANEDLEKQGCHPFYESVISNPFVAESEGTYDTYQHVPVESFAEVLLRTGKLAEAKNKGEVFPTTEVLLQLASEALPNDMTLALAYLLALPQVLDANRCFEKQSPSALSLQLAAYYYSLQIYARLAPCFRDKCHPLYRADPKELIKMVTRHVTRHEHEAWPEDLISLTKQLHCYNERLLDFTQAQILQGLRKGVDVQRFTADDQYKRETILGLAETLEESVYSIAISLAQRYSVSRWEVFMTHLEFLFTDSGLSTLEIENRAQDLHLFETLKTDPEAFHQHMVKYIYPTIGGFDHERLQYYFTLLENCGCADLGNCAIKPETHIRLLKKFKVVASGLNYKKLTDENMSPLEALEPVLSSQNILSISKLVPKIPEKDGQMLSPSSLYTIWLQKLFWTGDPHLIKQVPGSSPEWLHAYDVCMKYFDRLHPGDLITVVDAVTFSPKAVTKLSVEARKEMTRKAIKTVKHFIEKPRKRNSEDEAQEAKDSKVTYADTLNHLEKSLAHLETLSHSFILSLKNSEQETLQKYSHLYDLSRSEKEKLHDEAVAICLDGQPLAMIQQLLEVAVGPLDISPKDIVQSAIMKIISALSGGSADLGGPRDPLKVLEGVVAAVHASVDKGEELVSPEDLLEWLRPFCADDAWPVRPRIHVLQILGQSFHLTEEDSKLLVFFRTEAILKASWPQRQVDIADIENEENRYCLFMELLESSHHEAEFQHLVLLLQAWPPMKSEYVITNNPWVRLATVMLTRCTMENKEGLGNEVLKMCRSLYNTKQMLPAEGVKELCLLLLNQSLLLPSLKLLLESRDEHLHEMALEQITAVTTDIF

SEQ ID NO: 864568 - protein, 537 aa, Homo sapiens
SEQRYDAEFFKKFRNQNIVLSARTYAQESNVQALEILFTYHGSDLLPHRLAILSNFPETTSPHEYSVLLPEACFNGDSLMIIPWHEHKHRAKDWCEELACRMVVEPNLQDESEFLYAAQPELLRFRMTQLTVEKVMDWYQTRAEEIEHYARQVDCALSLIRLGMERNIPGLLVLCDNLVTLETLVYEARCDVTLTLKELQQMKDIEKLRLLMNSCSEDKYVTSAYQWMVPFLHRCEKQSPGVANELLKEYLVTLAKGDLKFPLKIFQHSKPDLQQKIIPDQDQLMAIALECIYTCERNDQLCLCYDLLECLPERGYGDKTEATTKLHDMVDQLEQILSVSELLEKHGLEKPISFVKNTQSSSEEARKLMVRLTRHTGRKQPPVSESHWRTLLQDMLTMQQNVYTCLDSDACYEIFTESLLCSSRLENIHLAGQMMHCSACSENPPAGIAHKGKPHYRVSYEKSIDLVLAASREYFNSSTNLTDSCMDLARCCLQLITDRPPAIQEELDLIQAVGCLEEFGVKILPLQGEFSTYCCIV

SEQ ID NO: 864569 - protein, 840 aa, Homo sapiens
MTLALAYLLALPQVLDANRCFEKQSPSALSLQLAAYYYSLQIYARLAPCFRDKCHPLYRADPKELIKMVTRHVTRHEHEAWPEDLISLTKQLHCYNERLLDFTQAQILQGLRKGVDVQRFTADDQYKRETILGLAETLEESVYSIAISLAQRYSVSRWEVFMTHLEFLFTDSGLSTLEIENRAQDLHLFETLKTDPEAFHQHMVKYIYPTIGGFDHERLQYYFTLLENCGCADLGNCAIKPETHIRLLKKFKVVASGLNYKKLTDENMSPLEALEPVLSSQNILSISKLVPKIPEKDGQMLSPSSLYTIWLQKLFWTGDPHLIKQVPGSSPEWLHAYDVCMKYFDRLHPGDLITVVDAVTFSPKAVTKLSVEARKEMTRKAIKTVKHFIEKPRKRNSEDEAQEAKDSKVTYADTLNHLEKSLAHLETLSHSFILSLKNSEQETLQKYSHLYDLSRSEKEKLHDEAVAICLDGQPLAMIQQLLEVAVGPLDISPKDIVQSAIMKIISALSGGSADLGGPRDPLKVLEGVVAAVHASVDKGEELVSPEDLLEWLRPFCADDAWPVRPRIHVLQILGQSFHLTEEDSKLLVFFRTEAILKASWPQRQVDIADIENEENRYCLFMELLESSHHEAEFQHLVLLLQAWPPMKSEYVITNNPWVRLATVMLTRCTMENKEGLGNEVLKMCRSLYNTKQMLPAEGVKELCLLLLNQSLLLPSLKLLLESRDEHLHEMALEQITAVTTVNDSNCDQELLSLLLDAKLLVKCVSTPFYPRIVDHLLASLQQGRWDAEELGRHLREAGHEAEAGSLLLAVRGTHQAFRTFSTALRAAQHWVLRATCGPAP

SEQ ID NO: 864570 - protein, 638 aa, Homo sapiens
MVKYIYPTIGGFDHERLQYYFTLLENCGCADLGNCAIKPETHIRLLKKFKVVASGLNYKKLTDENMSPLEALEPVLSSQNILSISKLVPKIPEKDGQMLSPSSLYTIWLQKLFWTGDPHLIKQVPGSSPEWLHAYDVCMKYFDRLHPGDLITVVDAVTFSPKAVTKLSVEARKEMTRKAIKTVKHFIEKPRKRNSEDEAQEAKDSKVTYADTLNHLEKSLAHLETLSHSFILSLKNSEQETLQKYSHLYDLSRSEKEKLHDEAVAICLDGQPLAMIQQLLEVAVGPLDISPKDIVQSAIMKIISALSGGSADLGGPRDPLKVLEGVVAAVHASVDKGEELVSPEDLLEWLRPFCADDAWPVRPRIHVLQILGQSFHLTEEDSKLLVFFRTEAILKASWPQRQVDIADIENEENRYCLFMELLESSHHEAEFQHLVLLLQAWPPMKSEYVITNNPWVRLATVMLTRCTMENKEGLGNEVLKMCRSLYNTKQMLPAEGVKELCLLLLNQSLLLPSLKLLLESRDEHLHEMALEQITAVTTVNDSNCDQELLSLLLDAKLLVKCVSTPFYPRIVDHLLASLQQGRWDAEELGRHLREAGHEAEAGSLLLAVRGTHQAFRTFSTALRAAQHWVLRATCGPAP

SEQ ID NO: 864571 - protein, 266 aa, Homo sapiens
NNTRTKPRQQHPISHQYTPPRFRTNHLESVVDIADIENEENRYCLFMELLESSHHEAEFQHLVLLLQAWPPMKSEYVITNNPWVRLATVMLTRCTMENKEGLGNEVLKMCRSLYNTKQMLPAEGVKELCLLLLNQSLLLPSLKLLLESRDEHLHEMALEQITAVTTVNDSNCDQELLSLLLDAKLLVKCVSTPFYPRIVDHLLASLQQGRWDAEELGRHLREAGHEAEAGSLLLAVRGTHQAFRTFSTALRAAQHWVLRATCGPAP

SEQ ID NO: 864572 - protein, 263 aa, Homo sapiens
TPTCPARDHDPDFYNTNPPLAYCTMKDVDIADIENEENRYCLFMELLESSHHEAEFQHLVLLLQAWPPMKSEYVITNNPWVRLATVMLTRCTMENKEGLGNEVLKMCRSLYNTKQMLPAEGVKELCLLLLNQSLLLPSLKLLLESRDEHLHEMALEQITAVTTVNDSNCDQELLSLLLDAKLLVKCVSTPFYPRIVDHLLASLQQGRWDAEELGRHLREAGHEAEAGSLLLAVRGTHQAFRTFSTALRAAQHWVLRATCGPAP

SEQ ID NO: 864573 - protein, 268 aa, Homo sapiens
GIRSEPPGCNRTTPRPRAPAFAHQRSVRPAPDVDIADIENEENRYCLFMELLESSHHEAEFQHLVLLLQAWPPMKSEYVITNNPWVRLATVMLTRCTMENKEGLGNEVLKMCRSLYNTKQMLPAEGVKELCLLLLNQSLLLPSLKLLLESRDEHLHEMALEQITAVTTVNDSNCDQELLSLLLDAKLLVKCVSTPFYPRIVDHLLASLQQGRWDAEELGRHLREAGHEAEAGSLLLAVRGTHQAFRTFSTALRAAQHWVLRATCGPAP

SEQ ID NO: 864574 - protein, 1630 aa, Homo sapiens
SEQRYDAEFFKKFRNQNIVLSARTYAQESNVQALEILFTYHGSDLLPHRLAILSNFPETTSPHEYSVLLPEACFNGDSLMIIPWHEHKHRAKDWCEELACRMVVEPNLQDESEFLYAAQPELLRFRMTQLTVEKVMDWYQTRAEEIEHYARQVDCALSLIRLGMERNIPGLLVLCDNLVTLETLVYEARCDVTLTLKELQQMKDIEKLRLLMNSCSEDKYVTSAYQWMVPFLHRCEKQSPGVANELLKEYLVTLAKGDLKFPLKIFQHSKPDLQQKIIPDQDQLMAIALECIYTCERNDQLCLCYDLLECLPERGYGDKTEATTKLHDMVDQLEQILSVSELLEKHGLEKPISFVKNTQSSSEEARKLMVRLTRHTGRKQPPVSESHWRTLLQDMLTMQQNVYTCLDSDACYEIFTESLLCSSRLENIHLAGQMMHCSACSENPPAGIAHKGKPHYRVSYEKSIDLVLAASREYFNSSTNLTDSCMDLARCCLQLITDRPPAIQEELDLIQAVGCLEEFGVKILPLQVRLCPDRISLIKECISQSPTCYKQSTKLLGLAELLRVAGENPEERRGQVLILLVEQALRFHDYKAASMHCQELMATGYPKSWDVCSQLGQSEGYQDLATRQELMAFALTHCPPSSIELLLAASSSLQTEILYQRVNFQIHHEGGENISASPLTSKAVQEDEVGVPGSNSADLLRWTTATTMKVLSNTTTTTKAVLQAVSDGQWWKKSLTYLRPLQGQKCGGAYQIGTTANEDLEKQGCHPFYESVISNPFVAESEGTYDTYQHVPVESFAEVLLRTGKLAEAKNKGEVFPTTEVLLQLASEALPNDMTLALAYLLALPQVLDANRCFEKQSPSALSLQLAAYYYSLQIYARLAPCFRDKCHPLYRADPKELIKMVTRHVTRHEHEAWPEDLISLTKQLHCYNERLLDFTQAQILQGLRKGVDVQRFTADDQYKRETILGLAETLEESVYSIAISLAQRYSVSRWEVFMTHLEFLFTDSGLSTLEIENRAQDLHLFETLKTDPEAFHQHMVKYIYPTIGGFDHERLQYYFTLLENCGCADLGNCAIKPETHIRLLKKFKVVASGLNYKKLTDENMSPLEALEPVLSSQNILSISKLVPKIPEKDGQMLSPSSLYTIWLQKLFWTGDPHLIKQVPGSSPEWLHAYDVCMKYFDRLHPGDLITVVDAVTFSPKAVTKLSVEARKEMTRKAIKTVKHFIEKPRKRNSEDEAQEAKDSKVTYADTLNHLEKSLAHLETLSHSFILSLKNSEQETLQKYSHLYDLSRSEKEKLHDEAVAICLDGQPLAMIQQLLEVAVGPLDISPKDIVQSAIMKIISALSGGSADLGGPRDPLKVLEGVVAAVHASVDKGEELVSPEDLLEWLRPFCADDAWPVRPRIHVLQILGQSFHLTEEDSKLLVFFRTEAILKASWPQRQVDIADIENEENRYCLFMELLESSHHEAEFQHLVLLLQAWPPMKSEYVITNNPWVRLATVMLTRCTMENKEGLGNEVLKMCRSLYNTKQMLPAEVNDSNCDQELLSLLLDAKLLVKCVSTPFYPRIVDHLLASLQQGRWDAEELGRHLREAGHEAEAGSLLLAVRGTHQAFRTFSTALRAAQHWVLRATCGPAP

SEQ ID NO: 864575 - protein, 1141 aa, Homo sapiens [sequence omitted]

SEQ ID NO: 864576 - protein, 1141 aa, Homo sapiens [sequence omitted]

SEQ ID NO: 864577 - protein, 958 aa, Homo sapiens
MLTSFPCCVSSCNSFSPTDNKFATCSDDGTVRIWDFLRCHEERILRGHGADVKCVDWHPTKGLVVSGSKDSQQPIKFWDPKTGQSLATLHAHKNTVMEVKLNLNGNWLLTASRDHLCKLFDIRNLKEELQVFRGHKKEATAVAWHPVHEGLFASGGSDGSLLFWHVGVEKEVGGMEMAHEGMIWSLAWHPLGHILCSGSNDHTSKFWTRNRPGDKMRDRYNLNLLPGMSEDGVEYDDLEPNSLAVIPGMGIPEQLKLAMEQEQMGKDESNEIEMTIPGLDWGMEEVMQKDQKKVPQKKVPYAKPIPAQFQQAWMQNKVPIPAPNEVLNDRKEDIKLEEKKKTQAEIEQEMATLQYTNPQLLEQLKIERLAQKQVEQIQPPPSSGTPLLGPQPFPGQGPMSQIPQGFQQPHPSQQMPMNMAQMGPPGPQGQFRPPGPQGQMGPQGPPLHQGGGGPQGFMGPQGPQGPPQGLPRPQDMHGPQGMQRHPGPHGPLGPQGPPGPQGSSGPQGHMGPQGPPGPQGHIGPQGPPGPQGHLGPQGPPGTQGMQGPPGPRGMQGPPHPHGIQGGPGSQGIQGPVSQGPLMGLNPRGMQGPPGPRENQGPAPQGMIMGHPPQEMRGPHPPGGLLGHGPQEMRGPQEIRGMQGPPPQGSMLGPPQELRGPPGSQSQQGPPQGSLGPPPQGGMQGPPGPQGQQNPARGPHPSQGPIPFQQQKTPLLGDGPRAPFNQEGQSTGPPPLIPGNSARGMAGVQPEALRGHGKAAGPEMNVSPGIPRTHVFEGAEKKVSEEEPRRGMRAVLPPEEGMVFLVLKTLVQRRILMLLRKRPEDEISEVEVGVPHEEEGRVYFPLLTSSLALKEGGSQIPGMETESLGQVMNIFVILPALIIPLTTVIPQPAENAPLLSKAWTWHPYLPESAPGMMAQALLSTERWRPQEALLKTEEAKAEGAQDLLRECPNLGVPAP

SEQ ID NO: 864578 - protein, 326 aa, Homo sapiens
MATEIGSPPRFFHMPRFQHQAPRQLFYKRPDFAQQQAMQQLTFDGKRMRKAVNRKTIDYNPSVIKYLENRIWQRDQRDMRAIQPDAGYYNDLVPPIGMLNNPMNAVTTKFVRTSTNKVKCPVFVVRWTPEGRRLVTGASSGEFTLWNGLTFNFETILQAHDSPVRAMTWSHNDMWMLTADHGGYVKYWQSNMNNVKMFQAHKEAIREARFIHNIPFSVVPIVMVKLFSKCILGAEMHGLCQFLGNFLHPINTIFFFVFTHSPFCWHLSEVVLSRYQPLQYVRDVLSAAFCTGFLFSFMINNVYTLFLFIIYCVRQEYFIPNKEFSL

SEQ ID NO: 864579 - protein, 326 aa, Homo sapiens; identical to SEQ ID NO: 864578

SEQ ID NO: 864580 - protein, 1141 aa, Homo sapiens [sequence omitted]

SEQ ID NO: 864581 - protein, 243 aa, Homo sapiens
MDILLFSLYSFRRGAPPRHEGRAPPRGRDGFPGPEDFGPEENFDASEEAARGRDLRGRGRGTPRGGRKGLLPTPDEFPRFEGGRKPDSWDGNREPGPGHEHFRDTPRPDHPPHDGHSPASRERSSSLQGMDMASLPPRKRPWHDGPGTSEHREMEAPGGPSEDRGGKGRGGPGPAQRVPKSGRSSSLDGEHHDGYHRDEPFGGPPGSGTPSRGGRSGSNWGRGSNMNSGPPRRGASRGGGRGR

SEQ ID NO: 864582 - protein, 326 aa, Homo sapiens; identical to SEQ ID NO: 864578

SEQ ID NO: 864583 - protein, 1336 aa, Homo sapiens
MATEIGSPPRFFHMPRFQHQAPRQLFYKRPDFAQQQAMQQLTFDGKRMRKAVNRKTIDYNPSVIKYLENRIWQRDQRDMRAIQPDAGYYNDLVPPIGMLNNPMNAVTTKFVRTSTNKVKCPVFVVRWTPEGRRLVTGASSGEFTLWNGLTFNFETILQAHDSPVRAMTWSHNDMWMLTADHGGYVKYWQSNMNNVKMFQAHKEAIREASFSPTDNKFATCSDDGTVRIWDFLRCHEERILRGHGADVKCVDWHPTKGLVVSGSKDSQQPIKFWDPKTGQSLATLHAHKNTVMEVKLNLNGNWLLTASRDHLCKLFDIRNLKEELQVFRGHKKEATAVAWHPVHEGLFASGGSDGSLLFWHVGVEKEVGGMEMAHEGMIWSLAWHPLGHILCSGSNDHTSKFWTRNRPGDKMRDRYNLNLLPGMSEDGVEYDDLEPNSLAVIPGMGIPEQLKLAMEQEQMGKDESNEIEMTIPGLDWGMEEVMQKDQKKVPQKKVPYAKPIPAQFQQAWMQNKVPIPAPNEVLNDRKEDIKLEEKKKTQAEIEQEMATLQYTNPQLLEQLKIERLAQKQVEQIQPPPSSGTPLLGPQPFPGQGPMSQIPQGFQQPHPSQQMPMNMAQMGPPGPQGQFRPPGPQGQMGPQGPPLHQGGGGPQGFMGPQGPQGPPQGLPRPQDMHGPQGMQRHPGPHGPLGPQGPPGPQGSSGPQGHMGPQGPPGPQGHIGPQGPPGPQGHLGPQGPPGTQGMQGPPGPRGMQGPPHPHGIQGGPGSQGIQGPVSQGPLMGLNPRGMQGPPGPRENQGPAPQGMIMGHPPQEMRGPHPPGGLLGHGPQEMRGPQEIRGMQGPPPQGSMLGPPQELRGPPGSQSQQGPPQGSLGPPPQGGMQGPPGPQGQQNPARGPHPSQGPIPFQQQKTPLLGDGPRAPFNQEGQSTGPPPLIPGLGQQGAQGRIPPLNPGQGPGPNKGDSRGPPNHHMGPMSERRHEQSGGPEHGPERGPFRGGQDCRGPPDRRGPHPDFPDDFSRPDDFHPDKRFGHRLREFEGRGGPLPQEEKWRRGGPGPPFPPDHREFSEGDGRGAARGPPGAWEGRRPGDERFPRDPEDPRFRGRREESFRRGAPPRHEGRAPPRGRDGFPGPEDFGPEENFDASEEAARGRDLRGRGRGTPRGGRKGLLPTPDEFPRFEGGRKPDSWDGNREPGPGHEHFRDTPRPDHPPHDGHSPASRERSSSLQGMDMASLPPRKRPWHDGPGTSEHREMEAPGGPSEDRGGKGRGGPGPAQRVPKSGRSSSLDGEHHDGYHRDEPFGGPPGSGTPSRGGRSGSNWGRGSNMNSGPPRRGASRGGGRGR

SEQ ID NO: 864584 - protein, 95 aa, Homo sapiens
PPVRDDPESVRSVAHRGRWRLLLWRSGIERIGVGRPNKRDISGSEGERFAGHLGALLKARRILEGKHHHGYRNWFSSSFFPYAKVPAPGTSTAVL

SEQ ID NO: 864585 - protein, 97 aa, Homo sapiens
PPVRDDPESVRSVAHRGRWRLLLWRSGIERIGVGRPNKRDISGSEGERFAGHLGALLKARRLPSACHCRHAPPRLTGFGGDGVSLCWPGRSPAPNRE

SEQ ID NO: 864586 - protein, 938 aa, Homo sapiens
MLTSFPCCVSSCNSFSPTDNKFATCSDDGTVRIWDFLRCHEERILRGHGADVKCVDWHPTKGLVVSGSKDSQQPIKFWDPKTGQSLATLHAHKNTVMEVKLNLNGNWLLTASRDHLCKLFDIRNLKEELQVFRGHKKEATAVAWHPVHEGLFASGGSDGSLLFWHVGVEKEVGGMEMAHEGMIWSLAWHPLGHILCSGSNDHTSKFWTRNRPGDKMRDRYNLNLLPGMSEDGVEYDDLEPNSLAVIPGMGIPEQLKLAMEQEQMGKDESNEIEMTIPGLDWGMEEVMQKDQKKVPQKKVPYAKPIPAQFQQAWMQNKVPIPAPNEVLNDRKEDIKLEEKKKTQAEIEQEMATLQYTNPQLLEQLKIERLAQKQVEQIQPPPSSGTPLLGPQPFPGQGPMSQIPQGFQQPHPSQQMPMNMAQMGPPGPQGQFRPPGPQGQMGPQGPPLHQGGGGPQGFMGPQGPQGPPQGLPRPQDMHGPQGMQRHPGPHGPLGPQGPPGPQGSSGPQGHMGPQGPPGPQGHIGPQGPPGPQGHLGPQGPPGTQGMQGPPGPRGMQGPPHPHGIQGGPGSQGIQGPVSQGPLMGLNPRGMQGPPGPRENQGPAPQGMIMGHPPQEMRGPHPPGGLLGHGPQEMRGPQEIRGMQGPPPQGSMLGPPQELRGPPGSQSQQGPPQGSLGPPPQGGMQGPPGPQGQQNPARGPHPSQGPIPFQQQKTPLLGDGPRAPFNQEGQSTGPPPLIPGLGQQGAQGRIPPLNPGQGPGPNKVSEEEPRRGMRAVLPPEEGMVFLVLKTLVQRRILMLLRKRPEDEISEVEVGVPHEEEGRVYFPLLTSSLALKEGGSQIPGMETESLGQVMNIFVILPALIIPLTTVIPQPAENAPLLSKAWTWHPYLPESAPGMMAQALLSTERWRPQEALLKTEEAKAEGAQDLLRECPNLGVPAP

SEQ ID NO: 864587 - protein, 1141 aa, Homo sapiens [sequence omitted]

SEQ ID NO: 864588 - protein, 999 aa, Homo sapiens
MSFLRGREKLGNFCEQIFSLWCCCRVEKEVGGMEMAHEGMIWSLAWHPLGHILCSGSNDHTSKFWTRNRPGDKMRDRYNLNLLPGMSEDGVEYDDLEPNSLAVIPGMGIPEQLKLAMEQEQMGKDESNEIEMTIPGLDWGMEEVMQKDQKKVPQKKVPYAKPIPAQFQQAWMQNKVPIPAPNEVLNDRKEDIKLEEKKKTQAEIEQEMATLQYTNPQLLEQLKIERLAQKQVEQIQPPPSSGTPLLGPQPFPGQGPMSQIPQGFQQPHPSQQMPMNMAQMGPPGPQGQFRPPGPQGQMGPQGPPLHQGGGGPQGFMGPQGPQGPPQGLPRPQDMHGPQGMQRHPGPHGPLGPQGPPGPQGSSGPQGHMGPQGPPGPQGHIGPQGPPGPQGHLGPQGPPGTQGMQGPPGPRGMQGPPHPHGIQGGPGSQGIQGPVSQGPLMGLNPRGMQGPPGPRENQGPAPQGMIMGHPPQEMRGPHPPGGLLGHGPQEMRGPQEIRGMQGPPPQGSMLGPPQELRGPPGSQSQQGPPQGSLGPPPQGGMQGPPGPQGQQNPARGPHPSQGPIPFQQQKTPLLGDGPRAPFNQEGQSTGPPPLIPGLGQQGAQGRIPPLNPGQGPGPNKGDSRGPPNHHMGPMSERRHEQSGGPEHGPERGPFRGGQDCRGPPDRRGPHPDFPDDFSRPDDFHPDKRFGHRLREFEGRGGPLPQEEKWRRGGPGPPFPPDHREFSEGDGRGAARGPPGAWEGRRPGDERFPRDPEDPRFRGRREESFRRGAPPRHEGRAPPRGRDGFPGPEDFGPEENFDASEEAARGRDLRGRGRGTPRGGRKGLLPTPDEFPRFEGGRKPDSWDGNREPGPGHEHFRDTPRPDHPPHDGHSPASRERSSSLQGMDMASLPPRKRPWHDGPGTSEHREMEAPGGPSEDRGGKGRGGPGPAQRVPKSGRSSSLDGEHHDGYHRDEPFGGPPGSGTPSRGGRSGSNWGRGSNMNSGPPRRGASRGGGRGR

SEQ ID NO: 864589 - protein, 322 aa, Homo sapiens
MATEIGSPPRFFHMPRFQHQAPRQLFYKRPDFAQQQAMQQLTFDGKRMRKAVNRKTIDYNPSVIKYLENRIWQRDQRDMRAIQPDAGYYNDLVPPIGMLNNPMNAVTTKFVRTSTNKVKCPVFVVRWTPEGRRLVTGASSGEFTLWNGLTFNFETILQAHDSPVRAMTWSHNDMWMLTADHGGYVKYWQSNMNNVKMFQAHKEAIREASFSPTDNKFATCSDDGTVRIWDFLRCHEERILRGMADVNCVQRLPPRVIVQKSRITAISSGPHGRVWNFCHKHDGGDTPRVGYTQDPGWLNQKRSGKTCAFKSRENIMTQQTRS

SEQ ID NO: 864590 - protein, 477 aa, Homo sapiens
GLTSSYSLWWMLRSSLKQYSFEALREKSNYSDIPDVKNDFAFILHLADQYDPLYSKRFSIFLSEVSENKLKQINLNNEWTVEKLKSKLVKNAQDKIELHLFMLNGLPDNVFELTEMEVLSLELIPEVKLPSAVSQLVNLKELRVYHSSLVVDHPALAFLEENLKILRLKFTEMGKIPRWVFHLKNLKELYLSGCVLPEQLSTMQLEGFQDLKNLRTLYLKSSLSRIPQVVTDLLPSLQKLSLDNEGSKLVVLNNLKKMVNLKSLELISCDLERIPHSIFSLNNLHELDLRENNLKTVEEIISFQHLQNLSCLKLWHNNIAYIPAQIGALSNLEQLSLDHNNIENLPLQLFLCTKLHYLDLSYNHLTFIPEEIQYLSNLQYFAVTNNNIEMLPDGLFQCKKLQCLLLGKNSLMNLSPHVGELSNLTHLELIGNYLETLPPELEGCQSLKRNCLIVEENLLNTLPLPVTERLQTCLDKC

SEQ ID NO: 864591 - protein, 477 aa, Homo sapiens; identical to SEQ ID NO: 864590

SEQ ID NO: 864592 - protein, 477 aa, Homo sapiens; identical to SEQ ID NO: 864590

SEQ ID NO: 864593 - protein, 231 aa, Homo sapiens
LTWSVRVSGCGELRDWGATGRAGPSGPRRRRRYKAGDWEHVMSECGGRGGGSSSSEDAEDEGGGGGGPAGSDCLSSSPTLATASSAGRLRRGLRGAFLMARQRPELLCGAVALGCALLLALKFTCSRAKDVIIPAKPPVSFFSLRSPVLDLFQGQLDYAEYVRRDSEVVLLFFYAPWCGQSIAARAEIEQAASRLSDQVLFVAINCWWNQGKCRKQKHFFYFPVIYLYHRR

SEQ ID NO: 864594 - protein, 703 aa, Homo sapiens
LTWSVRVSGCGELRDWGATGRAGPSGPRRRRRYKAGDWEHVMSECGGRGGGSSSSEDAEDEGGGGGGPAGSDCLSSSPTLATASSAGRLRRGLRGAFLMARQRPELLCGAVALGCALLLALKFTCSRAKDVIIPAKPPVSFFSLRSPVLDLFQGQLDYAEYVRRDSEVVLLFFYAPWCGQSIAARAEIEQAASRLSDQVLFVAINCWWNQGKCRKQKHFFYFPVIYLYHRSFGPIEYKGPMSAVYIEKFVRRVMKPLLYIPSQSELLDFLSNYEPGVLGYFEFSGSPQPPGYLTFFTSALHSLKKDYLGTVRFGVITNKHLAKLVSLVHSGSVYLHRHFNTSLVFPREVLNYTAENICKWALENQETLFRWLRPHGGKSLLLNNELKKGPALFLFIPFNPLAESHPLIDEITEVALEYNNCHGDQVVERLLQHLRRVDAPVLESLALEVPAQLPDPPTITASPCCNTVVLPQWHSFSRTHNVCELCVNQTSGGMKPSSVSVPQCSFFEMAAALDSFYLKEQTFYHVASDSIECSNFLTSYSPFSYYTACCRTISRGVSGFIDSEQGVFEAPTVAFSSLEKKCEVDAPSSVPHIEENRYLFPEVDMTSTNFTGLSCRTNKTLNIYLLDSNLFWLYAERLGAPSSTQVKEFAAIVDVKEESHYILDPKQALMKLTLGTAGSLFPQALYILLDFIWVNFIDGSHYI

SEQ ID NO: 864595 - protein, 999 aa, Homo sapiens
LTWSVRVSGCGELRDWGATGRAGPSGPRRRRRYKAGDWEHVMSECGGRGGGSSSSEDAEDEGGGGGGPAGSDCLSSSPTLATASSAGRLRRGLRGAFLMARQRPELLCGAVALGCALLLALKFTCSRAKDVIIPAKPPVSFFSLRSPVLDLFQGQLDYAEYVRRDSEVVLLFFYAPWCGQSIAARAEIEQAASRLSDQVLFVAINCWWNQGKCRKQKHFFYFPVIYLYHRSFGPIEYKGPMSAVYIEKFVRRVMKPLLYIPSQSELLDFLSNYEPGVLGYFEFSGSPQPPGYLTFFTSALHSLKKDYLGTVRFGVITNKHLAKLVSLVHSGSVYLHRHFNTSLVFPREVLNYTAENICKWALENQETLFRWLRPHGGKSLLLNNELKKGPALFLFIPFNPLAESHPLIDEITEVALEYNNCHGDQVVERLLQHLRRVDAPVLESLALEVPAQLPDPPTITASPCCNTVVLPQWHSFSRTHNVCELCVNQTSGGMKPSSVSVPQCSFFEMAAALDSFYLKEQTFYHVASDSIECSNFLTSYSPFSYYTACCRTISRGVSGFIDSEQGVFEAPTVAFSSLEKKCEVDAPSSVPHIEENRYLFPEVDMTSTNFTGLSCRTNKTLNIYLLDSNLFWLYAERLGAPSSTQVKEFAAIVDVKEESHYILDPKQALMKLTLESFIQNFSVLYSPLKRHLIGSGSAQFPSQHLITEVTTDTFWEVVLQKQDVLLLYYAPWCGFCPSLNHIFIQLARNLPMDTFTVARIDVSQNDLPWEFMVDRLPTVLFFPCNRKDLSVKYPEDVPITLPNLLRFILHHSDPASSPQNVANSPTKECLQSEAVLQRGHISHLEREIQKLRAEISSLQRAQVQVESQLSSARRDEHRLRQQQRALEEQHSLLHAHSEQLQALYEQKTRELQELARKLQELADASENLLTENTWLKILVATMERKLEGRDGAESLAAQREVHPKQPEPSATPQLPGSSPPPANVSATLVSERNKENRTD

SEQ ID NO: 864596 - protein, 786 aa, Homo sapiens
LTWSVRVSGCGELRDWGATGRAGPSGPRRRRRYKAGDWEHVMSECGGRGGGSSSSEDAEDEGGGGGGPAGSDCLSSSPTLATASSAGRLRRGLRGAFLMARQRPELLCGAVALGCALLLALKFTCSRAKDVIIPAKPPVSFFSLRSPVLDLFQGQLDYAEYVRRDSEVVLLFFYAPWCGQSIAARAEIEQAASRLSDQVLFVAINCWWNQGKCRKQKHFFYFPVIYLYHRSFGPIEYKGPMSAVYIEKFVRRVMKPLLYIPSQSELLDFLSNYEPGVLGYFEFSGSPQPPGYLTFFTSALHSLKKDYLGTVRFGVITNKHLAKLVSLVHSGSVYLHRHFNTSLVFPREVLNYTAENICKWALENQETLFRWLRPHGGKSLLLNNELKKGPALFLFIPFNPLAESHPLIDEITEVALEYNNCHGDQVVERLLQHLRRVDAPVLESLALEVPAQLPDPPTITASPCCNTVVLPQWHSFSRTHNVCELCVNQTSGGMKPSSVSVPQCSFFEMAAALDSFYLKEQTFYHVASDSIECSNFLTSYSPFSYYTACCRTISRGVSGFIDSEQGVFEAPTVAFSSLEKKCEVDAPSSVPHIEENRYLFPEVDMTSTNFTGLSCRTNKTLNIYLLDSNLFWLYAERLGAPSSTQVKEFAAIVDVKEESHYILDPKQALMKLTLESFIQNFSVLYSPLKRHLIGSGSAQFPSQHLITEVTTDTFWEVVLQKQDVLLLYYAPWCGFCPSLNHIFIQLARNLPMDTFTVARIDVSQNDLPWEFMVDRLPTVLFFPCNR

SEQ ID NO: 864597 - protein, 123 aa, Homo sapiens
VSLSLSTRWAVPRISLWPPQRFAASGPAVPLSSLDQDGEHPRNPPHQHSRRTLPEVAAETSQLARPPTRTTAPSTPQGPTPARTTIPGVLRKLKCTQARCLLGIVVDVGQHGGHRIPARPLWD

SEQ ID NO: 864598 - protein, 123 aa, Homo sapiens; identical to SEQ ID NO: 864597

SEQ ID NO: 864599 - protein, 123 aa, Homo sapiens; identical to SEQ ID NO: 864597

SEQ ID NO: 864600 - protein, 123 aa, Homo sapiens; identical to SEQ ID NO: 864597

SEQ ID NO: 864601 - protein, 123 aa, Homo sapiens; identical to SEQ ID NO: 864597

SEQ ID NO: 864602 - protein, 123 aa, Homo sapiens; identical to SEQ ID NO: 864597

SEQ ID NO: 864603 - protein, 123 aa, Homo sapiens; identical to SEQ ID NO: 864597

SEQ ID NO: 864604 - protein, 123 aa, Homo sapiens; identical to SEQ ID NO: 864597

SEQ ID NO: 864605 - protein, 123 aa, Homo sapiens; identical to SEQ ID NO: 864597

SEQ ID NO: 864606 - protein, 145 aa, Homo sapiens
MNELQRRLGPRGLVVLGFPCNQFGHQENAKNEEILNSLKYVRPGGGFEPNFMLFEKCEVNGAGAHPLFAFLREALPAPSDDATALMTDPKLITWSPVCRNDVAWNFEKFLVGPDGVPLRRYSRRFQTIDIEPDIEALLSQGPSCA

SEQ ID NO: 864607 - protein, 74 aa, Homo sapiens
FLEDPRTALITTALMTDPKLITWSPVCRNDVAWNFEKFLVGPDGVPLRRYSRRFQTIDIEPDIEALLSQGPSCA

SEQ ID NO: 864608 - protein, 135 aa, Homo sapiens
MTGNKSHDEEGNLAVAENAKNEEILNSLKYVRPGGGFEPNFMLFEKCEVNGAGAHPLFAFLREALPAPSDDATALMTDPKLITWSPVCRNDVAWNFEKFLVGPDGVPLRRYSRRFQTIDIEPDIEALLSQGPSCA

SEQ ID NO: 864609 - protein, 145 aa, Homo sapiens; identical to SEQ ID NO: 864606

SEQ ID NO: 864610 - protein, 145 aa, Homo sapiens; identical to SEQ ID NO: 864606

SEQ ID NO: 864611 - protein, 145 aa, Homo sapiens; identical to SEQ ID NO: 864606

SEQ ID NO: 864612 - protein, 145 aa, Homo sapiens; identical to SEQ ID NO: 864606

SEQ ID NO: 864613 - protein, 145 aa, Homo sapiens; identical to SEQ ID NO: 864606

SEQ ID NO: 864614 - protein, 145 aa, Homo sapiens; identical to SEQ ID NO: 864606

SEQ ID NO: 864615 - protein, 145 aa, Homo sapiens; identical to SEQ ID NO: 864606

SEQ ID NO: 864616 - protein, 145 aa, Homo sapiens; identical to SEQ ID NO: 864606

SEQ ID NO: 864617 - protein, 145 aa, Homo sapiens; identical to SEQ ID NO: 864606

SEQ ID NO: 864618 - protein, 145 aa, Homo sapiens; identical to SEQ ID NO: 864606

SEQ ID NO: 864619 - protein, 145 aa, Homo sapiens; identical to SEQ ID NO: 864606

SEQ ID NO: 864620 - protein, 145 aa, Homo sapiens; identical to SEQ ID NO: 864606

SEQ ID NO: 864621 - protein, 145 aa, Homo sapiens; identical to SEQ ID NO: 864606

SEQ ID NO: 864622 - protein, 118 aa, Homo sapiens
MCAARLAAARGGGPVGVCLLGAPAGRRGACEPGLPAGQGERQERRDSEFPQVRPAWWWVRAQLHALREVRGERCGGAPSLRLPAGGPASSQRRRHRAYDRPQAHHLVSGVSQRCCLEL

SEQ ID NO: 864623 - protein, 148 aa, Homo sapiens
MCAARLAAARGGGPVGVCLLGAPAGRRGACEPGLPAGQGTTYRECGVPLRHHGPGLHPDERAAAAPRTPGPGGARLPVQPVWASGAPGGAGRGGGGRAVVAGGAGGVLVGAVGSMRGESGYSLVSFLLLVAAEIPLRPWDCAWRAKSR

SEQ ID NO: 864624 - protein, 144 aa, Homo sapiens
MNELQRRLGPRGLVVLGFPCNQFGHQENAKNEEILNSLKYVRPGGGFEGGLCLGGGFSGVFVLGVLVGGGGEALPAPSDDATALMTDPKLITWSPVCRNDVAWNFEKFLVGPDGVPLRRYSRRFQTIDIEPDIEALLSQGPSCA

SEQ ID NO: 864625 - protein, 118 aa, Homo sapiens; identical to SEQ ID NO: 864622

SEQ ID NO: 864626 - protein, 184 aa, Homo sapiens
MCAARLAAARGGGPVGVCLLGAPAGRRGACEPGLPAGQGTTYRECGVPLRHHGPGLHPDERAAAAPRTPGPGGARLPVQPVWASGERQERRDSEFPQVRPAWWWVRAQLHALREVRGERCPYAGTAAASRPLTSSLTSKPCCLKGPAVPRAPLLPRLLGSCSAAVSGGFSSMRVFPLNLRGRNT

SEQ ID NO: 864627 - protein, 145 aa, Homo sapiens; identical to SEQ ID NO: 864606

SEQ ID NO: 864628 - protein, 145 aa, Homo sapiens; identical to SEQ ID NO: 864606

SEQ ID NO: 864629 - protein, 145 aa, Homo sapiens; identical to SEQ ID NO: 864606

SEQ ID NO: 864630 - protein, 117 aa, Homo sapiens
NFVYIPHLLRQYVRPGGGFEPNFMLFEKCEVNGAGAHPLFAFLREALPAPSDDATALMTDPKLITWSPVCRNDVAWNFEKFLVGPDGVPLRRYSRRFQTIDIEPDIEALLSQGPSCA

SEQ ID NO: 864631 - protein, 127 aa, Homo sapiens
GGFEPNFMLFEKCEGILNSLKYVRPGGGFEPNFMLFEKCEVNGAGAHPLFAFLREALPAPSDDATALMTDPKLITWSPVCRNDVAWNFEKFLVGPDGVPLRRYSRRFQTIDIEPDIEALLSQGPSCA

SEQ ID NO: 864632 - protein, 145 aa, Homo sapiens; identical to SEQ ID NO: 864606

SEQ ID NO: 864633 - protein, 145 aa, Homo sapiens; identical to SEQ ID NO: 864606

SEQ ID NO: 864634 - protein, 145 aa, Homo sapiens; identical to SEQ ID NO: 864606

SEQ ID NO: 864635 - protein, 145 aa, Homo sapiens; identical to SEQ ID NO: 864606

SEQ ID NO: 864636 - protein, 148 aa, Homo sapiens; identical to SEQ ID NO: 864623

SEQ ID NO: 864637 - protein, 136 aa, Homo sapiens
MPPACRSGRYIYSRFLGENAKNEEILNSLKYVRPGGGFEPNFMLFEKCEVNGAGAHPLFAFLREALPAPSDDATALMTDPKLITWSPVCRNDVAWNFEKFLVGPDGVPLRRYSRRFQTIDIEPDIEALLSQGPSCA

SEQ ID NO: 864638 - protein, 135 aa, Homo sapiens
MNELQRRLGPRGLVVLGFPCNQFGHQENAKNEEILNSLKYVRPGGGFEPNFMLFEKCEVNGAGAHPLFAFLPTALMTDPKLITWSPVCRNDVAWNFEKFLVGPDGVPLRRYSRRFQTIDIEPDIEALLSQGPSCA

SEQ ID NO: 864639 - protein, 151 aa, Homo sapiens
MNELQRRLGPRGLVVLGFPCNQFGHQENAKNEEILNSLKYVRPGGGFEPNFMLFEKCEVNGAGAHPLFAFLREALPAPSDDATALMTDPKLITWSPVCRNDVAWNFEKFLVGPDGVPLRRYSRRFQTIDIEPDIEACLAVAVLLSRGGFHL

SEQ ID NO: 864640 - protein, 544 aa, Homo sapiens
MATGQDRVVALVDMDCFFVQVEQRQNPHLRNKPCAVVQYKSWKGGGIIAVSYEARAFGVTRSMWADDAKKLCPDLLLAQVRESRGKANLTKYREASVEVMEIMSRFAVIERASIDEAYVDLTSAVQERLQKLQGQPISADLLPSTYIEGLPQGPTTAEETVQKEGMRKQGLFQWLDSLQIDNLTSPDLQLTVGAVIVEEMRAAIERETGFQCSAGISHNKVLAKLACGLNKPNRQTLVSHGSVPQLFSQMPIRKIRSLGGKLGASVIEILGIEYMGELTQFTESQLQSHFGEKNGSWLYAMCRGIEHDPVKPRQLPKTIGCSKNFPGKTALATREQVQWWLLQLAQELEERLTKDRNDNDRVATQLVVSIRVQGDKRLSSLRRCCALTRYDAHKMSHDAFTVIKNCNTSGIQTEWSPPLTMLFLCATKFSASAPSSSTDITSFLSSDPSSLPKVPVTSSEAKTQGSGPAVTATKKATTSLESFFQKAAERQKVKEASLSSLTAPTQAPMSNSPSKPSLPFQTSQSTGTEPFFEAEKSASKAETA

SEQ ID NO: 864641 - protein, 129 aa, Homo sapiens
MWADDAKKLCPDLLLAQVRESRGKANLTKYREASVEVMEIMSRFAVIERASIDEAYVDLTSAVQERLQKLQGQPISADLLPSTYIEGLPQGPTTAEETVQKGTSIASYCFCFLPLEPALLGHADSPWNN

SEQ ID NO: 864642 - protein, 713 aa, Homo sapiens
MATGQDRVVALVDMDCFFVQVEQRQNPHLRNKPCAVVQYKSWKGGGIIAVSYEARAFGVTRSMWADDAKKLCPDLLLAQVRESRGKANLTKYREASVEVMEIMSRFAVIERASIDEAYVDLTSAVQERLQKLQGQPISADLLPSTYIEGLPQGPTTAEETVQKEGMRKQGLFQWLDSLQIDNLTSPDLQLTVGAVIVEEMRAAIERETGFQCSAGISHNKVLAKLACGLNKPNRQTLVSHGSVPQLFSQMPIRKIRSLGGKLGASVIEILGIEYMGELTQFTESQLQSHFGEKNGSWLYAMCRGIEHDPVKPRQLPKTIGCSKNFPGKTALATREQVQWWLLQLAQELEERLTKDRNDNDRVATQLVVSIRVQGDKRLSSLRRCCALTRYDAHKMSHDAFTVIKNCNTSGIQTEWSPPLTMLFLCATKFSASAPSSSTDITSFLSSDPSSLPKVPVTSSEAKTQGSGPAVTATKKATTSLESFFQKAAERQKVKEASLSSLTAPTQAPMSNSPSKPSLPFQTSQSTGTEPFFKQKSLLLKQKQLNNSSVSSPQQNPWSNCKALPNSLPTEYPGCVPVCEGVSKLEESSKATPAEMDLAHNSQSMHASSASKSVLEVTQKATPNPSLLAAEDQVPCEKCGSLVPVWDMPEHMDYHFALELQKSFLQPHSSNPQVVSAVSHQGKRNPKSPLACTNKRPRPEGMQTLESFFKPLTH

SEQ ID NO: 864643 - protein, 713 aa, Homo sapiens; identical to SEQ ID NO: 864642

SEQ ID NO: 864644 - protein, 651 aa, Homo sapiens
MWADDAKKLCPDLLLAQVRESRGKANLTKYREASVEVMEIMSRFAVIERASIDEAYVDLTSAVQERLQKLQGQPISADLLPSTYIEGLPQGPTTAEETVQKEGMRKQGLFQWLDSLQIDNLTSPDLQLTVGAVIVEEMRAAIERETGFQCSAGISHNKVLAKLACGLNKPNRQTLVSHGSVPQLFSQMPIRKIRSLGGKLGASVIEILGIEYMGELTQFTESQLQSHFGEKNGSWLYAMCRGIEHDPVKPRQLPKTIGCSKNFPGKTALATREQVQWWLLQLAQELEERLTKDRNDNDRVATQLVVSIRVQGDKRLSSLRRCCALTRYDAHKMSHDAFTVIKNCNTSGIQTEWSPPLTMLFLCATKFSASAPSSSTDITSFLSSDPSSLPKVPVTSSEAKTQGSGPAVTATKKATTSLESFFQKAAERQKVKEASLSSLTAPTQAPMSNSPSKPSLPFQTSQSTGTEPFFKQKSLLLKQKQLNNSSVSSPQQNPWSNCKALPNSLPTEYPGCVPVCEGVSKLEESSKATPAEMDLAHNSQSMHASSASKSVLEVTQKATPNPSLLAAEDQVPCEKCGSLVPVWDMPEHMDYHFALELQKSFLQPHSSNPQVVSAVSHQGKRNPKSPLACTNKRPRPEGMQTLESFFKPLTH

SEQ ID NO: 864645 - protein, 598 aa, Homo sapiens
MATGQDRVVALVDMDCFFVQVEQRQNPHLRNKPCAVVQYKSWKGGGIIAVSYEARAFGVTRSMWADDAKKLCPDLLLAQVRESRGKANLTKYREASVEVMEIMSRFAVIERASIDEAYVDLTSAVQERLQKLQGQPISADLLPSTYIEGLPQGPTTAEETVQKEGMRKQGLFQWLDSLQIDNLTSPDLQLTVGAVIVEEMRAAIERETGFQCSAGISHNKVLAKLACGLNKPNRQTLVSHGSVPQLFSQMPIRKIRSLGGKLGASVIEILGIEYMGELTQFTESQLQSHFGEKNGSWLYAMCRGIEHDPVKPRQLPKTIGCSKNFPGKTALATREQVQWWLLQLAQELEERLTKDRNDNDRVATQLVVSIRVQGDKRLSSLRRCCALTRYDAHKMSHDAFTVIKNCNTSGIQTEWSPPLTMLFLCATKFSASAPSSSTDITSFLSSDPSSLPKVPVTSSEAKTQGSGPAVTATKKATTSLESFFQKAAERQKVKEASLSSLTAPTQAPMSNSPSKPSLPFQTSQSTGTEPFSRKVVLGRTAYNLGFPPKPAPVGSPSPVRGRWWGARPHPGLAGGVHVGGAPLVVWGSWVPFRRRLLS

SEQ ID NO: 864646 - protein, 414 aa, Homo sapiens
MATGQDRVVALVDMDCFFVQVEQRQNPHLRNKPCAVVQYKSWKGGGIIAVSYEARAFGVTRSMWADDAKKLCPDLLLAQVRESRGKANLTKYREASVEVMEIMSRFAVIERASIDEAYVDLTSAVQERLQKLQGQPISADLLPSTYIEGLPQGPTTAEETVQKEGMRKQGLFQWLDSLQIDNLTSPDLQLTVGAVIVEEMRAAIERETGFQCSAGISHNKVLAKLACGLNKPNRQTLVSHGSVPQLFSQMPIRKIRSLGGKLGASVIEILGIEYMGELTQFTESQLQSHFGEKNGSWLYAMCRGIEHDPVKPRQLPKTIGCSKNFPGKTALATREQVQWWLLQLAQELEERLTKDRNDNDRVATQLVVSIRVQGDKRLSSLRRCCALTRYDAHKMSHDAFTVIKNCNTSGIQTE

SEQ ID NO: 864647 - protein, 713 aa, Homo sapiens; identical to SEQ ID NO: 864642

SEQ ID NO: 864648 - protein, 713 aa, Homo sapiens; identical to SEQ ID NO: 864642

SEQ ID NO: 864649 - protein, 319 aa, Homo sapiens
MSHDAFTVIKNCNTSGIQTEWSPPLTMLFLCATKFSASAPSSSTDITSFLSSDPSSLPKVPVTSSEAKTQGSGPAVTATKKATTSLESFFQKAAERQKVKEASLSSLTAPTQAPMSNSPSKPSLPFQTSQSTGTEPFFKQKSLLLKQKQLNNSSVSSPQQNPWSNCKALPNSLPTEYPGCVPVCEGVSKLEESSKATPAEMDLAHNSQSMHASSASKSVLEVTQKATPNPSLLAAEDQVPCEKCGSLVPVWDMPEHMDYHFALELQKSFLQPHSSNPQVVSAVSHQGKRNPKSPLACTNKRPRPEGMQTLESFFKPLTH

SEQ ID NO: 864650 - protein, 191 aa, Homo sapiens
MATGQDRVVALVDMDCFFVQVEQRQNPHLRNKPCAVVQYKSWKGGGIIAVSYEARAFGVTRSMWADDAKKLCPDLLLAQVRESRGKANLTKYREASVEVMEIMSRFAVIERASIDEAYVDLTSAVQERLQKLQGQPISADLLPSTYIEGLPQGPTTAEETVQKGTSIASYCFCFLPLEPALLGHADSPWNN

SEQ ID NO: 864651 - protein, 40 aa, Homo sapiens
MSMKAQHIQKNTNKNPSQKSPPKPKQQHTRKNTQNRNEPT

SEQ ID NO: 864652 - protein, 520 aa, Homo sapiens
MASNDKGMAPSLGSPWASQMGPWDAILKAVKDQLPSLDSDSPLSDYGEEELFIFQRNQTSLIPDLSEELAEDPADGDKSRAWVAAAEESLPEPVLVPAELATEPGCRQNTRTKDASSQEGRDPGRPFESSGEVSALLGMAEEPPRWLEGDLGSLSFNTKGSQGPPWDPQAEATLSCHEGDPKAEPLSTASQESVNRRALRQERRKMIETDILQKVTRDACGPTSSDKGGVKEAPCHAAESAPRSKMPLVEPPEGPPVLSLQQLEAWDLDDILQSLAGQEDNQGNRAPGTVWWAADHRQVQDRMVPSAHNRLMEQLALLCTTQSKASACARKVPADTPQDTKEADSGSRCASRKQGSQAGPGPQLAQGMRLNAESPTIFIDLRQMELPDHLSPESSSHSSSDSEEEEEEEMAALGDAEGASPSSLGLRTCTGKSQLLQQLRAFQKGTAQPELPASKGPAGGRAQAPEDTAGSRTGRKQHMKLCAKGQSAQARLPRGRPRALGDVPEPGAAREALMPPLEQL

SEQ ID NO: 864653 - protein, 247 aa, Homo sapiens
MSGLRPGTQVDPEIELFVKAGSDGESIGNCPFCQRLFMILWLKGVKFNVTTVDMTRKPEELKDLAPGTNPPFLVYNKELKTDFIKIEEFLEQTLAPPRYPHLSPKYKESFDVGCNLFAKFSAYIKNTQKEANKNFEKSLLKEFKRLDDYLNTPLLDEIDPDSAEEPPVSRRLFLDGDQLTLADCSLLPKLNIIKVAAKKYRDFDIPAEFSGVWRYLHNAYAREEFTHTCPEDKEIENTYANVAKQKS

SEQ ID NO: 864654 - protein, 247 aa, Homo sapiens; identical to SEQ ID NO: 864653

SEQ ID NO: 864655 - protein, 120 aa, Homo sapiens
SGLLLKHFEKSLLKEFKRLDDYLNTPLLDEIDPDSAEEPPVSRRLFLDGDQLTLADCSLLPKLNIIKVAAKKYRDFDIPAEFSGVWRYLHNAYAREEFTHTCPEDKEIENTYANVAKQKS

SEQ ID NO: 864656 - protein, 247 aa, Homo sapiens; identical to SEQ ID NO: 864653

SEQ ID NO: 864657 - protein, 205 aa, Homo sapiens
MSGLRPGTQVDPEIELFVKAGSDGESIGNCPFCQRLFMILWLKGVKFNVTTVDMTRYPHLSPKYKESFDVGCNLFAKFSAYIKNTQKEANKNFEKSLLKEFKRLDDYLNTPLLDEIDPDSAEEPPVSRRLFLDGDQLTLADCSLLPKLNIIKVAAKKYRDFDIPAEFSGVWRYLHNAYAREEFTHTCPEDKEIENTYANVAKQKS

SEQ ID NO: 864658 - protein, 229 aa, Homo sapiens
MSGLRPGTQVDPEIELFVKAGSDGESIGNCPFCQRLFMILWLKGVKFNVTTVDMTRKPEELKDLAPGTNPPFLVYNKELKTDFIKIEEFLEQTLAPPRYPHLSPKYKESFDVGCNLFAKFSAYIKNTQKEANKNFEKSLLKEFKRLDDYLNTPLLDEIDPDSAEEPPVSRRLFLDGDQLTLADCSLLPKLNIIKIGSCSVTQVGVQWHDQGLLQPPPLRLKQSSHPTLE

SEQ ID NO: 864659 - protein, 227 aa, Homo sapiens
MSGLRPGTQVDPEIELFVKAGSDGESIGNCPFCQRLFMILWLKGVKFNVTTVDMTRKPEELKDLAPGTNPPFLVYNKELKTDFIKIEEFLEQTLAPPRYPHLSPKYKESFDVGCNLFAKFSAYIKNTQKEANKILDEIDPDSAEEPPVSRRLFLDGDQLTLADCSLLPKLNIIKVAAKKYRDFDIPAEFSGVWRYLHNAYAREEFTHTCPEDKEIENTYANVAKQKS

SEQ ID NO: 864660 - protein, 245 aa, Homo sapiens
MSPPRPQTVPKALRDATARPSNAWASDIRPPGAWLDARAASPLISPPSRRVERLLGPEPPGGGGIGAGRRHLPPSTAPLAAPSPACARPRSGAGRLAPSAIRRAARLGLGPARWQSRAAAFYFVRGFRTGWSFVGWVVLGTSAKRTRLFFFLSKMAASSRAQVLSLYRAMLRESKRFSAYNYRTYAVRRIRDAFRENKNVKDPVEIQTLVNKAKRDLGVIRRQVHIGQLYSTDKLIIENRDMPRT

SEQ ID NO: 864661 - protein, 245 aa, Homo sapiens; identical to SEQ ID NO: 864660

SEQ ID NO: 864662 - protein, 245 aa, Homo sapiens; identical to SEQ ID NO: 864660

SEQ ID NO: 864663 - protein, 99 aa, Homo sapiens
SVTRATRPPGCRKGRCPRNTNVSAKTPDGSQRLSVMQLHVPRMPGPPISVRQELGWMHGRPVLLFPRPPAAWSGCWVPSLRAGAGSGRGGGISLPAPPP

SEQ ID NO: 864664 - protein, 99 aa, Homo sapiens
MAASSRAQVLSLYRAMLRESKRFSAYNYRTYAVRRIRDAFRENKNVKDPVEIQTLVNKAKRDLGVIRRQMDSHSVAQAGVHWNDLSSLQPLPPWFKQFS

SEQ ID NO: 864665 - protein, 245 aa, Homo sapiens; identical to SEQ ID NO: 864660

SEQ ID NO: 864666 - protein, 99 aa, Homo sapiens; identical to SEQ ID NO: 864663

SEQ ID NO: 864667 - protein, 917 aa, Homo sapiens
RCWPRRGSFWKALLFRFSVPVPGVAQTDPVNMSGFSPELIDYLEGKISFEEFERRREERKTREKKSLQEKGKLSAEENPDDSEVPSSSGINSTKSQDKDVNEGETSDGVRKSVHKVFASMLGENEDDEEEEEEEEEEEEEEETPEQPTAGDVFVLEMVLNRETKKMMKEKRPRSKLPRALRGLMGEANIRFARGEREEAILMCMEIIRQAPLAYEPFSTLAMIYEDQGDMEKSLQFELIAAHLNPSDTEEWVRLAEMSLEQDNIKQAIFCYTKALKYEPTNVRYLWERSSLYEQMGDHKMAMDGYRRILNLLSPSDGERFMQLARDMAKSYYEANDVTSAINIIDEAFSKHQGLVSMEDVNIAAELYISNKQYDKALEIITDFSGIVLEKKTSEEGTSEENKAPENVTCTIPDGVPIDITVKLMVCLVHLNILEPLNPLLTTLVEQNPEDMGDLYLDVAEAFLDVGEYNSALPLLSALVCSERYNLAVVWLRHAECLKALGYMERAAESYGKVVDLAPLHLDARISLSTLQQQLGQPEKALEALEPMYDPDTLAQDANAAQQELKLLLHRSTLLFSQGKMYGYVDTLLTMLAMLLKVAMNRAQVCLISSSKSGERHLYLIKVSRDKISDSNDQESANCDAKAIFAVLTSVLTKDDWWNLLLKAIYSLCDLSRFQEAELLVDSSLEYYSFYDDRQKRKELEYFGLSAAILDKNFRKAYNYIRIMVMENVNKPQLWNIFNQVTMHSQDVRHHRFCLRLMLKNPENHALCVLNGHNAFVSGSFKHALGQYVQAFRTHPDEPLYSFCIGLTFIHMASQKYVLRRHALIVQGFSFLNRYLSLRGPCQESFYNLGRGLHQLGLIHLAIHYYQKALELPPLVVEGIELDQLDLRRDIAYNLSLIYQSSGNTGMAQTLLYTYCSI

SEQ ID NO: 864668 - protein, 734 aa, Homo sapiens [sequence omitted]

SEQ ID NO: 864669 - protein, 891 aa, Homo sapiens
RCWPRRGSFWKALLFRFSVPVPGVAQTDPVNMSGFSPELIDYLEGKISFEEFERRREERKTREKKSLQEKGKLSAEENPDDSEVPSSSGINSTKSQDKDVNEGETSDGVRKSVHKVFASMLGENEDDEEEEEEEEEEEEEEETPEQPTAGDVFVLEMVLNRETKKMMKEKRPRSKLPRALRGLMGEANIRFARGEREEAILMCMEIIRQAPLAYEPFSTLAMIYEDQGDMEKSLQFELIAAHLNPSDTEEWVRLAEMSLEQDNIKQAIFCYTKALKYEPTNVRYLWERSSLYEQMGDHKMAMDGYRRILNLLSPSDGERFMQLARDMAKSYYEANDVTSAINIIDEAFSKHQGLVSMEDVNIAAELYISNKQYDKALEIITDFSGIVLEKKTSEEGTSEENKAPENVTCTIPDGVPIDITVKLMVCLVHLNILEPLNPLLTTLVEQNPEDMGDLYLDVAEAFLDVGEYNSALPLLSALVCSERYNLAVVWLRHAECLKALGYMERAAESYGKVVDLAPLHLDARISLSTLQQQLGQPEKALEALEPMYDPDTLAQDANAAQQELKLLLHRSTLLFSQGKMYGYVDTLLTMLAMLLKMVLSSCRKTSSGLPLILHYAIFAVLTSVLTKDDWWNLLLKAIYSLCDLSRFQEAELLVDSSLEYYSFYDDRQKRKELEYFGLSAAILDKNFRKAYNYIRIMVMENVNKPQLWNIFNQVTMHSQDVRHHRFCLRLMLKNPENHALCVLNGHNAFVSGSFKHALGQYVQAFRTHPDEPLYSFCIGLTFIHMASQKYVLRRHALIVQGFSFLNRYLSLRGPCQESFYNLGRGLHQLGLIHLAIHYYQKALELPPLVVEGIELDQLDLRRDIAYNLSLIYQSSGNTGMAQTLLYTYCSI

SEQ ID NO: 864670 - protein, 558 aa, Homo sapiens
KPWQLLLYVLSIQFDKAKDIITDFSGIVLEKKTSEEGTSEENKAPENVTCTIPDGVPIDITVKLMVCLVHLNILEPLNPLLTTLVEQNPEDMGDLYLDVAEAFLDVGEYNSALPLLSALVCSERYNLAVVWLRHAECLKALGYMERAAESYGKVVDLAPLHLDARISLSTLQQQLGQPEKALEALEPMYDPDTLAQDANAAQQELKLLLHRSTLLFSQGKMYGYVDTLLTMLAMLLKVAMNRAQVCLISSSKSGERHLYLIKVSRDKISDSNDQESANCDAKAIFAVLTSVLTKDDWWNLLLKAIYSLCDLSRFQEAELLVDSSLEYYSFYDDRQKRKELEYFGLSAAILDKNFRKAYNYIRIMVMENVNKPQLWNIFNQVTMHSQDVRHHRFCLRLMLKNPENHALCVLNGHNAFVSGSFKHALGQYVQAFRTHPDEPLYSFCIGLTFIHMASQKYVLRRHALIVQGFSFLNRYLSLRGPCQESFYNLGRGLHQLGLIHLAIHYYQKALELPPLVVEGIELDQLDLRRDIAYNLSLIYQSSGNTGMAQTLLYTYCSI

SEQ ID NO: 864671 - protein, 825 aa, Homo sapiens
RCWPRRGSFWKALLFRFSVPVPGVAQTDPVNMSGFSPELIDYLEGKISFEEFERRREERKTREKKSLQEKGKLSAEENPDDSEVPSSSGINSTKSQDKDVNEGETSDGVRKSVHKVFASMLGENEDDEEEEEEEEEEEEEEETPEQPTAGDVFVLEMVLNRETKKMMKEKRPRSKLPRALRGLMGEANIRFARGEREEAILMCMEIIRQAPLAYEPFSTLAMIYEDQGDMEKSLQFELIAAHLNPSDTEEWVRLAEMSLEQDNIKQAIFCYTKALKYEPTNVRYLWERSSLYEQMGDHKMAMDGYRRILNLLSPSDGERFMQLARDMAKSYYEANDVTSAINIIDEAFSKHQGLVSMEDVNIAAELYISNKQYDKALEIITDFSGIVLEKKTSEEGTSEENKAPENVTCTIPDGVPIDITVKLMVCLVHLNILEPLNPLLTTLVEQNPEDMGDLYLDVAEAFLDVGEYNSALPLLSALVCSERYNLAVVWLRHAECLKALGYMERAAESYGKVVDLAPLHLDARISLSTLQQQLGQPEKALEALEPMYDPDTLAQDANAAQQELKLLLHRSTLLFSQGKMYGYVDTLLTMLAMLLKVAMNRAQVCLISSSKSGERHLYLIKVSRDKISDSNDQESANCDAKAIFAVLTSVLTKDDWWNLLLKAIYSLCDLSRFQEAELLVDSSLEYYSFYDDRQKRKELEYFGLSAAILDKNFRKAYNYIRIMVMENVNKPQLWNIFNQVTMHSQDVRHHRFCLRLMLKNPENHALCVLNGHNAFVSGSFKHALGQYVQAFRTHPDEPLYSFVSLTGQVLYPLPQVDAAANLVVV

SEQ ID NO: 864672 - protein, 507 aa, Homo sapiens
RCWPRRGSFWKALLFRFSVPVPGVAQTDPVNMSGFSPELIDYLEGKISFEEFERRREERKTREKKSLQEKGKLSAEENPDDSEVPSSSGINSTKSQDKDVNEGETSDGVRKSVHKVFASMLGENEDDEEEEEEEEEEEEEEETPEQPTAGDVFVLEMVLNRETKKMMKEKRPRSKLPRALRGLMGEANIRFARGEREEAILMCMEIIRQAPLAYEPFSTLAMIYEDQGDMEKSLQFELIAAHLNPSDTEEWVRLAEMSLEQDNIKQAIFCYTKALKYEPTNVRYLWERSSLYEQMGDHKMAMDGYRRILNLLSPSDGERFMQLARDMAKSYYEANDVTSAINIIDEAFSKHQGLVSMEDVNIAAELYISNKQYDKALEIITDFSGIVLEKKTSEEGTSEENKAPENVTCTIPDGVPIDITVKLMVCLVHLNILEPLNPLLTTLVEQNPEDMGDLYLDVAEAFLDVGEYNSALPLLSALVCSERYNLAVVWLRHAGNTFLWEEEVLII

SEQ ID NO: 864673 - protein, 69 aa, Homo sapiens
RCWPRRGSFWKALLFRFSVPVPGVAQTDPVNMSGFSPELIDYLEGKISFEEFERRREERKTREKKVRRC

SEQ ID NO: 864674 - protein, 917 aa, Homo sapiens; identical to SEQ ID NO: 864667

SEQ ID NO: 864675 - protein, 752 aa, Homo sapiens
MRKEKRPRSKLPRALRGLMGEANIRFARGEREEAILMCMEIIRQAPLAYEPFSTLAMIYEDQGDMEKSLQFELIAAHLNPSDTEEWVRLAEMSLEQDNIKQAIFCYTKALKYEPTNVRYLWERSSLYEQMGDHKMAMDGYRRILNLLSPSDGERFMQLARDMAKSYYEANDVTSAINIIDEAFSKHQGLVSMEDVNIAAELYISNKQYDKALEIITDFSGIVLEKKTSEEGTSEENKAPENVTCTIPDGVPIDITVKLMVCLVHLNILEPLNPLLTTLVEQNPEDMGDLYLDVAEAFLDVGEYNSALPLLSALVCSERYNLAVVWLRHAECLKALGYMERAAESYGKVVDLAPLHLDARISLSTLQQQLGQPEKALEALEPMYDPDTLAQDANAAQQELKLLLHRSTLLFSQGKMYGYVDTLLTMLAMLLKVAMNRAQVCLISSSKSGERHLYLIKVSRDKISDSNDQESANCDAKAIFAVLTSVLTKDDWWNLLLKAIYSLCDLSRFQEAELLVDSSLEYYSFYDDRQKRKELEYFGLSAAILDKNFRKAYNYIRIMVMENVNKPQLWNIFNQVTMHSQDVRHHRFCLRLMLKNPENHALCVLNGHNAFVSGSFKHALGQYVQAFRTHPDEPLYSFCIGLTFIHMASQKYVLRRHALIVQGFSFLNRYLSLRGPCQESFYNLGRGLHQLGLIHLAIHYYQKALELPPLVVEGIELDQLDLRRDIAYNLSLIYQSSGNTGMAQTLLYTYCSI

SEQ ID NO: 864676 - protein, 917 aa, Homo sapiens; identical to SEQ ID NO: 864667

SEQ ID NO: 864677 - protein, 656 aa, Homo sapiens
RCWPRRGSFWKALLFRFSVPVPGVAQTDPVNMSGFSPELIDYLEGKISFEEFERRREERKTREKKSLQEKGKLSAEENPDDSEVPSSSGINSTKSQDKDVNEGETSDGVRKSVHKVFASMLGENEDDEEEEEEEEEEEEEEETPEQPTAGDVFVLEMVLNRETKKMMKEKRPRSKLPRALRGLMGEANIRFARGEREEAILMCMEIIRQAPLAYEPFSTLAMIYEDQGDMEKSLQFELIAAHLNPSDTEEWVRLAEMSLEQDNIKQAIFCYTKALKYEPTNVRYLWERSSLYEQMGDHKMAMDGYRRILNLLSPSDGERFMQLARDMAKSYYEANDVTSAINIIDEAFSKHQGLVSMEDVNIAAELYISNKQYDKALEIITDFSGIVLEKKTSEEGTSEENKAPENVTCTIPDGVPIDITVKLMVCLVHLNILEPLNPLLTTLVEQNPEDMGDLYLDVAEAFLDVGEYNSALPLLSALVCSERYNLAVVWLRHAECLKALGYMERAAESYGKVVDLAPLHLDARISLSTLQQQLGQPEKALEALEPMYDPDTLAQDANAAQQELKLLLHRSTLLFSQGKMYGYVDTLLTMLAMLLKVAMNRAQVCLISSSKSGERHLYLIKVSRDKISDSNDQESANCDAKGNNFICIMLYKIWLN

SEQ ID NO: 864678 - protein, 165 aa, Homo sapiens
RKGKGPICLFSRPTLRPSRSKVSLIEGRGANMAARWRFWCVSVTMVVALLIVCDVPSASAQRKKEMVLSEKVSQLMEWTNKRPVIRMNGDKFRRLVKAPPRNYSVIVMFTALQLHRQCVVCKQADEEFQILANSWRYSSAFTNRIFFAMVDFDEGSDVFQMFQVF

SEQ ID NO: 864679 - protein, 366 aa, Homo sapiens
RKGKGPICLFSRPTLRPSRSKVSLIEGRGANMAARWRFWCVSVTMVVALLIVCDVPSASAQRKKEMVLSEKVSQLMEWTNKRPVIRMNGDKFRRLVKAPPRNYSVIVMFTALQLHRQCVVCKQADEEFQILANSWRYSSAFTNRIFFAMVDFDEGSDVFQMLNMNSAPTFINFPAKGKPKRGDTYELQVRGFSAEQIARWIADRTDVNIRVIRPPNYAGPLMLGLLLAVIGGLVYLRRSNMEFLFNKTGWAFAALCFVLAMTSGQMWNHIRGPPYAHKNPHTGHVNYIHGSSQAQFVAETHIVLLFNGGVTLGMVLLCEAATSDMDIGKRKIMCVAGIGLVVLFFSWMLSIFRSKYHGYPYSFLMS

SEQ ID NO: 864680 - protein, 335 aa, Homo sapiens
MAARWRFWCVSVTMVVALLIVCDVPSASAQRKKEMVLSEKVSQLMEWTNKRPVIRMNGDKFRRLVKAPPRNYSVIVMFTALQLHRQCVVCKQADEEFQILANSWRYSSAFTNRIFFAMVDFDEGSDVFQMLNMNSAPTFINFPAKGKPKRGDTYELQVRGFSAEQIARWIADRTDVNIRVIRPPNYAGPLMLGLLLAVIGGLVYLRRSNMEFLFNKTGWAFAALCFVLAMTSGQMWNHIRGPPYAHKNPHTGHVNYIHGSSQAQFVAETHIVLLFNGGVTLGMVLLCEAATSDMDIGKRKIMCVAGIGLVVLFFSWMLSIFRSKYHGYPYSFLMS

SEQ ID NO: 864681 - protein, 366 aa, Homo sapiens; identical to SEQ ID NO: 864679

SEQ ID NO: 864682 - protein, 366 aa, Homo sapiens; identical to SEQ ID NO: 864679

SEQ ID NO: 864683 - protein, 301 aa, Homo sapiens
MVLSEKVSQLMEWTNKRPVIRMNGDKFRRLVKAPPRNYSVIVMFTALQLHRQCVVCKQADEEFQILANSWRYSSAFTNRIFFAMVDFDEGSDVFQMLNMNSAPTFINFPAKGKPKRGDTYELQVRGFSAEQIARWIADRTDVNIRVIRPPNYAGPLMLGLLLAVIGGLVYLRRSNMEFLFNKTGWAFAALCFVLAMTSGQMWNHIRGPPYAHKNPHTGHVNYIHGSSQAQFVAETHIVLLFNGGVTLGMVLLCEAATSDMDIGKRKIMCVAGIGLVVLFFSWMLSIFRSKYHGYPYSFLMS

SEQ ID NO: 864684 - protein, 366 aa, Homo sapiens; identical to SEQ ID NO: 864679

SEQ ID NO: 864685 - protein, 112 aa, Homo sapiens
RKGKGPICLFSRPTLRPSRSKVSLIEGRGANMAARWRFWCVSVTMVVALLIVCDVPSASAQRKKEMVLSEKVSQLMEWTNKRPVIRMNGDKFRRLVKAPPRNYSVISSPVCS

SEQ ID NO: 864686 - protein, 281 aa, Homo sapiens
RKGKGPICLFSRPTLRPSRSKVSLIEGRGANMAARWRFWCVSVTMVVALLIVCDVPSASAQRKKEMVLSEKVSQLMEWTNKRPVIRMNGDKFRRLVKAPPRNYSVIVMFTALQLHRQCVVCKQADEEFQILANSWRYSSAFTNRIFFAMVDFDEGSDVFQMLNMNSAPTFINFPAKGKPKRGDTYELQVRGFSAEQIARWIADRTDVNIRVIRPPNYAGPLMLGLLLAVIGGLVYLRRSNMEFLFNKTGWAFAALVSEFQKTKNYLNKIPNSVFLGKLLFM

SEQ ID NO: 864687 - protein, 366 aa, Homo sapiens; identical to SEQ ID NO: 864679

SEQ ID NO: 864688 - protein, 366 aa, Homo sapiens; identical to SEQ ID NO: 864679

SEQ ID NO: 864689 - protein, 366 aa, Homo sapiens; identical to SEQ ID NO: 864679

SEQ ID NO: 864690 - protein, 366 aa, Homo sapiens; identical to SEQ ID NO: 864679

SEQ ID NO: 864691 - protein, 148 aa, Homo sapiens
RKGKGPICLFSRPTLRPSRSKVSLIEGRGANMAARWRFWCVSVTMVVALLIVCDVPSASAQRKKEMVLSEKVSQLMEWTNKRPVIRMNGDKFRRLVKAPPRNYSVIVMFTALQCTPAWQQSETPSQKKKKKVRKKRTPLEWERKIIKY

SEQ ID NO: 864692 - protein, 110 aa, Homo sapiens
MDGEWAPERQGMDDVSLPSLCTGRLGECWCWGHRASTRAFIFARVLVSVNLCVHVSLHGSECLCECTNVCLYICGGLRAKAPRLGFGIQEPHLGLGMEGQHKAAHLSATS

SEQ ID NO: 864693 - protein, 521 aa, Homo sapiens
MGRKKIQIQRITDERNRQVTFTKRKFGLMKKAYELSVLCDCEIALIIFNHSNKLFQYASTDMDKVLLKYTEYNEPHESRTNADIIETLRKKGFNGCDSPEPDGEDSLEQSPLLEDKYRRASEELDGLFRRYGSTVPAPNFAMPVTVPVSNQSSLQFSNPSGSLVTPSLVTSSLTDPRLLSPQQPALQRNSVSPGLPQRPASAGAMLGGDLNSANGACPSPVGNGYVSARASPGLLPVANGNSLNKVIPAKSPPPPTHSTQLGAPSRKPDLRVITSQAGKGLMHHLTEDHLDLNNAQRLGVSQSTHSLTTPVVSVATPSLLSQGLPFSSMPTAYNTDYQLTSAELSSLPAFSSPGGLSLGNVTAWQQPQQPQQPQQPQPPQQQPPQPQQPQPQQPQQPQQPPQQQSHLVPVSLSNLIPGSPLPHVGAALTVTTHPHISIKSEPVSPSRERSPAPPPPAVFPAARPEPGDGLSSPAGGSYETGDRDDGRGDFGPTLGLLRPAPEPEAEGSAVKRMRLDTWTLK

SEQ ID NO: 864694 - protein, 521 aa, Homo sapiens; identical to SEQ ID NO: 864693

SEQ ID NO: 864695 - protein, 521 aa, Homo sapiens; identical to SEQ ID NO: 864693

SEQ ID NO: 864696 - protein, 150 aa, Homo sapiens
MSLPGNSHSSPSSRSSHSLHSSSHRSHSSHSHSSLSSRNSHLSNSPTWSLYLSATSSRAAPCPTWVLPSQSPPTPTSASSQNRCPQAVSAALRLPLQLCSQLPALSLAMVSAAQPGDPMRRETGMTDGGTSGPHWACCAQPQSLRLRAQL

SEQ ID NO: 864697 - protein, 122 aa, Homo sapiens
QAVLARGLRWRKEAKYQQQPRRLRRSAPVPRLPAARLLAPAPTTGAQASRRRPGPARTPASFIILPARSCGFPVLKIPRTRGEGYPLFAVTTPFPQPGWRLCRRYPADHELSTVPRPFMSTV

SEQ ID NO: 864698 - protein, 521 aa, Homo sapiens; identical to SEQ ID NO: 864693

SEQ ID NO: 864699 - protein, 426 aa, Homo sapiens
MGRKKIQIQRITDERNRQVTFTKRKFGLMKKAYELSVLCDCEIALIIFNHSNKLFQYASTDMDKVLLKYTEYNEPHESRTNADIIETLRKKGFNGCDSPEPDGEDSLEQSPLLEDKYRRASEELDGLFRRYGSTVPAPNFAMPVTVPVSNQSSLQFSNPSGSLVTPSLVTSSLTDPRLLSPQQPALQRNSVSPGLPQRPASAGAMLGGDLNSANGACPSPVGNGYVSARASPGLLPVANGNSLNKVIPAKSPPPPTHSTQLGAPSRKPDLRVITSQAGKGLMHHLNNAQRLGVSQSTHSLTTPVVSVATPSLLSQGLPFSSMPTAYNTDYQLTSAELSSLPAFSSPGGLSLGNVTAWQQPQQPQQPQQPQPPQQQPPQPQQPQPQQPQQPQQPPPCSWRPYCLWLPPCPTTSRLHPTFPLGYCNCK

SEQ ID NO: 864700 - protein, 146 aa, Homo sapiens [sequence omitted]

SEQ ID NO: 864701 - protein, 514 aa, Homo sapiens
MGRKKIQIQRITDERNRQVTFTKRKFGLMKKAYELSVLCDCEIALIIFNHSNKLFQYASTDMDKVLLKYTEYNEPHESRTNADIIETLRKKGFNGCDSPEPDGEDSLEQSPLLEDKYRRASEELDGLFRRYGSTVPAPNFAMPVTVPVSNQSSLQFSNPSGSLVTPSLVTSSLTDPRLLSPQQPALQRNSVSPGLPQRPASAGAMLGGDLNSANGACPSPVGNGYVSARASPGLLPVANGNSLNKVIPAKSPPPPTHSTQLGAPSRKPDLRVITSQAGKGLMHHLNNAQRLGVSQSTHSLTTPVVSVATPSLLSQGLPFSSMPTAYNTDYQLTSAELSSLPAFSSPGGLSLGNVTAWQQPQQPQQPQQPQPPQQQPPQPQQPQPQQPQQPQQPPQQQSHLVPVSLSNLIPGSPLPHVGAALTVTTHPHISIKSEPVSPSRERSPAPPPPAVFPAARPEPGDGLSSPAGGSYETGDRDDGRGDFGPTLGLLRPAPEPEAEGSAVKRMRLDTWTLK

SEQ ID NO: 864702 - protein, 521 aa, Homo sapiens; identical to SEQ ID NO: 864693

SEQ ID NO: 864703 - protein, 521 aa, Homo sapiens; identical to SEQ ID NO: 864693

SEQ ID NO: 864704 - protein, 521 aa, Homo sapiens; identical to SEQ ID NO: 864693

SEQ ID NO: 864705 - protein, 347 aa, Homo sapiens
MDGEWAPERQGMDDVSLPSLCTGRLGECWCWGHRASTRAFIFARVLVSVNLCVHVSLHGSECLCECTNVCLYICGGLRAKAPRLGFGIQEPHLGLGMEGQHKAAHLSSHLLTDSFLLQNNAQRLGVSQSTHSLTTPVVSVATPSLLSQGLPFSSMPTAYNTDYQLTSAELSSLPAFSSPGGLSLGNVTAWQQPQQPQQPQQPQPPQQQPPQPQQPQPQQPQQPQQPPQQQSHLVPVSLSNLIPGSPLPHVGAALTVTTHPHISIKSEPVSPSRERSPAPPPPAVFPAARPEPGDGLSSPAGGSYETGDRDDGRGDFGPTLGLLRPAPEPEAEGSAVKRMRLDTWTLK

SEQ ID NO: 864706 - protein, 521 aa, Homo sapiens; identical to SEQ ID NO: 864693

SEQ ID NO: 864707 - protein, 303 aa, Homo sapiens
MGRKKIQIQRITDERNRQVTFTKRKFGLMKKAYELSVLCDCEIALIIFNHSNKLFQYASTDMDKVLLKYTEYNEPHESRTNADIIETLRKKGFNGCDSPEPDGEDSLEQSPLLEDKYRRASEELDGLFRRYGSTVPAPNFAMPVTVPVSNQSSLQFSNPSGSLVTPSLVTSSLTDPRLLSPQQPALQRNSVSPGLPQRPASAGAMLGGDLNSANGACPSPVGNGYVSARASPGLLPVANGNSLNKVIPAKSPPPPTHSTQLGAPSRKPDLRVITSQAGKGLMHHLTEDHLDLVSEAVSSLLWL

SEQ ID NO: 864708 - protein, 309 aa, Homo sapiens [sequence omitted]

SEQ ID NO: 864709 - protein, 146 aa, Homo sapiens [sequence omitted]

SEQ ID NO: 864710 - protein, 779 aa, Homo sapiens
QPVPALRLQAGPAVPGGMEGPRSSTHVPLVLPLLVLLLLAPARQAAAQRCPQACICDNSRRHVACRYQNLTEVPDAIPELTQRLDLQGNLLKVIPAAAFQGVPHLTHLDLRHCEVELVAEGAFRGLGRLLLLNLASNHLRELPQEALDGLGSLRRLELEGNALEELRPGTFGALGALATLNLAHNALVYLPAMAFQGLLRVRWLRLSHNALSVLAPEALAGLPALRRLSLHHNELQALPGPVLSQARGLARLELGHNPLTYAGEEDGLALPGLRELLLDGGALQALGPRAFAHCPRLHTLDLRGNQLDTLPPLQGPGQLRRLRLQGNPLWCGCQARPLLEWLARARVRSDGACQGPRRLRGEALDALRPWDLRCPGDAAQEEEELEERAVAGPRAPPRGPPRGPGEERAVAPCPRACVCVPESRHSSCEGCGLQAVPRGFPSDTQLLDLRRNHFPSVPRAAFPGLGHLVSLHLQHCGIAELEAGALAGLGRLIYLYLSDNQLAGLSAAALEGAPRLGYLYLERNRFLQVPGAALRALPSLFSLHLQDNAVDRLAPGDLGRTRALRWVYLSGNRITEVSLGALGPARELEKLHLDRNQLREVPTGALEGLPALLELQLSGNPLRALRDGAFQPVGRSLQHLFLNSSGLEQICPGAFSGLGPGLQSLHLQKNQLRALPALPSLSQLELIDLSSNPFHCDCQLLPLHRWLTGLNLRVGATCATPPNARGQRVKAAAAVFEDCPGWAARKAKRTPASRPSARRTPIKGRQCGADKVGKEKGRL

SEQ ID NO: 864711 - protein, 272 aa, Homo sapiens
TACPCAAPPGWTSSSRRHGGVSLWARWCKGGFRAAQWPQDNAVDRLAPGDLGRTRALRWVYLSGNRITEVSLGALGPARELEKLHLDRNQLREVPTGALEGLPALLELQLSGNPLRALRDGAFQPVGRSLQHLFLNSSGLEQICPGAFSGLGPGLQSLHLQKNQLRALPALPSLSQLELIDLSSNPFHCDCQLLPLHRWLTGLNLRVGATCATPPNARGQRVKAAAAVFEDCPGWAARKAKRTPASRPSARRTPIKGRQCGADKVGKEKGRL

SEQ ID NO: 864712 - protein, 499 aa, Homo sapiens
MLERPPALAMPMPTEGTPPPLSGTPIPVPAYFRHAEPGFSLKRPRGLSRSLPPPPPAKGSIPISRLFPPRTPGWHQLQPRRVSFRGEASETLQSPGYDPSRPESFFQQSFQRLSRLGHGSYGEVFKVRSKEDGRLYAVKRSMSPFRGPKDRARKLAEVGSHEKVGQHPCCVRLEQAWEEGGILYLQTELCGPSLQQHCEAWGASLPEAQVWGYLRDTLLALAHLHSQGLVHLDVKPANIFLGPRGRCKLGDFGLLVELGTAGAGEVQEGDPRYMAPELLQGSYGTAADVFSLGLTILEVACNMELPHGGEGWQQLRQGYLPPEFTAGLSSELRSVLVMMLEPDPKLRATAEALLALPVLRQPRAWGVLWCMAAEALSRGWALWQALLALLCWLWHGLAHPASWLQPLGPPATPPGSPPCSLLLDSSLSSNWDDDSLGPSLSPEAVLARTVGSTSTPRSRCTPRDALDLSDINSEPPRGSFPSFEPRNLLSLFEDTLDPT

SEQ ID NO: 864713 - protein, 499 aa, Homo sapiens; identical to SEQ ID NO: 864712

SEQ ID NO: 864714 - protein, 499 aa, Homo sapiens; identical to SEQ ID NO: 864712

SEQ ID NO: 864715 - protein, 499 aa, Homo sapiens; identical to SEQ ID NO: 864712

SEQ ID NO: 864716 - protein, 499 aa, Homo sapiens; identical to SEQ ID NO: 864712

SEQ ID NO: 864717 - protein, 499 aa, Homo sapiens; identical to SEQ ID NO: 864712

SEQ ID NO: 864718 - protein, 430 aa, Homo sapiens
MLERWHQLQPRRVSFRGEASETLQSPGYDPSRPESFFQQSFQRLSRLGHGSYGEVFKVRSKEDGRLYAVKRSMSPFRGPKDRARKLAEVGSHEKVGQHPCCVRLEQAWEEGGILYLQTELCGPSLQQHCEAWGASLPEAQVWGYLRDTLLALAHLHSQGLVHLDVKPANIFLGPRGRCKLGDFGLLVELGTAGAGEVQEGDPRYMAPELLQGSYGTAADVFSLGLTILEVACNMELPHGGEGWQQLRQGYLPPEFTAGLSSELRSVLVMMLEPDPKLRATAEALLALPVLRQPRAWGVLWCMAAEALSRGWALWQALLALLCWLWHGLAHPASWLQPLGPPATPPGSPPCSLLLDSSLSSNWDDDSLGPSLSPEAVLARTVGSTSTPRSRCTPRDALDLSDINSEPPRGSFPSFEPRNLLSLFEDTLDPT

SEQ ID NO: 864719 - protein, 234 aa, Homo sapiens
PRGSPGLGLCPRANPAPFCPHPVPASLGLTILEVACNMELPHGGEGWQQLRQGYLPPEFTAGLSSELRSVLVMMLEPDPKLRATAEALLALPVLRQPRAWGVLWCMAAEALSRGWALWQALLALLCWLWHGLAHPASWLQPLGPPATPPGSPPCSLLLDSSLSSNWDDDSLGPSLSPEAVLARTVGSTSTPRSRCTPRDALDLSDINSEPPRGSFPSFEPRNLLSLFEDTLDPT

SEQ ID NO: 864720 - protein, 105 aa, Homo sapiens
TVSSHLYFLLERSFPLYESCMKTILLKSTNNIGPQVSFLTGEPTFHTTAWAACVALQLLFPPRDTSKRSPGVSAGRPWLLRRWVSTDPARGMEVCLVLLLPWAGV

SEQ ID NO: 864721 - protein, 52 aa, Homo sapiens
MHRPRSPSVPGLGLEAVLVTSDLQDPNTLAPDLEKPWAGTLRYLESEEESPQ

SEQ ID NO: 864722 - protein, 112 aa, Homo sapiens
MSWKHPRSQPLADELGGTPGVANSRRLLWAGWHGSSVPGTGVVGSPEQVGHDAGVQLQDGAHAQQVHDLVGVAPVVKAARSPALGQTGYIYQSPKQRQCVHAQVAGQGAWSP

SEQ ID NO: 864723 - protein, 499 aa, Homo sapiens; identical to SEQ ID NO: 864712

SEQ ID NO: 864724 - protein, 499 aa, Homo sapiens; identical to SEQ ID NO: 864712

SEQ ID NO: 864725 - protein, 463 aa, Homo sapiens
MLERPPALAMPMPTEGTPPPLSGTPIPVPAYFRHAEPGFSLKRPRGLSRSLPPPPPAKGSIPISRLFPPRTPGWHQLQPRRVSFRGEASETLQSPGYDPSRPESFFQQSFQRLSRLGHGSYGEVFKVRSKEDGRLYAVKRSMSPFRGPKDRARKLAEVGSHEKVGQHPCCVRLEQAWEEGGILYLQTELCGPSLQQHCEAWGASLPEAQVWGYLRDTLLALAHLHSQGLVHLDVKPANIFLGPRGRCKLGDFGLLVELGTAGAGEVQEGDPRYMAPELLQGSYGTAADVFSLGLTILEVACNMELPHGGEGWQQLRQGYLPPEFTAGLSSELRSVLVMMLEPDPKLRATAEALLALPVLRQPRAWGVLWCMAAEALSRGWALWQALLALLCWLWHGLAHPASWLQPLGPPATPPGSPPCSLLLDSSLSSNWDDDSLGPSLSPEAVLARTVGSTSTPRSRCTPR

SEQ ID NO: 864726 - protein, 490 aa, Homo sapiens
MPMPTEGTPPPLSGTPIPVPAYFRHAEPGFSLKRPRGLSRSLPPPPPAKGSIPISRLFPPRTPGWHQLQPRRVSFRGEASETLQSPGYDPSRPESFFQQSFQRLSRLGHGSYGEVFKVRSKEDGRLYAVKRSMSPFRGPKDRARKLAEVGSHEKVGQHPCCVRLEQAWEEGGILYLQTELCGPSLQQHCEAWGASLPEAQVWGYLRDTLLALAHLHSQGLVHLDVKPANIFLGPRGRCKLGDFGLLVELGTAGAGEVQEGDPRYMAPELLQGSYGTAADVFSLGLTILEVACNMELPHGGEGWQQLRQGYLPPEFTAGLSSELRSVLVMMLEPDPKLRATAEALLALPVLRQPRAWGVLWCMAAEALSRGWALWQALLALLCWLWHGLAHPASWLQPLGPPATPPGSPPCSLLLDSSLSSNWDDDSLGPSLSPEAVLARTVGSTSTPRSRCTPRDALDLSDINSEPPRGSFPSFEPRNLLSLFEDTLDPT

SEQ ID NO: 864727 - protein, 360 aa, Homo sapiens
MSAAGAGAGVEAGFSSEELLSLRFPLHRACRDGDLATLCSLLQQTPHAHLASEDSFYGWTPVHWAAHFGKLECLVQLVRAGATLNVSTTRYAQTPAHIAAFGGHPQCLVWLIQAGANINKPDCEGETPIHKAARSGSLECISALVANGAHVDLGLTILEVACNMELPHGGEGWQQLRQGYLPPEFTAGLSSELRSVLVMMLEPDPKLRATAEALLALPVLRQPRAWGVLWCMAAEALSRGWALWQALLALLCWLWHGLAHPASWLQPLGPPATPPGSPPCSLLLDSSLSSNWDDDSLGPSLSPEAVLARTVGSTSTPRSRCTPRDALDLSDINSEPPRGSFPSFEPRNLLSLFEDTLDPT

SEQ ID NO: 864728 - protein, 112 aa, Homo sapiens; identical to SEQ ID NO: 864722

SEQ ID NO: 864729 - protein, 178 aa, Homo sapiens
SSFRRHERIHTGERPYKCKLCGKGFRSSSYIQLHERTHTGEKPYGCQQCGKALSDLSSFRRHMITHTGNGPHKCKICGKGFDYPSSVQRHERTHTGEKPYECKECGKAFSHSSYLRIHERVHTGEKPYKCKECGKPFHCPSAFHKHERTHSMEKPYKCKECGEAFHCISSFHKHEMTH

SEQ ID NO: 864730 - protein, 223 aa, Homo sapiens
ASLLNFWNPPTTAQVTIEAQPPKVSEGKDVLLLVHNLPQNLAGYIWYKGQMTYLYHYITSYVVDGQRIIYGPAYSGRERVYSNASLLIQNVTQEDAGSYTLHIIKRRDETREEIGHFTFTLYLETPKPYISSSNLNPREAMEAVRLICDPETLDASYLWWMNGQSLPVTHRLQLSKTNRTLYLFGVTKYIAGPYECEIRNPVSASRSDPVTLNLLREYPLFLC

SEQ ID NO: 864731 - protein, 258 aa, Homo sapiens
MNGQSLPVTHRLQLSKTNRTLYLFGVTKYIAGPYECEIRNPVSASRSDPVTLNLLPKLPIPYITINNLNPRENKDVLAFTCEPKSENYTYIWWLNGQSLPVSPGVKRPIENRILILPSVTRNETGPYQCEIRDRYGGLRSNPVILNVLYGPDLPRIYPSFTYYRSGENLDLSCFTESNPPAEYFWTINGKFQQSGQKLFIPQITRNHSGLYACSVHNSATGKEISKSMTVKVSGSLPWRPDRVSVMTATTETLRKRTG

SEQ ID NO: 864732 - protein, 258 aa, Homo sapiens; identical to SEQ ID NO: 864731

SEQ ID NO: 864733 - protein, 258 aa, Homo sapiens; identical to SEQ ID NO: 864731

SEQ ID NO: 864734 - protein, 258 aa, Homo sapiens; identical to SEQ ID NO: 864731

SEQ ID NO: 864735 - protein, 258 aa, Homo sapiens; identical to SEQ ID NO: 864731

SEQ ID NO: 864736 - protein, 246 aa, Homo sapiens
MNGQSLPVTHRLQLSKTNRTLYLFGVTKYIAGPYECEIRNPVSASRSDPVTLNLLPKLPIPYITINNLNPRENKDVLAFTCEPKSENYTYIWWLNGQSLPVSPGVKRPIENRILILPSVTRNETGPYQCEIRDRYGGLRSNPVILNVLYGPDLPRIYPSFTYYRSGENLDLSCFTESNPPAEYFWTINGKFQQSGQKLFIPQITRNHSGLYACSVHNSATGKEISKSMTVKVSGGPCHGDLTESQS

SEQ ID NO: 864737 - protein, 177 aa, Homo sapiens
MRSDPVTLNVLYGPDLPSIYPSFTYYRSGENLYLSCFAESNPPAEYFWTINGKFQQSGQKLSIPQITTKHRGLYACSVRNSATGKESSKSMTVKVSGKWIPASLAVGFYVESIWLSEKSQENIFIPSLCPMGTSKSQILLLNPPNLSLQTLFSLFFCFLMADLVSGLKKVGRGLYQP

SEQ ID NO: 864738 - protein, 329 aa, Homo sapiens
MSRRKDAGTYTLHIIKRGDETREEIRHFTFTLYLETPKPSISSSNLNPREAMEAVILTCDPATPAASYQWWMNGQSLPMTHRLQLSKTNRTLFIFGVTKYIAGPYECEIRNPVSASRSDPVTLNLLPKLPIPYITINNLNPRENKDVLAFTCEPKSENYTYIWWLNGQSLPVSPGVKRPIENRILILPSVTRNETGPYQCEIRDRYGGLRSNPVILNVLYGPDLPRIYPSFTYYRSGENLDLSCFTESNPPAEYFWTINGKFQQSGQKLFIPQITRNHSGLYACSVHNSATGKEISKSMTVKVSGSLPWRPDRVSVMTATTETLRKRTG

SEQ ID NO: 864739 - protein, 329 aa, Homo sapiens; identical to SEQ ID NO: 864738

SEQ ID NO: 864740 - protein, 144 aa, Homo sapiens
MSPGKDAGSYTLHIIKRRDGTGGVTGHFTFTLHLETPKPSISSSNLNPREAMEAVILTCDPATPAASYQWWMNGQSLPMTHRLQLSKTNRTLFIFGVTKYIAGPYECEIRNPVSASRSDPVTLNLLPKLPKPYITINNLNPQGE

SEQ ID NO: 864741 - protein, 144 aa, Homo sapiens; identical to SEQ ID NO: 864740

SEQ ID NO: 864742 - protein, 148 aa, Homo sapiens
MNGQSLPVTHRLQLSKTNRTLYLFGVTKYIAGPYECEIRNPVSASRSDPVTLNLLPKLPIPYITINNLNPRENKDVLAFTCEPKSENYTYIWWLNGQSLPVSPGVKRPIENRILILPSVTRNVSRTLCNVNIGTVVCAPRIYPGHHII

SEQ ID NO: 864743 - protein, 165 aa, Homo sapiens
MNGQSLPVTHRLQLSKTNRTLYLFGVTKYIAGPYECEIRNPVSASRSDPVTLNLLHGPDLPRIYPSFTYYRSGENLDLSCFTESNPPAEYFWTINGKFQQSGQKLFIPQITRNHSGLYACSVHNSATGKEISKSMTVKVSGSLPWRPDRVSVMTATTETLRKRTG

SEQ ID NO: 864744 - protein, 81 aa, Homo sapiens
PDNDRRGVDDRRVEGQHSLTAVLRKFLDPRLSSTEENTQAAETMGPLSAPPCTQHITWKGVLLTASLLNFWNPPTTARSHD

SEQ ID NO: 864745 - protein, 258 aa, Homo sapiens; identical to SEQ ID NO: 864731

SEQ ID NO: 864746 - protein, 131 aa, Homo sapiens
MSRRKDAGTYTLHIIKRGDETREEIRHFTFTLYYGPDLPRIYPSFTYYRSGENLDLSCFTESNPPAEYFWTINGKFQQSGQKLFIPQITRNHSGLYACSVHNSATGKEISKSMTVKVSGGPCHGDLTESQS

SEQ ID NO: 864747 - protein, 258 aa, Homo sapiens; identical to SEQ ID NO: 864731

SEQ ID NO: 864748 - protein, 258 aa, Homo sapiens; identical to SEQ ID NO: 864731

SEQ ID NO: 864749 - protein, 258 aa, Homo sapiens; identical to SEQ ID NO: 864731

SEQ ID NO: 864750 - protein, 314 aa, Homo sapiens
MNGQSLPVTHRLQLSKTNRTLYLFGVTKYIAGPYECEIRNPVSASRSDPVTLNLLPKLPIPYITINNLNPRENKDVLAFTCEPKSENYTYIWWLNGQSLPVSPGVKRPIENRILILPSVTRNETGPYQCEIRDRYGGLRSNPVILNVLYGPDLPRIYPSFTYYRSGENLDLSCFTESNPPAEYFWTINGKFQQSGQKLFIPQITRNHSGLYACSVHNSATGKEISKSMTVKVSGKWIPASLAVGFYVESIWLSEKSQENIFIPSLCPMGTSKSQILLLNPPNLSLQTLFSLFFCFLMADLVSGLKKVGRGLYQP

SEQ ID NO: 864751 - protein, 314 aa, Homo sapiens
MNGQSLPVTHRLQLSKTNRTLYLFGVTKYIAGPYECEIRNPVSASRSDPVTLNLLPKLPIPYITINNLNPRENKDVLAFTCEPKSENYTYIWWLNGQSLPVSPGVKRPIENRILILPSVTRNETGPYQCEIRDRYGGLRSNPVILNVLYGPDLPRIYPSFTYYRSGENLDLSCFTESNPPAEYFWTINGKFQQSGQKLSIPQITTKHRGLYACSVRNSATGKESSKSMTVKVSGKWIPASLAVGFYVESIWLSEKSQENIFIPSLCPMGTSKSQILLLNPPNLSLQTLFSLFFCFLMADLVSGLKKVGRGLYQP

SEQ ID NO: 864752 - protein, 329 aa, Homo sapiens
MSPGKDAGSYTLHIIKRRDGTGGVTGHFTFTLHLETPKPSISSSNLNPREAMEAVILTCDPATPAASYQWWMNGQSLPMTHRLQLSKTNRTLFIFGVTKYIAGPYECEIRNPVSASRSDPVTLNLLPKLPIPYITINNLNPRENKDVLAFTCEPKSENYTYIWWLNGQSLPVSPGVKRPIENRILILPSVTRNETGPYQCEIRDRYGGLRSNPVILNVLYGPDLPRIYPSFTYYRSGENLDLSCFTESNPPAEYFWTINGKFQQSGQKLFIPQITRNHSGLYACSVHNSATGKEISKSMTVKVSGSLPWRPDRVSVMTATTETLRKRTG

SEQ ID NO: 864753 - protein, 177 aa, Homo sapiens
MNGQSLPVTHRLQLSKTNRTLYLFGVTKYIAGPYECEIRNPVSASRSDPVTLNLLPKLPIPYITINNLNPRENKDVLAFTCEPKSENYTYIWWLNGQSLPVSPGVKRPIENRILILPSVTRNETGPYECEIRDRDGGMRSDPVTLNVLYGPDLPSIYPSFTYYRSGGKPRLVLLHGI

SEQ ID NO: 864754 - protein, 177 aa, Homo sapiens; identical to SEQ ID NO: 864753

SEQ ID NO: 864755 - protein, 221 aa, Homo sapiens
MNGQSLPVTHRLQLSKTNRTLYLFGVTKYIAGPYECEIRNPVSASRSDPVTLNLLHGPDLPRIYPSFTYYRSGENLDLSCFTESNPPAEYFWTINGKFQQSGQKLFIPQITRNHSGLYACSVHNSATGKEISKSMTVKVSGKWIPASLAVGFYVESIWLSEKSQENIFIPSLCPMGTSKSQILLLNPPNLSLQTLFSLFFCFLMADLVSGLKKVGRGLYQP

SEQ ID NO: 864756 - protein, 116 aa, Homo sapiens
MRLEKKFDISPSPYTLETPKPYISSSNLNPREAMEAVRLICDPETLDASYLWWMNGQSLPVTHRLQLSKTNRTLYLFGVTKYIAGPYECEIRNPVSASRSDPVTLNLLREYPLFLC

SEQ ID NO: 864757 - protein, 740 aa, Homo sapiens
ARAPLPSGKRGQDRVASSGRAPQRELWLPEVERRQEIMAAATGDPGLSKLQFAPFSSALDVGFWHELTQKKLNEYRLDEAPKDIKGYYYNGDSAGLPARLTLEFSAFDMSAPTPARCCPAIGTLYNTNTLESFKTADKKLLLEQAANEIWESIKSGTALENPVLLNKFLLLTFADLKKYHFYYWFCYPALCLPESLPLIQGPVGLDQRFSLKQIEALECAYDNLCQTEGVTALPYFLIKYDENMVLVSLLKHYSDFFQGQRTKITIGVYDPCNLAQYPGWPLRNFLVLAAHRWSSSFQSVEVVCFRDRTMQGARDVAHSIIFEVKLPEMAFSPDCPKAVGWEKNQKGGMGPRMVNLSECMDPKRLAESSVDLNLKLMCWRLVPTLDLDKVVSVKCLLLGAGTLGCNVARTLMGWGVRHITFVDNAKISYSNPVRQPLYEFEDCLGGGKPKALAAADRLQKIFPGVNARGFNMSIPMPGHPVNFSSVTLEQARRDVEQLEQLIESHDVVFLLMDTRESRWLPAVIAASKRKLVINAALGFDTFVVMRHGLKKPKQQGAGDLCPNHPVASADLLGSSLFANIPGYKLGCYFCNDVVAPGDSTRDRTLDQQCTVSRPGLAVIAGALAVELMVSVLQHPEGGYAIASSSDDRMNEPPTSLGLVPHQIRGFLSRFDNVLPVSLAFDKCTACSSKVLDQYEREGFNFLAKVFNSSHSFLEDLTGLTLLHQETQAAEIWDMSDDETI

SEQ ID NO: 864758 - protein, 392 aa, Homo sapiens
MGPRMVNLSECMDPKRLAESSVDLNLKLMCWRLVPTLDLDKVVSVKCLLLGAGTLGCNVARTLMGWGVRHITFVDNAKISYSNPVRQPLYEFEDCLGGGKPKALAAADRLQKIFPGVNARGFNMSIPMPGHPVNFSSVTLEQARRDVEQLEQLIESHDVVFLLMDTRESRWLPAVIAASKRKLVINAALGFDTFVVMRHGLKKPKQQGAGDLCPNHPVASADLLGSSLFANIPGYKLGCYFCNDVVAPGDSTRDRTLDQQCTVSRPGLAVIAGALAVELMVSVLQHPEGGYAIASSSDDRMNEPPTSLGLVPHQIRGFLSRFDNVLPVSLAFDKCTACSSKVLDQYEREGFNFLAKVFNSSHSFLEDLTGLTLLHQETQAAEIWDMSDDETI

SEQ ID NO: 864759 - protein, 689 aa, Homo sapiens
HEGLPEVERRQEIMAAATGDPGLSKLQFAPFSSALDVGFWHELTQKKLNEYRLDEAPKDIKGYYYNGDSAGLPARLTLEFSAFDMSAPTPARCCPAIGTLYNTNTLESFKTADKKLLLEQAANEIWESIKSGTALENPVLLNKFLLLTFADLKKYHFYYWFCYPALCLPESLPLIQGPVGLDQRFSLKQIEALECAYDNLCQTEGVTALPYFLIKYDENMVLVSLLKHYSDFFQGQRTKITIGVYDPCNLAQYPGWPLRNFLVLAAHRWSSSFQSVEVVCFRDRTMQGARDVAHSIIFEVKLPEMAFSPDCPKAVGWEKNQKGGMGPRMVNLSECMDPKRLAESSVDLNLKLMCWRLVPTLDLDKVVSVKCLLLGAGTLGCNVARTLMGWGVRHITFVDNAKISYSNPVRQPLYEFEDCLGGGKPKALAAADRLQKIFPGVNARGFNMSIPMPGHPVNFSSVTLEQARRDVEQLEQLIESHDVVFLLMDTRESRWLPAVIAASKRKLVINAALGFDTFVVMRHGLKKPKQQGAGDLCPNHPVASADLLGSSLFANIPGYKLGCYFCNDVVAPGDSTRDRTLDQQCTVSRPGLAVIAGALAVELMVSVLQHPEGGYAIASSSDDRMNEPPTSLGLVPHQVLDQYEREGFNFLAKVFNSSHSFLEDLTGLTLLHQETQAAEIWDMSDDETI

SEQ ID NO: 864760 - protein, 732 aa, Homo sapiens
ARAPLPSGKRGQDRVASSGRAPQRELWLPEVERRQEIMAAATGDPGLSKLQFAPFSSALDVGFWHELTQKKLNEYRLDEAPKDIKGYYYNGDSAGLPARLTLEFSAFDMSAPTPARCCPAIGTLYNTNTLESFKTADKKLLLEQAANEIWESIKSGTALENPVLLNKFLLLTFADLKKYHFYYWFCYPALCLPESLPLIQGPVGLDQRFSLKQIEALECAYDNLCQTEGVTALPYFLIKYDENMVLVSLLKHYSDFFQGQRTKITIGVYDPCNLAQYPGWPLRNFLVLAAHRWSSSFQSVEVVCFRDRTMQGARDVAHSIIFEVKLPEMAFSPDCPKAVGWEKNQKGGMGPRMVNLSECMDPKRLAESSVDLNLKLMCWRLVPTLDLDKVVSVKCLLLGAGTLGCNVARTLMGWGVRHITFVDNAKISYSNPVRQPLYEFEDCLGGGKPKALAAADRLQKIFPGVNARGFNMSIPMPGHPVNFSSVTLEQARRDVEQLEQLIESHDVVFLLMDTRESRWLPAVIAASKRKLVINAALGFDTFVVMRHGLKKPKQQGAGDLCPNHPVASADLLGSSLFANIPGYKLGCYFCNDVVAPGDSTRDRTLDQQCTVSRPGLAVIAGALAVELMVSVLQHPEGGYAIASSSDDRMNEPPTSLGLVPHQIRGFLSRFDNVLPVSLAFDKCTACSSKVLDQYEREGFNFLAKVFNSSHSFLEDLTGLTLLHQETQAAEHL

SEQ ID NO: 864761 - protein, 740 aa, Homo sapiens; identical to SEQ ID NO: 864757

SEQ ID NO: 864762 - protein, 740 aa, Homo sapiens; identical to SEQ ID NO: 864757

SEQ ID NO: 864763 - protein, 120 aa, Homo sapiens
MSRIFNPHLNKTANGDCRRDPRERSRQPHRARCGPHHEPARKPPVHLPPQPWPGAAPAPGTRPPAPPTPPRVTPLFTDKETCPRSVLHRAGQLWVVFLLRRSVACSNNKLVAMNADAVFS

SEQ ID NO: 864764 - protein, 741 aa, Homo sapiens
ARAPLPSGKRGQDRVASSGRAPQRELWLPEVERRQEIMAAATGDPGLSKLQFAPFSSALDVGFWHELTQKKLNEYRLDEAPKDIKGYYYNGDSAGLPARLTLEFSAFDMSAPTPARCCPAIGTLYNTNTLESFKTADKKLLLEQAANEIWESIKSGTALENPVLLNKFLLLTFADLKKYHFYYWFCYPALCLPESLPLIQGPVGLDQRFSLKQIEALECAYDNLCQTEGVTALPYFLIKYDENMVLVSLLKHYSDFFQGQRTKITIGVYDPCNLAQYPGWPLRNFLVLAAHRWSSSFQSVEVVCFRDRTMQGARDVAHSIIFEVKLPEMAFSPDCPKAVGWEKNQKGGMGPRMVNLSECMDPKRLAESSVDLNLKLMCWRLVPTLDLDKVVSVKCLLLGAGTLGCNVARTLMGWGVRHITFVDNAKISYSNPVRQPLYEFEDCLGGGKPKALAAADRLQKIFPGVNARGFNMSIPMPGHPVNFSSVTLEQARRDVEQLEQLIESHDVVFLLMDTRESRWLPAVIAASKRKLVINAALGFDTFVVMRHGLKKPKQQGAGDLCPNHPVASADLLGSSLFANIPGYKLGCYFCNDVVAPGDSTRDRTLDQQCTVSRPGLAVIAGALAVELMVSVLQHPEGGYAIASSSDDRMNEPPTSLGLVPHQIRGFLSRFDNVLPVSLAFDKCTACSSKVLDQYEREGFNFLAKVFNSSHSFLEDLTGLTLLHQETQAAEVRTKQAFCSED

SEQ ID NO: 864765 - protein, 775 aa, Homo sapiens
ARAPLPSGKRGQDRVASSGRAPQRELWLPEVERRQEIMAAATGDPGLSKLQFAPFSSALDVGFWHELTQKKLNEYRLDEAPKDIKGYYYNGDSAGLPARLTLEFSAFDMSAPTPARCCPAIGTLYNTNTLESFKTADKKLLLEQAANEIWESIKSGTALENPVLLNKFLLLTFADLKKYHFYYWFCYPALCLPESLPLIQGPVGLDQRFSLKQIEALECAYDNLCQTEGVTALPYFLIKYDENMVLVSLLKHYSDFFQGQRTKITIGVYDPCNLAQYPGWPLRNFLVLAAHRWSSSFQSVEVVCFRDRTMQGARDVAHSIIFEVKLPEMAFSPDCPKAVGWEKNQKGGMGPRMVNLSECMDPKRLAESSVDLNLKLMCWRLVPTLDLDKVVSVKCLLLGAGTLGCNVARTLMGWGVRHITFVDNAKISYSNPVRQPLYEFEDCLGGGKPKALAAADRLQKIFPGVNARGFNMSIPMPGHPVNFSSVTLEQARRDVEQLEQLIESHDVVFLLMDTRESRWLPAVIAASKRKLVINAALGFDTFVVMRHGLKKPKQQGAGDLCPNHPVASADLLGSSLFANIPGYKLGCYFCNDVVAPGDSTRDRTLDQQCTVSRPGLAVIAGALAVELMVSVLQHPEGGYAIASSSDDRMNEPPTSLGLVPHQIRGFLSRFDNVLPVSLAFDKCTACSSKVLDQYEREGFNFLAKVFNSSHSFLEDLTGLTLLHQETQAAEDHLSFIRPKNGTFPAHQATCTQESAACPEIDLYQLSSRTIPCIHT

SEQ ID NO: 864766 - protein, 788 aa, Homo sapiens
ARAPLPSGKRGQDRVASSGRAPQRELWLPEVERRQEIMAAATGDPGLSKLQFAPFSSALDVGFWHELTQKKLNEYRLDEAPKDIKGYYYNGDSAGLPARLTLEFSAFDMSAPTPARCCPAIGTLYNTNTLESFKTADKKLLLEQAANEIWESIKSGTALENPVLLNKFLLLTFADLKKYHFYYWFCYPALCLPESLPLIQGPVGLDQRFSLKQIEALECAYDNLCQTEGVTALPYFLIKYDENMVLVSLLKHYSDFFQGQRTKITIGVYDPCNLAQYPGWPLRNFLVLAAHRWSSSFQSVEVVCFRDRTMQGARDVAHSIIFEVKLPEMAFSPDCPKAVGWEKNQKGGMGPRMVNLSECMDPKRLAESSVDLNLKLMCWRLVPTLDLDKVVSVKCLLLGAGTLGCNVARTLMGWGVRHITFVDNAKISYSNPVRQPLYEFEDCLGGGKPKALAAADRLQKIFPGVNARGFNMSIPMPGHPVNFSSVTLEQARRDVEQLEQLIESHDVVFLLMDTRESRWLPAVIAASKRKLVINAALGFDTFVVMRHGLKKPKQQGAGDLCPNHPVASADLLGSSLFANIPGYKLGCYFCNDVVAPGDSTRDRTLDQQCTVSRPGLAVIAGALAVELMVSVLQHPEGGYAIASSSDDRMNEPPTSLGLVPHQIRGFLSRFDNVLPVSLAFDKCTACSSKTKIPAFNKALATVLFQLFQPSTGHMKEERSFHFQKIYLAEESRSPGNIQNQDPRDMALRKPSQPSPDIRVTQLRPQSMWSRDKNCEAVPVVPCPNFLPT

SEQ ID NO: 864767 - protein, 87 aa, Homo sapiens
MAAATGDPGLSKLQFAPFSSALDVGFWHELTQKKLNEYRLDEAPKDIKGYYYNGDSAGLPARLTLEFSAFDIVPCGHVKLCAEVDSS

SEQ ID NO: 864768 - protein, 740 aa, Homo sapiens; identical to SEQ ID NO: 864757

SEQ ID NO: 864769 - protein, 740 aa, Homo sapiens; identical to SEQ ID NO: 864757

SEQ ID NO: 864770 - protein, 740 aa, Homo sapiens; identical to SEQ ID NO: 864757

SEQ ID NO: 864771 - protein, 740 aa, Homo sapiens; identical to SEQ ID NO: 864757

SEQ ID NO: 864772 - protein, 269 aa, Homo sapiens
ARAPLPSGKRGQDRVASSGRAPQRELWLPEVERRQEIMAAATGDPGLSKLQFAPFSSALDVGFWHELTQKKLNEYRLDEAPKDIKGYYYNGDSAGLPARLTLEFSAFDMSAPTPARCCPAIGTLYNTNTLESFKTADKKLLLEQAANEIWESIKSGTALENPVLLNKFLLLTFADLKKYHFYYWFCYPALCLPESLPLIQGPVGLDQRFSLKQIEALECAYDNLCQTEGVTALPYFLIKYDENMVLVSLLKHYMFGVARDSRYHQFRAK

SEQ ID NO: 864773 - protein, 148 aa, Homo sapiens [sequence omitted]

SEQ ID NO: 864774 - protein, 740 aa, Homo sapiens; identical to SEQ ID NO: 864757

SEQ ID NO: 864775 - protein, 740 aa, Homo sapiens; identical to SEQ ID NO: 864757

SEQ ID NO: 864776 - protein, 732 aa, Homo sapiens; identical to SEQ ID NO: 864760

SEQ ID NO: 864777 - protein, 731 aa, Homo sapiens
ARAPLPSGKRGQDRVASSGRAPQRELWLPEVERRQEIMAAATGDPGLSKLQFAPFSSALDVGFWHELTQKKLNEYRLDEAPKDIKGYYYNGDSAGLPARLTLEFSAFDMSAPTPARCCPAIGTLYNTNTLESFKTADKKLLLEQAANEIWESIKSGTALENPVLLNKFLLLTFADLKKYHFYYWFCYPALCLPESLPLIQGPVGLDQRFSLKQIEALECAYDNLCQTEGVTALPYFLIKYDENMVLVSLLKHYSDFFQGQRTKITIGVYDPCNLAQYPGWPLRNFLVLAAHRWSSSFQSVEVVCFRDRTMQGARDVAHSIIFEVKLPEMAFSPDCPKAVGWEKNQKGGMGPRMVNLSECMDPKRLAESSVDLNLKLMCWRLVPTLDLDKVVSVKCLLLGAGTLGCNVARTLMGWGVRHITFVDNAKISYSNPVRQPLYEFEDCLGGGKPKALAAADRLQKIFPGVNARGFNMSIPMPGHPVNFSSVTLEQARRDVEQLEQLIESHDVVFLLMDTRESRWLPAVIAASKRKLVINAALGFDTFVVMRHGLKKPKQQGAGDLCPNHPVASADLLGSSLFANIPGYKLGCYFCNDVVAPGDSTRDRTLDQQCTVSRPGLAVIAGALAVELMVSVLQHPEGGYAIASSSDDRMNEPPTSLGLVPHQIRGFLSRFDNVLPVSLAFDKCTACSSKVLDQYEREGFNFLAKVFNSSHSFLEDLTGLTLLHQETQAAEH

SEQ ID NO: 864778 - protein, 206 aa, Homo sapiens
MFEGPLVRIPSKYKNRTQIPTTWFLQINHPFPSPHPTPMIFFFLSTDCSKLRQTMQIHVLLEEALPSGDHRGGVTVADHVGRGAGGLAPARGGLRAAGCSVLGRFDLEPRVTQSFGKVVVHGARDGHGVGCRLGLLVILAQAPAENAPPPRGHRWWQLQASRKAGSQTQVAADRQARLQHPPSGSPEPDWLPRSAWALQTEPTSPG

SEQ ID NO: 864779 - protein, 894 aa, Homo sapiens
MAWRCPRMGRVPLAWCLALCGWACMAPRGTQAEESPFVGNPGNITGARGLTGTLRCQLQVQGEPPEVHWLRDGQILELADSTQTQVPLGEDEQDDWIVVSQLRITSLQLSDTGQYQCLVFLGHQTFVSQPGYVGLEGLPYFLEEPEDRTVAANTPFNLSCQAQGPPEPVDLLWLQDAVPLATAPGHGPQRSLHVPGLNKTSSFSCEAHNAKGVTTSRTATITVLPQQPRNLHLVSRQPTELEVAWTPGLSGIYPLTHCTLQAVLSDDGMGIQAGEPDPPEEPLTSQASVPPHQLRLGSLHPHTPYHIRVACTSSQGPSSWTHWLPVETPEGVPLGPPENISATRNGSQAFVHWQEPRAPLQGTLLGYRLAYQGQDTPEVLMDIGLRQEVTLELQGDGSVSNLTVCVAAYTAAGDGPWSLPVPLEAWRPGQAQPVHQLVKEPSTPAFSWPWWYVLLGAVVAAACVLILALFLVHRRKKETRYGEVFEPTVERGELVVRYRVRKSYSRRTTEATLNSLGISEELKEKLRDVMVDRHKVALGKTLGEGEFGAVMEGQLNQDDSILKVAVKTMKIAICTRSELEDFLSEAVCMKEFDHPNVMRLIGVCFQGSERESFPAPVVILPFMKHGDLHSFLLYSRLGDQPVYLPTQMLVKFMADIASGMEYLSTKRFIHRDLAARNCMLNENMSVCVADFGLSKKIYNGDYYRQGRIAKMPVKWIAIESLADRVYTSKSDVWSFGVTMWEIATRGQTPYPGVENSEIYDYLRQGNRLKQPADCLDGLYALMSRCWELNPQDRPSFTELREDLENTLKALPPAQEPDEILYVNMDEGGGYPEPPGAAGGADPPTQPDPKDSCSCLTAAEVHPAGRYVLCPSTTPSPAQPADRGSPAAPGQEDGA

SEQ ID NO: 864780 - protein, 493 aa, Homo sapiens
MCTSLPRPSASLPHHPFGSQRAGSKASSMTCSSYPLMKEPSTPAFSWPWWYVLLGAVVAAACVLILALFLVHRRKKETRYGEVFEPTVERGELVVRYRVRKSYSRRTTEATLNSLGISEELKEKLRDVMVDRHKVALGKTLGEGEFGAVMEGQLNQDDSILKVAVKTMKIAICTRSELEDFLSEAVCMKEFDHPNVMRLIGVCFQGSERESFPAPVVILPFMKHGDLHSFLLYSRLGDQPVYLPTQMLVKFMADIASGMEYLSTKRFIHRDLAARNCMLNENMSVCVADFGLSKKIYNGDYYRQGRIAKMPVKWIAIESLADRVYTSKSDVWSFGVTMWEIATRGQTPYPGVENSEIYDYLRQGNRLKQPADCLDGLYALMSRCWELNPQDRPSFTELREDLENTLKALPPAQEPDEILYVNMDEGGGYPEPPGAAGGADPPTQPDPKDSCSCLTAAEVHPAGRYVLCPSTTPSPAQPADRGSPAAPGQEDGA

SEQ ID NO: 864781 - protein, 894 aa, Homo sapiens; identical to SEQ ID NO: 864779

SEQ ID NO: 864782 - protein, 894 aa, Homo sapiens; identical to SEQ ID NO: 864779

SEQ ID NO: 864783 - protein, 894 aa, Homo sapiens; identical to SEQ ID NO: 864779

SEQ ID NO: 864784 - protein, 121 aa, Homo sapiens
MSPECQPCSMTLSTPTLHAVNSLGISEELKEKLRDVMVDRHKVALGKTLGEGESPGSITHPSELLRSCTSTLPPNYRKYSPHGPSEVSVSLWPPTGEFGAVMEGQLNQDDSILKVAVKTMK

SEQ ID NO: 864785 - protein, 80 aa, Homo sapiens
MPLLDLLGANGHRAKARGDPGAAGGRVCVQSDSVCGSLHCCWGWTLEPPSTPGGLAPRSKAMPNLLQPCLSLTALTYSLY

SEQ ID NO: 864786 - protein, 885 aa, Homo sapiens
MAWRCPRMGRVPLAWCLALCGWACMAPRGTQAEESPFVGNPGNITGARGLTGTLRCQLQVQGEPPEVHWLRDGQILELADSTQTQVPLGEDEQDDWIVVSQLRITSLQLSDTGQYQCLVFLGHQTFVSQPGYVGLEGLPYFLEEPEDRTVAANTPFNLSCQAQGPPEPVDLLWLQDAVPLATAPGHGPQRSLHVPGLNKTSSFSCEAHNAKGVTTSRTATITVLPQQPRNLHLVSRQPTELEVAWTPGLSGIYPLTHCTLQAVLSDDGMGIQAGEPDPPEEPLTSQASVPPHQLRLGSLHPHTPYHIRVACTSSQGPSSWTHWLPVETPEGVPLGPPENISATRNGSQAFVHWQEPRAPLQGTLLGYRLAYQGQDTPEVLMDIGLRQEVTLELQGDGSVSNLTVCVAAYTAAGDGPWSLPVPLEAWRPVKEPSTPAFSWPWWYVLLGAVVAAACVLILALFLVHRRKKETRYGEVFEPTVERGELVVRYRVRKSYSRRTTEATLNSLGISEELKEKLRDVMVDRHKVALGKTLGEGEFGAVMEGQLNQDDSILKVAVKTMKIAICTRSELEDFLSEAVCMKEFDHPNVMRLIGVCFQGSERESFPAPVVILPFMKHGDLHSFLLYSRLGDQPVYLPTQMLVKFMADIASGMEYLSTKRFIHRDLAARNCMLNENMSVCVADFGLSKKIYNGDYYRQGRIAKMPVKWIAIESLADRVYTSKSDVWSFGVTMWEIATRGQTPYPGVENSEIYDYLRQGNRLKQPADCLDGLYALMSRCWELNPQDRPSFTELREDLENTLKALPPAQEPDEILYVNMDEGGGYPEPPGAAGGADPPTQPDPKDSCSCLTAAEVHPAGRYVLCPSTTPSPAQPADRGSPAAPGQEDGA

SEQ ID NO: 864787 - protein, 894 aa, Homo sapiens; identical to SEQ ID NO: 864779

SEQ ID NO: 864788 - protein, 62 aa, Homo sapiens
MDIGLRQEVTLELQGDGSVSNLTVCVAAYTAAGDGPWSLPVPLEAWRPGPKPCPTCFNLSLP

SEQ ID NO: 864789 - protein, 954 aa, Homo sapiens
MVNSHRKPMFNIHRGFYCLTAILPQICICSQFSVPSSYHFTEDPGAFPVATNGERFPWQELRLPSVVIPLHYDLFVHPNLTSLDFVASEKIEVLVSNATQFIILHSKDLEITNATLQSEEDSRYMKPGKELKVLSYPAHEQIALLVPEKLTPHLKYYVAMDFQAKLGDGFEGFYKSTYRTLGGETRILAVTDFEPTQARMAFPCFDEPLFKANFSIKIRRESRHIALSNMPKVKTIELEGGLLEDHFETTVKMSTYLVAYIVCDFHSLSGFTSSGVKVSIYASPDKRNQTHYALQASLKLLDFYEKYFDIYYPLSKLDLIAIPDFAPGAMENWGLITYRETSLLFDPKTSSASDKLWVTRVIAHELAHQWFGNLVTMEWWNDIWLKEGFAKYMELIAVNATYPELQFDDYFLNVCFEVITKDSLNSSRPISKPAETPTQIQEMFDEVSYNKGACILNMLKDFLGEEKFQKGIIQYLKKFSYRNAKNDDLWSSLSNSCLESDFTSGGVCHSDPKMTSNMLAFLGENAEVKEMMTTWTLQKGIPLLVVKQDGCSLRLQQERFLQGVFQEDPEWRALQERYLWHIPLTYSTSSSNVIHRHILKSKTDTLDLPEKTSWVKFNVDSNGYYIVHYEGHGWDQLITQLNQNHTLLRPKDRVGLIHDVFQLVGAGRLTLDKALDMTYYLQHETSSPALLEGLSYLESFYHMMDRRNISDISENLKRYLLQYFKPVIDRQSWSDKGSVWDRMLRSALLKLACDLNHAPCIQKAAELFSQWMESSGKLNIPTDVLKIVYSVGAQTTAGWNYLLEQYELSMSSAEQNKILYALSTSKHQEKLLKLIELGMEGKVIKTQNLAALLHAIARRPKGQQLAWDFVRENWTHLLKKFDLGSYDIRMIISGTTAHFSSKDKLQEVKLFFESLEAQGSHLDIFQTVLETITKNIKWLEKNLPTLRTWLMVNT

SEQ ID NO: 864790 - protein, 965 aa, Homo sapiens
MFNIHRGFYCLTAILPQICICSQFSVPSSYHFTEDPGAFPVATNGERFPWQELRLPSVVIPLHYDLFVHPNLTSLDFVASEKIEVLVSNATQFIILHSKDLEITNATLQSEEDSRYMKPGKELKVLSYPAHEQIALLVPEKLTPHLKYYVAMDFQAKLGDGFEGFYKSTYRTLGGETRILAVTDFEPTQARMAFPCFDEPLFKANFSIKIRRESRHIALSNMPKVKTIELEGGLLEDHFETTVKMSTYLVAYIVCDFHSLSGFTSSGVKVSIYASPDKRNQTHYALQASLKLLDFYEKYFDIYYPLSKLDLIAIPDFAPGAMENWGLITYRETSLLFDPKTSSASDKLWVTRVIAHELAHQWFGNLVTMEWWNDIWLKEGFAKYMELIAVNATYPELQFDDYFLNVCFEVITKDSLNSSRPISKPAETPTQIQEMFDEVSYNKGACILNMLKDFLGEEKFQKGIIQYLKKFSYRNAKNDDLWSSLSNSCLESDFTSGGVCHSDPKMTSNMVRIKRVTEVEEICGIACPRLAFLGENAEVKEMMTTWTLQKGIPLLVVKQDGCSLRLQQERFLQGVFQEDPEWRALQERYLWHIPLTYSTSSSNVIHRHILKSKTDTLDLPEKTSWVKFNVDSNGYYIVHYEGHGWDQLITQLNQNHTLLRPKDRVGLIHDVFQLVGAGRLTLDKALDMTYYLQHETSSPALLEGLSYLESFYHMMDRRNISDISENLKRYLLQYFKPVIDRQSWSDKGSVWDRMLRSALLKLACDLNHAPCIQKAAELFSQWMESSGKLNIPTDVLKIVYSVGAQTTAGWNYLLEQYELSMSSAEQNKILYALSTSKHQEKLLKLIELGMEGKVIKTQNLAALLHAIARRPKGQQLAWDFVRENWTHLLKKFDLGSYDIRMIISGTTAHFSSKDKLQEVKLFFESLEAQGSHLDIFQTVLETITKNIKWLEKNLPTLRTWLMVNT

SEQ ID NO: 864791 - protein, 918 aa, Homo sapiens
MVNSHRKPMFNIHRGFYCLTAILPQICICSQFSVPSSYHFTEDPGAFPVATNGERFPWQELRLPSVVIPLHYDLFVHPNLTSLDFVASEKIEVLVSNATQFIILHSKDLEITNATLQSEEDSRYMKPGKELKVLSYPAHEQIALLVPEKLTPHLKYYVAMDFQAKLGDGFEGFYKSTYRTLGGETRILAVTDFEPTQARMAFPCFDEPLFKANFSIKIRRESRHIALSNMPKVKTIELEGGLLEDHFETTVKMSTYLVAYIVCDFHSLSGFTSSGVKVSIYASPDKRNQTHYALQASLKLLDFYEKYFDIYYPLSKLDLIAIPDFAPGAMENWGLITYRETSLLFDPKTSSASDKLWVTRVIAHELAHQWFGNLVTMEWWNDIWLKEGFAKYMELIAVNATYPELQFDDYFLNVCFEVITKDSLNSSRPISKPAETPTQIQEMFDEVSYNKGACILNMLKDFLGEEKFQKGIIQYLKKFSYRNAKNDDLWSSLSNSCLESDFTSGGVCHSDPKMTSNMLAFLGENAEVKEMMTTWTLQKGIPLLVVKQDGCSLRLQQERFLQGVFQEDPEWRALQERYLWHIPLTYSTSSSNVIHRHILKSKTDTLDLPEKTSWVKFNVDSNGYYIVHYEGHGWDQLITQLNQNHTLLRPKDRVGLIHDVFQLVGAGRLTLDKALDMTYYLQHETSSPALLEGLSYLESFYHMMDRRNISDISENLKRYLLQYFKPVIDRQSWSDKGSVWDRMLRSALLKLACDLNHAPCIQKAAELFSQWMESSGKLNIPTDVLKIVYSVGAQTTAGWNYLLEQYELSMSSAEQNKILYALSTSKHQEKLLKLIELGMEGKVIKTQNLAALLHAIARRPKGQQLAWDFVRENWTHLLKKFDLGSYDIRMIISGTTAHFSSKDKLQEVCDFLFLTISK

SEQ ID NO: 864792 - protein, 344 aa, Homo sapiens
MVNSHRKPMFNIHRGFYCLTAILPQICICSQFSVPSSYHFTEDPGAFPVATNGERFPWQELRLPSVVIPLHYDLFVHPNLTSLDFVASEKIEVLVSNATQFIILHSKDLEITNATLQSEEDSRYMKPGKELKVLSYPAHEQIALLVPEKLTPHLKYYVAMDFQAKLGDGFEGFYKSTYRTLGGETRILAVTDFEPTQARMAFPCFDEPLFKANFSIKIRRESRHIALSNMPKVKTIELEGGLLEDHFETTVKMSTYLVAYIVCDFHSLSGFTSSGVKVSIYASPDKRNQTHYALQASLKLLDFYEKYFDIYYPLSKLGMFKFHIIVFIFAHKTCFDLFPLSLSM

SEQ ID NO: 864793 - protein, 779 aa, Homo sapiens
MVNSHRKPMFNIHRGFYCLTAILPQICICSQFSVPSSYHFTEDPGAFPVATNGERFPWQELRLPSVVIPLHYDLFVHPNLTSLDFVASEKIEVLVSNATQFIILHSKDLEITNATLQSEEDSRYMKPGKELKVLSYPAHEQIALLVPEKLTPHLKYYVAMDFQAKLGDGFEGFYKSTYRTLGGETRILAVTDFEPTQARMAFPCFDEPLFKANFSIKIRRESRHIALSNMPKVKTIELEGGLLEDHFETTVKMSTYLVAYIVCDFHSLSGFTSSGVKVSIYASPDKRNQTHYALQASLKLLDFYEKYFDIYYPLSKLDLIAIPDFAPGAMENWGLITYRETSLLFDPKTSSASDKLWVTRVIAHELAHQWFGNLVTMEWWNDIWLKEGFAKYMELIAVNATYPELQFDDYFLNVCFEVITKDSLNSSRPISKPAETPTQIQEMFDEVSYNKGACILNMLKDFLGEEKFQKGIIQYLKKFSYRNAKNDDLWSSLSNSCLESDFTSGGVCHSDPKMTSNMLAFLGENAEVKEMMTTWTLQKGIPLLVVKQDGCSLRLQQERFLQGVFQEDPEWRALQERYLWHIPLTYSTSSSNVIHRHILKSKTDTLDLPEKTSWVKFNVDSNGYYIVHYEGHGWDQLITQLNQNHTLLRPKDRVGLIHDVFQLVGAGRLTLDKALDMTYYLQHETSSPALLEGLSYLESFYHMMDRRNISDISENLKRYLLQYFKPVIDRQSWSDKGSVWDRMLRSALLKLACDLNHAPCIQKAAELFSQWMESSGKLK

SEQ ID NO: 864794 - protein, 968 aa, Homo sapiens
MVNSHRKPMFNIHRGFYCLTAILPQICICSQFSVPSSYHFTEDPGAFPVATNGERFPWQELRLPSVVIPLHYDLFVHPNLTSLDFVASEKIEVLVSNATQFIILHSKDLEITNATLQSEEDSRYMKPGKELKVLSYPAHEQIALLVPEKLTPHLKYYVAMDFQAKLGDGFEGFYKSTYRTLGGETRILAVTDFEPTQARMAFPCFDEPLFKANFSIKIRRESRHIALSNMPKVKTIELEGGLLEDHFETTVKMSTYLVAYIVCDFHSLSGFTSSGVKVSIYASPDKRNQTHYALQASLKLLDFYEKYFDIYYPLSKLDLIAIPDFAPGAMENWGLITYRETSLLFDPKTSSASDKLWVTRVIAHELAHQWFGNLVTMEWWNDIWLKEGFAKYMELIAVNATYPELQFDDYFLNVCFEVITKDSLNSSRPISKPAETPTQIQEMFDEVSYNKGACILNMLKDFLGEEKFQKGIIQYLKKFSYRNAKNDDLWSSLSNSCLESDFTSGGVCHSDPKMTSNMLAFLGENAEVKEMMTTWTLQKGIPLLVVKQDGCSLRLQQERFLQGVFQEDPEWRALQERYLWHIPLTYSTSSSNVIHRHILKSKTDTLDLPEKTSWVKFNVDSNGYYIVHYEGHGWDQLITQLNQNHTLLRPKDRVGLIHDVFQLVGAGRLTLDKALDMTYYLQHETSSPALLEGLSYLESFYHMMDRRNISDISENLKRYLLQYFKPVIDRQSWSDKGSVWDRMLRSALLKLACDLNHAPCIQKAAELFSQWMESSGKLNIPTDVLKIVYSVGAQTTAGWNYLLEQYELSMSSAEQNKILYALSTSKHQEKLLKLIELGMEGKVIKTQNLAALLHAIARRPKGQQLAWDFVRENWTHLLKKFDLGSYDIRMIISGTTAHFSSKDKLQEVKLFFESLEAQGSHLDIFQTVLETITKNIKWLEKNLYFLLILYSWNRHSLASLEVLAGSSR

SEQ ID NO: 864795 - protein, 169 aa, Homo sapiens
LGEGWGCGRPWSAAVMAGPVKDREAFQRLNFLYQAAHCVLAQDPENQALARFYCYTERTIAKRLVLRRDPSVKRTLCRGCSSLLVPGLTCTQRQRRCRGQRWTVQTCLTCQRSQRFLNDPGHLLWGDRPEAQLGSQADSKPLQPLPNTAHSISDRLPEEKMQTQGSSNQ

SEQ ID NO: 864796 - protein, 169 aa, Homo sapiens; identical to SEQ ID NO: 864795

SEQ ID NO: 864797 - protein, 169 aa, Homo sapiens; identical to SEQ ID NO: 864795

SEQ ID NO: 864798 - protein, 68 aa, Homo sapiens
LGEGWGCGRPWSAAVMAGPVKDREAFQRLNFLYQAAHCVLAQDPENQALARFYCYTERTIAKRLVLRR

SEQ ID NO: 864799 - protein, 68 aa, Homo sapiens; identical to SEQ ID NO: 864798

SEQ ID NO: 864800 - protein, 129 aa, Homo sapiens
LGEGWGCGRPWSAAVMAGPVKDREAFQRLNFLYQAAHCVLAQDPENQALARFYCYTERTIAKRLVLRRDPSVKRTLCRGCSSLLVPGLTCTQRQRRECSNGGGRLRSIGGAEGGGVGGGHWRPTAPFSL

SEQ ID NO: 864801 - protein, 129 aa, Homo sapiens; identical to SEQ ID NO: 864800

SEQ ID NO: 864802 - protein, 192 aa, Homo sapiens
LGEGWGCGRPWSAAVMAGPVKDREAFQRLNFLYQVSLRQGPHGDGARRPRVTAPLPQAAHCVLAQDPENQALARFYCYTERTIAKRLVLRRDPSVKRTLCRGCSSLLVPGLTCTQRQRRCRGQRWTVQTCLTCQRSQRFLNDPGHLLWGDRPEAQLGSQADSKPLQPLPNTAHSISDRLPEEKMQTQGSSNQ

SEQ ID NO: 864803 - protein, 161 aa, Homo sapiens
LGEGWGCGRPWSAAVMAGPVKDREAFQRLNFLYQDPENQALARFYCYTERTIAKRLVLRRDPSVKRTLCRGCSSLLVPGLTCTQRQRRCRGQRWTVQTCLTCQRSQRFLNDPGHLLWGDRPEAQLGSQADSKPLQPLPNTAHSISDRLPEEKMQTQGSSNQ

SEQ ID NO: 864804 - protein, 177 aa, Homo sapiens
LGEGWGCGRPWSAAVMAGPVKDREAFQRLNFLYQAAHCVLAQDPENQALARFYCYTERTIAKRLVLRRPLSSSAPRDPSVKRTLCRGCSSLLVPGLTCTQRQRRCRGQRWTVQTCLTCQRSQRFLNDPGHLLWGDRPEAQLGSQADSKPLQPLPNTAHSISDRLPEEKMQTQGSSNQ

SEQ ID NO: 864805 - protein, 192 aa, Homo sapiens; identical to SEQ ID NO: 864802

SEQ ID NO: 864806 - protein, 129 aa, Homo sapiens; identical to SEQ ID NO: 864800

SEQ ID NO: 864807 - protein, 153 aa, Homo sapiens
LGEGWGCGRPWSAAVMAGPVKDREAFQRLNFLYQAAHCVLAQDPENQALARFYCYTERTIAKRLVLRRDPSVKRTLCRGCSSLLVPGLTCTQRQRRCRGQRWTVQTCLTCQRSQRFLNDPGHLLWGDRPEAQLGSQADRLPEEKMQTQGSSNQ

SEQ ID NO: 864808 - protein, 99 aa, Homo sapiens
GLLLLLNSRPRRLRGSWDRRSVANMQLFVRAQELHTFEVTGQETVAQIKAHVASLGGHCPGKIKVVLLAGAPLEDEATLGQCGVEALTTPGSSRPHAWR

SEQ ID NO: 864809 - protein, 99 aa, Homo sapiens
HASRTRGSTHASLRGSWDRRSVANMQLFVRAQELHTFEVTGQETVAQIKAHVASLGGHCPGKIKVVLLAGAPLEDEATLGQCGVEALTTPGSSRPHAWR

SEQ ID NO: 864810 - protein, 103 aa, Homo sapiens
RIRQRAPSLLPLSRLHLRGSWDRRSVANMQLFVRAQELHTFEVTGQETVAQIKAHVASLGGHCPGKIKVVLLAGAPLEDEATLGQCGVEALTTPGSSRPHAWR

SEQ ID NO: 864811 - protein, 99 aa, Homo sapiens; identical to SEQ ID NO: 864809

SEQ ID NO: 864812 - protein, 117 aa, Homo sapiens
PHPPPHLPARYEDSVNRRGSASLLPLSRLHLRGSWDRRSVANMQLFVRAQELHTFEVTGQETVAQIKAHVASLGGHCPGKIKVVLLAGAPLEDEATLGQCGVEALTTPGSSRPHAWR

SEQ ID NO: 864813 - protein, 103 aa, Homo sapiens
PPGCRNWHELPLSRLHLRGSWDRRSVANMQLFVRAQELHTFEVTGQETVAQIKAHVASLGGHCPGKIKVVLLAGAPLEDEATLGQCGVEALTTPGSSRPHAWR

SEQ ID NO: 864814 - protein, 118 aa, Homo sapiens
IIFRLKEFNKGQGDPTVCTDAPSLLPLSRLHLRGSWDRRSVANMQLFVRAQELHTFEVTGQETVAQIKAHVASLGGHCPGKIKVVLLAGAPLEDEATLGQCGVEALTTPGSSRPHAWR

SEQ ID NO: 864815 - protein, 103 aa, Homo sapiens; identical to SEQ ID NO: 864810

SEQ ID NO: 864816 - protein, 116 aa, Homo sapiens
TARSLSRRGDTQPTVCTDAPSLLPLSRLHLRGSWDRRSVANMQLFVRAQELHTFEVTGQETVAQIKAHVASLGGHCPGKIKVVLLAGAPLEDEATLGQCGVEALTTPGSSRPHAWR

SEQ ID NO: 864817 - protein, 116 aa, Homo sapiens; identical to SEQ ID NO: 864816

SEQ ID NO: 864818 - protein, 116 aa, Homo sapiens; identical to SEQ ID NO: 864816

SEQ ID NO: 864819 - protein, 103 aa, Homo sapiens; identical to SEQ ID NO: 864813

SEQ ID NO: 864820 - protein, 118 aa, Homo sapiens; identical to SEQ ID NO: 864814

SEQ ID NO: 864821 - protein, 99 aa, Homo sapiens; identical to SEQ ID NO: 864808

SEQ ID NO: 864822 - protein, 116 aa, Homo sapiens; identical to SEQ ID NO: 864816

SEQ ID NO: 864823 - protein, 116 aa, Homo sapiens; identical to SEQ ID NO: 864816

SEQ ID NO: 864824 - protein, 116 aa, Homo sapiens; identical to SEQ ID NO: 864816

SEQ ID NO: 864825 - protein, 116 aa, Homo sapiens; identical to SEQ ID NO: 864816

SEQ ID NO: 864826 - protein, 116 aa, Homo sapiens; identical to SEQ ID NO: 864816

SEQ ID NO: 864827 - protein, 117 aa, Homo sapiens; identical to SEQ ID NO: 864812

SEQ ID NO: 864828 - protein, 103 aa, Homo sapiens
GSLIKLIPPPPSPVLSRGIFAELGSVANMQLFVRAQELHTFEVTGQETVAQIKAHVASLGGHCPGKIKVVLLAGAPLEDEATLGQCGVEALTTPGSSRPHAWR

SEQ ID NO: 864829 - protein, 79 aa, Homo sapiens
TRRGRVGRPTRRELHTFEVTGQETVAQIKAHVASLGGHCPGKIKVVLLAGAPLEDEATLGQCGVEALTTPGSSRPHAWR

SEQ ID NO: 864830 - protein, 114 aa, Homo sapiens
MVGNTVGIWSKEEESKKKTPATKKNSLKNQAGRGGSVANMQLFVRAQELHTFEVTGQETVAQIKAHVASLGGHCPGKIKVVLLAGAPLEDEATLGQCGVEALTTPGSSRPHAWR

SEQ ID NO: 864831 - protein, 99 aa, Homo sapiens; identical to SEQ ID NO: 864808

SEQ ID NO: 864832 - protein, 91 aa, Homo sapiens
GLLLLLNSRPRRSVANMQLFVRAQELHTFEVTGQETVAQIKAHVASLGGHCPGKIKVVLLAGAPLEDEATLGQCGVEALTTPGSSRPHAWR

SEQ ID NO: 864833 - protein, 99 aa, Homo sapiens
GFSLFSSTFALSRVGWGTARSVANMQLFVRAQELHTFEVTGQETVAQIKAHVASLGGHCPGKIKVVLLAGAPLEDEATLGQCGVEALTTPGSSRPHAWR

SEQ ID NO: 864834 - protein, 99 aa, Homo sapiens; identical to SEQ ID NO: 864809

SEQ ID NO: 864835 - protein, 103 aa, Homo sapiens; identical to SEQ ID NO: 864810

SEQ ID NO: 864836 - protein, 116 aa, Homo sapiens; identical to SEQ ID NO: 864816

SEQ ID NO: 864837 - protein, 116 aa, Homo sapiens; identical to SEQ ID NO: 864816

SEQ ID NO: 864838 - protein, 116 aa, Homo sapiens; identical to SEQ ID NO: 864816

SEQ ID NO: 864839 - protein, 116 aa, Homo sapiens; identical to SEQ ID NO: 864816

SEQ ID NO: 864840 - protein, 92 aa, Homo sapiens
MITRSARPHTTRHCTRISSAPLTASYTHILRYSSTPLDGACVYLVPPSTQHTNNSYFQLPANRAPVSFHLSRTTTPTPHPLPDSEHRLTPRR

SEQ ID NO: 864841 - protein, 103 aa, Homo sapiens; identical to SEQ ID NO: 864810

SEQ ID NO: 864842 - protein, 86 aa, Homo sapiens
QWEAFTPTGWGQSLIFLMLRFLFNQVFTNDKMEECVKLTSLYLFAKNVRSLLHTYHYQQIFLHEFSMAYTKYVGETLQPVGWSGYR

SEQ ID NO: 864843 - protein, 908 aa, Homo sapiens
MENLQDAIGAVNSLHRYKIGSKKILVSLATGAASKSLSLLSAETMSVLQDAPACCLPLFKFTDIYEKKFGHKLNVSDLYKLTDTVAIREQGNGRLVCLLPSSQARQSPLGSSQSHDGSSTNCSPIIFEELEYHEPVCRQHCSNKDFSEHEFDPDSYKIPFVILSLKTFAPQVHSLLQTHEGTVPLLSFPDCYIAEFGDLEVVQENQGGVPLEHFITCVPGVNIATAQNGIKVVKWIHNKPPPPNTDPWLLRSKSPVGNPQLIQFSREVIDLLKSQPSCVIPISHFIPSYHHHFAKQCRVSDYGYSKLIELLEAVPHVLQILGMGSKRLLTLTHRAQVKRFTQDLLKLLKSQASKQVIVREFSQAYHWCFSKDWDVTEYGVCELIDIVSEIPDTTICLSQQDNEMVICIPKRERTQDEIERTKQFSKDVVDLLRHQPHFRMPFNKFIPSYHHHFGRQCKLAYYGFTKLLELFEAIPDTLQVLECGEEKILTLTEVERFKALAAQFVKLLRSQKDNCLMMTDLLTEYAKTFGYTFRLQDYDVSSISALTQKLCHVVKVADIESGRQIQLINRKSLRSLTAQLLVLLMSWEGTTHLSVEELKRHYESTHNTPLNPCEYGFMTLTELLKSLPYLVEVFTNDKMEECVKLTSLYLFAKNVRSLLHTYHYQQIFLHEFSMAYTKYVGETLQPKTYGHSSVEELLGAIPQVVVQFLQKNGKELSCENYLNLYAKAGRLSSLSLSPANHENQPSEGERILEVPESHTASELKLGADGSGPSHTEQELLRLTDDSPVDLLCAPVPSCLPSPQLRPDPVILQSADLIQFEERPQEPSEIMILNQEEKMEIPIPGKSKTLTSDSSSSCISAAVPVPPCPSSETSESLLSKDPVESPAKKQPKNRVKLAANFSLAPITKL

SEQ ID NO: 864844 - protein, 908 aa, Homo sapiens; identical to SEQ ID NO: 864843

SEQ ID NO: 864845 - protein, 302 aa, Homo sapiens
SVGGLHFPTGWGQSLIFLMLRFLFNQVFTNDKMEECVKLTSLYLFAKNVRSLLHTYHYQQIFLHEFSMAYTKYVGETLQPKTYGHSSVEELLGAIPQVVVQFLQKNGKELSCENYLNLYAKAGRLSSLSLSPANHENQPSEGERILEVPESHTASELKLGADGSGPSHTEQELLRLTDDSPVDLLCAPVPSCLPSPQLRPDPVILQSADLIQFEERPQEPSEIMILNQEEKMEIPIPGKSKTLTSDSSSSCISAAVPVPPCPSSETSESLLSKDPVESPAKKQPKNRVKLAANFSLAPITKL

SEQ ID NO: 864846 - protein, 851 aa, Homo sapiens
MENLQDAIGAVNSLHRYKIGSKKILVSLATGAASKSLSLLSAETMSVLQDAPACCLPLFKFTDIYEKKFGHKLNVSDLYKLTDTVAIREQGNGRLVCLLPSSQARQSPLGSSQSHDGSSTNCSPIIFEELEYHEPVCRQHCSNKDFSEHEFDPDSYKIPFVILSLKTFAPQVHSLLQTHEGTVPLLSFPDCYIAEFGDLEVVQENQGGVPLEHFITCVPGVNIATAQNGIKVVKWIHNKPPPPNTDPWLLRSKSPVGNPQLIQFSREVIDLLKSQPSCVIPISHFIPSYHHHFAKQCRVSDYGYSKLIELLEAVPHVLQILGMGSKRLLTLTHRAQVKRFTQDLLKLLKSQASKQVIVREFSQAYHWCFSKDWDVTEYGVCELIDIVSEIPDTTICLSQQDNEMVICIPKRERTQDEIERTKQFSKDVVDLLRHQPHFRMPFNKFIPSYHHHFGRQCKLAYYGFTKLLELFEAIPDTLQVLECGEEKILTLTEVERFKALAAQFVKLLRSQKDNCLMMTDLLTEYAKTFGYTFRLQDYDVSSISALTQKLCHVVKVADIESGRQIQLINRKSLRSLTAQLLVLLMSWEGTTHLSVEELKRHYESTHNTPLNPCEYGFMTLTELLKSLPYLVEVFTNDKMEECVKLTSLYLFAKNVRSLLHTYHYQQIFLHEFSMAYTKYVGETLQPKTYGHSSVEELLGAIPQVVVQFLQKNGKELSCENYLNLYAKAGRLSSLSLSPANHENQPSEGERILEVPESHTASELKLGADGSGPSHTEQELLRLTDDSPVDLLCAPVPSCLPSPQLRPDPVILQSADLIQFEERPQEPSGWVTPCCHGDFLRGLKQNHDEILI

SEQ ID NO: 864847 - protein, 322 aa, Homo sapiens
MPQCHTLLYVYNLPANKDGKSVSNRLRRLSDNCGGKVLSITGCSAILRFINQDSAERAQKRMENEDVFGNRIIVSFTPKNRELCETKSSNAIADKVKSPKKLKNPKLCLIKDASEQSSSAKATPGKGSQANSGSATKNTNVKSLQELCRMESKTGHRNSEHQQGHLRLVVPTHGNSSAAVSTPKNSGVAEPVYKTSQKKENLSARSVTSSPVEKKDKEETVFQVSYPSAFSKLVASRQVSPLLASQSWSSRASPLAFNIANSSSEADCPDPFANGADVQVSNIDYRLSRKELQQLLQEAFARHGKVTFSLLCLLCYTLWWSL

SEQ ID NO: 864848 - protein, 375 aa, Homo sapiens
MPQCHTLLYVYNLPANKDGKSVSNRLRRLSDNCGGKVLSITGCSAILRFINQDSAERAQKRMENEDVFGNRIIVSFTPKNRELCETKSSNAIADKVKSPKKLKNPKLCLIKDASEQSSSAKATPGKGSQANSGSATKNTNVKSLQELCRMESKTGHRNSEHQQGHLRLVVPTHGNSSAAVSTPKNSGVAEPVYKTSQKKENLSARSVTSSPVEKKDKEETVFQVSYPSAFSKLVASRQVSPLLASQSWSSSRSMSPNLLNRASPLAFNIANSSSEADCPDPFANGADVQVSNIDYRLSRKELQQLLQEAFARHGKVKSVELSPHTDYQLKAVVQMENLQDAIGAVNSLHRYKIGSKKILVSLATGAASKSLSLLR

SEQ ID NO: 864849 - protein, 305 aa, Homo sapiens
MPQCHTLLYVYNLPANKDGKSVSNRLRRLSDNCGGKVLSITGCSAILRFINQDSAERAQKRMENEDVFGNRIIVSFTPKNRELCETKSSNAIADKVKSPKKLKNPKLCLIKDASEQSSSAKATPGKGSQANSGSATKNTNVKSLQELCRMESKTGHRNSEHQQGHLRLVVPTHGNSSAAVSTPKNSGVAEPVYKTSQKKENLSARSVTSSPVEKKDKEETVFQVSYPSAFSKLVASRQVSPLLASQSWSSRASPLAFNIANSSSEADCPDPFANGADVQVSNIDYRLSRKELQQLLQEAFARHGK

SEQ ID NO: 864850 - protein, 1227 aa, Homo sapiens
MPQCHTLLYVYNLPANKDGKSVSNRLRRLSDNCGGKVLSITGCSAILRFINQDSAERAQKRMENEDVFGNRIIVSFTPKNRELCETKSSNAIADKVKSPKKLKNPKLCLIKDASEQSSSAKATPGKGSQANSGSATKNTNVKSLQELCRMESKTGHRNSEHQQGHLRLVVPTHGNSSAAVSTPKNSGVAEPVYKTSQKKENLSARSVTSSPVEKKDKEETVFQVSYPSAFSKLVASRQVSPLLASQSWSSRASPLAFNIANSSSEADCPDPFANGADVQVSNIDYRLSRKELQQLLQEAFARHGKVKSVELSPHTDYQLKAVVQMENLQDAIGAVNSLHRYKIGSKKILVSLATGAASKSLSLLSAETMSVLQDAPACCLPLFKFTDIYEKKFGHKLNVSDLYKLTDTVAIREQGNGRLVCLLPSSQARQSPLGSSQSHDGSSTNCSPIIFEELEYHEPVCRQHCSNKDFSEHEFDPDSYKIPFVILSLKTFAPQVHSLLQTHEGTVPLLSFPDCYIAEFGDLEVVQENQGGVPLEHFITCVPGVNIATAQNGIKVVKWIHNKPPPPNTDPWLLRSKSPVGNPQLIQFSREVIDLLKSQPSCVIPISHFIPSYHHHFAKQCRVSDYGYSKLIELLEAVPHVLQILGMGSKRLLTLTHRAQVKRFTQDLLKLLKSQASKQVIVREFSQAYHWCFSKDWDVTEYGVCELIDIVSEIPDTTICLSQQDNEMVICIPKRERTQDEIERTKQFSKDVVDLLRHQPHFRMPFNKFIPSYHHHFGRQCKLAYYGFTKLLELFEAIPDTLQVLECGEEKILTLTEVERFKALAAQFVKLLRSQKDNCLMMTDLLTEYAKTFGYTFRLQDYDVSSISALTQKLCHVVKVADIESGRQIQLINRKSLRSLTAQLLVLLMSWEGTTHLSVEELKRHYESTHNTPLNPCEYGFMTLTELLKSLPYLVEVFTNDKMEECVKLTSLYLFAKNVRSLLHTYHYQQIFLHEFSMAYTKYVGETLQPKTYGHSSVEELLGAIPQVVWIKGHGHKRIVVLKNDMKSRLSSLSLSPANHENQPSEGERILEVPESHTASELKLGADGSGPSHTEQELLRLTDDSPVDLLCAPVPSCLPSPQLRPDPVILQSADLIQFEERPQEPSEIMILNQEEKMEIPIPGKSKTLTSDSSSSCISAAVPVPPCPSSETSESLLSKDPVESPAKKQPKNRVKLAANFSLAPITKL

SEQ ID NO: 864851 - protein, 1102 aa, Homo sapiens
MPQCHTLLYVYNLPANKDGKSVSNRLRRLSDNCGGKVLSITGCSAILRFINQDSAERAQKRMENEDVFEKKDKEETVFQVSYPSAFSKLVASRQVSPLLASQSWSSRASPLAFNIANSSSEADCPDPFANGADVQVSNIDYRLSRKELQQLLQEAFARHGKVKSVELSPHTDYQLKAVVQMENLQDAIGAVNSLHRYKIGSKKILVSLATGAASKSLSLLRFGHKLNVSDLYKLTDTVAIREQGNGRLVCLLPSSQARQSPLGSSQSHDGSSTNCSPIIFEELEYHEPVCRQHCSNKDFSFPDCYIAEFGDLEVVQENQGGVPLEHFITCVPGVNIATAQNGIKVVKWIHNKPPPPNTDPWLLRSKSPVGNPQLIQFSREVIDLLKSQPSCVIPISHFIPSYHHHFAKQCRVSDYGYSKLIELLEAVPHVLQILGMGSKRLLTLTHRAQVKRFTQDLLKLLKSQASKQVIVREFSQAYHWCFSKDWDVTEYGVCELIDIVSEIPDTTICLSQQDNEMVICIPKRERTQDEIERTKQFSKDVVDLLRHQPHFRMPFNKFIPSYHHHFGRQCKLAYYGFTKLLELFEAIPDTLQVLECGEEKILTLTEVERFKALAAQFVKLLRSQKDNCLMMTDLLTEYAKTFGYTFRLQDYDVSSISALTQKLCHVVKVADIESGRQIQLINRKSLRSLTAQLLVLLMSWEGTTHLSVEELKRHYESTHNTPLNPCEYGFMTLTELLKSLPYLVETAAAFDLQIELKFAGGYSLLLEEILEYIPPPFLSPLPSFLPPPPFFFFVFFVIFIFFIFVFVQFVVFVFFIVVFVFFIVVFVFTNDKMEECVKLTSLYLFAKNVRSLLHTYHYQQIFLHEFSMAYTKYVGETLQPKTYGHSSVEELLGAIPQVVVQFLQKNGKELSCENYLNLYAKAGRLSSLSLSPANHENQPSEGERILEVPESHTASELKLGADGSGPSHTEQELLRLTDDSPVDLLCAPVPSCLPSPQLRPDPVILQSADLIQFEERPQEPSEIMILNQEEKMEIPIPGKSKTLTSDSSSSCISAAVPVPPCPSSETSESLLSKDPVESPAKKQPKNRVKLAANFSLAPITKL

SEQ ID NO: 864852 - protein, 1242 aa, Homo sapiens
MPQCHTLLYVYNLPANKDGKSVSNRLRRLSDNCGGKVLSITGCSAILRFINQDSAERAQKRMENEDVFGNRIIVSFTPKNRELCETKSSNAIADKVKSPKKLKNPKLCLIKDASEQSSSAKATPGKGSQANSGSATKNTNVKSLQELCRMESKTGHRNSEHQQGHLRLVVPTHGNSSAAVSTPKNSGVAEPVYKTSQKKENLSARSVTSSPVEKKDKEETVFQVSYPSAFSKLVASRQVSPLLASQSWSSSRSMSPNLLNRASPLAFNIANSSSEADCPDPFANGADVQVSNIDYRLSRKELQQLLQEAFARHGKVKSVELSPHTDYQLKAVVQMENLQDAIGAVNSLHRYKIGSKKILVSLATGAASKSLSLLSAETMSVLQDAPACCLPLFKFTDIYEKKFGHKLNVSDLYKLTDTVAIREQGNGRLVCLLPSSQARQSPLGSSQSHDGSSTNCSPIIFEELEYHEPVCRQHCSNKDFSEHEFDPDSYKIPFVILSLKTFAPQVHSLLQTHEGTVPLLSFPDCYIAEFGDLEVVQENQGGVPLEHFITCVPGVNIATAQNGIKVVKWIHNKPPPPNTDPWLLRSKSPVGNPQLIQFSREVIDLLKSQPSCVIPISHFIPSYHHHFAKQCRVSDYGYSKLIELLEAVPHVLQILGMGSKRLLTLTHRAQVKRFTQDLLKLLKSQASKQVIVREFSQAYHWCFSKDWDVTEYGVCELIDIVSEIPDTTICLSQQDNEMVICIPKRERTQDEIERTKQFSKDVVDLLRHQPHFRMPFNKFIPSYHHHFGRQCKLAYYGFTKLLELFEAIPDTLQVLECGEEKILTLTEVERFKALAAQFVKLLRSQKDNCLMMTDLLTEYAKTFGYTFRLQDYDVSSISALTQKLCHVVKVADIESGRQIQLINRKSLRSLTAQLLVLLMSWEGTTHLSVEELKRHYESTHNTPLNPCEYGFMTLTELLKSLPYLVEVFTNDKMEECVKLTSLYLFAKNVRSLLHTYHYQQIFLHEFSMAYTKYVGETLQPKTYGHSSVEELLGAIPQVVVQFLQKNGKELSCENYLNLYAKAGRLSSLSLSPANHENQPSEGERILEVPESHTASELKLGADGSGPSHTEQELLRLTDDSPVDLLCAPVPSCLPSPQLRPDPVILQSADLIQFEERPQEPSEIMILNQEEKMEIPIPGKSKTLTSDSSSSCISAAVPVPPCPSSETSESLLSKDPVESPAKKQPKNRVKLAANFSLAPITKL

SEQ ID NO: 864853 - protein, 999 aa, Homo sapiens
NVNMCVLSRSMSPNLLNRASPLAFNIANSSSEADCPDPFANGADVQVSNIDYRLSRKELQQLLQEAFARHGKVKSVELSPHTDYQLKAVVQMENLQDAIGAVNSLHRYKIGSKKILVSLATGAASKSLSLLSAETMSVLQDAPACCLPLFKFTDIYEKKFGHKLNVSDLYKLTDTVAIREQGNGRLVCLLPSSQARQSPLGSSQSHDGSSTNCSPIIFEELEYHEPVCRQHCSNKDFSEHEFDPDSYKIPFVILSLKTFAPQVHSLLQTHEGTVPLLSFPDCYIAEFGDLEVVQENQGGVPLEHFITCVPGVNIATAQNGIKVVKWIHNKPPPPNTDPWLLRSKSPVGNPQLIQFSREVIDLLKSQPSCVIPISHFIPSYHHHFAKQCRVSDYGYSKLIELLEAVPHVLQILGMGSKRLLTLTHRAQVKRFTQDLLKLLKSQASKQVIVREFSQAYHWCFSKDWDVTEYGVCELIDIVSEIPDTTICLSQQDNEMVICIPKRERTQDEIERTKQFSKDVVDLLRHQPHFRMPFNKFIPSYHHHFGRQCKLAYYGFTKLLELFEAIPDTLQVLECGEEKILTLTEVERFKALAAQFVKLLRSQKDNCLMMTDLLTEYAKTFGYTFRLQDYDVSSISALTQKLCHVVKVADIESGRQIQLINRKSLRSLTAQLLVLLMSWEGTTHLSVEELKRHYESTHNTPLNPCEYGFMTLTELLKSLPYLVEVFTNDKMEECVKLTSLYLFAKNVRSLLHTYHYQQIFLHEFSMAYTKYVGETLQPKTYGHSSVEELLGAIPQVVVQFLQKNGKELSCENYLNLYAKAGRLSSLSLSPANHENQPSEGERILEVPESHTASELKLGADGSGPSHTEQELLRLTDDSPVDLLCAPVPSCLPSPQLRPDPVILQSADLIQFEERPQEPSEIMILNQEEKMEIPIPGKSKTLTSDSSSSCISAAVPVPPCPSSETSESLLSKDPVESPAKKQPKNRVKLAANFSLAPITKL

SEQ ID NO: 864854 - protein, 908 aa, Homo sapiens; identical to SEQ ID NO: 864843

SEQ ID NO: 864855 - protein, 659 aa, Homo sapiens
MENLQDAIGAVNSLHRYKIGSKKILVSLATGAASKSLSLLSAETMSVLQDAPACCLPLFKFTDIYEKKFGHKLNVSDLYKLTDTVAIREQGNGRLVCLLPSSQARQSPLGSSQSHDGSSTNCSPIIFEELEYHEPVCRQHCSNKDFSEHEFDPDSYKIPFVILSLKTFAPQVHSLLQTHEGTVPLLSFPDCYIAEFGDLEVVQENQGGVPLEHFITCVPGVNIATAQNGIKVVKWIHNKPPPPNTDPWLLRSKSPVGNPQLIQFSREVIDLLKSQPSCVIPISHFIPSYHHHFAKQCRVSDYGYSKLIELLEAVPHVLQILGMGSKRLLTLTHRAQVKRFTQDLLKLLKSQASKQVIVREFSQAYHWCFSKDWDVTEYGVCELIDIVSEIPDTTICLSQQDNEMVICIPKRERTQDEIERTKQFSKDVVDLLRHQPHFRMPFNKFIPSYHHHFGRQCKLAYYGFTKLLELFEAIPDTLQVLECGEEKILTLTEVERFKALAAQFVKLLRSQKDNCLMMTDLLTEYAKTFGYTFRLQDYDVSSISALTQKLCHVVKVADIESGRQIQLINRKSLRSLTAQLLVLLMSWEGTTHLSVEELKRHYESTHNTPLNPCEYGFMTLTELLKSLPYLVEVFTNDKMEECVKLTSLYLFAKNVRSRS

SEQ ID NO: 864856 - protein, 436 aa, Homo sapiens
MPQCHTLLYVYNLPANKDGKSVSNRLRRLSDNCGGKVLSITGCSAILRFINQDSAERAQKRMENEDVFGNRIIVSFTPKNRELCETKSSNAIADKVKSPKKLKNPKLCLIKDASEQSSSAKATPGKGSQANSGSATKNTNVKSLQELCRMESKTGHRNSEHQQGHLRLVVPTHGNSSAAVSTPKNSGVAEPVYKTSQKKENLSARSVTSSPVEKKDKEETVFQVSYPSAFSKLVASRQVSPLLASQSWSSSRSMSPNLLNRASPLAFNIANSSSEADCPDPFANGADVQVSNIDYRLSRKELQQLLQEAFARHGKVKSVELSPHTDYQLKAVVQMENLQDAIGAVNSLHRYKIGSKKILVSLATGAASKSLSLLSAETMSVLQDAPACCLPLFKFTDIYEKKLAAVMCQIYINYRHVASDQKTWVFYRVRRKPGFQ

SEQ ID NO: 864857 - protein, 112 aa, Homo sapiens
EPVEGGGGGASAEDQDRLRTAQLAPPGLGRTRSGFSSCRPYGAVFSLSRGVRASHAGPGREKSKACRGCREKTKRGCISGNFRCSICARKEKEKGKNRKTNCYIRAPTRRWT

SEQ ID NO: 864858 - protein, 112 aa, Homo sapiens; identical to SEQ ID NO: 864857

SEQ ID NO: 864859 - protein, 71 aa, Homo sapiens
ARTGGRVRRVVGSCQSDLGRRLRVDLHFVTKSCRKAAVASFYLPLTLAAPDLHRAPAHAEGVTRGTFRGMW

SEQ ID NO: 864860 - protein, 129 aa, Homo sapiens
MRARSATWKYGLETHLANCRKRGSMIFTNSDGSSCRDAQLAPPGLGRTRSGFSSCRPYGAVFSLSRGVRASHAGPGREKSKACRGCREKTKRGCISGNFRCSICARKEKEKGKNRKTNCYIRAPTRRWT

SEQ ID NO: 864861 - protein, 112 aa, Homo sapiens; identical to SEQ ID NO: 864857

SEQ ID NO: 864862 - protein, 71 aa, Homo sapiens; identical to SEQ ID NO: 864859

SEQ ID NO: 864863 - protein, 90 aa, Homo sapiens
TNCQHGTEIYIIHQEWKIYEPHPSPKGSPEEEEKRAKLAEAAERRQKEAASRGILDVQSVQEKRKKKEKIEKQIATSGPPPEGGLRWTVS

SEQ ID NO: 864864 - protein, 105 aa, Homo sapiens
RSAERDDATEPVQACLHAVLSPMDAVDCTLVPVRSACCRTPDLQENISKSLQRLHERYDHITEAASRGILDVQSVQEKRKKKEKIEKQIATSGPPPEGGLRWTVS

SEQ ID NO: 864865 - protein, 129 aa, Homo sapiens; identical to SEQ ID NO: 864860

SEQ ID NO: 864866 - protein, 255 aa, Homo sapiens
MKLIILEHYSQASEWAAKYIRNRIIQFNPGPEKYFTLGLPTGLPRDHPESYHSFMWNNFFKHIDIHPENTHILDGNAVDLQAECDAFEEKIKAAGGIELFVGGIGPDGHIAFNEPGSSLVSRTRVKTLAMDTILANARFFDGELTKVPTMALTVGVGTVMDAREVMILITGAHKAFALYKAIEEGVNHMWTVSAFQQHPRTVFVCDEDATLELKVKTVKYFKGLMLVHNKLVDPLYSIKEKETEKSQSSKKPYSD

SEQ ID NO: 864867 - protein, 289 aa, Homo sapiens
MKLIILEHYSQASEWAAKYIRNRIIQFNPGPEKYFTLGLPTGSTPLGCYKKLIEYYKNGDLSFKYVKTFNMDEYVGLPRDHPESYHSFMWNNFFKHIDIHPENTHILDGNAVDLQAECDAFEEKIKAAGGIELFVGGIGPDGHIAFNEPGSSLVSRTRVKTLAMDTILANARFFDGELTKVPTMALTVGVGTVMDAREVMILITGAHKAFALYKAIEEGVNHMWTVSAFQQHPRTVFVCDEDATLELKVKTVKYFKGLMLVHNKLVDPLYSIKEKETEKSQSSKKPYSD

SEQ ID NO: 864868 - protein, 289 aa, Homo sapiens; identical to SEQ ID NO: 864867

SEQ ID NO: 864869 - protein, 328 aa, Homo sapiens
DPRGAGPPAQSLQPPREASVRKRLRENLGPLTEVLQVDKMKLIILEHYSQASEWAAKYIRNRIIQFNPGPEKYFTLGLPTGSTPLGCYKKLIEYYKNGDLSFKYVKTFNMDEYVGLPRDHPESYHSFMWNNFFKHIDIHPENTHILDGNAVDLQAECDAFEEKIKAAGGIELFVGGIGPDGHIAFNEPGSSLVSRTRVKTLAMDTILANARFFDGELTKVPTMALTVGVGTVMDAREVMILITGAHKAFALYKAIEEGVNHMWTVSAFQQHPRTVFVCDEDATLELKVKTVKYFKGLMLVHNKLVDPLYSIKEKETEKSQSSKKPYSD

SEQ ID NO: 864870 - protein, 255 aa, Homo sapiens
MKLIILEHYSQASEWAAKYIRNRIIQFNPGPEKYFTLGLPTGSTPLGCYKKLIEYYKNGDLSFKYVKTFNMDEYVGLPRDHPESYHSFMWNNFFKHIDIHPENTHILDGNAVDLQAECDAFEEKIKAAGGIELFVGGIGPDGHIAFNEPGSSLVSRTRVKTLAMDTILANARFFDGELTKAIEEGVNHMWTVSAFQQHPRTVFVCDEDATLELKVKTVKYFKGLMLVHNKLVDPLYSIKEKETEKSQSSKKPYSD

SEQ ID NO: 864871 - protein, 289 aa, Homo sapiens; identical to SEQ ID NO: 864867

SEQ ID NO: 864872 - protein, 281 aa, Homo sapiens
MKLIILEHYSQASEWAAKYIRNRIIQFNPGPEKYFTLGLPTGSTPLGCYKKLIEYYKNGDLSFKYVKTFNMDEYVGLPRDHPESYHSFMWNNFFKHIDIHPENTHILDGNAVDLQAECDAFEEKIKAAGIGPDGHIAFNEPGSSLVSRTRVKTLAMDTILANARFFDGELTKVPTMALTVGVGTVMDAREVMILITGAHKAFALYKAIEEGVNHMWTVSAFQQHPRTVFVCDEDATLELKVKTVKYFKGLMLVHNKLVDPLYSIKEKETEKSQSSKKPYSD

SEQ ID NO: 864873 - protein, 271 aa, Homo sapiens
MKLIILEHYSQASEWAAKYIRNRIIQFNPGPEKYFTLGLPTGSTPLGCYKKLIEYYKNGDLSFKYVKTFNMDEYVGLPRDHPESYHSFMWNNFFKHIDIHPENTHILDGNAVDLQAECDAFEEKIKAAGGIELFVGGIGPDGHIAFNEPGSSLVSRTRVKTLAMDTILANARFFDGELTKVMILITGAHKAFALYKAIEEGVNHMWTVSAFQQHPRTVFVCDEDATLELKVKTVKYFKGLMLVHNKLVDPLYSIKEKETEKSQSSKKPYSD

SEQ ID NO: 864874 - protein, 173 aa, Homo sapiens
MPMKGRFPIRRTLQYLSQGNVVFKDSVKVMTVNYNTHGELGEGARKFVFFNIPQIQYKNPWVQIMMFKNMTPSPFLRFYLDSGEQVLVDVETKSNKEIMEHIRKILGKNEETLREEEEEKKQLSHPANFGPRKYCLRECICEVEGQVPCPSLVPLPKEMRGKYKAALKADAQD

SEQ ID NO: 864875 - protein, 135 aa, Homo sapiens
MPMKGRFPIRRTLQYLSQGNVVFKDSVKVMTVNYNTHGELGEGARKFVFFNIPQIQYKNPWVQIMMFKNMTPSPFLRFYLGEWGPRHGPGAVPDMPGETASFLWERQDELQCALSWCVCDSWHLWLPHTEALSSH

SEQ ID NO: 864876 - protein, 145 aa, Homo sapiens
MPMKGRFPIRRTLQYLSQGNVVFKDSVKVMTVNYNTHGELGEGARKFVFFNIPQIQYKNPWVQIMMFKNMTPSPFLRFYLDSGEQVLVDVETKSNKEIMEHIRKILGKNEHYLAAPSKPVSSAVVPVTQEAEAGGSLEPRRLRLE

SEQ ID NO: 864877 - protein, 108 aa, Homo sapiens
MLSFKEYYLVGCLFLTGDRKMGITIYSVIRTVPHILLTEHSASLGNCYHLWESGLTDTDRSESLTVTPVSGLLNRAEVAGKADGSDPTAKFLPGRAMNRCMKRLKIPT

SEQ ID NO: 864878 - protein, 173 aa, Homo sapiens; identical to SEQ ID NO: 864874

SEQ ID NO: 864879 - protein, 173 aa, Homo sapiens; identical to SEQ ID NO: 864874

SEQ ID NO: 864880 - protein, 112 aa, Homo sapiens
MPMKGRFPIRRTLQYLSQGNVVFKDSVKVMTVNYNTHGELGEGARKFVFFNIPQIQYKNPWVQIMMFKNMTPSPFLRFYLGTTWQHHLNLYHLLWSQLLRRLRQEDHLSPGG

SEQ ID NO: 864881 - protein, 173 aa, Homo sapiens; identical to SEQ ID NO: 864874

SEQ ID NO: 864882 - protein, 173 aa, Homo sapiens; identical to SEQ ID NO: 864874

SEQ ID NO: 864883 - protein, 184 aa, Homo sapiens
SGLAETQGRSEAAAMLPSLQESMDGDEKELESSEEGGSAEERRLEPPSSSHYCLYSYRGSRLAQQRGDSEDGSPSGTNAETPSGDDFSLSLADTNLPSEVEPELRSFIAKRLSRGAVFEGLGNVASVELKIPGYRVGCYYCLFQNEKLLPETVTIDSERNPSEYVVCFLGGSEKGLELYPFFGF

SEQ ID NO: 864884 - protein, 80 aa, Homo sapiens
RPITVFYRQSKREEKRSRRNEAKNPSLSQPNGYHHVPQEADTKWPTASFPAPPPVKHCGRRRSQEGEGHMTQTSALSGWD

SEQ ID NO: 864885 - protein, 259 aa, Homo sapiens
SGLAETQGRSEAAAMLPSLQESMDGDEKELESSEEGGSAEERRLEPPSSSHYCLYSYRGSRLAQQRGDSEDGSPSGTNAETPSGDDFSLSLADTNLPSEVEPELRSFIAKRLSRGAVFEGLGNVASVELKIPGYRVGCYYCLFQNEKLLPETVTIDSERNPSEYVVCFLGGSEKGLELFRLELDKYIQGLKNNMNCEARGLESHIKSYLSSWFEDVVCPIQRVVLLFQEKLTFLLHAALSYTPVEVKESDEKTKRDINR

SEQ ID NO: 864886 - protein, 320 aa, Homo sapiens
SGLAETQGRSEAAAMLPSLQESMDGDEKELESSEEGGSAEERRLEPPSSSHYCLYSYRGSRLAQQRGDSEDGSPSGTNAETPSGDDFSLSLADTNLPSEVEPELRSFIAKRLSRGAVFEGLGNVASVELKIPGYRVGCYYCLFQNEKLLPETVTIDSERNPSEYVVCFLGGSEKGLELFRLELDKYIQGLKNNMNCEARGLESHIKSYLSSWFEDVVCPIQRVVLLFQEKLTFLLHAALSYTPVEVKESDEKTKRDINRFLSVASLQGLIHEGTMTSLCMAMTEEQHKSVVIDCSSSQPQFCNAEILDPPPLLFTLSHPS

SEQ ID NO: 864887 - protein, 217 aa, Homo sapiens
MNCEARGLESHIKSYLSSWFEDVVCPIQRVVLLFQEKLTFLLHAALSYTPVEVKESDEKTKRDINRFLSVASLQGLIHEGTMTSLCMAMTEEQHKSVVIDCSSSQPQFCNAGSNRFCEDWMQAFLNGAKGGNPFLFRQVLENFKLKAIQDTNNLKRFIRQAEMNHYALFKCYMFLKNCGSGDILLKIVKVEHEEMPEAKNVIAVLEEFMKEALDQSF

SEQ ID NO: 864888 - protein, 290 aa, Homo sapiens
MHFTFSFFSRIPGYRVGCYYCLFQNEKLLPETVTIDSERNPSEYVVCFLGGSEKGLELFRLELDKYIQGLKNNMNCEARGLESHIKSYLSSWFEDVVCPIQRVVLLFQEKLTFLLHAALSYTPVEVKESDEKTKRDINRFLSVASLQGLIHEGTMTSLCMAMTEEQHKSVVIDCSSSQPQFCNAGSNRFCEDWMQAFLNGAKGGNPFLFRQVLENFKLKAIQDTNNLKRFIRQAEMNHYALFKCYMFLKNCGSGDILLKIVKVEHEEMPEAKNVIAVLEEFMKEALDQSF

SEQ ID NO: 864889 - protein, 215 aa, Homo sapiens
SGLAETQGRSEAAAMLPSLQESMDGDEKELESSEEGGSAEERRLEPPSSSHYCLYSYRGSRLAQQRGDSEDGSPSGTNAETPSGDDFSLSLADTNLPSEVEPELRSFIAKRLSRGAVFEGLGNVASVELKIPGYRVGCYYCLFQNEKLLPETVTIDSERNPSEYVVCFLGGARPPPPAPPSPPAPANIRKENMGRQVEEYYYQPPKSFSTPRVFS

SEQ ID NO: 864890 - protein, 410 aa, Homo sapiens
SGLAETQGRSEAAAMLPSLQESMDGDEKELESSEEGGSAEERRLEPPSSSHYCLYSYRGSRLAQQRGDSEDGSPSGTNAETPSGDDFSLSLADTNLPSEVEPELRSFIAKRLSRGAVFEGLGNVASVELKIPGYRVGCYYCLFQNEKLLPETVTIDSERNPSEYVVCFLGGSEKGLELFRLELDKYIQGLKNNMNCEARGLESHIKSYLSSWFEDVVCPIQRVVLLFQEKLTFLLHAALSYTPVEVKESDEKTKRDINRFLSVASLQGLIHEGTMTSLCMAMTEEQHKSVVIDCSSSQPQFCNAGSNRFCEDWMQAFLNGAKGGNPFLFRQVLENFKLKAIQDTNNLKRFIRQAEMNHYALFKCYMFLKNCGSGDILLKIVKVEHEEMPEAKNVIAVLEEFMKEALDQSF

SEQ ID NO: 864891 - protein, 388 aa, Homo sapiens
MDGDEKELESSEEGGSAEERRLEPPSSSHYCLYSYRGSRLAQQRGDSEDGSPSGTNAETPSGDDFSLSLADTNLPSEVEPELRSFIAKRLSRGAVFEGLGNVASVELKIPGYRVGCYYCLFQNEKLLPETVTIDSERNPSEYVVCFLGGSEKGLELFRLELDKYIQGLKNNMNCEARGLESHIKSYLSSWFEDVVCPIQRVVLLFQEKLTFLLHAALSYTPVEVKESDEKTKRDINRFLSVASLQGLIHEGTMTSLCMAMTEEQHKSVVIDCSSSQPQFCNAGSNRFCEDWMQAFLNGAKGGNPFLFRQVLENFKLKAIQDTNNLKRFIRQAEMNHYALFKCYMFLKNCGSGDILLKIVKVEHEEMPEAKNVIAVLEEFMKEALDQSF

SEQ ID NO: 864892 - protein, 410 aa, Homo sapiens; identical to SEQ ID NO: 864890

SEQ ID NO: 864893 - protein, 363 aa, Homo sapiens
PAAPKSHLLLSQPRLAQQRGDSEDGSPSGTNAETPSGDDFSLSLADTNLPSEVEPELRSFIAKRLSRGAVFEGLGNVASVELKIPGYRVGCYYCLFQNEKLLPETVTIDSERNPSEYVVCFLGGSEKGLELFRLELDKYIQGLKNNMNCEARGLESHIKSYLSSWFEDVVCPIQRVVLLFQEKLTFLLHAALSYTPVEVKESDEKTKRDINRFLSVASLQGLIHEGTMTSLCMAMTEEQHKSVVIDCSSSQPQFCNAGSNRFCEDWMQAFLNGAKGGNPFLFRQVLENFKLKAIQDTNNLKRFIRQAEMNHYALFKCYMFLKNCGSGDILLKIVKVEHEEMPEAKNVIAVLEEFMKEALDQSF

SEQ ID NO: 864894 - protein, 309 aa, Homo sapiens
MVFPAKRFCLVPSMEGVRWAFSCGTWLPSRAEWLLAVRSIQPEEKERIGQFVFARDAKAAMAGRLMIRKLVAEKLNIPWNHIRLQRTAKGKPVLAKDSSNPYPNFNFNISHQGDYAVLAAEPELQVGIDIMKTSFPGRGSIPEFFHIMKRKFTNKEWETIRSFKDEWTQLDMFYRNWALKESFIKAIGVGLGFELQRLEFDLSPLNLDIGQVYKETRLFLDGEEEKEWAFEESKIDEHHFVAVALRKPDGSRHQDVPSQDDSKPTQRQFTILNFNDLMSSAVPMTPEDPSFWDCFCFTEEIPIRNGTKS

SEQ ID NO: 864895 - protein, 309 aa, Homo sapiens; identical to SEQ ID NO: 864894

SEQ ID NO: 864896 - protein, 146 aa, Homo sapiens
MVFPAKRFCLVPSMEGVRWAFSCGTWLPSRAEWLLAVRSIQPEEKERIGQFVFARDAKAAMAGRLMIRKLVAEKLNIPWNHIRLQRTAKGKPVLAKDSSNPYPNFNFNISHQGDYAVLAAEPELQVGIDIMKTSFPAWFNSRILSY

SEQ ID NO: 864897 - protein, 309 aa, Homo sapiens; identical to SEQ ID NO: 864894

SEQ ID NO: 864898 - protein, 309 aa, Homo sapiens; identical to SEQ ID NO: 864894

SEQ ID NO: 864899 - protein, 291 aa, Homo sapiens
MVFPAKRFCLVPSMEGVRWAFSCGTWLPSRAEWLLAVRSIQPEEKERIGQFVFARDAKAAMAGRLMIRKLVAEKLNIPWNHIRLQRTAKGISHQGDYAVLAAEPELQVGIDIMKTSFPGRGSIPEFFHIMKRKFTNKEWETIRSFKDEWTQLDMFYRNWALKESFIKAIGVGLGFELQRLEFDLSPLNLDIGQVYKETRLFLDGEEEKEWAFEESKIDEHHFVAVALRKPDGSRHQDVPSQDDSKPTQRQFTILNFNDLMSSAVPMTPEDPSFWDCFCFTEEIPIRNGTKS

SEQ ID NO: 864900 - protein, 138 aa, Homo sapiens
MVFPAKRFCLVPSMEGVRWAFSCGTWLPSRAEWLLAVRSIQPEEKERIGQFVFARDAKAAMAGRLMIRKLVAEKLNIPWNHIRLQRTAKGKPVLAKDSSNPYPNFNFNISHQGDYAVLAAEPELQVGIDIMKTSFPGT

SEQ ID NO: 864901 - protein, 122 aa, Homo sapiens
TAAVAQVFERGNMNSEPEEEDGGLEDEDGDDEVAEVAEKETQAASKYFHVQKVARQDPRVAPMSNLLPAPGLPPHGQQAKEDHTKDASKASSSVSTAGQLNWNLDEQLKQNGGLAWSDDADG

SEQ ID NO: 864902 - protein, 164 aa, Homo sapiens
MSSRGGKKKSTKTSRSAKAGVIFPVGRMLRYIKKGHPKYRIGVGAPVYMAAVLEYLTAEILELAGNAARDNKKGRVTPRHILLAVANDEELNQLLKGVTIASGGVLPNIHPELLAKKRGSKGKLEAIITPPPAKKAKSPSQKKPVSKKAGGKKGARKSEEEEAG

SEQ ID NO: 864903 - protein, 164 aa, Homo sapiens; identical to SEQ ID NO: 864902

SEQ ID NO: 864904 - protein, 164 aa, Homo sapiens; identical to SEQ ID NO: 864902

SEQ ID NO: 864905 - protein, 231 aa, Homo sapiens
ETKDLTARYEAVSAPGGGGERGPRGREAKRRAGQRGARREKARAARRAQAETPCSCRRRHRAAAATAMSSRGGKKKSTKTSRSAKAGVIFPVGRMLRYIKKGHPKYRIGVGAPVYMAAVLEYLTAEILELAGNAARDNKKGRVTPRHILLAVANDEELNQLLKGVTIASGGVLPNIHPELLAKKRGSKGKLEAIITPPPAKKAKSPSQKKPVSKKAGGKKGARKSEEEEAG

SEQ ID NO: 864906 - protein, 170 aa, Homo sapiens
KPRTLRLGTRLCRRRAEGESAGRAGGKRRGGRASEERGEKRRERPGGLRPRHLAAAAAATEPPPEILELAGNAARDNKKGRVTPRHILLAVANDEELNQLLKGVTIASGGVLPNIHPELLAKKRGSKGKLEAIITPPPAKKAKSPSQKKPVSKKAGGKKGARKSEEEEAG

SEQ ID NO: 864907 - protein, 164 aa, Homo sapiens; identical to SEQ ID NO: 864902

SEQ ID NO: 864908 - protein, 164 aa, Homo sapiens; identical to SEQ ID NO: 864902

SEQ ID NO: 864909 - protein, 164 aa, Homo sapiens; identical to SEQ ID NO: 864902

SEQ ID NO: 864910 - protein, 223 aa, Homo sapiens
HSGPFRLCKKKKQGEVSKAASADSTTEGTPADGFTVLSTKSLFLGQKLNLIHSEISNLAGFEVEAIINPTNADIDLKDDLGNTLEKKGGKEFVEAVLELRKKNGPLEVAGAAVSAGHGLPAKFVIHCNSPVWGADKCEELLEKTVKNCLALADDKKLKSIAFPSIGSGRNGFPKQTAAQLILKAISSYFVSTMSSSIKTVYFVLFDSESIGIYVQEMAKLDAN

SEQ ID NO: 864911 - protein, 209 aa, Homo sapiens
RIYNFEKKLKLSNGTVFDGFTVLSTKSLFLGQKLNLIHSEISNLAGFEVEAIINPTNADIDLKDDLGNTLEKKGGKEFVEAVLELRKKNGPLEVAGAAVSAGHGLPAKFVIHCNSPVWGADKCEELLEKTVKNCLALADDKKLKSIAFPSIGSGRNGFPKQTAAQLILKAISSYFVSTMSSSIKTVYFVLFDSESIGIYVQEMAKLDAN

SEQ ID NO: 864912 - protein, 200 aa, Homo sapiens
MSSRGGKKKSTKTSRSAKAGVIFPVGRMLRYIKKGHPKYRIGVGAPVYMAAVLEYLTGNTLEKKGGKEFVEAVLELRKKNGPLEVAGAAVSAGHGLPAKFVIHCNSPVWGADKCEELLEKTVKNCLALADDKKLKSIAFPSIGSGRNGFPKQTAAQLILKAISSYFVSTMSSSIKTVYFVLFDSESIGIYVQEMAKLDAN

SEQ ID NO: 864913 - protein, 168 aa, Homo sapiens
LHISFLEKVKDWKDLFTKEKLTSALRRHQILIPCGRVEMCGRRKKKRAPLESKLEAAVSAGHGLPAKFVIHCNSPVWGADKCEELLEKTVKNCLALADDKKLKSIAFPSIGSGRNGFPKQTAAQLILKAISSYFVSTMSSSIKTVYFVLFDSESIGIYVQEMAKLDAN

SEQ ID NO: 864914 - protein, 164 aa, Homo sapiens; identical to SEQ ID NO: 864902

SEQ ID NO: 864915 - protein, 164 aa, Homo sapiens; identical to SEQ ID NO: 864902

SEQ ID NO: 864916 - protein, 164 aa, Homo sapiens; identical to SEQ ID NO: 864902

SEQ ID NO: 864917 - protein, 161 aa, Homo sapiens
AGREDWFQFTRQRRRAEGESAGRAGGKRRGGRASEERGEKRRERPGGLRPRHLAAAAAATEPPLCSLIRLQGHRHVEPRWEEEVHQDVQVCQSRSHLSRGADAAVHQERPPQVQDWSGGTRVHGRRPGIPDSGDSGAGWQCSERQQEGTGHTPAHPAGCGQ

SEQ ID NO: 864918 - protein, 164 aa, Homo sapiens; identical to SEQ ID NO: 864902

SEQ ID NO: 864919 - protein, 164 aa, Homo sapiens; identical to SEQ ID NO: 864902

SEQ ID NO: 864920 - protein, 164 aa, Homo sapiens; identical to SEQ ID NO: 864902

SEQ ID NO: 864921 - protein, 161 aa, Homo sapiens
MSSRGGKKKSTKTSRSAKAGVIFPVGRMLRYIKKGHPKYRIGVGAPVYMAAVLEYLTAEILELAGNAARDNKKGRVTPRHILLAVANDEELNQLLKGVTIASGGVLPNIHPELLAKKRGSKGKLEAIITPPPAKKAKSPSQKKPVSKKAGGKKGARKSEGM

SEQ ID NO: 864922 - protein, 164 aa, Homo sapiens; identical to SEQ ID NO: 864902

SEQ ID NO: 864923 - protein, 164 aa, Homo sapiens; identical to SEQ ID NO: 864902

SEQ ID NO: 864924 - protein, 229 aa, Homo sapiens
MSSRGGKKKSTKTSRSAKAGVIFPVGRMLRYIKKGHPKYRIGVGAPVYMAAVLEYLTAEILELAGNAARDNKKGRVTPRHILLAVANDEELNQLLKGVTIASGGVLPNIHPELLAKKRGSKGKLEAIITPPPAKKAKSPSQKKPVSKAEQKGRNQRSEQRSRRRTGPARWNSARVRRRNRDSMKRATHAGNKNGSIVFLMLSAPQRLPSPFSTPKRKQQTRTNNTAPKN

SEQ ID NO: 864925 - protein, 164 aa, Homo sapiens; identical to SEQ ID NO: 864902

SEQ ID NO: 864926 - protein, 164 aa, Homo sapiens; identical to SEQ ID NO: 864902

SEQ ID NO: 864927 - protein, 164 aa, Homo sapiens; identical to SEQ ID NO: 864902

SEQ ID NO: 864928 - protein, 164 aa, Homo sapiens; identical to SEQ ID NO: 864902

SEQ ID NO: 864929 - protein, 164 aa, Homo sapiens; identical to SEQ ID NO: 864902

SEQ ID NO: 864930 - protein, 164 aa, Homo sapiens; identical to SEQ ID NO: 864902

SEQ ID NO: 864931 - protein, 164 aa, Homo sapiens; identical to SEQ ID NO: 864902

SEQ ID NO: 864932 - protein, 153 aa, Homo sapiens
HRALEGPGRYTVAGEWVCVWHLVLCSEPELTVSVSSPHHYAAVSAGHGLPAKFVIHCNSPVWGADKCEELLEKTVKNCLALADDKKLKSIAFPSIGSGRNGFPKQTAAQLILKAISSYFVSTMSSSIKTVYFVLFDSESIGIYVQEMAKLDAN

SEQ ID NO: 864933 - protein, 164 aa, Homo sapiens; identical to SEQ ID NO: 864902

SEQ ID NO: 864934 - protein, 164 aa, Homo sapiens; identical to SEQ ID NO: 864902

SEQ ID NO: 864935 - protein, 164 aa, Homo sapiens; identical to SEQ ID NO: 864902

SEQ ID NO: 864936 - protein, 120 aa, Homo sapiens
LLPSLKAHSTSFCRCQLSAQLSVPHPIFWALGFPTLAYKQTRGSTDTDPTQGKLQHRGRWPVRWGRSCSPRGIPVAECLSSLLQERFSKADSSSADSEGHLQLLRVYNVLFHQNGVLRAF

SEQ ID NO: 864937 - protein, 317 aa, Homo sapiens
MSHGPKQPGAAAAPAGGKAPGQHGGFVVTVKQERGEGPRAGEKGSHEEEPVKKRGWPKGKKRKKILPNGPKAPVTGYVRFLNERREQIRTRHPDLPFPEITKMLGAEWSKLQPTEKQRYLDEAEREKQQYMKELRAYQQSEAYKMCTEKIQEKKIKKEDSSSGLMNTLLNGHKGGDCDGFSTFDVPIFTEEFLDQNKAREAELRRLRKMNVAFEEQNAVLQRHTQSMSSARERLEQELALEERRTLALQQQLQAVRQALTASFASLPVPGTGETPTLGTLDFYMARLHGAIERDPAQHEKLIVRIKEILAQVASEHL

SEQ ID NO: 864938 - protein, 317 aa, Homo sapiens; identical to SEQ ID NO: 864937

SEQ ID NO: 864939 - protein, 317 aa, Homo sapiens; identical to SEQ ID NO: 864937

SEQ ID NO: 864940 - protein, 317 aa, Homo sapiens; identical to SEQ ID NO: 864937

SEQ ID NO: 864941 - protein, 317 aa, Homo sapiens; identical to SEQ ID NO: 864937

SEQ ID NO: 864942 - protein, 317 aa, Homo sapiens; identical to SEQ ID NO: 864937

SEQ ID NO: 864943 - protein, 317 aa, Homo sapiens; identical to SEQ ID NO: 864937

SEQ ID NO: 864944 - protein, 317 aa, Homo sapiens; identical to SEQ ID NO: 864937

SEQ ID NO: 864945 - protein, 317 aa, Homo sapiens; identical to SEQ ID NO: 864937

SEQ ID NO: 864946 - protein, 317 aa, Homo sapiens; identical to SEQ ID NO: 864937

SEQ ID NO: 864947 - protein, 317 aa, Homo sapiens; identical to SEQ ID NO: 864937

SEQ ID NO: 864948 - protein, 574 aa, Homo sapiens
RYLHGLARGEGLTQWDRSPRPSLACRGRGGAGRPTGAGCGRLVGASRSREVRESFFGGPARSGHVPRPQAARRGRRAGGRQGSGPAWGLRGDCQARARRGSTRGREGVPRGGGESPCAELGEAPGSRPSLEAPPQAGFELLVAPPTAHFPLEAETPPRASCHAPDRSSATLSPGPAHRTMPALPTLRSRPLPLLGGGTLPLVLWARSPAENHAHQAEATPTTEVNANPVLKPRPIVPQIPSPLARIPLTHRVPTADRALPPSFPGSSSQLGPAPITRPYALGPAHAPLSPAPVRQAPLPTTQPGSAPVKKRGWPKGKKRKKILPNGPKAPVTGYVRFLNERREQIRTRHPDLPFPEITKMLGAEWSKLQPTEKQRYLDEAEREKQQYMKELRAYQQSEAYKMCTEKIQEKKIKKEDSSSGLMNTLLNGHKGGDCDGFSTFDVPIFTEEFLDQNKAREAELRRLRKMNVAFEEQNAVLQRHTQSMSSARERLEQELALEERRTLALQQQLQAVRQALTASFASLPVPGTGETPTLGTLDFYMARLHGAIERDPAQHEKLIVRIKEILAQVASEHL

SEQ ID NO: 864949 - protein, 640 aa, Homo sapiens
RYLHGLARGEGLTQWDRSPRPSLACRGRGGAGRPTGAGCGRLVGASRSREVRESFFGGENSRGTPGPERGRGCRGPRAGPGSFLARGKPAQASRGGQSPNKGFLGRPPSRTSLPLDPAPPALRARHPGALHRGVPQFAVCHRAARALLTSARVRVPGRPARSGHVPRPQAARRGRRAGGRQGSGPAWGLRGDCQARARRGSTRGREGVPRGGAHFPLEAETPPRASCHAPDRSSATLSPGPAHRTMPALPTLRSRPLPLLGGGTLPLVLWARSPAENHAHQAEATPTTEVNANPVLKPRPIVPQIPSPLARIPLTHRVPTADRALPPSFPGSSSQLGPAPITRPYALGPAHAPLSPAPVRQAPLPTTQPGSAPVKKRGWPKGKKRKKILPNGPKAPVTGYVRFLNERREQIRTRHPDLPFPEITKMLGAEWSKLQPTEKQRYLDEAEREKQQYMKELRAYQQSEAYKMCTEKIQEKKIKKEDSSSGLMNTLLNGHKGGDCDGFSTFDVPIFTEEFLDQNKAREAELRRLRKMNVAFEEQNAVLQRHTQSMSSARERLEQELALEERRTLALQQQLQAVRQALTASFASLPVPGTGETPTLGTLDFYMARLHGAIERDPAQHEKLIVRIKEILAQVASEHL

SEQ ID NO: 864950 - protein, 317 aa, Homo sapiens; identical to SEQ ID NO: 864937

SEQ ID NO: 864951 - protein, 402 aa, Homo sapiens
MPGAGRGGAADGGRAAGGWLERRAVGRSGKVSLEVKTAAELRALRGGGGAGVPGPGRGLSWPGGNRPRPPGGGNRPTKDSWGARPRGLPCPWIRPPQRSGPGIPGLSIAGYPSSRSAIGQPGRYSPPPASVFQVPVKKRGWPKGKKRKKILPNGPKAPVTGYVRFLNERREQIRTRHPDLPFPEITKMLGAEWSKLQPTEKQRYLDEAEREKQQYMKELRAYQQSEAYKMCTEKIQEKKIKKEDSSSGLMNTLLNGHKGGDCDGFSTFDVPIFTEEFLDQNKAREAELRRLRKMNVAFEEQNAVLQRHTQSMSSARERLEQELALEERRTLALQQQLQAVRQALTASFASLPVPGTGETPTLGTLDFYMARLHGAIERDPAQHEKLIVRIKEILAQVASEHL

SEQ ID NO: 864952 - protein, 109 aa, Homo sapiens
MNVAFEEQNAVLQRHTQSMSSARERLEQELALEERRTLALQQQLQAVRQALTASFASLPVPGTGETPTLGTLDFYMARLHGAIERDPAQHEKLIVRIKEILAQVASEHL

SEQ ID NO: 864953 - protein, 171 aa, Homo sapiens
MQRRSCGRGPATPHPVDERLGVHPLGPGPILHLGGSSPPKIKFLQHPFSFQSPQPPEPGKSTRCAIHPEEPHSRGCPSSEDSHALHWLSGPPPGHRADETHPQHTAGPPKLLTTGGCAIGHTGSCLVGTYLGCPPHACTPDGWGPALPILLSSSRGTLVGVAPSHCWIRTF

SEQ ID NO: 864954 - protein, 341 aa, Homo sapiens
RYLHGLARGEGLTQWDRSPRPSLACRGRGGAGRPTGAGCGRLVGASRSREVRESFFGGENSRGTPGPERGRGCRGPRAGPGSFLARGKPAQASRGGQSPNKGFLGRPPSRTSLPLDPAPPALRARHPGALHRGVPQFAVCHRAARALLTSARVRVPGRPARSGHVPRPQAARRGRRAGGRQGSGPAWGLRGDCQARARRGSTRAGHSGLLHGPASRSHRARPRPAREAHRPHQGNPGPGRQRAPVRSGRAHDAEEKLWARPCHTPPRGREAGGPPFGAWSHPAPWGCAIGHTGSCLVGTYLGCPPHACTPDGWGPALPILLSSSRGTLVGVAPSHCWIRTF

SEQ ID NO: 864955 - protein, 317 aa, Homo sapiens; identical to SEQ ID NO: 864937

SEQ ID NO: 864956 - protein, 317 aa, Homo sapiens; identical to SEQ ID NO: 864937

SEQ ID NO: 864957 - protein, 330 aa, Homo sapiens
MSHGPKQPGAAAAPAGGKAPGQHGGFVVTVKQERGEGPRAGEKGSHEEEPVKKRGWPKGKKRKKILPNGPKAPVTGYVRFLNERREQIRTRHPDLPFPEITKMLGAEWSKLQPTEKQASPASSLLVLPPQRYLDEAEREKQQYMKELRAYQQSEAYKMCTEKIQEKKIKKEDSSSGLMNTLLNGHKGGDCDGFSTFDVPIFTEEFLDQNKAREAELRRLRKMNVAFEEQNAVLQRHTQSMSSARERLEQELALEERRTLALQQQLQAVRQALTASFASLPVPGTGETPTLGTLDFYMARLHGAIERDPAQHEKLIVRIKEILAQVASEHL

SEQ ID NO: 864958 - protein, 109 aa, Homo sapiens; identical to SEQ ID NO: 864952

SEQ ID NO: 864959 - protein, 360 aa, Homo sapiens
MSHGPKQPGAAAAPAGGKAPGQHGGFVVTVKQERGEGPRAGEKGSHEEEPVKKRGWPKGKKRKKILPNGPKAPVTGYVRFLNERREQIRTRHPDLPFPEITKMLGAEWSKLQPTEKQRYLDEAEREKQQYMKELRAYQQSEAYKMCTEKIQEKKIKKEDSSSGLMNTLLNGHKVSDLFLSKHLGEKGLEASRTLSQSQCSPRCVQAGAVPLHRGIAVDCTPTGVSQETLLGLGHTQRAWLPPTTSKLPPCPFVFRVGTAMASPPSMFPSSLKSSWTKTKVSGNCAPDANSVKLGGRGGRGPGGPQDCRRRIGRFPMSVQAHAVAPEADVEQEAEGAVRETWAGARPGQKPGGRGKGRRRL

SEQ ID NO: 864960 - protein, 225 aa, Homo sapiens
MSCESSMVLGYWDIRGLAHAIRLLLEFTDTSYEEKRYTCGEAPDYDRSQWLDVKFKLDLDFPNLPYLLDGKNKITQSNAILRYIARKHNMCGETEEEKIRVDIIENQVMDFRTQLIRLCYSSDHEKLKPQYLEELPGQLKQFSMFLGKFSWFAGEKLTFVDFLTYDILDQNRIFDPKCLDEFPNLKAFMCRFEALEKIAAYLQSDQFCKMPINNKMAQWGNKPVC

SEQ ID NO: 864961 - protein, 225 aa, Homo sapiens; identical to SEQ ID NO: 864960

SEQ ID NO: 864962 - protein, 225 aa, Homo sapiens; identical to SEQ ID NO: 864960

SEQ ID NO: 864963 - protein, 222 aa, Homo sapiens
MSGIKPLPLTVSLVLEGSEARHHVVRVVYGSRVLGYSWAPDYDRSQWLDVKFKLDLDFPNLPYLLDGKNKITQSNAILRYIARKHNMCGETEEEKIRVDIIENQVMDFRTQLIRLCYSSDHEKLKPQYLEELPGQLKQFSMFLGKFSWFAGEKLTFVDFLTYDILDQNRIFDPKCLDEFPNLKAFMCRFEALEKIAAYLQSDQFCKMPINNKMAQWGNKPVC

SEQ ID NO: 864964 - protein, 225 aa, Homo sapiens; identical to SEQ ID NO: 864960

SEQ ID NO: 864965 - protein, 132 aa, Homo sapiens
MSCESSMVLGYWDIRGLAHAIRLLLEFTDTSYEEKRYTCGEAPDYDRSQWLDVKFKLDLDFPNLPYLLDGKNKITQSNAILRYIARKHNMCGETEEEKIRVDIIENQVMDFRTQLIRLCYSSDHVSFLSTHL

SEQ ID NO: 864966 - protein, 225 aa, Homo sapiens; identical to SEQ ID NO: 864960

SEQ ID NO: 864967 - protein, 335 aa, Homo sapiens
MSCESSMVLGYWDIRGVSAVSTESRSVKETDAERAGLWVRDLQQEQLYAGAFSSCRATDVDPCPASGIAGPVGRGGGDHAGAGPRGRLTTAPAGRRDSAAPGRGTLAGGGWEWVGAAQSLNRCLPQLAHAIRLLLEFTDTSYEEKRYTCGEAPDYDRSQWLDVKFKLDLDFPNLPYLLDGKNKITQSNAILRYIARKHNMCGETEEEKIRVDIIENQVMDFRTQLIRLCYSSDHEKLKPQYLEELPGQLKQFSMFLGKFSWFAGEKLTFVDFLTYDILDQNRIFDPKCLDEFPNLKAFMCRFEALEKIAAYLQSDQFCKMPINNKMAQWGNKPVC

SEQ ID NO: 864968 - protein, 213 aa, Homo sapiens [sequence omitted]

SEQ ID NO: 864969 - protein, 222 aa, Homo sapiens; identical to SEQ ID NO: 864963

SEQ ID NO: 864970 - protein, 136 aa, Homo sapiens
LPVNAFPGEGRPPTSPGSTVSSRAGAQAVGPACALQRLLWGSDGMGVSTSSGGSTPFPFLHVCHQQRPSHVASLGVFVFFGVFLPRVLYHPCGRGFWVENEVFAGFLQCGACPGLGRCLHVALCAAVCPALPPPGW

SEQ ID NO: 864971 - protein, 348 aa, Homo sapiens
MTTALEPEDQKGLLIIKAEDHYWGQDSSSQKCSPHRRELYRQHFRKLCYQDAPGPREALTQLWELCRQWLRPECHTKEQILDLLVLEQFLSILPKDLQAWVRAHHPETGEEAVTVLEDLERELDEPGKQVPGNSERRDILMDKLAPLGRPYESLTVQLHPKKTQLEQEAGKPQRNGDKTRTKNEELFQKEDMPKDKEFLGEINDRLNKDTPQHPKSKDIIENEGRSEWQQRERRRYKCDECGKSFSHSSDLSKHRRTHTGEKPYKCDECGKAFIQRSHLIGHHRVHTGVKPYKCKECGKDFSGRTGLIQHQRIHTGEKPYECDECGRPFRVSSALIRHQRIHTANKLY

SEQ ID NO: 864972 - protein, 105 aa, Homo sapiens
MLPRQLPPQRPSHGFRGSRTLAFFFPPPFGELAVLGLSPKSREMLQASVRLPTRRVVPEAGPEPQASRDSFGRCWGLSGRGRSRFRSRGRESRGFTVLARMVSIS

SEQ ID NO: 864973 - protein, 126 aa, Homo sapiens
RQWTCSPGNGAADGARALPRLTPVADAPAALPPQRPSHGFRGSRTLAFFFPPRFGELAVLGLSPKSREMLQASVRLPTRRVVPEAGPEPQASRDSFGRCWGLSGRGRSRFRSRGRGAFPSLVCSGL

SEQ ID NO: 864974 - protein, 126 aa, Homo sapiens; identical to SEQ ID NO: 864973

SEQ ID NO: 864975 - protein, 102 aa, Homo sapiens
MLPRQLPPQRPSHGFRGSRTLAFFFPPPFGELAVLGLSPKSREMLQASVRLPTRRVVPEAGPEPQASRDSFGRCWGLSGRGRSRFRSRGRGASGLLCLLYGQ

SEQ ID NO: 864976 - protein, 126 aa, Homo sapiens; identical to SEQ ID NO: 864973

SEQ ID NO: 864977 - protein, 126 aa, Homo sapiens; identical to SEQ ID NO: 864973

SEQ ID NO: 864978 - protein, 126 aa, Homo sapiens; identical to SEQ ID NO: 864973

SEQ ID NO: 864979 - protein, 126 aa, Homo sapiens; identical to SEQ ID NO: 864973

SEQ ID NO: 864980 - protein, 126 aa, Homo sapiens; identical to SEQ ID NO: 864973

SEQ ID NO: 864981 - protein, 102 aa, Homo sapiens; identical to SEQ ID NO: 864975

SEQ ID NO: 864982 - protein, 105 aa, Homo sapiens; identical to SEQ ID NO: 864972

SEQ ID NO: 864983 - protein, 105 aa, Homo sapiens; identical to SEQ ID NO: 864972

SEQ ID NO: 864984 - protein, 126 aa, Homo sapiens; identical to SEQ ID NO: 864973

SEQ ID NO: 864985 - protein, 126 aa, Homo sapiens; identical to SEQ ID NO: 864973

SEQ ID NO: 864986 - protein, 126 aa, Homo sapiens; identical to SEQ ID NO: 864973

SEQ ID NO: 864987 - protein, 126 aa, Homo sapiens; identical to SEQ ID NO: 864973

SEQ ID NO: 864988 - protein, 126 aa, Homo sapiens; identical to SEQ ID NO: 864973

SEQ ID NO: 864989 - protein, 101 aa, Homo sapiens
MTSEFFAAQLRSQISDHTTHPISYYKPEFYTPDDGGTAHLSVVAEDGSAVSATSTINLYFGSKVCSPVSGILFNNEWTTSALPASPMSLGHPPHLPISSSQ

SEQ ID NO: 864990 - protein, 350 aa, Homo sapiens
MEGDRNVPPVPPASSTPYKPPYGKLLLPPGTDGGKEGPRVLNGNPQQEDGGLAGITEQQSGAFDRWEMIQAQELHNKLKIKQNLQQLNSDISAITTWLKKTEAELEMLKMAKPPSDIQEIELRVKRLQEILKAFDTYKALVVSVNVSSKEFLQTESPESTELQSRLRQLSLLWEAAQGAVDSWRGGLRQSLMQCQGSKTRPRSDVLFFEGDFHQLSQNLLLWLASAKNRRQKAHVTDPKADPRALLECRRELMQLEKELVERQPQVDMLQEISNSLLIKGHGEDCIEAEEKVHVIEKKLKQLREQVSQDLMALQGTQNPASPLPSFDEVDSGDQPPATSVPAPRAKSSEQ

SEQ ID NO: 864991 - protein, 113 aa, Homo sapiens [sequence omitted]

SEQ ID NO: 864992 - protein, 1093 aa, Homo sapiens
HMPLTLDHPTFLVLPGGQERFSLYQTRSLIHELKNKEIHFQRRRTTCALTLEAGEKLLLTTDLKTKESVGRRISQLQDSWKDMEPQLAEMIKQFQSTVETWDQCEKKIKELKSRLQVLKAQSEDPLPELHEDLHNEKELIKELEQSLASWTQNLKELQTMKADLTRHVLVEDVMVLKEQIEHLHRQWEDLCLRVAIRKQEIEDRLNTWVVFNEKNKELCAWLVQMENKVLQTADISIEEMIEKLQKDCMEEINLFSENKLQLKQMGDQLIKASNKSRAAEIDDKLNKINDRWQHLFDVIGSRVKKLKETFAFIQQLDKNMSNLRTWLARIESELSKPVVYDVCDDQEIQKRLAEQQDLQRDIEQHSAGVESVFNICDVLLHDSDACANETECDSIQQTTRSLDRRWRNICAMSMERRMKIEETWRLWQKFLDDYSRFEDWLKSAERTAACPNSSEVLYTSAKEELKRFEAFQRQIHERLTQLELINKQYRRLARENRTDTASRLKQMVHEGNQRWDNLQRRVTAVLRRLRHFTNQREEFEGTRESILVWLTEMDLQLTNVEHFSESDADDKMRQLNGFQQEITLNTNKIDQLIVFGEQLIQKSEPLDAVLIEDELEELHRYCQEVFGRVSRFHRRLTSCTPGLEDEKEASENETDMEDPREIQTDSWRKRGESEEPSSPQSLCHLVAPGHERSGCETPVSVDSIPLEWDHTGDVGGSSSHEEDEEGPYYSALSGKSISDGHSWHVPDSPSCPEHHYKQMEGDRNVPPVPPASSTPYKPPYGKLLLPPGTDGGKEGPRVLNGNPQQEDGGLAGITEQQSGAFDRWEMIQAQELHNKLKIKQNLQQLNSDISAITTWLKKTEAELEMLKMAKPPSDIQEIELRVKRLQEILKAFDTYKALVVSVNVSSKEFLQTESPESTELQSRLRQLSLLWEAAQGAVDSWRGGLRQSLMQCQDFHQLSQNLLLWLASAKNRRQKAHVTDPKADPRALLECRRELMQLEKELVERQPQVDMLQEISNSLLIKGHGEDCIEAEEKVHVIEKKLKQLREQVSQDLMALQGTQNPASPLPSFDEVDSGDQPPATSVPAPRAKSSEQ

SEQ ID NO: 864993 - protein, 1116 aa, Homo sapiens
HMPLTLDHPTFLVLPGGQERFSLYQTRSLIHELKNKEIHFQRRRTTCALTLEAGEKLLLTTDLKTKESVGRRISQLQDSWKDMEPQLAEMIKQFQSTVETWDQCEKKIKELKSRLQVLKAQSEDPLPELHEDLHNEKELIKELEQSLASWTQNLKELQTMKADLTRHVLVEDVMVLKEQIEHLHRQWEDLCLRVAIRKQEIEDRLNTWVVFNEKNKELCAWLVQMENKVLQTADISIEEMIEKLQKDCMEEINLFSENKLQLKQMGDQLIKASNKSRAAEIDDKLNKINDRWQHLFDVIGSRVKKLKETFAFIQQLDKNMSNLRTWLARIESELSKPVVYDVCDDQEIQKRLAEQQDLQRDIEQHSAGVESVFNICDVLLHDSDACANETECDSIQQTTRSLDRRWRNICAMSMERRMKIEETWRLWQKFLDDYSRFEDWLKSAERTAACPNSSEVLYTSAKEELKRFEAFQRQIHERLTQLELINKQYRRLARENRTDTASRLKQMVHEGNQRWDNLQRRVTAVLRRLRHFTNQREEFEGTRESILVWLTEMDLQLTNVEHFSESDADDKMRQLNGFQQEITLNTNKIDQLIVFGEQLIQKSEPLDAVLIEDELEELHRYCQEVFGRVSRFHRRLTSCTPGLEDEKEASENETDMEDPREIQTDSWRKRGESEEPSSPQSLCHLVAPGHERSGCETPVSVDSIPLEWDHTGDVGGSSSHEEDEEGPYYSALSDVEIPENPEAYLKMTTKTLKASSGKSISDGHSWHVPDSPSCPEHHYKQMEGDRNVPPVPPASSTPYKPPYGKLLLPPGTDGGKEGPRVLNGNPQQEDGGLAGITEQQSGAFDRWEMIQAQELHNKLKIKQNLQQLNSDISAITTWLKKTEAELEMLKMAKPPSDIQEIELRVKRLQEILKAFDTYKALVVSVNVSSKEFLQTESPESTELQSRLRQLSLLWEAAQGAVDSWRGGLRQSLMQCQDFHQLSQNLLLWLASAKNRRQKAHVTDPKADPRALLECRRELMQLEKELVERQPQVDMLQEISNSLLIKGHGEDCIEAEEKVHVIEKKLKQLREQVSQDLMALQGTQNPASPLPSFDEVDSGDQPPATSVPAPRAKSSEQ

SEQ ID NO: 864994 - protein, 1046 aa, Homo sapiens
GTAYHLCQLGLHVFPAVLKLTKQFQSTVETWDQCEKKIKELKSRLQVLKAQSEDPLPELHEDLHNEKELIKELEQSLASWTQNLKELQTMKADLTRHVLVEDVMVLKEQIEHLHRQWEDLCLRVAIRKQEIEDRLNTWVVFNEKNKELCAWLVQMENKVLQTADISIEEMIEKLQKDCMEEINLFSENKLQLKQMGDQLIKASNKSRAAEIDDKLNKINDRWQHLFDVIGSRVKKLKETFAFIQQLDKNMSNLRTWLARIESELSKPVVYDVCDDQEIQKRLAEQQDLQRDIEQHSAGVESVFNICDVLLHDSDACANETECDSIQQTTRSLDRRWRNICAMSMERRMKIEETWRLWQKFLDDYSRFEDWLKSAERTAACPNSSEVLYTSAKEELKRFEAFQRQIHERLTQLELINKQYRRLARENRTDTASRLKQMVHEGNQRWDNLQRRVTAVLRRLRHFTNQREEFEGTRESILVWLTEMDLQLTNVEHFSESDADDKMRQLNGFQQEITLNTNKIDQLIVFGEQLIQKSEPLDAVLIEDELEELHRYCQEVFGRVSRFHRRLTSCTPGLEDEKEASENETDMEDPREIQTDSWRKRGESEEPSSPQSLCHLVAPGHERSGCETPVSVDSIPLEWDHTGDVGGSSSHEEDEEGPYYSALSDVEIPENPEAYLKMTTKTLKASSGKSISDGHSWHVPDSPSCPEHHYKQMEGDRNVPPVPPASSTPYKPPYGKLLLPPGTDGGKEGPRVLNGNPQQEDGGLAGITEQQSGAFDRWEMIQAQELHNKLKIKQNLQQLNSDISAITTWLKKTEAELEMLKMAKPPSDIQEIELRVKRLQEILKAFDTYKALVVSVNVSSKEFLQTESPESTELQSRLRQLSLLWEAAQGAVDSWRGGLRQSLMQCQDFHQLSQNLLLWLASAKNRRQKAHVTDPKADPRALLECRRELMQLEKELVERQPQVDMLQEISNSLLIKGHGEDCIEAEEKVHVIEKKLKQLREQVSQDLMALQGTQNPASPLPSFDEVDSGDQPPATSVPAPRAKSSEQ

SEQ ID NO: 864995 - protein, 679 aa, Homo sapiens
MNPWQQVAWDVEGKEGVWHSACFGSDPSHVMQAFQRQIHERLTQLELINKQYRRLARENRTDTASRLKQMVHEGNQRWDNLQRRVTAVLRRLRHFTNQREEFEGTRESILVWLTEMDLQLTNVEHFSESDADDKMRQLNGFQQEITLNTNKIDQLIVFGEQLIQKSEPLDAVLIEDELEELHRYCQEVFGRVSRFHRRLTSCTPGLEDEKEASENETDMEDPREIQTDSWRKRGESEEPSSPQSLCHLVAPGHERSGCETPVSVDSIPLEWDHTGDVGGSSSHEEDEEGPYYSALSDVEIPENPEAYLKMTTKTLKASSGKSISDGHSWHVPDSPSCPEHHYKQMEGDRNVPPVPPASSTPYKPPYGKLLLPPGTDGGKEGPRVLNGNPQQEDGGLAGITEQQSGAFDRWEMIQAQELHNKLKIKQNLQQLNSDISAITTWLKKTEAELEMLKMAKPPSDIQEIELRVKRLQEILKAFDTYKALVVSVNVSSKEFLQTESPESTELQSRLRQLSLLWEAAQGAVDSWRGGLRQSLMQCQDFHQLSQNLLLWLASAKNRRQKAHVTDPKADPRALLECRRELMQLEKELVERQPQVDMLQEISNSLLIKGHGEDCIEAEEKVHVIEKKLKQLREQVSQDLMALQGTQNPASPLPSFDEVDSGDQPPATSVPAPRAKSSEQ

SEQ ID NO: 864996 - protein, 1116 aa, Homo sapiens; identical to SEQ ID NO: 864993

SEQ ID NO: 864997 - protein, 1116 aa, Homo sapiens; identical to SEQ ID NO: 864993

SEQ ID NO: 864998 - protein, 1126 aa, Homo sapiens
HMPLTLDHPTFLVLPGGQERFSLYQTRSLIHELKNKEIHFQRRRTTCALTLEAGEKLLLTTDLKTKESVGRRISQLQDSWKDMEPQLAEMIKQFQSTVETWDQCEKKIKELKSRLQVLKAQSEDPLPELHEDLHNEKELIKELEQSLASWTQNLKELQTMKADLTRHVLVEDVMVLKEQIEHLHRQWEDLCLRVAIRKQEIEDRLNTWVVFNEKNKELCAWLVQMENKVLQTADISIEEMIEKLQKDCMEEINLFSENKLQLKQMGDQLIKASNKSRAAEIDDKLNKINDRWQHLFDVIGSRVKKLKETFAFIQQLDKNMSNLRTWLARIESELSKPVVYDVCDDQEIQKRLAEQQDLQRDIEQHSAGVESVFNICDVLLHDSDACANETECDSIQQTTRSLDRRWRNICAMSMERRMKIEETWRLWQKFLDDYSRFEDWLKSAERTAACPNSSEVLYTSAKEELKRFEAFQRQIHERLTQLELINKQYRRLARENRTDTASRLKQMVHEGNQRWDNLQRRVTAVLRRLRHFTNQREEFEGTRESILVWLTEMDLQLTNVEHFSESDADDKMRQLNGFQQEITLNTNKIDQLIVFGEQLIQKSEPLDAVLIEDELEELHRYCQEVFGRVSRFHRRLTSCTPGLEDEKEASENETDMEDPREIQTDSWRKRGESEEPSSPQSLCHLVAPGHERSGCETPVSVDSIPLEWDHTGDVGGSSSHEEDEEGPYYSALSDVEIPENPEAYLKMTTKTLKASSGKSISDGHSWHVPDSPSCPEHHYKQMEGDRNVPPVPPASSTPYKPPYGKLLLPPGTDGGKEGPRVLNGNPQQEDGGLAGITEQQSGAFDRWEMIQAQELHNKLKIKQNLQQLNSDISAITTWLKKTEAELEMLKMAKPPSDIQEIELRVKRLQEILKAFDTYKALVVSVNVSSKEFLQTESPESTELQSRLRQLSLLWEAAQGAVDSWRGGLRQSLMQCQDFHQLSQNLLLWLASAKNRRQKAHVTDPKADPRALLECRRELMQLEKELVERQPQVDMLQEISNSLLIKGHGEDCIEAEEKVHVIEKKLKQLREQVSQDLMALQGTQNPASPLPSFDEVDSGDQPPATSVPAPRAKFRAVRTVLYVSAGL

SEQ ID NO: 864999 - protein, 875 aa, Homo sapiens
HMPLTLDHPTFLVLPGGQERFSLYQTRSLIHELKNKEIHFQRRRTTCALTLEAGEKLLLTTDLKTKESVGRRISQLQDSWKDMEPQLAEMIKQFQSTVETWDQCEKKIKELKSRLQVLKAQSEDPLPELHEDLHNEKELIKELEQSLASWTQNLKELQTMKADLTRHVLVEDVMVLKEQIEHLHRQWEDLCLRVAIRKQEIEDRLNTWVVFNEKNKELCAWLVQMENKVLQTADISIEEMIEKLQKDCMEEINLFSENKLQLKQMGDQLIKASNKSRAAEIDDKLNKINDRWQHLFDVIGSRVKKLKETFAFIQQLDKNMSNLRTWLARIESELSKPVVYDVCDDQEIQKRLAEQQDLQRDIEQHSAGVESVFNICDVLLHDSDACANETECDSIQQTTRSLDRRWRNICAMSMERRMKIEETWRLWQKFLDDYSRFEDWLKSAERTAACPNSSEVLYTSAKEELKRFEAFQRQIHERLTQLELINKQYRRLARENRTDTASRLKQMVHEGNQRWDNLQRRVTAVLRRLRHFTNQREEFEGTRESILVWLTEMDLQLTNVEHFSESDADDKMRQLNGFQQEITLNTNKIDQLIVFGEQLIQKSEPLDAVLIEDELEELHRYCQEVFGRVSRFHRRLTSCTPGLEDEKEASENETDMEDPREIQTDSWRKRGESEEPSSPQSLCHLVAPGHERSGCETPVSVDSIPLEWDHTGDVGGSSSHEEDEEGPYYSALSDVEIPENPEAYLKMTTKTLKASSGKSISDGHSWHVPDSPSCPEHHYKQMEGDRNVPPVPPANLDHRFAGGVVRRGWFGLLPLFRNIQAEISFSQVVIKCAKYKPPLPRGTIYIWYSPLLRDRDLYILHVLTHACTRSQAHTI

SEQ ID NO: 865000 - protein, 207 aa, Homo sapiens
HMPLTLDHPTFLVLPGGQERFSLYQTRSLIHELKNKEIHFQRRRTTCALTLEAGEKLLLTTDLKTKESVGRRISQLQDSWKDMEPQLAEMIKQFQSTVETWDQCEKKIKELKSRLQVLKAQSEDPLPELHEDLHNEKELIKELEQSLASWTQNLKELQTMKADLTRHVLVEDVMVLKEQIEHLHRQWEDLCLRVSQLTAGHGCLGVD

SEQ ID NO: 865001 - protein, 127 aa, Homo sapiens
RVYLCLLWTPCALVLVSWCIYTAVLTHNCVLLTKPHPSQSRLDANPLSSLQACAEGIFHGACFDDFFLHLTEVLWHGPSFLHGGLVWNCFLALLGSPGGKGWGVGAVKGADDLPQEGKNLPFLDLQL

SEQ ID NO: 865002 - protein, 795 aa, Homo sapiens
MQSFCNFSIISSILMSAVCRTLFTICTSQAHNSLFFSLNTTHVLSLSSISCLRMATLKQRSSDACANETECDSIQQTTRSLDRRWRNICAMSMERRMKIEETWRLWQKFLDDYSRFEDWLKSAERTAACPNSSEVLYTSAKEELKRFEAFQRQIHERLTQLELINKQYRRLARENRTDTASRLKQMVHEGNQRWDNLQRRVTAVLRRLRHFTNQREEFEGTRESILVWLTEMDLQLTNVEHFSESDADDKMRQLNGFQQEITLNTNKIDQLIVFGEQLIQKSEPLDAVLIEDELEELHRYCQEVFGRVSRFHRRLTSCTPGLEDEKEASENETDMEDPREIQTDSWRKRGESEEPSSPQSLCHLVAPGHERSGCETPVSVDSIPLEWDHTGDVGGSSSHEEDEEGPYYSALSDVEIPENPEAYLKMTTKTLKASSGKSISDGHSWHVPDSPSCPEHHYKQMEGDRNVPPVPPASSTPYKPPYGKLLLPPGTDGGKEGPRVLNGNPQQEDGGLAGITEQQSGAFDRWEMIQAQELHNKLKIKQNLQQLNSDISAITTWLKKTEAELEMLKMAKPPSDIQEIELRVKRLQEILKAFDTYKALVVSVNVSSKEFLQTESPESTELQSRLRQLSLLWEAAQGAVDSWRGGLRQSLMQCQDFHQLSQNLLLWLASAKNRRQKAHVTDPKADPRALLECRRELMQLEKELVERQPQVDMLQEISNSLLIKGHGEDCIEAEEKVHVIEKKLKQLREQVSQDLMALQGTQNPASPLPSFDEVDSGDQPPATSVPAPRAKSSEQ

SEQ ID NO: 865003 - protein, 461 aa, Homo sapiens
MEDPREIQTDSWRKRGESEEPSSPQSLCHLVAPGHERSGCETPVSVDSIPLEWDHTGDVGGSSSHEEDEEGPYYSALSDVEIPENPEAYLKMTTKTLKASSGKSISDGHSWHVPDSPSCPEHHYKQMEGDRNVPPVPPASSTPYKPPYGKLLLPPGTDGGKEGPRVLNGNPQQEDGGLAGITEQQSGAFDRWEMIQAQELHNKLKIKQNLQQLNSDISAITTWLKKTEAELEMLKMAKPPSDIQEIELRVKRLQEILKAFDTYKALVVSVNVSSKEFLQTESPESTELQSRLRQLSLLWEAAQGAVDSWRGGLRQSLMQCQDFHQLSQNLLLWLASAKNRRQKAHVTDPKADPRALLECRRELMQLEKELVERQPQVDMLQEISNSLLIKGHGEDCIEAEEKVHVIEKKLKQLREQVSQDLMALQGTQNPASPLPSFDEVDSGDQPPATSVPAPRAKSSEQ

SEQ ID NO: 865004 - protein, 580 aa, Homo sapiens
HMPLTLDHPTFLVLPGGQERFSLYQTRSLIHELKNKEIHFQRRRTTCALTLEAGEKLLLTTDLKTKESVGRRISQLQDSWKDMEPQLAEMIKQFQSTVETWDQCEKKIKELKSRLQVLKAQSEDPLPELHEDLHNEKELIKELEQSLASWTQNLKELQTMKADLTRHVLVEDVMVLKEQIEHLHRQWEDLCLRVAIRKQEIEDRLNTWVVFNEKNKELCAWLVQMENKVLQTADISIEEMIEKLQKDCMEEINLFSENKLQLKQMGDQLIKASNKSRAAEIDDKLNKINDRWQHLFDVIGSRVKKLKETFAFIQQLDKNMSNLRTWLARIESELSKPVVYDVCDDQEIQKRLAEQQDLQRDIEQHSAGVESVFNICDVLLHDSDACANETECDSIQQTTRSLDRRWRNICAMSMERRMKIEETWRLWQKFLDDYSRFEDWLKSAERTAACPNSSEVLYTSAKEELKRFEAFQRQIHERLTQLELINKQYRRLARENRTDTASRLKQMVHEGNQRWDNLQRRVTAVLRRLRHFTNQREEFEGTRESILVWLTEMDYSCTQANNFARSFYPMLRYTNGPPPT

SEQ ID NO: 865005 - protein, 1116 aa, Homo sapiens; identical to SEQ ID NO: 864993

SEQ ID NO: 865006 - protein, 1116 aa, Homo sapiens; identical to SEQ ID NO: 864993

SEQ ID NO: 865007 - protein, 1133 aa, Homo sapiens
HMPLTLDHPTFLVLPGGQERFSLYQTRSLIHELKNKEIHFQRRRTTCALTLEAGEKLLLTTDLKTKESVGRRISQLQDSWKDMEPQLAEMIKQFQSTVETWDQCEKKIKELKSRLQVLKAQSEDPLPELHEDLHNEKELIKELEQSLASWTQNLKELQTMKADLTRHVLVEDVMVLKEQIEHLHRQWEDLCLRVAIRKQEIEDRLNTWVVFNEKNKELCAWLVQMENKVLQTADISIEEMIEKLQKDCMEEINLFSENKLQLKQMGDQLIKASNKSRAAEIDDKLNKINDRWQHLFDVIGSRVKKLKETFAFIQQLDKNMSNLRTWLARIESELSKPVVYDVCDDQEIQKRLAEQQDLQRDIEQHSAGVESVFNICDVLLHDSDACANETECDSIQQTTRSLDRRWRNICAMSMERRMKIEETWRLWQKFLDDYSRFEDWLKSAERTAACPNSSEVLYTSAKEELKRFEAFQRQIHERLTQLELINKQYRRLARENRTDTASRLKQMVHEGNQRWDNLQRRVTAVLRRLRHFTNQREEFEGTRESILVWLTEMDLQLTNVEHFSESDADDKMRQLNGFQQEITLNTNKIDQLIVFGEQLIQKSEPLDAVLIEDELEELHRYCQEVFGRVSRFHRRLTSCTPGLEDEKEASENETDMEDPREIQTDSWRKRGESEEPSSPQSLCHLVAPGHERSGCETPVSVDSIPLEWDHTGDVGGSSSHEEDEEGPYYSALSDVEIPENPEAYLKMTTKTLKASSGKSISDGHSWHVPDSPSCPEHHYKQMEGDRNVPPVPPASSTPYKPPYGKLLLPPGTDGGKEGPRVLNGNPQQEDGGLAGITEQQSGAFDRWEMIQAQELHNKLKIKQNLQQLNSDISAITTWLKKTEAELEMLKMAKPPSDIQEIELRVKRLQEILKAFDTYKALVVSVNVSSKEFLQTESPESTELQSRLRQLSLLWEAAQGAVDSWRGGLRQSLMQCQDFHQLSQNLLLWLASAKNRRQKAHVTDPKADPRALLECRRELMQLEKELVERQPQVDMLQEISNSLLIKGHGEDCIEEFRAVRTTEGEEETESRVPGSTRPQRSFLSRVVRAALPLQLLLLLLLLLACLLPSSEEDYSCTQANNFARSFYPMLRPPS

SEQ ID NO: 865008 - protein, 829 aa, Homo sapiens
HMPLTLDHPTFLVLPGGQERFSLYQTRSLIHELKNKEIHFQRRRTTCALTLEAGEKLLLTTDLKTKESVGRRISQLQDSWKDMEPQLAEMIKQFQSTVETWDQCEKKIKELKSRLQVLKAQSEDPLPELHEDLHNEKELIKELEQSLASWTQNLKELQTMKADLTRHVLVEDVMVLKEQIEHLHRQWEDLCLRVAIRKQEIEDRLNTWVVFNEKNKELCAWLVQMENKVLQTADISIEEMIEKLQKDCMEEINLFSENKLQLKQMGDQLIKASNKSRAAEIDDKLNKINDRWQHLFDVIGSRVKKLKETFAFIQQLDKNMSNLRTWLARIESELSKPVVYDVCDDQEIQKRLAEQQDLQRDIEQHSAGVESVFNICDVLLHDSDACANETECDSIQQTTRSLDRRWRNICAMSMERRMKIEETWRLWQKFLDDYSRFEDWLKSAERTAACPNSSEVLYTSAKEELKRFEAFQRQIHERLTQLELINKQYRRLARENRTDTASRLKQMVHEGNQRWDNLQRRVTAVLRRLRHFTNQREEFEGTRESILVWLTEMDLQLTNVEHFSESDADDKMRQLNGFQQEITLNTNKIDQLIVFGEQLIQKSEPLDAVLIEDELEELHRYCQEVFGRVSRFHRRLTSCTPGLEDEKEASENETDMEDPREIQTDSWRKRGESEEPSSPQSLCHLVAPGHERSGCETPVSVDSIPLEWDHTGDVGGSSSHEEDEEGPYYSALSDVEIPENPEAYLKMTTKTLKASSGKSISDGHSWHVPDSPSCPEHHYKQMEGDRNVPPVPPASSTPYKPPYVSLNFTGSTAYVCESYLHLQEREILV

SEQ ID NO: 865009 - protein, 210 aa, Homo sapiens
MSTKVPIYLKRGSRKGKKEKLRDLLSSDMISPPLGDFRHTIHIGSGGGSDMFGDISFLQGKFHLLPGTMVEGPEEDGTFDLPFQFTRTATVCGRELPDGPSPLLKNAISLPVIGGPQALTLPTAQAPPKPPRLHLETPQPSPQEGGSVDIWRIPETGSPNSGLTPESGAEEPFLSNASSLLSLHVDLGPSILDDVLQIMDQDLDSMQIPT

SEQ ID NO: 865010 - protein, 115 aa, Homo sapiens
EFGLGFSQLRGGPPRGPSLWRPAPARALALPLTSLSSFRGLLGLHGASHPHLGSRSLARARHGPWGRNASRPRIPRSALHFVSGPPPPSRDPGVPRRPASPPGLGAVFLADSELF

SEQ ID NO: 865011 - protein, 210 aa, Homo sapiens; identical to SEQ ID NO: 865009

SEQ ID NO: 865012 - protein, 810 aa, Homo sapiens
MKLLKPTWVNHNGKPIFSVDIHPDGTKFATGGQGQDSGKVVIWNMSPVLQEDDEKDENIPKMLCQMDNHLACVNCVRWSNSGMYLASGGDDKLIMVWKRATYIGPSTVFGSSGKLANVEQWRCVSILRNHSGDVMDVAWSPHDAWLASCSVDNTVVIWNAVKFPEILATLRGHSGLVKGLTWDPVGKYIASQADDRSLKVWRTLDWQLETSITKPFDECGGTTHVLRLSWSPDGHYLVSAHAMNNSGPTAQIIEREGWKTNMDFVGHRKAVTVVKFNPKIFKKKQKNGSSAKPSCPYCCCAVGSKDRSLSVWLTCLKRPLVVIHELFDKSIMDISWTLNGLGILVCSMDGSVAFLDFSQDELGDPLSEEEKSRIHQSTYGKSLAIMTEAQLSTAVIENPEMLKYQRRQQQQQLDQKSAATREMGSATSVAGVVNGESLEDIRKNLLKKQVETRTADGRRRITPLCIAQLDTGDFSTAFFNSIPLSGSLAGTMLSSHSSPQLLPLDSSTPNSFGASKPCTEPVVAASARPAGDSVNKDSMNATSTPAALSPSVLTTPSKIEPMKAFDSRFTERSKATPGAPALTSMTPTAVERDVHRQVVVVKEESLHSILAGSDMTVSQILLTQHGIPVMNLSDGKAYCFNPSLSTWNLVSDKQDSLAQCADFRSSLPSQDAMLCSGPLAIIQGRTSNSGRQAARLFSVPHVVQQETTLAYLENQVAAALTLQSSHEYRHWLLVYARYLVNEGFEYRLREICKDLLGPVHYSTGSQWESTVVGLRKRELLKELLPVIGQNLRFQRLFTECQEQLDILRDK

SEQ ID NO: 865013 - protein, 526 aa, Homo sapiens
MLSSHSSPQLLPLDSSTPNSFGASKPCTEPVVAASARPAGDSVNKDSMNATSTPAALSPSVLTTPSKIEPMKAFDSRFTERSKATPGAPALTSMTPTAVERLKEQNLVKELRPRDLLESSSDSDEKVPLAKASSLSKRKLELEVETVEKKKKGRPRKDSRLMPVSLSVQSPAALTAEKEAMCLSAPALALKLPIPSPQRAFTLQVSSDPSMYIEVENEVTVVGGVKLSRLKCNREGKEWETVLTSRILTAAGSCDVVCVACEKRMLSVFSTCGRRLLSPILLPSPISTLHCTGSYVMALTAAATLSVWDVHRQVVVVKEESLHSILAGSDMTVSQILLTQHGIPVMNLSDGKAYCFNPSLSTWNLVSDKQDSLAQCADFRSSLPSQDAMLCSGPLAIIQGRTSNSGRQAARLFSVPHVVQQETTLAYLENQVAAALTLQSSHEYRHWLLVYARYLVNEGFEYRLREICKDLLGPVHYSTGSQWESTVVGLRKRELLKELLPVIGQNLRFQRLFTECQEQLDILRDK

SEQ ID NO: 865014 - protein, 236 aa, Homo sapiens
MSSNHGARALTVQHISVWDVHRQVVVVKEESLHSILAGSDMTVSQILLTQHGIPVMNLSDGKAYCFNPSLSTWNLVSDKQDSLAQCADFRSSLPSQDAMLCSGPLAIIQGRTSNSGRQAARLFSVPHVVQQETTLAYLENQVAAALTLQSSHEYRHWLLVYARYLVNEGFEYRLREICKDLLGPVHYSTGSQWESTVVGLRKRELLKELLPVIGQNLRFQRLFTECQEQLDILRDK

SEQ ID NO: 865015 - protein, 576 aa, Homo sapiens
MKLLKPTWVNHNGKPIFSVDIHPDGTKFATGGQGQDSGKVVIWNMSPVLQEDDEKDENIPKMLCQMDNHLACVNCVRWSNSGMYLASGGDDKLIMVWKRATYIGPSTVFGSSGKLANVEQWRCVSILRNHSGDVMDVAWSPHDAWLASCSVDNTVVIWNAVKFPEILATLRGHSGLVKGLTWDPVGKYIASQADDRSLKVWRTLDWQLETSITKPFDECGGTTHVLRLSWSPDGHYLVSAHAMNNSGPTAQIIEREGWKTNMDFVGHRKAVTVVKFNPKIFKKKQKNGSSAKPSCPYCCCAVGSKDRSLSVWLTCLKRPLVVIHELFDKSIMDISWTLNGLGILVCSMDGSVAFLDFSQDELGDPLSEEEKSRIHQSTYGKSLAIMTEAQLSTAVIENPEMLKYQRRQQQQQLDQKSAATREMGSATSVAGVVNGESLEDIRKNLLKKQVETRTADGRRRITPLCIAQLDTGDFSTAFFNSIPLSGSLAGTMLSSHSSPQLLPLDSSTPNSFGASKPCTEPVVAASARPAGDSVNKDRLVGAKACSCPWGKFRFAHSFEDREFYSVCTLWPLQSKK

SEQ ID NO: 865016 - protein, 1017 aa, Homo sapiens
MKLLKPTWVNHNGKPIFSVDIHPDGTKFATGGQGQDSGKVVIWNMSPVLQEDDEKDENIPKMLCQMDNHLACVNCVRWSNSGMYLASGGDDKLIMVWKRATYIGPSTVFGSSGKLANVEQWRCVSILRNHSGDVMDVAWSPHDAWLASCSVDNTVVIWNAVKFPEILATLRGHSGLVKGLTWDPVGKYIASQADDRSLKVWRTLDWQLETSITKPFDECGGTTHVLRLSWSPDGHYLVSAHAMNNSGPTAQIIEREGWKTNMDFVGHRKAVTVVKFNPKIFKKKQKNGSSAKPSCPYCCCAVGSKDRSLSVWLTCLKRPLVVIHELFDKSIMDISWTLNGLGILVCSMDGSVAFLDFSQDELGDPLSEEEKSRIHQSTYGKSLAIMTEAQLSTAVIENPEMLKYQRRQQQQQLDQKSAATREMGSATSVAGVVNGESLEDIRKNLLKKQVETRTADGRRRITPLCIAQLDTGDFSTAFFNSIPLSGSLAGTMLSSHSSPQLLPLDSSTPNSFGASKPCTEPVVAASARPAGDSVNKDSMNATSTPAALSPSVLTTPSKIEPMKAFDSRFTERSKATPGAPALTSMTPTAVERLKEQNLVKELRPRDLLESSSDSDEKVPLAKASSLSKRKLELEVETVEKKKKGRPRKDSRLMPVSLSVQSPAALTAEKEAMCLSAPALALKLPIPSPQRAFTLQVSSDPSMYIEVENEVTVVGGVKLSRLKCNREGKEWETVLTSRILTAAGSCDVVCVACEKRMLSVFSTCGRRLLSPILLPSPISTLHCTGSYVMALTAAATLSVWDVHRQVVVVKEESLHSILAGSDMTVSQILLTQHGIPVMNLSDGKAYCFNPSLSTWNLVSDKQDSLAQCADFRSSLPSQDAMLCSGPLAIIQGRTSNSGRQAARLFSVPHVVQQETTLAYLENQVAAALTLQSSHEYRHWLLVYARYLVNEGFEYRLREICKDLLGPVHYSTGSQWESTVVGLRKRELLKELLPVIGQNLRFQRLFTECQEQLDILRDK

SEQ ID NO: 865017 - protein, 1017 aa, Homo sapiens; identical to SEQ ID NO: 865016

SEQ ID NO: 865018 - protein, 883 aa, Homo sapiens [sequence omitted]

SEQ ID NO: 865019 - protein, 1040 aa, Homo sapiens
MKLLKPTWVNHNGKPIFSVDIHPDGTKFATGGQGQDSGKVVIWNMSPVLQEDDEKDENIPKMLCQMDNHLACVNCVRWSNSGMYLASGGDDKLIMVWKRATYIGPSTVFGSSGKLANVEQWRCVSILRNHSGELPTLLLFVLLNRISTFISGSQVHVMDVAWSPHDAWLASCSVDNTVVIWNAVKFPEILATLRGHSGLVKGLTWDPVGKYIASQADDRSLKVWRTLDWQLETSITKPFDECGGTTHVLRLSWSPDGHYLVSAHAMNNSGPTAQIIEREGWKTNMDFVGHRKAVTVVKFNPKIFKKKQKNGSSAKPSCPYCCCAVGSKDRSLSVWLTCLKRPLVVIHELFDKSIMDISWTLNGLGILVCSMDGSVAFLDFSQDELGDPLSEEEKSRIHQSTYGKSLAIMTEAQLSTAVIENPEMLKYQRRQQQQQLDQKSAATREMGSATSVAGVVNGESLEDIRKNLLKKQVETRTADGRRRITPLCIAQLDTGDFSTAFFNSIPLSGSLAGTMLSSHSSPQLLPLDSSTPNSFGASKPCTEPVVAASARPAGDSVNKDSMNATSTPAALSPSVLTTPSKIEPMKAFDSRFTERSKATPGAPALTSMTPTAVERLKEQNLVKELRPRDLLESSSDSDEKVPLAKASSLSKRKLELEVETVEKKKKGRPRKDSRLMPVSLSVQSPAALTAEKEAMCLSAPALALKLPIPSPQRAFTLQVSSDPSMYIEVENEVTVVGGVKLSRLKCNREGKEWETVLTSRILTAAGSCDVVCVACEKRMLSVFSTCGRRLLSPILLPSPISTLHCTGSYVMALTAAATLSVWDVHRQVVVVKEESLHSILAGSDMTVSQILLTQHGIPVMNLSDGKAYCFNPSLSTWNLVSDKQDSLAQCADFRSSLPSQDAMLCSGPLAIIQGRTSNSGRQAARLFSVPHVVQQETTLAYLENQVAAALTLQSSHEYRHWLLVYARYLVNEGFEYRLREICKDLLGPVHYSTGSQWESTVVGLRKRELLKELLPVIGQNLRFQRLFTECQEQLDILRDK

SEQ ID NO: 865020 - protein, 805 aa, Homo sapiens
CRCFFQCGGTTHVLRLSWSPDGHYLVSAHAMNNSGPTAQIIEREGWKTNMDFVGHRKAVTVVKFNPKIFKKKQKNGSSAKPSCPYCCCAVGSKDRSLSVWLTCLKRPLVVIHELFDKSIMDISWTLNGLGILVCSMDGSVAFLDFSQDELGDPLSEEEKSRIHQSTYGKSLAIMTEAQLSTAVIENPEMLKYQRRQQQQQLDQKSAATREMGSATSVAGVVNGESLEDIRKNLLKKQVETRTADGRRRITPLCIAQLDTGDFSTAFFNSIPLSGSLAGTMLSSHSSPQLLPLDSSTPNSFGASKPCTEPVVAASARPAGDSVNKDSMNATSTPAALSPSVLTTPSKIEPMKAFDSRFTERSKATPGAPALTSMTPTAVERLKEQNLVKELRPRDLLESSSDSDEKVPLAKASSLSKRKLELEVETVEKKKKGRPRKDSRLMPVSLSVQSPAALTAEKEAMCLSAPALALKLPIPSPQRAFTLQVSSDPSMYIEVENEVTVVGGVKLSRLKCNREGKEWETVLTSRILTAAGSCDVVCVACEKRMLSVFSTCGRRLLSPILLPSPISTLHCTGSYVMALTAAATLSVWDVHRQVVVVKEESLHSILAGSDMTVSQILLTQHGIPVMNLSDGKAYCFNPSLSTWNLVSDKQDSLAQCADFRSSLPSQDAMLCSGPLAIIQGRTSNSGRQAARLFSVPHVVQQETTLAYLENQVAAALTLQSSHEYRHWLLVYARYLVNEGFEYRLREICKDLLGPVHYSTGSQWESTVVGLRKRELLKELLPVIGQNLRFQRLFTECQEQLDILRDK

SEQ ID NO: 865021 - protein, 733 aa, Homo sapiens
MKLLKPTWVNHNGKPIFSVDIHPDGTKFATGGQGQDSGKVVIWNMSPVLQEDDEKDENIPKMLCQMDNHLACVNCVRWSNSGMYLASGGDDKLIMVWKRATYIGPSTVFGSSGKLANVEQWRCVSILRNHSGDVMDVAWSPHDAWLASCSVDNTVVIWNAVKFPEILATLRGHSGLVKGLTWDPVGKYIASQADDRSLKVWRTLDWQLETSITKPFDECGGTTHVLRLSWSPDGHYLVSAHAMNNSGPTAQIIEREGWKTNMDFVGHRKAVTVVKFNPKIFKKKQKNGSSAKPSCPYCCCAVGSKDRSLSVWLTCLKRPLVVIHELFDKSIMDISWTLNGLGILVCSMDGSVAFLDFSQDELGDPLSEEEKSRIHQSTYGKSLAIMTEAQLSTAVIENPEMLKYQRRQQQQQLDQKSAATREMGSATSVAGVVNGESLEDIRKNLLKKQVETRTADGRRRITPLCIAQLDTGDFSTAFFNSIPLSGSLAGTMLSSHSSPQLLPLDSSTPNSFGASKPCTEPVVAASARPAGDSVNKDSMNATSTPAALSPSVLTTPSKIEPMKAFDSRFTERSKATPGAPALTSMTPTAVERLKEQNLVKELRPRDLLESSSDSDEKVPLAKASSLSKRKLELEVETVEKKKKGRPRKDSRLMPVSLSVQSPAALTAEKEAMCLSAPALALKLPIPSPQRAFTLQGLRKRELLKELLPVIGQNLRFQRLFTECQEQLDILRDK

SEQ ID NO: 865022 - protein, 699 aa, Homo sapiens
MKLLKPTWVNHNGKPIFSVDIHPDGTKFATGGQGQDSGKVVIWNMSPVLQEDDEKDENIPKMLCQMDNHLACVNCVRWSNSGMYLASGGDDKLIMVWKRATYIGPSTVFGSSGKLANVEQWRCVSILRNHSGDVMDVAWSPHDAWLASCSVDNTVVIWNAVKFPEILATLRGHSGLVKGLTWDPVGKYIASQADDRSLKVWRTLDWQLETSITKPFDECGGTTHVLRLSWSPDGHYLVSAHAMNNSGPTAQIIEREGWKTNMDFVGHRKAVTVVKFNPKIFKKKQKNGSSAKPSCPYCCCAVGSKDRSLSVWLTCLKRPLVVIHELFDKSIMDISWTLNGLGILVCSMDGSVAFLDFSQDELGDPLSEEEKSRIHQSTYGKSLAIMTEAQLSTAVIENPEMLKYQRRQQQQQLDQKSAATREMGSATSVAGVVNGESLEDIRKNLLKKQVETRTADGRRRITPLCIAQLDTGDFSTAFFNSIPLSGSLAGTMLSSHSSPQLLPLDSSTPNSFGASKPCTEPVVAASARPAGDSVNKDSMNATSTPAALSPSVLTTPSKIEPMKAFDSRFTERSKATPGAPALTSMTPTAVERLKEQNLVKELRPRDLLESSSDSDEKVPLAKASSLSKRKLELEVETVEKKKKGRPRKDSRLMPVSLSVQSPAALTAEKEAMCPSREPERRDALFSIAVTQLLPLDSVQ

SEQ ID NO: 865023 - protein, 548 aa, Homo sapiens
MKLLKPTWVNHNGKPIFSVDIHPDGTKFATGGQGQDSGKVVIWNMSPVLQEDDEKDENIPKMLCQMDNHLACVNCVRWSNSGMYLASGGDDKLIMVWKRATYIGPSTVFGSSGKLANVEQWRCVSILRNHSGDVMDVAWSPHDAWLASCSVDNTVVIWNAVKFPEILATLRGHSGLVKGLTWDPVGKYIASQADDRSLKVWRTLDWQLETSITKPFDECGGTTHVLRLSWSPDGHYLVSAHAMNNSGPTAQIIEREGWKTNMDFVGHRKAVTVVKFNPKIFKKKQKNGSSAKPSCPYCCCAVGSKDRSLSVWLTCLKRPLVVIHELFDKSIMDISWTLNGLGILVCSMDGSVAFLDFSQDELGDPLSEEEKSRIHQSTYGKSLAIMTEAQLSTAVIENPEMLKYQRRQQQQQLDQKSAATREMGSATSVAGVVNGESLEDIRKNLLKKQVETRTADGRRRITPLCIAQLDTGDFSTAFFNSIPLSGSLAGTMLSSHSSPQLLPLDSSTPNSFGASKPCTEPVVAASARPAGDSVNKDSMNASVEVGLP

SEQ ID NO: 865024 - protein, 509 aa, Homo sapiens
MKLLKPTWVNHNGKPIFSVDIHPDGTKFATGGQGQDSGKVVIWNMSPVLQEDDEKDENIPKMLCQMDNHLACVNCVRWSNSGMYLASGGDDKLIMVWKRATYIGPSTVFGSSGKLANVEQWRCVSILRNHSGDVMDVAWSPHDAWLASCSVDNTVVIWNAVKFPEILATLRGHSGLVKGLTWDPVGKYIASQADDRSLKVWRTLDWQLETSITKPFDECGGTTHVLRLSWSPDGHYLVSAHAMNNSGPTAQIIEREGWKTNMDFVGHRKAVTVVKFNPKIFKKKQKNGSSAKPSCPYCCCAVGSKDRSLSVWLTCLKRPLVVIHELFDKSIMDISWTLNGLGILVCSMDGSVAFLDFSQDELGDPLSEEEKSRIHQSTYGKSLAIMTEAQLSTAVIENPEMLKYQRRQQQQQLDQKSAATREMGSATSVAGVVNGESLEDIRKNLLKKQVETRTADGRRRITPLCIAQLDTGYWFIPLSWSYLARSSCLLSAVNTFTVRIFTGPSQPDW

SEQ ID NO: 865025 - protein, 1328 aa, Homo sapiens
TGGGGAESHRGARAGLVAASVGERGPRRCSAVGLPSPGPPPWSLARALAAAGPGSARPEKAAGPGHGGLGQRGRSSTMRRGGWRKRAENDGWETWGGYMAAKVQKLEEQFRSDAAMQKDGTSSTIFSGVAIYVNGYTDPSAEELRKLMMLHGGQYHVYYSRSKTTHIIATNLPNAKIKELKGEKVIRPEWIVESIKAGRLLSYIPYQLYTKQSSVQKGLSFNPVCRPEDPLPGPSNIAKQLNNRVNHIVKKIETENEVKVNGMNSWNEEDENNDFSFVDLEQTSPGRKQNGIPHPRGSTAIFNGHTPSSNGALKTQDCLVPMVNSVASRLSPAFSQEEDKAEKSSTDFRDCTLQQLQQSTRNTDALRNPHRTNSFSLSPLHSNTKINGAHHSTVQGPSSTKSTSSVSTFSKAAPSVPSKPSDCNFISNFYSHSRLHHISMWKCELTEFVNTLQRQSNGIFPGREKLKKMKTGRSALVVTDTGDMSVLNSPRHQSCIMHVDMDCFFVSVGIRNRPDLKGKPVAVTSNRGTGRAPLRPGANPQLEWQYYQNKILKGKAADIPDSSLWENPDSAQANGIDSVLSRAEIASCSYEARQLGIKNGMFFGHAKQLCPNLQAVPYDFHAYKEVAQTLYETLASYTHNIEAVSCDEALVDITEILAETKLTPDEFANAVRMEIKDQTKCAASVGIGSNILLARMATRKAKPDGQYHLKPEEVDDFIRGQLVTNLPGVGHSMESKLASLGIKTCGDLQYMTMAKLQKEFGPKTGQMLYRFCRGLDDRPVRTEKERKSVSAEINYGIRFTQPKEAEAFLLSLSEEIQRRLEATGMKGKRLTLKIMVRKPGAPVETAKFGGHGICDNIARTVTLDQATDNAKIIGKAMLNMFHTMKLNISDMRGVGIHVNQLVPTNLNPSTCPSRPSVQSSHFPSGSYSVRDVFQVQKAKKSTEEEHKEVFRAAVDLEISSASRTCTFLPPFPAHLPTSPDTNKAESSGKWNGLHTPVSVQSRLNLSIEVPSPSQLDQSVLEALPPDLREQVEQVCAVQQAESHGDKKKEPVNGCNTGILPQPVGTVLLQIPEPQESNSDAGINLIALPAFSQVDPEVFAALPAELQRELKAAYDQRQRQGENSTHQQSASASVPKNPLLHLKAAVKEKKRNKKKKTIGSPKRIQSPLNNKLLNSPAKTLPGACGSPQKLIDGFLKHEGPPAEKPLEELSASTSGVPGLSSLQSDPAGCVRPPAPNLAGAVEFNDVKTLLREWITTISDPMEEDILQVVKYCTDLIEEKDLEKLDLVIKYMKRLMQQSVESVWNMAFDFILDNVQVVLQQTYGSTLKVT

SEQ ID NO: 865026 - protein, 392 aa, Homo sapiens
MAAKVQKLEEQFRSDAAMQKDGTSSTIFSGVAIYVNGYTDPSAEELRKLMMLHGGQYHVYYSRSKTTHIIATNLPNAKIKELKGEKVIRPEWIVESIKAGRLLSYIPYQLYTKQSSVQKGLSFNPVCRPEDPLPGPSNIAKQLNNRVNHIVKKIETENEVKVNGMNSWNEEDENNDFSFVDLEQTSPGRKQNGIPHPRGSTAIFNGHTPSSNGALKTQDCLVPMVNSVASRLSPAFSQEEDKAEKSSTDFRDCTLQQLQQSTRNTDALRNPHRTNSFSLSPLHSNTKINGAHHSTVQGPSSTKSTSSVSTFSKAAPSVPSKPSDCNFISNFYSHSRLHHISMWKCELTEFVNTLQRQSNGIFPGREKLKKMKTGRSALVVTDTGRYLLKLSS

SEQ ID NO: 865027 - protein, 1165 aa, Homo sapiens
MAAKVQKLEEQFRSDAAMQKDGTSSTIFSGVAIYVNGYTDPSAEELRKLMMLHGGQYHVYYSRSKTTHIIATNLPNAKIKELKGEKVIRPEWIVESIKAGRLLSYIPYQLYTKQSSVQKGLSFNPVCRPEDPLPGPSNIAKQLNNRVNHIVKKIETENEVKVNGMNSWNEEDENNDFSFVDLEQTSPGRKQNGIPHPRGSTAIFNGHTPSSNGALKTQDCLVPMVNSVASRLSPAFSQEEDKAEKSSTDFRDCTLQQLQQSTRNTDALRNPHRTNSFSLSPLHSNTKINGAHHSTVQGPSSTKSTSSVSTFSKAAPSVPSKPSDCNFISNFYSHSRLHHISMWKCELTEFVNTLQRQSNGIFPGREKLKKMKTGRSALVVTDTGDMSVLNSPRHQSCIMHVDMDCFFVSVGIRNRPDLKGKPVAVTSNRGTGRAPLRPGANPQLEWQYYQNKILKGKAADIPDSSLWENPDSAQANGIDSVLSRAEIASCSYEARQLGIKNGMFFGHAKQLCPNLQAVPYDFHAYKEVAQTLYETLASYTHNIEAVSCDEALVDITEILAETKLTPDEFANAVRMEIKDQTKCAASVGIGSNILLARMATRKAKPDGQYHLKPEEVDDFIRGQLVTNLPGVGHSMESKLASLGIKTCGDLQYMTMAKLQKEFGPKTGQMLYRFCRGLDDRPVRTEKERKSVSAEINYGIRFTQPKEAEAFLLSLSEEIQRRLEATGMKGKRLTLKIMVRKPGAPVETAKFGGHGICDNIARTVTLDQATDNAKIIGKAMLNMFHTMKLNISDMRGVGIHVNQLVPTNLNPSTCPSRPSVQSSHFPSGSYSVRDVFQVQKAKKSTEEEHKEVFRAAVDLEISSASRTCTFLPPFPAHLPTSPDTNKAESSGKWNGLHTPVSVQSRLNLSIEVPSPSQLDQSVLEALPPDLREQVEQVCAVQQAESHGDKKKEPVNGCNTGILPQPVGTVLLQIPEPQESNSDAGINLIALPAFSQVDPEVFAALPAELQRELKAAYDQRQRQGENSTHQQSASASVPKNPLLHLKAAVKEKKRNKKKKTIGSPKRIQSPLNNKLLNSPAKTLPGACGSPQKLIDGFLKHEGPPAEKPLEELSASTSGVPGLSSLQSDPAGCVRPPAPNLAGAVEFNDVKTLLREWITTISGWLGLC

SEQ ID NO: 865028 - protein, 1110 aa, Homo sapiens
MAAKVQKLEEQFRSDAAMQKDGTSSTIFSGVAIYVNGYTDPSAEELRKLMMLHGGQYHVYYSRSKTTHIIATNLPNAKIKELKGEKVIRPEWIVESIKAGRLLSYIPYQLYTKQSSVQKGLSFNPVCRPEDPLPGPSNIAKQLNNRVNHIVKKIETENEVKVNGMNSWNEEDENNDFSFVDLEQTSPGRKQNGIPHPRGSTAIFNGHTPSSNGALKTQDCLVPMVNSVASRLSPAFSQEEDKAEKSSTDFRDCTLQQLQQSTRNTDALRNPHRTNSFSLSPLHSNTKINGAHHSTVQGPSSTKSTSSVSTFSKAAPSVPSKPSDCNFISNFYSHSRLHHISMWKCELTEFVNTLQRQSNGIFPGREKLKKMKTGRSALVVTDTGDMSVLNSPRHQSCIMHVDMDCFFVSVGIRNRPDLKGKPVAVTSNRGTGRAPLRPGANPQLEWQYYQNKILKGKAADIPDSSLWENPDSAQANGIDSVLSRAEIASCSYEARQLGIKNGMFFGHAKQLCPNLQAVPYDFHAYKEVAQTLYETLASYTHNIEAVSCDEALVDITEILAETKLTPDEFANAVRMEIKDQTKCAASVGIGSNILLARMATRKAKPDGQYHLKPEEVDDFIRGQLVTNLPGVGHSMESKLASLGIKTCGDLQYMTMAKLQKEFGPKTGQMLYRFCRGLDDRPVRTEKERKSVSAEINYGIRFTQPKEAEAFLLSLSEEIQRRLEATGMKGKRLTLKIMVRKPGAPVETAKFGGHGICDNIARTVTLDQATDNAKIIGKAMLNMFHTMKLNISDMRGVGIHVNQLVPTNLNPSTCPSRPSVQSSHFPSGSYSVRDVFQVQKAKKSTEEEHKEVFRAAVDLEISSASRTCTFLPPFPAHLPTSPDTNKAESSGKWNGLHTPVSVQSRLNLSIEVPSPSQLDQSVLEALPPDLREQVEQVCAVQQAESHGDKKKEPVNGCNTGILPQPVGTVLLQIPEPQESNSDAGINLIALPAFSQVDPEVFAALPAELQRELKAAYDQRQRQGENSTHQQSASASVPKNPLLHLKAAVKEKKRNKKKKTIGSPKRIQSPLNNKLLNSPAKTLPGACGSPQKLIDGFLKHEGPPAEKPLVIP

SEQ ID NO: 865029 - protein, 1140 aa, Homo sapiens
MAAKVQKLEEQFRSDAAMQKDGTSSTIFSGVAIYVNGYTDPSAEELRKLMMLHGGQYHVYYSRSKTTHIIATNLPNAKIKELKGEKVIRPEWIVESIKAGRLLSYIPYQLYTKQSSVQKGLSFNPVCRPEDPLPGPSNIAKQLNNRVNHIVKKIETENEVKVNGMNSWNEEDENNDFSFVDLEQTSPGRKQNGIPHPRGSTAIFNGHTPSSNGALKTQDCLVPMVNSVASRLSPAFSQEEDKAEKSSTDFRDCTLQQLQQSTRNTDALRNPHRTNSFSLSPLHSNTKINGAHHSTVQGPSSTKSTSSVSTFSKAAPSVPSKPSDCNFISNFYSHSRLHHISMWKCELTEFVNTLQRQSNGIFPGREKLKKMKTGRSALVVTDTGDMSVLNSPRHQSCIMHVDMDCFFVSVGIRNRPDLKGKPVAVTSNRGTGRAPLRPGANPQLEWQYYQNKILKGKAADIPDSSLWENPDSAQANGIDSVLSRAEIASCSYEARQLGIKNGMFFGHAKQLCPNLQAVPYDFHAYKEVAQTLYETLASYTHNIEAVSCDEALVDITEILAETKLTPDEFANAVRMEIKDQTKCAASVGIGSNILLARMATRKAKPDGQYHLKPEEVDDFIRGQLVTNLPGVGHSMESKLASLGIKTCGDLQYMTMAKLQKEFGPKTGQMLYRFCRGLDDRPVRTEKERKSVSAEINYGIRFTQPKEAEAFLLSLSEEIQRRLEATGMKGKRLTLKIMVRKPGAPVETAKFGGHGICDNIARTVTLDQATDNAKIIGKAMLNMFHTMKLNISDMRGVGIHVNQLVPTNLNPSTCPSRPSVQSSHFPSGSYSVRDVFQVQKAKKSTEEEHKEVFRAAVDLEISSASRTCTFLPPFPAHLPTSPDTNKAESSGKWNGLHTPVSVQSRLNLSIEVPSPSQLDQSVLEALPPDLREQVEQVCAVQQAESHGDKKKEPVNGCNTGILPQPVGTVLLQIPEPQESNSDAGINLIALPAFSQVDPEVFAALPAELQRELKAAYDQRQRQGENSTHQQSASASVPKNPLLHLKAAVKEKKRNKKKKTIGSPKRIQSPLNNKLLNSPAKTLPGACGSPQKLIDGFLKHEGPPAEKPLEELSASTSGVPGLSSLQSDPAGCVRPPSCEILY

SEQ ID NO: 865030 - protein, 752 aa, Homo sapiens
GRSHIRMLTASCSYEARQLGIKNGMFFGHAKQLCPNLQAVPYDFHAYKEVAQTLYETLASYTHNIEAVSCDEALVDITEILAETKLTPDEFANAVRMEIKDQTKCAASVGIGSNILLARMATRKAKPDGQYHLKPEEVDDFIRGQLVTNLPGVGHSMESKLASLGIKTCGDLQYMTMAKLQKEFGPKTGQMLYRFCRGLDDRPVRTEKERKSVSAEINYGIRFTQPKEAEAFLLSLSEEIQRRLEATGMKGKRLTLKIMVRKPGAPVETAKFGGHGICDNIARTVTLDQATDNAKIIGKAMLNMFHTMKLNISDMRGVGIHVNQLVPTNLNPSTCPSRPSVQSSHFPSGSYSVRDVFQVQKAKKSTEEEHKEVFRAAVDLEISSASRTCTFLPPFPAHLPTSPDTNKAESSGKWNGLHTPVSVQSRLNLSIEVPSPSQLDQSVLEALPPDLREQVEQVCAVQQAESHGDKKKEPVNGCNTGILPQPVGTVLLQIPEPQESNSDAGINLIALPAFSQVDPEVFAALPAELQRELKAAYDQRQRQGENSTHQQSASASVPKNPLLHLKAAVKEKKRNKKKKTIGSPKRIQSPLNNKLLNSPAKTLPGACGSPQKLIDGFLKHEGPPAEKPLEELSASTSGVPGLSSLQSDPAGCVRPPAPNLAGAVEFNDVKTLLREWITTISDPMEEDILQVVKYCTDLIEEKDLEKLDLVIKYMKRLMQQSVESVWNMAFDFILDNVQVVLQQTYGSTLKVT

SEQ ID NO: 865031 - protein, 930 aa, Homo sapiens
MAAKVQKLEEQFRSDAAMQKDGTSSTIFSGVAIYVNGYTDPSAEELRKLMMLHGGQYHVYYSRSKTTHIIATNLPNAKIKELKGEKVIRPEWIVESIKAGRLLSYIPYQLYTKQSSVQKGLSFNPVCRPEDPLPGPSNIAKQLNNRVNHIVKKIETENEVKVNGMNSWNEEDENNDFSFVDLEQTSPGRKQNGIPHPRGSTAIFNGHTPSSNGALKTQDCLVPMVNSVASRLSPAFSQEEDKAEKSSTDFRDCTLQQLQQSTRNTDALRNPHRTNSFSLSPLHSNTKINGAHHSTVQGPSSTKSTSSVSTFSKAAPSVPSKPSDCNFISNFYSHSRLHHISMWKCELTEFVNTLQRQSNGIFPGREKLKKMKTGRSALVVTDTGDMSVLNSPRHQSCIMHVDMDCFFVSVGIRNRPDLKGKPVAVTSNRGTGRAPLRPGANPQLEWQYYQNKILKGKAADIPDSSLWENPDSAQANGIDSVLSRAEIASCSYEARQLGIKNGMFFGHAKQLCPNLQAVPYDFHAYKEVAQTLYETLASYTHNIEAVSCDEALVDITEILAETKLTPDEFANAVRMEIKDQTKCAASVGIGSNILLARMATRKAKPDGQYHLKPEEVDDFIRGQLVTNLPGVGHSMESKLASLGIKTCGDLQYMTMAKLQKEFGPKTGQMLYRFCRGLDDRPVRTEKERKSVSAEINYGIRFTQPKEAEAFLLSLSEEIQRRLEATGMKGKRLTLKIMVRKPGAPVETAKFGGHGICDNIARTVTLDQATDNAKIIGKAMLNMFHTMKLNISDMRGVGIHVNQLVPTNLNPSTCPSRPSVQSSHFPSGSYSVRDVFQVQKAKKSTEEEHKEVFRAAVDLEISSASRTCTFLPPFPAHLPTSPDTNKAESSGKWNGLHTPVSVQSRLNLSIEVPSPSQVHFCSPKYKYILYS

SEQ ID NO: 865032 - protein, 120 aa, Homo sapiens
VLCINGGYFVLINLLLVAYSAYLTIFPFLGVGHSMESKLASLGIKTCGDLQYMTMAKLQKEFGPKTGQMLYRFCRGLDDRPVRTEKERKSVSAEINYGIRFTQVLIIEQILPSVALYIFT

SEQ ID NO: 865033 - protein, 1328 aa, Homo sapiens; identical to SEQ ID NO: 865025

SEQ ID NO: 865034 - protein, 1230 aa, Homo sapiens
MAAKVQKLEEQFRSDAAMQKDGTSSTIFSGVAIYVNGYTDPSAEELRKLMMLHGGQYHVYYSRSKTTHIIATNLPNAKIKELKGEKVIRPEWIVESIKAGRLLSYIPYQLYTKQSSVQKGLSFNPVCRPEDPLPGPSNIAKQLNNRVNHIVKKIETENEVKVNGMNSWNEEDENNDFSFVDLEQTSPGRKQNGIPHPRGSTAIFNGHTPSSNGALKTQDCLVPMVNSVASRLSPAFSQEEDKAEKSSTDFRDCTLQQLQQSTRNTDALRNPHRTNSFSLSPLHSNTKINGAHHSTVQGPSSTKSTSSVSTFSKAAPSVPSKPSDCNFISNFYSHSRLHHISMWKCELTEFVNTLQRQSNGIFPGREKLKKMKTGRSALVVTDTGDMSVLNSPRHQSCIMHVDMDCFFVSVGIRNRPDLKGKPVAVTSNRGTGRAPLRPGANPQLEWQYYQNKILKGKAADIPDSSLWENPDSAQANGIDSVLSRAEIASCSYEARQLGIKNGMFFGHAKQLCPNLQAVPYDFHAYKEVAQTLYETLASYTHNIEAVSCDEALVDITEILAETKLTPDEFANAVRMEIKDQTKCAASVGIGSNILLARMATRKAKPDGQYHLKPEEVDDFIRGQLVTNLPGVGHSMESKLASLGIKTCGDLQYMTMAKLQKEFGPKTGQMLYRFCRGLDDRPVRTEKERKSVSAEINYGIRFTQPKEAEAFLLSLSEEIQRRLEATGMKGKRLTLKIMVRKPGAPVETAKFGGHGICDNIARTVTLDQATDNAKIIGKAMLNMFHTMKLNISDMRGVGIHVNQLVPTNLNPSTCPSRPSVQSSHFPSGSYSVRDVFQVQKAKKSTEEEHKEVFRAAVDLEISSASRTCTFLPPFPAHLPTSPDTNKAESSGKWNGLHTPVSVQSRLNLSIEVPSPSQLDQSVLEALPPDLREQVEQVCAVQQAESHGDKKKEPVNGCNTGILPQPVGTVLLQIPEPQESNSDAGINLIALPAFSQVDPEVFAALPAELQRELKAAYDQRQRQGENSTHQQSASASVPKNPLLHLKAAVKEKKRNKKKKTIGSPKRIQSPLNNKLLNSPAKTLPGACGSPQKLIDGFLKHEGPPAEKPLEELSASTSGVPGLSSLQSDPAGCVRPPAPNLAGAVEFNDVKTLLREWITTISDPMEEDILQVVKYCTDLIEEKDLEKLDLVIKYMKRLMQQSVESVWNMAFDFILDNVQVVLQQTYGSTLKVT

SEQ ID NO: 865035 - protein, 1380 aa, Homo sapiens
TGGGGAESHRGARAGLVAASVGERGPRRCSAVGLPSPGPPPWSLARALAAAGPGSARPEKAAGPGHGGLGQRGRSSTMRRGGWRKRAENDGWETWGGYMAAKVQKLEEQFRSDAAMQKDGTSSTIFSGVAIYVNGYTDGFHASLHTEEYVRAFRSELQRALLTSSSRRAMYFPVPNFWSELVFKEQLVDDPSAEELRKLMMLHGGQYHVYYSRSKTTHIIATNLPNAKIKELKGEKVIRPEWIVESIKAGRLLSYIPYQLYTKQSSVQKGLSFNPVCRPEDPLPGPSNIAKQLNNRVNHIVKKIETENEVKVNGMNSWNEEDENNDFSFVDLEQTSPGRKQNGIPHPRGSTAIFNGHTPSSNGALKTQDCLVPMVNSVASRLSPAFSQEEDKAEKSSTDFRDCTLQQLQQSTRNTDALRNPHRTNSFSLSPLHSNTKINGAHHSTVQGPSSTKSTSSVSTFSKAAPSVPSKPSDCNFISNFYSHSRLHHISMWKCELTEFVNTLQRQSNGIFPGREKLKKMKTGRSALVVTDTGDMSVLNSPRHQSCIMHVDMDCFFVSVGIRNRPDLKGKPVAVTSNRGTGRAPLRPGANPQLEWQYYQNKILKGKAADIPDSSLWENPDSAQANGIDSVLSRAEIASCSYEARQLGIKNGMFFGHAKQLCPNLQAVPYDFHAYKEVAQTLYETLASYTHNIEAVSCDEALVDITEILAETKLTPDEFANAVRMEIKDQTKCAASVGIGSNILLARMATRKAKPDGQYHLKPEEVDDFIRGQLVTNLPGVGHSMESKLASLGIKTCGDLQYMTMAKLQKEFGPKTGQMLYRFCRGLDDRPVRTEKERKSVSAEINYGIRFTQPKEAEAFLLSLSEEIQRRLEATGMKGKRLTLKIMVRKPGAPVETAKFGGHGICDNIARTVTLDQATDNAKIIGKAMLNMFHTMKLNISDMRGVGIHVNQLVPTNLNPSTCPSRPSVQSSHFPSGSYSVRDVFQVQKAKKSTEEEHKEVFRAAVDLEISSASRTCTFLPPFPAHLPTSPDTNKAESSGKWNGLHTPVSVQSRLNLSIEVPSPSQLDQSVLEALPPDLREQVEQVCAVQQAESHGDKKKEPVNGCNTGILPQPVGTVLLQIPEPQESNSDAGINLIALPAFSQVDPEVFAALPAELQRELKAAYDQRQRQGENSTHQQSASASVPKNPLLHLKAAVKEKKRNKKKKTIGSPKRIQSPLNNKLLNSPAKTLPGACGSPQKLIDGFLKHEGPPAEKPLEELSASTSGVPGLSSLQSDPAGCVRPPAPNLAGAVEFNDVKTLLREWITTISDPMEEDILQVVKYCTDLIEEKDLEKLDLVIKYMKRLMQQSVESVWNMAFDFILDNVQVVLQQTYGSTLKVT

SEQ ID NO: 865036 - protein, 805 aa, Homo sapiens
MAAKVQKLEEQFRSDAAMQKDGTSSTIFSGVAIYVNGYTDPSAEELRKLMMLHGGQYHVYYSRSKTTHIIATNLPNAKIKELKGEKVIRPEWIVESIKAGRLLSYIPYQLYTKQSSVQKGLSFNPVCRPEDPLPGPSNIAKQLNNRVNHIVKKIETENEVKVNGMNSWNEEDENNDFSFVDLEQTSPGRKQNGIPHPRGSTAIFNGHTPSSNGALKTQDCLVPMVNSVASRLSPAFSQEEDKAEKSSTDFRDCTLQQLQQSTRNTDALRNPHRTNSFSLSPLHSNTKINGAHHSTVQGPSSTKSTSSVSTFSKAAPSVPSKPSDCNFISNFYSHSRLHHISMWKCELTEFVNTLQRQSNGIFPGREKLKKMKTGRSALVVTDTGDMSVLNSPRHQSCIMHVDMDCFFVSVGIRNRPDLKGKPVAVTSNRGTGRAPLRPGANPQLEWQYYQNKILKGKAADIPDSSLWENPDSAQANGIDSVLSRAEIASCSYEARQLGIKNGMFFGHAKQLCPNLQAVPYDFHAYKEVAQTLYETLASYTHNIEAVSCDEALVDITEILAETKLTPDEFANAVRMEIKDQTKCAASVGIGSNILLARMATRKAKPDGQYHLKPEEVDDFIRGQLVTNLPGVGHSMESKLASLGIKTCGDLQYMTMAKLQKEFGPKTGQMLYRFCRGLDDRPVRTEKERKSVSAEINYGIRFTQPKEAEAFLLSLSEEIQRRLEATGMKGKRLTLKIMVRKPGAPVETAKFGGHGICDNIARTVTLDQATDNAKIIGKAMLNMFHTMKLNISDMRGSPISSVKPLS

SEQ ID NO: 865037 - protein, 761 aa, Homo sapiens
MAAKVQKLEEQFRSDAAMQKDGTSSTIFSGVAIYVNGYTDPSAEELRKLMMLHGGQYHVYYSRSKTTHIIATNLPNAKIKELKGEKVIRPEWIVESIKAGRLLSYIPYQLYTKQSSVQKGLSFNPVCRPEDPLPGPSNIAKQLNNRVNHIVKKIETENEVKVNGMNSWNEEDENNDFSFVDLEQTSPGRKQNGIPHPRGSTAIFNGHTPSSNGALKTQDCLVPMVNSVASRLSPAFSQEEDKAEKSSTDFRDCTLQQLQQSTRNTDALRNPHRTNSFSLSPLHSNTKINGAHHSTVQGPSSTKSTSSVSTFSKAAPSVPSKPSDCNFISNFYSHSRLHHISMWKCELTEFVNTLQRQSNGIFPGREKLKKMKTGRSALVVTDTGDMSVLNSPRHQSCIMHVDMDCFFVSVGIRNRPDLKGKPVAVTSNRGTGRAPLRPGANPQLEWQYYQNKILKGKAADIPDSSLWENPDSAQANGIDSVLSRAEIASCSYEARQLGIKNGMFFGHAKQLCPNLQAVPYDFHAYKEVAQTLYETLASYTHNIEAVSCDEALVDITEILAETKLTPDEFANAVRMEIKDQTKCAASVGIGSNILLARMATRKAKPDGQYHLKPEEVDDFIRGQLVTNLPGVGHSMESKLASLGIKTCGDLQYMTMAKLQKEFGPKTGQMLYRFCRGLDDRPVRTEKERKSVSAEINYGIRFTQPKEAEAFLLSLSEEIQRRLEATGMKGKRLTLKIMVRKPGAPVETAKFGGHGICDNIAR

SEQ ID NO: 865038 - protein, 142 aa, Homo sapiens
AGCRAAGAWFGLARPAAPNTGRAAAAALPGWPSPCWSREREGAGPRGQGSAPPWLPWRLEARDAGAMAGTRGLMLLGPGPVAGPRDVGTCRGRQMEIQKHKDNKKLPQGIIIVFRLQTHTTPQIYTQLKGKLRKFFKEPYSE

SEQ ID NO: 865039 - protein, 145 aa, Homo sapiens
LAGAAQGHGRSGGPLSSGETQRPTITWPRRAGLCADPRPCLHLPQACGAREAWPHGPGRRAAGVKGAPRPNSAPLASRLPPCGRAASAASAPPARPAFVRRLGPAPPPDPGNTNRRRLTRPRSLSQTSPSSSSPSPQLLLSGGSG

SEQ ID NO: 865040 - protein, 142 aa, Homo sapiens; identical to SEQ ID NO: 865038

SEQ ID NO: 865041 - protein, 142 aa, Homo sapiens; identical to SEQ ID NO: 865038

SEQ ID NO: 865042 - protein, 142 aa, Homo sapiens; identical to SEQ ID NO: 865038

SEQ ID NO: 865043 - protein, 116 aa, Homo sapiens
LAGAAQGHGRSGGPLSSGETQRPTITWPRRAGLCADPRPCLHLPQACGAREAWPHGPGRRAAGVKGAPRPNSAPLASRLPPCGRAASAASAPPARPAFVRRLGPAPPPDPDGDSET

SEQ ID NO: 865044 - protein, 306 aa, Homo sapiens
MAAAAAAAAAAGAAGGRGSGPGRRRHLVPGAGGEAGEGAPGGAGDYGNGLESEELEPEELLLEPEPEPEPEEEPPRPRAPPGAPGPGPGSGAPGSQEEEEEPGLVEGDPGDGAIEDPELEAIKARVREMEEEAEKLKELQNEVEKQMNMSPPPGNAGPVIMSIEEKMEADARSIYVGNVDYGATAEELEAHFHGCGSVNRVTILCDKFSGHPKGFAYIEFSDKESVRTSLALDESLFRGRQIKVIPKRTNRPGISTTDRGFPRARYRARTTNYNSSRSRFYSGFNSRPRGRVYRGRARATSWYSPY

SEQ ID NO: 865045 - protein, 306 aa, Homo sapiens; identical to SEQ ID NO: 865044

SEQ ID NO: 865046 - protein, 306 aa, Homo sapiens; identical to SEQ ID NO: 865044

SEQ ID NO: 865047 - protein, 306 aa, Homo sapiens; identical to SEQ ID NO: 865044

SEQ ID NO: 865048 - protein, 306 aa, Homo sapiens; identical to SEQ ID NO: 865044

SEQ ID NO: 865049 - protein, 178 aa, Homo sapiens
MEEEAEKLKELQNEVEKQMNMSPPPGNAGPVIMSIEEKMEADARSIYVGNVDYGATAEELEAHFHGCGSVNRVTILCDKFSGHPKGFAYIEFSDKESVRTSLALDESLFRGRQIKVIPKRTNRPGISTTDRGFPRARYRARTTNYNSSRSRFYSGFNSRPRGRVYRGRARATSWYSPY

SEQ ID NO: 865050 - protein, 297 aa, Homo sapiens
MAAAAAAAAAAGAAGGRGSGPGRRRHLVPGAGGEAGEGAPGGAGDYGNGLESEELEPEELLLEPEPEPEPEEEPPRPRAPPGAPGPGPGSGAPGSQEEEEEPGLVEGDPGDGAIEDPELEAIKARVREMEEEAEKLKELQNEVEKQMNMSPPPGNAGPVIMSIEEKMEADARSIYVGNVDYGATAEELEAHFHGCGSVNRVTILCDKFSGHPKGFAYIEFSDKESVRTSLALDESLFRGRQIKVIPKRTNRPGISTTDRGFPRARYRARTTNYNSSRSRFYSGFNSRPRGRVYSRSG

SEQ ID NO: 865051 - protein, 178 aa, Homo sapiens; identical to SEQ ID NO: 865049

SEQ ID NO: 865052 - protein, 297 aa, Homo sapiens; identical to SEQ ID NO: 865050

SEQ ID NO: 865053 - protein, 297 aa, Homo sapiens; identical to SEQ ID NO: 865050

SEQ ID NO: 865054 - protein, 169 aa, Homo sapiens
MEEEAEKLKELQNEVEKQMNMSPPPGNAGPVIMSIEEKMEADARSIYVGNVDYGATAEELEAHFHGCGSVNRVTILCDKFSGHPKGFAYIEFSDKESVRTSLALDESLFRGRQIKVIPKRTNRPGISTTDRGFPRARYRARTTNYNSSRSRFYSGFNSRPRGRVYSRSG

SEQ ID NO: 865055 - protein, 366 aa, Homo sapiens
MAAAAAAAAAAGAAGGRGSGPGRRRHLVPGAGGEAGEGAPGGAGDYGNGLESEELEPEELLLEPEPEPEPEEEPPRPRAPPGAPGPGPGSGAPGSQEEEEEPGLVEGDPGDGAIEDPELEAIKARVREMEEEAEKLKELQNEVEKQMNMSPPPGNAGPVIMSIEEKMEADARSIYVGNVDYGATAEELEAHFHGCGSVNRVTILCDKFSGHPKGFAYIEFSDKESVRTSLALDESLFRGRQIKDPKTNQQTRHQHNSELEAHFHGCGSVNRVTILCDKFSGHPKGFAYIEFSDKESVRTSLALDESLFRGRQVIPKRTNRPGISTTDRGFPRARYRARTTNYNSSRSRFYSGFNSRPRGRVYSRSG

SEQ ID NO: 865056 - protein, 137 aa, Homo sapiens
MSIEEKMEADARSIYVGNVDYGATAEELEAHFHGCGSVNRVTILCDKFSGHPKGFAYIEFSDKESVRTSLALDESLFRGRQIKVIPKRTNRPGISTTDRGFPRARYRARTTNYNSSRSRFYSGFNSRPRGRVYSRSG

SEQ ID NO: 865057 - protein, 137 aa, Homo sapiens; identical to SEQ ID NO: 865056

SEQ ID NO: 865058 - protein, 208 aa, Homo sapiens [sequence omitted]

SEQ ID NO: 865059 - protein, 306 aa, Homo sapiens; identical to SEQ ID NO: 865044

SEQ ID NO: 865060 - protein, 306 aa, Homo sapiens; identical to SEQ ID NO: 865044

SEQ ID NO: 865061 - protein, 272 aa, Homo sapiens
HFIYSFSSNISIIKSLESEELEPEELLLEPEPEPEPEEEPPRPRAPPGAPGPGPGSGAPGSQEEEEEPGLVEGDPGDGAIEDPELEAIKARVREMEEEAEKLKELQNEVEKQMNMSPPPGNAGPVIMSIEEKMEADARSIYVGNVDYGATAEELEAHFHGCGSVNRVTILCDKFSGHPKGFAYIEFSDKESVRTSLALDESLFRGRQIKVIPKRTNRPGISTTDRGFPRARYRARTTNYNSSRSRFYSGFNSRPRGRVYRGRARATSWYSPY

SEQ ID NO: 865062 - protein, 306 aa, Homo sapiens; identical to SEQ ID NO: 865044

SEQ ID NO: 865063 - protein, 306 aa, Homo sapiens; identical to SEQ ID NO: 865044

SEQ ID NO: 865064 - protein, 306 aa, Homo sapiens; identical to SEQ ID NO: 865044

SEQ ID NO: 865065 - protein, 178 aa, Homo sapiens; identical to SEQ ID NO: 865049

SEQ ID NO: 865066 - protein, 182 aa, Homo sapiens
MSVKLEEEAEKLKELQNEVEKQMNMSPPPGNAGPVIMSIEEKMEADARSIYVGNVDYGATAEELEAHFHGCGSVNRVTILCDKFSGHPKGFAYIEFSDKESVRTSLALDESLFRGRQIKVIPKRTNRPGISTTDRGFPRARYRARTTNYNSSRSRFYSGFNSRPRGRVYRGRARATSWYSPY

SEQ ID NO: 865067 - protein, 137 aa, Homo sapiens; identical to SEQ ID NO: 865056

SEQ ID NO: 865068 - protein, 143 aa, Homo sapiens
SSRSKDPLPKRRCEADARSIYVGNVDYGATAEELEAHFHGCGSVNRVTILCDKFSGHPKGFAYIEFSDKESVRTSLALDESLFRGRQIKVIPKRTNRPGISTTDRGFPRARYRARTTNYNSSRSRFYSGFNSRPRGRVYSRSG

SEQ ID NO: 865069 - protein, 107 aa, Homo sapiens
MVYRSIRSVPPTASPVQFSGHPKGFAYIEFSDKESVRTSLALDESLFRGRQIKVIPKRTNRPGISTTDRGFPRARYRARTTNYNSSRSRFYSGFNSRPRGRVYSRSG

SEQ ID NO: 865070 - protein, 297 aa, Homo sapiens; identical to SEQ ID NO: 865050

SEQ ID NO: 865071 - protein, 273 aa, Homo sapiens
MAAAAAAAAAAGAAGGRGSGPGRRRHLVPGAGGEAGEGAPGGAGDYGNGLESEELEPEELLLEPEPEPEPEEEPPRPRAPPGAPGPGPGSGAPGSQEEEEEPGLVEGDPGDGAIEDPELEAIKARVREMEEEAEKLKELQNEVEKQMNMSPPPGNAGPVIMSIEEKMEADARSIYVGNVDYGATAEELEAHFHGCGSVNRVTILCDKFSGHPKGFAYIEFSDKESVRTSLALDESLFRGRQIKVIPKRTNRPGISRAGLERHHGIPLTKKSVY

SEQ ID NO: 865072 - protein, 262 aa, Homo sapiens
MAAAAAAAAAAGAAGGRGSGPGRRRHLVPGAGGEAGEGAPGGAGDYGNGLESEELEPEELLLEPEPEPEPEEEPPRPRAPPGAPGPGPGSGAPGSQEEEEEPGLVEGDPGDGAIEDPELEAIKARVREMEEEAEKLKELQNEVEKQMNMSPPPGNAGPVIMSIEEKMEADARSIYVGNVDYGATAEELEAHFHGCGSVNRVTILCDKFSGHPKGFAYIEFSDKESVRTSLALDESLFRGRQIKDPKTNQQTRHQPPSSPQWT

SEQ ID NO: 865073 - protein, 210 aa, Homo sapiens
MSCPNYCSGNSNSGSLRTSRHIPLTSIDLCPTSVSCGDVLYLPTSSQDHTWVTDNCQETCGEPTSCQPVHCETGNLETSCGSSTAYYVPRPCQGSSFLPASFFSSSCLPVSCRPQRYVSSGCRPLRPLLNSYQPIGDCVPNAYRPQFCLSKSCQPQNLLTSGCQPSSCLAYRPQSLHVVSSSLRPLGPLFSGCQPLTHVFSTCRPSCSGL

SEQ ID NO: 865074 - protein, 67 aa, Homo sapiens
LCATLHGGAKEKAWEGKSEPSLVEGPLLRQWGDRLLHATGLTSYYWHRNHHLRYRRRQKWKQRKMEK

SEQ ID NO: 865075 - protein, 77 aa, Homo sapiens
FVMRLFFPLVIYNLILKIVIWSLPVHSKEELPCFSPPLISDSDVLCFQHCLFPGVSTGALRVCRSIGQMVSGAIVTK

SEQ ID NO: 865076 - protein, 595 aa, Homo sapiens
MALTDGGWCLPKRFGAAGADASDSRAFPAREPSTPPSPISSSSSSCSRGGERGPGGASNCGTPQLDTEAAAGPPARSLLLSSYASHPFGAPHGPSAPGVAGPGGNLSSWEDLLLFTDLDQAATASKLLWSSRGAKLSPFAPEQPEEMYQTLAALSSQGPAAYDGAPGGFVHSAAAAAAAAAAASSPVYVPTTRVGSMLPGLPYHLQGSGSGPANHAGGAGAHPGWPQASADSPPYGSGGGAAGGGAAGPGGAGSAAAHVSARFPYSPSPPMANGAAREPGGYAAAGSGGAGGVSGGGSSLAAMGGREPQYSSLSAARPLNGTYHHHHHHHHHHPSPYSPYVGAPLTPAWPAGPFETPVLHSLQSRAGAPLPVPRGPSADLLEDLSESRECVNCGSIQTPLWRRDGTGHYLCNACGLYSKMNGLSRPLIKPQKRVPSSRRLGLSCANCHTTTTTLWRRNAEGEPVCNACGLYMKLHGVPRPLAMKKEGIQTRKRKPKNINKSKTCSGNSNNSIPMTPTSTSSNSDDCSKNTSPTTQPTASGAGAPVMTGAGESTNPENSELKYSGQDGLYIGVSLASPAEVTSSVRPDSWCALALA

SEQ ID NO: 865077 - protein, 165 aa, Homo sapiens
VQKYWTNGQWSNSDEITLLLALRPRRKAQPGRARAGKPGTGAGGRGPRGDAGRDGSGAPTPALTHRCRRRPAGGPVREPRVRELRLHPDAAVAAGRHRPLPVQRLRALQQDERPQPAPHQAAEARGECDPPCPWLAAGPGLSWPGRPRPGSACLGRPPPRGQVRP

SEQ ID NO: 865078 - protein, 595 aa, Homo sapiens; identical to SEQ ID NO: 865076

SEQ ID NO: 865079 - protein, 595 aa, Homo sapiens; identical to SEQ ID NO: 865076

SEQ ID NO: 865080 - protein, 116 aa, Homo sapiens
RPLNGTYHHHHHHHHHHPSPYSPYVGAPLTPAWPAGPFETPVLHSLQSRAGAPLPVPRGPSAGKGRASGSGCGSKALGRTGDVEQLLHSGPVFRTFSSGCAEVGLVPGRICRPVAG

SEQ ID NO: 865081 - protein, 144 aa, Homo sapiens
VQKYWTNGQWSNSDEITLLLALRPRRKAQPGRARAGKPGTGAGGRGPRGDAGRDGSGAPTPALTHRCRRRPAGGPVREPRVRELRLHPDAAVAAGRHRPLPVQRLRALQQDERPQPAPHQAAEARGECDPPCPWLAAGPGLSWP

SEQ ID NO: 865082 - protein, 297 aa, Homo sapiens
MMDSEAHEKRPPILTSSKQDISPHITNVGEMKHYLCGCCAAFNNVAITFPIQKVLFRQQLYGIKTRDAILQLRRDGFRNLYRGILPPLMQKTTTLALMFGLYEDLSCLLHKHVSAPEFATSGVAAVLAGTTEAIFTPLERVQTLLQDHKHHDKFTNTYQAFKALKCHGIGEYYRGLVPILFRNGLSNVLFFGLRGPIKEHLPTATTHSAHLVNDFICGGLLGAMLGFLFFPINVVKTRIQSQIGGEFQSFPKVFQKIWLERDRKLINLFRGAHLNYHRSLISWGIINATYEFLLKVI

SEQ ID NO: 865083 - protein, 79 aa, Homo sapiens
RCAGVALYLPRRGGLRPGEVGWRHLAGRGPREGRRGGAVSPSRDPNSAQRVALRPNLGVGHSLRLRGPRLASRPAGRRR

SEQ ID NO: 865084 - protein, 79 aa, Homo sapiens; identical to SEQ ID NO: 865083

SEQ ID NO: 865085 - protein, 79 aa, Homo sapiens; identical to SEQ ID NO: 865083

SEQ ID NO: 865086 - protein, 79 aa, Homo sapiens; identical to SEQ ID NO: 865083

SEQ ID NO: 865087 - protein, 155 aa, Homo sapiens; identical to SEQ ID NO: 790206

SEQ ID NO: 865088 - protein, 201 aa, Homo sapiens
GLAAVARAPRQARGGQAWEGAGPRGLRRSPPCQRRGRSRRKGAAAATAASARSQGRAAAMSYCRQEGKDRIIFVTKEDHETPSSAELVADDPNDPYEEHGLILPNGNINWNCPCLGGMASGPCGEQFKSAFSCFHYSTEEIKGSDCVDQFRAMQECMQKYPDLYPQEDEDEEEEREKKPAEQAEETAPIEATATKEEEGSS

SEQ ID NO: 865089 - protein, 140 aa, Homo sapiens
GLAAVARAPRQARGGQAWEGAGPRGLRRSPPCQRRGRSRRKGAAAATAASARSQGRAAAMSYCRQEGKDRIIFVTKEDHETPSSAELVADDPNDPYEEHGLILPNGNINWNCPCLGGMASGPCGEQFKSAFSCLPFIIPF

SEQ ID NO: 865090 - protein, 201 aa, Homo sapiens; identical to SEQ ID NO: 865088

SEQ ID NO: 865091 - protein, 373 aa, Homo sapiens
MGSQVSVESGALHVVIVGGGFGGIAAASQLQALNVPFMLVDMKDSFHHNVAALRASVETGFAKKTFISYSVTFKDNFRQGLVVGIDLKNQMVLLQGGEALPFSHLILATGSTGPFPGKFNEVSSQQAAIQAYEDMVRQVQRSRFIVVVGGGSAGVEMAAEIKTEYPEKEVTLIHSQVALADKELLPSVRQEVKEILLRKGVQLLLSERVSNLEELPLNEYREYIKVQTDKGTEVATNLVILCTGIKINSSAYRKAFESRLASSGALRVNEHLQVEGHSNVYAIGDCADVRTPKMAYLAGLHANIAVANIVNSVKQRPLQAYKPGALTFLLSMGRNDGVGQISGFYVGRLMVRLTKSRDLFVSTSWKTMRQSPP

SEQ ID NO: 865092 - protein, 373 aa, Homo sapiens; identical to SEQ ID NO: 865091

SEQ ID NO: 865093 - protein, 243 aa, Homo sapiens
CFTCPLLQVQRSRFIVVVGGGSAGVEMAAEIKTEYPEKEVTLIHSQVALADKELLPSVRQEVKEILLRKGVQLLLSERVSNLEELPLNEYREYIKVQTDKGTEVATNLVILCTGIKINSSAYRKAFESRLASSGALRVNEHLQVEGHSNVYAIGDCADVRTPKMAYLAGLHANIAVANIVNSVKQRPLQAYKPGALTFLLSMGRNDGVGQISGFYVGRLMVRLTKSRDLFVSTSWKTMRQSPP

SEQ ID NO: 865094 - protein, 206 aa, Homo sapiens
MEVTLIHSQVALADKELLPSVRQEVKEILLRKGVQLLLSERVSNLEELPLNEYREYIKVQTDKGTEVATNLVILCTGIKINSSAYRKAFESRLASSGALRVNEHLQVEGHSNVYAIGDCADVRTPKMAYLAGLHANIAVANIVNSVKQRPLQAYKPGALTFLLSMGRNDGVGQISGFYVGRLMVRLTKSRDLFVSTSWKTMRQSPP

SEQ ID NO: 865095 - protein, 355 aa, Homo sapiens
MGSQVSVESGALHVVIVGGGFGGIAAASQLQALNVPFMLVDMKDSFHHNVAALRASVETGFAKKTFISYSVTFKDNFRQGLVVGIDLKNQMVLLQGGEALPFSHLILATGSTGPFPGKFNEVSSQQAAIQAYEDMVRQVQRSRFIVVVGGGSAGVEMAAEIADKELLPSVRQEVKEILLRKGVQLLLSERVSNLEELPLNEYREYIKVQTDKGTEVATNLVILCTGIKINSSAYRKAFESRLASSGALRVNEHLQVEGHSNVYAIGDCADVRTPKMAYLAGLHANIAVANIVNSVKQRPLQAYKPGALTFLLSMGRNDGVGQISGFYVGRLMVRLTKSRDLFVSTSWKTMRQSPP

SEQ ID NO: 865096 - protein, 353 aa, Homo sapiens
MGSQVSVESGALHVVIVGGGFGGIAAASQLQALNVPFMLVDMKDSFHHNVAALRASVETGFAKKTFISYSVTFKDNFRQGLVVGIDLKNQMVLLQGGEALPFSHLILATGSTGPFPGKFNEVSSQQAAIQAYEDMVRQVQRSRFIVVVGGGSAGVEMAAEIKTEYPEKEVTLIHSQVALADKELLPSVRQEVKEILLRKGVQLLLSERVSNLEELPLNEYREYIKVQTDKGTEVATNLVILCTGIKINSSAYRKAFESRLASSGALRVNEHLQVEGHSNVYAIGDCADVRTPKMAYLAGLHANIAVANIVNSVKQRPLQAYKPGKRGPMCFAVLIEFGVKHGEAFLGYPIPGH

SEQ ID NO: 865097 - protein, 333 aa, Homo sapiens
MGSQVSVESGALHVVIVGGGFGGIAAASQLQALNVPFMLVDMKDSFHHNVAALRASVETGFAKKTFISYSVTFKDNFRQGLVVGIDLKNQMVLLQGGEVQRSRFIVVVGGGSAGVEMAAEIKTEYPEKEVTLIHSQVALADKELLPSVRQEVKEILLRKGVQLLLSERVSNLEELPLNEYREYIKVQTDKGTEVATNLVILCTGIKINSSAYRKAFESRLASSGALRVNEHLQVEGHSNVYAIGDCADVRTPKMAYLAGLHANIAVANIVNSVKQRPLQAYKPGALTFLLSMGRNDGVGQISGFYVGRLMVRLTKSRDLFVSTSWKTMRQSPP

SEQ ID NO: 865098 - protein, 176 aa, Homo sapiens
MGSQVSVESGALHVVIVGGGFGGIAAASQLQALNVPFMLVDMKDSFHHNVAALRASVETGFAKKTFISYSVTFKDNFRQGLVVGIDLKNQMVLLQGGEALPFSHLILATGSTGPFPGKFNEVSSQQAAIQAYEDMVRQVQRSRFIVVVGGGSAGVEMAAEIKTEYPEKEVLNKYPP

SEQ ID NO: 865099 - protein, 1762 aa, Homo sapiens
MNSFLSFPISLCSARKAVDEEEEAVEERRNMRTIWVTGRKGLTEREAAALIVEEARMILQQDLVEMGVQWNPCALLHSSTCSLTHSESEVKEHTFISQTKSSYKKLTSKNKSNTIFSDSYIKHSPNIVQDLNKSREHTSSFNCNFQNGNQEHQTCSIFRARKRASLDINKEKPGASQNEGKTSDKKVVQTFSQKTKKAPLNFNSEKMSRSFRSWKRRKHLKRSRDSSPLKDSGACRIHLQGQTLSNPSLCEDPFTLDEKKTEFRNSGPFAKNVSLSGKEKDNKTSFPLQIKQNCSWNITLTNDNFVEHIVTGSQSKNVTCQATSVVSEKGRGVAVEAEKINEVLIQNGSKNQNVYMKHHDIHPINQYLRKQSHEQTSTITKQKNIIERQMPCEAVSSYINRDSNVTINCERIKLNTEENKPSHFQALGDDISRTVIPSEVLPSAGAFSKSEGQHENFLNISRLQEKTGTYTTNKTKNNHVSDLGLVLCDFEDSFYLDTQSEKIIQQMATENAKLGAKDTNLAAGIMQKSLVQQNSMNSFQKECHIPFPAEQHPLGATKIDHLDLKTVGTMKQSSDSHGVDILTPESPIFHSPILLEENGLFLKKNEVSVTDSQLNSFLQGYQTQETVKPVILLIPQKRTPTGVEGECLPVPETSLNMSDSLLFDSFSDDYLVKEQLPDMQMKEPLPSEVTSNHFSDSLCLQEDLIKKSNVNENQDTHQQLTCSNDESIIFSEMDSVQMVEALDNVDIFPVQEKNHTVVSPRALELSDPVLDEHHQGDQDGGDQDERAEKSKLTGTRQNHSFIWSGASFDLSPGLQRILDKVSSPLENEKLKSMTINFSSLNRKNTELNEEQEVISNLETKQVQGISFSSNNEVKSKIEMLENNANHDETSSLLPRKESNIVDDNGLIPPTPIPTSASKLTFPGILETPVNPWKTNNVLQPGESYLFGSPSDIKNHDLSPGSRNGFKDNSPISDTSFSLQLSQDGLQLTPASSSSESLSIIDVASDQNLFQTFIKEWRCKKRFSISLACEKIRSLTSSKTATIGSRFKQASSPQEIPIRDDGFPIKGCDDTLVVGLAVCWGGRDAYYFSLQKEQKHSEISASLVPPSLDPSLTLKDRMWYLQSCLRKESDKECSVVIYDFIQSYKILLLSCGISLEQSYEDPKVACWLLDPDSQEPTLHSIVTSFLPHELPLLEGMETSQGIQSLGLNAGSEHSGRYRASVESILIFNSMNQLNSLLQKENLQDVFRKVEMPSQYCLALLELNGIGFSTAECESQKHIMQAKLDAIETQAYQLAGHSFSFTSSDDIAEVLFLELKLPPNREMKNQGSKKTLGSTRRGIDNGRKLRLGRQFSTSKDVLNKLKALHPLPGLILEWRRITNAITKVVFPLQREKCLNPFLGMERIYPVSQSHTATGRITFTEPNIQNVPRDFEIKMPTLVGESPPSQAVGKGLLPMGRGKYKKGFSVNPRCQAQMEERAVDRGMPFSISMRHAFVPFPGGSILAADYSQLELRILAHLSHDRRLIQVLNTGADVFRSIAAEWKMIEPESVGDDLRQQAKQICYGIIYGMGAKSLGEQMGIKENDAACYIDSFKSRYTGINQFMTETVKNCKRDGFVQTILGRRRYLPGIKDNNPYRKAHAERQAINTIVQGSAADIVKIATVNIQKQLETFHSTFKSHGHREGMLQSDRTGLSRKRKLQGMFCPIRGGFFILQLHDELLYEVAEEDVVQVAQIVKNEMESAVKLSVKLKVKVKIGASWGELKDFDV

SEQ ID NO: 865100 - protein, 213 aa, Homo sapiens [sequence omitted]

SEQ ID NO: 865101 - protein, 2724 aa, Homo sapiens
MNGHRFTFRTRSLLPLQKGQHRCITKLLAHNDPWGIFRAPSSRRSYSVSGVCQPAIPNSSLHIPHNACWLKWKLCSEIALPYHHILGERRKLCSIRNFEDWREDVRSCCQARVLPRGRTLGLWLALIGREEFAMNLLRRSGKRRRSESGSDSFSGSGGDSSASPQFLSGSVLSPPPGLGRCLKAAAAGECKPTVPDYEIDKLLLANWGLPKAVLEKYHSFGVKKMFEWQAECLLLGQVLEGKNLVYSAPTSAGKTLVAELLILKRVLEMRKKALFILPFVSVAKEKKYYLQSLFQEVGIKVDGYMGSTSPSRHFSSLDIAVCTIERANGLINRLIEENKMDLLGMVVVDELHMLGDSHRGYLLELLLTKICYITRKSASCQADLASSLSNAVQIVGMSATLPNLELVASWLNAELYHTDFRPVPLLESVKVGNSIYDSSMKLVREFEPMLQVKGDEDHVVSLCYETICDNHSVLLFCPSKKWCEKLADIIAREFYNLHHQAEGEGLVKPSECPPVILEQKELLEVMDQLRRLPSGLDSVLQKTVPWGVAFHHAGLTFEERDIIEGAFRQGLIRVLAATSTLSSGVNLPARRVIIRTPIFGGRPLDILTYKQMVGRAGRKGVDTVGSILICKNSEKSKGIALLQGSLKPVRSCLQRREGEEVTGSMIRAILEIIVGGVASTSQDMHTYAACTFLAASMKEGKQGIQRNQESVQLGVIEACVMWLLENEFIQSTEASDGTEGKVYHPTHLGSATLSSSLSPADTLDIFADLQRAMKGFVLENDLHILYLVTPMFEDWTTIDWYRFFCLWEKLPTSMKRVAELVGVEEGFLARCVKGKVVARTERQHRQMAIHKRFFTSLVLLDLISEVPLREINQKYGCNRGQIQSLQQSAAVYAGMITVFSNRLGWHNMELLLSQFQKRLTFGIQRELCDLVRVSLLNAQRARVLYASGFHTVADLARANIVEVEVILKNAVPFKSARKAVDEEEEAVEERRNMRTIWVTGRKGLTEREAAALIVEEARMILQQDLVEMGVQWNPCALLHSSTCSLTHSESEVKEHTFISQTKSSYKKLTSKNKSNTIFSDSYIKHSPNIVQDLNKSREHTSSFNCNFQNGNQEHQTCSIFRARKRASLDINKEKPGASQNEGKTSDKKVVQTFSQKTKKAPLNFNSEKMSRSFRSWKRRKHLKRSRDSSPLKDSGACRIHLQGQTLSNPSLCEDPFTLDEKKTEFRNSGPFAKNVSLSGKEKDNKTSFPLQIKQNCSWNITLTNDNFVEHIVTGSQSKNVTCQATSVVSEKGRGVAVEAEKINEVLIQNGSKNQNVYMKHHDIHPINQYLRKQSHEQTSTITKQKNIIERQMPCEAVSSYINRDSNVTINCERIKLNTEENKPSHFQALGDDISRTVIPSEVLPSAGAFSKSEGQHENFLNISRLQEKTGTYTTNKTKNNHVSDLGLVLCDFEDSFYLDTQSEKIIQQMATENAKLGAKDTNLAAGIMQKSLVQQNSMNSFQKECHIPFPAEQHPLGATKIDHLDLKTVGTMKQSSDSHGVDILTPESPIFHSPILLEENGLFLKKNEVSVTDSQLNSFLQGYQTQETVKPVILLIPQKRTPTGVEGECLPVPETSLNMSDSLLFDSFSDDYLVKEQLPDMQMKEPLPSEVTSNHFSDSLCLQEDLIKKSNVNENQDTHQQLTCSNDESIIFSEMDSVQMVEALDNVDIFPVQEKNHTVVSPRALELSDPVLDEHHQGDQDGGDQDERAEKSKLTGTRQNHSFIWSGASFDLSPGLQRILDKVSSPLENEKLKSMTINFSSLNRKNTELNEEQEVISNLETKQVQGISFSSNNEVKSKIEMLENNANHDETSSLLPRKESNIVDDNGLIPPTPIPTSASKLTFPGILETPVNPWKTNNVLQPGESYLFGSPSDIKNHDLSPGSRNGFKDNSPISDTSFSLQLSQDGLQLTPASSSSESLSIIDVASDQNLFQTFIKEWRCKKRFSISLACEKIRSLTSSKTATIGSRFKQASSPQEIPIRDDGFPIKGCDDTLVVGLAVCWGGRDAYYFSLQKEQKHSEISASLVPPSLDPSLTLKDRMWYLQSCLRKESDKECSVVIYDFIQSYKILLLSCGISLEQSYEDPKVACWLLDPDSQEPTLHSIVTSFLPHELPLLEGMETSQGIQSLGLNAGSEHSGRYRASVESILIFNSMNQLNSLLQKENLQDVFRKVEMPSQYCLALLELNGIGFSTAECESQKHIMQAKLDAIETQAYQLAGHSFSFTSSDDIAEVLFLELKLPPNREMKNQGSKKTLGSTRRGIDNGRKLRLGRQFSTSKDVLNKLKALHPLPGLILEWRRITNAITKVVFPLQREKCLNPFLGMERIYPVSQSHTATGRITFTEPNIQNVPRDFEIKMPTLVGESPPSQAVGKGLLPMGRGKYKKGFSVNPRCQAQMEERAVDRGMPFSISMRHAFVPFPGGSILAADYSQLELRILAHLSHDRRLIQVLNTGADVFRSIAAEWKMIEPESVGDDLRQQAKQICYGIIYGMGAKSLGEQMGIKENDAACYIDSFKSRYTGINQFMTETVKNCKRDGFVQTILGRRRYLPGIKDNNPYRKAHAERQAINTIVQGSAADIVKIATVNIQKQLETFHSTFKSHGHREGMLQSDRTGLSRKRKLQGMFCPIRGGFFILQLHDELLYEVAEEDVVQVAQIVKNEMESAVKLSVKLKVKVKIGASWGELKDFDV

SEQ ID NO: 865102 - protein, 213 aa, Homo sapiens [sequence omitted]

SEQ ID NO: 865103 - protein, 2561 aa, Homo sapiens
MNGHRFTFRTRSLLPLQKGQHRCITKLLAHNDPWGIFRAPSSRRSYSVSGVCQPAIPNSSLHIPHNACWLKWKLCSEIALPYHHILGERRKLCSIRNFEDWREDVRSCCQARVLPRGRTLGLWLALIGREEFAMNLLRRSGKRRRSESGSDSFSGSGGDSSASPQFLSGSVLSPPPGLGRCLKAAAAGECKPTVPDYEIDKLLLANWGLPKAVLEKYHSFGVKKMFEWQAECLLLGQVLEGKNLVYSAPTSAGKTLVAELLILKRVLEMRKKALFILPFVSVAKEKKYYLQSLFQEVGIKVDGYMGSTSPSRHFSSLDIAVCTIERANGLINRLIEENKMDLLGMVVVDELHMLGDSHRGYLLELLLTKICYITRKSASCQADLASSLSNAVQIVGMSATLPNLELVASWLNAELYHTDFRPVPLLESVKVGNSIYDSSMKLVREFEPMLQVKGDEDHVVSLCYETICDNHSVLLFCPSKKWCEKLADIIAREFYNLHHQAEGEGLVKPSECPPVILEQKELLEVMDQLRRLPSGLDSVLQKTVPWGVAFHHAGLTFEERDIIEGAFRQGLIRVLAATSTLSSGVNLPARRVIIRTPIFGGRPLDILTYKQMVGRAGRKGVDTVGSILICKNSEKSKGIALLQGSLKPVRSCLQRREGEEVTGSMIRAILEIIVGGVASTSQDMHTYAACTFLAASMKEGKQGIQRNQESVQLGVIEACVMWLLENEFIQSTEASDGTEGKVYHPTHLGSATLSSSLSPADTLDIFADLQRAMKGFVLENDLHILYLVTPMFEDWTTIDWYRFFCLWEKLPTSMKRVAELVGVEEGFLARCVKGKVVARTERQHRQMAIHKRFFTSLVLLDLISEVPLREINQKYGCNRGQIQSLQQSAAVYAGMITVFSNRLGWHNMELLLSQFQKRLTFGIQRELCDLVRVSLLNAQRARVLYASGFHTVADLARANIVEVEVILKNAVPFKSARKAVDEEEEAVEERRNMRTIWVTGRKGLTEREAAALIVEEARMILQQDLVEMGVQWNPCALLHSSTCSLTHSESEVKEHTFISQTKSSYKKLTSKNKSNTIFSDSYIKHSPNIVQDLNKSREHTSSFNCNFQNGNQEHQTCSIFRARKRASLDINKEKPGASQNEGKTSDKKVVQTFSQKTKKAPLNFNSEKMSRSFRSWKRRKHLKRSRDSSPLKDSGACRIHLQGQTLSNPSLCEDPFTLDEKKTEFRNSGPFAKNVSLSGKEKDNKTSFPLQIKQNCSWNITLTNDNFVEHIVTGSQSKNVTCQATSVVSEKGRGVAVEAEKINEVLIQNGSKNQNVYMKHHDIHPINQYLRKQSHEQTSTITKQKNIIERQMPCEAVSSYINRDSNVTINCERIKLNTEENKPSHFQALGDDISRTVIPSEVLPSAGAFSKSEGQHENFLNISRLQEKTGTYTTNKTKNNHVSDLGLVLCDFEDSFYLDTQSEKIIQQMATENAKLGAKDTNLAAGIMQKSLVQQNSMNSFQKECHIPFPAEQHPLGATKIDHLDLKTVGTMKQSSDSHGVDILTPESPIFHSPILLEENGLFLKKNEVSVTDSQLNSFLQGYQTQETVKPVILLIPQKRTPTGVEGECLPVPETSLNMSDSLLFDSFSDDYLVKEQLPDMQMKEPLPSEVTSNHFSDSLCLQEDLIKKSNVNENQDTHQQLTCSNDESIIFSEMDSVQMVEALDNVDIFPVQEKNHTVVSPRALELSDPVLDEHHQGDQDGGDQDERAEKSKLTGTRQNHSFIWSGASFDLSPGLQRILDKVSSPLENEKLKSMTINFSSLNRKNTELNEEQEVISNLETKQVQGISFSSNNEVKSKIEMLENNANHDETSSLLPRKESNIVDDNGLIPPTPIPTSASKLTFPGILETPVNPWKTNNVLQPGESYLFGSPSDIKNHDLSPGSRNGFKDNSPISDTSFSLQLSQDGLQLTPASSSSESLSIIDVASDQNLFQTFIKEWRCKKRFSISLACEKIRSLTSSKTATIGSRFKQASSPQEIPIRDDGFPIKGCDDTLVVGLAVCWGGRDAYYFSLQKEQKHSEISASLVPPSLDPSLTLKDRMWYLQSCLRKESDKECSVVIYDFIQSYKILLLSCGISLEQSYEDPKVACWLLDPDSQEPTLHSIVTSFLPHELPLLEGMETSQGIQSLGLNAGSEHSGRYRASVESILIFNSMNQLNSLLQKENLQDVFRKVEMPSQYCLALLELNGIGFSTAECESQKHIMQAKLDAIETQAYQLAGHSFSFTSSDDIAEVLFLELKLPPNREMKNQGSKKTLGSTRRGIDNGRKLRLGRQFSTSKDVLNKLKALHPLPGLILEWRRITNAITKVVFPLQREKCLNPFLGMERIYPVSQSHTATGRITFTEPNIQNVPRDFEIKMPTLVGESPPSQAVGKGLLPMGRGKYKKGFSVNPRCQAQMEERAVDRGMPFSISMRHAFVPFPGGSILAADYSQLELRILAHLSHDRRLIQVLNTGADVFRSIAAEWKMIEPESVGDDLRQQAKQICYGIIYGMGAKSLGEQMGIKENDAACYIDSFKSRYTGNLSSR

SEQ ID NO: 865104 - protein, 132 aa, Homo sapiens
MLLRMSEHRNEALGNYLEMRLKSSFLRGLGSWKSNPLRLGGWTILLTLTMGQGEPGGPQGDPWVPHELLLPSLCDSSHASSWGSGSITCAWRGGDSSSHPLVSGHILSNSPVAAVMCSSMGTHLSPFKGTLL

SEQ ID NO: 865105 - protein, 132 aa, Homo sapiens; identical to SEQ ID NO: 865104

SEQ ID NO: 865106 - protein, 132 aa, Homo sapiens; identical to SEQ ID NO: 865104

SEQ ID NO: 865107 - protein, 132 aa, Homo sapiens; identical to SEQ ID NO: 865104

SEQ ID NO: 865108 - protein, 455 aa, Homo sapiens
HRQPKQSLPFQAPAWARETPQGYLRWCGLPIYVDRPKKGAPSAELARKVILGGAGHARVSPRGFLPRRLLSGARAPPAGGPRESLAGEPGAWFPRQPPSRPPRRPPWGRGSPARGRGRRAIGLCAEPRGGTSAGRQTRPSAEAGLEEKMAAKQPPPLMKKHSQTDLVSRLKTRKILGVGGEDDDGEVHRSKISQVLGNEIKFTIREPLGLRVWQFVSAVLFSGIAIMALAFPDQLYDAVFDGAQVTSKTPIRLYGGALLKVETESDRGEVTCLRSQLVSGEAKIGTQAIQLGRTKDGVSETSPASALLLAFSLIQTWLQPLGWDWPPYLPFNASASLLPEGAFQKAHVTTALSCWNPTSTGDQAASYRPQDLQDSPSPPLVIPALTFLSPPSKESPPEITSHGPGLRSAGLPDKCNQRRHVSWEEPPTTSKPRKPSVFMFLLDPHNRPAKPAQQR

SEQ ID NO: 865109 - protein, 114 aa, Homo sapiens
TTTKFAAASTSAVLFSGIAIMALAFPDQLYDAVFDGAQVTSKTPIRLYGGALLSISLIMWNALYTAEKVIIRWTLLTEACYFGVQFLVVTATLAETGLMSLGILLTRSSRRGRE

SEQ ID NO: 865110 - protein, 189 aa, Homo sapiens
MAAKQPPPLMKKHSQTDLVSRLKTRKILGVGGEDDDGEVHRSKISQVLGNEIKFTIREPLGLRVWQFVSAVLFSGIAIMALAFPDQLYDAVFDGAQVTSKTPIRLYGGALLSISLIMWNALYTAEKVIIRWTLLTEACYFGVQFLVVTATLAETGLMSLGILLLLVSRLLFVVISIYYYYQVGRRPKKA

SEQ ID NO: 865111 - protein, 189 aa, Homo sapiens; identical to SEQ ID NO: 865110

SEQ ID NO: 865112 - protein, 189 aa, Homo sapiens; identical to SEQ ID NO: 865110

SEQ ID NO: 865113 - protein, 189 aa, Homo sapiens; identical to SEQ ID NO: 865110

SEQ ID NO: 865114 - protein, 189 aa, Homo sapiens; identical to SEQ ID NO: 865110

SEQ ID NO: 865115 - protein, 189 aa, Homo sapiens; identical to SEQ ID NO: 865110

SEQ ID NO: 865116 - protein, 189 aa, Homo sapiens; identical to SEQ ID NO: 865110

SEQ ID NO: 865117 - protein, 189 aa, Homo sapiens; identical to SEQ ID NO: 865110

SEQ ID NO: 865118 - protein, 189 aa, Homo sapiens; identical to SEQ ID NO: 865110

SEQ ID NO: 865119 - protein, 126 aa, Homo sapiens
MAAKQPPPLMKKHSQTDLVSRLKTRKILGVGGEDDDGEVHRSKYTQWVGACSRHHLQGALISVCTASGRCGTEMEEAQAQPLGIHSLEERQINSVSAKPLAPPLFYPQSHFCLNHFCFLSNLRCTR

SEQ ID NO: 865120 - protein, 189 aa, Homo sapiens; identical to SEQ ID NO: 865110

SEQ ID NO: 865121 - protein, 337 aa, Homo sapiens
HRQPKQSLPFQAPAWARETPQGYLRWCGLPIYVDRPKKGAPSAELARKVILGGAGHARVSPRGFLPRRLLSGARAPPAGGPRESLAGEPGAWFPRQPPSRPPRRPPWGRGSPARGRGRRAIGLCAEPRGGTSAGRQTRPSAEAGLEEKMAAKQPPPLMKKHSQTDLVSRLKTRKILGVGGEDDDGEVHRSKISQVLGNEIKFTIREPLGLRVWQFVSAVLFSGIAIMALAFPDQLYDAVFDGAQVTSKTPIRLYGGALLSISLIMWNALYTAEKVIIRWTLLTEACYFGVQFLVVTATLAETGLMSLGILLLLVSRLLFVVISIYYYYQVGRRPKKA

SEQ ID NO: 865122 - protein, 189 aa, Homo sapiens; identical to SEQ ID NO: 865110

SEQ ID NO: 865123 - protein, 189 aa, Homo sapiens; identical to SEQ ID NO: 865110

SEQ ID NO: 865124 - protein, 189 aa, Homo sapiens; identical to SEQ ID NO: 865110

SEQ ID NO: 865125 - protein, 121 aa, Homo sapiens
MHTPEVASPSPGDRCREKSSPRPQTRFPSWHRVGDGWRVSIGTARSGCCQVGPCQGSSPLSTLCLAVPAPRYSNMACTQQSGGTTMVTADAPRLCLVNVAEQNGRLDPEEGPLSWHLSLAT

SEQ ID NO: 865126 - protein, 189 aa, Homo sapiens; identical to SEQ ID NO: 865110

SEQ ID NO: 865127 - protein, 189 aa, Homo sapiens; identical to SEQ ID NO: 865110

SEQ ID NO: 865128 - protein, 189 aa, Homo sapiens; identical to SEQ ID NO: 865110

SEQ ID NO: 865129 - protein, 189 aa, Homo sapiens; identical to SEQ ID NO: 865110

SEQ ID NO: 865130 - protein, 189 aa, Homo sapiens; identical to SEQ ID NO: 865110

SEQ ID NO: 865131 - protein, 189 aa, Homo sapiens; identical to SEQ ID NO: 865110

SEQ ID NO: 865132 - protein, 189 aa, Homo sapiens; identical to SEQ ID NO: 865110

SEQ ID NO: 865133 - protein, 154 aa, Homo sapiens
MAAKQPPPLMKKHSQTDLVSRLKTRKILGVGGEDDDGEVHRSKISQVLGNEIKFTIREPLGLRVWQFVSAVLFSGIAIMALAFPDQLYDAVFDGAQVTSKTPIRLYGGALLNAAPTPRPLMKLSAGDVLPSCGHWWNTPSGLELAVATICKERS

SEQ ID NO: 865134 - protein, 516 aa, Homo sapiens
RSVRVAWIPRSGPAMSLVLLSLAALCRSAVPREPTVQCGSETGPSPEWMLQHDLIPGDLRDLRVEPVTTSVATGDYSILMNVSWVLRADASIRLLKATKICVTGKSNFQSYSCVRCNYTEAFQTQTRPSGGKWTFSYIGFPVELNTVYFIGAHNIPNANMNEDGPSMSVNFTSPGCLDHIMKYKKKCVKAGSLWDPNITACKKNEETVEVNFTTTPLGNRYMALIQHSTIIGFSQVFEPHQKKQTRASVVIPVTGDSEGATVQLTPYFPTCGSDCIRHKGTVVLCPQTGVPFPLDNNKSKPGGWLPLLLLSLLVATWVLVAGIYLMWRHERIKKTSFSTTTLLPPIKVLVVYPSEICFHHTICYFTEFLQNHCRSEVILEKWQKKKIAEMGPVQWLATQKKAADKVVFLLSNDVNSVCDGTCGKSEGSPSENSQDLFPLAFNLFCSDLRSQIHLHKYVVVYFREIDTKDDYNALSVCPKYHLMKDATAFCAELLHVKQQVSAGKRSQACHDGCCSL

SEQ ID NO: 865135 - protein, 516 aa, Homo sapiens; identical to SEQ ID NO: 865134

SEQ ID NO: 865136 - protein, 516 aa, Homo sapiens; identical to SEQ ID NO: 865134

SEQ ID NO: 865137 - protein, 302 aa, Homo sapiens
RSVRVAWIPRSGPAMSLVLLSLAALCRSAVPREPTVQCGSETGPSPEWMLQHDLIPGDLRDLRVEPVTTSVATGDYSILMNVSWVLRADASIRLLKATKICVTGKSNFQSYSCVRCNYTEAFQTQTRPSGGKWTFSYIGFPVELNTVYFIGAHNIPNANMNEDGPSMSVNFTSPGCLDHIMKYKKKCVKAGSLWDPNITACKKNEETVEVNFTTTPLGNRYMALIQHSTIIGFSQVFEPHQKKQTRASVVIPVTGDSEGATVQVKFSELLWGGKGHRRLFHHSLLLRMSSLLSNALLPADTS

SEQ ID NO: 865138 - protein, 302 aa, Homo sapiens; identical to SEQ ID NO: 865137

SEQ ID NO: 865139 - protein, 279 aa, Homo sapiens
MPHQKKQTRASVVIPVTGDSEGATVQLTPYFPTCGSDCIRHKGTVVLCPQTGVPFPLDNNKSKPGGWLPLLLLSLLVATWVLVAGIYLMWRHERIKKTSFSTTTLLPPIKVLVVYPSEICFHHTICYFTEFLQNHCRSEVILEKWQKKKIAEMGPVQWLATQKKAADKVVFLLSNDVNSVCDGTCGKSEGSPSENSQDLFPLAFNLFCSDLRSQIHLHKYVVVYFREIDTKDDYNALSVCPKYHLMKDATAFCAELLHVKQQVSAGKRSQACHDGCCSL

SEQ ID NO: 865140 - protein, 209 aa, Homo sapiens [sequence omitted]

SEQ ID NO: 865141 - protein, 330 aa, Homo sapiens
RSVRVAWIPRSGPAMSLVLLSLAALCRSAVPREPTVQCGSETGPSPEWMLQHDLIPGDLRDLRVEPVTTSVATGDYSILMNVSWVLRADASIRLLKATKICVTGKSNFQSYSCVRCNYTEAFQTQTRPSGGKWTFSYIGFPVELNTVYFIGAHNIPNANMNEDGPSMSVNFTSPGCLDHIMKYKKKCVKAGSLWDPNITACKKNEETVEVNFTTTPLGNRYMALIQHSTIIGFSQVFEPHQKKQTRASVVIPVTGDSEGATVQLTPYFPTCGSDCIRHKGTVVLCPQTGVPFPLDNNKSKPGGWLPLLLLSLLVATWVLVAGIYLMWRHG

SEQ ID NO: 865142 - protein, 302 aa, Homo sapiens; identical to SEQ ID NO: 865137

SEQ ID NO: 865143 - protein, 357 aa, Homo sapiens [sequence omitted]

SEQ ID NO: 865144 - protein, 500 aa, Homo sapiens
RSVRVAWIPRSGPAMSLVLLSLAALCRSAVPREPTVQCGSETGPSPEWMLQHDLIPGDLRDLRVEPVTTSVATGDYSILMNVSWVLRADASIRLLKATKICVTGKSNFQSYSCVRCNYTEAFQTQTRPSGGKWTFSYIGFPVELNTVYFIGAHNIPNANMNEDGPSMSVNFTSPGSLWDPNITACKKNEETVEVNFTTTPLGNRYMALIQHSTIIGFSQVFEPHQKKQTRASVVIPVTGDSEGATVQLTPYFPTCGSDCIRHKGTVVLCPQTGVPFPLDNNKSKPGGWLPLLLLSLLVATWVLVAGIYLMWRHERIKKTSFSTTTLLPPIKVLVVYPSEICFHHTICYFTEFLQNHCRSEVILEKWQKKKIAEMGPVQWLATQKKAADKVVFLLSNDVNSVCDGTCGKSEGSPSENSQDLFPLAFNLFCSDLRSQIHLHKYVVVYFREIDTKDDYNALSVCPKYHLMKDATAFCAELLHVKQQVSAGKRSQACHDGCCSL

SEQ ID NO: 865145 - protein, 368 aa, Homo sapiens
RSVRVAWIPRSGPAMSLVLLSLAALCRSAVPREPTVQCGSETGPSPEWMLQHDLIPGDLRDLRVEPVTTSVATGDYSILMNVSWVLRADASIRLLKATKICVTGKSNFQSYSCVRCNYTEAFQTQTRPSGGKWTFSYIGFPVELNTVYFIGAHNIPNANMNEDGPSMSVNFTSPGCLDHIMKYKKKCVKAGSLWDPNITACKKNEETVEVNFTTTPLGNRYMALIQHSTIIGFSQVFEPHQKKQTRASVVIPVTGDSEGATVQLTPYFPTCGSDCIRHKGTVVLCPQTGVPFPLDNNKSKPGGWLPLLLLSLLVATWVLVAGIYLMWRHVLWFTHLKYVSITQFVTSLNFFKTIAEVRSSLKSGRKRK

SEQ ID NO: 865146 - protein, 682 aa, Homo sapiens
GTKVSERRRQNPGRGQGEGLWGRDLSPAPTRSLESRRPDTQRPDQELTGSWGHGPRSTLVRAKAMAPPPPPLAASTPLLHGEFGSYPARGPRFALTLTSQALHIQRLRPKPEARPRGGLVPLAEVSGCCTLRSRSPSDSAAYFCIYTYPRGRRGARRRATRTFRADGAATYEENRAEAQRWATALTCLLRGLPLPGDGEITPDLLPRPPRLLLLVNPFGGRGLAWQWCKNHVLPMISEAGLSFNLIQTERQNHARELVQGLSLSEWDGIVTVSGDGLLHEVLNGLLDRPDWEEAVKMPVGILPCGSGNALAGAVNQHGGFEPALGLDLLLNCSLLLCRGGGHPLDLLSVTLASGSRCFSFLSVAWGFVSDVDIQSERFRALGSARFTLGTVLGLATLHTYRGRLSYLPATVEPASPTPAHSLPRAKSELTLTPDPAPPMAHSPLHRSVSDLPLPLPQPALASPGSPEPLPILSLNGGGPELAGDWGGAGDAPLSPDPLLSSPPGSPKAALHSPVSEGAPVIPPSSGLPLPTPDARVGASTCGPPDHLLPPLGTPLPPDWVTLEGDFVLMLAISPSHLGADLVAAPHARFDDGLVHLCWVRSGISRAALLRLFLAMERGSHFSLGCPQLGYAAARAFRLEPLTPRGVLTVDGEQVEYGPLQAQMHPGIGTLLTGPPGCPGREP

SEQ ID NO: 865147 - protein, 654 aa, Homo sapiens
MNGHLEAEEQQDQRPDQELTGSWGHGPRSTLVRAKAMAPPPPPLAASTPLLHGEFGSYPARGPRFALTLTSQALHIQRLRPKPEARPRGGLVPLAEVSGCCTLRSRSPSDSAAYFCIYTYPRGRRGARRRATRTFRADGAATYEENRAEAQRWATALTCLLRGLPLPGDGEITPDLLPRPPRLLLLVNPFGGRGLAWQWCKNHVLPMISEAGLSFNLIQTERQNHARELVQGLSLSEWDGIVTVSGDGLLHEVLNGLLDRPDWEEAVKMPVGILPCGSGNALAGAVNQHGGFEPALGLDLLLNCSLLLCRGGGHPLDLLSVTLASGSRCFSFLSVAWGFVSDVDIQSERFRALGSARFTLGTVLGLATLHTYRGRLSYLPATVEPASPTPAHSLPRAKSELTLTPDPAPPMAHSPLHRSVSDLPLPLPQPALASPGSPEPLPILSLNGGGPELAGDWGGAGDAPLSPDPLLSSPPGSPKAALHSPVSEGAPVIPPSSGLPLPTPDARVGASTCGPPDHLLPPLGTPLPPDWVTLEGDFVLMLAISPSHLGADLVAAPHARFDDGLVHLCWVRSGISRAALLRLFLAMERGSHFSLGCPQLGYAAARAFRLEPLTPRGVLTVDGEQVEYGPLQAQMHPGIGTLLTGPPGCPGREP

SEQ ID NO: 865148 - protein, 654 aa, Homo sapiens; identical to SEQ ID NO: 865147

SEQ ID NO: 865149 - protein, 654 aa, Homo sapiens; identical to SEQ ID NO: 865147

SEQ ID NO: 865150 - protein, 685 aa, Homo sapiens
MNGHLEAEEQQDQRPDQELTGSWGHGPRSTLVRAKAMAPPPPPLAASTPLLHGEFGSYPARGPRFALTLTSQALHIQRLRPKPEARPRGGLVPLAEVSGCCTLRSRSPSDSAAYFCIYTYPRGRRGARRRATRTFRADGAATYEENRAEAQRWATALTCLLRGLPLPGDGEITPDLLPRPPRLLLLVNPFGGRGLAWQWCKNHVLPMISEAGLSFNLIQTERQNHARELVQGLSLSEWDGIVTVSGDGLLHEVLNGLLDRPDWEEAVKMPVGILPCGSGNALAGAVNQHGGFEPALGLDLLLNCSLLLCRGGGHPLDLLSVTLASGSRCFSFLSVAWGFVSDVDIQSERFRALGSARFTLGTVLGLATLHTYRGRLSYLPATVEPASPTPAHSLPRAKSELTLTPDPAPPMAHSPLHRSVSDLPLPLPQPALASPGSPEPLPILSLNGGGPELAGDWGGAGDAPLSPDPLLSSPPGSPKAALHSPVSEGAPVIPPSSGLPLPTPDARVGASTCGPPDHLLPPLGTPLPPDWVTLEGDFVLMLAISPSHLGADLVAAPHARFDDGLVHLCWVRSGISRAALLRLFLAMERGSHFSLGCPQLGYAAARAFRLEPLTPRGVLTVDGEQVEYGPLQAQMHPGIGTLLTGPPGCPGRDCARFHGTRRDAGRWASSRLKRNGLVPRVVPDQ

SEQ ID NO: 865151 - protein, 789 aa, Homo sapiens
MNGHLEAEEQQDQRPDQELTGSWGHGPRSTLVRAKAMAPPPPPLAASTPLLHGEFGSYPARGPRFALTLTSQALHIQRLRPKPEARPRGGLVPLAEVSGCCTLRSRSPSDSAAYFCIYTYPRGRRGARRRATRTFRADGAATYEENRAEAQRWATALTCLLRGLPLPGDGEITPDLLPRPPRLLLLVNPFGGRGLAWQWCKNHVLPMISEAGLSFNLIQTERQNHARELVQGLSLSEWDGIVTVSGDGLLHEVLNGLLDRPDWEEAVKMPVGILPCGSGNALAGAVNQHGGQVEDTTKGGMSPSWGDRDPYISHSAKPTVSQVNQPACGMLTPSSWTFLPACFPAVSRAPRTLPGMGGSSVNCREQMKDDQEPGPVRSRLEVAPRLWWAWAMAFVVSLPAAFLPVSFPNPCLLLPSVCPSISGCEGFEPALGLDLLLNCSLLLCRGGGHPLDLLSVTLASGSRCFSFLSVAWGFVSDVDIQSERFRALGSARFTLGTVLGLATLHTYRGRLSYLPATVEPASPTPAHSLPRAKSELTLTPDPAPPMAHSPLHRSVSDLPLPLPQPALASPGSPEPLPILSLNGGGPELAGDWGGAGDAPLSPDPLLSSPPGSPKAALHSPVSEGAPVIPPSSGLPLPTPDARVGASTCGPPDHLLPPLGTPLPPDWVTLEGDFVLMLAISPSHLGADLVAAPHARFDDGLVHLCWVRSGISRAALLRLFLAMERGSHFSLGCPQLGYAAARAFRLEPLTPRGVLTVDGEQVEYGPLQAQMHPGIGTLLTGPPGCPGREP

SEQ ID NO: 865152 - protein, 423 aa, Homo sapiens
MKDDQEPGPVRSRLEVAPRLWWAWAMAFVVSLPAAFLPVSFPNPCLLLPSVCPSISGCEGFEPALGLDLLLNCSLLLCRGGGHPLDLLSVTLASGSRCFSFLSVAWGFVSDVDIQSERFRALGSARFTLGTVLGLATLHTYRGRLSYLPATVEPASPTPAHSLPRAKSELTLTPDPAPPMAHSPLHRSVSDLPLPLPQPALASPGSPEPLPILSLNGGGPELAGDWGGAGDAPLSPDPLLSSPPGSPKAALHSPVSEGAPVIPPSSGLPLPTPDARVGASTCGPPDHLLPPLGTPLPPDWVTLEGDFVLMLAISPSHLGADLVAAPHARFDDGLVHLCWVRSGISRAALLRLFLAMERGSHFSLGCPQLGYAAARAFRLEPLTPRGVLTVDGEQVEYGPLQAQMHPGIGTLLTGPPGCPGREP

SEQ ID NO: 865153 - protein, 587 aa, Homo sapiens
MQFLRALHIQRLRPKPEARPRGGLVPLAEVSGCCTLRSRSPSDSAAYFCIYTYPRGRRGARRRATRTFRADGAATYEENRAEAQRWATALTCLLRGLPLPGDGEITPDLLPRPPRLLLLVNPFGGRGLAWQWCKNHVLPMISEAGLSFNLIQTERQNHARELVQGLSLSEWDGIVTVSGDGLLHEVLNGLLDRPDWEEAVKMPVGILPCGSGNALAGAVNQHGGFEPALGLDLLLNCSLLLCRGGGHPLDLLSVTLASGSRCFSFLSVAWGFVSDVDIQSERFRALGSARFTLGTVLGLATLHTYRGRLSYLPATVEPASPTPAHSLPRAKSELTLTPDPAPPMAHSPLHRSVSDLPLPLPQPALASPGSPEPLPILSLNGGGPELAGDWGGAGDAPLSPDPLLSSPPGSPKAALHSPVSEGAPVIPPSSGLPLPTPDARVGASTCGPPDHLLPPLGTPLPPDWVTLEGDFVLMLAISPSHLGADLVAAPHARFDDGLVHLCWVRSGISRAALLRLFLAMERGSHFSLGCPQLGYAAARAFRLEPLTPRGVLTVDGEQVEYGPLQAQMHPGIGTLLTGPPGCPGREP

SEQ ID NO: 865154 - protein, 169 aa, Homo sapiens
KNLFNKRVGSRLVFVASAGPSASGTLELPALGADVGFGVAVRGSWGLADMPVHLSALARTGEQDSATALRGVQGQLVESEDLAPCPEDAAAGPAGHAQCTYLQFGYLLNPHIISYGPHNHGRLVFPARKLHLPDHPGKGQRRPVGATHKQPLQHNLVECGVGSSGQKPV

SEQ ID NO: 865155 - protein, 124 aa, Homo sapiens
ALGLGNVRGRTGRWLGGAVGNKGERKEEAESGQRAGRGPVGKGPQSCSHPLPGEQAARHPGQCSGTSSWPLPLAGARMWLLSDPVVPVISLLSSCLHACLVPLLFALPSTLSCLSRWGEKVLLS

SEQ ID NO: 865156 - protein, 387 aa, Homo sapiens
VLTCGTAWRRTRRRPDQELTGSWGHGPRSTLVRAKAMAPPPPPLAASTPLLHGEFGSYPARGPRFALTLTSQALHIQRLRPKPEARPRGGLVPLAEVSGCCTLRSRSPSDSAAYFCIYTYPRGRRGARRRATRTFRADGAATYEENRAEAQRWATALTCLLRGLPLPGDGEITPDLLPRPPRLLLLVNPFGGRGLAWQWCKNHVLPMISEAGLSFNLIQTERQNHARELVQGLSLSEWDGIVTVSGDGLLHEVLNGLLDRPDWEEAVKMPVGILPCGSGNALAGAVNQHGGPREDSDSSTSSSACPLWTTARSCPRAAASMPGSCPLLPQQLALGFSRFIQDRVNGGGGRIGSLTCRGHTQRTLPAPAREGGGSLFLKNINVFICII

SEQ ID NO: 865157 - protein, 654 aa, Homo sapiens; identical to SEQ ID NO: 865147

SEQ ID NO: 865158 - protein, 387 aa, Homo sapiens
MNGHLEAEEQQDQRPDQELTGSWGHGPRSTLVRAKAMAPPPPPLAASTPLLHGEFGSYPARGPRFALTLTSQALHIQRLRPKPEARPRGGLVPLAEVSGCCTLRSRSPSDSAAYFCIYTYPRGRRGARRRATRTFRADGAATYEENRAEAQRWATALTCLLRGLPLPGDGEITPDLLPRPPRLLLLVNPFGGRGLAWQWCKNHVLPMISEAGLSFNLIQTERQNHARELVQGLSLSEWDGIVTVSGDGLLHEVLNGLLDRPDWEEAVKMPVGILPCGSGNALAGAVNQHGGPREDSDSSTSSSACPLWTTARSCPRAAASMPGSCPLLPQQLALGFSRFIQDRVNGGGGRIGSLTCRGHTQRTLPAPAREGGGSLFLKNINVFICII

SEQ ID NO: 865159 - protein, 448 aa, Homo sapiens
MISEAGLSFNLIQTERQNHARELVQGLSLSEWDGIVTVSGDGLLHEVLNGLLDRPDWEEAVKMPVGILPCGSGNALAGAVNQHGGFEPALGLDLLLNCSLLLCRGGGHPLDLLSVTLASGSRCFSFLSVAWGFVSDVDIQSERFRALGSARFTLGTVLGLATLHTYRGRLSYLPATVEPASPTPAHSLPRAKSELTLTPDPAPPMAHSPLHRSVSDLPLPLPQPALASPGSPEPLPILSLNGGGPELAGDWGGAGDAPLSPDPLLSSPPGSPKAALHSPVSEGAPVIPPSSGLPLPTPDARVGASTCGPPDHLLPPLGTPLPPDWVTLEGDFVLMLAISPSHLGADLVAAPHARFDDGLVHLCWVRSGISRAALLRLFLAMERGSHFSLGCPQLGYAAARAFRLEPLTPRGVLTVDGEQVEYGPLQAQMHPGIGTLLTGPPGCPGREP

SEQ ID NO: 865160 - protein, 220 aa, Homo sapiens
MASLAPTQPEAHALPSPLHRRPCTYSGCAPNLKPGPGVAWSRWPRSQAAAPCEAAAPQTQRPTSASTPTPDARVGASTCGPPDHLLPPLGTPLPPDWVTLEGDFVLMLAISPSHLGADLVAAPHARFDDGLVHLCWVRSGISRAALLRLFLAMERGSHFSLGCPQLGYAAARAFRLEPLTPRGVLTVDGEQVEYGPLQAQMHPGIGTLLTGPPGCPGREP

SEQ ID NO: 865161 - protein, 169 aa, Homo sapiens; identical to SEQ ID NO: 865154

SEQ ID NO: 865162 - protein, 423 aa, Homo sapiens [sequence omitted]

SEQ ID NO: 865163 - protein, 70 aa, Homo sapiens
MITKFKYDTNRKFWPSKAKEILGTRAISCGGDVPPPSGLPACSLPAEGLSRTPLVLAAPSPLLVPPQTPG

SEQ ID NO: 865164 - protein, 447 aa, Homo sapiens
QPGSWTWLRQWVERGSQPQPEVSEMLPPQKKPWESMAKGLVLGALFTSFLLLMYSYAVPPLHAGLASTTPEAAASCSPPALEPEAVIRANGSAGECQPRRNIVFLKTHKTASSTLLNILFRFGQKHRLKFAFPNGRNDFDYPTFFARSLVQDYRPGACFNIICNHMRFHYDEVRGLVPTNAIFITVLRDPARLFESSFHYFGPVVPLTWKLSAGDKLTEFLQDPDRYYDPNGFNAHYLRNLLFFDLGYDNSLDPSSPQVQEHILEVERRFHLVLLQEYFDESLVLLKDLLCWELEDVLYFKLNARRDSPVPRLSGELYGRATAWNMLDSHLYRHFNASFWRKVEAFGRERMAREVAALRHANERMRTICIDGGHAVDAAAIQDEAMQPWQPLGTKSILGYNLKKSIGQRHAQLCRRMLTPEIQYLMDLGANLWVTKLWKFIRDFLRW

SEQ ID NO: 865165 - protein, 423 aa, Homo sapiens [sequence omitted]

SEQ ID NO: 865166 - protein, 412 aa, Homo sapiens
MAKGLVLGALFTSFLLLMYSYAVPPLHAGLASTTPEAAASCSPPALEPEAVIRANGSAGECQPRRNIVFLKTHKTASSTLLNILFRFGQKHRLKFAFPNGRNDFDYPTFFARSLVQDYRPGACFNIICNHMRFHYDEVRGLVPTNAIFITVLRDPARLFESSFHYFGPVVPLTWKLSAGDKLTEFLQDPDRYYDPNGFNAHYLRNLLFFDLGYDNSLDPSSPQVQEHILEVERRFHLVLLQEYFDESLVLLKDLLCWELEDVLYFKLNARRDSPVPRLSGELYGRATAWNMLDSHLYRHFNASFWRKVEAFGRERMAREVAALRHANERMRTICIDGGHAVDAAAIQDEAMQPWQPLGTKSILGYNLKKSIGQRHAQLCRRMLTPEIQYLMDLGANLWVTKLWKFIRDFLRW

SEQ ID NO: 865167 - protein, 433 aa, Homo sapiens
LIPEGTLVSEMLPPQKKPWESMAKGLVLGALFTSFLLLMYSYAVPPLHAGLASTTPEAAASCSPPALEPEAVIRANGSAGECQPRRNIVFLKTHKTASSTLLNILFRFGQKHRLKFAFPNGRNDFDYPTFFARSLVQDYRPGACFNIICNHMRFHYDEVRGLVPTNAIFITVLRDPARLFESSFHYFGPVVPLTWKLSAGDKLTEFLQDPDRYYDPNGFNAHYLRNLLFFDLGYDNSLDPSSPQVQEHILEVERRFHLVLLQEYFDESLVLLKDLLCWELEDVLYFKLNARRDSPVPRLSGELYGRATAWNMLDSHLYRHFNASFWRKVEAFGRERMAREVAALRHANERMRTICIDGGHAVDAAAIQDEAMQPWQPLGTKSILGYNLKKSIGQRHAQLCRRMLTPEIQYLMDLGANLWVTKLWKFIRDFLRW

SEQ ID NO: 865168 - protein, 443 aa, Homo sapiens
RGPGRASHAEAEEDGDKVSEMLPPQKKPWESMAKGLVLGALFTSFLLLMYSYAVPPLHAGLASTTPEAAASCSPPALEPEAVIRANGSAGECQPRRNIVFLKTHKTASSTLLNILFRFGQKHRLKFAFPNGRNDFDYPTFFARSLVQDYRPGACFNIICNHMRFHYDEVRGLVPTNAIFITVLRDPARLFESSFHYFGPVVPLTWKLSAGDKLTEFLQDPDRYYDPNGFNAHYLRNLLFFDLGYDNSLDPSSPQVQEHILEVERRFHLVLLQEYFDESLVLLKDLLCWELEDVLYFKLNARRDSPVPRLSGELYGRATAWNMLDSHLYRHFNASFWRKVEAFGRERMAREVAALRHANERMRTICIDGGHAVDAAAIQDEAMQPWQPLGTKSILGYNLKKSIGQRHAQLCRRMLTPEIQYLMDLGANLWVTKLWKFIRDFLRW

SEQ ID NO: 865169 - protein, 247 aa, Homo sapiens
MAKGLVLGALFTSFLLLMYSYAVPPLHAGLASTTPEAAASCSPPALEPEAVIRANGSAGECQPRRNIVFLKTHKTASSTLLNILFRFGQKHRLKFAFPNGRNDFDYPTFFARSLVQDYRPGACFNIICNHMRFHVNASFWRKVEAFGRERMAREVAALRHANERMRTICIDGGHAVDAAAIQDEAMQPWQPLGTKSILGYNLKKSIGQRHAQLCRRMLTPEIQYLMDLGANLWVTKLWKFIRDFLRW

SEQ ID NO: 865170 - protein, 322 aa, Homo sapiens
PARMATEGEAARPGLEGDLALPRVPAMATSSAALPRILGAGARAPSRWLGFLGKATPRPARPSRRTLGSATALMIRESEDSTDFNDKILNEPLKHSDFFNVKELFSVRSLFDARVHLGHKAGCRHRFMEPYIFGSRLDHDIIDLEQTATHLQLALNFTAHMAYRKGIILFISRNRQFSYLIENMARDCGEYAHTRYFRGGMLTNARLLFGPTVRLPDLIIFLHTLNNIFEPHVAVRDAAKMNIPTVGIVDTNCNPCLITYPVPGNDDSPLAVHLYCRLFQTAITRAKEKRQQVEALYRLQGQKEPGDQGPAHPPGADMSHSL

SEQ ID NO: 865171 - protein, 128 aa, Homo sapiens
PARMATEGEAARPGLEGDLALPRVPAMATSSAALPRILGAGARAPSRWLGFLGKATPRPARPSRRTLGSATALMIRESEDSTDFNDKILNEPLKHSDFFNVKELFSVRSLFDARVHLGHKAGCRHSFR

SEQ ID NO: 865172 - protein, 249 aa, Homo sapiens [sequence omitted]

SEQ ID NO: 865173 - protein, 322 aa, Homo sapiens; identical to SEQ ID NO: 865170

SEQ ID NO: 865174 - protein, 211 aa, Homo sapiens
MSFWRHVGCPHIHMGFMEPYIFGSRLDHDIIDLEQTATHLQLALNFTAHMAYRKGIILFISRNRQFSYLIENMARDCGEYAHTRYFRGGMLTNARLLFGPTVRLPDLIIFLHTLNNIFEPHVAVRDAAKMNIPTVGIVDTNCNPCLITYPVPGNDDSPLAVHLYCRLFQTAITRAKEKRQQVEALYRLQGQKEPGDQGPAHPPGADMSHSL

SEQ ID NO: 865175 - protein, 125 aa, Homo sapiens
PARMATEGEAARPGLEGDLALPRVPAMATSSAALPRILGAGARAPSRWLGFLGKATPRPARPSRRTLGSATALMIRESEDSTDFNDKILNEPLKHSDFFNVKELFSVRSLFDARVHLGWWDSQAR

SEQ ID NO: 865176 - protein, 322 aa, Homo sapiens; identical to SEQ ID NO: 865170

SEQ ID NO: 865177 - protein, 304 aa, Homo sapiens
MRWGAGVVHSGLGARTSIYFPPGARAPSRWLGFLGKATPRPARPSRRTLGSATALMIRESEDSTDFNDKILNEPLKHSDFFNVKELFSVRSLFDARVHLGHKAGCRHRFMEPYIFGSRLDHDIIDLEQTATHLQLALNFTAHMAYRKGIILFISRNRQFSYLIENMARDCGEYAHTRYFRGGMLTNARLLFGPTVRLPDLIIFLHTLNNIFEPHVAVRDAAKMNIPTVGIVDTNCNPCLITYPVPGNDDSPLAVHLYCRLFQTAITRAKEKRQQVEALYRLQGQKEPGDQGPAHPPGADMSHSL

SEQ ID NO: 865178 - protein, 195 aa, Homo sapiens [sequence omitted]

SEQ ID NO: 865179 - protein, 389 aa, Homo sapiens
PARMATEGEAARPGLEGDLALPRVPAMATSSAALPRILGAGARAPSRWLGFLGKATPRPARPSRRTLGSATALMIRESEDSTGNTGRPAELGGNEERPAAAGDANPRGAWALHAVETARSAGLLPLPCSPPLGPAYVAQRAEATASPWKDFNDKILNEPLKHSDFFNVKELFSVRSLFDARVHLGHKAGCRHRFMEPYIFGSRLDHDIIDLEQTATHLQLALNFTAHMAYRKGIILFISRNRQFSYLIENMARDCGEYAHTRYFRGGMLTNARLLFGPTVRLPDLIIFLHTLNNIFEPHVAVRDAAKMNIPTVGIVDTNCNPCLITYPVPGNDDSPLAVHLYCRLFQTAITRAKEKRQQVEALYRLQGQKEPGDQGPAHPPGADMSHSL

SEQ ID NO: 865180 - protein, 217 aa, Homo sapiens
VTEMVKTRGDLGDITSLVPTRFMEPYIFGSRLDHDIIDLEQTATHLQLALNFTAHMAYRKGIILFISRNRQFSYLIENMARDCGEYAHTRYFRGGMLTNARLLFGPTVRLPDLIIFLHTLNNIFEPHVAVRDAAKMNIPTVGIVDTNCNPCLITYPVPGNDDSPLAVHLYCRLFQTAITRAKEKRQQVEALYRLQGQKEPGDQGPAHPPGADMSHSL

SEQ ID NO: 865181 - protein, 322 aa, Homo sapiens; identical to SEQ ID NO: 865170

SEQ ID NO: 865182 - protein, 86 aa, Homo sapiens
INPFFPRSPPDRRRAAIMDTSRVQPIKLARVTKVLGRTGSQGQCTQVRVEFMDDTSRSIIRNVKGPVREGDVLTLLESEREARRLR

SEQ ID NO: 865183 - protein, 94 aa, Homo sapiens
NSRPRRHGCERRQKGSPPDRRRAAIMDTSRVQPIKLARVTKVLGRTGSQGQCTQVRVEFMDDTSRSIIRNVKGPVREGDVLTLLESEREARRLR

SEQ ID NO: 865184 - protein, 81 aa, Homo sapiens
WYGRGEDRRAAIMDTSRVQPIKLARVTKVLGRTGSQGQCTQVRVEFMDDTSRSIIRNVKGPVREGDVLTLLESEREARRLR

SEQ ID NO: 865185 - protein, 76 aa, Homo sapiens
WIRIRIQPDQRRVQPIKLARVTKVLGRTGSQGQCTQVRVEFMDDTSRSIIRNVKGPVREGDVLTLLESEREARRLR

SEQ ID NO: 865186 - protein, 120 aa, Homo sapiens
LLLLNSRPRRPLASLIGCTRLVSAYQAGQGHQGPGQDRFSGTVHAGARGIHGRHEPIHHPQCKRPRARGRRAHPFGVRARSPEVALSLAARWVLDVGFDHLADGNGLSQSAPFFLSATRN

SEQ ID NO: 865187 - protein, 107 aa, Homo sapiens
FSTCLVPSGFSRTTAFTMKLHELSQFKLGLLQHFYFSNASLPIRHEIKLARVTKVLGRTGSQGQCTQVRVEFMDDTSRSIIRNVKGPVREGDVLTLLESEREARRLR

SEQ ID NO: 865188 - protein, 92 aa, Homo sapiens
ESEIYADEYDSEMDFGDRRRAAIMDTSRVQPIKLARVTKVLGRTGSQGQCTQVRVEFMDDTSRSIIRNVKGPVREGDVLTLLESEREARRLR

SEQ ID NO: 865189 - protein, 87 aa, Homo sapiens
AFREPVMSLRQYRRRAAIMDTSRVQPIKLARVTKVLGRTGSQGQCTQVRVEFMDDTSRSIIRNVKGPVREGDVLTLLESEREARRLR

SEQ ID NO: 865190 - protein, 134 aa, Homo sapiens
GNWPSCNAKVTFLLSPALTMWRVVTEPPCIEDILIQVAFSSMVTIFNIITTTTITPHSDRRRAAIMDTSRVQPIKLARVTKVLGRTGSQGQCTQVRVEFMDDTSRSIIRNVKGPVREGDVLTLLESEREARRLR

SEQ ID NO: 865191 - protein, 81 aa, Homo sapiens; identical to SEQ ID NO: 865184

SEQ ID NO: 865192 - protein, 81 aa, Homo sapiens; identical to SEQ ID NO: 865184

SEQ ID NO: 865193 - protein, 94 aa, Homo sapiens; identical to SEQ ID NO: 865183

SEQ ID NO: 865194 - protein, 94 aa, Homo sapiens; identical to SEQ ID NO: 865183

SEQ ID NO: 865195 - protein, 117 aa, Homo sapiens
MVPFNDLYSGPDTFSEFISASHSAVPFRGPPLLLPPLRWGPVGARGIHGRHEPIHHPQCKRPRARGRRAHPFGVRARSPEVALSLAARWVLDVGFDHLADGNGLSQSAPFFLSATRN

SEQ ID NO: 865196 - protein, 134 aa, Homo sapiens; identical to SEQ ID NO: 865190

SEQ ID NO: 865197 - protein, 78 aa, Homo sapiens
IRGGALLLLLDHGLYQPIKLARVTKVLGRTGSQGQCTQVRVEFMDDTSRSIIRNVKGPVREGDVLTLLESEREARRLR

SEQ ID NO: 865198 - protein, 93 aa, Homo sapiens
AAAYYYYTARIQASNDVRGARGIHGRHEPIHHPQCKRPRARGRRAHPFGVRARSPEVALSLAARWVLDVGFDHLADGNGLSQSAPFFLSATRN

SEQ ID NO: 865199 - protein, 86 aa, Homo sapiens; identical to SEQ ID NO: 865182

SEQ ID NO: 865200 - protein, 92 aa, Homo sapiens; identical to SEQ ID NO: 865188

SEQ ID NO: 865201 - protein, 212 aa, Homo sapiens
MVIDVRHGTLVPVVVLESRRREELAEASEGKPLGSGLLNWFDCDVSFSLLFCHRGPHCNILRDVSPTVTPRSCSPFRTFLDGRPSPFLKSSLARLRVSAQDLDRPDMAAAGNGGGRGTAPQTPGVARLSSARQAPAQHRRAAIMDTSRVQPIKLARVTKVLGRTGSQGQCTQVRVEFMDDTSRSIIRNVKGPVREGDVLTLLESEREARRLR

SEQ ID NO: 865202 - protein, 72 aa, Homo sapiens
AYGKALPYADAYGKAKVTKVLGRTGSQGQCTQVRVEFMDDTSRSIIRNVKGPVREGDVLTLLESEREARRLR

SEQ ID NO: 865203 - protein, 94 aa, Homo sapiens; identical to SEQ ID NO: 865183

SEQ ID NO: 865204 - protein, 94 aa, Homo sapiens; identical to SEQ ID NO: 865183

SEQ ID NO: 865205 - protein, 86 aa, Homo sapiens; identical to SEQ ID NO: 865182

SEQ ID NO: 865206 - protein, 91 aa, Homo sapiens
VSSRGSLMRFSGTVHAGARGIHGRHEPIHHPQCKRPRARGRRAHPFGVRARSPEVALSLAARWVLDVGFDHLADGNGLSQSAPFFLSATRN

SEQ ID NO: 865207 - protein, 117 aa, Homo sapiens; identical to SEQ ID NO: 865195

SEQ ID NO: 865208 - protein, 112 aa, Homo sapiens
MVPFNDLYSGPDTFSEFISASHSAVPFRGPPLLLPPLRWGPVGARGIHGRHEPIHHPQCKRPRARGRRAHPFGVRARSPEVALSLAARWWVQRGHPFDRPLVGGREASLSPG

SEQ ID NO: 865209 - protein, 287 aa, Homo sapiens
ARKRSSPGLYPAQLGAAASSGVVSPPGMGLLDLCEEVFGTADLYRVLGVRREASDGEVRRGYHKVSLQVHPDRVGEGDKEDATRRFQILGKVYSVLSDREQRAVYDEQGTVDEDSPVLTQDRDWEAYWRLLFKKISLEDIQAFEKTYKGSEEELADIKQAYLDFKGDMDQIMESVLCVQYTEEPRIRNIIQQAIDAGEVPSYNAFVKESKQKMNARKRRAQEEAKEAEMSRKELGLDEGVDSLKAAIQSRQKDRQKEMDNFLAQMEAKYCKSSKGGGKKSALKKEKK

SEQ ID NO: 865210 - protein, 80 aa, Homo sapiens
YGSPTMVARKRRAQEEAKEAEMSRKELGLDEGVDSLKAAIQSRQKDRQKEMDNFLAQMEAKYCKSSKGGGKKSALKKEKK

SEQ ID NO: 865211 - protein, 287 aa, Homo sapiens; identical to SEQ ID NO: 865209

SEQ ID NO: 865212 - protein, 102 aa, Homo sapiens
RKRSSPGLYPAQLGAAASSGVVSPPGMGLLDLCEEVFGTADLYRVLGVRREASDGEVRRGYHKVSLQVHPDRVGEGDKEDATRRFQVCRVPPRSRPAARASP

SEQ ID NO: 865213 - protein, 287 aa, Homo sapiens; identical to SEQ ID NO: 865209

SEQ ID NO: 865214 - protein, 255 aa, Homo sapiens
ARKRSSPGLYPAQLGAAASSGVVSPPGMGLLDLCEEVFGTADLYRVLGVRREASDGEVRRGYHKVSLQVHPDRVGEGDKEDATRRFQILGKVYSVLSDREQRAVYDEQGTVDEDSPVLTQDRDWEAYWRLLFKKISLEDIQAFEKTYKGSEEELADIKQAYLDFKGDMDQIMESVLCVQYTEEPRIRNIIQQAIDAGEVPSYNAFVKESKQKMNARKRRAQEEAKEAEMSRKELGLDEGVDSLKAAIQVLASRLC

SEQ ID NO: 865215 - protein, 447 aa, Homo sapiens
MAAALKCLLTLGRWCPGLGVAPQARALAALVPGVTQVDNKSGFLQKRPHRQHPGILKLPHVRLPQALANGAQLLLLGSAGPTMENQVQTLTSYLWSRHLPVEPEELQRRARHLEKKFLENPDLSQTEEKLRGAVLHALRKTTYHWQELSYTEGLSLVYMAARLDGGFAAVSRAFHEIRARNPAFQPQTLMDFGSGTGSVTWAAHSIWGQSLREYMCVDRSAAMLVLAEKLLKGGSESGEPYIPGVFFRQFLPVSPKVQFDVVVSAFSLSELPSKADRTEVVQTLWRKTGHFLVLVENGTKAGHSLLMDARDLVLKGKEKSPLDPRPGFVFAPCPHELPCPQLTNLACSFSQAYHPIPFSWNKKPKEEKFSMVILARGSPEEAHRWPRITQPVLKRPRHVHCHLCCPDGHMQHAVLTARRHGSSWGDLLPVLTPSAFPPSTAQDPSES

SEQ ID NO: 865216 - protein, 158 aa, Homo sapiens
MAAALKCLLTLGRWCPGLGVAPQARALAALVPGVTQVDNKSGFLQKRPHRQHPGILKLPHVRLPQALANGAQLLLLGSAGPTMENQVQTLTSYLWSRHLPVEPEELQRRARHLEKKFLENPGPDFQSLFSPQTYLRQRRNFVEQCYTHYVKLPTIGKN

SEQ ID NO: 865217 - protein, 294 aa, Homo sapiens
MAAALKCLLTLGRWCPGLGVAPQARALAALVPGVTQVDNKSGFLQKRPHRQHPGILKLPHVRLPQALANGAQLLLLGSAGPTMENQVQTLTSYLWSRHLPVEPEELQRRARHLEKKFLENPDLSQTEEKLRGAVLHALRKTTYHWQELSYTEGLSLVYMAARLDGGFAAVSRAFHEIRARNPAFQPQTLMDFGSGTGSVTWAAHSIWGQSLREYMCVDRSAAMLVLAEKLLKGGSESGEPYIPGVFFRQFLPVSPKVQFDVVVSAFSLSELPSKADRTEVVQTLWRKTGHFLVS

SEQ ID NO: 865218 - protein, 461 aa, Homo sapiens
MAAALKCLLTLGRWCPGLGVAPQARALAALVPGVTQVDNKSGFLQKRPHRQHPGILKLPHVRLPQALANGAQLLLLGSAGPTMENQVQTLTSYLWSRHLPVEPEELQRRARHLEKKFLENPDLSQTEEKLRGAVLHALRKTTYHWQELSYTEGLSLVYMAARLDGGFAAVSRAFHEIRARNPAFQPQTLMDFGSGTGSVTWAAHSIWGQSLREYMCVDRSAAMLVLAEKLLKGGSESGEPYIPGVFFRQFLPVSPKVQFDVVVSAFSLSELPSKADRTEVVQTLWRKTGHFLVLVENGTKAGHSLLMDARDLVLKCPHELPCPQLTNLACSFSQAYHPIPFSWNKKPKEEKFSMVILARGSPEEAHRWPRITQPVLKRPRHVHCHLCCPDGHMQHAVLTARRHGRYGGCDQNQWDVAGSCSPRQHLFPQGFVSLCPCQLLGRSFTCAYSVCVSSIYGSGSL

SEQ ID NO: 865219 - protein, 494 aa, Homo sapiens
MVPRPWSGSPGPGECLHSLLSERLWICRDISAQRRSAPGSPRPSDCQQLSFLPGNQPTFLCLQALAALVPGVTQVDNKSGFLQKRPHRQHPGILKLPHVRLPQALANGAQLLLLGSAGPTMENQVQTLTSYLWSRHLPVEPEELQRRARHLEKKFLENPDLSQTEEKLRGAVLHALRKTTYHWQELSYTEGLSLVYMAARLDGGFAAVSRAFHEIRARNPAFQPQTLMDFGSGTGSVTWAAHSIWGQSLREYMCVDRSAAMLVLAEKLLKGGSESGEPYIPGVFFRQFLPVSPKVQFDVVVSAFSLSELPSKADRTEVVQTLWRKTGHFLVLVENGTKAGHSLLMDARDLVLKGKEKSPLDPRPGFVFAPCPHELPCPQLTNLACSFSQAYHPIPFSWNKKPKEEKFSMVILARGSPEEAHRWPRITQPVLKRPRHVHCHLCCPDGHMQHAVLTARRHGRDLYRCARVSSWGDLLPVLTPSAFPPSTAQDPSES

SEQ ID NO: 865220 - protein, 374 aa, Homo sapiens [sequence omitted]

SEQ ID NO: 865221 - protein, 158 aa, Homo sapiens
MAAALKCLLTLGRWCPGLGVAPQARALAALVPGVTQVDNKSGFLQKRPHRQHPGILKLPHVRLPQALANGAQLLLLGSAGPTMENQVQTLTSYLWSRHLPVEPEELQRRARHLEKKFLENPDLSQTEEKLRGAVLHALRKTTYHWQELSVPMNSLVPS

SEQ ID NO: 865222 - protein, 191 aa, Homo sapiens [sequence omitted]

SEQ ID NO: 865223 - protein, 108 aa, Homo sapiens
MVILARGSPEEAHRWPRITQPVLKRPRHVHCHLCCPDGHMQHAVLTARRHGRYGGCDQNQWDVAGSCSPRQHLFPQGFVSLCPCQLLGRSFTCAYSVCVSSIYGSGSL

SEQ ID NO: 865224 - protein, 232 aa, Homo sapiens
MAAALKCLLTLGRWCPGLGVAPQARALAALVPGVTQVDNKSGFLQKRPHRQHPGILKLPHVRLPQALANGAQLLLLGSAGPTMENQVQTLTSYLWSRHLPVEPEELQRRARHLEKKFLENPDLSQTEEKLRGAVLHALRKTTYHWQELSYTEGLSLVYMAARLDGGFAAVSRAFHEIRARNPAFQPQTLMDFGSGTGSVTWAAHSIWGQSLREYMCVDRSAAMLVLAEKLLK

SEQ ID NO: 865225 - protein, 154 aa, Homo sapiens
MAAALKCLLTLGRWCPGLGVAPQARALAALVPGVTQVDNKSGFLQKRPHRQHPGILKLPHVRLPQALANGAQLLLLGSAGPTMENQVQTLTSYLWSRHLPVEPEELQRRARHLEKKFLENPDLSQTEEKLRGAVLHALRKTTYHWQELRVDEDV

SEQ ID NO: 865226 - protein, 456 aa, Homo sapiens
MAAALKCLLTLGRWCPGLGVAPQARALAALVPGVTQVDNKSGFLQKRPHRQHPGILKLPHVRLPQALANGAQLLLLGSAGPTMENQVQTLTSYLWSRHLPVEPEELQRRARHLEKKFLENPDLSQTEEKLRGAVLHALRKTTYHWQELSYTEGLSLVYMAARLDGGFAAVSRAFHEIRARNPAFQPQTLMDFGSGTGSVTWAAHSIWGQSLREYMCVDRSAAMLVLAEKLLKGGSESGEPYIPGVFFRQFLPVSPKVQFDVVVSAFSLSELPSKADRTEVVQTLWRKTGHFLVLVENGTKAGHSLLMDARDLVLKGKEKSPLDPRPGFVFAPCPHELPCPQLTNLACSFSQAYHPIPFSWNKKPKEEKFSMVILARGSPEEAHRWPRITQPVLKRPRHVHCHLCCPDGHMQHAVLTARRHGRDLYRCARVSSWGDLLPVLTPSAFPPSTAQDPSES

SEQ ID NO: 865227 - protein, 478 aa, Homo sapiens
MAAALKCLLTLGRWCPGLGVAPQARALAALVPGVTQVDNKSGFLQKRPHRQHPGILKLPHVRLPQALANGAQLLLLGSAGPTMENQVQTLTSYLWSRHLPVEPEELQRRARHLEKKFLENPDLSQTEEKLRGAVLHALRKTTYHWQELSYTEGLSLVYMAARLDGGFAAVSRAFHEIRARNPAFQPQTLMDFGSGTGSVTWAAHSIWGQSLREYMCVDRSAAMLVLAEKLLKGGSESGEPYIPGVFFRQFLPVSPKVQFDVVVSAFSLSELPSKADRTEVVQTLWRKTGHFLVLVENGTKAGHSLLMDARDLVLKGKEKSPLDPRPGFVFAPCPHELPCPQLTNLACSFSQAYHPIPFSWNKKPKEEKFSMVILARGSPEEAHRWPRITQPVLKRPRHVHCHLCCPDGHMQHAVLTARRHGRYGGCDQNQWDVAGSCSPRQHLFPQGFVSLCPCQLLGRSFTCAYSVCVSSIYGSGSL

SEQ ID NO: 865228 - protein, 294 aa, Homo sapiens; identical to SEQ ID NO: 865217

SEQ ID NO: 865229 - protein, 344 aa, Homo sapiens
MAAALKCLLTLGRWCPGLGVAPQARALAALVPGVTQVDNKSGFLQKRPHRQHPGILKLPHVRLPQALANGAQLLLLGSAGPTMENQVQTLTSYLWSRHLPVEPEELQRRARHLEKKFLENPDLSQTEEKLRGAVLHALRKTTYHWQELSYTEGLSLVYMAARLDGGFAAVSRAFHEIRARNPAFQPQTLMDFGSGTGSVTWAAHSIWGQSLREYMCVDRSAAMLVLAEKLLKGGSESGEPYIPGVFFRQFLPVSPKVQFDVVVSAFSLSELPSKADRTEVVQTLWRKTGHFLVLVENGTKAGHSLLMDARDLVLKGKEKSPLDPRPGFVFAPVSITSACPTTRI

SEQ ID NO: 865230 - protein, 467 aa, Homo sapiens
MAAALKCLLTLGRWCPGLGVAPQARALAALVPGVTQVDNKSGFLQKRPHRQHPGILKLPHVRLPQALANGAQLLLLGSAGPTMENQVQTLTSYLWSRHLPVEPEELQRRARHLEKKFLENPGPDFQSLFLTTDLSQTEEKLRGAVLHALRKTTYHWQELSYTEGLSLVYMAARLDGGFAAVSRAFHEIRARNPAFQPQTLMDFGSGTGSVTWAAHSIWGQSLREYMCVDRSAAMLVLAEKLLKGGSESGEPYIPGVFFRQFLPVSPKVQFDVVVSAFSLSELPSKADRTEVVQTLWRKTGHFLVLVENGTKAGHSLLMDARDLVLKGKEKSPLDPRPGFVFAPCPHELPCPQLTNLACSFSQAYHPIPFSWNKKPKEEKFSMVILARGSPEEAHRWPRITQPVLKRPRHVHCHLCCPDGHMQHAVLTARRHGRDLYRCARVSSWGDLLPVLTPSAFPPSTAQDPSES

SEQ ID NO: 865231 - protein, 374 aa, Homo sapiens [sequence omitted]

SEQ ID NO: 865232 - protein, 349 aa, Homo sapiens
EACVRVGGVYRIPEREENEDDLSVARLNALSCITVHISQGLSYTEGLSLVYMAARLDGGFAAVSRAFHEIRARNPAFQPQTLMDFGSGTGSVTWAAHSIWGQSLREYMCVDRSAAMLVLAEKLLKGGSESGEPYIPGVFFRQFLPVSPKVQFDVVVSAFSLSELPSKADRTEVVQTLWRKTGHFLVLVENGTKAGHSLLMDARDLVLKGKEKSPLDPRPGFVFAPCPHELPCPQLTNLACSFSQAYHPIPFSWNKKPKEEKFSMVILARGSPEEAHRWPRITQPVLKRPRHVHCHLCCPDGHMQHAVLTARRHGRDLYRCARVSSWGDLLPVLTPSAFPPSTAQDPSES

SEQ ID NO: 865233 - protein, 240 aa, Homo sapiens
AGLVRKVLRRQFLPVSPKVQFDVVVSAFSLSELPSKADRTEVVQTLWRKTGHFLVLVENGTKAGHSLLMDARDLVLKGKEKSPLDPRPGFVFAPCPHELPCPQLTNLACSFSQAYHPIPFSWNKKPKEEKFSMVILARGSPEEAHRWPRITQPVLKRPRHVHCHLCCPDGHMQHAVLTARRHGRYGGCDQNQWDVAGSCSPRQHLFPQGFVSLCPCQLLGRSFTCAYSVCVSSIYGSGSL

SEQ ID NO: 865234 - protein, 180 aa, Homo sapiens
MAAALKCLLTLGRWCPGLGVAPQARALAALVPGVTQVDNKSGFLQKRPHRQHPGILKLPHVRLPQALANGAQLLLLGSAGPTMENQVQTLTSYLWSRHLPVEPEELQRRARHLEKKFLENPDLSQTEEKLRGAVLHALRKTTYHWQELSYTEGLSLVYMAARLDGGFAAVSRAFHEVKVP

SEQ ID NO: 865235 - protein, 104 aa, Homo sapiens
MAAALKCLLTLGRWCPGLGVAPQARALAALVPGVTQVDNKSGFLQKRPHRQHPGILKLPHVRLPQALANGAQLLLLASAGPAVANQALALRGWGGPPAGEPDGA

SEQ ID NO: 865236 - protein, 102 aa, Homo sapiens
MFLTMEAKKEDNLDLNQYFLHLNSPHHYGSKPDTEPNRNTFLQIQSCSPWKTLKPSVVAAGGLHQNAAIHLAAGGLHQNAAIHLCFCSTYKKCSLAHSRGQL

SEQ ID NO: 865237 - protein, 691 aa, Homo sapiens
AELREDLLAAVRSGGGRGRPAMIASCLCYLLLPATRLFRALSDAFFTCRKNVLLANSSSPQVEGDFAMAPRGPEQEECEGLLQQWREEGLSQVLSTASEGPLIDKGLAQSSLALLMDNPGEENAASEDRWSSRQLSDLRAAENLDEPFPEMLGEEPLLEVEGVEGSMWAAIPMQSEPQYADCAALPVGALATEQWEEDPAVLAWSIAPEPVPQEEASIWPFEGLGQLQPPAVEIPYHEILWREWEDFSTQPDAQGLKAGDGPQFQFTLMSYNILAQDLMQQSSELYLHCHPDILNWNYRFVNLMQEFQHWDPDILCLQEVQEDHYWEQLEPSLRMMGFTCFYKRRTGCKTDGCAVCYKPTRFRLLCASPVEYFRPGLELLNRDNVGLVLLLQPLVPEGLGQVSVAPLCVANTHILYNPRRGDVKLAQMAILLAEVDKVARLSDGSHCPIILCGDLNSVPDSPLYNFIRDGELQYHGMPAWKVSGQEDFSHQLYQRKLQAPLWPSSLGITDCCQYVTSCHPKRSERRKYGRDFLLRFRFCSIACQRPVGLVLMEGVTDTKPERPAGWAESVLEEDASELEPAFSRTVGTIQHCLHLTSVYTHFLPQRGRPEVTTMPLGLGMTVDYIFFSAESCENGNRTDHRLYRDGTLKLLGRLSLLSEEILWAANGLPNPFCSSDHLCLLASFGMEVTAP

SEQ ID NO: 865238 - protein, 691 aa, Homo sapiens; identical to SEQ ID NO: 865237

SEQ ID NO: 865239 - protein, 691 aa, Homo sapiens; identical to SEQ ID NO: 865237

SEQ ID NO: 865240 - protein, 624 aa, Homo sapiens [sequence omitted]

SEQ ID NO: 865241 - protein, 691 aa, Homo sapiens; identical to SEQ ID NO: 865237

SEQ ID NO: 865242 - protein, 691 aa, Homo sapiens; identical to SEQ ID NO: 865237

SEQ ID NO: 865243 - protein, 224 aa, Homo sapiens
MGEVRPVHGMPAWKVSGQEDFSHQLYQRKLQAPLWPSSLGITDCCQYVTSCHPKRSERRKYGRDFLLRFRFCSIACQRPVGLVLMEGVTDTKPERPAGWAESVLEEDASELEPAFSRTVGTIQHCLHLTSVYTHFLPQRGRPEVTTMPLGLGMTVDYIFFSAESCENGNRTDHRLYRDGTLKLLGRLSLLSEEILWAANGLPNPFCSSDHLCLLASFGMEVTAP

SEQ ID NO: 865244 - protein, 691 aa, Homo sapiens; identical to SEQ ID NO: 865237

SEQ ID NO: 865245 - protein, 691 aa, Homo sapiens; identical to SEQ ID NO: 865237

SEQ ID NO: 865246 - protein, 691 aa, Homo sapiens; identical to SEQ ID NO: 865237

SEQ ID NO: 865247 - protein, 189 aa, Homo sapiens
AELREDLLAAVRSGGGRGRPAMIASCLCYLLLPATRLFRALSDAFFTCRKNVLLANSSSPFRHSAAMTLRPPPSRCGGYDSLKVDNLTYRTSPDTLRRVFEKYGQRRRTCTSTRDRYTKESRRLRLRSLFTTKRDAEDAMDAMDRGRAGTDSELARMHNDSSIQATPQRITTTRQTGTDNHAKYTGAGG

SEQ ID NO: 865248 - protein, 691 aa, Homo sapiens; identical to SEQ ID NO: 865237

SEQ ID NO: 865249 - protein, 624 aa, Homo sapiens [sequence omitted]

SEQ ID NO: 865250 - protein, 691 aa, Homo sapiens; identical to SEQ ID NO: 865237

SEQ ID NO: 865251 - protein, 691 aa, Homo sapiens; identical to SEQ ID NO: 865237

SEQ ID NO: 865252 - protein, 368 aa, Homo sapiens
MKRSIHIVALGNEGDTFHQDNRPSGLIRTYLGRSPLVSGDESSLLLNAASTVARPVFTEYQASAFGNVKLVVHDCPVWDIFDSDWYTSRNLIGGADIIVIKYNVNDKFSFHEVKDNYIPVIKRALNSVPVIIAAVGTRQNEELPCTCPLCTSDRGSCVSTTEGIQLAKELGATYLELHSLDDFYIGKYFGGVLEYFMIQALNQKTSEKMKKRKMSNSFHGIRPPQLEQPEKMPVLKAEASHYNSDLNNLLFCCQCVDVVFYNPNLKKVVEAHKIVLCAVSHVFMLLFNVKSPTDIQDSSIIRTTQDLFAINRDTAFPGASHESSGNPPLRVIVKDALFCSCLSDILRFIYSGILSSGSGYLQSHKLWK

SEQ ID NO: 865253 - protein, 72 aa, Homo sapiens
SQKPEFQDLSDHTELLSKEQGRKQEVTGIFQAMCLLICAEMYQVSRLQHICELFIITQLAARTLRMRPNPQL

SEQ ID NO: 865254 - protein, 611 aa, Homo sapiens
MSIHIVALGNEGDTFHQDNRPSGLIRTYLGRSPLVSGDESSLLLNAASTVARPVFTEYQASAFGNVKLVVHDCPVWDIFDSDWYTSRNLIGGADIIVIKYNVNDKFSFHEVKDNYIPVIKRALNSVPVIIAAVGTRQNEELPCTCPLCTSDRGSCVSTTEGIQLAKELGATYLELHSLDDFYIGKYFGGVLEYFMIQALNQKTSEKMKKRKMSNSFHGIRPPQLEQPEKMPVLKAEASHYNSDLNNLLFCCQCVDVVFYNPNLKKVVEAHKIVLCAVSHVFMLLFNVKSPTDIQDSSIIRTTQDLFAINRDTAFPGASHESSGNPPLRVIVKDALFCSCLSDILRFIYSGAFQWEELEEDIRKKLKDSGDVSNVIEKVKCILKTPGKINCLRNCKTYQARKPLWFYNTSLKFFLNKPMLADVVFEIQGTTVPAHRAILVARCEVMAAMFNGNYMEAKSVLIPVYGVSKETFLSFLEYLYTDSCCPAGIFQAMCLLICAEMYQVSRLQHICELFIITQLQSMPSRELASMNLDIVDLLKKAKFHHSDCLSTWLLHFIATNYLIFSQKPEFQDLSVEERSFVEKHRWPSNMYLKQLAEYRKYIHSRKCRCLVM

SEQ ID NO: 865255 - protein, 611 aa, Homo sapiens; identical to SEQ ID NO: 865254

SEQ ID NO: 865256 - protein, 611 aa, Homo sapiens; identical to SEQ ID NO: 865254

SEQ ID NO: 865257 - protein, 611 aa, Homo sapiens; identical to SEQ ID NO: 865254

SEQ ID NO: 865258 - protein, 611 aa, Homo sapiens; identical to SEQ ID NO: 865254

SEQ ID NO: 865259 - protein, 326 aa, Homo sapiens
MISHEIIPRDLAQDRAVIEKESCMDFLEGLCHWNLSRGPPIETLIVKDALFCSCLSDILRFIYSGAFQWEELEEDIRKKLKDSGDVSNVIEKVKCILKTPGKINCLRNCKTYQARKPLWFYNTSLKFFLNKPMLADVVFEIQGTTVPAHRAILVARCEVMAAMFNGNYMEAKSVLIPVYGVSKETFLSFLEYLYTDSCCPAGIFQAMCLLICAEMYQVSRLQHICELFIITQLQSMPSRELASMNLDIVDLLKKAKFHHSDCLSTWLLHFIATNYLIFSQKPEFQDLSVEERSFVEKHRWPSNMYLKQLAEYRKYIHSRKCRCLVM

SEQ ID NO: 865260 - protein, 611 aa, Homo sapiens; identical to SEQ ID NO: 865254

SEQ ID NO: 865261 - protein, 598 aa, Homo sapiens
MSIHIVALGNEGDTFHQDNRPSGLIRTYLGRSPLVSGDESSLLLNAASTVARPVFTEYQASAFGNVKLVVHDCPVWDIFDSDWYTSRNLIGGADIIVIKYNVNDKFSFHEVKDNYIPVIKRALNSVPVIIAAVGTRQNEELPCTCPLCTSDRGSCVSTTEGIQLAKELGATYLELHSLDDFYIGKYFGGVLEYFMIQALNQKTSEKMKKRKMSNSFHGIRPPQLEQPEKMPVLKAEASHYNSDLNNLLFCCQCVDVVFYNPNLKKVVEAHKIVLCAVSHVFMLLFNVKSPTDIQDSSIIRTTQDLFAINRDTAFPGASHESSGNPPLRVIVKDALFCSCLSDILRFIYSGAFQWEELEEDIRKKLKDSGDVSNVIEKVKCILKTPGKINCLRNCKTYQARKPLWFYNTSLKFFLNKPMLADVVFEIQGTTVPAHRAILVARCEVMAAMFNGNYMEAKSVLIPVYGVSKETFLSFLEYLYTDSCCPAGIFQAMCLLICAEMYQVSRLQHICELFIITQLQSMPSRELASMNLDIVDLLKKAKFHHSDCLSTWLLHFIATNYLIFSQKPEFQDLSVGKERQFFVWKKAQVGPFEGYFEGQ

SEQ ID NO: 865262 - protein, 366 aa, Homo sapiens
MSIHIVALGNEGDTFHQDNRPSGLIRTYLGRSPLVSGDESSLLLNAASTVARPVFTEYQASAFGNVKLVVHDCPVWDIFDSDWYTSRNLIGGADIIVIKYNVNDKFSFHEVKDNYIPVIKRALNSVPVIIAAVGTRQNEELPCTCPLCTSDRGSCVSTTEGIQLAKELGATYLELHSLDDFYIGKYFGGVLEYFMIQALNQKTSEKMKKRKMSNSFHGIRPPQLEQPEKMPVLKAEASHYNSDLNNLLFCCQCVDVVFYNPNLKKVVEAHKIVLCAVSHVFMLLFNVKSPTDIQDSSIIRTTQDLFAINRDTAFPGASHESSGNPPLRVIVKDALFCSCLSDILRFIYSGILSSGSGYLQSHKLWK

SEQ ID NO: 865263 - protein, 611 aa, Homo sapiens; identical to SEQ ID NO: 865254

SEQ ID NO: 865264 - protein, 611 aa, Homo sapiens; identical to SEQ ID NO: 865254

SEQ ID NO: 865265 - protein, 611 aa, Homo sapiens; identical to SEQ ID NO: 865254

SEQ ID NO: 865266 - protein, 611 aa, Homo sapiens; identical to SEQ ID NO: 865254

SEQ ID NO: 865267 - protein, 611 aa, Homo sapiens; identical to SEQ ID NO: 865254

SEQ ID NO: 865268 - protein, 613 aa, Homo sapiens
MKRSIHIVALGNEGDTFHQDNRPSGLIRTYLGRSPLVSGDESSLLLNAASTVARPVFTEYQASAFGNVKLVVHDCPVWDIFDSDWYTSRNLIGGADIIVIKYNVNDKFSFHEVKDNYIPVIKRALNSVPVIIAAVGTRQNEELPCTCPLCTSDRGSCVSTTEGIQLAKELGATYLELHSLDDFYIGKYFGGVLEYFMIQALNQKTSEKMKKRKMSNSFHGIRPPQLEQPEKMPVLKAEASHYNSDLNNLLFCCQCVDVVFYNPNLKKVVEAHKIVLCAVSHVFMLLFNVKSPTDIQDSSIIRTTQDLFAINRDTAFPGASHESSGNPPLRVIVKDALFCSCLSDILRFIYSGAFQWEELEEDIRKKLKDSGDVSNVIEKVKCILKTPGKINCLRNCKTYQARKPLWFYNTSLKFFLNKPMLADVVFEIQGTTVPAHRAILVARCEVMAAMFNGNYMEAKSVLIPVYGVSKETFLSFLEYLYTDSCCPAGIFQAMCLLICAEMYQVSRLQHICELFIITQLQSMPSRELASMNLDIVDLLKKAKFHHSDCLSTWLLHFIATNYLIFSQKPEFQDLSVEERSFVEKHRWPSNMYLKQLAEYRKYIHSRKCRCLVM

SEQ ID NO: 865269 - protein, 417 aa, Homo sapiens
MIQALNQKTSEKMKKRKMSNSFHGIRPPQLEQPEKMPVLKAEASHYNSDLNNLLFCCQCVDVVFYNPNLKKVVEAHKIVLCAVSHVFMLLFNVKSPTDIQDSSIIRTTQDLFAINRDTAFPGASHESSGNPPLRVIVKDALFCSCLSDILRFIYSGAFQWEELEEDIRKKLKDSGDVSNVIEKVKCILKTPGKINCLRNCKTYQARKPLWFYNTSLKFFLNKPMLADVVFEIQGTTVPAHRAILVARCEVMAAMFNGNYMEAKSVLIPVYGVSKETFLSFLEYLYTDSCCPAGIFQAMCLLICAEMYQVSRLQHICELFIITQLQSMPSRELASMNLDIVDLLKKAKFHHSDCLSTWLLHFIATNYLIFSQKPEFQDLSVEERSFVEKHRWPSNMYLKQLAEYRKYIHSRKCRCLVM

SEQ ID NO: 865270 - protein, 167 aa, Homo sapiens
MAAMFNGNYMEAKSVLIPVYGVSKETFLSFLEYLYTDSCCPAGIFQAMCLLICAEMYQVSRLQHICELFIITQLQSMPSRELASMNLDIVDLLKKAKFHHSDCLSTWLLHFIATNYLIFSQKPEFQDLSVEERSFVEKHRWPSNMYLKQLAEYRKYIHSRKCRCLVM

SEQ ID NO: 865271 - protein, 611 aa, Homo sapiens; identical to SEQ ID NO: 865254

SEQ ID NO: 865272 - protein, 312 aa, Homo sapiens
MSIHIVALGNEGDTFHQDNRPSGLIRTYLGRSPLVSGDESSLLLNAASTVARPVFTEYQASAFGNVKLVVHDCPVWDIFDSDWYTSRNLIGGADIIVIKYNVNDKFSFHEVKDNYIPVIKRALNSVPVIIAAVGTRQNEELPCTCPLCTSDRGSCVSTTEGIQLAKELGATYLELHSLDDFYIGKYFGGVLEYFMIQALNQKTSEKMKKRKMSNSFHGIRPPQLEQPEKMPVLKAEASHYNSDLNNLLFCCQCVDVVFYNPNLKKVVEAHKIVLCAVSHVFMLLFNVKSPTDIQDSSIIRTTQDLVGLYNFL

SEQ ID NO: 865273 - protein, 417 aa, Homo sapiens
PSSHPHQQLQGWVRRPTLARHRGAARTRGNGPKPNPPASASQEPAPRPPPPLRPRPAQPPRSCAPRSEVPEMKVWLLLGLLLVHEALEDVTGQHLPKNKRPKEPGENRIKPTNKKVKPKIPKMKDRDSANSAPKTQSIMMQVLDKGRFQKPAATLSLLAGQTVELRCKGSRIGWSYPAYLDTFKDSRLSVKQNERYGQLTLVNSTSADTGEFSCWVQLCSGYICRKDEAKTGSTYIFFTEKGELFVPSPSYFDVVYLNPDRQAVVPCRVTVLSAKVTLHREFPAKEIPANGTDIVYDMKRGFVYLQPHSEHQGVVYCRAEAGGRSQISVKYQLLYVAVPSGPPSTTILASSNKVKSGDDISVLCTVLGEPDVEVEFTWIFPGQKQKLLQPAKIYLSNIDSFEFREEELTSHSSSVSP

SEQ ID NO: 865274 - protein, 107 aa, Homo sapiens
LSVRVQVDNIEVAGRRYKEFSFLCKKDEVEPDVEVEFTWIFPGQKDERPVTIQDTWRLIHRGLGHTTRISQSVITVEDFETIDAGYYICTAQNLQGQTTVATTVEFS

SEQ ID NO: 865275 - protein, 446 aa, Homo sapiens
PSSHPHQQLQGWVRRPTLARHRGAARTRGNGPKPNPPASASQEPAPRPPPPLRPRPAQPPRSCAPRSEVPEMKVWLLLGLLLVHEALEDVTGQHLPKNKRPKEPGENRIKPTNKKVKPKIPKMKDRDSANSAPKTQSIMMQVLDKGRFQKPAATLSLLAGQTVELRCKGSRIGWSYPAYLDTFKDSRLSVKQNERYGQLTLVNSTSADTGEFSCWVQLCSGYICRKDEAKTGSTYIFFTEKGELFVPSPSYFDVVYLNPDRQAVVPCRVTVLSAKVTLHREFPAKEIPANGTDIVYDMKRGFVYLQPHSEHQGVVYCRAEAGGRSQISVKYQLLYVAVPSGPPSTTILASSNKVKSGDDISVLCTVLGEPDVEVEFTWIFPGQKDERPVTIQDTWRLIHRGLGHTTRISQSVITVEDFETIDAGYYICTAQNLQGQTTVATTVEFS

SEQ ID NO: 865276 - protein, 750 aa, Homo sapiens
MGKSESQMDITDINTPKPKKKQRWTPLEISLSVLVLLLTIIAVTMIALYATYDDGICKSSDCIKSAARLIQNMDATTEPCTDFFKYACGGWLKRNVIPETSSRYGNFDILRDELEVVLKDVLQEPKTEDIVAVQKAKALYRSCINESAIDSRGGEPLLKLLPDIYGWPVATENWEQKYGASWTAEKAIAQLNSKYGKKVLINLFVGTDDKNSVNHVIHIDQPRLGLPSRDYYECTGIYKEACTAYVDFMISVARLIRQEERLPIDENQLALEMNKVMELEKEIANATAKPEDRNDPMLLYNKMTLAQIQNNFSLEINGKPFSWLNFTNEIMSTVNISITNEEDVVVYAPEYLTKLKPILTKYSARDLQNLMSWRFIMDLVSSLSRTYKESRNAFRKALYGTTSETATWRRCANYVNGNMENAVGRLYVEAAFAGESKHVVEDLIAQIREVFIQTLDDLTWMDAETKKRAEEKALAIKERIGYPDDIVSNDNKLNNEYLELNYKEDEYFENIIQNLKFSQSKQLKKLREKVDKDEWISGAAVVNAFYSSGRNQIVFPAGILQPPFFSAQQSNSLNYGGIGMVIGHEITHGFDDNGRNFNKDGDLVDWWTQQSASNFKEQSQCMVYQYGNFSWDLAGGQHLNGINTLGENIADNGGLGQAYRAYQNYIKKNGEEKLLPGLDLNHKQLFFLNFAQVWCGTYRPEYAVNSIKTDVHSPGNFRIIGTLQNSAEFSEAFHCRKNSYMNPEKKCRVW

SEQ ID NO: 865277 - protein, 750 aa, Homo sapiens; identical to SEQ ID NO: 865276

SEQ ID NO: 865278 - protein, 750 aa, Homo sapiens; identical to SEQ ID NO: 865276

SEQ ID NO: 865279 - protein, 750 aa, Homo sapiens; identical to SEQ ID NO: 865276

SEQ ID NO: 865280 - protein, 750 aa, Homo sapiens; identical to SEQ ID NO: 865276

SEQ ID NO: 865281 - protein, 750 aa, Homo sapiens; identical to SEQ ID NO: 865276

SEQ ID NO: 865282 - protein, 672 aa, Homo sapiens [sequence omitted]

SEQ ID NO: 865283 - protein, 750 aa, Homo sapiens; identical to SEQ ID NO: 865276

SEQ ID NO: 865284 - protein, 750 aa, Homo sapiens; identical to SEQ ID NO: 865276

SEQ ID NO: 865285 - protein, 145 aa, Homo sapiens
AEGERSKGRERPGRWEPVGRARGGQSQPRGAAAGRCAEQGPQLRSSAIRAPRTLRPWRRRALGRSRYWDLKSEGRERGPEGDLEEGSGSHVRLALQVHFHSSLRPLPWGVMFCYRDPRYQIAPGLIWGLGICHSAVQTLIFFSSF

SEQ ID NO: 865286 - protein, 156 aa, Homo sapiens
MGKSESQMDITDINTPKPKKKQRWTPLEISLSVLVLLLTIIAVTMIALYATYDDGICKSSDCIKSAARLIQNMDATTEPCTDFFKYACGGWLKRNVIPETSSRYGNFDILRDELEVVLKDVPFRTKMRYSSGGKKACEGLVKDLVWKGGNFEVRIL

SEQ ID NO: 865287 - protein, 750 aa, Homo sapiens; identical to SEQ ID NO: 865276

SEQ ID NO: 865288 - protein, 750 aa, Homo sapiens; identical to SEQ ID NO: 865276

SEQ ID NO: 865289 - protein, 750 aa, Homo sapiens; identical to SEQ ID NO: 865276

SEQ ID NO: 865290 - protein, 147 aa, Homo sapiens
GLAQHHRPMKKYIQPEQLHQELFLMGLHLLSSQLRSGQPVHRLLVSAAPPCPLLPGQGSDTTGQRYWHLFMPSSVRAYSGTNIGPRLWGWEMGFSHVPGRKSRECDEVRLRGSLLWSQHFGRPKQEDRSSPGGQGCSEPWSGSCTPA

SEQ ID NO: 865291 - protein, 132 aa, Homo sapiens
MLRSASYCGWCCSRGARGPLAARSLHCCSSPSVAVVARASCGSVRSSCVVVRLFDFSAPGELDKAAGDFCAAIARVPCVWVFVSGVLFWVCVPLCPPGGGSFLGVVGGWFSLCVCVCGALFWFLALLLAPFS

SEQ ID NO: 865292 - protein, 283 aa, Homo sapiens
MSSGTQMLTIRWEIQEESDMWKIRELEKQMEDAYRGTKRKMLPSSSSRMRSDGFDEESQRYYWRPKNEISGTLEDDFLKAKSWNKKFYDYEANMPDRWGHSGYKELYPEEFETDSSDQQDITNGKKTSPQVKSSTHESRKHKKSKKSHKKKQKKRSHKKQKKSKKEATDITADSSSEFSEETGASGTRKGKQPHKRKKKSRKKSLKKPALFLEAESNTSHSDDSASSSSEESEERDTKKTKRKKREKKAHTSVANNEIQERTNKRTNWKVATDERSAESSEDD

SEQ ID NO: 865293 - protein, 330 aa, Homo sapiens
MWLLVSVILISRISSVGGEATFCDFPKINHGILYDEEKYKPFSQVPTGEVFYYSCEYNFVSPSKSFWTRITCTEEGWSPTPKCLRLCFFPFVENGHSESSGQTHLEGDTVQIICNTGYRLQNNENNISCVERGWSTPPKCRSTDTSCVNPPTVQNAHILSRQMSKYPSGERVRYECRSPYEMFGDEEVMCLNGNWTEPPQCKDSTGKCGPPPPIDNGDITSFPLSVYAPASSVEYQCQNLYQLEGNKRITCRNGQWSEPPKCLHPCVISREIMENYNIALRWTAKQKLYSRTGESVEFVCKRGYRLSSRSHTLRTTCWDGKLEYPTCAKR

SEQ ID NO: 865294 - protein, 330 aa, Homo sapiens
MLLLINVILTLWVSCANGQVKPCDFPDIKHGGLFHENMRRPYFPVAVGKYYSYYCDEHFETPSGSYWDYIHCTQNGWSPAVPCLRKCYFPYLENGYNQNYGRKFVQGNSTEVACHPGYGLPKAQTTVTCTEKGWSPTPRCIRVRTCSKSDIEIENGFISESSSIYILNKEIQYKCKPGYATADGNSSGSITCLQNGWSAQPICINSSEKCGPPPPISNGDTTSFLLKVYVPQSRVEYQCQPYYELQGSNYVTCSNGEWSEPPRCIHPCIITEENMNKNNIKLKGRSDRKYYAKTGDTIEFMCKLGYNANTSILSFQAVCREGIVEYPRCE

SEQ ID NO: 865295 - protein, 212 aa, Homo sapiens
QDSARGQVKPCDFPDIKHGGLFHENMRRPYFPVAVGKYYSYYCDEHFETPSGSYWDYIHCTQNGWSPAVPCLRKCYFPYLENGYNQNYGRKFVQGNSTEVACHPGYGLPKAQTTVTCTEKGWSPTPRCIRVRTCSKSDIEIENGFISESSSIYILNKEIQYKCKPGYATADGNSSGSITCLQNGWSAQPICITACIAFRAHAQKKLYMSGEK

SEQ ID NO: 865296 - protein, 330 aa, Homo sapiens; identical to SEQ ID NO: 865293

SEQ ID NO: 865297 - protein, 168 aa, Homo sapiens
MSKYPSGERVRYECRSPYEMFGDEEVMCLNGNWTEPPQCKDSTGKCGPPPPIDNGDITSFPLSVYAPASSVEYQCQNLYQLEGNKRITCRNGQWSEPPKCLHPCVISREIMENYNIALRWTAKQKLYSRTGESVEFVCKRGYRLSSRSHTLRTTCWDGKLEYPTCAKR

SEQ ID NO: 865298 - protein, 276 aa, Homo sapiens
MWLLVSVILISRISSVGGEEEGWSPTPKCLRLCFFPFVENGHSESSGQTHLEGDTVQIICNTGYRLQNNENNISCVERGWSTPPKCRSTDTSCVNPPTVQNAHILSRQMSKYPSGERVRYECRSPYEMFGDEEVMCLNGNWTEPPQCKDSTGKCGPPPPIDNGDITSFPLSVYAPASSVEYQCQNLYQLEGNKRITCRNGQWSEPPKCLHPCVISREIMENYNIALRWTAKQKLYSRTGESVEFVCKRGYRLSSRSHTLRTTCWDGKLEYPTCAKR

SEQ ID NO: 865299 - protein, 235 aa, Homo sapiens
MHRRRMVTNTKVSHVQIICNTGYRLQNNENNISCVERGWSTPPKCRSTDTSCVNPPTVQNAHILSRQMSKYPSGERVRYECRSPYEMFGDEEVMCLNGNWTEPPQCKDSTGKCGPPPPIDNGDITSFPLSVYAPASSVEYQCQNLYQLEGNKRITCRNGQWSEPPKCLHPCVISREIMENYNIALRWTAKQKLYSRTGESVEFVCKRGYRLSSRSHTLRTTCWDGKLEYPTCAKR

SEQ ID NO: 865300 - protein, 330 aa, Homo sapiens; identical to SEQ ID NO: 865293

SEQ ID NO: 865301 - protein, 276 aa, Homo sapiens
MWLLVSVILISRISSVGGEATFCDFPKINHGILYDEEKYKPFSQVPTGEVFYYSCEYNFVSPSKSFWTRITCTEEGWSPTPKCLRLCFFPFVENGHSESSGQTHLEGDTVQIICNTGYRLQNNENNISCVERGWSTPPKCRSTDTSCVNPPTVQNAHILSRQMSKYPSGERVRYECRSPYEMFGDEEVMCLNGNWTEPPQCKDSTGKCGPPPPIDNGDITSFPLSVYAPASSVEYQCQNLYQLEGNKRITCRNGQWSEPPKCLHPCVISREIMENR

SEQ ID NO: 865302 - protein, 230 aa, Homo sapiens
MWLLVSVILISRISSVGGEATFCDFPKINHGILYDEEKYKPFSQVPTGEVFYYSCEYNFVSPSKSFWTRITCTEEGWSPTPKCLRLCFFPFVENGHSESSGQTHLEGDTVQIICNTGYRLQNNENNISCVERGWSTPPKCRSTDTSCVNPPTVQNAHILSRQMSKYPSGERVRYECRSPYEMFGDEEVMCLNGNWTEPPQCKDSRCQYMLQLHQLSTNARTCINLRVTSE

SEQ ID NO: 865303 - protein, 235 aa, Homo sapiens
MLLLINVILTLWVSCANGQVKPCDFPDIKHGGLFHENMRRPYFPVAVGKYYSYYCDEHFETPSGSYWDYIHCTQNGWSPAVPCLRKCYFPYLENGYNQNYGRKFVQGNSTEVACHPGYGLPKAQTTVTCTEKGWSPTPRCIRVRTCSKSDIEIENGFISESSSIYILNKEIQYKCKPGYATADGNSSGSITCLQNGWSAQPICINTVCFVARSDMRENDRIYSVRRIDYDMSLGS

SEQ ID NO: 865304 - protein, 200 aa, Homo sapiens
AKRGLTLLTTTATRTCSKSDIEIENGFISESSSIYILNKEIQYKCKPGYATADGNSSGSITCLQNGWSAQPICINSSEKCGPPPPISNGDTTSFLLKVYVPQSRVEYQCQPYYELQGSNYVTCSNGEWSEPPRCIHPCIITEENMNKNNIKLKGRSDRKYYAKTGDTIEFMCKLGYNANTSILSFQAVCREGIVEYPRCE

SEQ ID NO: 865305 - protein, 310 aa, Homo sapiens
MWLLVSVILISRISSVGGEATFCDFPKINHGILYDEEKYKPFSQVPTGEVFYYSCEYNFVSPSKSFWTRITCTEEGWSPTPKCLRLCFFPFVENGHSESSGQTHLEGDTVQIICNTGYRLQNNDTSCVNPPTVQNAHILSRQMSKYPSGERVRYECRSPYEMFGDEEVMCLNGNWTEPPQCKDSTGKCGPPPPIDNGDITSFPLSVYAPASSVEYQCQNLYQLEGNKRITCRNGQWSEPPKCLHPCVISREIMENYNIALRWTAKQKLYSRTGESVEFVCKRGYRLSSRSHTLRTTCWDGKLEYPTCAKR

SEQ ID NO: 865306 - protein, 265 aa, Homo sapiens
MWLLVSVILISRISSVGGEGLCFFPFVENGHSESSGQTHLEGDTVQIICNTGYRLQNNENNISCVERGWSTPPKCRSTDTSCVNPPTVQNAHILSRQMSKYPSGERVRYECRSPYEMFGDEEVMCLNGNWTEPPQCKDSTGKCGPPPPIDNGDITSFPLSVYAPASSVEYQCQNLYQLEGNKRITCRNGQWSEPPKCLHPCVISREIMENYNIALRWTAKQKLYSRTGESVEFVCKRGYRLSSRSHTLRTTCWDGKLEYPTCAKR

SEQ ID NO: 865307 - protein, 271 aa, Homo sapiens
MLLLINVILTLWVSCANGQVKPCDFPDIKHGGLFHENMRRPYFPVAVGKYYSYYCDEHFETPSGSYWDYIHCTQNGWSPAVPCLNTSCVNPPTVQNAHILSRQMSKYPSGERVRYECRSPYEMFGDEEVMCLNGNWTEPPQCKDSTGKCGPPPPIDNGDITSFPLSVYAPASSVEYQCQNLYQLEGNKRITCRNGQWSEPPKCLHPCVISREIMENYNIALRWTAKQKLYSRTGESVEFVCKRGYRLSSRSHTLRTTCWDGKLEYPTCAKR

SEQ ID NO: 865308 - protein, 230 aa, Homo sapiens; identical to SEQ ID NO: 865302

SEQ ID NO: 865309 - protein, 330 aa, Homo sapiens; identical to SEQ ID NO: 865293

SEQ ID NO: 865310 - protein, 330 aa, Homo sapiens; identical to SEQ ID NO: 865293

SEQ ID NO: 865311 - protein, 264 aa, Homo sapiens
MWLLVSVILISRISSVGGEATFCDFPKINHGILYDEEKYKPFSQVPTGEVFYYSCEYNFVSPSKSFWTRITCTEEGWSPTPKCLRLCFFPFVENGHSESSGQTHLEGDTVQIICNTGYRLQNNENNISCVERGWSTPPKCRSTDTSCVNPPTVQNAHILSRQMSKYPSGERVRYECRSPYEMFGDEEVMCLNGNWTEPPQCKDSTGKCGPPPPIDNGDITSFPLSVYAPASSVEYQCQNLYQLEGNKRITCRNGQWSEPPKCLL

SEQ ID NO: 865312 - protein, 3830 aa, Homo sapiens
MAFVATQGATVVDQTTLMKKYLQFVAALTDVNTPDETKLKMMQEVSENFENVTSSPQYSTFLEHIIPRFLTFLQDGEVQFLQEKPAQQLRKLVLEIIHRIPTNEHLRPHTKNVLSVMFRFLETENEENVLICLRIIIELHKQFRPPITQEIHHFLDFVKQIYKELPKVVNRYFENPQVIPENTVPPPEMVGMITTIAVKVNPEREDSETRTHSIIPRGSLSLKVLAELPIIVVLMYQLYKLNIHNVVAEFVPLIMNTIAIQVSAQARQHKLYNKELYADFIAAQIKTLSFLAYIIRIYQELVTKYSQQMVKGMLQLLSNCPAETAHLRKELLIAAKHILTTELRNQFIPCMDKLFDESILIGSGYTARETLRPLAYSTLADLVHHVRQHLPLSDLSLAVQLFAKNIDDESLPSSIQTMSCKLLLNLVDCIRSKSEQESGNGRDVLMRMLEVFVLKFHTIARYQLSAIFKKCKPQSELGAVEAALPGVPTAPAAPGPAPSPAPVPAPPPPPPPPPPATPVTPAPVPPFEKQGEKDKEDKQTFQVTDCRSLVKTLVCGVKTITWGITSCKAPGEAQFIPNKQLQPKETQIYIKLVKYAMQALDIYQVQIAGNGQTYIRVANCQTVRMKEEKEVLEHFAGVFTMMNPLTFKEIFQTTVPYMVERISKNYALQIVANSFLANPTTSALFATILVEYLLDRLPEMGSNVELSNLYLKLFKLVFGSVSLFAAENEQMLKPHLHKIVNSSMELAQTAKEPYNYFLLLRALFRSIGGGSHDLLYQEFLPLLPNLLQGLNMLQSGLHKQHMKDLFVELCLTVPVRLSSLLPYLPMLMDPLVSALNGSQTLVSQGLRTLELCVDNLQPDFLYDHIQPVRAELMQALWRTLRNPADSISHVAYRVLGKFGGSNRKMLKESQKLHYVVTEVQGPSITVEFSDCKASLQLPMEKAIETALDCLKSANTEPYYRRQAWEVIKCFLVAMMSLEDNKHALYQLLAHPNFTEKTIPNVIISHRYKAQDTPARKTFEQALTGAFMSAVIKDLRPSALPFVASLIRHYTMVAVAQQCGPFLLPCYQVGSQPSTAMFHSEENGSKGMDPLVLIDAIAICMAYEEKELCKIGEVALAVIFDVASIILGSKERACQLPLFSYIVERLCACCYEQAWYAKLGGVVSIKFLMERLPLTWVLQNQQTFLKALLFVMMDLTGEVSNGAVAMAKTTLEQLLMRCATPLKDEERAEEIVAAQEKSFHHVTHDLVREVTSPNSTVRKQAMHSLQVLAQVTGKSVTVIMEPHKEVLQDMVPPKKHLLRHQPANAQIGLMEGNTFCTTLQPRLFTMDLNVVEHKVFYTELLNLCEAEDSALTKLPCYKSLPSLVPLRIAALNALAACNYLPQSREKIIAALFKALNSTNSELQEAGEACMRKFLEGATIEVDQIHTHMRPLLMMLGDYRSLTLNVVNRLTSVTRLFPNSFNDKFCDQMMQHLRKWMEVVVITHKGGQRSDGNEMKICSAIINLFHLIPAAPQTLVKPLLEVVMKTERAMLIEAGSPFREPLIKFLTRHPSQTVELFMMEATLNDPQWSRMFMSFLKHKDARPLRDVLAANPNRFITLLLPGGAQTAVRPGSPSTSTMRLDLQFQAIKIISIIVKNDDSWLASQHSLVSQLRRVWVSENFQERHRKENMAATNWKEPKLLAYCLLNYCKRNYGDIELLFQLLRAFTGRFLCNMTFLKEYMEEEIPKNYSIAQKRALFFRFVDFNDPNFGDELKAKVLQHILNPAFLYSFEKGEGEQLLGPPNPEGDNPESITSVFITKVLDPEKQADMLDSLRIYLLQYATLLVEHAPHHIHDNNKNRNSKLRRLMTFAWPCLLSKACVDPACKYSGHLLLAHIIAKFAIHKKIVLQVFHSLLKAHAMEARAIVRQAMAILTPAVPARMEDGHQMLTHWTRKIIVEEGHTVPQLVHILHLIVQHFKVYYPVRHHLVQHMVSAMQRLGFTPSVTIEQRRLAVDLSEVVIKWELQRIKDQQPDSDMDPNSSGEGVNSVSSSIKRGLSVDSAQEVKRFRTATGAISAVFGRSQSLPGADSLLAKPIDKQHTDTVVNFLIRVACQVNDNTNTAGSPGEVLSRRCVNLLKTALRPDMWPKSELKLQWFDKLLMTVEQPNQVNYGNICTGLEVLSFLLTVLQSPAILSSFKPLQRGIAACMTCGNTKVLRAVHSLLSRLMSIFPTEPSTSSVASKYEELECLYAAVGKVIYEGLTNYEKATNANPSQLFGTLMILKSACSNNPSYIDRLISVFMRSLQKMVREHLNPQAASGSTEATSGTSELVMLSLELVKTRLAVMSMEMRKNFIQAILTSLIEKSPDAKILRAVVKIVEEWVKNNSPMAANQTPTLREKSILLVKMMTYIEKRFPEDLELNAQFLDLVNYVYRDETLSGSELTAKLEPAFLSGLRCAQPLIRAKFFEVFDNSMKRRVYERLLYVTCSQNWEAMGNHFWIKQCIELLLAVCEKSTPIGTSCQGAMLPSITNVINLADSHDRAAFAMVTHVKQEPRERENSESKEEDVEIDIELAPGDQTSTPKTKELSEKDIGNQLHMLTNRHDKFLDTLREVKTGALLSAFVQLCHISTTLAEKTWVQLFPRLWKILSDRQQHALAGEISPFLCSGSHQVQRDCQPSALNCFVEAMSQCVPPIPIRPCVLKYLGKTHNLWFRSTLMLEHQAFEKGLSLQIKPKQTTEFYEQESITPPQQEILDSLAELYSLLQEEDMWAGLWQKRCKYSETATAIAYEQHGFFEQAQESYEKAMDKAKKEHERSNASPAIFPEYQLWEDHWIRCSKELNQWEALTEYGQSKGHINPYLVLECAWRVSNWTAMKEALVQVEVSCPKEMAWKVNMYRGYLAICHPEEQQLSFIERLVEMASSLAIREWRRLPHVVSHVHTPLLQAAQQIIELQEAAQINAGLQPTNLGRNNSLHDMKTVVKTWRNRLPIVSDDLSHWSSIFMWRQHHYQAIVTAYENSSQHDPSSNNAMLGVHASASAIIQYGKIARKQGLVNVALDILSRIHTIPTVPIVDCFQKIRQQVKCYLQLAGVMGKNECMQGLEVIESTNLKYFTKEMTAEFYALKGMFLAQINKSEEANKAFSAAVQMHDVLVKAWAMWGDYLENIFVKERQLHLGVSAITCYLHACRHQNESKSRKYLAKVLWLLSFDDDKNTLADAVDKYCIGVPPIQWLAWIPQLLTCLVGSEGKLLLNLISQVGRVYPQAVYFPIRTLYLTLKIEQRERYKSDPGPIRATAPMWRCSRIMHMQRELHPTLLSSLEGIVDQMVWFRENWHEEVLRQLQQGLAKCYSVAFEKSGAVSDAKITPHTLNFVKKLVSTFGVGLENVSNVSTMFSSAASESLARRAQATAQDPVFQKLKGQFTTDFDFSVPGSMKLHNLISKLKKWIKILEAKTKQLPKFFLIEEKCRFLSNFSAQTAEVEIPGEFLMPKPTHYYIKIARFMPRVEIVQKHNTAARRLYIRGHNGKIYPYLVMNDACLTESRREERVLQLLRLLNPCLEKRKETTKRHLFFTVPRVVAVSPQMRLVEDNPSSLSLVEIYKQRCAKKGIEHDNPISRYYDRLATVQARGTQASHQVLRDILKEVQSNMVPRSMLKEWALHTFPNATDYWTFRKMFTIQLALIGFAEFVLHLNRLNPEMLQIAQDTGKLNVAYFRFDINDATGDLDANRPVPFRLTPNISEFLTTIGVSGPLTASMIAVARCFAQPNFKVDGILKTVLRDEIIAWHKKTQEDTSSPLSAAGQPENMDSQQLVSLVQKAVTAIMTRLHNLAQFEGGESKVNTLVAAANSLDNLCRMDPAWHPWL

SEQ ID NO: 865313 - protein, 3859 aa, Homo sapiens
MAFVATQGATVVDQTTLMKKYLQFVAALTDVNTPDETKLKMMQEVSENFENVTSSPQYSTFLEHIIPRFLTFLQDGEVQFLQEKPAQQLRKLVLEIIHRIPTNEHLRPHTKNVLSVMFRFLETENEENVLICLRIIIELHKQFRPPITQEIHHFLDFVKQIYKELPKVVNRYFENPQVIPENTVPPPEMVGMITTIAVKVNPEREDSETRTHSIIPRGSLSLKVLAELPIIVVLMYQLYKLNIHNVVAEFVPLIMNTIAIQVSAQARQHKLYNKELYADFIAAQIKTLSFLAYIIRIYQELVTKYSQQMVKGMLQLLSNCPAETAHLRKELLIAAKHILTTELRNQFIPCMDKLFDESILIGSGYTARETLRPLAYSTLADLVHHVRQHLPLSDLSLAVQLFAKNIDDESLPSSIQTMSCKLLLNLVDCIRSKSEQESGNGRDVLMRMLEVFVLKFHTIARYQLSAIFKKCKPQSELGAVEAALPGVPTAPAAPGPAPSPAPVPAPPPPPPPPPPATPVTPAPVPPFEKQGEKDKEDKQTFQVTDCRSLVKTLVCGVKTITWGITSCKAPGEAQFIPNKQLQPKETQIYIKLVKYAMQALDIYQVQIAGNGQTYIRVANCQTVRMKEEKEVLEHFAGVFTMMNPLTFKEIFQTTVPYMVERISKNYALQIVANSFLANPTTSALFATILVEYLLDRLPEMGSNVELSNLYLKLFKLVFGSVSLFAAENEQMLKPHLHKIVNSSMELAQTAKEPYNYFLLLRALFRSIGGGSHDLLYQEFLPLLPNLLQGLNMLQSGLHKQHMKDLFVELCLTVPVRLSSLLPYLPMLMDPLVSALNGSQTLVSQGLRTLELCVDNLQPDFLYDHIQPVRAELMQALWRTLRNPADSISHVAYRVLGKFGGSNRKMLKESQKLHYVVTEVQGPSITVEFSDCKASLQLPMEKAIETALDCLKSANTEPYYRRQAWEVIKCFLVAMMSLEDNKHALYQLLAHPNFTEKTIPNVIISHRYKAQDTPARKTFEQALTGAFMSAVIKDLRPSALPFVASLIRHYTMVAVAQQCGPFLLPCYQVGSQPSTAMFHSEENGSKGMDPLVLIDAIAICMAYEEKELCKIGEVALAVIFDVASIILGSKERACQLPLFSYIVERLCACCYEQAWYAKLGGVVSIKFLMERLPLTWVLQNQQTFLKALLFVMMDLTGEVSNGAVAMAKTTLEQLLMRCATPLKDEERAEEIVAAQEKSFHHVTHDLVREVTSPNSTVRKQAMHSLQVLAQVTGKSVTVIMEPHKEVLQDMVPPKKHLLRHQPANAQIGLMEGNTFCTTLQPRLFTMDLNVVEHKVFYTELLNLCEAEDSALTKLPCYKSLPSLVPLRIAALNALAACNYLPQSREKIIAALFKALNSTNSELQEAGEACMRKFLEGATIEVDQIHTHMRPLLMMLGDYRSLTLNVVNRLTSVTRLFPNSFNDKFCDQMMQHLRKWMEVVVITHKGGQRSDGNESISECGRCPLSPFCQFEEMKICSAIINLFHLIPAAPQTLVKPLLEVVMKTERAMLIEAGSPFREPLIKFLTRHPSQTVELFMMEATLNDPQWSRMFMSFLKHKDARPLRDVLAANPNRFITLLLPGGAQTAVRPGSPSTSTMRLDLQFQAIKIISIIVKNDDSWLASQHSLVSQLRRVWVSENFQERHRKENMAATNWKEPKLLAYCLLNYCKRNYGDIELLFQLLRAFTGRFLCNMTFLKEYMEEEIPKNYSIAQKRALFFRFVDFNDPNFGDELKAKVLQHILNPAFLYSFEKGEGEQLLGPPNPEGDNPESITSVFITKVLDPEKQADMLDSLRIYLLQYATLLVEHAPHHIHDNNKNRNSKLRRLMTFAWPCLLSKACVDPACKYSGHLLLAHIIAKFAIHKKIVLQVFHSLLKAHAMEARAIVRQAMAILTPAVPARMEDGHQMLTHWTRKIIVEEGHTVPQLVHILHLIVQHFKVYYPVRHHLVQHMVSAMQRLGFTPSVTIEQRRLAVDLSEVVIKWELQRIKDQQPDSDMDPNSSGEGVNSVSSSIKRGLSVDSAQEVKRFRTATGAISAVFGRSQSLPGADSLLAKPIDKQHTDTVVNFLIRVACQVNDNTNTAGSPGEVLSRRCVNLLKTALRPDMWPKSELKLQWFDKLLMTVEQPNQVNYGNICTGLEVLSFLLTVLQSPAILSSFKPLQRGIAACMTCGNTKVLRAVHSLLSRLMSIFPTEPSTSSVASKYEELECLYAAVGKVIYEGLTNYEKATNANPSQLFGTLMILKSACSNNPSYIDRLISVFMRSLQKMVREHLNPQAASGSTEATSGTSELVMLSLELVKTRLAVMSMEMRKNFIQAILTSLIEKSPDAKILRAVVKIVEEWVKNNSPMAANQTPTLREKSILLVKMMTYIEKRFPEDLELNAQFLDLVNYVYRDETLSGSELTAKLEPAFLSGLRCAQPLIRAKFFEVFDNSMKRRVYERLLYVTCSQNWEAMGNHFWIKQCIELLLAVCEKSTPIGTSCQGAMLPSITNVINLADSHDRAAFAMVTHVKQEPRERENSESKEEDVEIDIELAPGDQTSTPKTKELSEKDIGNQLHMLTNRHDKFLDTLREVKTGALLSAFVQLCHISTTLAEKTWVQLFPRLWKILSDRQQHALAGEISPFLCSGSHQVQRDCQPSALNCFVEAMSQCVPPIPIRPCVLKYLGKTHNLWFRSTLMLEHQAFEKGLSLQIKPKQTTEFYEQESITPPQQEILDSLAELYSLLQEEDMWAGLWQKRCKYSETATAIAYEQHGFFEQAQESYEKAMDKAKKEHERSNASPAIFPEYQLWEDHWIRCSKELNQWEALTEYGQSKGHINPYLVLECAWRVSNWTAMKEALVQVEVSCPKEMAWKVNMYRGYLAICHPEEQQLSFIERLVEMASSLAIREWRRLPHVVSHVHTPLLQAAQQIIELQEAAQINAGLQPTNLGRNNSLHDMKTVVKTWRNRLPIVSDDLSHWSSIFMWRQHHYQGKPTWSGMHSSSIVTAYENSSQHDPSSNNAMLGVHASASAIIQYGKIARKQGLVNVALDILSRIHTIPTVPIVDCFQKIRQQVKCYLQLAGVMGKNECMQGLEVIESTNLKYFTKEMTAEFYALKGMFLAQINKSEEANKAFSAAVQMHDVLVKAWAMWGDYLENIFVKERQLHLGVSAITCYLHACRHQNESKSRKYLAKVLWLLSFDDDKNTLADAVDKYCIGVPPIQWLAWIPQLLTCLVGSEGKLLLNLISQVGRVYPQAVYFPIRTLYLTLKIEQRERYKSDPGPIRATAPMWRCSRIMHMQRELHPTLLSSLEGIVDQMVWFRENWHEEVLRQLQQGLAKCYSVAFEKSGAVSDAKITPHTLNFVKKLVSTFGVGLENVSNVSTMFSSAASESLARRAQATAQDPVFQKLKGQFTTDFDFSVPGSMKLHNLISKLKKWIKILEAKTKQLPKFFLIEEKCRFLSNFSAQTAEVEIPGEFLMPKPTHYYIKIARFMPRVEIVQKHNTAARRLYIRGHNGKIYPYLVMNDACLTESRREERVLQLLRLLNPCLEKRKETTKRHLFFTVPRVVAVSPQMRLVEDNPSSLSLVEIYKQRCAKKGIEHDNPISRYYDRLATVQARGTQASHQVLRDILKEVQSNMVPRSMLKEWALHTFPNATDYWTFRKMFTIQLALIGFAEFVLHLNRLNPEMLQIAQDTGKLNVAYFRFDINDATGDLDANRPVPFRLTPNISEFLTTIGVSGPLTASMIAVARCFAQPNFKVDGILKTVLRDEIIAWHKKTQEDTSSPLSAAGQPENMDSQQLVSLVQKAVTAIMTRLHNLAQFEGGESKVNTLVAAANSLDNLCRMDPAWHPWL

SEQ ID NO: 865314 - protein, 3866 aa, Homo sapiens
MAFVATQGATVVDQTTLMKKYLQFVAALTDVNTPDETKLKMMQEVSENFENVTSSPQYSTFLEHIIPRFLTFLQDGEVQFLQEKPAQQLRKLVLEIIHRIPTNEHLRPHTKNVLSVMFRFLETENEENVLICLRIIIELHKQFRPPITQEIHHFLDFVKQIYKELPKVVNRYFENPQVIPENTVPPPEMVGMITTIAVKVNPEREDSETRTHSIIPRGSLSLKVLAELPIIVVLMYQLYKLNIHNVVAEFVPLIMNTIAIQVSAQARQHKLYNKELYADFIAAQIKTLSFLAYIIRIYQELVTKYSQQMVKGMLQLLSNCPAETAHLRKELLIAAKHILTTELRNQFIPCMDKLFDESILIGSGYTARETLRPLAYSTLADLVHHVRQHLPLSDLSLAVQLFAKNIDDESLPSSIQTMSCKLLLNLVDCIRSKSEQESGNGRDVLMRMLEVFVLKFHTIARYQLSAIFKKCKPQSELGAVEAALPGVPTAPAAPGPAPSPAPVPAPPPPPPPPPPATPVTPAPVPPFEKQGEKDKEDKQTFQVTDCRSLVKTLVCGVKTITWGITSCKAPGEAQFIPNKQLQPKETQIYIKLVKYAMQALDIYQVQIAGNGQTYIRVANCQTVRMKEEKEVLEHFAGVFTMMNPLTFKEIFQTTVPYMVERISKNYALQIVANSFLANPTTSALFATILVEYLLDRLPEMGSNVELSNLYLKLFKLVFGSVSLFAAENEQMLKPHLHKIVNSSMELAQTAKEPYNYFLLLRALFRSIGGGSHDLLYQEFLPLLPNLLQGLNMLQSGLHKQHMKDLFVELCLTVPVRLSSLLPYLPMLMDPLVSALNGSQTLVSQGLRTLELCVDNLQPDFLYDHIQPVRAELMQALWRTLRNPADSISHVAYRVLGKFGGSNRKMLKESQKLHYVVTEVQGPSITVEFSDCKASLQLPMEKAIETALDCLKSANTEPYYRRQAWEVIKCFLVAMMSLEDNKHALYQLLAHPNFTEKTIPNVIISHRYKAQDTPARKTFEQALTGAFMSAVIKDLRPSALPFVASLIRHYTMVAVAQQCGPFLLPCYQVGSQPSTAMFHSEENGSKGMDPLVLIDAIAICMAYEEKELCKIGEVALAVIFDVASIILGSKERACQLPLFSYIVERLCACCYEQAWYAKLGGVVSIKFLMERLPLTWVLQNQQTFLKALLFVMMDLTGEVSNGAVAMAKTTLEQLLMRCATPLKDEERAEEIVAAQEKSFHHVTHDLVREVTSPNSTVRKQAMHSLQVLAQVTGKSVTVIMEPHKEVLQDMVPPKKHLLRHQPANAQIGLMEGNTFCTTLQPRLFTMDLNVVEHKVFYTELLNLCEAEDSALTKLPCYKSLPSLVPLRIAALNALAACNYLPQSREKIIAALFKALNSTNSELQEAGEACMRKFLEGATIEVDQIHTHMRPLLMMLGDYRSLTLNVVNRLTSVTRLFPNSFNDKFCDQMMQHLRKWMEVVVITHKGGQRSDGNESISECGRCPLSPFCQFEEMKICSAIINLFHLIPAAPQTLVKPLLEVVMKTERAMLIEAGSPFREPLIKFLTRHPSQTVELFMMEATLNDPQWSRMFMSFLKHKDARPLRDVLAANPNRFITLLLPGGAQTAVRPGSPSTSTMRLDLQFQAIKIISIIVKNDDSWLASQHSLVSQLRRVWVSENFQERHRKENMAATNWKEPKLLAYCLLNYCKRNYGDIELLFQLLRAFTGRFLCNMTFLKEYMEEEIPKNYSIAQKRALFFRFVDFNDPNFGDELKAKVLQHILNPAFLYSFEKGEGEQLLGPPNPEGDNPESITSVFITKVLDPEKQADMLDSLRIYLLQYATLLVEHAPHHIHDNNKNRNSKLRRLMTFAWPCLLSKACVDPACKYSGHLLLAHIIAKFAIHKKIVLQVFHSLLKAHAMEARAIVRQAMAILTPAVPARMEDGHQMLTHWTRKIIVEEGHTVPQLVHILHLIVQHFKVYYPVRHHLVQHMVSAMQRLGFTPSVTIEQRRLAVDLSEVVIKWELQRIKDQQPDSDMDPNSSGEGVNSVSSSIKRGLSVDSAQEVKRFRTATGAISAVFGRSQSLPGADSLLAKPIDKQHTDTVVNFLIRVACQVNDNTNTAGSPGEVLSRRCVNLLKTALRPDMWPKSELKLQWFDKLLMTVEQPNQVNYGNICTGLEVLSFLLTVLQSPAILSSFKPLQRGIAACMTCGNTKVLRAVHSLLSRLMSIFPTEPSTSSVASKYEELECLYAAVGKVIYEGLTNYEKATNANPSQLFGTLMILKSACSNNPSYIDRLISVFMRSLQKMVREHLNPQAASGSTEATSGTSELVMLSLELVKTRLAVMSMEMRKNFIQAILTSLIEKSPDAKILRAVVKIVEEWVKNNSPMAANQTPTLREKSILLVKMMTYIEKRFPEDLELNAQFLDLVNYVYRDETLSGSELTAKLEPAFLSGLRCAQPLIRAKFFEVFDNSMKRRVYERLLYVTCSQNWEAMGNHFWIKQCIELLLAVCEKSTPIGTSCQGAMLPSITNVINLADSHDRAAFAMVTHVKQEPRERENSESKEEDVEIDIELAPGDQTSTPKTKELSEKDIGNQLHMLTNRHDKFLDTLREVKTGALLSAFVQLCHISTTLAEKTWVQLFPRLWKILSDRQQHALAGEISPFLCSGSHQVQRDCQPSALNCFVEAMSQCVPPIPIRPCVLKYLGKTHNLWFRSTLMLEHQAFEKGLSLQIKPKQTTEFYEQESITPPQQEILDSLAELYSLLQEEDMWAGLWQKRCKYSETATAIAYEQHGFFEQAQESYEKAMDKAKKEHERSNASPAIFPEYQLWEDHWIRCSKELNQWEALTEYGQSKGHINPYLVLECAWRVSNWTAMKEALVQVEVSCPKEMAWKVNMYRGYLAICHPEEQQLSFIERLVEMASSLAIREWRRLPHVVSHVHTPLLQAAQQIIELQEAAQINAGLQPTNLGRNNSLHDMKTVVKTWRNRLPIVSDDLSHWSSIFMWRQHHYQAIVTAYENSSQHDPSSNNAMLGVHASASAIIQYGKIARKQGLVNVALDILSRIHTIPTVPIVDCFQKIRQQVKCYLQLAGVMGKNECMQGLEVIESTNLKYFTKEMTAEFYALKGMFLAQINKSEEANKAFSAAVQMHDVLVKAWAMWGDYLENIFVKERQLHLGVSAITCYLHACRHQNESKSRKYLAKVLWLLSFDDDKNTLADAVDKYCIGVPPIQWLAWIPQLLTCLVGSEGKLLLNLISQVGRVYPQAVYFPIRTLYLTLKIEQRERYKSDSGQQQPSSVGNQSHSASDPGPIRATAPMWRCSRIMHMQRELHPTLLSSLEGIVDQMVWFRENWHEEVLRQLQQGLAKCYSVAFEKSGAVSDAKITPHTLNFVKKLVSTFGVGLENVSNVSTMFSSAASESLARRAQATAQDPVFQKLKGQFTTDFDFSVPGSMKLHNLISKLKKWIKILEAKTKQLPKFFLIEEKCRFLSNFSAQTAEVEIPGEFLMPKPTHYYIKIARFMPRVEIVQKHNTAARRLYIRGHNGKIYPYLVMNDACLTESRREERVLQLLRLLNPCLEKRKETTKRHLFFTVPRVVAVSPQMRLVEDNPSSLSLVEIYKQRCAKKGIEHDNPISRYYDRLATVQARGTQASHQVLRDILKEVQSNMVPRSMLKEWALHTFPNATDYWTFRKMFTIQLALIGFAEFVLHLNRLNPEMLQIAQDTGKLNVAYFRFDINDATGDLDANRPVPFRLTPNISEFLTTIGVSGPLTASMIAVARCFAQPNFKVDGILKTVLRDEIIAWHKKTQEDTSSPLSAAGQPENMDSQQLVSLVQKAVTAIMTRLHNLAQFEGGESKVNTLVAAANSLDNLCRMDPAWHPWL

SEQ ID NO: 865315 - protein, 3848 aa, Homo sapiens
MAFVATQGATVVDQTTLMKKYLQFVAALTDVNTPDETKLKMMQEVSENFENVTSSPQYSTFLEHIIPRFLTFLQDGEVQFLQEKPAQQLRKLVLEIIHRIPTNEHLRPHTKNVLSVMFRFLETENEENVLICLRIIIELHKQFRPPITQEIHHFLDFVKQIYKELPKVVNRYFENPQVIPENTVPPPEMVGMITTIAVKVNPEREDSETRTHSIIPRGSLSLKVLAELPIIVVLMYQLYKLNIHNVVAEFVPLIMNTIAIQVSAQARQHKLYNKELYADFIAAQIKTLSFLAYIIRIYQELVTKYSQQMVKGMLQLLSNCPAETAHLRKELLIAAKHILTTELRNQFIPCMDKLFDESILIGSGYTARETLRPLAYSTLADLVHHVRQHLPLSDLSLAVQLFAKNIDDESLPSSIQTMSCKLLLNLVDCIRSKSEQESGNGRDVLMRMLEVFVLKFHTIARYQLSAIFKKCKPQSELGAVEAALPGVPTAPAAPGPAPSPAPVPAPPPPPPPPPPATPVTPAPVPPFEKQGEKDKEDKQTFQVTDCRSLVKTLVCGVKTITWGITSCKAPGEAQFIPNKQLQPKETQIYIKLVKYAMQALDIYQVQIAGNGQTYIRVANCQTVRMKEEKEVLEHFAGVFTMMNPLTFKEIFQTTVPYMVERISKNYALQIVANSFLANPTTSALFATILVEYLLDRLPEMGSNVELSNLYLKLFKLVFGSVSLFAAENEQMLKPHLHKIVNSSMELAQTAKEPYNYFLLLRALFRSIGGGSHDLLYQEFLPLLPNLLQGLNMLQSGLHKQHMKDLFVELCLTVPVRLSSLLPYLPMLMDPLVSALNGSQTLVSQGLRTLELCVDNLQPDFLYDHIQPVRAELMQALWRTLRNPADSISHVAYRVLGKFGGSNRKMLKESQKLHYVVTEVQGPSITVEFSDCKASLQLPMEKAIETALDCLKSANTEPYYRRQAWEVIKCFLVAMMSLEDNKHALYQLLAHPNFTEKTIPNVIISHRYKAQDTPARKTFEQALTGAFMSAVIKDLRPSALPFVASLIRHYTMVAVAQQCGPFLLPCYQVGSQPSTAMFHSEENGSKGMDPLVLIDAIAICMAYEEKELCKIGEVALAVIFDVASIILGSKERACQLPLFSYIVERLCACCYEQAWYAKLGGVVSIKFLMERLPLTWVLQNQQTFLKALLFVMMDLTGEVSNGAVAMAKTTLEQLLMRCATPLKDEERAEEIVAAQEKSFHHVTHDLVREVTSPNSTVRKQAMHSLQVLAQVTGKSVTVIMEPHKEVLQDMVPPKKHLLRHQPANAQIGLMEGNTFCTTLQPRLFTMDLNVVEHKVFYTELLNLCEAEDSALTKLPCYKSLPSLVPLRIAALNALAACNYLPQSREKIIAALFKALNSTNSELQEAGEACMRKFLEGATIEVDQIHTHMRPLLMMLGDYRSLTLNVVNRLTSVTRLFPNSFNDKFCDQMMQHLRKWMEVVVITHKGGQRSDGNESISECGRCPLSPFCQFEEMKICSAIINLFHLIPAAPQTLVKPLLEVVMKTERAMLIEAGSPFREPLIKFLTRHPSQTVELFMMEATLNDPQWSRMFMSFLKHKDARPLRDVLAANPNRFITLLLPGGAQTAVRPGSPSTSTMRLDLQFQAIKIISIIVKNDDSWLASQHSLVSQLRRVWVSENFQERHRKENMAATNWKEPKLLAYCLLNYCKRNYGDIELLFQLLRAFTGRFLCNMTFLKEYMEEEIPKNYSIAQKRALFFRFVDFNDPNFGDELKAKVLQHILNPAFLYSFEKGEGEQLLGPPNPEGDNPESITSVFITKVLDPEKQADMLDSLRIYLLQYATLLVEHAPHHIHDNNKNRNSKLRRLMTFAWPCLLSKACVDPACKYSGHLLLAHIIAKFAIHKKIVLQVFHSLLKAHAMEARAIVRQAMAILTPAVPARMEDGHQMLTHWTRKIIVEEGHTVPQLVHILHLIVQHFKVYYPVRHHLVQHMVSAMQRLGFTPSVTIEQRRLAVDLSEVVIKWELQRIKDQQPDSDMDPNSSGEGVNSVSSSIKRGLSVDSAQEVKRFRTATGAISAVFGRSQSLPGADSLLAKPIDKQHTDTVVNFLIRVACQVNDNTNTAGSPGEVLSRRCVNLLKTALRPDMWPKSELKLQWFDKLLMTVEQPNQVNYGNICTGLEVLSFLLTVLQSPAILSSFKPLQRGIAACMTCGNTKVLRAVHSLLSRLMSIFPTEPSTSSVASKYEELECLYAAVGKVIYEGLTNYEKATNANPSQLFGTLMILKSACSNNPSYIDRLISVFMRSLQKMVREHLNPQAASGSTEATSGTSELVMLSLELVKTRLAVMSMEMRKNFIQAILTSLIEKSPDAKILRAVVKIVEEWVKNNSPMAANQTPTLREKSILLVKMMTYIEKRFPEDLELNAQFLDLVNYVYRDETLSGSELTAKLEPAFLSGLRCAQPLIRAKFFEVFDNSMKRRVYERLLYVTCSQNWEAMGNHFWIKQCIELLLAVCEKSTPIGTSCQGAMLPSITNVINLADSHDRAAFAMVTHVKQEPRERENSESKEEDVEIDIELAPGDQTSTPKTKELSEKDIGNQLHMLTNRHDKFLDTLREVKTGALLSAFVQLCHISTTLAEKTWVQLFPRLWKILSDRQQHALAGEISPFLCSGSHQVQRDCQPSALNCFVEAMSQCVPPIPIRPCVLKYLGKTHNLWFRSTLMLEHQAFEKGLSLQIKPKQTTEFYEQESITPPQQEILDSLAELYSLLQEEDMWAGLWQKRCKYSETATAIAYEQHGFFEQAQESYEKAMDKAKKEHERSNASPAIFPEYQLWEDHWIRCSKELNQWEALTEYGQSKGHINPYLVLECAWRVSNWTAMKEALVQVEVSCPKEMAWKVNMYRGYLAICHPEEQQLSFIERLVEMASSLAIREWRRLPHVVSHVHTPLLQAAQQIIELQEAAQINAGLQPTNLGRNNSLHDMKTVVKTWRNRLPIVSDDLSHWSSIFMWRQHHYQAIVTAYENSSQHDPSSNNAMLGVHASASAIIQYGKIARKQGLVNVALDILSRIHTIPTVPIVDCFQKIRQQVKCYLQLAGVMGKNECMQGLEVIESTNLKYFTKEMTAEFYALKGMFLAQINKSEEANKAFSAAVQMHDVLVKAWAMWGDYLENIFVKERQLHLGVSAITCYLHACRHQNESKSRKYLAKVLWLLSFDDDKNTLADAVDKYCIGVPPIQWLAWIPQLLTCLVGSEGKLLLNLISQVGRVYPQAVYFPIRTLYLTLKIEQRERYKSDSGQQQPSSVGNQSHSASDPGPIRATAPMWRCSRIMHMQRELHPTLLSSLEGIVDQMVWFRENWHEEVLRQLQQGLAKCYSVAFEKSGAVSDAKITPHTLNFVKKLVSTFGVGLENVSNVSTMFSSAASESLARRAQATAQDPVFQKLKGQFTTDFDFSVPGSMKLHNLISKLKKWIKILEAKTKQLPKFFLIEEKCRFLSNFSAQTAEVEIPGEFLMPKPTHYYIKIARFMPRVEIVQKHNTAARRLYIRGHNGKIYPYLVMNDACLTESRREERVLQLLRLLNPCLEKRKETTKRHLFFTVPRVVAVSPQMRLVEDNPSSLSLVEIYKQRCAKKGIEHDNPISRYYDRLATVQARGTQASHQVLRDILKEVQSNMVPRSMLKEWALHTFPNATDYWTFRKMFTIQLALIGFAEFVLHLNRLNPEMLQIAQDTGKLNVAYFRFDINDATGDLDANRPVPFRLTPNISEFLTTIGVSGPLTASMIAVARCFAQPNFKVDGILKTVLRDEIIAWHKMDSQQLVSLVQKAVTAIMTRLHNLAQFEGGESKVNTLVAAANSLDNLCRMDPAWHPWL

SEQ ID NO: 865316 - protein, 1244 aa, Homo sapiens
TEYEEAVLLLFQCGGGGSLTVHGRALAGEISPFLCSGSHQVQRDCQPSALNCFVEAMSQCVPPIPIRPCVLKYLGKTHNLWFRSTLMLEHQAFEKGLSLQIKPKQTTEFYEQESITPPQQEILDSLAELYSLLQEEDMWAGLWQKRCKYSETATAIAYEQHGFFEQAQESYEKAMDKAKKEHERSNASPAIFPEYQLWEDHWIRCSKELNQWEALTEYGQSKGHINPYLVLECAWRVSNWTAMKEALVQVEVSCPKEMAWKVNMYRGYLAICHPEEQQLSFIERLVEMASSLAIREWRRLPHVVSHVHTPLLQAAQQIIELQEAAQINAGLQPTNLGRNNSLHDMKTVVKTWRNRLPIVSDDLSHWSSIFMWRQHHYQAIVTAYENSSQHDPSSNNAMLGVHASASAIIQYGKIARKQGLVNVALDILSRIHTIPTVPIVDCFQKIRQQVKCYLQLAGVMGKNECMQGLEVIESTNLKYFTKEMTAEFYALKGMFLAQINKSEEANKAFSAAVQMHDVLVKAWAMWGDYLENIFVKERQLHLGVSAITCYLHACRHQNESKSRKYLAKVLWLLSFDDDKNTLADAVDKYCIGVPPIQWLAWIPQLLTCLVGSEGKLLLNLISQVGRVYPQAVYFPIRTLYLTLKIEQRERYKSDSGQQQPSSVGNQSHSASDPGPIRATAPMWRCSRIMHMQRELHPTLLSSLEGIVDQMVWFRENWHEEVLRQLQQGLAKCYSVAFEKSGAVSDAKITPHTLNFVKKLVSTFGVGLENVSNVSTMFSSAASESLARRAQATAQDPVFQKLKGQFTTDFDFSVPGSMKLHNLISKLKKWIKILEAKTKQLPKFFLIEEKCRFLSNFSAQTAEVEIPGEFLMPKPTHYYIKIARFMPRVEIVQKHNTAARRLYIRGHNGKIYPYLVMNDACLTESRREERVLQLLRLLNPCLEKRKETTKRHLFFTVPRVVAVSPQMRLVEDNPSSLSLVEIYKQRCAKKGIEHDNPISRYYDRLATVQARGTQASHQVLRDILKEVQSNMVPRSMLKEWALHTFPNATDYWTFRKMFTIQLALIGFAEFVLHLNRLNPEMLQIAQDTGKLNVAYFRFDINDATGDLDANRPVPFRLTPNISEFLTTIGVSGPLTASMIAVARCFAQPNFKVDGILKTVLRDEIIAWHKKTQEDTSSPLSAAGQPENMDSQQLVSLVQKAVTAIMTRLHNLAQFEGGESKVNTLVAAANSLDNLCRMDPAWHPWL

SEQ ID NO: 865317 - protein, 729 aa, Homo sapiens
QLWRELLTQGELLTQGELLTQERQLHLGVSAITCYLHACRHQNESKSRKYLAKVLWLLSFDDDKNTLADAVDKYCIGVPPIQWLAWIPQLLTCLVGSEGKLLLNLISQVGRVYPQAVYFPIRTLYLTLKIEQRERYKSDSGQQQPSSVGNQSHSASDPGPIRATAPMWRCSRIMHMQRELHPTLLSSLEGIVDQMVWFRENWHEEVLRQLQQGLAKCYSVAFEKSGAVSDAKITPHTLNFVKKLVSTFGVGLENVSNVSTMFSSAASESLARRAQATAQDPVFQKLKGQFTTDFDFSVPGSMKLHNLISKLKKWIKILEAKTKQLPKFFLIEEKCRFLSNFSAQTAEVEIPGEFLMPKPTHYYIKIARFMPRVEIVQKHNTAARRLYIRGHNGKIYPYLVMNDACLTESRREERVLQLLRLLNPCLEKRKETTKRHLFFTVPRVVAVSPQMRLVEDNPSSLSLVEIYKQRCAKKGIEHDNPISRYYDRLATVQARGTQASHQVLRDILKEVQSNMVPRSMLKEWALHTFPNATDYWTFRKMFTIQLALIGFAEFVLHLNRLNPEMLQIAQDTGKLNVAYFRFDINDATGDLDANRPVPFRLTPNISEFLTTIGVSGPLTASMIAVARCFAQPNFKVDGILKTVLRDEIIAWHKKTQEDTSSPLSAAGQPENMDSQQLVSLVQKAVTAIMTRLHNLAQFEGGESKVNTLVAAANSLDNLCRMDPAWHPWL

SEQ ID NO: 865318 - protein, 3866 aa, Homo sapiens; identical to SEQ ID NO: 865314

SEQ ID NO: 865319 - protein, 2762 aa, Homo sapiens
MAFVATQGATVVDQTTLMKKYLQFVAALTDVNTPDETKLKMMQEVSENFENVTSSPQYSTFLEHIIPRFLTFLQDGEVQFLQEKPAQQLRKLVLEIIHRIPTNEHLRPHTKNVLSVMFRFLETENEENVLICLRIIIELHKQFRPPITQEIHHFLDFVKQIYKELPKVVNRYFENPQVIPENTVPPPEMVGMITTIAVKVNPEREDSETRTHSIIPRGSLSLKVLAELPIIVVLMYQLYKLNIHNVVAEFVPLIMNTIAIQVSAQARQHKLYNKELYADFIAAQIKTLSFLAYIIRIYQELVTKYSQQMVKGMLQLLSNCPAETAHLRKELLIAAKHILTTELRNQFIPCMDKLFDESILIGSGYTARETLRPLAYSTLADLVHHVRQHLPLSDLSLAVQLFAKNIDDESLPSSIQTMSCKLLLNLVDCIRSKSEQESGNGRDVLMRMLEVFVLKFHTIARYQLSAIFKKCKPQSELGAVEAALPGVPTAPAAPGPAPSPAPVPAPPPPPPPPPPATPVTPAPVPPFEKQGEKDKEDKQTFQVTDCRSLVKTLVCGVKTITWGITSCKAPGEAQFIPNKQLQPKETQIYIKLVKYAMQALDIYQVQIAGNGQTYIRVANCQTVRMKEEKEVLEHFAGVFTMMNPLTFKEIFQTTVPYMVERISKNYALQIVANSFLANPTTSALFATILVEYLLDRLPEMGSNVELSNLYLKLFKLVFGSVSLFAAENEQMLKPHLHKIVNSSMELAQTAKEPYNYFLLLRALFRSIGGGSHDLLYQEFLPLLPNLLQGLNMLQSGLHKQHMKDLFVELCLTVPVRLSSLLPYLPMLMDPLVSALNGSQTLVSQGLRTLELCVDNLQPDFLYDHIQPVRAELMQALWRTLRNPADSISHVAYRVLGKFGGSNRKMLKESQKLHYVVTEVQGPSITVEFSDCKASLQLPMEKAIETALDCLKSANTEPYYRRQAWEVIKCFLVAMMSLEDNKHALYQLLAHPNFTEKTIPNVIISHRYKAQDTPARKTFEQALTGAFMSAVIKDLRPSALPFVASLIRHYTMVAVAQQCGPFLLPCYQVGSQPSTAMFHSEENGSKGMDPLVLIDAIAICMAYEEKELCKIGEVALAVIFDVASIILGSKERACQLPLFSYIVERLCACCYEQAWYAKLGGVVSIKFLMERLPLTWVLQNQQTFLKALLFVMMDLTGEVSNGAVAMAKTTLEQLLMRCATPLKDEERAEEIVAAQEKSFHHVTHDLVREVTSPNSTVRKQAMHSLQVLAQVTGKSVTVIMEPHKEVLQDMVPPKKHLLRHQPANAQIGLMEGNTFCTTLQPRLFTMDLNVVEHKVFYTELLNLCEAEDSALTKLPCYKSLPSLVPLRIAALNALAACNYLPQSREKIIAALFKALNSTNSELQEAGEACMRKFLEGATIEVDQIHTHMRPLLMMLGDYRSLTLNVVNRLTSVTRLFPNSFNDKFCDQMMQHLRKWMEVVVITHKGGQRSDGNESISECGRCPLSPFCQFEEMKICSAIINLFHLIPAAPQTLVKPLLEVVMKTERAMLIEAGSPFREPLIKFLTRHPSQTVELFMMEATLNDPQWSRMFMSFLKHKDARPLRDVLAANPNRFITLLLPGGAQTAVRPGSPSTSTMRLDLQFQAIKIISIIVKNDDSWLASQHSLVSQLRRVWVSENFQERHRKENMAATNWKEPKLLAYCLLNYCKRNYGDIELLFQLLRAFTGRFLCNMTFLKEYMEEEIPKNYSIAQKRALFFRFVDFNDPNFGDELKAKVLQHILNPAFLYSFEKGEGEQLLGPPNPEGDNPESITSVFITKVLDPEKQADMLDSLRIYLLQYATLLVEHAPHHIHDNNKNRNSKLRRLMTFAWPCLLSKACVDPACKYSGHLLLAHIIAKFAIHKKIVLQVFHSLLKAHAMEARAIVRQAMAILTPAVPARMEDGHQMLTHWTRKIIVEEGHTVPQLVHILHLIVQHFKVYYPVRHHLVQHMVSAMQRLGFTPSVTIEQRRLAVDLSEVVIKWELQRIKDQQPDSDMDPNSSGEGVNSVSSSIKRGLSVDSAQEVKRFRTATGAISAVFGRSQSLPGADSLLAKPIDKQHTDTVVNFLIRVACQVNDNTNTAGSPGEVLSRRCVNLLKTALRPDMWPKSELKLQWFDKLLMTVEQPNQVNYGNICTGLEVLSFLLTVLQSPAILSSFKPLQRGIAACMTCGNTKVLRAVHSLLSRLMSIFPTEPSTSSVASKYEELECLYAAVGKVIYEGLTNYEKATNANPSQLFGTLMILKSACSNNPSYIDRLISVFMRSLQKMVREHLNPQAASGSTEATSGTSELVMLSLELVKTRLAVMSMEMRKNFIQAILTSLIEKSPDAKILRAVVKIVEEWVKNNSPMAANQTPTLREKSILLVKMMTYIEKRFPEDLELNAQFLDLVNYVYRDETLSGSELTAKLEPAFLSGLRCAQPLIRAKFFEVFDNSMKRRVYERLLYVTCSQNWEAMGNHFWIKQCIELLLAVCEKSTPIGTSCQGAMLPSITNVINLADSHDRAAFAMVTHVKQEPRERENSESKEEDVEIDIELAPGDQTSTPKTKELSEKDIGNQLHMLTNRHDKFLDTLREVKTGALLSAFVQLCHISTTLAEKTWVQLFPRLWKILSDRQQHALAGEISPFLCSGSHQVQRDCQPSALNCFVEAMSQCVPPIPIRPCVLKYLGKTHNLWFRSTLMLEHQAFEKGLSLQIKPKQTTEFYEQESITPPQQVRVRLSLLITSSLPVTSHFK

SEQ ID NO: 865320 - protein, 1307 aa, Homo sapiens
MAFVATQGATVVDQTTLMKKYLQFVAALTDVNTPDETKLKMMQEVSENFENVTSSPQYSTFLEHIIPRFLTFLQDGEVQFLQEKPAQQLRKLVLEIIHRIPTNEHLRPHTKNVLSVMFRFLETENEENVLICLRIIIELHKQFRPPITQEIHHFLDFVKQIYKELPKVVNRYFENPQVIPENTVPPPEMVGMITTIAVKVNPEREDSETRTHSIIPRGSLSLKVLAELPIIVVLMYQLYKLNIHNVVAEFVPLIMNTIAIQVSAQARQHKLYNKELYADFIAAQIKTLSFLAYIIRIYQELVTKYSQQMVKGMLQLLSNCPAETAHLRKELLIAAKHILTTELRNQFIPCMDKLFDESILIGSGYTARETLRPLAYSTLADLVHHVRQHLPLSDLSLAVQLFAKNIDDESLPSSIQTMSCKLLLNLVDCIRSKSEQESGNGRDVLMRMLEVFVLKFHTIARYQLSAIFKKCKPQSELGAVEAALPGVPTAPAAPGPAPSPAPVPAPPPPPPPPPPATPVTPAPVPPFEKQGEKDKEDKQTFQVTDCRSLVKTLVCGVKTITWGITSCKAPGEAQFIPNKQLQPKETQIYIKLVKYAMQALDIYQVQIAGNGQTYIRVANCQTVRMKEEKEVLEHFAGVFTMMNPLTFKEIFQTTVPYMVERISKNYALQIVANSFLANPTTSALFATILVEYLLDRLPEMGSNVELSNLYLKLFKLVFGSVSLFAAENEQMLKPHLHKIVNSSMELAQTAKEPYNYFLLLRALFRSIGGGSHDLLYQEFLPLLPNLLQGLNMLQSGLHKQHMKDLFVELCLTVPVRLSSLLPYLPMLMDPLVSALNGSQTLVSQGLRTLELCVDNLQPDFLYDHIQPVRAELMQALWRTLRNPADSISHVAYRVLGKFGGSNRKMLKESQKLHYVVTEVQGPSITVEFSDCKASLQLPMEKAIETALDCLKSANTEPYYRRQAWEVIKCFLVAMMSLEDNKHALYQLLAHPNFTEKTIPNVIISHRYKAQDTPARKTFEQALTGAFMSAVIKDLRPSALPFVASLIRHYTMVAVAQQCGPFLLPCYQVGSQPSTAMFHSEENGSKGMDPLVLIDAIAICMAYEEKELCKIGEVALAVIFDVASIILGSKERACQLPLFSYIVERLCACCYEQAWYAKLGGVVSIKFLMERLPLTWVLQNQQTFLKALLFVMMDLTGEVSNGAVAMAKTTLEQLLMRCATPLKDEERAEEIVAAQEKSFHHVTHDLVREVTSPNSTVRKQAMHSLQVLAQVTGKSVTVIMEPHKEVLQDMSPYRSTCSNTPTHIEVRY

SEQ ID NO: 865321 - protein, 76 aa, Homo sapiens
TLMILKSACSNNPSYIDRLISVFMRSLQKMVREHLNPQAASGSTEATSGDVLATGGLSSDSVEQRTDSVVQAGAEL

SEQ ID NO: 865322 - protein, 1064 aa, Homo sapiens
FFEQAQESYEKAMDKANWEDHWIRCSKELNQWEALTEYGQSKGHINPYLVLECAWRVSNWTAMKEALVQVEVSCPKEMAWKVNMYRGYLAICHPEEQQLSFIERLVEMASSLAIREWRRLPHVVSHVHTPLLQAAQQIIELQEAAQINAGLQPTNLGRNNSLHDMKTVVKTWRNRLPIVSDDLSHWSSIFMWRQHHYQAIVTAYENSSQHDPSSNNAMLGVHASASAIIQYGKIARKQGLVNVALDILSRIHTIPTVPIVDCFQKIRQQVKCYLQLAGVMGKNECMQGLEVIESTNLKYFTKEMTAEFYALKGMFLAQINKSEEANKAFSAAVQMHDVLVKAWAMWGDYLENIFVKERQLHLGVSAITCYLHACRHQNESKSRKYLAKVLWLLSFDDDKNTLADAVDKYCIGVPPIQWLAWIPQLLTCLVGSEGKLLLNLISQVGRVYPQAVYFPIRTLYLTLKIEQRERYKSDSGQQQPSSVGNQSHSASDPGPIRATAPMWRCSRIMHMQRELHPTLLSSLEGIVDQMVWFRENWHEEVLRQLQQGLAKCYSVAFEKSGAVSDAKITPHTLNFVKKLVSTFGVGLENVSNVSTMFSSAASESLARRAQATAQDPVFQKLKGQFTTDFDFSVPGSMKLHNLISKLKKWIKILEAKTKQLPKFFLIEEKCRFLSNFSAQTAEVEIPGEFLMPKPTHYYIKIARFMPRVEIVQKHNTAARRLYIRGHNGKIYPYLVMNDACLTESRREERVLQLLRLLNPCLEKRKETTKRHLFFTVPRVVAVSPQMRLVEDNPSSLSLVEIYKQRCAKKGIEHDNPISRYYDRLATVQARGTQASHQVLRDILKEVQSNMVPRSMLKEWALHTFPNATDYWTFRKMFTIQLALIGFAEFVLHLNRLNPEMLQIAQDTGKLNVAYFRFDINDATGDLDANRPVPFRLTPNISEFLTTIGVSGPLTASMIAVARCFAQPNFKVDGILKTVLRDEIIAWHKKTQEDTSSPLSAAGQPENMDSQQLVSLVQKAVTAIMTRLHNLAQFEGGESKVNTLVAAANSLDNLCRMDPAWHPWL

SEQ ID NO: 865323 - protein, 476 aa, Homo sapiens
CKVVDWCCRRQRSGLGENAWAQATAQDPVFQKLKGQFTTDFDFSVPGSMKLHNLISKLKKWIKILEAKTKQLPKFFLIEEKCRFLSNFSAQTAEVEIPGEFLMPKPTHYYIKIARFMPRVEIVQKHNTAARRLYIRGHNGKIYPYLVMNDACLTESRREERVLQLLRLLNPCLEKRKETTKRHLFFTVPRVVAVSPQMRLVEDNPSSLSLVEIYKQRCAKKGIEHDNPISRYYDRLATVQARGTQASHQVLRDILKEVQSNMVPRSMLKEWALHTFPNATDYWTFRKMFTIQLALIGFAEFVLHLNRLNPEMLQIAQDTGKLNVAYFRFDINDATGDLDANRPVPFRLTPNISEFLTTIGVSGPLTASMIAVARCFAQPNFKVDGILKTVLRDEIIAWHKKTQEDTSSPLSAAGQPENMDSQQLVSLVQKAVTAIMTRLHNLAQFEGGESKVNTLVAAANSLDNLCRMDPAWHPWL

SEQ ID NO: 865324 - protein, 3866 aa, Homo sapiens; identical to SEQ ID NO: 865314

SEQ ID NO: 865325 - protein, 1067 aa, Homo sapiens
MAFVATQGATVVDQTTLMKKYLQFVAALTDVNTPDETKLKMMQEVSENFENVTSSPQYSTFLEHIIPRFLTFLQDGEVQFLQEKPAQQLRKLVLEIIHRIPTNEHLRPHTKNVLSVMFRFLETENEENVLICLRIIIELHKQFRPPITQEIHHFLDFVKQIYKELPKVVNRYFENPQVIPENTVPPPEMVGMITTIAVKVNPEREDSETRTHSIIPRGSLSLKVLAELPIIVVLMYQLYKLNIHNVVAEFVPLIMNTIAIQVSAQARQHKLYNKELYADFIAAQIKTLSFLAYIIRIYQELVTKYSQQMVKGMLQLLSNCPAETAHLRKELLIAAKHILTTELRNQFIPCMDKLFDESILIGSGYTARETLRPLAYSTLADLVHHVRQHLPLSDLSLAVQLFAKNIDDESLPSSIQTMSCKLLLNLVDCIRSKSEQESGNGRDVLMRMLEVFVLKFHTIARYQLSAIFKKCKPQSELGAVEAALPGVPTAPAAPGPAPSPAPVPAPPPPPPPPPPATPVTPAPVPPFEKQGEKDKEDKQTFQVTDCRSLVKTLVCGVKTITWGITSCKAPGEAQFIPNKQLQPKETQIYIKLVKYAMQALDIYQVQIAGNGQTYIRVANCQTVRMKEEKEVLEHFAGVFTMMNPLTFKEIFQTTVPYMVERISKNYALQIVANSFLANPTTSALFATILVEYLLDRLPEMGSNVELSNLYLKLFKLVFGSVSLFAAENEQMLKPHLHKIVNSSMELAQTAKEPYNYFLLLRALFRSIGGGSHDLLYQEFLPLLPNLLQGLNMLQSGLHKQHMKDLFVELCLTVPVRLSSLLPYLPMLMDPLVSALNGSQTLVSQGLRTLELCVDNLQPDFLYDHIQPVRAELMQALWRTLRNPADSISHVAYRVLGKFGGSNRKMLKESQKLHYVVTEVQGPSITVEFSDCKASLQLPMEKAIETALDCLKSANTEPYYRRQAWEVIKCFLVAMMSLEDNKHALYQLLAHPNFTEKTIPNVIISHRYKAQDTPARKTFEQALTGAFMSAVIKDLRPSALPFVASLIRHYTMVAVAQQCDRVSLCCPG

SEQ ID NO: 865326 - protein, 1443 aa, Homo sapiens
MAFVATQGATVVDQTTLMKKYLQFVAALTDVNTPDETKLKMMQEVSENFENVTSSPQYSTFLEHIIPRFLTFLQDGEVQFLQEKPAQQLRKLVLEIIHRIPTNEHLRPHTKNVLSVMFRFLETENEENVLICLRIIIELHKQFRPPITQEIHHFLDFVKQIYKELPKVVNRYFENPQVIPENTVPPPEMVGMITTIAVKVNPEREDSETRTHSIIPRGSLSLKVLAELPIIVVLMYQLYKLNIHNVVAEFVPLIMNTIAIQVSAQARQHKLYNKELYADFIAAQIKTLSFLAYIIRIYQELVTKYSQQMVKGMLQLLSNCPAETAHLRKELLIAAKHILTTELRNQFIPCMDKLFDESILIGSGYTARETLRPLAYSTLADLVHHVRQHLPLSDLSLAVQLFAKNIDDESLPSSIQTMSCKLLLNLVDCIRSKSEQESGNGRDVLMRMLEVFVLKFHTIARYQLSAIFKKCKPQSELGAVEAALPGVPTAPAAPGPAPSPAPVPAPPPPPPPPPPATPVTPAPVPPFEKQGEKDKEDKQTFQVTDCRSLVKTLVCGVKTITWGITSCKAPGEAQFIPNKQLQPKETQIYIKLVKYAMQALDIYQVQIAGNGQTYIRVANCQTVRMKEEKEVLEHFAGVFTMMNPLTFKEIFQTTVPYMVERISKNYALQIVANSFLANPTTSALFATILVEYLLDRLPEMGSNVELSNLYLKLFKLVFGSVSLFAAENEQMLKPHLHKIVNSSMELAQTAKEPYNYFLLLRALFRSIGGGSHDLLYQEFLPLLPNLLQGLNMLQSGLHKQHMKDLFVELCLTVPVRLSSLLPYLPMLMDPLVSALNGSQTLVSQGLRTLELCVDNLQPDFLYDHIQPVRAELMQALWRTLRNPADSISHVAYRVLGKFGGSNRKMLKESQKLHYVVTEVQGPSITVEFSDCKASLQLPMEKAIETALDCLKSANTEPYYRRQAWEVIKCFLVAMMSLEDNKHALYQLLAHPNFTEKTIPNVIISHRYKAQDTPARKTFEQALTGAFMSAVIKDLRPSALPFVASLIRHYTMVAVAQQCGPFLLPCYQVGSQPSTAMFHSEENGSKGMDPLVLIDAIAICMAYEEKELCKIGEVALAVIFDVASIILGSKERACQLPLFSYIVERLCACCYEQAWYAKLGGVVSIKFLMERLPLTWVLQNQQTFLKALLFVMMDLTGEVSNGAVAMAKTTLEQLLMRCATPLKDEERAEEIVAAQEKSFHHVTHDLVREVTSPNSTVRKQAMHSLQVLAQVTGKSVTVIMEPHKEVLQDMVPPKKHLLRHQPANAQIGLMEGNTFCTTLQPRLFTMDLNVVEHKVFYTELLNLCEAEDSALTKLPCYKSLPSLVPLRIAALNALAACNYLPQSREKIIAALFKALNSTNSELQESPAAVTSEPREGQPGSQMIGKTTVLKRDSGVTERGSSTGV

SEQ ID NO: 865327 - protein, 100 aa, Homo sapiens
TLSGSELTAKLEPAFLSGLRCAQPLIRAKFFEVFDNSMKRRVYERLLYVTCSQNWEAMGNHFWIKQCIEVGRLGSHLWPGAAVGFLSWGSKARRCSHTLR

SEQ ID NO: 865328 - protein, 270 aa, Homo sapiens
MRLIELLDSDRQEHQDLGLYHLKQINSPMMTVSAYNNFLNYVSSLPSTKAGPKIVSHLLHLVDNKESLENISENDDYLKHQPEISLQMQLLRGLWQICPQAYFSMVSEHLLVLALKTAYQSNTVAACSPFVLQFLQGRTLTLGALNLQYFFDHPESLSLLRSIHFSIRGNKTSPRAHFSVLETCFDKSQVPTIDQDYASAFEPMNEWGAKFRLEKEDNVKSYMDMAAQGITRTLVLAIGKLFSKGRYKIPCLEVDVNDIDVVGQDMLEIL

SEQ ID NO: 865329 - protein, 623 aa, Homo sapiens
MNRYTTMRQLGDGTYGSVLMGKSNESGELVAIKRMKRKFYSWDECMNLREVKSLKKLNHANVIKLKEVIRENDHLYFIFEYMKENLYQLMKDRNKLFPESVIRNIMYQILQGLAFIHKHGFFHRDMKPENLLCMGPELVKIADFGLARELRSQPPYTDYVSTRWYRAPEVLLRSSVYSSPIDVWAVGSIMAELYMLRPLFPGTSEVDEIFKICQVLGTPKKSDWPEGYQLASSMNFRFPQCVPINLKTLIPNASNEAIQLMTEMLNWDPKKRPTASQALKHPYFQVGQVLGPSSNHLESKQSLNKQLQPLESKPSLVEVEPKPLPDIIDQVVGQPQPKTSQQPLQPIQPPQNLSVQQPPKQQSQEKPPQTLFPSIVKNMPTKPNGTLSHKSGRRRWGQTIFKSGDSWEELEDYDFGASHSKKPSMGVFKEKRKKDSPFRLPEPVPSGSNHSTGENKSLPAVTSLKSDSELSTAPTSKQYYLKQSRYLPGVNPKKVSLIASGKEINPHTWSNQLFPKSLGPVGAELAFKRSNAGNLGSYATYNQSGYIPSFLKKEVQSAGQRIHLAPLNATASEYTWNTKTGRGQFSGRTYNPTAKNLNIVNRAQPIPSVHGRTDWVAKYGGHR

SEQ ID NO: 865330 - protein, 623 aa, Homo sapiens; identical to SEQ ID NO: 865329

SEQ ID NO: 865331 - protein, 386 aa, Homo sapiens
MNRYTTMRQLGDGTYGSVLMGKSNESGELVAIKRMKRKFYSWDECMNLREVKSLKKLNHANVIKLKEVIRENDHLYFIFEYMKENLYQLMKDRNKLFPESVIRNIMYQILQGLAFIHKHGFFHRDMKPENLLCMGPELVKIADFGLARELRSQPPYTDYVSTRWYRAPEVLLRSSVYSSPIDVWAVGSIMAELYMLRPLFPGTSEVDEIFKICQVLGTPKKSDWPEGYQLASSMNFRFPQCVPINLKTLIPNASNEAIQLMTEMLNWDPKKRPTASQALKHPYFQVGQVLGPSSNHLESKQSLNKQLQPLESKPSLVEVEPKPLPDIIDQVVGQPQPKTSQQPLQPIQPPQNLSVQQPPKQQSQEKPPQTLFPSIVKNMPTVSSQS

SEQ ID NO: 865332 - protein, 623 aa, Homo sapiens; identical to SEQ ID NO: 865329

SEQ ID NO: 865333 - protein, 434 aa, Homo sapiens
MAELYMLRPLFPGTSEVDEIFKICQVLGTPKKSDWPEGYQLASSMNFRFPQCVPINLKTLIPNASNEAIQLMTEMLNWDPKKRPTASQALKHPYFQVGQVLGPSSNHLESKQSLNKQLQPLESKPSLVEVEPKPLPDIIDQVVGQPQPKTSQQPLQPIQPPQNLSVQQPPKQQSQEKPPQTLFPSIVKNMPTKPNGTLSHKSGRRRWGQTIFKSGDSWEELEDYDFGASHSKKPSMGVFKEKRKKDSPFRLPEPVPSGSNHSTGENKSLPAVTSLKSDSELSTAPTSKQYYLKQSRYLPGVNPKKVSLIASGKEINPHTWSNQLFPKSLGPVGAELAFKRSNAGNLGSYATYNQSGYIPSFLKKEVQSAGQRIHLAPLNATASEYTWNTKTGRGQFSGRTYNPTAKNLNIVNRAQPIPSVHGRTDWVAKYGGHR

SEQ ID NO: 865334 - protein, 128 aa, Homo sapiens
MSKPPCYEEAVLMAEPPPPYSEVLTDTRGLYRKIVTPFLSRRDSAEKQEQPPPSYKPLFLDRGYTSALHLPSAPRPAPPCPALCLQADRGRRVFPSWTDSELSSREPLEHGAWRLPVSIPLFGRTTAV

SEQ ID NO: 865335 - protein, 274 aa, Homo sapiens
MVMSQGTYTFLTCFAGFWLIWGLIVLLCCFCSFLRRRLKRRQEERLREQNLRALELEPLELEGSLAGSPPGLAPPQPPPHRSRLEAPAHAHSHPHVHVHPLLHHGPAQPHAHAHPHPHHHALPHPPPTHLSVPPRPWSYPRQAESDMSKPPCYEEAVLMAEPPPPYSEVLTDTRGLYRKIVTPFLSRRDSAEKQEQPPPSYKPLFLDRGYTSALHLPSAPRPAPPCPALCLQADRGRRVFPSWTDSELSSREPLEHGAWRLPVSIPLFGRTTAV

SEQ ID NO: 865336 - protein, 181 aa, Homo sapiens
ASIRSLRENTGGGGLGFGLGLGRGRPLAGASARGWEPAASPPPTASHSAAESDMSKPPCYEEAVLMAEPPPPYSEVLTDTRGLYRKIVTPFLSRRDSAEKQEQPPPSYKPLFLDRGYTSALHLPSAPRPAPPCPALCLQADRGRRVFPSWTDSELSSREPLEHGAWRLPVSIPLFGRTTAV

SEQ ID NO: 865337 - protein, 274 aa, Homo sapiens; identical to SEQ ID NO: 865335

SEQ ID NO: 865338 - protein, 358 aa, Homo sapiens
MAAVLKPVLLGLRDAPVHGSPTGPGAWTASKLGGIPDALPTVAAPRPVCQRCGQPLALVVQVYCPLEGSPFHRLLHVFACACPGCSTGGARSWKVFRSQCLQVPEREAQDAQKQGNSLAAEDWCEGADDWGSDTEEGPSPQFTLDFGNDASSAKDVDWTARLQDLRLQDAVLGAAHPVPPGLPLFLPYYICVADEDDYRDFVNLDHAHSLLRDYQQREGIAMDQLLSQSLPNDGDEKYEKTIIKSGDQTFYKFMKRIAACQEQILRYSWSGEPLFLTCPTSEVTELPACSQCGGQRIFEFQLMPALVSMLKSANLGLSVEFGTILVYTCEKSCWPPNHQTPMEEFCIIQEDPDELLFK

SEQ ID NO: 865339 - protein, 396 aa, Homo sapiens
MAAVLKPVLLGLRDAPVHGSPTGPGAWTASKLGGIPDALPTVAAPRPVCQRCGQPLALVVQVYCPLEGSPFHRLLHVFACACPGCSTGGARRKAGKSQSCSRGVLSSGLGRAGGLESGCSPHGPLSSPRSWKVFRSQCLQVPEREAQDAQKQGNSLAAEDWCEGADDWGSDTEEGPSPQFTLDFGNDASSAKDVDWTARLQDLRLQDAVLGAAHPVPPGLPLFLPYYICVADEDDYRDFVNLDHAHSLLRDYQQREGIAMDQLLSQSLPNDGDEKYEKTIIKSGDQTFYKFMKRIAACQEQILRYSWSGEPLFLTCPTSEVTELPACSQCGGQRIFEFQLMPALVSMLKSANLGLSVEFGTILVYTCEKSCWPPNHQTPMEEFCIIQEDPDELLFK

SEQ ID NO: 865340 - protein, 242 aa, Homo sapiens
MAAVLKPVLLGLRDAPVHGSPTGPGAWTASKLGGIPDALPTVAAPRPVCQRCGQPLALVVQVYCPLEGSPFHRLLHVFACACPGCSTGGARRRRGSPRAAPGVSFPAGWGGPAGWSRGAALTALCLHPEAGRCSAPSACRCQRERRRTLRYSWSGEPLFLTCPTSEVTELPACSQCGGQRIFEFQLMPALVSMLKSANLGLSVEFGTILVYTCEKSCWPPNHQTPMEEFCIIQEDPDELLFK

SEQ ID NO: 865341 - protein, 358 aa, Homo sapiens; identical to SEQ ID NO: 865338

SEQ ID NO: 865342 - protein, 389 aa, Homo sapiens
PRVDGKYITKSGTRVDHQTGPIVWGEPGTNGQHAFYQLIHQGTKMIPCDFLIPVQTQHPIRKGLHHKDALPTVAAPRPVCQRCGQPLALVVQVYCPLEGSPFHRLLHVFACACPGCSTGGARSWKVFRSQCLQVPEREAQDAQKQGNSLAAEDWCEGADDWGSDTEEGPSPQFTLDFGNDASSAKDVDWTARLQDLRLQDAVLGAAHPVPPGLPLFLPYYICVADEDDYRDFVNLDHAHSLLRDYQQREGIAMDQLLSQSLPNDGDEKYEKTIIKSGDQTFYKFMKRIAACQEQILRYSWSGEPLFLTCPTSEVTELPACSQCGGQRIFEFQLMPALVSMLKSANLGLSVEFGTILVYTCEKSCWPPNHQTPMEEFCIIQEDPDELLFK

SEQ ID NO: 865343 - protein, 375 aa, Homo sapiens
MEKILFYLFLIGIAVKAQICPKRCVCQILSPNLATLCAKKGLLFVPPNIDRRTVELRLADNFVTNIKRKDFANMTSLVDLTLSRNTISFITPHAFADLRNLRALHLNSNRLTKITNDMFSGLSNLHHLILNNNQLTLISSTAFDDVFALEELDLSYNNLETIPWDAVEKMVSLHTLSLDHNMIDNIPKGTFSHLHKMTRLDVTSNKLQKLPPDPLFQRAQVLATSGIISPSTFALSFGGNPLHCNCELLWLRRLSREDDLETCASPPLLTGRYFWSIPEEEFLCEPPLITRHTHEMRVLEGQRATLRCKARGDPEPAIHWISPEGKLISNATRSLVYDHGTLDILITTVKDTGAFTCLASHPAGEATPNSGSSYN

SEQ ID NO: 865344 - protein, 375 aa, Homo sapiens; identical to SEQ ID NO: 865343

SEQ ID NO: 865345 - protein, 291 aa, Homo sapiens
AICTADGTMRLGEPTSNETLSCVIIFVIVYYALMAGVVTMRLGEPTSNETLSCVIIFVIVYYALMAGVVWFVVLTYAWHTSFKALGTTYQPLSGKTSYFHLLTWSLPFVLTVAILAVAQVDGDSVSGICFVGYKNYRYRAGFVLAPIGLVLIVAAFSLSSPGWLLLMNHHGAGTLYTYPENWRAFKALIAAQYSGAQVPGALPPPTSILAKQRTLNSRKFLAGRPHIEGDGSGSETPLPICGRARGRPKSPGEGAGAQLPHTGARCPTKEGGRGGFTGSETGNHPLGRQHG

SEQ ID NO: 865346 - protein, 781 aa, Homo sapiens
VSKGLKTTWIARLGLGESCIPFRASAAQHGPRVPKFAKLGAEGPGRAERPGGPGPGFSGRTGRLSRLRGAEVVRVAGGLRGAGGGAGAFAELAGLAMAAARPARGPELPLLGLLLLLLLGDPGRGAASSGNATGPGPRSAGGSARRSAAVTGPPPPLSHCGRAAPCEPLRYNVCLGSVLPYGATSTLLAGDSDSQEEAHGKLVLWSGLRNAPRCWAVIQPLLCAVYMPKCENDRVELPSRTLCQATRGPCAIVERERGWPDFLRCTPDRFPEGCTNEVQNIKFNSSGQCEVPLVRTDNPKSWYEDVEGCGIQCQNPLFTEAEHQDMHSYIAAFGAVTGLCTLFTLATFVADWRNSNRYPAVILFYVNACFFVGSIGWLAQFMDGARREIVCRADGTMRLGEPTSNETLSCVIIFVIVYYALMAGVVWFVVLTYAWHTSFKALGTTYQPLSGKTSYFHLLTWSLPFVLTVAILAVAQVDGDSVSGICFVGYKNYRYRAGFVLAPIGLVLIVGGYFLIRGVMTLFSIKSNHPGLLSEKAASKINETMLRLGIFGFLAFGFVLITFSCHFYDFFNQAEWERSFRDYVLCQANVTIGLPTKQPIPDCEIKNRPSLLVEKINLFAMFGTGIAMSTWVWTKATLLIWRRTWCRLTGQSDDEPKRIKKSKMIAKAFSKRHELLQNPGQELSFSMHTVSHDGPVAGLAFDLNEPSADVSSAWAQHVTKMVARRGAILPQDISVTPVATPGMRVQASGGRWGEHRGWGLLGLEYRGCRRRRKRKERPQRI

SEQ ID NO: 865347 - protein, 751 aa, Homo sapiens
MAAARPARGPELPLLGLLLLLLLGDPGRGAASSGNATGPGPRSAGGSARRSAAVTGPPPPLSHCGRAAPCEPLRYNVCLGSVLPYGATSTLLAGDSDSQEEAHGKLVLWSGLRNAPRCWAVIQPLLCAVYMPKCENDRVELPSRTLCQATRGPCAIVERERGWPDFLRCTPDRFPEGCTNEVQNIKFNSSGQCEVPLVRTDNPKSWYEDVEGCGIQCQNPLFTEAEHQDMHSYIAAFGAVTGLCTLFTLATFVADWRNSNRYPAVILFYVNACFFVGSIGWLAQFMDGARREIVCRADGTMRLGEPTSNETLSCVIIFVIVYYALMAGVVWFVVLTYAWHTSFKALGTTYQPLSGKTSYFHLLTWSLPFVLTVAILAVAQVDGDSVSGICFVGYKNYRYRAGFVLAPIGLVLIVGGYFLIRGVMTLFSIKSNHPGLLSEKAASKINETMLRLGCQANVTIGLPTKQPIPDCEIKNRPSLLVEKINLFAMFGTGIAMSTWVWTKATLLIWRRTWCRLTGQSDDEPKRIKKSKMIAKAFSKRHELLQNPGQELSFSMHTVSHDGPVAGLAFDLNEPSADVSSAWAQHVTKMVARRGAILPQDISVTPVATPVPPEEQANLWLVEAEISPELQKRLGRKKKRRKRKKEVCPLAPPPELHPPAPAPSTIPRLPQLPRQKCLVAAGAWGAGDSCRQGAWTLVSNPFCPEPSPPQDPFLPSAPAPVAWAHGRRQGLGPIHSRTNLMDTELMDADSDF

SEQ ID NO: 865348 - protein, 925 aa, Homo sapiens
VSKGLKTTWIARLGLGESCIPFRASAAQHGPRVPKFAKLGAEGPGRAERPGGPGPGFSGRTGRLSRLRGAEVVRVAGGLRGAGGGAGAFAELAGLAMAAARPARGPELPLLGLLLLLLLGDPGRGAASSGNATGPGPRSAGGSARRSAAVTGPPPPLSHCGRAAPCEPLRYNVCLGSVLPYGATSTLLAGDSDSQEEAHGKLVLWSGLRNAPRCWAVIQPLLCAVYMPKCENDRVELPSRTLCQATRGPCAIVERERGWPDFLRCTPDRFPEGCTNEVQNIKFNSSGQCEVPLVRTDNPKSWYEDVEGCGIQCQNPLFTEAEHQDMHSYIAAFGAVTGLCTLFTLATFVADWRNSNRYPAVILFYVNACFFVGSIGWLAQFMDGARREIVCRADGTMRLGEPTSNETLSCVIIFVIVYYALMAGVVWFVVLTYAWHTSFKALGTTYQPLSGKTSYFHLLTWSLPFVLTVAILAVAQVDGDSVSGICFVGYKNYRYRAGFVLAPIGLVLIVGGYFLIRGVMTLFSIKSNHPGLLSEKAASKINETMLRLGIFGFLAFGFVLITFSCHFYDFFNQAEWERSFRDYVLCQANVTIGLPTKQPIPDCEIKNRPSLLVEKINLFAMFGTGIAMSTWVWTKATLLIWRRTWCRLTGQSDDEPKRIKKSKMIAKAFSKRHELLQNPGQELSFSMHTVSHDGPVVALPGQEKSGFQELDFWPPVRPFGDVRPFSSDSEGVEITVVQAGLAFDLNEPSADVSSAWAQHVTKMVARRGAILPQDISVTPVATPVPPEEQANLWLVEAEISPELQKRLGRKKKRRKRKKEVCPLAPPPELHPPAPAPSTIPRLPQLPRQKCLVAAGAWGAGDSCRQGAWTLVSNPFCPEPSPPQDPFLPSAPAPVAWAHGRRQGLGPIHSRTNLMDTELMDADSDF

SEQ ID NO: 865349 - protein, 883 aa, Homo sapiens
VSKGLKTTWIARLGLGESCIPFRASAAQHGPRVPKFAKLGAEGPGRAERPGGPGPGFSGRTGRLSRLRGAEVVRVAGGLRGAGGGAGAFAELAGLAMAAARPARGPELPLLGLLLLLLLGDPGRGAASSGNATGPGPRSAGGSARRSAAVTGPPPPLSHCGRAAPCEPLRYNVCLGSVLPYGATSTLLAGDSDSQEEAHGKLVLWSGLRNAPRCWAVIQPLLCAVYMPKCENDRVELPSRTLCQATRGPCAIVERERGWPDFLRCTPDRFPEGCTNEVQNIKFNSSGQCEVPLVRTDNPKSWYEDVEGCGIQCQNPLFTEAEHQDMHSYIAAFGAVTGLCTLFTLATFVADWRNSNRYPAVILFYVNACFFVGSIGWLAQFMDGARREIVCRADGTMRLGEPTSNETLSCVIIFVIVYYALMAGVVWFVVLTYAWHTSFKALGTTYQPLSGKTSYFHLLTWSLPFVLTVAILAVAQVDGDSVSGICFVGYKNYRYRAGFVLAPIGLVLIVGGYFLIRGVMTLFSIKSNHPGLLSEKAASKINETMLRLGIFGFLAFGFVLITFSCHFYDFFNQAEWERSFRDYVLCQANVTIGLPTKQPIPDCEIKNRPSLLVEKINLFAMFGTGIAMSTWVWTKATLLIWRRTWCRLTGQSDDEPKRIKKSKMIAKAFSKRHELLQNPGQELSFSMHTVSHDGPVAGLAFDLNEPSADVSSAWAQHVTKMVARRGAILPQDISVTPVATPVPPEEQANLWLVEAEISPELQKRLGRKKKRRKRKKEVCPLAPPPELHPPAPAPSTIPRLPQLPRQKCLVAAGAWGAGDSCRQGAWTLVSNPFCPEPSPPQDPFLPSAPAPVAWAHGRRQGLGPIHSRTNLMDTELMDADSDF

SEQ ID NO: 865350 - protein, 628 aa, Homo sapiens
ELEQQRSRVAGGESSGGCGALGRRWLLGRGLARGRSRNSDSQEEAHGKLVLWSGLRNAPRCWAVIQPLLCAVYMPKCENDRVELPSRTLCQATRGPCAIVERERGWPDFLRCTPDRFPEGCTNEVQNIKFNSSGQCEVPLVRTDNPKSWYEDVEGCGIQCQNPLFTEAEHQDMHSYIAAFGAVTGLCTLFTLATFVADWRNSNRYPAVILFYVNACFFVGSIGWLAQFMDGARREIVCRADGTMRLGEPTSNETLSCVIIFVIVYYALMAGVVWFVVLTYAWHTSFKALGTTYQPLSGKTSYFHLLTWSLPFVLTVAILAVAQVDGDSVSGICFVGYKNYRYRAGFVLAPIGLVLIVGGYFLIRGVMTLFSIKSNHPGLLSEKAASKINETMLRLGIFGFLAFGFVLITFSCHFYDFFNQAEWERSFRDYVLCQANVTIGLPTKQPIPDCEIKNRPSLLVEKINLFAMFGTGIAMSTWVWTKATLLIWRRTWCRLTGQSDDEPKRIKKSKMIAKAFSKRHELLQNPGQELSFSMHTVSHDGPVAGLAFDLNEPSADVSSAWAQHVTKMVARRGAILPQDISVTPVATPGMRVQASGGRWGEHRGWGLLGLEYRGCRRRRKRKERPQRI

SEQ ID NO: 865351 - protein, 883 aa, Homo sapiens; identical to SEQ ID NO: 865349

SEQ ID NO: 865352 - protein, 893 aa, Homo sapiens
MEKDDPPQLVTPTSVKAIILRIEAAQLTRAQEDISTQLSDILDNVNCVINRFQEELGYDLKENAKSQQRDPKGKKRFILLEKIASFSKDAMMKEKHLYDILRWLGDWGDTLTYEIGPRKSEEEAAALDEWIEVTEKVLPLSLIATKRGIESLTALCSTLIEGQKKRSQVSKRTFWQGWQGRSPQTSPSHPQPLSPEQMLQDQHTMNTKASEVTSMLQELLDSTMFSKGEVRAIRYMATVVENLNKALILQHKENRSLETKYRHLQMQATKELSSQRLHFQQFMEVLESRRDALLKQVEILGGRYHDLLLMKQALEFQLKKAQNATGQAEDLAEVSVDSPGPSERETLPRKETVMEESQQEPMKEEQLFSPLPPSPMAMIRDSGAIAAGHQPLSTMTVRSRVADVFGSKDTESLEPVLLPLVDRRFPKKWERPVAESLGHKDKDQEDYFQKGGLQIKFHCSKQLSLESSRQVTSESQEEPWEEEFGREMRRQLWLEEEEMWQQRQKKWALLEQEHQEKLRQWNLEDLAREQQRRWVQLEKEQESPRREPEQLGEDVERRIFTPTSRWRDLEKAELSLVPAPSRTQSAHQSRRPHLPMSPSTQQPALGKQRPMSSVEFTYRPRTRRVPTKPKKSASFPVTGTSIRRLTWPSLQISPANIKKKVYHMDMEAQRKNLQLLSEESELRLPHYLRSKALELTTTTMELGALRLQYLCHKYIFYRRLQSLRQEAINHVQIMKETEASYKAQNLYIFLENIDRLQSLRLQAWTDKQKGLEEKHRECLSSMVTMFPKLQLEWNVHLNIPEVTSPKPKKCKLPAASPRHIRPSGPTYKQPFLSRHRACVPLQMARQQGKQMEAVWKTEVASSSYAIEKKTPASLPRDQLRGHPDIPRLLTLDV

SEQ ID NO: 865353 - protein, 871 aa, Homo sapiens
MEKDDPPQLVTPTSVKAIILRIEAAQLTRAQEDISTQLSDILDNVNCVINRFQEELGYDLKENAKSQQRDPKGKKRFILLEKIASFSKDAMMKEKHLYDILRWLGDWGDTLTYEIGPRKSEEEAAALDEWIEVTEKVLPLSLIATKRGIESLTALCSTLIEGQKKRSQVSKRTFWQGWQGRSPQTSPSHPQPLSPEQMLQDQHTMNTKASEVTSMLQELLDSTMFSKGEVRAIRYMATVVENLNKALILQHKENRSLETKYRHLQMQATKELSSQRLHFQQFMEVLESRRDALLKQVEILGGRYHDLLLMKQALEFQLKKAQNATGQAEDLAEVSVDSPGPSERETLPRKETVMEESQQEPMKEEQLFSPLPPSPMAMIRDSGAIAAGHQPLSTMTVRSRVADVFGSKDTESLEPVLLPLVDRRFPKKWERPVAESLGHKDKDQEDYFQKGGLQIKFHCSKQLSLESSRQVTSESQEEPWEEEFGREMRRQLWLEEEEMWQQRQKKWALLEQEHQEKLRQWNLEDLAREQQRRWVQLEKEQESPRREPEQLGEDVERRIFTPTSRWRDLEKAELSLVPAPSRTQSAHQSRRPHLPMSPSTQQPALGKQRPMSSVEFTYRPRTRRVPTKPKKSASFPVTGTSIRRLTWPSLQISPANIKKKVYHMDMEAQRKNLQLLSEESELRLPHYLRSKALELTTTTMELGALRLQYLCHKYIFYRRLQSLRQEAINHVQIMKETEASYKAQNLYIFLENIDRLQSLRLQAWTDKQKGLEEKHRECLSSMVTMFPKLQLEWNVHLNIPEVTSPKPKKCKLPAASPRHIRPSGPTYKQPFLSRHRACVPLQMARLLALCLRGLVAELALVMEDFDLLHVL

SEQ ID NO: 865354 - protein, 696 aa, Homo sapiens
MLQDQHTMNTKASEVTSMLQELLDSTMFSKGEVRAIRYMATVVENLNKALILQHKENRSLETKYRHLQMQATKELSSQRLHFQQFMEVLESRRDALLKQVEILGGRYHDLLLMKQALEFQLKKAQNATGQAEDLAEVSVDSPGPSERETLPRKETVMEESQQEPMKEEQLFSPLPPSPMAMIRDSGAIAAGHQPLSTMTVRSRVADVFGSKDTESLEPVLLPLVDRRFPKKWERPVAESLGHKDKDQEDYFQKGGLQIKFHCSKQLSLESSRQVTSESQEEPWEEEFGREMRRQLWLEEEEMWQQRQKKWALLEQEHQEKLRQWNLEDLAREQQRRWVQLEKEQESPRREPEQLGEDVERRIFTPTSRWRDLEKAELSLVPAPSRTQSAHQSRRPHLPMSPSTQQPALGKQRPMSSVEFTYRPRTRRVPTKPKKSASFPVTGTSIRRLTWPSLQISPANIKKKVYHMDMEAQRKNLQLLSEESELRLPHYLRSKALELTTTTMELGALRLQYLCHKYIFYRRLQSLRQEAINHVQIMKETEASYKAQNLYIFLENIDRLQSLRLQAWTDKQKGLEEKHRECLSSMVTMFPKLQLEWNVHLNIPEVTSPKPKKCKLPAASPRHIRPSGPTYKQPFLSRHRACVPLQMARQQGKQMEAVWKTEVASSSYAIEKKTPASLPRDQLRGHPDIPRLLTLDV

SEQ ID NO: 865355 - protein, 893 aa, Homo sapiens; identical to SEQ ID NO: 865352

SEQ ID NO: 865356 - protein, 893 aa, Homo sapiens; identical to SEQ ID NO: 865352

SEQ ID NO: 865357 - protein, 358 aa, Homo sapiens
MKENKENSSPSVTSANLDHTKPCWYWDKKDLAHTPSQLEGLDPATEARYRREGARFIFDVGTRLGLHYDTLATGIIYFHRFYMFHSFKQFPRYVTGACCLFLAGKVEETPKKCKDIIKTARSLLNDVQFGQFGDDPKEEVMVLERILLQTIKFDLQVEHPYQFLLKYAKQLKGDKNKIQKLVQMAWTFVNDSLCTTLSLQWEPEIIAVAVMYLAGRLCKFEIQEWTSKPMYRRWWEQFVQDVPVDVLEDICHQILDLYSQGKQQMPHHTPHQLQQPPSLQPTPQVPQVQQSQPSQSSEPSQPQQKDPPPSSSRVGPAASQLPTSCRPPWRTASCAPAHSPTRHASSWGAGAGSLDEIT

SEQ ID NO: 865358 - protein, 357 aa, Homo sapiens
MKENKENSSPSVTSANLDHTKPCWYWDKKDLAHTPSQLEGLDPATEARYRREGARFIFDVGTRLGLHYDTLATGIIYFHRFYMFHSFKQFPRYVTGACCLFLAGKVEETPKKCKDIIKTARSLLNDVQFGQFGDDPKEEVMVLERILLQTIKFDLQVEHPYQFLLKYAKQLKGDKNKIQKLVQMAWTFVNDSLCTTLSLQWEPEIIAVAVMYLAGRLCKFEIQEWTSKPMYRRWWEQFVQDVPVDVLEDICHQILDLYSQGKQQMPHHTPHQLQQPPSLQPTPQVPQVQQSQPSQSSEPSQPQQKDPPPHPPPGLGLPPASYPPPAVPPGGQPPVPPPIPPPGMPPVGGLGRAAWMR

SEQ ID NO: 865359 - protein, 357 aa, Homo sapiens; identical to SEQ ID NO: 865358

SEQ ID NO: 865360 - protein, 293 aa, Homo sapiens
DIGEPALGEELGVHRCLYVSCACKQFPRYVTGACCLFLAGKVEETPKKCKDIIKTARSLLNDVQFGQFGDDPKEEVMVLERILLQTIKFDLQVEHPYQFLLKYAKQLKGDKNKIQKLVQMAWTFVNDSLCTTLSLQWEPEIIAVAVMYLAGRLCKFEIQEWTSKPMYRRWWEQFVQDVPVDVLEDICHQILDLYSQGKQQMPHHTPHQLQQPPSLQPTPQVPQVQQSQPSQSSEPSQPQQKDPPPHPPPGLGLPPASYPPPAVPPGGQPPVPPPIPPPGMPPVGGLGRAAWMR

SEQ ID NO: 865361 - protein, 358 aa, Homo sapiens; identical to SEQ ID NO: 865357

SEQ ID NO: 865362 - protein, 357 aa, Homo sapiens
MKENKENSSPSVTSANLDHTKPCWYWDKKDLAHTPSQLEGLDPATEARYRREGARFIFDVGTRLGLHYDTLATGIIYFHRFYMFHSFKQFPRYVTGACCLFLAGKVEETPKKCKDIIKTARSLLNDVQFGQFGDDPKEEVMVLERILLQTIKFDLQVEHPYQFLLKYAKQLKGDKNKIQKLVQMAWTFVNDSLCTTLSLQWEPEIIAVAVMYLAGRLCKFEIQEWTSKPMYRRWWEQFVQDVPVDVLEDICHQILDLYSQGKQQMPHHTPHQLQQPPSLQPTPQVPQVQQSQPSQSSEPSQPQQKDPQQPAQQQQPAQQPKKPSPQPSSPRQVKRAVVVSPKEENKAAEPAPSQHLW

SEQ ID NO: 865363 - protein, 412 aa, Homo sapiens
MKENKENSSPSVTSANLDHTKPCWYWDKKDLAHTPSQLEGLDPATEARYRREGARFIFDVGTRLGLHYDTLATGIIYFHRFYMFHSFKQFPRYVTGACCLFLAGKVEETPKKCKDIIKTARSLLNDVQFGQFGDDPKEEVMVLERILLQTIKFDLQVEHPYQFLLKYAKQLKGDKNKIQKLVQMAWTFVNDSLCTTLSLQWEPEIIAVAVMYLAGRLCKFEIQEWTSKPMYRRWWEQFVQDVPVDVLEDICHQILDLYSQGKQQMPHHTPHQLQQPPSLQPTPQVPQVQQSQPSQSSEPSQPQQKDPQQPAQQQQPAQQPKKPSPQPSSPRQVKRAVVVSPKEENKAAEPPPPKIPKIETTHPPLPPAHPPPDRKPPLAAALGEAEPPGPVDATDLPKVQIPPPAHPAPVHQ

SEQ ID NO: 865364 - protein, 310 aa, Homo sapiens
MKENKENSSPSVTSANLDHTKPCWYWDKKDLAHTPSQLEGLDPATEARYRREGARFIFDVGTRLGLHYDTLATGIIYFHRFYMFHSFKQFPRYVTGACCLFLAGKVEETPKKCKDIIKTARSLLNDVQFGQFGDDPKEEVMVLERILLQTIKFDLQVEHPYQFLLKYAKQLKGDKNKIQKLVQMAWTFVNDSLCTTLSLQWEPEIIAVAVMYLAGRLCKFEIQEWTSKPMYRRWWEQFVQDVPVDVLEDICHQILDLYSQGKQQMPHHTPHQLQQPPSLQPTPQVPQVQQSQPSQSSEPSQPQQKDPQCY

SEQ ID NO: 865365 - protein, 119 aa, Homo sapiens
MKENKENSSPSVTSANLDHTKPCWYWDKKDLAHTPSQLEGLDPATEARYRREGARFIFDVGTRLGLHYDTLATGIIYFHRFYMFHSFKQFPRYQEAHKEAFIYLAQSRHYHNLVCYSFY

SEQ ID NO: 865366 - protein, 173 aa, Homo sapiens
MKENKENSSPSVTSANLDHTKPCWYWDKKDLAHTPSQLEGLDPATEARYRREGARFIFDVGTRLGLHYDTLATGIIYFHRFYMFHSFKQFPRYVTGACCLFLAGKVEETPKKCKDIIKTARSLLNDVQFGQFGDDPKEEVMVLERILLQTIKFDLQVEHPYQFLLKYAKQLKV

SEQ ID NO: 865367 - protein, 157 aa, Homo sapiens
PSFRSFNSSSYSYMQSNSKGDKNKIQKLVQMAWTFVNDSLCTTLSLQWEPEIIAVAVMYLAGRLCKFEIQEWTSKPMYRRWWEQFVQDVPVDVLEDICHQILDLYSQGKQQMPHHTPHQLQQPPSLQPTPQVPQVQQSQPSQSSEPSQPQQKDPQCY

SEQ ID NO: 865368 - protein, 358 aa, Homo sapiens; identical to SEQ ID NO: 865357

SEQ ID NO: 865369 - protein, 357 aa, Homo sapiens; identical to SEQ ID NO: 865358

SEQ ID NO: 865370 - protein, 184 aa, Homo sapiens [sequence omitted]

SEQ ID NO: 865371 - protein, 139 aa, Homo sapiens
MSVLGLTLRAGKESMSRDGGQGPGAEQRLEDICHQILDLYSQGKQQMPHHTPHQLQQPPSLQPTPQVPQVQQSQPSQSSEPSQPQQKDPPPHPPPGLGLPPASYPPPAVPPGGQPPVPPPIPPPGMPPVGGLGRAAWMR

SEQ ID NO: 865372 - protein, 353 aa, Homo sapiens [sequence omitted]

SEQ ID NO: 865373 - protein, 79 aa, Homo sapiens
MSGFLICFFFVEPPPPKIPKIETTHPPLPPAHPPPGKHLLKQLGQLCTSPLNVGRSRSWELRKGRLGPRLTMSATGRNL

SEQ ID NO: 865374 - protein, 682 aa, Homo sapiens
TSTHSYFCSIYSSDEDDEDFEMCDHDYDGLLPKSGKRHLGKTRWTREEDEKLKKLVEQNGTDDWKVIANYLPNRTDVQCQHRWQKVLNPELIKGPWTKEEDQRVIELVQKYGPKRWSVIAKHLKGRIGKQCRERWHNHLNPEVKKTSWTEEEDRIIYQAHKRLGNRWAEIAKLLPGRTDNAIKNHWNSTMRRKVEQEGYLQESSKASQPAVATSFQKNSHLMGFAQAPPTAQLPATGQPTVNNDYSYYHISEAQNVSSHVPYPVALHVNIVNVPQPAAAAIQRHYNDEDPEKEKRIKELELLLMSTENELKGQQVLPLCGPLLNSDIFSDWAANWDGSLCFATYIVNQQRQEKRSDDPTQNHTCSYPGWHSTTIADHTRPHGDSAPVSCLGEHHSTPSLPADPGSLPEESASPARCMIVHQGTILDNVKNLLEFAETLQFIDSFLNTSSNHENSDLEMPSLTSTPLIGHKLTVTTPFHRDQTVKTQKENTVFRTPAIKRSILESSPRTPTPFKHALAAQEIKYGPLKMLPQTPSHLVEDLQDVIKQESDESGIVAEFQENGPPLLKKIKQEVESPTDKSGNFFCSHHWEGDSLNTQLFTQTSPVADAPNILTSSVLMAPASEDEDNVLKAFTVPKNRSLASPLQPCSSTWEPASCGKMEEQMTSSSQARKYVNAFSARTLVM

SEQ ID NO: 865375 - protein, 616 aa, Homo sapiens
MARRPRHSIYSSDEDDEDFEMCDHDYDGLLPKSGKRHLGKTRWTREENRTDVQCQHRWQKVLNPELIKGPWTKEEDQRVIELVQKYGPKRWSVIAKHLKGRIGKQCRERWHNHLNPEVKKTSWTEEEDRIIYQAHKRLGNRWAEIAKLLPGRTDNAIKNHWNSTMRRKVEQEGYLQESSKASQPAVATSFQKNSHLMGFAQAPPTAQLPATGQPTVNNDYSYYHISEAQNVSSHVPYPVALHVNIVNVPQPAAAAIQRHYNDEDPEKEKRIKELELLLMSTENELKGQQVLPTQNHTCSYPGWHSTTIADHTRPHGDSAPVSCLGEHHSTPSLPADPGSLPEESASPARCMIVHQGTILDNVKNLLEFAETLQFIDSFLNTSSNHENSDLEMPSLTSTPLIGHKLTVTTPFHRDQTVKTQKENTVFRTPAIKRSILESSPRTPTPFKHALAAQEIKYGPLKMLPQTPSHLVEDLQDVIKQESDESGIVAEFQENGPPLLKKIKQEVESPTDKSGNFFCSHHWEGDSLNTQLFTQTSPVADAPNILTSSVLMAPASEDEDNVLKAFTVPKNRSLASPLQPCSSTWEPASCGKMEEQMTSSSQARKYVNAFSARTLVM

SEQ ID NO: 865376 - protein, 329 aa, Homo sapiens
RGDRTDPREGVLRRSPWSIYSSDEDDEDFEMCDHDYDGLLPKSGKRHLGKTRWTREEDEKLKKLVEQNGTDDWKVIANYLPNRTDVQCQHRWQKVLNPELIKGPWTKEEDQRVIELVQKYGPKRWSVIAKHLKGRIGKQCRERWHNHLNPEVKKTSWTEEEDRIIYQAHKRLGNRWAEIAKLLPGRTDNAIKNHWNSTMRRKVEQEGYLQESSKASQPAVATSFQKNSHLMGFAQAPPTAQLPATGQPTVNNDYSYYHISEAQNVSSHVPYPVALHVNIVNVPQPAAAAIQRHYNDEDPEKEKRIKELELLLMSTENELKGQQVLPCYQ

SEQ ID NO: 865377 - protein, 300 aa, Homo sapiens
MARRPRHSIYSSDEDDEDFEMCDHDYDGLLPKSGKRHLGKTRWTREEDEKLKKLVEQNGTDDWKVIANYLPNRTDVQCQHRWQKVLNPELIKGPWTKEEDQRVIELVQKYGPKRWSVIAKHLKGRIGKQCRERWHNHLNPEVKKTSWTEEEDRIIYQAHKRLGNRWAEIAKLLPGRTDNAIKNHWNSTMRRKVEQEGYLQESSPVGLGVQGGLGQQHWVLLRGHAQLVVEGVVPDLLHVVPVGDDAMLNGVLQGQDATLALGLVAHVGVHLAHAHHDALVSKAPDDGRKHGSGSVVEPIS

SEQ ID NO: 865378 - protein, 640 aa, Homo sapiens
MARRPRHSIYSSDEDDEDFEMCDHDYDGLLPKSGKRHLGKTRWTREEDEKLKKLVEQNGTDDWKVIANYLPNRTDVQCQHRWQKVLNPELIKGPWTKEEDQRVIELVQKYGPKRWSVIAKHLKGRIGKQCRERWHNHLNPEVKKTSWTEEEDRIIYQAHKRLGNRWAEIAKLLPGRTDNAIKNHWNSTMRRKVEQEGYLQESSKASQPAVATSFQKNSHLMGFAQAPPTAQLPATGQPTVNNDYSYYHISEAQNVSSHVPYPVALHVNIVNVPQPAAAAIQRHYNDEDPEKEKRIKELELLLMSTENELKGQQVLPTQNHTCSYPGWHSTTIADHTRPHGDSAPVSCLGEHHSTPSLPADPGSLPEESASPARCMIVHQGTILDNVKNLLEFAETLQFIDSFLNTSSNHENSDLEMPSLTSTPLIGHKLTVTTPFHRDQTVKTQKENTVFRTPAIKRSILESSPRTPTPFKHALAAQEIKYGPLKMLPQTPSHLVEDLQDVIKQESDESGIVAEFQENGPPLLKKIKQEVESPTDKSGNFFCSHHWEGDSLNTQLFTQTSPVADAPNILTSSVLMAPASEDEDNVLKAFTVPKNRSLASPLQPCSSTWEPASCGKMEEQMTSSSQARKYVNAFSARTLVM

SEQ ID NO: 865379 - protein, 650 aa, Homo sapiens
RGDRTDPREGVLRRSPWSIYSSDEDDEDFEMCDHDYDGLLPKSGKRHLGKTRWTREEDEKLKKLVEQNGTDDWKVIANYLPNRTDVQCQHRWQKVLNPELIKGPWTKEEDQRVIELVQKYGPKRWSVIAKHLKGRIGKQCRERWHNHLNPEVKKTSWTEEEDRIIYQAHKRLGNRWAEIAKLLPGRTDNAIKNHWNSTMRRKVEQEGYLQESSKASQPAVATSFQKNSHLMGFAQAPPTAQLPATGQPTVNNDYSYYHISEAQNVSSHVPYPVALHVNIVNVPQPAAAAIQRHYNDEDPEKEKRIKELELLLMSTENELKGQQVLPTQNHTCSYPGWHSTTIADHTRPHGDSAPVSCLGEHHSTPSLPADPGSLPEESASPARCMIVHQGTILDNVKNLLEFAETLQFIDSFLNTSSNHENSDLEMPSLTSTPLIGHKLTVTTPFHRDQTVKTQKENTVFRTPAIKRSILESSPRTPTPFKHALAAQEIKYGPLKMLPQTPSHLVEDLQDVIKQESDESGIVAEFQENGPPLLKKIKQEVESPTDKSGNFFCSHHWEGDSLNTQLFTQTSPVADAPNILTSSVLMAPASEDEDNVLKAFTVPKNRSLASPLQPCSSTWEPASCGKMEEQMTSSSQARKYVNAFSARTLVM

SEQ ID NO: 865380 - protein, 364 aa, Homo sapiens
TLFQDSSSWCDLSSFEFFEEADFSPSQHHTGKALQLQQREGNGTKPAGEPSPRVNKRMLSESSLDPPKVLPPARHSTIPLVILRKKRGQASPLATGDCSSFIFADVSSSTPKRSPVKSLPFSPSQFLNTSSNHENSDLEMPSLTSTPLIGHKLTVTTPFHRDQTVKTQKENTVFRTPAIKRSILESSPRTPTPFKHALAAQEIKYGPLKMLPQTPSHLVEDLQDVIKQESDESGIVAEFQENGPPLLKKIKQEVESPTDKSGNFFCSHHWEGDSLNTQLFTQTSPVADAPNILTSSVLMAPASEDEDNVLKAFTVPKNRSLASPLQPCSSTWEPASCGKMEEQMTSSSQARKYVNAFSARTLVM

SEQ ID NO: 865381 - protein, 60 aa, Homo sapiens
REHHTRMRIISKINFELIRLQRPAHTDERIRDGKPPPQNWATEITSHKKRTAQNQTAEGT

SEQ ID NO: 865382 - protein, 307 aa, Homo sapiens
SGWLRRPPAPRRKRRAEGRGRRRPGGRHRAAGQAYRGSQFGSAAEMLSEQTAALGTRWESMNVQLDGAEPQVERGSQEERPWRTVPGPLEHLCCDLEEEPQSLQEKAQSAPWVPAIPQEGNTGDWEMAAALLAAGSQGLVTIKDVSLCFSQEEWRSLDPSQTDFYGEYVMQENCGIVVSLRFPIPKLDMLSQLEGGEEQWVPDPQDLEERDILRVTYTGDGSEHEGDTPELEAEPPRMLSSVSEDTVLWNPEHDESWDSMPSSSRGMLLGPPFLQEDSFSNLLCSTEMDSLLRPHTCPQCGKQFVWG

SEQ ID NO: 865383 - protein, 138 aa, Homo sapiens
MQENCGIVVSLRFPIPKLDMLSQLEGGEEQWVPDPQDLEERDILRVTYTGDGSEHEGDTPELEAEPPRMLSSVSEDTVLWNPEHDESWDSMPSSSRGMLLGPPFLQEDSFSNLLCSTEMDSLLRPHTCPQCGKQFVWG

SEQ ID NO: 865384 - protein, 119 aa, Homo sapiens
MLSQLEGGEEQWVPDPQDLEERDILRVTYTGDGSEHEGDTPELEAEPPRMLSSVSEDTVLWNPEHDESWDSMPSSSRGMLLGPPFLQEDSFSNLLCSTEMDSLLRPHTCPQCGKQFVWG

SEQ ID NO: 865385 - protein, 111 aa, Homo sapiens [sequence omitted]

SEQ ID NO: 865386 - protein, 328 aa, Homo sapiens
VAVGDVPASKMAAAAVSGALGRAGWRLLQLRCLPVARCRQALVPRAFHASAVGLRSSDEQKQQPPNSFSQQHSETQGAEKPDPESSHSPPRYTDQGGEEEEDYESEEQLQHRILTAALEFVPAHGWTAEAIAEGAQSLGLSSAAASMFGKDGSELILHFVTQCNTRLTRVLEEEQKLVQLGQAEKRKTDQFLRDAVETRLRMLIPYIEHWPRALSILMLPHNIPSSLSLLTSMVDDMWHYAGDQSTDFNWYTRRAMLAAIYNTTELVMMQDSSPDFEDTWRFLENRVNDAMNMGHTAKQVKSTGEALVQGLMGAAVTLKNLTGLNQRR

SEQ ID NO: 865387 - protein, 328 aa, Homo sapiens; identical to SEQ ID NO: 865386

SEQ ID NO: 865388 - protein, 328 aa, Homo sapiens; identical to SEQ ID NO: 865386

SEQ ID NO: 865389 - protein, 182 aa, Homo sapiens
MFGKDGSELILHFVTQCNTRLTRVLEEEQKLVQLGQAEKRKTDQFLRDAVETRLRMLIPYIEHWPRALSILMLPHNIPSSLSLLTSMVDDMWHYAGDQSTDFNWYTRRAMLAAIYNTTELVMMQDSSPDFEDTWRFLENRVNDAMNMGHTAKQVKSTGEALVQGLMGAAVTLKNLTGLNQRR

SEQ ID NO: 865390 - protein, 270 aa, Homo sapiens
VAVGDVPASKMAAAAVSGALGRAGWRLLQLRCLPVARCRQALVPRAFHASAVGLRSSDEQKQQPPNSFSQQHSETQGAEKPDPESSHSPPRYTDQGGEEEEDYESEEQLQHRILTAALEFVPAHGWTAEAIAEGAQSLGLSSAAASMFGKDGSELILHFVTQCNTRLTRVLEEEQKLVQLGQAEKRKTDQFLRDAVETRLRMLIPYIEHWPRALSILMLPHNIPSSLSLLTSMVDDMWHYAGDQSTDVSAFCRPTGGWERLVLSISSRSL

SEQ ID NO: 865391 - protein, 134 aa, Homo sapiens
MGGTPLKMMSQYCRAWAGALSILMLPHNIPSSLSLLTSMVDDMWHYAGDQSTDFNWYTRRAMLAAIYNTTELVMMQDSSPDFEDTWRFLENRVNDAMNMGHTAKQVKSTGEALVQGLMGAAVTLKNLTGLNQRR

SEQ ID NO: 865392 - protein, 352 aa, Homo sapiens
VAVGDVPASKMAAAAVSGALGRAGWRLLQLRCLPVARCRQALVPRAFHASAVGLRSSDEQKQQPPNSFSQQHSETQGAEKPDPESSHSPPRYTDQGGEEEEDYESEEQLQHRILTAALEFVPAHGWTAEAIAEGAQSLGLSSAAASMFGKDGSELILHFVTQCNTRLTRVLEEEQKLVQLGQAEKRKTDQFLRDAVETRLRMLIPYIEHWPRALSILMLPHNIPSSLSLLTSMVDDMWHYAGDQSTDFNWYTRRAMLAAIYNTTELVMMQDSSPDFEDTWRFLENRVNDAMNMGHTAKQVKSTGEALVQGLMGAAVTVSTAQHIPAPPLSHSGSVIHVLLTSHHFVALTWKQ

SEQ ID NO: 865393 - protein, 309 aa, Homo sapiens
VAVGDVPASKMAAAAVSGALGRAGWRLLQLRCLPVARCRQALVPRAFHASAVGLRSSDEQKQQPPNSFSQQHSETQGAEKPDPESSHSPPRYTDQGGEEEEDYESEEQLQHRILTAALEFVPAHGWTAEAIAEGAQSLGLSSAAASMFGKDGSELILHFVTQCNTRLTRVLEEEQKLVQLGQAEKRKTDQFLRDAVETRLRMLIPYIEHWPRALSILMLPHNIPSSLSLLTSMVDDMWHYAGDQSTDFNWYTRRAMLAAIYNTTELVMMQDSSPDFEDTWRFLENRVNDAMNLRQVPAGQRCDSRPGVT

SEQ ID NO: 865394 - protein, 272 aa, Homo sapiens
VAVGDVPASKMAAAAVSGALGRAGWRLLQLRCLPVARCRQALVPRAFHASAVGLRSSDEQKQQPPNSFSQQHSETQGAEKPDPESSHSPPRYTDQGGEEEEDYESEEQLQHRILTAALEFVPAHGWTAEAIAEGAQSLGLSSAAASMFGKDGSELILHFVTQCNTRLTRVLEEEQKLVQLGQAEKRKTDQFLRDAVETRLRMLIPYIEHWPRVPSLYPGPRATIILIFIILSTFHSDDFVHCSELSFSISINPTILSTLGKAGFQTWTYQRE

SEQ ID NO: 865395 - protein, 328 aa, Homo sapiens; identical to SEQ ID NO: 865386

SEQ ID NO: 865396 - protein, 328 aa, Homo sapiens; identical to SEQ ID NO: 865386

SEQ ID NO: 865397 - protein, 324 aa, Homo sapiens
MRLGTRLGLAAVSGALGRAGWRLLQLRCLPVARCRQALVPRAFHASAVGLRSSDEQKQQPPNSFSQQHSETQGAEKPDPESSHSPPRYTDQGGEEEEDYESEEQLQHRILTAALEFVPAHGWTAEAIAEGAQSLGLSSAAASMFGKDGSELILHFVTQCNTRLTRVLEEEQKLVQLGQAEKRKTDQFLRDAVETRLRMLIPYIEHWPRALSILMLPHNIPSSLSLLTSMVDDMWHYAGDQSTDFNWYTRRAMLAAIYNTTELVMMQDSSPDFEDTWRFLENRVNDAMNMGHTAKQVKSTGEALVQGLMGAAVTLKNLTGLNQRR

SEQ ID NO: 865398 - protein, 328 aa, Homo sapiens; identical to SEQ ID NO: 865386

SEQ ID NO: 865399 - protein, 270 aa, Homo sapiens; identical to SEQ ID NO: 865390

SEQ ID NO: 865400 - protein, 345 aa, Homo sapiens
VAVGDVPASKMAAAAVSGALGRAGWRLLQLRCLPVARCRQALVPRAFHASAVGLRSSDEQKQQPPNSFSQQHSETQGAEKPDPESSHSPPRYTDQGGEEEEDYESEEQLQHRILTAALEFVPAHGWTAEAIAEGAQSLGLSSAAASMFGKDGSELILHFVTQCNTRLTRVLEEEQKLVQLGQAEKRKTDQFLRDAVETRLRMLIPYIEHWPRALSILMLPHNIPSSLSLLTSMVDDMWHYAGDQSTDFNWYTRRAMLAAIYNTTELVMMQDSSPDFEDTWRFLENRVNDAMNMGHTAKQEVHGRGTGARTDGCSGHAQEPDGSKPASVREGNPCAGRSSSRYEGL

SEQ ID NO: 865401 - protein, 303 aa, Homo sapiens
VAVGDVPASKMAAAAVSGALGRAGWRLLQLRCLPVARCRQALVPRAFHASAVGLRSSDEQKQQPPNSFSQQHSETQGAEKPDPESSHSPPRYTDQGGEEEEDYESEEQLQHRILTAALEFVPAHGWTAEAIAEGAQSLGLSSAAASMFGKDGSELILHFVTQCNTRLTRVLEEEQKLVQLGQAEKRKTDQFLRDAVETRLRMLIPYIEHWPRALSILMLPHNIPSSLSLLTSMVDDMWHYAGDQSTDFNWYTRRAMLAAIYNTTELVMMQDSSPDFEDTWRFLENRVNDAMNMGHTAKQVGGD

SEQ ID NO: 865402 - protein, 105 aa, Homo sapiens
SFDFPGHNYTRETSCQVSTSLVPFHKTQNPQCPIFRLGDIFRETGDNFSDVAIQGGIMGIEIYWDCNLNMGHTAKQVKSTGEALVQGLMGAAVTLKNLTGLNQRR

SEQ ID NO: 865403 - protein, 130 aa, Homo sapiens
VAVGDVPASKMAAAAVSGALGRAGWRLLQLRCLPVARCRQALVPRAFHASAVGLRSSDEQKQQPPNSFSQQHSETQGAEKPDPESSHSPPRYTDQGGEEEEDYESEEQLQHRILTAALEFVPAHGWTAEV

SEQ ID NO: 865404 - protein, 260 aa, Homo sapiens
GGARLGGLCVLAVGGGGGCLAKVRDPSRAGGGPRSCAGSVWAQAAAPRLVRVGVCARFEGSARGFLFLLLRGCSSGLRPDPAPMASEELQKDLEEVKVLLEKATRKRVRDALTAEKSKIETEIKNKMQQKSQKKAELLDNEKPAAVVAPITTGYTVKISNYGWDQSDKFVKIYITLTGVHQVPTENVQVHFTERSFDLLVKNLNGKSYSMIVNNLLKPISVEGSSKKVKTDTVLILCRKKVENTRWDYLTQVEKECKEKE

SEQ ID NO: 865405 - protein, 103 aa, Homo sapiens
MQQKSQKKAELLDNEKPAAVVAPITTGYTVKISNYGWDQSDKFVKIYITLTGVHQVPTENVQVHFTERSFDLLVKNLNGKSYSMIVNNLLKPISVEGSSKKPD

SEQ ID NO: 865406 - protein, 248 aa, Homo sapiens
GGARLGGLCVLAVGGGGGCLAKVRDPSRAGGGPRSCAGSVWAQAAAPRLVRVGVCARFEGSARGFLFLLLRGCSSGLRPDPAPMASEELQKDLEEVKVLLEKATRKRVRDALTAEKSKIETEIKNKMQQKSQKKAELLDNEKPAAVVAPITTGYTVKISNYGWDQSDKFVKIYITLTGVHQVPTENVQVHFTERHLNLWERIQGVTPRIWNNSLIPLGREFQKKPKQLKIKKKVGPQGGGPWPPGKRG

SEQ ID NO: 865407 - protein, 311 aa, Homo sapiens
GGARLGGLCVLAVGGGGGCLAKVRDPSRAGGGPRSCAGSVWAQAAAPRLVRVGVCARFEGSARGFLFLLLRGCSSGLRPDPAPMASEELQKDLEEVKVLLEKATRKRVRDALTAEKSKIETEIKNKMQQKSQKKAELLDNEKPAAVVAPITTGYTVKISNYGWDQSDKFVKIYITLTGVHQVPTENVQVHFTERSFDLLVKNLNGKSYSMIVNNLLKPISVEGSSKKVKTDTVLILCRKKVENTRWDYLTQVEKECKEKEKPSYDTETDPSEGLMNVLKKIYEDGDDDMKRTINKAWVESREKQAKGDTEF

SEQ ID NO: 865408 - protein, 311 aa, Homo sapiens; identical to SEQ ID NO: 865407

SEQ ID NO: 865409 - protein, 311 aa, Homo sapiens; identical to SEQ ID NO: 865407

SEQ ID NO: 865410 - protein, 311 aa, Homo sapiens; identical to SEQ ID NO: 865407

SEQ ID NO: 865411 - protein, 294 aa, Homo sapiens
GGARLGGLCVLAVGGGGGCLAKVRDPSRAGGGPRSCVCARFEGSARGFLFLLLRGCSSGLRPDPAPMASEELQKDLEEVKVLLEKATRKRVRDALTAEKSKIETEIKNKMQQKSQKKAELLDNEKPAAVVAPITTGYTVKISNYGWDQSDKFVKIYITLTGVHQVPTENVQVHFTERSFDLLVKNLNGKSYSMIVNNLLKPISVEGSSKKVKTDTVLILCRKKVENTRWDYLTQVEKECKEKEKPSYDTETDPSEGLMNVLKKIYEDGDDDMKRTINKAWVESREKQAKGDTEF

SEQ ID NO: 865412 - protein, 185 aa, Homo sapiens
MQQKSQKKAELLDNEKPAAVVAPITTGYTVKISNYGWDQSDKFVKIYITLTGVHQVPTENVQVHFTERSFDLLVKNLNGKSYSMIVNNLLKPISVEGSSKKVKTDTVLILCRKKVENTRWDYLTQVEKECKEKEKPSYDTETDPSEGLMNVLKKIYEDGDDDMKRTINKAWVESREKQAKGDTEF

SEQ ID NO: 865413 - protein, 304 aa, Homo sapiens
GGARLGGLCVLAVGGGGGCLAKVRDPSRAGGGPRSCAGSVWAQAAAPRLVRVGVCARFEGSARGFLFLLLRGCSSGLRPDPAPMASEELQKDLEEVKVLLEKATRKRVRDALTAEKSKIETEIKNKMQQKSQKKAELLDNEKPAAVVAPITTGYTVKISNYGWDQSDKFVKIYITLTGVHQVPTENVQVHFTERSFDLLVKNLNGKSYSMIVNNLLKPISVEGSSKKVKTDTVLILCRKKVENTRWDYLTQVEKECKEKEKPSYDTETDPSEGLMNVLKPGWNQERSKPKETRNFETLKSFWEL

SEQ ID NO: 865414 - protein, 102 aa, Homo sapiens [sequence omitted]

SEQ ID NO: 865415 - protein, 102 aa, Homo sapiens [sequence omitted]

SEQ ID NO: 865416 - protein, 232 aa, Homo sapiens
GGARLGGLCVLAVGGGGGCLAKVRDPSRAGGGPRSCAGSVWAQAAAPRLVRVGVCARFEGSARGFLFLLLRGCSSGLRPDPAPMASEELQKDLEEVKVLLEKATRKRVRDALTAEKSKIETEIKNKMQQKSQKKAELLDNEKPAAVVAPITTGYTVKISNYGWDQSDKFVKIYITLTGVHQVPTENVQVHFTERSFDLLVKNLNGKSYSMIVNNLLKPISVEGSSKKLDSLP

SEQ ID NO: 865417 - protein, 311 aa, Homo sapiens; identical to SEQ ID NO: 865407

SEQ ID NO: 865418 - protein, 215 aa, Homo sapiens
GGARLGGLCVLAVGGGGGCLAKVRDPSRAGGGPRSCVCARFEGSARGFLFLLLRGCSSGLRPDPAPMASEELQKDLEEVKVLLEKATRKRVRDALTAEKSKIETEIKNKMQQKSQKKAELLDNEKPAAVVAPITTGYTVKISNYGWDQSDKFVKIYITLTGVHQVPTENVQVHFTERSFDLLVKNLNGKSYSMIVNNLLKPISVEGSSKKLDSLP

SEQ ID NO: 865419 - protein, 74 aa, Homo sapiens
MIVNNLLKPISVEGSSKKVKTDTVLILCRKKVENTRWDYLTQVEKECKEKDLYDTEPIQWGLMMSKVMDGTMFE

SEQ ID NO: 865420 - protein, 311 aa, Homo sapiens; identical to SEQ ID NO: 865407

SEQ ID NO: 865421 - protein, 228 aa, Homo sapiens
MASEELQKDLEEVKVLLEKATRKRVRDALTAEKSKIETEIKNKMQQKSQKKAELLDNEKPAAVVAPITTGYTVKISNYGWDQSDKFVKIYITLTGVHQVPTENVQVHFTERSFDLLVKNLNGKSYSMIVNNLLKPISVEGSSKKVKTDTVLILCRKKVENTRWDYLTQVEKECKEKEKPSYDTETDPSEGLMNVLKKIYEDGDDDMKRTINKAWVESREKQAKGDTEF

SEQ ID NO: 865422 - protein, 302 aa, Homo sapiens
GGARLGGLCVLAVGGGGGCLAKVRDPSRAGGGPRSCAGSVWAQAAAPRLVRVGVCARFEGSARGFLFLLLRGCSSGLRPDPAPMASEELQKDLEEVKVLLEKATRKRVRDALTAEKSKIETEIKNKMQQKSQKKAELLDNEKPAAVVAPITTGYTVKISNYGWDQSDKFVKIYITLTGVHQVPTENVQVHFTERSFDLLVKNLNGKSYSMIVNNLLKPISVEGSSKKVKTDTVLILCRKKVENTRWDYLTQVEKECKEKEKPSYDTETDPSEGLMNVLKKIYEDGDDDMKRTINKLKSFWEL

SEQ ID NO: 865423 - protein, 305 aa, Homo sapiens
AVQISKKRKFVADGIFKAELNEFLTRELAEDGYSGVEVRVTPTRTEIIILATRTQKRGFLFLLLRGCSSGLRPDPAPMASEELQKDLEEVKVLLEKATRKRVRDALTAEKSKIETEIKNKMQQKSQKKAELLDNEKPAAVVAPITTGYTVKISNYGWDQSDKFVKIYITLTGVHQVPTENVQVHFTERSFDLLVKNLNGKSYSMIVNNLLKPISVEGSSKKVKTDTVLILCRKKVENTRWDYLTQVEKECKEKEKPSYDTETDPSEGLMNVLKKIYEDGDDDMKRTINKAWVESREKQAKGDTEF

SEQ ID NO: 865424 - protein, 330 aa, Homo sapiens
LVASGWRACRSDLSEQCVSRLPSTEGPEILTTCVEFVTKLHMHAHAVRCRASVAERRHRKSVLRVKVVACNRYRSELPVRGGALYLLHAPVVSSGLRPDPAPMASEELQKDLEEVKVLLEKATRKRVRDALTAEKSKIETEIKNKMQQKSQKKAELLDNEKPAAVVAPITTGYTVKISNYGWDQSDKFVKIYITLTGVHQVPTENVQVHFTERSFDLLVKNLNGKSYSMIVNNLLKPISVEGSSKKVKTDTVLILCRKKVENTRWDYLTQVEKECKEKEKPSYDTETDPSEGLMNVLKKIYEDGDDDMKRTINKAWVESREKQAKGDTEF

SEQ ID NO: 865425 - protein, 322 aa, Homo sapiens
PAPVSAPPSRGTPHSPLAAPSAPQRFHSTSHPTRLLGSSGGVRRLSVQAVRGVGLGERPFARVPQALSALVSQPVDRKLHSSKAGCKHECQFLVEGGWKLQKDLEEVKVLLEKATRKRVRDALTAEKSKIETEIKNKMQQKSQKKAELLDNEKPAAVVAPITTGYTVKISNYGWDQSDKFVKIYITLTGVHQVPTENVQVHFTERSFDLLVKNLNGKSYSMIVNNLLKPISVEGSSKKVKTDTVLILCRKKVENTRWDYLTQVEKECKEKEKPSYDTETDPSEGLMNVLKKIYEDGDDDMKRTINKAWVESREKQAKGDTEF

SEQ ID NO: 865426 - protein, 124 aa, Homo sapiens
MNSEVPMNSEVPMNSRYSSAPSMIVNNLLKPISVEGSSKKVKTDTVLILCRKKVENTRWDYLTQVEKECKEKEKPSYDTETDPSEGLMNVLKKIYEDGDDDMKRTINKAWVESREKQAKGDTEF

SEQ ID NO: 865427 - protein, 258 aa, Homo sapiens
GGARLGGLCVLAVGGGGGCLAKVRDPSRAGGGPRSCAGSVWAQAAAPRLVRVGVCARFEGSARGFLFLLLRGCSSGLRPDPAPMASEELQKDLEEVKVLLEKATRKRVRDALTAEKSKIETEIKNKMQQKSQKKAELLDNEKPAAVVAPITTGYTVKISNYGWDQSDKFVKIYITLTGVHQVPTENVQVHFTERSFDLLVKNLNGKSYSMIVNNLLKPISVEGSSKKRRFPIQNDTVLLSCRNKHANTSDLVDDDPAL

SEQ ID NO: 865428 - protein, 1969 aa, Homo sapiens
PEFRGRLLLLNSRPRRLKTQGMQCFSLGTKCIPVDSSGDQQLCFVLTENGLSLILFGLTQEEFLNRLMIHGSASTVDTLCHLNGWGRCSIPIHALEAGIENRQLDTVNFFLKSKENLFNPSSKSSVSDQFDHLSSHLYLRNVEELIPALDLLCSAIRESYSEPQSKHFSEQLLNLTLSFLNNQIKELFIHTEELDEHLQKGVNILTSYINELRTFMIKFPWKLTDAIDEYDVHENVPKVKESNIWKKLSFEEVIASAILNNKIPEAQTFFRIDSHSAQKLEELIGIGLNLVFDNLKKNNIKEASELLKNMGFDVKGQLLKICFYTTNKNIRDFLVEILKEKNYFSEKEKRTIDFVHQVEKLYLGHFQENMQIQSFPRYWIKEQDFFKHKSVLDSFLKYDCKDEFNKQDHRIVLNWALWWDQLTQESILLPRISPEEYKSYSPEALWRYLTARHDWLNIILWIGEFQTQHSYASLQQNKWPLLTVDVINQNTSCNNYMRNEILDKLARNGVFLASELEDFECFLLRLSRIGGVIQDTLPVQNYKTKEGWDFHSQFILYCLEHSLQLFFMSTLTVTNPKLIFQASLANAQILIPTNQASVSSMLLEGHTLLALATTMYSPGGVSQVVQNEENENCLKKVDPQLLKMALTPYPKLKTALFPQCTPPSVLPSDITIYHLIQSLSPFDPSRLFGWQSANTLAIGDAWSHLPHFSSPDLVNKYAIVERLNFAYYLHNGRPSFAFGTFLVQELIKSKTPKQLIQQVGNEAYVIGLSSFHIPSIGAACVCFLELLGLDSLKLRVDMKVANIILSYKCRNEDAQYSFIRESVAEKLSKLADGEKTTTEELLVLLEEGTWNSIQQQEIKRLSSESSSQWALVVQFCRLHNMKLSISYLRECAKANDWLQFIIHSQLHNYHPAEVKSLIQYFSPVIQDHLRLAFENLPSVPTSKMDSDQVCNKCPQELQGSKQEMTDLFEILLQCSEEPDSWHWLLVEAVKQQAPILSVLASCLQGASAISCLCVWIITSVEDNVATEAMGHIQDSTEDHTWNLEDLSVIWRTLLTRQKSKTLIRGFQLFFKDSPLLLVMEMYELCMFFRNYKEAEAKLLEFQKSLETLNTAATKVHPVIPAMWLEDQVCFLLKLMLQQCKTQYELGKLLQLFVEREHLFSDGPDVKKLCILCQILKDTSIAINHTIITSYSIENLQHECRSIWKDCRQMDNSALARRVAELAELPVDNLVIKEITQEMQTLKHIEQWSLKQARIDFWKKCHENFKKNSISSKAASSFFSTQAHVACEHPTGWSSMEERHLLLTLAGHWLAQEDVVPLDKLEELEKQIWLCRITQHTLGRNQEETEPRFSRQISTSGELSFDSLASEFSFSKLAALNTSKYLELNSLPSKETCENRLDWKEQESLNFLIGRLLDDGCVHEASRVCRYFHFYNPDVALVLHCRALASGEASMEDLHPEIHALLQSAELLEEEAPDIPLRRVHSTSSLDSQKFVTVPSSNEVVTNLEVLTSKCLHGKNYCRQVLCLYDLAKELGCSYTDVAAQDGEAMLRKILASQQPDRCKRAQAFISTQGLKPDTVAELVAEEVTRELLTSSQGTGHKQMFNPTEESQTFLQLTTLCQDRTLVGMKLLDKISSVPHGELSCTTELLILAHHCFTLTCHMEGIIRVLQAAHMLTDNHLAPSEEYGLVVRLLTGIGRYNEMTYIFDLLHKKHYFEVLMRKKLDPSGTLKTALLDYIKRCRPGDSEKHNMIALCFSMCREIGENHEAAARIQLKLIESQPWEDSLKDGHQLKQLLLKALTLMLDAAESYAKDSCVRQAQHCQRLTKLITLQIHFLNTGQNTMLINLGRHKLMDCILALPRFYQASIVAEAYDFVPDWAEILYQQVILKGDFNYLEEFKQQRLLKSSIFEEISKKYKQHQPTDMVMENLKKLLTYCEDVYLYYKLAYEHKFYEIVNVLLKDPQTGCCLKDMLAG

SEQ ID NO: 865429 - protein, 2327 aa, Homo sapiens
MCNEQQQEPAKISSFTSLKVSQDLDVAVIVSSSNSAVALNLNLYFRQHPGHLLCERILEDLPIQGPKGVDEDDPVNSAYNMKLAKFSFQIDRSWKAQLSSLNETIKNSKLEVSCCAPWFQDILHLESPESGNHSTSVQSWAFIPQDIMHGQYNVLQKDHAKTSDPGRSWKIMHISEQEEPIELKCVSVTGFTALFTWEVERMGYTITLWDLETQGMQCFSLGTKCIPVDSSGDQQLCFVLTENGLSLILFGLTQEEFLNRLMIHGSASTVDTLCHLNGWGRCSIPIHALEAGIENRQLDTVNFFLKSKENLFNPSSKSSVSDQFDHLSSHLYLRNVEELIPALDLLCSAIRESYSEPQSKHFSEQLLNLTLSFLNNQIKELFIHTEELDEHLQKGVNILTSYINELRTFMIKFPWKLTDAIDEYDVHENVPKVKESNIWKKLSFEEVIASAILNNKIPEAQTFFRIDSHSAQKLEELIGIGLNLVFDNLKKNNIKEASELLKNMGFDVKGQLLKICFYTTNKNIRDFLVGKGDDYIVYIFQKAWVKNLEENLGRKTLSNFNVQLISNKKKCDNPFIFFSPSSFFNDYFTFVAKEKFVLTYINSNVQNIILEMAYYLMTFFNESLIPSTTLFDNLMTFFAKVLDFLESHCFNYFLFKVEILKEKNYFSEKEKRTIDFVHQVEKLYLGHFQENMQIQSFPRYWIKEQDFFKHKSVLDSFLKYDCKDEFNKQDHRIVLNWALWWDQLTQESILLPRISPEEYKSYSPEALWRYLTARHDWLNIILWIGEFQTQHSYASLQQNKWPLLTVDVINQNTSCNNYMRNEILDKLARNGVFLASELEDFECFLLRLSRIGGVIQDTLPVQNYKTKEGWDFHSQFILYCLEHSLQHLLYVYLDCYKLSPENCPFLEKKELHEAHPWFEFLVQCRQVASNLTDPKLIFQASLANAQILIPTNQASVSSMLLEGHTLLALATTMYSPGGVSQVVQNEENENCLKKVDPQLLKMALTPYPKLKTALFPQCTPPSVLPSDITIYHLIQSLSPFDPSRLFGWQSANTLAIGDAWSHLPHFSSPDLVNKYAIVERLNFAYYLHNGRPSFAFGTFLVQELIKSKTPKQLIQQVGNEAYVIGLSSFHIPSIGAACVCFLELLGLDSLKLRVDMKVANIILSYKCRNEDAQYSFIRESVAEKLSKLADGEKTTTEELLVLLEEGTWNSIQQQEIKRLSSESSSQWALVVQFCRLHNMKLSISYLRECAKANDWLQFIIHSQLHNYHPAEVKSLIQYFSPVIQDHLRLAFENLPSVPTSKMDSDQVCNKCPQELQGSKQEMTDLFEILLQCSEEPDSWHWLLVEAVKQQAPILSVLASCLQGASAISCLCVWIITSVEDNVATEAMGHIQDSTEDHTWNLEDLSVIWRTLLTRQKSKTLIRGFQLFFKDSPLLLVMEMYELCMFFRNYKEAEAKLLEFQKSLETLNTAATKVHPVIPAMWLEDQVCFLLKLMLQQCKTQYELGKLLQLFVEREHLFSDGPDVKKLCILCQILKDTSIAINHTIITSYSIENLQHECRSIWKDCRQMDKFALARRVAELAELPVDNLVIKEITQEMQTLKHIEQWSLKQARIDFWKKCHENFKKNSISSKAASSFFSTQAHVACEHPTGWSSMEERHLLLTLAGHWLAQEDVVPLDKLEELEKQIWLCRITQHTLGRNQEETEPRFSRQISTSGELSFDSLASEFSFSKLAALNTSKYLELNSLPSKETCENRLDWKEQESLNFLIGRLLDDGCVHEASRVCRYFHFYNPDVALVLHCRALASGEASMEDLHPEIHALLQSAELLEEEAPDIPLRRVHSTSSLDSQKFVTVPSSNEVVTNLEVLTSKCLHGKNYCRQVLCLYDLAKELGCSYTDVAAQDGEAMLRKILASQQPDRCKRAQAFISTQGLKPDTVAELVAEEVTRELLTSSQGTGHKQMFNPTEESQTFLQLTTLCQDRTLVGMKLLDKISSVPHGELSCTTELLILAHHCFTLTCHMEGIIRVLQAAHMLTDNHLAPSEEYGLVVRLLTGIGRYNEMTYIFDLLHKKHYFEVLMRKKLDPSGTLKTALLDYIKRCRPGDSEKHNMIALCFSMCREIGENHEAAARIQLKLIESQPWEDSLKDGHQLKQLLLKALTLMLDAAESYAKDSCVRQAQHCQRLTKLITLQIHFLNTGQNTMLINLGRHKLMDCILALPRFYQASIVAEAYDFVPDWAEILYQQVILKGDFNYLEEFKQQRLLKSSIFEEISKKYKQHQPTDMVMENLKKLLTYCEDVYLYYKLAYEHKFYEIVNVLLKDPQTGCCLKDMLAG

SEQ ID NO: 865430 - protein, 2285 aa, Homo sapiens
MCNEQQQEPAKISSFTSLKVSQDLDVAVIVSSSNSAVALNLNLYFRQHPGHLLCERILEDLPIQGPKGVDEDDPVNSAYNMKLAKFSFQIDRSWKAQLSSLNETIKNSKLEVSCCAPWFQDILHLESPESGNHSTSVQSWAFIPQDIMHGQYNVLQKDHAKTSDPGRSWKIMHISEQEEPIELKCVSVTGFTALFTWEVERMGYTITLWDLETQGMQCFSLGTKCIPVDSSGDQQLCFVLTENGLSLILFGLTQEEFLNRLMIHGSASTVDTLCHLNGWGRCSIPIHALEAGIENRQLDTVNFFLKSKENLFNPSSKSSVSDQFDHLSSHLYLRNVEELIPALDLLCSAIRESYSEPQSKHFSEQLLNLTLSFLNNQIKELFIHTEELDEHLQKGVNILTSYINELRTFMIKFPWKLTDAIDEYDVHENVPKVKESNIWKKLSFEEVIASAILNNKIPEAQTFFRIDSHSAQKLEELIGIGLNLVFDNLKKNNIKEASELLKNMGFDVKGQLLKICFYTTNKNIRDFLVEILKEKNYFSEKEKRTIDFVHQVEKLYLGHFQENMQIQSFPRYWIKEQDFFKHKSVLDSFLKYDCKDEFNKQDHRIVLNWALWWDQLTQESILLPRISPEEYKSYSPEALWRYLTARHDWLNIILWIGEFQTQHSYASLQQNKWPLLTVDVINQNTSCNNYMRNEILDKLARNGVFLASELEDFECFLLRLSRIGGVIQDTLPVQNYKTKEGWDFHSQFILYCLEHSLQHLLYVYLDCYKLSPENCPFLEKKELHEAHPWFEFLVQCRQVASNLTDPKLIFQASLANAQILIPTNQASVSSMLLEGHTLLALATTMYSPGGVSQVVQNEENENCLKKVDPQLLKMALTPYPKLKTALFPQCTPPSVLPSDITIYHLIQSLSPFDPSRLFGWQSANTLAIGDAWSHLPHFSSPDLVNKYAIVERLNFAYYLHNGRPSFAFGTFLVQELIKSKTPKQLIQQVGNEAYVIGLSSFHIPSIGAACVCFLELLGLDSLKLRVDMKVANIILSYKCRNEDAQYSFIRESVGTAPFIWPALFREGVTRSKALNCECLGRKWLSSWFYPFPAECVFFVSLSWALELGSEMALSHTIQTEMLQVLTFSLHHILLFIFLTAEKLSKLADGEKTTTEELLVLLEEGTWNSIQQQEIKRLSSESSSQWALVVQFCRLHNMKLSISYLRECAKANDWLQFIIHSQLHNYHPAEVKSLIQYFSPVIQDHLRLAFENLPSVPTSKMDSDQVCNKCPQELQGSKQEMTDLFEILLQCSEEPDSWHWLLVEAVKQQAPILSVLASCLQGASAISCLCVWIITSVEDNVATEAMGHIQDSTEDHTWNLEDLSVIWRTLLTRQKSKTLIRGFQLFFKDSPLLLVMEMYELCMFFRNYKEAEAKLLEFQKSLETLNTAATKVHPVIPAMWLEDQVCFLLKLMLQQCKTQYELGKLLQLFVEREHLFSDGPDVKKLCILCQILKDTSIAINHTIITSYSIENLQHECRSIWKDCRQMDKFALARRVAELAELPVDNLVIKEITQEMQTLKHIEQWSLKQARIDFWKKCHENFKKNSISSKAASSFFSTQAHVACEHPTGWSSMEERHLLLTLAGHWLAQEDVVPLDKLEELEKQIWLCRITQHTLGRNQEETEPRFSRQISTSGELSFDSLASEFSFSKLAALNTSKYLELNSLPSKETCENRLDWKEQESLNFLIGRLLDDGCVHEASRVCRYFHFYNPDVALVLHCRALASGEASMEDLHPEIHALLQSAELLEEEAPDIPLRRVHSTSSLDSQKFVTVPSSNEVVTNLEVLTSKCLHGKNYCRQVLCLYDLAKELGCSYTDVAAQDGEAMLRKILASQQPDRCKRAQAFISTQGLKPDTVAELVAEEVTRELLTSSQGTGHKQMFNPTEESQTFLQLTTLCQDRTLVGMKLLDKISSVPHGELSCTTELLILAHHCFTLTCHMEGIIRVLQAAHMLTDNHLAPSEEYGLVVRLLTGIGRYNEMTYIFDLLHKKHYFEVLMRKKLDPSGTLKTALLDYIKRCRPGDSEKHNMIALCFSMCREIGENHEAAARIQLKLIESQPWEDSLKDGHQLKQLLLKALTLMLDAAESYAKDSCVRQAQHCQRLTKLITLQIHFLNTGQNTMLINLGRHKLMDCILALPRFYQASIVAEAYDFVPDWAEILYQQVILKGDFNYLEEFKQQRLLKSSIFEEISKKYKQHQPTDMVMENLKKLLTYCEDVYLYYKLAYEHKFYEIVNVLLKDPQTGCCLKDMLAG

SEQ ID NO: 865431 - protein, 2351 aa, Homo sapiens
MCNEQQQEPAKISSFTSLKVSQDLDVAVIVSSSNSAVALNLNLYFRQHPGHLLCERILEDLPIQGPKGVDEDDPVNSAYNMKLAKFSFQIDRSWKAQLSSLNETIKNSKLEVSCCAPWFQDILHLESPESGNHSTSVQSWAFIPQDIMHGQYNVLQKDHAKTSDPGRSWKIMHISEQEEPIELKCVSVTGFTALFTWEVERMGYTITLWDLETQGMQCFSLGTKCIPVDSSGDQQLCFVLTENGLSLILFGLTQEEFLNRLMIHGSASTVDTLCHLNGWGRCSIPIHALEAGIENRQLDTVNFFLKSKENLFNPSSKSSVSDQFDHLSSHLYLRNVEELIPALDLLCSAIRESYSEPQSKHFSEQLLNLTLSFLNNQIKELFIHTEELDEHLQKGVNILTSYINELRTFMIKFPWKLTDAIDEYDVHENVPKVKESNIWKKLSFEEVIASAILNNKIPEAQTFFRIDSHSAQKLEELIGIGLNLVFDNLKKNNIKEASELLKNMGFDVKGQLLKICFYTTNKNIRDFLVGKGDDYIVYIFQKAWVKNLEENLGRKTLSNFNVQLISNKKKCDNPFIFFSPSSFFNDYFTFVAKEKFVLTYINSNVQNIILEMAYYLMTFFNESLIPSTTLFDNLMTFFAKVLDFLESHCFNYFLFKVEILKEKNYFSEKEKRTIDFVHQVEKLYLGHFQENMQIQSFPRYWIKEQDFFKHKSVLDSFLKYDCKDEFNKQDHRIVLNWALWWDQLTQESILLPRISPEEYKSYSPEALWRYLTARHDWLNIILWIGEFQTQHSYASLQQNKWPLLTVDVINQNTSCNNYMRNEILDKLARNGVFLASELEDFECFLLRLSRIGGVIQDTLPVQNYKTKEGWDFHSQFILYCLEHSLQHLLYVYLDCYKLSPENCPFLEKKELHEAHPWFEFLVQCRQVASNLTDPKLIFQASLANAQILIPTNQASVSSMLLEGHTLLALATTMYSPGGVSQVVQNEENENCLKKVDPQLLKMALTPYPKLKTALFPQCTPPSVLPSDITIYHLIQSLSPFDPSRLFGWQSANTLAIGDAWSHLPHFSSPDLVNKYAIVERLNFAYYLHNGRPSFAFGTFLVQELIKSKTPKQLIQQVGNEAYVIGLSSFHIPSIGAACVCFLELLGLDSLKLRVDMKVANIILSYKCRNEDAQYSFIRESVAEKLSKLADGEKTTTEELLVLLEEGTWNSIQQQEIKRLSSESSSQWALVVQFCRLHNMKLSISYLRECAKANDWLQFIIHSQLHNYHPAEVKSLIQYFSPVIQDHLRLAFENLPSVPTSKMDSDQVCNKCPQELQGSKQEMTDLFEILLQCSEEPDSWHWLLVEAVKQQAPILSVLASCLQGASAISCLCVWIITSVEDNVATEAMGHIQDSTEDHTWNLEDLSVIWRTLLTRQKSKTLIRGFQLFFKDSPLLLVMEMYELCMFFRNYKEAEAKLLEFQKSLETLNTAATKVHPVIPAMWLEDQVCFLLKLMLQQCKTQYELGKLLQLFVEREHLFSDGKRIRLPSAKSVTEAMQTAQPSGEGPDVKKLCILCQILKDTSIAINHTIITSYSIENLQHECEIYLERLQTDGQFALARRVAELAELPVDNLVIKEITQEMQTLKHIEQWSLKQARIDFWKKCHENFKKNSISSKAASSFFSTQAHVACEHPTGWSSMEERHLLLTLAGHWLAQEDVVPLDKLEELEKQIWLCRITQHTLGRNQEETEPRFSRQISTSGELSFDSLASEFSFSKLAALNTSKYLELNSLPSKETCENRLDWKEQESLNFLIGRLLDDGCVHEASRVCRYFHFYNPDVALVLHCRALASGEASMEDLHPEIHALLQSAELLEEEAPDIPLRRVHSTSSLDSQKFVTVPSSNEVVTNLEVLTSKCLHGKNYCRQVLCLYDLAKELGCSYTDVAAQDGEAMLRKILASQQPDRCKRAQAFISTQGLKPDTVAELVAEEVTRELLTSSQGTGHKQMFNPTEESQTFLQLTTLCQDRTLVGMKLLDKISSVPHGELSCTTELLILAHHCFTLTCHMEGIIRVLQAAHMLTDNHLAPSEEYGLVVRLLTGIGRYNEMTYIFDLLHKKHYFEVLMRKKLDPSGTLKTALLDYIKRCRPGDSEKHNMIALCFSMCREIGENHEAAARIQLKLIESQPWEDSLKDGHQLKQLLLKALTLMLDAAESYAKDSCVRQAQHCQRLTKLITLQIHFLNTGQNTMLINLGRHKLMDCILALPRFYQASIVAEAYDFVPDWAEILYQQVILKGDFNYLEEFKQQRLLKSSIFEEISKKYKQHQPTDMVMENLKKLLTYCEDVYLYYKLAYEHKFYEIVNVLLKDPQTGCCLKDMLAG

SEQ ID NO: 865432 - protein, 2291 aa, Homo sapiens
MCNEQQQEPAKISSFTSLKVSQDLDVAVIVSSSNSAVALNLNLYFRQHPGHLLCERILEDLPIQGPKGVDEDDPVNSAYNMKLAKFSFQIDRSWKAQLSSLNETIKNSKLEVSCCAPWFQDILHLESPESGNHSTSVQSWAFIPQDIMHGQYNVLQKDHAKTSDPGRSWKIMHISEQEEPIELKCVSVTGFTALFTWEVERMGYTITLWDLETQGMQCFSLGTKCIPVDSSGDQQLCFVLTENGLSLILFGLTQEEFLNRLMIHGSASTVDTLCHLNGWGRCSIPIHALEAGIENRQLDTVNFFLKSKENLFNPSSKSSVSDQFDHLSSHLYLRNVEELIPALDLLCSAIRESYSEPQSKHFSEQLLNLTLSFLNNQIKELFIHTEELDEHLQKGVNILTSYINELRTFMIKFPWKLTDAIDEYDVHENVPKVKESNIWKKLSFEEVIASAILNNKIPEAQTFFRIDSHSAQKLEELIGIGLNLVFDNLKKNNIKEASELLKNMGFDVKGQLLKICFYTTNKNIRDFLVGKGDDYIVYIFQKAWVKNLEENLGRKTLSNFNVQLISNKKKCDNPFIFFSPSSFFNDYFTFVAKEKFVLTYINSNVQNIILEMAYYLMTFFNESLIPSTTLFDNLMTFFAKVLDFLESHCFNYFLFKVEILKEKNYFSEKEKRTIDFVHQVEKLYLGHFQENMQIQSFPRYWIKEQDFFKHKSVLDSFLKYDCKDEFNKQDHRIVLNWALWWDQLTQESILLPRISPEEYKSYSPEALWRYLTARHDWLNIILWIGEFQTQHSYASLQQNKWPLLTVDVINQNTSCNNYMRNEILDKLARNGVFLASELEDFECFLLRLSRIGGVIQDTLPVQNYKTKEGWDFHSQFILYCLEHSLQHLLYVYLDCYKLSPENCPFLEKKELHEAHPWFEFLVQCRQVASNLTDPKLIFQASLANAQILIPTNQASVSSMLLEGHTLLALATTMYSPGGVSQVVQNEENENCLKKVDPQLLKMALTPYPKLKTALFPQCTPPSVLPSDITIYHLIQSLSPFDPSRLFGWQSANTLAIGDAWSHLPHFSSPDLVNKYAIVERLNFAYYLHNGRPSFAFGTFLVQELIKSKTPKQLIQQVGNEAYVIGLSSFHIPSIGAACVCFLELLGLDSLKLRVDMKVANIILSYKCRNEDAQYSFIRESVAEKLSKLADGEKTTTEELLVLLEEGTWNSIQQQEIKRLSSESSSQWALVVQFCRLHNMKLSISYLRECAKANDWLQFIIHSQLHNYHPAEVKSLIQYFSPVIQDHLRLAFENLPSVPTSKMDSDQVCNKCPQELQGSKQEMTDLFEILLQCSEEPDSWHWLLVEAVKQQAPILSVLASCLQGASAISCLCVWIITSVEDNVATEAMGHIQDSTEDHTWNLEDLSVIWRTLLTRQKSKTLIRGFQLFFKDSPLLLVMEMYELCMFFRNYKEAEAKLLEFQKSLETLNTAATKVHPVIPAMWLEDQVCFLLKLMLQQCKTQYELGKLLQLFVEREHLFSDGPDVKKLCILCQILKDTSIAINHTIITSYSIENLQHECRSIWKDCRQMDKFALARRVAELAELPVDNLVIKEITQEMQTLKHIEQWSLKQARIDFWKKCHENFKKNSISSKAASSFFSTQAHVACEHPTGWSSMEERHLLLTLAGHWLAQEDVVPLDKLEELEKQIWLCRITQHTLGRNQEETEPRFSRQISTSGELSFDSLASEFSFSKLAALNTSKYLELNSLPSKETCENRLDWKEQESLNFLIGRLLDDGCVHEASRVCRYFHFYNPDVALVLHCRALASGEASMEDLHPEIHALLQSAELLEEEAPDIPLRRVHSTSSLDSQKFVTVPSSNEVVTNLEVLTSKCLHGKNYCRQVLCLYDLAKELGCSYTDVAAQDGEAMLRKILASQQPDRCKRAQAFISTQGLKPDTVAELVAEEVTRELLTSSQGTGHKQMFNPTEESQTFLQLTTLCQDRTLVGMKLLDKISSVPHGELSCTTELLILAHHCFTLTCHMEGIIRVLQAAHMLTDNHLAPSEEYGLVSGTLKTALLDYIKRCRPGDSEKHNMIALCFSMCREIGENHEAAARIQLKLIESQPWEDSLKDGHQLKQLLLKALTLMLDAAESYAKDSCVRQAQHCQRLTKLITLQIHFLNTGQNTMLINLGRHKLMDCILALPRFYQASIVAEAYDFVPDWAEILYQQVILKGDFNYLEEFKQQRLLKSSIFEEISKKYKQHQPTDMVMENLKKLLTYCEDVYLYYKLAYEHKFYEIVNVLLKDPQTGCCLKDMLAG

SEQ ID NO: 865433 - protein, 2396 aa, Homo sapiens
MCNEQQQEPAKISSFTSLKVSQDLDVAVIVSSSNSAVALNLNLYFRQHPGHLLCERILEDLPIQGPKGVDEDDPVNSAYNMKLAKFSFQIDRSWKAQLSSLNETIKNSKLEVSCCAPWFQDILHLESPESGNHSTSVQSWAFIPQDIMHGQYNVLQKDHAKTSDPGRSWKIMHISEQEEPIELKCVSVTGFTALFTWEVERMGYTITLWDLETQGMQCFSLGTKCIPVDSSGDQQLCFVLTENGLSLILFGLTQEEFLNRLMIHGSASTVDTLCHLNGWGRCSIPIHALEAGIENRQLDTVNFFLKSKENLFNPSSKSSVSDQFDHLSSHLYLRNVEELIPALDLLCSAIRESYSEPQSKHFSEQLLNLTLSFLNNQIKELFIHTEELDEHLQKGVNILTSYINELRTFMIKFPWKLTDAIDEYDVHENVPKVKESNIWKKLSFEEVIASAILNNKIPEAQTFFRIDSHSAQKLEELIGIGLNLVFDNLKKNNIKEASELLKNMGFDVKGQLLKICFYTTNKNIRDFLVGKGDDYIVYIFQKAWVKNLEENLGRKTLSNFNVQLISNKKKCDNPFIFFSPSSFFNDYFTFVAKEKFVLTYINSNVQNIILEMAYYLMTFFNESLIPSTTLFDNLMTFFAKVLDFLESHCFNYFLFKVEILKEKNYFSEKEKRTIDFVHQVEKLYLGHFQENMQIQSFPRYWIKEQDFFKHKSVLDSFLKYDCKDEFNKQDHRIVLNWALWWDQLTQESILLPRISPEEYKSYSPEALWRYLTARHDWLNIILWIGEFQTQHSYASLQQNKWPLLTVDVINQNTSCNNYMRNEILDKLARNGVFLASELEDFECFLLRLSRIGGVIQDTLPVQNYKTKEGWDFHSQFILYCLEHSLQHLLYVYLDCYKLSPENCPFLEKKELHEAHPWFEFLVQCRQVASNLTDPKLIFQASLANAQILIPTNQASVSSMLLEGHTLLALATTMYSPGGVSQVVQNEENENCLKKVDPQLLKMALTPYPKLKTALFPQCTPPSVLPSDITIYHLIQSLSPFDPSRLFGWQSANTLAIGDAWSHLPHFSSPDLVNKYAIVERLNFAYYLHNGRPSFAFGTFLVQELIKSKTPKQLIQQVGNEAYVIGLSSFHIPSIGAACVCFLELLGLDSLKLRVDMKVANIILSYKCRNEDAQYSFIRESVAEKLSKLADGEKTTTEELLVLLEEGTWNSIQQQEIKRLSSESSSQWALVVQFCRLHNMKLSISYLRECAKANDWLQFIIHSQLHNYHPAEVKSLIQYFSPVIQDHLRLAFENLPSVPTSKMDSDQVCNKCPQELQGSKQEMTDLFEILLQCSEEPDSWHWLLVEAVKQQAPILSVLASCLQGASAISCLCVWIITSVEDNVATEAMGHIQDSTEDHTWNLEDLSVIWRTLLTRQKSKTLIRGFQLFFKDSPLLLVMEMYELCMFFRNYKEAEAKLLEFQKSLETLNTAATKVHPVIPAMWLEDQVCFLLKLMLQQCKTQYELGKLLQLFVEREHLFSDGPDVKKLCILCQILKDTSIAINHTIITSYSIENLQHECRSIWKDCRQMDKFALARRVAELAELPVDNLVIKEITQEMQTLKHIEQWSLKQARIDFWKKCHENFKKNSISSKAASSFFSTQAHVACEHPTGWSSMEERHLLLTLAGHWLAQEDVVPLDKLEELEKQIWLCRITQHTLGRNQEETEPRFSRQISTSGELSFDSLASEFSFSKLAALNTSKYLELNSLPSKETCENRLDWKEQESLNFLIGRLLDDGCVHEASRVCRYFHFYNPDVALVLHCRALASGEASMEDLHPEIHALLQSAELLEEEAPDIPLRRVHSTSSLDSQKFVTVPSSNEVVTNLEVLTSKCLHGKNYCRQVLCLYDLAKELGCSYTDVAAQDGEAMLRKILASQQPDRCKRAQAFISTQGLKPDTVAELVAEEVTRELLTSSQGTGHKQMFNPTEESQTFLQLTTLCQDRTLVGMKLLDKISSVPHGELSCTTELLILAHHCFTLTCHMEGIIRVLQAAHMLTDNHLAPSEEYGLVVRLLTGIGRYNEMTYIFDLLHKKHYFEVLMRKKLDPSGTLKTALLDYIKRCRPGDSEKHNMIALCFSMCREIGENHEAAARIQLKLIESQPWEDSLKDGHQLKQLLLKALTLMLDAAESYAKVTQRLFSDWPWDLLSAVKLFSFVLGLFPGEAGGHHRPTRNRRGEYRCEGSHRRRQLGLSLLCLSTLVPQDSCVRQAQHCQRLTKLITLQIHFLNTGQNTMLINLGRHKLMDCILALPRFYQASIVAEAYDFVPDWAEILYQQVILKGDFNYLEEFKQQRLLKSSIFEEISKKYKQHQPTDMVMENLKKLLTYCEDVYLYYKLAYEHKFYEIVNVLLKDPQTGCCLKDMLAG

SEQ ID NO: 865434 - protein, 2137 aa, Homo sapiens
MCNEQQQEPAKISSFTSLKVSQDLDVAVIVSSSNSAVALNLNLYFRQHPGHLLCERILEDLPIQGPKGVDEDDPVNSAYNMKLAKFSFQIDRSWKAQLSSLNETIKNSKLEVSCCAPWFQDILHLESPESGNHSTSVQSWAFIPQDIMHGQYNVLQKDHAKTSDPGRSWKIMHISEQEEPIELKCVSVTGFTALFTWEVERMGYTITLWDLETQGMQCFSLGTKCIPVDSSGDQQLCFVLTENGLSLILFGLTQEEFLNRLMIHGSASTVDTLCHLNGWGRCSIPIHALEAGIENRQLDTVNFFLKSKENLFNPSSKSSVSDQFDHLSSHLYLRNVEELIPALDLLCSAIRESYSEPQSKHFSEQLLNLTLSFLNNQIKELFIHTEELDEHLQKGVNILTSYINELRTFMIKFPWKLTDAIDEYDVHENVPKVKESNIWKKLSFEEVIASAILNNKIPEAQTFFRIDSHSAQKLEELIGIGLNLVFDNLKKNNIKEASELLKNMGFDVKGQLLKICFYTTNKNIRDFLVGKGDDYIVYIFQKAWVKNLEENLGRKTLSNFNVQLISNKKKCDNPFIFFSPSSFFNDYFTFVAKEKFVLTYINSNVQNIILEMAYYLMTFFNESLIPSTTLFDNLMTFFAKVLDFLESHCFNYFLFKVEILKEKNYFSEKEKRTIDFVHQVEKLYLGHFQENMQIQSFPRYWIKEQDFFKHKSVLDSFLKYDCKDEFNKQDHRIVLNWALWWDQLTQESILLPRISPEEYKSYSPEALWRYLTARHDWLNIILWIGEFQTQHSYASLQQNKWPLLTVDVINQNTSCNNYMRNEILDKLARNGVFLASELEDFECFLLRLSRIGGVIQDTLPVQNYKTKEGWDFHSQFILYCLEHSLQHLLYVYLDCYKLSPENCPFLEKKELHEAHPWFEFLVQCRQVASNLTDPKLIFQASLANAQILIPTNQASVSSMLLEGHTLLALATTMYSPGGVSQVVQNEENENCLKKVDPQLLKMALTPYPKLKTALFPQCTPPSVLPSDITIYHLIQSLSPFDPSRLFGWQSANTLAIGDAWSHLPHFSSPDLVNKYAIVERLNFAYYLHNGRPSFAFGTFLVQELIKSKTPKQLIQQVGNEAYVIGLSSFHIPSIGAACVCFLELLGLDSLKLRVDMKVANIILSYKCRNEDAQYSFIRESVAEKLSKLADGEKTTTEELLVLLEEGTWNSIQQQEIKRLSSESSSQWALVVQFCRLHNMKLSISYLRECAKANDWLQFIIHSQLHNYHPAEVKSLIQYFSPVIQDHLRLAFENLPSVPTSKMDSDQVCNKCPQELQGSKQEMTDLFEILLQCSEEPDSWHWLLVEAVKQQAPILSVLASCLQGASAISCLCVWIITSVEDNVATEAMGHIQDSTEDHTWNLEDLSVIWRTLLTRQKSKTLIRGFQLFFKDSPLLLVMEMYELCMFFRNYKEAEAKLLEFQKSLETLNTAATKVHPVIPAMWLEDQVCFLLKLMLQQCKTQYELGKLLQLFVEREHLFSDGPDVKKLCILCQILKDTSIAINHTIITSYSIENLQHECRSIWKDCRQMDKFALARRVAELAELPVDNLVIKEITQEMQTLKHIEQWSLKQARIDFWKKCHENFKKNSISSKAASSFFSTQAHVACEHPTGWSSMEERHLLLTLAGHWLAQEDVVPLDKLEELEKQIWLCRITQHTLGRNQEETEPRFSRQISTSGELSFDSLASEFSFSKLAALNTSKYLELNSLPSKETCENRLDWKEQESLNFLIGRLLDDGCVHEASRVCRYFHFYNPDVALVLHCRALASGEASMEDLHPEIHALLQSAELLEEEAPDIPLRRVHSTSSLDSQKFVTVPSSNEVVTNLEVLTSKCLHGKNYCRQVLCLYDLAKELGCSYTDVAAQDGEAMLRKILASQQPDRCKRAQAFISTQGLKPDTVAELVAEEVTRELLTSSQGTGHKQMFNPTEESQTFLQLTTLCQDRTLVGMKLLDKISSVPHGELSCTTELLILAHHCFTLTCHMEGIIRVLQAAHMLTDNHLAPSEEYGLVVRLLTGIGRYNEMTYIFDLLHKKHYFEVLMRKKLDPSGTLKTALLDYIKRCRPGDSEKHNMIALCFSMCREIGENHEAAARIQLKLIESQPWGE

SEQ ID NO: 865435 - protein, 2327 aa, Homo sapiens; identical to SEQ ID NO: 865429

SEQ ID NO: 865436 - protein, 2009 aa, Homo sapiens
MCNEQQQEPAKISSFTSLKVSQDLDVAVIVSSSNSAVALNLNLYFRQHPGHLLCERILEDLPIQGPKGVDEDDPVNSAYNMKLAKFSFQIDRSWKAQLSSLNETIKNSKLEVSCCAPWFQDILHLESPESGNHSTSVQSWAFIPQDIMHGQYNVLQKDHAKTSDPGRSWKIMHISEQEEPIELKCVSVTGFTALFTWEVERMGYTITLWDLETQGMQCFSLGTKCIPVDSSGDQQLCFVLTENGLSLILFGLTQEEFLNRLMIHGSASTVDTLCHLNGWGRCSIPIHALEAGIENRQLDTVNFFLKSKENLFNPSSKSSVSDQFDHLSSHLYLRNVEELIPALDLLCSAIRESYSEPQSKHFSEQLLNLTLSFLNNQIKELFIHTEELDEHLQKGVNILTSYINELRTFMIKFPWKLTDAIDEYDVHENVPKVKESNIWKKLSFEEVIASAILNNKIPEAQTFFRIDSHSAQKLEELIGIGLNLVFDNLKKNNIKEASELLKNMGFDVKGQLLKICFYTTNKNIRDFLVEILKEKNYFSEKEKRTIDFVHQVEKLYLGHFQENMQIQSFPRYWIKEQDFFKHKSVLDSFLKYDCKDEFNKQDHRIVLNWALWWDQLTQESILLPRISPEEYKSYSPEALWRYLTARHDWLNIILWIGEFQTQHSYASLQQNKWPLLTVDVINQNTSCNNYMRNEILDKLARNGVFLASELEDFECFLLRLSRIGGVIQDTLPVQNYKTKEGWDFHSQFILYCLEHSLQHLLYVYLDCYKLSPENCPFLEKKELHEAHPWFEFLVQCRQVASNLTDPKLIFQASLANAQILIPTNQASVSSMLLEGHTLLALATTMYSPGGVSQVVQNEENENCLKKVDPQLLKMALTPYPKLKTALFPQCTPPSVLPSDITIYHLIQSLSPFDPSRLFGWQSANTLAIGDAWSHLPHFSSPDLVNKYAIVERLNFAYYLHNGRPSFAFGTFLVQELIKSKTPKQLIQQVGNEAYVIGLSSFHIPSIGAACVCFLELLGLDSLKLRVDMKVANIILSYKCRNEDAQYSFIRESVAEKLSKLADGEKTTTEELLVLLEEGTWNSIQQQEIKRLSSESSSQWALVVQFCRLHNMKLSISYLRECAKANDWLQFIIHSQLHNYHPAEVKSLIQYFSPVIQDHLRLAFENLPSVPTSKMDSDQVCNKCPQELQGSKQEMTDLFEILLQCSEEPDSWHWLLVEAVKQQAPILSVLASCLQGASAISCLCVWIITSVEDNVATEAMGHIQDSTEDHTWNLEDLSVIWRTLLTRQKSKTLIRGFQLFFKDSPLLLVMEMYELCMFFRNYKEAEAKLLEFQKSLETLNTAATKVHPVIPAMWLEDQVCFLLKLMLQQCKTQYELGKLLQLFVEREHLFSDGPDVKKLCILCQILKDTSIAINHTIITSYSIENLQHECRSIWKDCRQMDNSALARRVAELAELPVDNLVIKEITQEMQTLKHIEQWSLKQARIDFWKKCHENFKKNSISSKAASSFFSTQAHVACEHPTGWSSMEERHLLLTLAGHWLAQEDVVPLDKLEELEKQIWLCRITQHTLGRNQEETEPRFSRQISTSGELSFDSLASEFSFSKLAALNTSKYLELNSLPSKETCENRLDWKEQESLNFLIGRLLDDGCVHEASRVCRYFHFYNPDVALVLHCRALASGEASMEDLHPEIHALLQSAELLEEEAPDIPLRRVHSTSSLDSQKFVTVPSSNEVVTNLEVLTSKCLHGKNYCRQVLCLYDLAKELGCSYTDVAAQDGEAMLRKILASQQPDRCKRAQAFISTQGLKPDTVAELVAEEVTRELLTSSQGTGHKQMFNPTEESQTFLQLTTLCQDRTLVGMKLLDKISSVPHGELSCTTELLILAHHCFTLTCHMEGIIRVLQAAHMLTDNHLAPSEEYGLVVRLLTGIGRYNEMTYIFDLLHKKHYFEVLMRKKLDPSGTLKTALLDYIKRCRPGDSEKHNMIALCFSMCREIGENHEAAARIQLKLIESQPWGE

SEQ ID NO: 865437 - protein, 2223 aa, Homo sapiens
MCNEQQQEPAKISSFTSLKVSQDLDVAVIVSSSNSAVALNLNLYFRQHPGHLLCERILEDLPIQGPKGVDEDDPVNSAYNMKLAKFSFQIDRSWKAQLSSLNETIKNSKLEVSCCAPWFQDILHLESPESGNHSTSVQSWAFIPQDIMHGQYNVLQKDHAKTSDPGRSWKIMHISEQEEPIELKCVSVTGFTALFTWEVERMGYTITLWDLETQGMQCFSLGTKCIPVDSSGDQQLCFVLTENGLSLILFGLTQEEFLNRLMIHGSASTVDTLCHLNGWGRCSIPIHALEAGIENRQLDTVNFFLKSKENLFNPSSKSSVSDQFDHLSSHLYLRNVEELIPALDLLCSAIRESYSEPQSKHFSEQLLNLTLSFLNNQIKELFIHTEELDEHLQKGVNILTSYINELRTFMIKFPWKLTDAIDEYDVHENVPKVKESNIWKKLSFEEVIASAILNNKIPEAQTFFRIDSHSAQKLEELIGIGLNLVFDNLKKNNIKEASELLKNMGFDVKGQLLKICFYTTNKNIRDFLVGKGDDYIVYIFQKAWVKNLEENLGRKTLSNFNVQLISNKKKCDNPFIFFSPSSFFNDYFTFVAKEKFVLTYINSNVQNIILEMAYYLMTFFNESLIPSTTLFDNLMTFFAKVLDFLESHCFNYFLFKVEILKEKNYFSEKEKRTIDFVHQVEKLYLGHFQENMQIQSFPRYWIKEQDFFKHKSVLDSFLKYDCKDEFNKQDHRIVLNWALWWDQLTQESILLPRISPEEYKSYSPEALWRYLTARHDWLNIILWIGEFQTQHSYASLQQNKWPLLTVDVINQNTSCNNYMRNEILDKLARNGVFLASELEDFECFLLRLSRIGGVIQDTLPVQNYKTKEGWDFHSQFILYCLEHSLQHLLYVYLDCYKLSPENCPFLEKKELHEAHPWFEFLVQCRQVASNLTDPKLIFQASLANAQILIPTNQASVSSMLLEGHTLLALATTMYSPGGVSQVVQNEENENCLKKVDPQLLKMALTPYPKLKTALFPQCTPPSVLPSDITIYHLIQSLSPFDPSRLFGWQSANTLAIGDAWSHLPHFSSPDLVNKYAIVERLNFAYYLHNGRPSFAFGTFLVQELIKSKTPKQLIQQVGNEAYVIGLSSFHIPSIGAACVCFLELLGLDSLKLRVDMKVANIILSYKCRNEDAQYSFIRESVAEKLSKLADGEKTTTEELLVLLEEGTWNSIQQQEIKRLSSESSSQWALVVQFCRLHNMKLSISYLRECAKANDWLQFIIHSQLHNYHPAEVKSLIQYFSPVIQDHLRLAFENLPSVPTSKMDSDQVCNKCPQELQGSKQEMTDLFEILLQCSEEPDSWHWLLVEAVKQQAPILSVLASCLQGASAISCLCVWIITSVEDNVATEAMGHIQDSTEDHTWNLEDLSVIWRTLLTRQKSKTLIRGFQLFFKDSPLLLVMEMYELCMFFRNYKEAEAKLLEFQKSLETLNTAATKVHPVIPAMWLEDQVCFLLKLMLQQCKTQYELGKLLQLFVEREHLFSDGPDVKKLCILCQILKDTSIAINHTIITSYSIENLQHECRSIWKDCRQMDKFALARRVAELAELPVDNLVIKEITQEMQTLKHIEQWSLKQARIDFWKKCHENFKKNSISSKAASSFFSTQAHVACEHPTGWSSMEERHLLLTLAGHWLAQEDVVPLDKLEELEKQIWLCRITQHTLGRNQEETEPRFSRQISTSGELSFDSLASEFSFSKLAALNTSKYLELNSLPSKETCENRLDWKEQESLNFLIGRLLDDGCVHEASRVCRYFHFYNPDVALVLHCRALASGEASMEDLHPEIHALLQSAELLEEEAPDIPLRRVHSTSSLDSQKFVTVPSSNEVVTNLEVLTSKCLHGKNYCRQVLCLYDLAKELGCSYTDVAAQDGEAMLRKILASQQPDRCKRAQAFISTQGLKPDTVAELVAEEVTRELLTSSQGTGHKQMFNPTEESQTFLQLTTLCQDRTLVGMKLLDKISSVPHGELSCTTELLILAHHCFTLTCHMEGIIRVLQAAHMLTDNHLAPSEEYGLVVRLLTGIGRYNEMTYIFDLLHKKHYFEVLMRKKLDPSGTLKTALLDYIKRCRPGDSEKHNMIALCFSMCREIGENHEAAARIQLKLIESQPWEDSLKDGHQLKQLLLKALTLMLDAAESYAKDSCVRQAQHCQRLTKLITLEGPFWHFLWEDSRNSSTPTEKPQLLALGENYELLSMNLI

SEQ ID NO: 865438 - protein, 1835 aa, Homo sapiens
MCNEQQQEPAKISSFTSLKVSQDLDVAVIVSSSNSAVALNLNLYFRQHPGHLLCERILEDLPIQGPKGVDEDDPVNSAYNMKLAKFSFQIDRSWKAQLSSLNETIKNSKLEVSCCAPWFQDILHLESPESGNHSTSVQSWAFIPQDIMHGQYNVLQKDHAKTSDPGRSWKIMHISEQEEPIELKCVSVTGFTALFTWEVERMGYTITLWDLETQGMQCFSLGTKCIPVDSSGDQQLCFVLTENGLSLILFGLTQEEFLNRLMIHGSASTVDTLCHLNGWGRCSIPIHALEAGIENRQLDTVNFFLKSKENLFNPSSKSSVSDQFDHLSSHLYLRNVEELIPALDLLCSAIRESYSEPQSKHFSEQLLNLTLSFLNNQIKELFIHTEELDEHLQKGVNILTSYINELRTFMIKFPWKLTDAIDEYDVHENVPKVKESNIWKKLSFEEVIASAILNNKIPEAQTFFRIDSHSAQKLEELIGIGLNLVFDNLKKNNIKEASELLKNMGFDVKGQLLKICFYTTNKNIRDFLVEILKEKNYFSEKEKRTIDFVHQVEKLYLGHFQENMQIQSFPRYWIKEQDFFKHKSVLDSFLKYDCKDEFNKQDHRIVLNWALWWDQLTQESILLPRISPEEYKSYSPEALWRYLTARHDWLNIILWIGEFQTQHSYASLQQNKWPLLTVDVINQNTSCNNYMRNEILDKLARNGVFLASELEDFECFLLRLSRIGGVIQDTLPVQNYKTKEGWDFHSQFILYCLEHSLQHLLYVYLDCYKLSPENCPFLEKKELHEAHPWFEFLVQCRQVASNLTDPKLIFQASLANAQILIPTNQASVSSMLLEGHTLLALATTMYSPGGVSQVVQNEENENCLKKVDPQLLKMALTPYPKLKTALFPQCTPPSVLPSDITIYHLIQSLSPFDPSRLFGWQSANTLAIGDAWSHLPHFSSPDLVNKYAIVERLNFAYYLHNGRPSFAFGTFLVQELIKSKTPKQLIQQVGNEAYVIGLSSFHIPSIGAACVCFLELLGLDSLKLRVDMKVANIILSYKCRNEDAQYSFIRESVAEKLSKLADGEKTTTEELLVLLEEGTWNSIQQQEIKRLSSESSSQWALVVQFCRLHNMKLSISYLRECAKANDWLQFIIHSQLHNYHPAEVKSLIQYFSPVIQDHLRLAFENLPSVPTSKMDSDQVCNKCPQELQGSKQEMTDLFEILLQCSEEPDSWHWLLVEAVKQQAPILSVLASCLQGASAISCLCVWIITSVEDNVATEAMGHIQDSTEDHTWNLEDLSVIWRTLLTRQKSKTLIRGFQLFFKDSPLLLVMEMYELCMFFRNYKEAEAKLLEFQKSLETLNTAATKVHPVIPAMWLEDQVCFLLKLMLQQCKTQYELGKLLQLFVEREHLFSDGPDVKKLCILCQILKDTSIAINHTIITSYSIENLQHECRSIWKDCRQMDNSALARRVAELAELPVDNLVIKEITQEMQTLKHIEQWSLKQARIDFWKKCHENFKKNSISSKAASSFFSTQAHVACEHPTGWSSMEERHLLLTLAGHWLAQEDVVPLDKLEELEKQIWLCRITQHTLGRNQEETEPRFSRQISTSGELSFDSLASEFSFSKLAALNTSKYLELNSLPSKETCENRLDWKEQESLNFLIGRLLDDGCVHEASRVCRYFHFYNPDVALVLHCRALASGEASMEDLHPEIHALLQSAELLEEEAPDIPLRRVHSTSSLDSQKFVTVPSSNEVVTNLEVLTSKCLHGKNYCRQVLCLYDLAKELGCSYTDVAAQDGEAMLRKILASQQPDRCKRAQAFISTQGLKPDTVAELVAEEVTRELLTSSQGTGALPPGDSQPL

SEQ ID NO: 865439 - protein, 1713 aa, Homo sapiens
MCNEQQQEPAKISSFTSLKVSQDLDVAVIVSSSNSAVALNLNLYFRQHPGHLLCERILEDLPIQGPKGVDEDDPVNSAYNMKLAKFSFQIDRSWKAQLSSLNETIKNSKLEVSCCAPWFQDILHLESPESGNHSTSVQSWAFIPQDIMHGQYNVLQKDHAKTSDPGRSWKIMHISEQEEPIELKCVSVTGFTALFTWEVERMGYTITLWDLETQGMQCFSLGTKCIPVDSSGDQQLCFVLTENGLSLILFGLTQEEFLNRLMIHGSASTVDTLCHLNGWGRCSIPIHALEAGIENRQLDTVNFFLKSKENLFNPSSKSSVSDQFDHLSSHLYLRNVEELIPALDLLCSAIRESYSEPQSKHFSEQLLNLTLSFLNNQIKELFIHTEELDEHLQKGVNILTSYINELRTFMIKFPWKLTDAIDEYDVHENVPKVKESNIWKKLSFEEVIASAILNNKIPEAQTFFRIDSHSAQKLEELIGIGLNLVFDNLKKNNIKEASELLKNMGFDVKGQLLKICFYTTNKNIRDFLVEILKEKNYFSEKEKRTIDFVHQVEKLYLGHFQENMQIQSFPRYWIKEQDFFKHKSVLDSFLKYDCKDEFNKQDHRIVLNWALWWDQLTQESILLPRISPEEYKSYSPEALWRYLTARHDWLNIILWIGEFQTQHSYASLQQNKWPLLTVDVINQNTSCNNYMRNEILDKLARNGVFLASELEDFECFLLRLSRIGGVIQDTLPVQNYKTKEGWDFHSQFILYCLEHSLQHLLYVYLDCYKLSPENCPFLEKKELHEAHPWFEFLVQCRQVASNLTDPKLIFQASLANAQILIPTNQASVSSMLLEGHTLLALATTMYSPGGVSQVVQNEENENCLKKVDPQLLKMALTPYPKLKTALFPQCTPPSVLPSDITIYHLIQSLSPFDPSRLFGWQSANTLAIGDAWSHLPHFSSPDLVNKYAIVERLNFAYYLHNGRPSFAFGTFLVQELIKSKTPKQLIQQVGNEAYVIGLSSFHIPSIGAACVCFLELLGLDSLKLRVDMKVANIILSYKCRNEDAQYSFIRESVAEKLSKLADGEKTTTEELLVLLEEGTWNSIQQQEIKRLSSESSSQWALVVQFCRLHNMKLSISYLRECAKANDWLQFIIHSQLHNYHPAEVKSLIQYFSPVIQDHLRLAFENLPSVPTSKMDSDQVCNKCPQELQGSKQEMTDLFEILLQCSEEPDSWHWLLVEAVKQQAPILSVLASCLQGASAISCLCVWIITSVEDNVATEAMGHIQDSTEDHTWNLEDLSVIWRTLLTRQKSKTLIRGFQLFFKDSPLLLVMEMYELCMFFRNYKEAEAKLLEFQKSLETLNTAATKVHPVIPAMWLEDQVCFLLKLMLQQCKTQYELGKLLQLFVEREHLFSDGPDVKKLCILCQILKDTSIAINHTIITSYSIENLQHECRSIWKDCRQMDNSALARRVAELAELPVDNLVIKEITQEMQTLKHIEQWSLKQARIDFWKKCHENFKKNSISSKAASSFFSTQAHVACEHPTGWSSMEERHLLLTLAGHWLAQEDVVPLDKLEELEKQIWLCRITQHTLGRNQEETEPRFSRQISTSGELSFDSLASEFSFSKLAALNTSKYLELNSLPSKETCENRLDWKEQESLNFLIGRLLDDGCVHEASRVCRYFHFYNPDVALVLHCRALASGEASMEDLHPEIHALLQSAELLEEEAPDIPLRRVHSSK

SEQ ID NO: 865440 - protein, 535 aa, Homo sapiens
MCNEQQQEPAKISSFTSLKVSQDLDVAVIVSSSNSAVALNLNLYFRQHPGHLLCERILEDLPIQGPKGVDEDDPVNSAYNMKLAKFSFQIDRSWKAQLSSLNETIKNSKLEVSCCAPWFQDILHLESPESGNHSTSVQSWAFIPQDIMHGQYNVLQKDHAKTSDPGRSWKIMHISEQEEPIELKCVSVTGFTALFTWEVERMGYTITLWDLETQGMQCFSLGTKCIPVDSSGDQQLCFVLTENGLSLILFGLTQEEFLNRLMIHGSASTVDTLCHLNGWGRCSIPIHALEAGIENRQLDTVNFFLKSKENLFNPSSKSSVSDQFDHLSSHLYLRNVEELIPALDLLCSAIRESYSEPQSKHFSEQLLNLTLSFLNNQIKELFIHTEELDEHLQKGVNILTSYINELRTFMIKFPWKLTDAIDEYDVHENVPKVKESNIWKKLSFEEVIASAILNNKIPEAQTFFRIDSHSAQKLEELIGIGLNLVFDNLKKNNIKEASELLKNMGFDVKGQLLKICFYTTNKNIRDFLVGKGETT

SEQ ID NO: 865441 - protein, 535 aa, Homo sapiens; identical to SEQ ID NO: 865440

SEQ ID NO: 865442 - protein, 122 aa, Homo sapiens
PEFRGRLLLLNSRPRRLKTQGMQCFSLGTKCIPCRQVLCLYDLAKELGCSYTDVAAQDGEAMLRKILASQQPDRCKRAQAFISTQGLKPDTVAELVAEEVTRELLTSSQGTGALPPGDSQPL

SEQ ID NO: 865443 - protein, 2163 aa, Homo sapiens
MCNEQQQEPAKISSFTSLKVSQDLDVAVIVSSSNSAVALNLNLYFRQHPGHLLCERILEDLPIQGPKGVDEDDPVNSAYNMKLAKFSFQIDRSWKAQLSSLNETIKNSKLEVSCCAPWFQDILHLESPESGNHSTSVQSWAFIPQDIMHGQYNVLQKDHAKTSDPGRSWKIMHISEQEEPIELKCVSVTGFTALFTWEVERMGYTITLWDLETQGMQCFSLGTKCIPVDSSGDQQLCFVLTENGLSLILFGLTQEEFLNRLMIHGSASTVDTLCHLNGWGRCSIPIHALEAGIENRQLDTVNFFLKSKENLFNPSSKSSVSDQFDHLSSHLYLRNVEELIPALDLLCSAIRESYSEPQSKHFSEQLLNLTLSFLNNQIKELFIHTEELDEHLQKGVNILTSYINELRTFMIKFPWKLTDAIDEYDVHENVPKVKESNIWKKLSFEEVIASAILNNKIPEAQTFFRIDSHSAQKLEELIGIGLNLVFDNLKKNNIKEASELLKNMGFDVKGQLLKICFYTTNKNIRDFLVEILKEKNYFSEKEKRTIDFVHQVEKLYLGHFQENMQIQSFPRYWIKEQDFFKHKSVLDSFLKYDCKDEFNKQDHRIVLNWALWWDQLTQESILLPRISPEEYKSYSPEALWRYLTARHDWLNIILWIGEFQTQHSYASLQQNKWPLLTVDVINQNTSCNNYMRNEILDKLARNGVFLASELEDFECFLLRLSRIGGVIQDTLPVQNYKTKEGWDFHSQFILYCLEHSLQLFFMSTLTVTNPKLIFQASLANAQILIPTNQASVSSMLLEGHTLLALATTMYSPGGVSQVVQNEENENCLKKVDPQLLKMALTPYPKLKTALFPQCTPPSVLPSDITIYHLIQSLSPFDPSRLFGWQSANTLAIGDAWSHLPHFSSPDLVNKYAIVERLNFAYYLHNGRPSFAFGTFLVQELIKSKTPKQLIQQVGNEAYVIGLSSFHIPSIGAACVCFLELLGLDSLKLRVDMKVANIILSYKCRNEDAQYSFIRESVAEKLSKLADGEKTTTEELLVLLEEGTWNSIQQQEIKRLSSESSSQWALVVQFCRLHNMKLSISYLRECAKANDWLQFIIHSQLHNYHPAEVKSLIQYFSPVIQDHLRLAFENLPSVPTSKMDSDQVCNKCPQELQGSKQEMTDLFEILLQCSEEPDSWHWLLVEAVKQQAPILSVLASCLQGASAISCLCVWIITSVEDNVATEAMGHIQDSTEDHTWNLEDLSVIWRTLLTRQKSKTLIRGFQLFFKDSPLLLVMEMYELCMFFRNYKEAEAKLLEFQKSLETLNTAATKVHPVIPAMWLEDQVCFLLKLMLQQCKTQYELGKLLQLFVEREHLFSDGPDVKKLCILCQILKDTSIAINHTIITSYSIENLQHECRSIWKDCRQMDNSALARRVAELAELPVDNLVIKEITQEMQTLKHIEQWSLKQARIDFWKKCHENFKKNSISSKAASSFFSTQAHVACEHPTGWSSMEERHLLLTLAGHWLAQEDVVPLDKLEELEKQIWLCRITQHTLGRNQEETEPRFSRQISTSGELSFDSLASEFSFSKLAALNTSKYLELNSLPSKETCENRLDWKEQESLNFLIGRLLDDGCVHEASRVCRYFHFYNPDVALVLHCRALASGEASMEDLHPEIHALLQSAELLEEEAPDIPLRRVHSTSSLDSQKFVTVPSSNEVVTNLEVLTSKCLHGKNYCRQVLCLYDLAKELGCSYTDVAAQDGEAMLRKILASQQPDRCKRAQAFISTQGLKPDTVAELVAEEVTRELLTSSQGTGHKQMFNPTEESQTFLQLTTLCQDRTLVGMKLLDKISSVPHGELSCTTELLILAHHCFTLTCHMEGIIRVLQAAHMLTDNHLAPSEEYGLVVRLLTGIGRYNEMTYIFDLLHKKHYFEVLMRKKLDPSGTLKTALLDYIKRCRPGDSEKHNMIALCFSMCREIGENHEAAARIQLKLIESQPWEDSLKDGHQLKQLLLKALTLMLDAAESYAKDSCVRQAQHCQRLTKLITLQIHFLNTGQNTMLINLGRHKLMDCILALPRFYQASIVAEAYDFVPDWAEILYQQVILKGDFNYLEEFKQQRLLKSSIFEEISKKYKQHQPTDMVMENLKKLLTYCEDVYLYYKLAYEHKFYEIVNVLLKDPQTGCCLKDMLAG

SEQ ID NO: 865444 - protein, 2291 aa, Homo sapiens
MCNEQQQEPAKISSFTSLKVSQDLDVAVIVSSSNSAVALNLNLYFRQHPGHLLCERILEDLPIQGPKGVDEDDPVNSAYNMKLAKFSFQIDRSWKAQLSSLNETIKNSKLEVSCCAPWFQDILHLESPESGNHSTSVQSWAFIPQDIMHGQYNVLQKDHAKTSDPGRSWKIMHISEQEEPIELKCVSVTGFTALFTWEVERMGYTITLWDLETQGMQCFSLGTKCIPVDSSGDQQLCFVLTENGLSLILFGLTQEEFLNRLMIHGSASTVDTLCHLNGWGRCSIPIHALEAGIENRQLDTVNFFLKSKENLFNPSSKSSVSDQFDHLSSHLYLRNVEELIPALDLLCSAIRESYSEPQSKHFSEQLLNLTLSFLNNQIKELFIHTEELDEHLQKGVNILTSYINELRTFMIKFPWKLTDAIDEYDVHENVPKVKESNIWKKLSFEEVIASAILNNKIPEAQTFFRIDSHSAQKLEELIGIGLNLVFDNLKKNNIKEASELLKNMGFDVKGQLLKICFYTTNKNIRDFLVGKGDDYIVYIFQKAWVKNLEENLGRKTLSNFNVQLISNKKKCDNPFIFFSPSSFFNDYFTFVAKEKFVLTYINSNVQNIILEMAYYLMTFFNESLIPSTTLFDNLMTFFAKVLDFLESHCFNYFLFKVEILKEKNYFSEKEKRTIDFVHQVEKLYLGHFQENMQIQSFPRYWIKEQDFFKHKSVLDSFLKYDCKDEFNKQDHRIVLNWALWWDQLTQESILLPRISPEEYKSYSPEALWRYLTARHDWLNIILWIGEFQTQHSYASLQQNKWPLLTVDVINQNTSCNNYMRNEILDKLARNGVFLASELEDFECFLLRLSRIGGVIQDTLPVQNYKTKEGWDFHSQFILYCLEHSLQLFFMSTLTVTNPKLIFQASLANAQILIPTNQASVSSMLLEGHTLLALATTMYSPGGVSQVVQNEENENCLKKVDPQLLKMALTPYPKLKTALFPQCTPPSVLPSDITIYHLIQSLSPFDPSRLFGWQSANTLAIGDAWSHLPHFSSPDLVNKYAIVERLNFAYYLHNGRPSFAFGTFLVQELIKSKTPKQLIQQVGNEAYVIGLSSFHIPSIGAACVCFLELLGLDSLKLRVDMKVANIILSYKCRNEDAQYSFIRESVAEKLSKLADGEKTTTEELLVLLEEGTWNSIQQQEIKRLSSESSSQWALVVQFCRLHNMKLSISYLRECAKANDWLQFIIHSQLHNYHPAEVKSLIQYFSPVIQDHLRLAFENLPSVPTSKMDSDQVCNKCPQELQGSKQEMTDLFEILLQCSEEPDSWHWLLVEAVKQQAPILSVLASCLQGASAISCLCVWIITSVEDNVATEAMGHIQDSTEDHTWNLEDLSVIWRTLLTRQKSKTLIRGFQLFFKDSPLLLVMEMYELCMFFRNYKEAEAKLLEFQKSLETLNTAATKVHPVIPAMWLEDQVCFLLKLMLQQCKTQYELGKLLQLFVEREHLFSDGPDVKKLCILCQILKDTSIAINHTIITSYSIENLQHECRSIWKDCRQMDKFALARRVAELAELPVDNLVIKEITQEMQTLKHIEQWSLKQARIDFWKKCHENFKKNSISSKAASSFFSTQAHVACEHPTGWSSMEERHLLLTLAGHWLAQEDVVPLDKLEELEKQIWLCRITQHTLGRNQEETEPRFSRQISTSGELSFDSLASEFSFSKLAALNTSKYLELNSLPSKETCENRLDWKEQESLNFLIGRLLDDGCVHEASRVCRYFHFYNPDVALVLHCRALASGEASMEDLHPEIHALLQSAELLEEEAPDIPLRRVHSTSSLDSQKFVTVPSSNEVVTNLEVLTSKCLHGKNYCRQVLCLYDLAKELGCSYTDVAAQDGEAMLRKILASQQPDRCKRAQAFISTQGLKPDTVAELVAEEVTRELLTSSQGTGHKQMFNPTEESQTFLQLTTLCQDRTLVGMKLLDKISSVPHGELSCTTELLILAHHCFTLTCHMEGIIRVLQAAHMLTDNHLAPSEEYGLVVRLLTGIGRYNEMTYIFDLLHKKHYFEVLMRKKLDPSGTLKTALLDYIKRCRPGDSEKHNMIALCFSMCREIGENHEAAARIQLKLIESQPWEDSLKDGHQLKQLLLKALTLMLDAAESYAKDSCVRQAQHCQRLTKLITLQIHFLNTGQNTMLINLGRHKLMDCILALPRFYQASIVAEAYDFVPDWAEILYQQVILKGDFNYLEEFKQQRLLKSSIFEEISKKYKQHQPTDMVMENLKKLLTYCEDVYLYYKLAYEHKFYEIVNVLLKDPQTGCCLKDMLAG

SEQ ID NO: 865445 - protein, 2009 aa, Homo sapiens; identical to SEQ ID NO: 865436

SEQ ID NO: 865446 - protein, 2327 aa, Homo sapiens; identical to SEQ ID NO: 865429

SEQ ID NO: 865447 - protein, 2268 aa, Homo sapiens
MCNEQQQEPAKISSFTSLKVSQDLDVAVIVSSSNSAVALNLNLYFRQHPGHLLCERILEDLPIQGPKGVDEDDPVNSAYNMKLAKFSFQIDRSWKAQLSSLNETIKNSKLEVSCCAPWFQDILHLESPESGNHSTSVQSWAFIPQDIMHGQYNVLQKDHAKTSDPGRSWKIMHISEQEEPIELKCVSVTGFTALFTWEVERMGYTITLWDLETQGMQCFSLGTKCIPVDSSGDQQLCFVLTENGLSLILFGLTQEEFLNRLMIHGSASTVDTLCHLNGWGRCSIPIHALEAGIENRQLDTVNFFLKSKENLFNPSSKSSVSDQFDHLSSHLYLRNVEELIPALDLLCSAIRESYSEPQSKHFSEQLLNLTLSFLNNQIKELFIHTEELDEHLQKGVNILTSYINELRTFMIKFPWKLTDAIDEYDVHENVPKVKESNIWKKLSFEEVIASAILNNKIPEAQTFFRIDSHSAQKLEELIGIGLNLVFDNLKKNNIKEASELLKNMGFDVKGQLLKICFYTTNKNIRDFLVGKGDDYIVYIFQKAWVKNLEENLGRKTLSNFNVQLISNKKKCDNPFIFFSPSSFFNDYFTFVAKEKFVLTYINSNVQNIILEMAYYLMTFFNESLIPSTTLFDNLMTFFAKVLDFLESHCFNYFLFKVEILKEKNYFSEKEKRTIDFVHQVEKLYLGHFQENMQIQSFPRYWIKEQDFFKHKSVLDSFLKYDCKDEFNKQDHRIVLNWALWWDQLTQESILLPRISPEEYKSYSPEALWRYLTARHDWLNIILWIGEFQTQHSYASLQQNKWPLLTVDVINQNTSCNNYMRNEILDKLARNGVFLASELEDFECFLLRLSRIGGVIQDTLPVQNYKTKEGWDFHSQFILYCLEHSLQHLLYVYLDCYKLSPENCPFLEKKELHEAHPWFEFLVQCRQVASNLTDPKLIFQASLANAQILIPTNQASVSSMLLEGHTLLALATTMYSPGGVSQVVQNEENENCLKKVDPQLLKMALTPYPKLKTALFPQCTPPSVLPSDITIYHLIQSLSPFDPSRLFGWQSANTLAIGDAWSHLPHFSSPDLVNKYAIVERLNFAYYLHNGRPSFAFGTFLVQELIKSKTPKQLIQQVGNEAYVIGLSSFHIPSIGAACVCFLELLGLDSLKLRVDMKVANIILSYKCRNEDAQYSFIRESVAEKLSKLADGEKTTTEELLVLLEEGTWNSIQQQEIKRLSSESSSQWALVVQFCRLHNMKLSISYLRECAKANDWLQFIIHSQLHNYHPAEVKSLIQYFSPVIQDHLRLAFENLPSVPTSKMDSDQVCNKCPQELQGSKQEMTDLFEILLQCSEEPDSWHWLLVEAVKQQAPILSVLASCLQGASAISCLCVWIITSVEDNVATEAMGHIQDSTEDHTWNLEDLSVIWRTLLTRQKSKTLIRGFQLFFKDSPLLLVMEMYELCMFFRNYKEAEAKLLEFQKSLETLNTAATKVHPVIPAMWLEDQVCFLLKLMLQQCKTQYELGKLLQLFVEREHLFSDGPDVKKLCILCQILKDTSIAINHTIITSYSIENLQHECRSIWKDCRQMDKFALARRVAELAELPVDNLVIKEITQEMQTLKHIEQWSLKQARIDFWKKCHENFKKNSISSKAASSFFSTQAHVACEHPTGWSSMEERHLLLTLAGHWLAQEDVVPLDKLEELEKQIWLCRITQHTLGRNQEETEPRFSRQISTSGELSFDSLASEFSFSKLAALNTSKYLELNSLPSKETCENRLDWKEQESLNFLIGRLLDDGCVHEASRVCRYFHFYNPDVALVLHCRALASGEASMEDLHPEIHALLQSAELLEEEAPDIPLRRVHSTSSLDSQKFVTVPSSNEVVTNLEVLTSKCLHGKNYCRQVLCLYDLAKELGCSYTDVAAQDGEAMLRKILASQQPDRCKRAQAFISTQGLKPDTVAELVAEEVTRELLTSSQGTGHKQMFNPTEESQTFLQLTTLCQDRTLVGMKLLDKISSVPHGELSCTTELLILAHHCFTLTCHMEGIIRVLQAAHMLTDNHLAPSEEYGLVVRLLTGIGRYNEMTYIFDLLHKKHYFEVLMRKKLDPSGTLKTALLDYIKRCRPGDSEKHNMIALCFSMCREIGENHEAAARIQLKLIESQPWEDSLKDGHQLKQLLLKALTLMLDAAESYAKDSCVRQAQHCQRLTKLITLQIHFLNTGQNTMLINLGRHKLMDCILALPRFYQASIVAEAYDFVPDWAEILYQQVILKGDFNYLEEFKQQRLLKSSIFEEISKK

SEQ ID NO: 865448 - protein, 2137 aa, Homo sapiens; identical to SEQ ID NO: 865434

SEQ ID NO: 865449 - protein, 1853 aa, Homo sapiens
MCNEQQQEPAKISSFTSLKVSQDLDVAVIVSSSNSAVALNLNLYFRQHPGHLLCERILEDLPIQGPKGVDEDDPVNSAYNMKLAKFSFQIDRSWKAQLSSLNETIKNSKLEVSCCAPWFQDILHLESPESGNHSTSVQSWAFIPQDIMHGQYNVLQKDHAKTSDPGRSWKIMHISEQEEPIELKCVSVTGFTALFTWEVERMGYTITLWDLETQGMQCFSLGTKCIPVDSSGDQQLCFVLTENGLSLILFGLTQEEFLNRLMIHGSASTVDTLCHLNGWGRCSIPIHALEAGIENRQLDTVNFFLKSKENLFNPSSKSSVSDQFDHLSSHLYLRNVEELIPALDLLCSAIRESYSEPQSKHFSEQLLNLTLSFLNNQIKELFIHTEELDEHLQKGVNILTSYINELRTFMIKFPWKLTDAIDEYDVHENVPKVKESNIWKKLSFEEVIASAILNNKIPEAQTFFRIDSHSAQKLEELIGIGLNLVFDNLKKNNIKEASELLKNMGFDVKGQLLKICFYTTNKNIRDFLVGKGDDYIVYIFQKAWVKNLEENLGRKTLSNFNVQLISNKKKCDNPFIFFSPSSFFNDYFTFVAKEKFVLTYINSNVQNIILEMAYYLMTFFNESLIPSTTLFDNLMTFFAKVLDFLESHCFNYFLFKVEILKEKNYFSEKEKRTIDFVHQVEKLYLGHFQENMQIQSFPRYWIKEQDFFKHKSVLDSFLKYDCKDEFNKQDHRIVLNWALWWDQLTQESILLPRISPEEYKSYSPEALWRYLTARHDWLNIILWIGEFQTQHSYASLQQNKWPLLTVDVINQNTSCNNYMRNEILDKLARNGVFLASELEDFECFLLRLSRIGGVIQDTLPVQNYKTKEGWDFHSQFILYCLEHSLQHLLYVYLDCYKLSPENCPFLEKKELHEAHPWFEFLVQCRQVASNLTDPKLIFQASLANAQILIPTNQASVSSMLLEGHTLLALATTMYSPGGVSQVVQNEENENCLKKVDPQLLKMALTPYPKLKTALFPQCTPPSVLPSDITIYHLIQSLSPFDPSRLFGWQSANTLAIGDAWSHLPHFSSPDLVNKYAIVERLNFAYYLHNGRPSFAFGTFLVQELIKSKTPKQLIQQVGNEAYVIGLSSFHIPSIGAACVCFLELLGLDSLKLRVDMKVANIILSYKCRNEDAQYSFIRESVAEKLSKLADGEKTTTEELLVLLEEGTWNSIQQQEIKRLSSESSSQWALVVQFCRLHNMKLSISYLRECAKANDWLQFIIHSQLHNYHPAEVKSLIQYFSPVIQDHLRLAFENLPSVPTSKMDSDQVCNKCPQELQGSKQEMTDLFEILLQCSEEPDSWHWLLVEAVKQQAPILSVLASCLQGASAISCLCVWIITSVEDNVATEAMGHIQDSTEDHTWNLEDLSVIWRTLLTRQKSKTLIRGFQLFFKDSPLLLVMEMYELCMFFRNYKEAEAKLLEFQKSLETLNTAATKVHPVIPAMWLEDQVCFLLKLMLQQCKTQYELGKLLQLFVEREHLFSDGPDVKKLCILCQILKDTSIAINHTIITSYSIENLQHECRSIWKDCRQMDKFALARRVAELAELPVDNLVIKEITQEMQTLKHIEQWSLKQARIDFWKKCHENFKKNSISSKAASSFFSTQAHVACEHPTGWSSMEERHLLLTLAGHWLAQEDVVPLDKLEELEKQIWLCRITQHTLGRNQEETEPRFSRQISTSGELSFDSLASEFSFSKLAALNTSKYLELNSLPSKETCENRLDWKEQESLNFLIGRLLDDGCVHEASRVCRYFHFYNPDVALVLHCRALASGEASMEDLHPEIHALLQSAELLEWHAAQMSQRRAPSRKKRNSVGHDSKRT

SEQ ID NO: 865450 - protein, 535 aa, Homo sapiens; identical to SEQ ID NO: 865440

SEQ ID NO: 865451 - protein, 346 aa, Homo sapiens
MCNEQQQEPAKISSFTSLKVSQDLDVAVIVSSSNSAVALNLNLYFRQHPGHLLCERILEDLPIQGPKGVDEDDPVNSAYNMKLAKFSFQIDRSWKAQLSSLNETIKNSKLEVSCCAPWFQDILHLESPESGNHSTSVQSWAFIPQDIMHGQYNVLQKDHAKTSDPGRSWKIMHISEQEEPIELKCVSVTGFTALFTWEVERMGYTITLWDLETQGMQCFSLGTKCIPVDSSGDQQLCFVLTENGLSLILFGLTQEEFLNRLMIHGSASTVDTLCHLNGWGRCSIPIHALEAGIENRQLDTVNFFLKSKENLFNPSSKSSVSDQFDHLSSHLYLRSKWNKDFYICIY

SEQ ID NO: 865452 - protein, 595 aa, Homo sapiens
MATKARVMYDFAAEPGNNELTVNEGEIITITNPDVGGGWLEGRNIKGERGLVPTDYVEILPSDGKDQFSCGNSVADQAFLDSLSASTAQASSSAASNNHQVGSGNDPWSAWSASKSGNWESSEGWGAQPEGAGAQRNTNTPNNWDTAFGHPQAYQGPATGDDDDWDEDWDGPKSSSYFKDSESADAGGAQRGNSRASSSSMKIPLNKFPGFAKPGTEQYLLAKQLAKPKEKIPIIVGDYGPMWVYPTSTFDCVVADPRKGSKMYGLKSYIEYQLTPTNTNRSVNHRYKHFDWLYERLLVKFGSAIPIPSLPDKQVTGRFEEEFIKMRMERLQAWMTRMCRHPVISESEVFQQFLNFRDEKEWKTGKRKAERDELAGVMIFSTMEPEAPDLDLVEIEQKCEAVGKFTKAMDDGVKELLTVGQEHWKRCTGPLPKEYQKIGKALQSLATVFSSSGYQGETDLNDAITEAGKTYEEIASLVAEQPKKDLHFLMECNHEYKGFLGCFPDIIGTHKGAIEKVKESDKLVATSKITLQDKQNMVKRVSIMSYALQAEMNHFHSNRIYDYNSVIRLYLEQQVQFYETIAEKLRQALSRFPVM

SEQ ID NO: 865453 - protein, 112 aa, Homo sapiens
MATKARVMYDFAAEPGNNELTVNEGEIITITNPDVGGGWLEGRNIKGERGLVPTDYVEILPSDGKDQFSCGNSVADQAFLDSLSASTAQASSSAASNNHQVRLTSSFWMWLA

SEQ ID NO: 865454 - protein, 595 aa, Homo sapiens; identical to SEQ ID NO: 865452

SEQ ID NO: 865455 - protein, 618 aa, Homo sapiens
ACHHVRHDFAPSSPSAMIVRPPQPRGTARVMYDFAAEPGNNELTVNEGEIITITNPDVGGGWLEGRNIKGERGLVPTDYVEILPSDGKDQFSCGNSVADQAFLDSLSASTAQASSSAASNNHQVGSGNDPWSAWSASKSGNWESSEGWGAQPEGAGAQRNTNTPNNWDTAFGHPQAYQGPATGDDDDWDEDWDGPKSSSYFKDSESADAGGAQRGNSRASSSSMKIPLNKFPGFAKPGTEQYLLAKQLAKPKEKIPIIVGDYGPMWVYPTSTFDCVVADPRKGSKMYGLKSYIEYQLTPTNTNRSVNHRYKHFDWLYERLLVKFGSAIPIPSLPDKQVTGRFEEEFIKMRMERLQAWMTRMCRHPVISESEVFQQFLNFRDEKEWKTGKRKAERDELAGVMIFSTMEPEAPDLDLVEIEQKCEAVGKFTKAMDDGVKELLTVGQEHWKRCTGPLPKEYQKIGKALQSLATVFSSSGYQGETDLNDAITEAGKTYEEIASLVAEQPKKDLHFLMECNHEYKGFLGCFPDIIGTHKGAIEKVKESDKLVATSKITLQDKQNMVKRVSIMSYALQAEMNHFHSNRIYDYNSVIRLYLEQQVQFYETIAEKLRQALSRFPVM

SEQ ID NO: 865456 - protein, 595 aa, Homo sapiens; identical to SEQ ID NO: 865452

SEQ ID NO: 865457 - protein, 370 aa, Homo sapiens
MATKARVMYDFAAEPGNNELTVNEGEIITITNPDVGGGWLEGRNIKGERGLVPTDYVEILPSDGKDQFSCGNSVADQAFLDSLSASTAQASSSAASNNHQVGSGNDPWSAWSASKSGNWESSEGWGAQPEGAGAQRNTNTPNNWDTAFGHPQAYQGPATGDDDDWDEDWDGPKSSSYFKDSESADAGGAQRGNSRASSSSMKIPLNKFPGFAKPGTEQYLLAKQLAKPKEKIPIIVGDYGPMWVYPTSTFDCVVADPRKGSKMYGLKSYIEYQLTPTNTNRSVNHRYKHFDWLYERLLVKFGSAIPIPSLPDKQVTGRFEEEFIKMRMERLQAWMTRMCRHPVISESEVFQQFLNFRDEKDIFHHGTRGT

SEQ ID NO: 865458 - protein, 595 aa, Homo sapiens; identical to SEQ ID NO: 865452

SEQ ID NO: 865459 - protein, 395 aa, Homo sapiens [sequence omitted]

SEQ ID NO: 865460 - protein, 207 aa, Homo sapiens
MATKARVMYDFAAEPGNNELTVNEGEIITITNPDVGGGWLEGRNIKGERGLVPTDYVEILPSDGKDQFSCGNSVADQAFLDSLSASTAQASSSAASNNHQVGSGNDPWSAWSASKSGNWESSEGWGAQPEGAGAQRNTNTPNNWDTAFGHPQAYQGPATGDDDDWDEDWDGPKSSSYFKDSESADAGGAQRGNSRASSSSMKIPLNK

SEQ ID NO: 865461 - protein, 595 aa, Homo sapiens; identical to SEQ ID NO: 865452

SEQ ID NO: 865462 - protein, 595 aa, Homo sapiens; identical to SEQ ID NO: 865452

SEQ ID NO: 865463 - protein, 419 aa, Homo sapiens
MNSDSESADAGGAQRGNSRASSSSMKIPLNKFPGFAKPGTEQYLLAKQLAKPKEKIPIIVGDYGPMWVYPTSTFDCVVADPRKGSKMYGLKSYIEYQLTPTNTNRSVNHRYKHFDWLYERLLVKFGSAIPIPSLPDKQVTGRFEEEFIKMRMERLQAWMTRMCRHPVISESEVFQQFLNFRDEKEWKTGKRKAERDELAGVMIFSTMEPEAPDLDLVEIEQKCEAVGKFTKAMDDGVKELLTVGQEHWKRCTGPLPKEYQKIGKALQSLATVFSSSGYQGETDLNDAITEAGKTYEEIASLVAEQPKKDLHFLMECNHEYKGFLGCFPDIIGTHKGAIEKVKESDKLVATSKITLQDKQNMVKRVSIMSYALQAEMNHFHSNRIYDYNSVIRLYLEQQVQFYETIAEKLRQALSRFPVM

SEQ ID NO: 865464 - protein, 543 aa, Homo sapiens
KLLGGLKQENDLNWEAATAVSRDRATVLQPGLSETPQKKKNICQLTFQVGSGNDPWSAWSASKSGNWESSEGWGAQPEGAGAQRNTNTPNNWDTAFGHPQAYQGPATGDDDDWDEDWDGPKSSSYFKDSESADAGGAQRGNSRASSSSMKIPLNKFPGFAKPGTEQYLLAKQLAKPKEKIPIIVGDYGPMWVYPTSTFDCVVADPRKGSKMYGLKSYIEYQLTPTNTNRSVNHRYKHFDWLYERLLVKFGSAIPIPSLPDKQVTGRFEEEFIKMRMERLQAWMTRMCRHPVISESEVFQQFLNFRDEKEWKTGKRKAERDELAGVMIFSTMEPEAPDLDLVEIEQKCEAVGKFTKAMDDGVKELLTVGQEHWKRCTGPLPKEYQKIGKALQSLATVFSSSGYQGETDLNDAITEAGKTYEEIASLVAEQPKKDLHFLMECNHEYKGFLGCFPDIIGTHKGAIEKVKESDKLVATSKITLQDKQNMVKRVSIMSYALQAEMNHFHSNRIYDYNSVIRLYLEQQVQFYETIAEKLRQALSRFPVM

SEQ ID NO: 865465 - protein, 187 aa, Homo sapiens [sequence omitted]

SEQ ID NO: 865466 - protein, 711 aa, Homo sapiens
RRRPGAVFTRGAWWGGLLRQPRPNGHPEAVLSWRSGSSMSRTLASAVPLSSPDYYERLGQLQHGLRDSEKKRLDLEKKLYEYNQSDTCRVKLKYVKLKNYLKEICESEKKAHTRNQEYLKRFERVQAHVVHFTTNTEKLQKLKLEYETQIKKMLCSKDSLGLKEELTDEDREKVAVQEGINSGTAMSRGLYQPATIFMGRQMSAILSMRDFSTEHKSPQPTKNFSIPDPHSHRQTAQSSNVTDSCVVQTSNDTQCLNKSDNIDGKASLQIGEKMPVTASVLSEEEQTHCLEIGSNTRHGKSNLSEGKKSAELNSPLRERLSPENRTTDLKCDSSSGSEGEILTREHIEVEEKRASPPVSPIPVSEYCESENKWSQEKHSPWEGVSDHLAHREPKSQKPFRKMQEEEEESWSTSSDLTISISEDDLILESPEPQPNPGGKMEGEDGIEALKLIHAEQERVALSTEKNCILQTLSSPDSEKESSTNAPTREPGQTPDSDVPRAQVGQHVATLKEHDNSVKEEATALLRKALTEECGRRSAIHSSESSCSLPSILNDNSGIKEAKPAVWLNSVPTREQEVSSGCGDKSKKENVAADIPITETEAYQLLKKATLQDNTNQTENRFQKTDASVSHLSGLNIGSGAFETKTANKIASEASFSSSEGSPLSRHENKKKPVINLKSNALWDESDDSNSEIEAALRPRNHNTDDSDDFYD

SEQ ID NO: 865467 - protein, 105 aa, Homo sapiens
CLRAFSGCRSVLSPHKAAQSTRELMPWVESNPQPTEASWWISNPTPLLFTGTIWGEFCSLSGGPSRLSLACPLTARHPLVIIPFIGFLSSLCHCPHGSWDHLSSK

SEQ ID NO: 865468 - protein, 570 aa, Homo sapiens
MQLEYETQIKKMLCSKDSLGLKEELTDEDREKVAVQEGINSGTAMSRGLYQPATIFMGRQMSAILSMRDFSTEHKSPQPTKNFSIPDPHSHRQTAQSSNVTDSCVVQTSNDTQCLNKSDNIDGKASLQIGEKMPVTASVLSEEEQTHCLEIGSNTRHGKSNLSEGKKSAELNSPLRERLSPENRTTDLKCDSSSGSEGEILTREHIEVEEKRASPPVSPIPVSEYCESENKWSQEKHSPWEGVSDHLAHREPKSQKPFRKMQEEEEESWSTSSDLTISISEDDLILESPEPQPNPGGKMEGEDGIEALKLIHAEQERVALSTEKNCILQTLSSPDSEKESSTNAPTREPGQTPDSDVPRAQVGQHVATLKEHDNSVKEEATALLRKALTEECGRRSAIHSSESSCSLPSILNDNSGIKEAKPAVWLNSVPTREQEVSSGCGDKSKKENVAADIPITETEAYQLLKKATLQDNTNQTENRFQKTDASVSHLSGLNIGSGAFETKTANKIASEASFSSSEGSPLSRHENKKKPVINLKSNALWDESDDSNSEIEAALRPRNHNTDDSDDFYD

SEQ ID NO: 865469 - protein, 646 aa, Homo sapiens
GHLSEQYVPDSCVVQTSNDTQGLNKSDNIDGKASLQIGEKTPVTASVLSEEEQTHCLEIGSNTRHGKSNLSEGKKSAALEYETQIKKMLCSKDSLGLKEELTDEDREKVAVQEGINSGTAMSRGLYQPATIFMGRQMSAILSMRDFSTEHKSPQPTKNFSIPDPHSHRQTAQSSNVTDSCVVQTSNDTQCLNKSDNIDGKASLQIGEKMPVTASVLSEEEQTHCLEIGSNTRHGKSNLSEGKKSAELNSPLRERLSPENRTTDLKCDSSSGSEGEILTREHIEVEEKRASPPVSPIPVSEYCESENKWSQEKHSPWEGVSDHLAHREPKSQKPFRKMQEEEEESWSTSSDLTISISEDDLILESPEPQPNPGGKMEGEDGIEALKLIHAEQERVALSTEKNCILQTLSSPDSEKESSTNAPTREPGQTPDSDVPRAQVGQHVATLKEHDNSVKEEATALLRKALTEECGRRSAIHSSESSCSLPSILNDNSGIKEAKPAVWLNSVPTREQEVSSGCGDKSKKENVAADIPITETEAYQLLKKATLQDNTNQTENRFQKTDASVSHLSGLNIGSGAFETKTANKIASEASFSSSEGSPLSRHENKKKPVINLKSNALWDESDDSNSEIEAALRPRNHNTDDSDDFYD

SEQ ID NO: 865470 - protein, 693 aa, Homo sapiens
RRRPGAVFTRGAWWGGLLRQPRPNGHPEAVLSWRSGSSMSRTLASAVPLSSPDYYERLGQLQHGLRDSEKKRLDLEKKLYEYNQSDTCRVKLKYVKLKNYLKEICESEKKAHTRNQEYLKRFERVQAHVVHFTTNTEKLQKLKLEYETQIKKMLCSKDSLGLKEELTDEDREKVAVQEGINSGTAMSRGLYQPATIFMGRQMSAILSMRDFSTEHKSPQPTKNFSIPDPHSHRQTAQSSNVTDSCVVQTSNDTQCLNKSDNIDGKASLQIGEKMPVTASVLSEEEQTHCLEIGSNTRHGKSNLSEGKKSAELNSPLRERLSPENRTTDLKCDSSSGSEGEILTREHIEVEEKRASPPVSPIPVSEYCESENKWSQEKHSPWEGVSDHLAHREPKSQKPFRKMQEEEEESWSTSSDLTISISEDDLILESPEPQPNPGGKMEGEDGIEALKLIHAEQERVALSTEKNCILQTLSSPDSEKESSTNAPTREPGQTPDSDVPRAQATALLRKALTEECGRRSAIHSSESSCSLPSILNDNSGIKEAKPAVWLNSVPTREQEVSSGCGDKSKKENVAADIPITETEAYQLLKKATLQDNTNQTENRFQKTDASVSHLSGLNIGSGAFETKTANKIASEASFSSSEGSPLSRHENKKKPVINLKSNALWDESDDSNSEIEAALRPRNHNTDDSDDFYD

SEQ ID NO: 865471 - protein, 711 aa, Homo sapiens; identical to SEQ ID NO: 865466

SEQ ID NO: 865472 - protein, 665 aa, Homo sapiens
RRRPGAVFTRGAWWGGLLRQPRPNGHPEAVLSWRSGSSMSRTLASAVPLSSPDYYERLGQLQHGLRDSEKKRLDLEKKLYEYNQSDTCRVKLKYVKLKNYLKEICESEKKAHTRNQEYLKRFERVQAHVVHFTTNTEKLQKLKLEYETQIKKMLCSKDSLGLKEELTDEDREKVAVQEGINSGTAMSRGLYQPATIFMGRQMSAILSMRDFSTEHKSPQPTKNFSIPDPHSHRQTAQSSNVTDSCVVQTSNDTQCLNKSDNIDGKASLQIGEKMPVTASVLSEEEQTHCLEIGSNTRHGKSNLSEGKKSAELNSPLRERLSPENRTTDLKCDSSSGSEGEILTREHIEVEEKRASPPVSPIPVSEYCESENKWSQEKHSPWEGVSDHLAHREPKSQKPFRKMQEEEEESWSTSSDLTISISEDDLILESPEPQPNPGGKMEGEDGIEALKLIHAEQERVALSTEKNCILQTLSSPDSEKESSTNAPTREPGQTPDSDVPRAQVGQHVATLKEHDNSVKEEATALLRKALTEECGRRSAIHSSESSCSLPSILNDNSGIKEAKPAVWLNSVPTREQEVSSGCGDKSKKENVAADIPITETEAYQLLKKATLQDNTNQTENRFQKTDASVSHLSGLNIGSGAFETKTANKIASEASFSSSEGSPLSR

SEQ ID NO: 865473 - protein, 693 aa, Homo sapiens
RRRPGAVFTRGAWWGGLLRQPRPNGHPEAVLSWRSGSSMSRTLASAVPLSSPDYYERLGQLQHGLRDSEKKRLDLEKKLYEYNQSDTCRVKLKYVKLKNYLKEICESEKKAHTRNQEYLKRFERVQAHVVHFTTNTEKLQKLKLEYETQIKKMLCSKDSLGLKEELTDEDREKVAVQEGINSGTAMSRGLYQPATIFMGRQMSAILSMRDFSTEHKSPQPTKNFSIPDPHSHRQTAQSSNVTDSCVVQTSNDTQCLNKSDNIDGKASLQIGEKMPVTASVLSEEEQTHCLEIGSNTRHGKSNLSEGKKSAELNSPLRERLSPENRTTDLKCDSSSGSEGEILTREHIEVEEKRASPPVSPIPVSEYCESENKWSQEKHSPWEGVSDHLAHREPKSQKPFRKMQEEEEESWSTSSDLTISISEDDLILESPEPQPNPGGKMEGEDGIEALKLIHAEQERVALSTEKNCILQTLSSPDSEKESSTNAPTREPGQTPDSDVPRAQVGQHVATLKEHDNSVKEEATALLRKALTEECGRRSAIHSSESSCSLPSILNDNSGIKEAKPAVWLNSVPTREQEVSSGCGDKSKKENVAADIPITETEAYQLLKKATLQDNTNQTENRFQKTDASVSHLSGLNIGSGAFETKTANKIASEASFSSSEGSPLSRHENKKKPVINLKSNGERDNRTLDFLFLF

SEQ ID NO: 865474 - protein, 523 aa, Homo sapiens
RRRPGAVFTRGAWWGGLLRQPRPNGHPEAVLSWRSGSSMSRTLASAVPLSSPDYYERLGQLQHGLRDSEKKRLDLEKKLYEYNQSDTCRVKLKYVKLKNYLKEICESEKKAHTRNQEYLKRFERVQAHVVHFTTNTEKLQKLKLEYETQIKKMLCSKDSLGLKEELTDEDREKVAVQEGINSGTAMSRGLYQPATIFMGRQMSAILSMRDFSTEHKSPQPTKNFSIPDPHSHRQTAQSSNVTDSCVVQTSNDTQCLNKSDNIDGKASLQIGEKMPVTASVLSEEEQTHCLEIGSNTRHGKSNLSEGKKSAELNSPLRERLSPENRTTDLKCDSSSGSEGEILTREHIEVEEKRASPPVSPIPVSEYCESENKWSQEKHSPWEGVSDHLAHREPKSQKPFRKMQEEEEESWSTSSDLTISISEDDLILESPEPQPNPGGKMEGEDGIEALKLIHAEQERVALSTEKNCILQTLSSPDSEKESSTNAPTREPGQTPDSDVPRAQVGQHVATLKEHDNSVKEEVGS

SEQ ID NO: 865475 - protein, 459 aa, Homo sapiens
RTRGLFSVFICVVQTSNDTQCLNKSDNIDGKASLQIGEKMPVTASVLSEEEQTHCLEIGSNTRHGKSNLSEGKKSAELNSPLRERLSPENRTTDLKCDSSSGSEGEILTREHIEVEEKRASPPVSPIPVSEYCESENKWSQEKHSPWEGVSDHLAHREPKSQKPFRKMQEEEEESWSTSSDLTISISEDDLILESPEPQPNPGGKMEGEDGIEALKLIHAEQERVALSTEKNCILQTLSSPDSEKESSTNAPTREPGQTPDSDVPRAQATALLRKALTEECGRRSAIHSSESSCSLPSILNDNSGIKEAKPAVWLNSVPTREQEVSSGCGDKSKKENVAADIPITETEAYQLLKKATLQDNTNQTENRFQKTDASVSHLSGLNIGSGAFETKTANKIASEASFSSSEGSPLSRHENKKKPVINLKSNALWDESDDSNSEIEAALRPRNHNTDDSDDFYD

SEQ ID NO: 865476 - protein, 726 aa, Homo sapiens
RRRPGAVFTRGAWWGGLLRQPRPNGHPEAVLSWRSGSSMSRTLASAVPLSSPDYYERLGQLQHGLRDSEKKRLDLEKKLYEYNQSDTCRVKLKYVKLKNYLKEICESEKKAHTRNQEYLKRFERVQAHVVHFTTNTEKLQKLKVGFSLKQSLENRDLTLEYETQIKKMLCSKDSLGLKEELTDEDREKVAVQEGINSGTAMSRGLYQPATIFMGRQMSAILSMRDFSTEHKSPQPTKNFSIPDPHSHRQTAQSSNVTDSCVVQTSNDTQCLNKSDNIDGKASLQIGEKMPVTASVLSEEEQTHCLEIGSNTRHGKSNLSEGKKSAELNSPLRERLSPENRTTDLKCDSSSGSEGEILTREHIEVEEKRASPPVSPIPVSEYCESENKWSQEKHSPWEGVSDHLAHREPKSQKPFRKMQEEEEESWSTSSDLTISISEDDLILESPEPQPNPGGKMEGEDGIEALKLIHAEQERVALSTEKNCILQTLSSPDSEKESSTNAPTREPGQTPDSDVPRAQVGQHVATLKEHDNSVKEEATALLRKALTEECGRRSAIHSSESSCSLPSILNDNSGIKEAKPAVWLNSVPTREQEVSSGCGDKSKKENVAADIPITETEAYQLLKKATLQDNTNQTENRFQKTDASVSHLSGLNIGSGAFETKTANKIASEASFSSSEGSPLSRHENKKKPVINLKSNALWDESDDSNSEIEAALRPRNHNTDDSDDFYD

SEQ ID NO: 865477 - protein, 540 aa, Homo sapiens
MQVAVQEGINSGTAMSRGLYQPATIFMGRQMSAILSMRDFSTEHKSPQPTKNFSIPDPHSHRQTAQSSNVTDSCVVQTSNDTQCLNKSDNIDGKASLQIGEKMPVTASVLSEEEQTHCLEIGSNTRHGKSNLSEGKKSAELNSPLRERLSPENRTTDLKCDSSSGSEGEILTREHIEVEEKRASPPVSPIPVSEYCESENKWSQEKHSPWEGVSDHLAHREPKSQKPFRKMQEEEEESWSTSSDLTISISEDDLILESPEPQPNPGGKMEGEDGIEALKLIHAEQERVALSTEKNCILQTLSSPDSEKESSTNAPTREPGQTPDSDVPRAQVGQHVATLKEHDNSVKEEATALLRKALTEECGRRSAIHSSESSCSLPSILNDNSGIKEAKPAVWLNSVPTREQEVSSGCGDKSKKENVAADIPITETEAYQLLKKATLQDNTNQTENRFQKTDASVSHLSGLNIGSGAFETKTANKIASEASFSSSEGSPLSRHENKKKPVINLKSNALWDESDDSNSEIEAALRPRNHNTDDSDDFYD

SEQ ID NO: 865478 - protein, 503 aa, Homo sapiens
RRRPGAVFTRGAWWGGLLRQPRPNGHPEAVLSWRSGSSMSRTLASAVPLSSPDYYERLGQLQHGLRDSEKKRLDLEKKLYEYNQSDTCRVKLKYVKLKNYLKEICESEKKAHTRNQEYLKRFERVQAHVVHFTTNTEKLQKLKLEYETQIKKMLCSKDSLGLKEELTDEDREKVAVQEGINSGTAMSRGLYQPATIFMGRQMSAILSMRDFSTEHKSPQPTKNFSIPDPHSHRQTAQSSNVTDSCVVQTSNDTQCLNKSDNIDGKASLQIGEKMPVTASVLSEEEQTHCLEIGSNTRHGKSNLSEGKKSAELNSPLRERLSPENRTTDLKCDSSSGSEGEILTREHIEVEEKRASPPVSPIPVSEYCESENKWSQEKHSPWEGVSDHLAHREPKSQKPFRKMQEEEEESWSTSSDLTISISEDDLILESPEPQPNPGGKMEGEDGIEALKLIHAEQERVALSTEKNCILQTLSSPDSERKCGCRYPNHRNRSLSVAEEGHPSG

SEQ ID NO: 865479 - protein, 693 aa, Homo sapiens; identical to SEQ ID NO: 865473

SEQ ID NO: 865480 - protein, 693 aa, Homo sapiens; identical to SEQ ID NO: 865473

SEQ ID NO: 865481 - protein, 128 aa, Homo sapiens
MAAFMLGSLLRTFKQMVPSSASGQVRSHYVDWRMWRDVKRRKMAYEYADERLRINSLRKNTILPKILQDVADEEIAALPRDSCPVRIRNRCVMTSRPRGVKRRWRLSRIVFRHLADHGQLSGIQRATW

SEQ ID NO: 865482 - protein, 113 aa, Homo sapiens
MVPSSASGQVRSHYVDWRMWRDVKRRKMAYEYADERLRINSLRKNTILPKILQDVADEEIAALPRDSCPVRIRNRCVMTSRPRGVKRRWRLSRIVFRHLADHGQLSGIQRATW

SEQ ID NO: 865483 - protein, 128 aa, Homo sapiens; identical to SEQ ID NO: 865481

SEQ ID NO: 865484 - protein, 114 aa, Homo sapiens
MAAFMLGSLLRTFKQMVPSSASGQVRSHYVDWRMWRDVKRRKMAYEYADERLRINSLRKNTILPKILQCPVRIRNRCVMTSRPRGVKRRWRLSRIVFRHLADHGQLSGIQRATW

SEQ ID NO: 865485 - protein, 128 aa, Homo sapiens; identical to SEQ ID NO: 865481

SEQ ID NO: 865486 - protein, 128 aa, Homo sapiens; identical to SEQ ID NO: 865481

SEQ ID NO: 865487 - protein, 128 aa, Homo sapiens; identical to SEQ ID NO: 865481

SEQ ID NO: 865488 - protein, 128 aa, Homo sapiens; identical to SEQ ID NO: 865481

SEQ ID NO: 865489 - protein, 128 aa, Homo sapiens; identical to SEQ ID NO: 865481

SEQ ID NO: 865490 - protein, 141 aa, Homo sapiens
MAAFMLGSLLRTFKQMVPSSASGQVRSHYVDWRMWRDVKRRKMAYEYADERLRINSLRKNTILPKILQDVADEEIAALPRDSCPVRIRNRCVMTSRPRGVKRRWRLSRIVFRHLADHGQLSGIQRATCLNSIQLFLYFFFK

SEQ ID NO: 865491 - protein, 233 aa, Homo sapiens
MDWSELYPEFFAPLTQNQSHDDPKDKKEKRAQAQVEFADIGCGYGGLLVELSPLFPDTLILGLEIRVKVSDYVQDRIRALRAAPAGGFQNIACLRSNAMKHLPNFFYKGQLTKMFFLFPDPHFKRTKHKWRIISPTLLAEYAYVLRVGGLVYTITDVLELHDWMCTHFEEHPLFERVPLEDLSEDPVVGHLGTSTEEGKKVLRNGGKNFPAIFRRIQDPVLQAVTSQTSLPGH

SEQ ID NO: 865492 - protein, 276 aa, Homo sapiens
MAAETRNVAGAEAPPPQKRYYRQRAHSNPMADHTLRYPVKPEEMDWSELYPEFFAPLTQNQSHDDPKDKKEKRAQAQVEFADIGCGYGGLLVELSPLFPDTLILGLEIRVKVSDYVQDRIRALRAAPAGGFQNIACLRSNAMKHLPNFFYKGQLTKMFFLFPDPHFKRTKHKWRIISPTLLAEYAYVLRVGGLVYTITDVLELHDWMCTHFEEHPLFERVPLEDLSEDPVVGHLGTSTEEGKKVLRNGGKNFPAIFRRIQDPVLQAVTSQTSLPGH

SEQ ID NO: 865493 - protein, 307 aa, Homo sapiens
MAASLTCASGLRLHVDLVEKPRTGIMAAETRNVAGAEAPPPQKRYYRQRAHSNPMADHTLRYPVKPEEMDWSELYPEFFAPLTQNQSHDDPKDKKEKRAQAQVEFADIGCGYGGLLVELSPLFPDTLILGLEIRVKVSDYVQDRIRALRAAPAGGFQNIACLRSNAMKHLPNFFYKGQLTKMFFLFPDPHFKRTKHKWRIISPTLLAEYAYVLRVGGDLPMQGLVYTITDVLELHDWMCTHFEEHPLFERVPLEDLSEDPVVGHLGTSTEEGKKVLRNGGKNFPAIFRRIQDPVLQAVTSQTSLPGH

SEQ ID NO: 865494 - protein, 287 aa, Homo sapiens
MAASLTCASGLRLHVDLVEKPRTGIMAAETRNVAGAEAPPPQKRYYRQRAHSNPMADHTLRYPVKPEEMDWSELYPEFFAPLTQNQSHDDPKDKKEKRAQAQVEFADIGCGYGGLLVELSPLFPDTLILGLEIRVKVSDYVQDRIRALRAAPAGGFQNIACLRSNAMKHLPNFFYKGQRTKHKWRIISPTLLAEYAYVLRVGGLVYTITDVLELHDWMCTHFEEHPLFERVPLEDLSEDPVVGHLGTSTEEGKKVLRNGGKNFPAIFRRIQDPVLQAVTSQTSLPGH

SEQ ID NO: 865495 - protein, 180 aa, Homo sapiens
MDWSELYPEFFAPLTQNQSHDDPKDKKEKRAQAQVEFADIGCGYGGLLVELSPLFPDTLILGLEIRVKVSDYVQDRIRALRAAPAGGFQNIACLRSNAMKHLPNFFYKGQLTKMFFLFPDPHFKRTKHKWRIISPTLLAEYAYVLRVGGDFAYAGAGVYHNRCAGATRLDVHSFRRAPTV

SEQ ID NO: 865496 - protein, 301 aa, Homo sapiens
MAASLTCASGLRLHVDLVEKPRTGIMAAETRNVAGAEAPPPQKRYYRQRAHSNPMADHTLRYPVKPEEMDWSELYPEFFAPLTQNQSHDDPKDKKEKRAQAQVEFADIGCGYGGLLVELSPLFPDTLILGLEIRVKVSDYVQDRIRALRAAPAGGFQNIACLRSNAMKHLPNFFYKGQLTKMFFLFPDPHFKRTKHKWRIISPTLLAEYAYVLRVGGLVYTITDVLELHDWMCTHFEEHPLFERVPLEDLSEDPVVGHLGTSTEEGKKVLRNGGKNFPAIFRRIQDPVLQAVTSQTSLPGH

SEQ ID NO: 865497 - protein, 180 aa, Homo sapiens
MAASLTCASGLRLHVDLVEKPRTGIMAAETRNVAGAEAPPPQKRYYRQRAHSNPMADHTLRYPVKPEEMDWSELYPEFFAPLTQNQSHDDPKDKKEKRAQAQVEFADIGCGYGGLLADKDVLPLPRPTFQADKAQVANHQSHPASRICLRAKSWGAGVYHNRCAGATRLDVHSFRRAPTV

SEQ ID NO: 865498 - protein, 301 aa, Homo sapiens; identical to SEQ ID NO: 865496

SEQ ID NO: 865499 - protein, 185 aa, Homo sapiens
MELSPLFPDTLILGLEIRVKVSDYVQDRIRALRAAPAGGFQNIACLRSNAMKHLPNFFYKGQLTKMFFLFPDPHFKRTKHKWRIISPTLLAEYAYVLRVGGLVYTITDVLELHDWMCTHFEEHPLFERVPLEDLSEDPVVGHLGTSTEEGKKVLRNGGKNFPAIFRRIQDPVLQAVTSQTSLPGH

SEQ ID NO: 865500 - protein, 109 aa, Homo sapiens
MAAETRNVAGAEAPPPQKRYYRQRAHSNPMADHTLRYPVKPEEMDWSELYPEFFAPLTQNQSHDDPKDKKEKRAQAQVEFADIGCGYGGLLDTGDISMERLHLPSTLGL

SEQ ID NO: 865501 - protein, 88 aa, Homo sapiens
GRVGRGRVGPDAWVDPRVGPRTGIMAAETRNVAGAEAPPPQKRYYRQRAHSNPMADHTLRYCPSLARSHSFCPTLLFFGITGMSLNSS

SEQ ID NO: 865502 - protein, 95 aa, Homo sapiens
TGSPNSGLTPESGAEEPFLSNASSLLSLHVDLGPSILDDVLQIMDQDLDSMQIPTWTRGCLGWGPRWGPARRWGVDPALAAESGSQDPTCMVAGQ

SEQ ID NO: 865503 - protein, 1136 aa, Homo sapiens
RQFARERGAWVDGRLGAWAAGRWERKSLWDAEEARMATPSKKTSTPSPQPSKRALPRDPSSEVPSKRKNSAPQLPLLQSSGPFVEGSIVRISMENFLTYDICEVSPGPHLNMIVGANGTGKSSIVCAICLGLAGKPAFMGRADKVGFFVKRGCSRGMVEIELFRASGNLVITREIDVAKNQSFWFINKKSTTQKIVEEKVAALNIQVGNLCQFLPQDKVGEFAKLSKIELLEATEKSIGPPEMHKYHCELKNLREKEKQLETSCKEKTEYLQKMVQRNERYKQDVERFYERKRHLDLIEMLEAKRPWVEYENVRQEYEEVKLVRDRVKEEVRKLKEGQIPITCRIEEMENERHNLEARIKEKATDIKEASQKCKQKQDVIERKDKHIEELQQALIVKQNEELDRQRRIGNTRKMIEDLQNELKTTENCENLQPQIDAITNDLRRIQDEKALCEGEIIDKRRERETLEKEKKSVDDHIVRFDNLMNQKEDKLRQRFRDTYDAVLWLRNNRDKFKQRVCEPIMLTINMKDNKNAKYIENHIPSNDLRAFVFESQEDMEVFLKEVRDNKKLRVNAVIAPKSSYADKAPSRSLNELKQYGFFSYLRELFDAPDPVMSYLCCQYHIHEVPVGTEKTRERIERVIQETRLKQIYTAEEKYVVKTSFYSNKVISSNTSLKVAQFLTVTVDLEQRRHLEEQLKEIHRKLQAVDSGLIALRETSKHLEHKDNELRQKKKELLERKTKKRQLEQKISSKLGSLKLMEQDTCNLEEEERKASTKIKEINVQKAKLVTELTNLIKICTSLHIQKVDLILQNTTVISEKNKLESDYMAASSQLRLTEQHFIELDENRQRLLQKCKELMKRARQVCNLGAEQTLPQEYQTQVPTIPNGHNSSLPMVFQDLPNTLDEIDALLTEERSRASCFTGLNPTIVQEYTKREEEIEQLTEELKGKKVELDQYRENISQVKERWLNPLKELVEKINEKFSNFFSSMQCAGEVDLHTENEEDYDKYGIRIRVKFRSSTQLHELTPHHQSGGERSVSTMLYLMALQELNRCPFRVVDEINQGMDPINERRVFEMVVNTACKENTSQYFFITPKLLQNLPYSEKMTVLFVYNGPHMLEPNTWNLKAFQRRRRRITFTQPS

SEQ ID NO: 865504 - protein, 1121 aa, Homo sapiens
RQFARERGAWVDGRLGAWAAGRWERKSLWDAEEARMATPSKKTSTPSPQPSKRALPRDPSSEVPSKRKNSAPQLPLLQSSGPFVEGSIVRISMENFLTYDICEVSPGPHLNMIVGANGTGKSSIVCAICLGLAGKPAFMGRADKVGFFVKRGCSRGMVEIELFRASGNLVITREIDVAKNQSFWFINKKSTTQKIVEEKVAALNIQVGNLCQFLPQDKVGEFAKLSKIELLEATEKSIGPPEMHKYHCELKNLREKEKQLETSCKEKTEYLQKMVQRNERYKQDVERFYERKRHLDLIEMLEAKRPWVEYENVRQEYEEVKLVRDRVKEEVRKLKEGQIPITCRIEEMENERHNLEARIKEKATDIKEASQKCKQKQDVIERKDKHIEELQQALIVKQNEELDRQRRIGNTRKMIEDLQNELKTTENCENLQPQIDAITNDLRRIQDEKALCEGEIIDKRRERETLEKEKKSVDDHIVRFDNLMNQKEDKLRQRFRDTYDAVLWLRNNRDKFKQRVCEPIMLTINMKDNKNAKYIENHIPSNDLRAFVFESQEDMEVFLKEVRDNKKLRVNAVIAPKSSYADKAPSRSLNELKQYGFFSYLRELFDAPDPVMSYLCCQYHIHEVPVGTEKTRERIERVIQETRLKQIYTAEEKYVVKTSFYSNKVISSNTSLKVAQFLTVTVDLEQRRHLEEQLKEIHRKLQAVDSGLIALRETSKHLEHKDNELRQKKKELLERKTKKRQLEQKISSKLGSLKLMEQDTCNLEEEERKASTKIKEINVQKAKLVTELTNLIKICTSLHIQKVDLILQNTTVISEKNKLESDYMAASSQLRLTEQHFIELDENRQRLLQKCKELMKRARQVCNLGAEQTLPQEYQTVFQDLPNTLDEIDALLTEERSRASCFTGLNPTIVQEYTKREEEIEQLTEELKGKKVELDQYRENISQVKERWLNPLKELVEKINEKFSNFFSSMQCAGEVDLHTENEEDYDKYGIRIRVKFRSSTQLHELTPHHQSGGERSVSTMLYLMALQELNRCPFRVVDEINQGMDPINERRVFEMVVNTACKENTSQYFFITPKLLQNLPYSEKMTVLFVYNGPHMLEPNTWNLKAFQRRRRRITFTQPS

SEQ ID NO: 865505 - protein, 863 aa, Homo sapiens
MVQRNERYKQDVERFYERKRHLDLIEMLEAKRPWVEYENVRQEYEEVKLVRDRVKEEVRKLKEGQIPITCRIEEMENERHNLEARIKEKATDIKEASQKCKQKQDVIERKDKHIEELQQALIVKQNEELDRQRRIGNTRKMIEDLQNELKTTENCENLQPQIDAITNDLRRIQDEKALCEGEIIDKRRERETLEKEKKSVDDHIVRFDNLMNQKEDKLRQRFRDTYDAVLWLRNNRDKFKQRVCEPIMLTINMKDNKNAKYIENHIPSNDLRAFVFESQEDMEVFLKEVRDNKKLRVNAVIAPKSSYADKAPSRSLNELKQYGFFSYLRELFDAPDPVMSYLCCQYHIHEVPVGTEKTRERIERVIQETRLKQIYTAEEKYVVKTSFYSNKVISSNTSLKVAQFLTVTVDLEQRRHLEEQLKEIHRKLQAVDSGLIALRETSKHLEHKDNELRQKKKELLERKTKKRQLEQKISSKLGSLKLMEQDTCNLEEEERKASTKIKEINVQKAKLVTELTNLIKICTSLHIQKVDLILQNTTVISEKNKLESDYMAASSQLRLTEQHFIELDENRQRLLQKCKELMKRARQVCNLGAEQTLPQEYQTQVPTIPNGHNSSLPMVFQDLPNTLDEIDALLTEERSRASCFTGLNPTIVQEYTKREEEIEQLTEELKGKKVELDQYRENISQVKERWLNPLKELVEKINEKFSNFFSSMQCAGEVDLHTENEEDYDKYGIRIRVKFRSSTQLHELTPHHQSGGERSVSTMLYLMALQELNRCPFRVVDEINQGMDPINERRVFEMVVNTACKENTSQYFFITPKLLQNLPYSEKMTVLFVYNGPHMLEPNTWNLKAFQRRRRRITFTQPS

SEQ ID NO: 865506 - protein, 246 aa, Homo sapiens [sequence omitted]

SEQ ID NO: 865507 - protein, 1026 aa, Homo sapiens
RQFARERGAWVDGRLGAWAAGRWERKSLWDAEEARMATPSKKTSTPSPQPSKRALPRDPSSEVPSKRKNSAPQLPLLQSSGPFVEGSIVRISMENFLTYDICEVSPGPHLNMIVGANGTGKSSIVCAICLGLAGKPAFMGRADKVGFFVKRGCSRGMVEIELFRASGNLVITREIDVAKNQSFWFINKKSTTQKIVEEKVAALNIQVGNLCQFLPQDKVGEFAKLSKIELLEATEKSIGPPEMHKYHCELKNLREKEKQLETSCKEKTEYLQKMVQRNERYKQDVERFYERKRHLDLIEMLEAKRPWVEYENVRQEYEEVKLVRDRVKEEVRKLKEGQIPITCRIEEMENERHNLEARIKEKATDIKEASQKCKQKQDVIERKDKHIEELQQALIVKQNEELDRQRRIGNTRKMIEDLQNELKTTENCENLQPQIDAITNDLRRIQDEKALCEGEIIDKRRERETLEKEKKSVDDHIVRFDNLMNQKEDKLRQRFRDTYDAVLWLRNNRDKFKQRVCEPIMLTINMKDNKNAKYIENHIPSNDLRAFVFESQEDMEVFLKEVRDNKKLRVNAVIAPKSSYADKAPSRSLNELKQYGFFSYLRELFDAPDPVMSYLCCQYHIHEVPVGTEKTRERIERVIQETRLKQIYTAEEKYVVKTSFYSNKVISSNTSLKVAQFLTVTVDLEQRRHLEEQLKEIHRKLQAVDSGLIALRETSKHLEHKDNELRQKKKELLERKTKKRQLEQKISSKLGSLKLMEQDTCNLEEEERKASTKIKEINVQKAKLVTELTNLIKICTSLHIQKVDLILQNTTVISEKNKLESDYMAASSQLRLTEQHFIELDENRQRLLQKCKELMKRARQVCNLGAEQTLPQEYQTQVPTIPNGHNSSLPMVFQDLPNTLDEIDALLTEERSRASCFTGLNPTIVQEYTKREEEIEQLTEELKGKKVELDQYRENISQVKERWLNPLKELVEKINEKFSNFFSSMQCAGEVDLHTENETGKGQVLWLMPNPTFIGVSPCTRPKVDF

SEQ ID NO: 865508 - protein, 882 aa, Homo sapiens
RQFARERGAWVDGRLGAWAAGRWERKSLWDAEEARMATPSKKTSTPSPQPSKRALPRDPSSEVPSKRKNSAPQLPLLQSSGPFVEGSIVRISMENFLTYDICEVSPGPHLNMIVGANGTGKSSIVCAICLGLAGKPAFMGRADKVGFFVKRGCSRGMVEIELFRASGNLVITREIDVAKNQSFWFINKKSTTQKIVEEKVAALNIQVGNLCQFLPQDKVGEFAKLSKIELLEATEKSIGPPEMHKYHCELKNLREKEKQLETSCKEKTEYLQKMVQRNERYKQDVERFYERKRHLDLIEMLEAKRPWVEYENVRQEYEEVKLVRDRVKEEVRKLKEGQIPITCRIEEMENERHNLEARIKEKATDIKEASQKCKQKQDVIERKDKHIEELQQALIVKQNEELDRQRRIGNTRKMIEDLQNELKTTENCENLQPQIDAITNDLRRIQDEKALCEGEIIDKRRERETLEKEKKSVDDHIVRFDNLMNQKEDKLRQRFRDTYDAVLWLRNNRDKFKQRVCEPIMLTINMKDNKNAKYIENHIPSNDLRAFVFESQEDMEVFLKEVRDNKKLRVNAVIAPKSSYADKAPSRSLNELKQYGFFSYLRELFDAPDPVMSYLCCQYHIHEVPVGTEKTRERIERVIQETRLKQIYTAEEKYVVKTSFYSNKVISSNTSLKVAQFLTVTVDLEQRRHLEEQLKEIHRKLQAVDSGLIALRETSKHLEHKDNELRQKKKELLERKTKKRQLEQKISSKLGSLKLMEQDTCNLEEEERKASTKIKEINVQKAKLVTELTNLIKICTSLHIQKVDLILQNTTVISEKNKLESDYMAASSQLRLTEQHFIELDENRQRLLQKCKELMKRARQVCNLGAEQTLPQEYQTVSIKSI

SEQ ID NO: 865509 - protein, 539 aa, Homo sapiens
RQFARERGAWVDGRLGAWAAGRWERKSLWDAEEARMATPSKKTSTPSPQPSKRALPRDPSSEVPSKRKNSAPQLPLLQSSGPFVEGSIVRISMENFLTYDICEVSPGPHLNMIVGANGTGKSSIVCAICLGLAGKPAFMGRADKVGFFVKRGCSRGMVEIELFRASGNLVITREIDVAKNQSFWFINKKSTTQKIVEEKVAALNIQVGNLCQFLPQDKVGEFAKLSKIELLEATEKSIGPPEMHKYHCELKNLREKEKQLETSCKEKTEYLQKMVQRNERYKQDVERFYERKRHLDLIEMLEAKRPWVEYENVRQEYEEVKLVRDRVKEEVRKLKEGQIPITCRIEEMENERHNLEARIKEKATDIKEASQKCKQKQDVIERKDKHIEELQQALIVKQNEELDRQRRIGNTRKMIEDLQNELKTTENCENLQPQIDAITNDLRRIQDEKALCEGEIIDKRRERETLEKEKKSVDDHIVRFDNLMNQKEDKLRQRFRDTYDAVLWLRNNRDKFKQRVCEPIMLTVRNFVHLGSIGFIIVI

SEQ ID NO: 865510 - protein, 1136 aa, Homo sapiens; identical to SEQ ID NO: 865503

SEQ ID NO: 865511 - protein, 915 aa, Homo sapiens
RQFARERGAWVDGRLGAWAAGRWERKSLWDAEEARMATPSKKTSTPSPQPSKRALPRDPSSEVPSKRKNSAPQLPLLQSSGPFVEGSIVRISMENFLTYDICEVSPGPHLNMIVGANGTGKSSIVCAICLGLAGKPAFMGRADKVGFFVKRGCSRGMVEIELFRASGNLVITREIDVAKNQSFWFINKKSTTQKIVEEKVAALNIQVGNLCQFLPQDKVGEFAKLSKIELLEATEKSIGPPEMHKYHCELKNLREKEKQLETSCKEKTEYLQKMVQRNERYKQDVERFYERKRHLDLIEMLEAKRPWVEYENVRQEYEEVKLVRDRVKEEVRKLKEGQIPITCRIEEMENERHNLEARIKEKATDIKEASQKCKQKQDVIERKDKHIEELQQALIVKQNEELDRQRRIGNTRKMIEDLQNELKTTENCENLQPQIDAITNDLRRIQDEKALCEGEIIDKRRERETLEKEKKSVDDHIVRFDNLMNQKEDKLRQRFRDTYDAVLWLRNNRDKFKQRVCEPIMLTINMKDNKNAKYIENHIPSNDLRAFVFESQEDMEVFLKEVRDNKKLRVNAVIAPKSSYADKAPSRSLNELKQYGFFSYLRELFDAPDPVMSYLCCQYHIHEVPVGTEKTRERIERVIQETRLKQIYTAEEKYVVKTSFYSNKVISSNTSLKVAQFLTVTVDLEQRRHLEEQLKEIHRKLQAVDSGLIALRETSKHLEHKDNELRQKKKELLERKTKKRQLEQKISSKLGSLKLMEQDTCNLEEEERKASTKIKEINVQKAKLVTELTNLIKICTSLHIQKVDLILQNTTVISEKNKLESDYMAASSQLRLTEQHFIELDENRQRLLQKCKELMKRARQVCNLGAEQTLPQEYQTQVPTIPNGHNSSLPMVCSTHSFFPSSCFPSALLLPSHLL

SEQ ID NO: 865512 - protein, 313 aa, Homo sapiens
MAASSQLRLTEQHFIELDENRQRLLQKCKELMKRARQVCNLGAEQTLPQEYQTQVPTIPNGHNSSLPMVFQDLPNTLDEIDALLTEERSRASCFTGLNPTIVQEYTKREEEIEQLTEELKGKKVELDQYRENISQVKERWLNPLKELVEKINEKFSNFFSSMQCAGEVDLHTENEEDYDKYGIRIRVKFRSSTQLHELTPHHQSGGERSVSTMLYLMALQELNRCPFRVVDEINQGMDPINERRVFEMVVNTACKENTSQYFFITPKLLQNLPYSEKMTVLFVYNGPHMLEPNTWNLKAFQRRRRRITFTQPS

SEQ ID NO: 865513 - protein, 1136 aa, Homo sapiens; identical to SEQ ID NO: 865503

SEQ ID NO: 865514 - protein, 915 aa, Homo sapiens; identical to SEQ ID NO: 865511

SEQ ID NO: 865515 - protein, 272 aa, Homo sapiens
MDSYLLMWGLLTFIMVPGCQAELCDDDPPEIPHATFKAMAYKEGTMLNCECKRGFRRIKSGSLYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTGEMETSQFPGEEKPQASPEGRPESETSCLVTTTDFQIQTEMAATMETSIFTTEYQVAVAGCVFLLISVLLLSGLTWQRRQRKSRRTI

SEQ ID NO: 865516 - protein, 295 aa, Homo sapiens
MDSYLLMWGLLTFIMVPGCQAELCDDDPPEIPHATFIMVPGCQAELCDDDPPEIPHATFKAMAYKEGTMLNCECKRGFRRIKSGSLYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTGEMETSQFPGEEKPQASPEGRPESETSCLVTTTDFQIQTEMAATMETSIFTTEYQVAVAGCVFLLISVLLLSGLTWQRRQRKSRRTI

SEQ ID NO: 865517 - protein, 272 aa, Homo sapiens; identical to SEQ ID NO: 865515

SEQ ID NO: 865518 - protein, 200 aa, Homo sapiens
MDSYLLMWGLLTFIMVPGCQAELCDDDPPEIPHATFKAMAYKEGTMLNCECKRGFRRIKSGSLYMLCTGNSSHSSWDNQCQCTSSATRNTTKQVTPQPEEQKERKTTEMQSPMQPVDQASLPGEEKPQASPEGRPESETSCLVTTTDFQIQTEMAATMETSIFTTEYQVAVAGCVFLLISVLLLSGLTWQRRQRKSRRTI

SEQ ID NO: 865519 - protein, 199 aa, Homo sapiens
MDSYLLMWGLLTFIMVPGCQAELCDDDPPEIPHATFIMVPGCQAELCDDDPPEIPHATFKAMAYKEGTMLNCECKRGFRRIKSGSLYMLCTGNSSHSSWDNQCQCTSSATRNTTKQVTPQPEEQKERKTTEMQSPMQPVDQASLPDFQIQTEMAATMETSIFTTEYQVAVAGCVFLLISVLLLSGLTWQRRQRKSRRTI

SEQ ID NO: 865520 - protein, 272 aa, Homo sapiens; identical to SEQ ID NO: 865515

SEQ ID NO: 865521 - protein, 2510 aa, Homo sapiens
RHYPLRSERCGAEAAEAPRSFSTPRPDAPTPLTPREPKMDPSGVKVLETAEDIQERRQQVLDRYHRFKELSTLRRQKLEDSYRFQFFQRDAEELEKWIQEKLQIASDENYKDPTNLQGKLQKHQAFEAEVQANSGAIVKLDETGNLMISEGHFASETIRTRLMELHRQWELLLEKMREKGIKLLQAQKLVQYLRECEDVMDWINDKEAIVTSEELGQDLEHVEVLQKKFEEFQTDMAAHEERVNEVNQFAAKLIQEQHPEEELIKTKQDEVNAAWQRLKGLALQRQGKLFGAAEVQRFNRDVDETISWIKEKEQLMASDDFGRDLASVQALLRKHEGLERDLAALEDKVKALCAEADRLQQSHPLSATQIQVKREELITNWEQIRTLAAERHARLNDSYRLQRFLADFRDLTSWVTEMKALINADELASDVAGAEALLDRHQEHKGEIDAHEDSFKSADESGQALLAAGHYASDEVREKLTVLSEERAALLELWELRRQQYEQCMDLQLFYRDTEQVDNWMSKQEAFLLNEDLGDSLDSVEALLKKHEDFEKSLSAQEEKITALDEFATKLIQNNHYAMEDVATRRDALLSRRNALHERAMRRRAQLADSFHLQQFFRDSDELKSWVNEKMKTATDEAYKDPSNLQGKVQKHQAFEAELSANQSRIDALEKAGQKLIDVNHYAKDEVAARMNEVISLWKKLLEATELKGIKLREANQQQQFNRNVEDIELWLYEVEGHLASDDYGKDLTNVQNLQKKHALLEADVAAHQDRIDGITIQARQFQDAGHFDAENIKKKQEALVARYEALKEPMVARKQKLADSLRLQQLFRDVEDEETWIREKEPIAASTNRGKDLIGVQNLLKKHQALQAEIAGHEPRIKAVTQKGNAMVEEGHFAAEDVKAKLHELNQKWEALKAKASQRRQDLEDSLQAQQYFADANEAESWMREKEPIVGSTDYGKDEDSAEALLKKHEALMSDLSAYGSSIQALREQAQSCRQQVAPTDDETGKELVLALYDYQEKSPREVTMKKGDILTLLNSTNKDWWKVEVNDRQGFVPAAYVKKLDPAQSASRENLLEEQGSIALRQEQIDNQTRITKEAGSVSLRMKQVEELYHSLLELGEKRKGMLEKSCKKFMLFREANELQQWINEKEAALTSEEVGADLEQVEVLQKKFDDFQKDLKANESRLKDINKVAEDLESEGLMAEEVQAVQQQEVYGMMPRDETDSKTASPWKSARLMVHTVATFNSIKELNERWRSLQQLAEERSQLLGSAHEVQRFHRDADETKEWIEEKNQALNTDNYGHDLASVQALQRKHEGFERDLAALGDKVNSLGETAERLIQSHPESAEDLQEKCTELNQAWSSLGKRADQRKAKLGDSHDLQRFLSDFRDLMSWINGIRGLVSSDELAKDVTGAEALLERHQEHRTEIDARAGTFQAFEQFGQQLLAHGHYASPEIKQKLDILDQERADLEKAWVQRRMMLDQCLELQLFHRDCEQAENWMAAREAFLNTEDKGDSLDSVEALIKKHEDFDKAINVQEEKIAALQAFADQLIAAGHYAKGDISSRRNEVLDRWRRLKAQMIEKRSKLGESQTLQQFSRDVDEIEAWISEKLQTASDESYKDPTNIQSKHQKHQAFEAELHANADRIRGVIDMGNSLIERGACAGSEDAVKARLAALADQWQFLVQKSAEKSQKLKEANKQQNFNTGIKDFDFWLSEVEALLASEDYGKDLASVNNLLKKHQLLEADISAHEDRLKDLNSQADSLMTSSAFDTSQVKDKRDTINGRFQKIKSMAASRRAKLNESHRLHQFFRDMDDEESWIKEKKLLVGSEDYGRDLTGVQNLRKKHKRLEAELAAHEPAIQGVLDTGKKLSDDNTIGKEEIQQRLAQFVEHWKELKQLAAARGQRLEESLEYQQFVANVEEEEAWINEKMTLVASEDYGDTLAAIQGLLKKHEAFETDFTVHKDRVNDVCTNGQDLIKKNNHHEENISSKMKGLNGKVSDLEKAAAQRKAKLDENSAFLQFNWKADVVESWIGEKENSLKTDDYGRDLSSVQTLLTKQETFDAGLQAFQQEGIANITALKDQLLAAKHVQSKAIEARHASLMKRWSQLLANSAARKKKLLEAQSHFRKVEDLFLTFAKKASAFNSWFENAEEDLTDPVRCNSLEEIKALREAHDAFRSSLSSAQADFNQLAELDRQIKSFRVASNPYTWFTMEALEETWRNLQKIIKERELELQKEQRRQEENDKLRQEFAQHANAFHQWIQETRTYLLDGSCMVEESGTLESQLEATKRKHQEIRAMRSQLKKIEDLGAAMEEALILDNKYTEHSTVGLAQQWDQLDQLGMRMQHNLEQQIQARNTTGVTEEALKEFSMMFKHFDKDKSGRLNHQEFKSCLRSLGYDLPMVEEGEPDPEFEAILDTVDPNRDGHVSLQEYMAFMISRETENVKSSEEIESAFRALSSEGKPYVTKEELYQNLTREQADYCVSHMKPYVDGKGRELPTAFDYVEFTRSLFVN

SEQ ID NO: 865522 - protein, 2510 aa, Homo sapiens; identical to SEQ ID NO: 865521

SEQ ID NO: 865523 - protein, 2515 aa, Homo sapiens
RHYPLRSERCGAEAAEAPRSFSTPRPDAPTPLTPREPKMDPSGVKVLETAEDIQERRQQVLDRYHRFKELSTLRRQKLEDSYRFQFFQRDAEELEKWIQEKLQIASDENYKDPTNLQGKLQKHQAFEAEVQANSGAIVKLDETGNLMISEGHFASETIRTRLMELHRQWELLLEKMREKGIKLLQAQKLVQYLRECEDVMDWINDKEAIVTSEELGQDLEHVEVLQKKFEEFQTDMAAHEERVNEVNQFAAKLIQEQHPEEELIKTKQDEVNAAWQRLKGLALQRQGKLFGAAEVQRFNRDVDETISWIKEKEQLMASDDFGRDLASVQALLRKHEGLERDLAALEDKVKALCAEADRLQQSHPLSATQIQVKREELITNWEQIRTLAAERHARLNDSYRLQRFLADFRDLTSWVTEMKALINADELASDVAGAEALLDRHQEHKGEIDAHEDSFKSADESGQALLAAGHYASDEVREKLTVLSEERAALLELWELRRQQYEQCMDLQLFYRDTEQVDNWMSKQEAFLLNEDLGDSLDSVEALLKKHEDFEKSLSAQEEKITALDEFATKLIQNNHYAMEDVATRRDALLSRRNALHERAMRRRAQLADSFHLQQFFRDSDELKSWVNEKMKTATDEAYKDPSNLQGKVQKHQAFEAELSANQSRIDALEKAGQKLIDVNHYAKDEVAARMNEVISLWKKLLEATELKGIKLREANQQQQFNRNVEDIELWLYEVEGHLASDDYGKDLTNVQNLQKKHALLEADVAAHQDRIDGITIQARQFQDAGHFDAENIKKKQEALVARYEALKEPMVARKQKLADSLRLQQLFRDVEDEETWIREKEPIAASTNRGKDLIGVQNLLKKHQALQAEIAGHEPRIKAVTQKGNAMVEEGHFAAEDVKAKLHELNQKWEALKAKASQRRQDLEDSLQAQQYFADANEAESWMREKEPIVGSTDYGKDEDSAEALLKKHEALMSDLSAYGSSIQALREQAQSCRQQVAPTDDETGKELVLALYDYQEKSPREVTMKKGDILTLLNSTNKDWWKVEVNDRQGFVPAAYVKKLDPAQSASRENLLEEQGSIALRQEQIDNQTRITKEAGSVSLRMKQVEELYHSLLELGEKRKGMLEKSCKKFMLFREANELQQWINEKEAALTSEEVGADLEQVEVLQKKFDDFQKDLKANESRLKDINKVAEDLESEGLMAEEVQAVQQQEVYGMMPRDETDSKTASPWKSARLMVHTVATFNSIKELNERWRSLQQLAEERSQLLGSAHEVQRFHRDADETKEWIEEKNQALNTDNYGHDLASVQALQRKHEGFERDLAALGDKVNSLGETAERLIQSHPESAEDLQEKCTELNQAWSSLGKRADQRKAKLGDSHDLQRFLSDFRDLMSWINGIRGLVSSDELAKDVTGAEALLERHQEHRTEIDARAGTFQAFEQFGQQLLAHGHYASPEIKQKLDILDQERADLEKAWVQRRMMLDQCLELQLFHRDCEQAENWMAAREAFLNTEDKGDSLDSVEALIKKHEDFDKAINVQEEKIAALQAFADQLIAAGHYAKGDISSRRNEVLDRWRRLKAQMIEKRSKLGESQTLQQFSRDVDEIEAWISEKLQTASDESYKDPTNIQAFQVLSKHQKHQAFEAELHANADRIRGVIDMGNSLIERGACAGSEDAVKARLAALADQWQFLVQKSAEKSQKLKEANKQQNFNTGIKDFDFWLSEVEALLASEDYGKDLASVNNLLKKHQLLEADISAHEDRLKDLNSQADSLMTSSAFDTSQVKDKRDTINGRFQKIKSMAASRRAKLNESHRLHQFFRDMDDEESWIKEKKLLVGSEDYGRDLTGVQNLRKKHKRLEAELAAHEPAIQGVLDTGKKLSDDNTIGKEEIQQRLAQFVEHWKELKQLAAARGQRLEESLEYQQFVANVEEEEAWINEKMTLVASEDYGDTLAAIQGLLKKHEAFETDFTVHKDRVNDVCTNGQDLIKKNNHHEENISSKMKGLNGKVSDLEKAAAQRKAKLDENSAFLQFNWKADVVESWIGEKENSLKTDDYGRDLSSVQTLLTKQETFDAGLQAFQQEGIANITALKDQLLAAKHVQSKAIEARHASLMKRWSQLLANSAARKKKLLEAQSHFRKVEDLFLTFAKKASAFNSWFENAEEDLTDPVRCNSLEEIKALREAHDAFRSSLSSAQADFNQLAELDRQIKSFRVASNPYTWFTMEALEETWRNLQKIIKERELELQKEQRRQEENDKLRQEFAQHANAFHQWIQETRTYLLDGSCMVEESGTLESQLEATKRKHQEIRAMRSQLKKIEDLGAAMEEALILDNKYTEHSTVGLAQQWDQLDQLGMRMQHNLEQQIQARNTTGVTEEALKEFSMMFKHFDKDKSGRLNHQEFKSCLRSLGYDLPMVEEGEPDPEFEAILDTVDPNRDGHVSLQEYMAFMISRETENVKSSEEIESAFRALSSEGKPYVTKEELYQNLTREQADYCVSHMKPYVDGKGRELPTAFDYVEFTRSLFVN

SEQ ID NO: 865524 - protein, 2006 aa, Homo sapiens
MDLQLFYRDTEQVDNWMSKQEAFLLNEDLGDSLDSVEALLKKHEDFEKSLSAQEEKITALDEFATKLIQNNHYAMEDVATRRDALLSRRNALHERAMRRRAQLADSFHLQQFFRDSDELKSWVNEKMKTATDEAYKDPSNLQGKVQKHQAFEAELSANQSRIDALEKAGQKLIDVNHYAKDEVAARMNEVISLWKKLLEATELKGIKLREANQQQQFNRNVEDIELWLYEVEGHLASDDYGKDLTNVQNLQKKHALLEADVAAHQDRIDGITIQARQFQDAGHFDAENIKKKQEALVARYEALKEPMVARKQKLADSLRLQQLFRDVEDEETWIREKEPIAASTNRGKDLIGVQNLLKKHQALQAEIAGHEPRIKAVTQKGNAMVEEGHFAAEDVKAKLHELNQKWEALKAKASQRRQDLEDSLQAQQYFADANEAESWMREKEPIVGSTDYGKDEDSAEALLKKHEALMSDLSAYGSSIQALREQAQSCRQQVAPTDDETGKELVLALYDYQEKSPREVTMKKGDILTLLNSTNKDWWKVEVNDRQGFVPAAYVKKLDPAQSASRENLLEEQGSIALRQEQIDNQTRITKEAGSVSLRMKQVEELYHSLLELGEKRKGMLEKSCKKFMLFREANELQQWINEKEAALTSEEVGADLEQVEVLQKKFDDFQKDLKANESRLKDINKVAEDLESEGLMAEEVQAVQQQEVYGMMPRDETDSKTASPWKSARLMVHTVATFNSIKELNERWRSLQQLAEERSQLLGSAHEVQRFHRDADETKEWIEEKNQALNTDNYGHDLASVQALQRKHEGFERDLAALGDKVNSLGETAERLIQSHPESAEDLQEKCTELNQAWSSLGKRADQRKAKLGDSHDLQRFLSDFRDLMSWINGIRGLVSSDELAKDVTGAEALLERHQEHRTEIDARAGTFQAFEQFGQQLLAHGHYASPEIKQKLDILDQERADLEKAWVQRRMMLDQCLELQLFHRDCEQAENWMAAREAFLNTEDKGDSLDSVEALIKKHEDFDKAINVQEEKIAALQAFADQLIAAGHYAKGDISSRRNEVLDRWRRLKAQMIEKRSKLGESQTLQQFSRDVDEIEAWISEKLQTASDESYKDPTNIQSKHQKHQAFEAELHANADRIRGVIDMGNSLIERGACAGSEDAVKARLAALADQWQFLVQKSAEKSQKLKEANKQQNFNTGIKDFDFWLSEVEALLASEDYGKDLASVNNLLKKHQLLEADISAHEDRLKDLNSQADSLMTSSAFDTSQVKDKRDTINGRFQKIKSMAASRRAKLNESHRLHQFFRDMDDEESWIKEKKLLVGSEDYGRDLTGVQNLRKKHKRLEAELAAHEPAIQGVLDTGKKLSDDNTIGKEEIQQRLAQFVEHWKELKQLAAARGQRLEESLEYQQFVANVEEEEAWINEKMTLVASEDYGDTLAAIQGLLKKHEAFETDFTVHKDRVNDVCTNGQDLIKKNNHHEENISSKMKGLNGKVSDLEKAAAQRKAKLDENSAFLQFNWKADVVESWIGEKENSLKTDDYGRDLSSVQTLLTKQETFDAGLQAFQQEGIANITALKDQLLAAKHVQSKAIEARHASLMKRWSQLLANSAARKKKLLEAQSHFRKVEDLFLTFAKKASAFNSWFENAEEDLTDPVRCNSLEEIKALREAHDAFRSSLSSAQADFNQLAELDRQIKSFRVASNPYTWFTMEALEETWRNLQKIIKERELELQKEQRRQEENDKLRQEFAQHANAFHQWIQETRTYLLDGSCMVEESGTLESQLEATKRKHQEIRAMRSQLKKIEDLGAAMEEALILDNKYTEHSTVGLAQQWDQLDQLGMRMQHNLEQQIQARNTTGVTEEALKEFSMMFKHFDKDKSGRLNHQEFKSCLRSLGYDLPMVEEGEPDPEFEAILDTVDPNRDGHVSLQEYMAFMISRETENVKSSEEIESAFRALSSEGKPYVTKEELYQNLTREQADYCVSHMKPYVDGKGRELPTAFDYVEFTRSLFVN

SEQ ID NO: 865525 - protein, 2043 aa, Homo sapiens
MVTMPQMNLREKLTVLSEERAALLELWELRRQQYEQCMDLQLFYRDTEQVDNWMSKQEAFLLNEDLGDSLDSVEALLKKHEDFEKSLSAQEEKITALDEFATKLIQNNHYAMEDVATRRDALLSRRNALHERAMRRRAQLADSFHLQQFFRDSDELKSWVNEKMKTATDEAYKDPSNLQGKVQKHQAFEAELSANQSRIDALEKAGQKLIDVNHYAKDEVAARMNEVISLWKKLLEATELKGIKLREANQQQQFNRNVEDIELWLYEVEGHLASDDYGKDLTNVQNLQKKHALLEADVAAHQDRIDGITIQARQFQDAGHFDAENIKKKQEALVARYEALKEPMVARKQKLADSLRLQQLFRDVEDEETWIREKEPIAASTNRGKDLIGVQNLLKKHQALQAEIAGHEPRIKAVTQKGNAMVEEGHFAAEDVKAKLHELNQKWEALKAKASQRRQDLEDSLQAQQYFADANEAESWMREKEPIVGSTDYGKDEDSAEALLKKHEALMSDLSAYGSSIQALREQAQSCRQQVAPTDDETGKELVLALYDYQEKSPREVTMKKGDILTLLNSTNKDWWKVEVNDRQGFVPAAYVKKLDPAQSASRENLLEEQGSIALRQEQIDNQTRITKEAGSVSLRMKQVEELYHSLLELGEKRKGMLEKSCKKFMLFREANELQQWINEKEAALTSEEVGADLEQVEVLQKKFDDFQKDLKANESRLKDINKVAEDLESEGLMAEEVQAVQQQEVYGMMPRDETDSKTASPWKSARLMVHTVATFNSIKELNERWRSLQQLAEERSQLLGSAHEVQRFHRDADETKEWIEEKNQALNTDNYGHDLASVQALQRKHEGFERDLAALGDKVNSLGETAERLIQSHPESAEDLQEKCTELNQAWSSLGKRADQRKAKLGDSHDLQRFLSDFRDLMSWINGIRGLVSSDELAKDVTGAEALLERHQEHRTEIDARAGTFQAFEQFGQQLLAHGHYASPEIKQKLDILDQERADLEKAWVQRRMMLDQCLELQLFHRDCEQAENWMAAREAFLNTEDKGDSLDSVEALIKKHEDFDKAINVQEEKIAALQAFADQLIAAGHYAKGDISSRRNEVLDRWRRLKAQMIEKRSKLGESQTLQQFSRDVDEIEAWISEKLQTASDESYKDPTNIQSKHQKHQAFEAELHANADRIRGVIDMGNSLIERGACAGSEDAVKARLAALADQWQFLVQKSAEKSQKLKEANKQQNFNTGIKDFDFWLSEVEALLASEDYGKDLASVNNLLKKHQLLEADISAHEDRLKDLNSQADSLMTSSAFDTSQVKDKRDTINGRFQKIKSMAASRRAKLNESHRLHQFFRDMDDEESWIKEKKLLVGSEDYGRDLTGVQNLRKKHKRLEAELAAHEPAIQGVLDTGKKLSDDNTIGKEEIQQRLAQFVEHWKELKQLAAARGQRLEESLEYQQFVANVEEEEAWINEKMTLVASEDYGDTLAAIQGLLKKHEAFETDFTVHKDRVNDVCTNGQDLIKKNNHHEENISSKMKGLNGKVSDLEKAAAQRKAKLDENSAFLQFNWKADVVESWIGEKENSLKTDDYGRDLSSVQTLLTKQETFDAGLQAFQQEGIANITALKDQLLAAKHVQSKAIEARHASLMKRWSQLLANSAARKKKLLEAQSHFRKVEDLFLTFAKKASAFNSWFENAEEDLTDPVRCNSLEEIKALREAHDAFRSSLSSAQADFNQLAELDRQIKSFRVASNPYTWFTMEALEETWRNLQKIIKERELELQKEQRRQEENDKLRQEFAQHANAFHQWIQETRTYLLDGSCMVEESGTLESQLEATKRKHQEIRAMRSQLKKIEDLGAAMEEALILDNKYTEHSTVGLAQQWDQLDQLGMRMQHNLEQQIQARNTTGVTEEALKEFSMMFKHFDKDKSGRLNHQEFKSCLRSLGYDLPMVEEGEPDPEFEAILDTVDPNRDGHVSLQEYMAFMISRETENVKSSEEIESAFRALSSEGKPYVTKEELYQNLTREQADYCVSHMKPYVDGKGRELPTAFDYVEFTRSLFVN

SEQ ID NO: 865526 - protein, 2446 aa, Homo sapiens
RHYPLRSERCGAEAAEAPRSFSTPRPDAPTPLTPREPKMDPSGVKVLETAEDIQERRQQVLDRYHRFKELSTLRRQKLEDSYRFQFFQRDAEELEKWIQEKLQIASDENYKDPTNLQGKLQKHQAFEAEVQANSGAIVKLDETGNLMISEGHFASETIRTRLMELHRQWELLLEKMREKGIKLLQAQKLVQYLRECEDVMDWINDKEAIVTSEELGQDLEHVEVLQKKFEEFQTDMAAHEERVNEVNQFAAKLIQEQHPEEELIKTKQDEVNAAWQRLKGLALQRQGKLFGAAEVQRFNRDVDETISWIKEKEQLMASDDFGRDLASVQALLRKHEGLERDLAALEDKVKALCAEADRLQQSHPLSATQIQVKREELITNWEQIRTLAAERHARLNDSYRLQRFLADFRDLTSWVTEMKALINADELASDVAGAEALLDRHQEHKGEIDAHEDSFKSADESGQALLAAGHYASDEVREKLTVLSEERAALLELWELRRQQYEQCMDLQLFYRDTEQVDNWMSKQEAFLLNEDLGDSLDSVEALLKKHEDFEKSLSAQEEKITALDEFATKLIQNNHYAMEDVATRRDALLSRRNALHERAMRRRAQLADSFHLQQFFRDSDELKSWVNEKMKTATDEAYKDPSNLQGKVQKHQAFEAELSANQSRIDALEKAGQKLIDVNHYAKDEVAARMNEVISLWKKLLEATELKGIKLREANQQQQFNRNVEDIELWLYEVEGHLASDDYGKDLTNVQNLQKKHALLEADVAAHQDRIDGITIQARQFQDAGHFDAENIKKKQEALVARYEALKEPMVARKQKLADSLRLQQLFRDVEDEETWIREKEPIAASTNRGKDLIGVQNLLKKHQALQAEIAGHEPRIKAVTQKGNAMVEEGHFAAEDVKAKLHELNQKWEALKAKASQRRQDLEDSLQAQQYFADANEAESWMREKEPIVGSTDYGKDEDSAEALLKKHEALMSDLSAYGSSIQALREQAQSCRQQVAPTDDETGKELVLALYDYQEKSPREVTMKKGDILTLLNSTNKDWWKVEVNDRQGFVPAAYVKKLDPAQSASRENLLEEQGSIALRQEQIDNQTRITKEAGSVSLRMKQVEELYHSLLELGEKRKGMLEKSCKKFMLFREANELQQWINEKEAALTSEEVGADLEQVEVLQKKFDDFQKDLKANESRLKDINKVAEDLESEGLMAEEVQAVQQQEVYGMMPRDETDSKTASPWKSARLMVHTVATFNSIKELNERWRSLQQLAEERSQLLGSAHEVQRFHRDADETKEWIEEKNQALNTDNYGHDLASVQALQRKHEGFERDLAALGDKVNSLGETAERLIQSHPESAEDLQEKCTELNQAWSSLGKRADQRKAKLGDSHDLQRFLSDFRDLMSWINGIRGLVSSDELAKDVTGAEALLERHQEHRTEIDARAGTFQAFEQFGQQLLAHGHYASPEIKQKLDILDQERADLEKAWVQRRMMLDQCLELQLFHRDCEQAENWMAAREAFLNTEDKGDSLDSVEALIKKHEDFDKAINVQEEKIAALQAFADQLIAAGHYAKGDISSRRNEVLDRWRRLKAQMIEKRSKLGESQTLQQFSRDVDEIEAWISEKLQTASDESYKDPTNIQSKHQKHQAFEAELHANADRIRGVIDMGNSLIERGACAGSEDAVKARLAALADQWQFLVQKSAEKSQKLKEANKQQNFNTGIKDFDFWLSEVEALLASEDYGKDLASVNNLLKKHQLLEADISAHEDRLKDLNSQADSLMTSSAFDTSQVKDKRDTINGRFQKIKSMAASRRAKLNESHRLHQFFRDMDDEESWIKEKKLLVGSEDYGRDLTGVQNLRKKHKRLEAELAAHEPAIQGVLDTGKKLSDDNTIGKEEIQQRLAQFVEHWKELKQLAAARGQRLEESLEYQQFVANVEEEEAWINEKMTLVASEDYGDTLAAIQGLLKKHEAFETDFTVHKDRVNDVCTNGQDLIKKNNHHEENISSKMKGLNGKVSDLQAFQQEGIANITALKDQLLAAKHVQSKAIEARHASLMKRWSQLLANSAARKKKLLEAQSHFRKVEDLFLTFAKKASAFNSWFENAEEDLTDPVRCNSLEEIKALREAHDAFRSSLSSAQADFNQLAELDRQIKSFRVASNPYTWFTMEALEETWRNLQKIIKERELELQKEQRRQEENDKLRQEFAQHANAFHQWIQETRTYLLDGSCMVEESGTLESQLEATKRKHQEIRAMRSQLKKIEDLGAAMEEALILDNKYTEHSTVGLAQQWDQLDQLGMRMQHNLEQQIQARNTTGVTEEALKEFSMMFKHFDKDKSGRLNHQEFKSCLRSLGYDLPMVEEGEPDPEFEAILDTVDPNRDGHVSLQEYMAFMISRETENVKSSEEIESAFRALSSEGKPYVTKEELYQNLTREQADYCVSHMKPYVDGKGRELPTAFDYVEFTRSLFVN

SEQ ID NO: 865527 - protein, 1392 aa, Homo sapiens
MLEKSCKKFMLFREANELQQWINEKEAALTSEEVGADLEQVEVLQKKFDDFQKDLKANESRLKDINKVAEDLESEGLMAEEVQAVQQQEVYGMMPRDETDSKTASPWKSARLMVHTVATFNSIKELNERWRSLQQLAEERSQLLGSAHEVQRFHRDADETKEWIEEKNQALNTDNYGHDLASVQALQRKHEGFERDLAALGDKVNSLGETAERLIQSHPESAEDLQEKCTELNQAWSSLGKRADQRKAKLGDSHDLQRFLSDFRDLMSWINGIRGLVSSDELAKDVTGAEALLERHQEHRTEIDARAGTFQAFEQFGQQLLAHGHYASPEIKQKLDILDQERADLEKAWVQRRMMLDQCLELQLFHRDCEQAENWMAAREAFLNTEDKGDSLDSVEALIKKHEDFDKAINVQEEKIAALQAFADQLIAAGHYAKGDISSRRNEVLDRWRRLKAQMIEKRSKLGESQTLQQFSRDVDEIEAWISEKLQTASDESYKDPTNIQAFQVLSKHQKHQAFEAELHANADRIRGVIDMGNSLIERGACAGSEDAVKARLAALADQWQFLVQKSAEKSQKLKEANKQQNFNTGIKDFDFWLSEVEALLASEDYGKDLASVNNLLKKHQLLEADISAHEDRLKDLNSQADSLMTSSAFDTSQVKDKRDTINGRFQKIKSMAASRRAKLNESHRLHQFFRDMDDEESWIKEKKLLVGSEDYGRDLTGVQNLRKKHKRLEAELAAHEPAIQGVLDTGKKLSDDNTIGKEEIQQRLAQFVEHWKELKQLAAARGQRLEESLEYQQFVANVEEEEAWINEKMTLVASEDYGDTLAAIQGLLKKHEAFETDFTVHKDRVNDVCTNGQDLIKKNNHHEENISSKMKGLNGKVSDLEKAAAQRKAKLDENSAFLQFNWKADVVESWIGEKENSLKTDDYGRDLSSVQTLLTKQETFDAGLQAFQQEGIANITALKDQLLAAKHVQSKAIEARHASLMKRWSQLLANSAARKKKLLEAQSHFRKVEDLFLTFAKKASAFNSWFENAEEDLTDPVRCNSLEEIKALREAHDAFRSSLSSAQADFNQLAELDRQIKSFRVASNPYTWFTMEALEETWRNLQKIIKERELELQKEQRRQEENDKLRQEFAQHANAFHQWIQETRTYLLDGSCMVEESGTLESQLEATKRKHQEIRAMRSQLKKIEDLGAAMEEALILDNKYTEHSTVGLAQQWDQLDQLGMRMQHNLEQQIQARNTTGVTEEALKEFSMMFKHFDKDKSGRLNHQEFKSCLRSLGYDLPMVEEGEPDPEFEAILDTVDPNRDGHVSLQEYMAFMISRETENVKSSEEIESAFRALSSEGKPYVTKEELYQNLTREQADYCVSHMKPYVDGKGRELPTAFDYVEFTRSLFVN

SEQ ID NO: 865528 - protein, 2515 aa, Homo sapiens; identical to SEQ ID NO: 865523

SEQ ID NO: 865529 - protein, 1134 aa, Homo sapiens
MNYSNGDLMSWINGIRGLVSSDELAKDVTGAEALLERHQEHRTEIDARAGTFQAFEQFGQQLLAHGHYASPEIKQKLDILDQERADLEKAWVQRRMMLDQCLELQLFHRDCEQAENWMAAREAFLNTEDKGDSLDSVEALIKKHEDFDKAINVQEEKIAALQAFADQLIAAGHYAKGDISSRRNEVLDRWRRLKAQMIEKRSKLGESQTLQQFSRDVDEIEAWISEKLQTASDESYKDPTNIQAFQVLSKHQKHQAFEAELHANADRIRGVIDMGNSLIERGACAGSEDAVKARLAALADQWQFLVQKSAEKSQKLKEANKQQNFNTGIKDFDFWLSEVEALLASEDYGKDLASVNNLLKKHQLLEADISAHEDRLKDLNSQADSLMTSSAFDTSQVKDKRDTINGRFQKIKSMAASRRAKLNESHRLHQFFRDMDDEESWIKEKKLLVGSEDYGRDLTGVQNLRKKHKRLEAELAAHEPAIQGVLDTGKKLSDDNTIGKEEIQQRLAQFVEHWKELKQLAAARGQRLEESLEYQQFVANVEEEEAWINEKMTLVASEDYGDTLAAIQGLLKKHEAFETDFTVHKDRVNDVCTNGQDLIKKNNHHEENISSKMKGLNGKVSDLEKAAAQRKAKLDENSAFLQFNWKADVVESWIGEKENSLKTDDYGRDLSSVQTLLTKQETFDAGLQAFQQEGIANITALKDQLLAAKHVQSKAIEARHASLMKRWSQLLANSAARKKKLLEAQSHFRKVEDLFLTFAKKASAFNSWFENAEEDLTDPVRCNSLEEIKALREAHDAFRSSLSSAQADFNQLAELDRQIKSFRVASNPYTWFTMEALEETWRNLQKIIKERELELQKEQRRQEENDKLRQEFAQHANAFHQWIQETRTYLLDGSCMVEESGTLESQLEATKRKHQEIRAMRSQLKKIEDLGAAMEEALILDNKYTEHSTVGLAQQWDQLDQLGMRMQHNLEQQIQARNTTGVTEEALKEFSMMFKHFDKDKSGRLNHQEFKSCLRSLGYDLPMVEEGEPDPEFEAILDTVDPNRDGHVSLQEYMAFMISRETENVKSSEEIESAFRALSSEGKPYVTKEELYQNLTREQADYCVSHMKPYVDGKGRELPTAFDYVEFTRSLFVN

SEQ ID NO: 865530 - protein, 2540 aa, Homo sapiens
RHYPLRSERCGAEAAEAPRSFSTPRPDAPTPLTPREPKMDPSGVKVLETAEDIQERRQQVLDRYHRFKELSTLRRQKLEDSYRFQFFQRDAEELEKWIQEKLQIASDENYKDPTNLQGKLQKHQAFEAEVQANSGAIVKLDETGNLMISEGHFASETIRTRLMELHRQWELLLEKMREKGIKLLQAQKLVQYLRECEDVMDWINDKEAIVTSEELGQDLEHVEVLQKKFEEFQTDMAAHEERVNEVNQFAAKLIQEQHPEEELIKTKQDEVNAAWQRLKGLALQRQGKLFGAAEVQRFNRDVDETISWIKEKEQLMASDDFGRDLASVQALLRKHEGLERDLAALEDKVKALCAEADRLQQSHPLSATQIQVKREELITNWEQIRTLAAERHARLNDSYRLQRFLADFRDLTSWVTEMKALINADELASDVAGAEALLDRHQEHKGEIDAHEDSFKSADESGQALLAAGHYASDEVREKLTVLSEERAALLELWELRRQQYEQCMDLQLFYRDTEQVDNWMSKQEAFLLNEDLGDSLDSVEALLKKHEDFEKSLSAQEEKITALDEFATKLIQNNHYAMEDVATRRDALLSRRNALHERAMRRRAQLADSFHLQQFFRDSDELKSWVNEKMKTATDEAYKDPSNLQGKVQKHQAFEAELSANQSRIDALEKAGQKLIDVNHYAKDEVAARMNEVISLWKKLLEATELKGIKLREANQQQQFNRNVEDIELWLYEVEGHLASDDYGKDLTNVQNLQKKHALLEADVAAHQDRIDGITIQARQFQDAGHFDAENIKKKQEALVARYEALKEPMVARKQKLADSLRLQQLFRDVEDEETWIREKEPIAASTNRGKDLIGVQNLLKKHQALQAEIAGHEPRIKAVTQKGNAMVEEGHFAAEDVKAKLHELNQKWEALKAKASQRRQDLEDSLQAQQYFADANEAESWMREKEPIVGSTDYGKDEDSAEALLKKHEALMSDLSAYGSSIQALREQAQSCRQQVAPTDDETGKELVLALYDYQEKSPREVTMKKGDILTLLNSTNKDWWKVEVNDRQGFVPAAYVKKLDPAQSASRENLLEEQGSIALRQEQIDNQTRITKEAGSVSLRMKQVEELYHSLLELGEKRKGMLEKSCKKFMLFREANELQQWINEKEAALTSEEVGADLEQVEVLQKKFDDFQKDLKANESRLKDINKVAEDLESEGLMAEEVQAVQQQEVYGMMPRDETDSKTASPWKSARLMVHTVATFNSIKELNERWRSLQQLAEERSQLLGSAHEVQRFHRDADETKEWIEEKNQALNTDNYGHDLASVQALQRKHEGFERDLAALGDKVNSLGETAERLIQSHPESAEDLQEKCTELNQAWSSLGKRADQRKAKLGDSHDLQRFLSDFRDLMSWINGIRGLVSSDELAKDVTGAEALLERHQEHRTEIDARAGTFQAFEQFGQQLLAHGHYASPEIKQKLDILDQERADLEKAWVQRRMMLDQCLELQLFHRDCEQAENWMAAREAFLNTEDKGDSLDSVEALIKKHEDFDKAINVQEEKIAALQAFADQLIAAGHYAKGDISSRRNEVLDRWRRLKAQMIEKRSKLGESQTLQQFSRDVDEIEAWISEKLQTASDESYKDPTNIQSKHQKHQAFEAELHANADRIRGVIDMGNSLIERGACAGSEDAVKARLAALADQWQFLVQKSAEKSQKLKEANKQQNFNTGIKDFDFWLSEVEALLASEDYGKDLASVNNLLKKHQLLEADISAHEDRLKDLNSQADSLMTSSAFDTSQVKDKRDTINGRFQKIKSMAASRRAKLNESHRLHQFFRDMDDEESWIKEKKLLVGSEDYGRDLTGVQNLRKKHKRLEAELAAHEPAIQGVLDTGKKLSDDNTIGKEEIQQRLAQFVEHWKELKQLAAARGQRLEESLEYQQFVANVEEEEAWINEKMTLVASEDYGDTLAAIQGLLKKHEAFETDFTVHKDRVNDVCTNGQDLIKKNNHHEENISSKMKGLNGKVSDLEKAAAQRKAKLDENSAFLQFNWKADVVESWIGEKENSLKTDDYGRDLSSVQTLLTKQETFDAGLQAFQQEGIANITALKDQLLAAKHVQSKAIEARHASLMKRWSQLLANSAARKKKLLEAQSHFRKVEDLFLTFAKKASAFNSWFENAEEDLTDPVRCNSLEEIKALREAHDAFRSSLSSAQADFNQLAELDRQIKSFRVASNPYTWFTMEALEETWRNLQKIIKERELELQKEQRRQEENDKLRQEFAQHANAFHQWIQETRTYLLDGSCMVEESGTLESQLEATKRKHQEIRAMRSQLKKIEDLGAAMEEALILDNKYTEHSTVGLAQQWDQLDQLGMRMQHNLEQQIQARNTTGVTEEALKEFSMMFKHFDKDKSGRLNHQEFKSCLRSLGYDLPMVEEGEPDPEFEAILDTVDPNRKINYRPGAVSLCPGHPPALPAQALASPAPRDGHVSLQEYMAFMISRETENVKSSEEIESAFRALSSEGKPYVTKEELYQNLTREQADYCVSHMKPYVDGKGRELPTAFDYVEFTRSLFVN

SEQ ID NO: 865531 - protein, 2510 aa, Homo sapiens; identical to SEQ ID NO: 865521

SEQ ID NO: 865532 - protein, 508 aa, Homo sapiens
MVCLGFDVFPFYSISTEEGSIFSTLRFLGEKENSLKTDDYGRDLSSVQTLLTKQETFDAGLQAFQQEGIANITALKDQLLAAKHVQSKAIEARHASLMKRWSQLLANSAARKKKLLEAQSHFRKVEDLFLTFAKKASAFNSWFENAEEDLTDPVRCNSLEEIKALREAHDAFRSSLSSAQADFNQLAELDRQIKSFRVASNPYTWFTMEALEETWRNLQKIIKERELELQKEQRRQEENDKLRQEFAQHANAFHQWIQETRTYLLDGSCMVEESGTLESQLEATKRKHQEIRAMRSQLKKIEDLGAAMEEALILDNKYTEHSTVGLAQQWDQLDQLGMRMQHNLEQQIQARNTTGVTEEALKEFSMMFKHFDKDKSGRLNHQEFKSCLRSLGYDLPMVEEGEPDPEFEAILDTVDPNRDGHVSLQEYMAFMISRETENVKSSEEIESAFRALSSEGKPYVTKEELYQNLTREQADYCVSHMKPYVDGKGRELPTAFDYVEFTRSLFVN

SEQ ID NO: 865533 - protein, 473 aa, Homo sapiens
HANITAFLLEGLQPSVKSFRFGEERLQAFQQEGIANITALKDQLLAAKHVQSKAIEARHASLMKRWSQLLANSAARKKKLLEAQSHFRKVEDLFLTFAKKASAFNSWFENAEEDLTDPVRCNSLEEIKALREAHDAFRSSLSSAQADFNQLAELDRQIKSFRVASNPYTWFTMEALEETWRNLQKIIKERELELQKEQRRQEENDKLRQEFAQHANAFHQWIQETRTYLLDGSCMVEESGTLESQLEATKRKHQEIRAMRSQLKKIEDLGAAMEEALILDNKYTEHSTVGLAQQWDQLDQLGMRMQHNLEQQIQARNTTGVTEEALKEFSMMFKHFDKDKSGRLNHQEFKSCLRSLGYDLPMVEEGEPDPEFEAILDTVDPNRDGHVSLQEYMAFMISRETENVKSSEEIESAFRALSSEGKPYVTKEELYQNLTREQADYCVSHMKPYVDGKGRELPTAFDYVEFTRSLFVN

SEQ ID NO: 865534 - protein, 2476 aa, Homo sapiens
RHYPLRSERCGAEAAEAPRSFSTPRPDAPTPLTPREPKMDPSGVKVLETAEDIQERRQQVLDRYHRFKELSTLRRQKLEDSYRFQFFQRDAEELEKWIQEKLQIASDENYKDPTNLQGKLQKHQAFEAEVQANSGAIVKLDETGNLMISEGHFASETIRTRLMELHRQWELLLEKMREKGIKLLQAQKLVQYLRECEDVMDWINDKEAIVTSEELGQDLEHVEVLQKKFEEFQTDMAAHEERVNEVNQFAAKLIQEQHPEEELIKTKQDEVNAAWQRLKGLALQRQGKLFGAAEVQRFNRDVDETISWIKEKEQLMASDDFGRDLASVQALLRKHEGLERDLAALEDKVKALCAEADRLQQSHPLSATQIQVKREELITNWEQIRTLAAERHARLNDSYRLQRFLADFRDLTSWVTEMKALINADELASDVAGAEALLDRHQEHKGEIDAHEDSFKSADESGQALLAAGHYASDEVREKLTVLSEERAALLELWELRRQQYEQCMDLQLFYRDTEQVDNWMSKQEAFLLNEDLGDSLDSVEALLKKHEDFEKSLSAQEEKITALDEFATKLIQNNHYAMEDVATRRDALLSRRNALHERAMRRRAQLADSFHLQQFFRDSDELKSWVNEKMKTATDEAYKDPSNLQGKVQKHQAFEAELSANQSRIDALEKAGQKLIDVNHYAKDEVAARMNEVISLWKKLLEATELKGIKLREANQQQQFNRNVEDIELWLYEVEGHLASDDYGKDLTNVQNLQKKHALLEADVAAHQDRIDGITIQARQFQDAGHFDAENIKKKQEALVARYEALKEPMVARKQKLADSLRLQQLFRDVEDEETWIREKEPIAASTNRGKDLIGVQNLLKKHQALQAEIAGHEPRIKAVTQKGNAMVEEGHFAAEDVKAKLHELNQKWEALKAKASQRRQDLEDSLQAQQYFADANEAESWMREKEPIVGSTDYGKDEDSAEALLKKHEALMSDLSAYGSSIQALREQAQSCRQQVAPTDDETGKELVLALYDYQEKSPREVTMKKGDILTLLNSTNKDWWKVEVNDRQGFVPAAYVKKLDPAQSASRENLLEEQGSIALRQEQIDNQTRITKEAGSVSLRMKQVEELYHSLLELGEKRKGMLEKSCKKFMLFREANELQQWINEKEAALTSEEVGADLEQVEVLQKKFDDFQKDLKANESRLKDINKVAEDLESEGLMAEEVQAVQQQEVYGMMPRDETDSKTASPWKSARLMVHTVATFNSIKELNERWRSLQQLAEERSQLLGSAHEVQRFHRDADETKEWIEEKNQALNTDNYGHDLASVQALQRKHEGFERDLAALGDKVNSLGETAERLIQSHPESAEDLQEKCTELNQAWSSLGKRADQRKAKLGDSHDLQRFLSDFRDLMSWINGIRGLVSSDELAKDVTGAEALLERHQEHRTEIDARAGTFQAFEQFGQQLLAHGHYASPEIKQKLDILDQERADLEKAWVQRRMMLDQCLELQLFHRDCEQAENWMAAREAFLNTEDKGDSLDSVEALIKKHEDFDKAINVQEEKIAALQAFADQLIAAGHYAKGDISSRRNEVLDRWRRLKAQMIEKRSKLGESQTLQQFSRDVDEIEAWISEKLQTASDESYKDPTNIQSKHQKHQAFEAELHANADRIRGVIDMGNSLIERGACAGSEDAVKARLAALADQWQFLVQKSAEKSQKLKEANKQQNFNTGIKDFDFWLSEVEALLASEDYGKDLASVNNLLKKHQLLEADISAHEDRLKDLNSQADSLMTSSAFDTSQVKDKRDTINGRFQKIKSMAASRRAKLNESHRLHQFFRDMDDEESWIKEKKLLVGSEDYGRDLTGVQNLRKKHKRLEAELAAHEPAIQGVLDTGKKLSDDNTIGKEEIQQRLAQFVEHWKELKQLAAARGQRLEESLEYQQFVANVEEEEAWINEKMTLVASEDYGDTLAAIQGLLKKHEAFETDFTVHKDRVNDVCTNGQDLIKKNNHHEENISSKMKGLNGKVSDLEKAAAQRKAKLDENSAFLQFNWKADVVESWIGEKENSLKTDDYGRDLSSVQTLLTKQETFDAGLQAFQQEGIANITALKDQLLAAKHVQSKAIEARHASLMKRWSQLLANSAARKKKLLEAQSHFRKVEDLFLTFAKKASAFNSWFENAEEDLTDPVRCNSLEEIKALREAHDAFRSSLSSAQADFNQLAELDRQIKSFRVASNPYTWFTMEALEETWRNLQKIIKERELELQKEQRRQEENDKLRQEFAQHANAFHQWIQETRTYLLDGSCMVEESGTLESQLEATKRKHQEIRAMRSQLKKIEDLGAAMEEALILDNKYTEHSTVGLAQQWDQLDQLGMRMQHNLEQQIQARNTTGVTEEALKEFSMMFKHFDKDKSGRLNHQEFKSCLRSLGYDLPMVEEGEPDPEFEAILDTVDPNRDGHVSLQEYMAFMISRETENVKSSEEIESAFRALSSEGKPYVTKEELYQVWASGGG

SEQ ID NO: 865535 - protein, 398 aa, Homo sapiens
TGGEPKLRLRYEAPVEDLFLTFAKKASAFNSWFENAEEDLTDPVRCNSLEEIKALREAHDAFRSSLSSAQADFNQLAELDRQIKSFRVASNPYTWFTMEALEETWRNLQKIIKERELELQKEQRRQEENDKLRQEFAQHANAFHQWIQETRTYLLDGSCMVEESGTLESQLEATKRKHQEIRAMRSQLKKIEDLGAAMEEALILDNKYTEHSTVGLAQQWDQLDQLGMRMQHNLEQQIQARNTTGVTEEALKEFSMMFKHFDKDKSGRLNHQEFKSCLRSLGYDLPMVEEGEPDPEFEAILDTVDPNRDGHVSLQEYMAFMISRETENVKSSEEIESAFRALSSEGKPYVTKEELYQNLTREQADYCVSHMKPYVDGKGRELPTAFDYVEFTRSLFVN

SEQ ID NO: 865536 - protein, 2391 aa, Homo sapiens
RHYPLRSERCGAEAAEAPRSFSTPRPDAPTPLTPREPKMDPSGVKVLETAEDIQERRQQVLDRYHRFKELSTLRRQKLEDSYRFQFFQRDAEELEKWIQEKLQIASDENYKDPTNLQGKLQKHQAFEAEVQANSGAIVKLDETGNLMISEGHFASETIRTRLMELHRQWELLLEKMREKGIKLLQAQKLVQYLRECEDVMDWINDKEAIVTSEELGQDLEHVEVLQKKFEEFQTDMAAHEERVNEVNQFAAKLIQEQHPEEELIKTKQDEVNAAWQRLKGLALQRQGKLFGAAEVQRFNRDVDETISWIKEKEQLMASDDFGRDLASVQALLRKHEGLERDLAALEDKVKALCAEADRLQQSHPLSATQIQVKREELITNWEQIRTLAAERHARLNDSYRLQRFLADFRDLTSWVTEMKALINADELASDVAGAEALLDRHQEHKGEIDAHEDSFKSADESGQALLAAGHYASDEVREKLTVLSEERAALLELWELRRQQYEQCMDLQLFYRDTEQVDNWMSKQEAFLLNEDLGDSLDSVEALLKKHEDFEKSLSAQEEKITALDEFATKLIQNNHYAMEDVATRRDALLSRRNALHERAMRRRAQLADSFHLQQFFRDSDELKSWVNEKMKTATDEAYKDPSNLQGKVQKHQAFEAELSANQSRIDALEKAGQKLIDVNHYAKDEVAARMNEVISLWKKLLEATELKGIKLREANQQQQFNRNVEDIELWLYEVEGHLASDDYGKDLTNVQNLQKKHALLEADVAAHQDRIDGITIQARQFQDAGHFDAENIKKKQEALVARYEALKEPMVARKQKLADSLRLQQLFRDVEDEETWIREKEPIAASTNRGKDLIGVQNLLKKHQALQAEIAGHEPRIKAVTQKGNAMVEEGHFAAEDVKAKLHELNQKWEALKAKASQRRQDLEDSLQAQQYFADANEAESWMREKEPIVGSTDYGKDEDSAEALLKKHEALMSDLSAYGSSIQALREQAQSCRQQVAPTDDETGKELVLALYDYQEKSPREVTMKKGDILTLLNSTNKDWWKVEVNDRQGFVPAAYVKKLDPAQSASRENLLEEQGSIALRQEQIDNQTRITKEAGSVSLRMKQVEELYHSLLELGEKRKGMLEKSCKKFMLFREANELQQWINEKEAALTSEEVGADLEQVEVLQKKFDDFQKDLKANESRLKDINKVAEDLESEGLMAEEVQAVQQQEVYGMMPRDETDSKTASPWKSARLMVHTVATFNSIKELNERWRSLQQLAEERSQLLGSAHEVQRFHRDADETKEWIEEKNQALNTDNYGHDLASVQALQRKHEGFERDLAALGDKVNSLGETAERLIQSHPESAEDLQEKCTELNQAWSSLGKRADQRKAKLGDSHDLQRFLSDFRDLMSWINGIRGLVSSDELAKDVTGAEALLERHQEHRTEIDARAGTFQAFEQFGQQLLAHGHYASPEIKQKLDILDQERADLEKAWVQRRMMLDQCLELQLFHRDCEQAENWMAAREAFLNTEDKGDSLDSVEALIKKHEDFDKAINVQEEKIAALQAFADQLIAAGHYAKGDISSRRNEVLDRWRRLKAQMIEKRSKLGESQTLQQFSRDVDEIEAWISEKLQTASDESYKDPTNIQSKHQKHQAFEAELHANADRIRGVIDMGNSLIERGACAGSEDAVKARLAALADQWQFLVQKSAEKSQKLKEANKQQNFNTGIKDFDFWLSEVEALLASEDYGKDLASVNNLLKKHQLLEADISAHEDRLKDLNSQADSLMTSSAFDTSQVKDKRDTINGRFQKIKSMAASRRAKLNESHRLHQFFRDMDDEESWIKEKKLLVGSEDYGRDLTGVQNLRKKHKRLEAELAAHEPAIQGVLDTGKKLSDDNTIGKEEIQQRLAQFVEHWKELKQLAAARGQRLEESLEYQQFVANVEEEEAWINEKMTLVASEDYGDTLAAIQGLLKKHEAFETDFTVHKDRVNDVCTNGQDLIKKNNHHEENISSKMKGLNGKVSDLEKAAAQRKAKLDENSAFLQFNWKADVVESWIGEKENSLKTDDYGRDLSSVQTLLTKQETFDAGLQAFQQEGIANITALKDQLLAAKHVQSKAIEARHASLMKRWSQLLANSAARKKKLLEAQSHFRKVEDLFLTFAKKASAFNSWFENAEEDLTDPVRCNSLEEIKALREAHDAFRSSLSSAQADFNQLAELDRQIKSFRVASNPYTWFTMEALEETWRNLQKIIKERELELQKEQRRQEENDKLRQEFAQHANAFHQWIQETRTYLLDGSCMVEESGTLESQLEATKRKHQEIRAMRSQLKKIEDLGAAMEEALILDNKYTEHSTVGLAQQWDQLDQLGMRMQHNLEQQIQARNTTGVTEEALKEFSMMFKHFDKDKQGCVCLISRYSPST
